United States Patent 7,834,146 (RECOMBINANT POLYPEPTIDES ASSOCIATED WITH PLANTS) - sequence listing, part 3

SEQ ID NO: 7767 - DNA, 499 bp, Sorghum bicolor
  Clone ID: SORBI-28MAY03-CLUS110975_1
gcacgaggctttccattccatctcacgcacactctgcgtcggatccaagcaagcaaagcgtctccatggcttcgacgacggcgtccaacctgggcggggcgtggttcggcgagctggcttcagcgctgcaggggacgtggcagcccgtggccgccaccgccggcgaggacccgcggcagctccagcagcagaagccggcacgaggcggcggcagcagcaacaaggcggcgcagggcaaggaggagggggacgtcgcgaggtgcggcggcgccatgtccgacaccacgctctacctgctgctcgaccggttcacgcccaactgagctgaccggacccccttggtcgcccgtcgtgtccgtcggcgcgtgctgtagtactctactgtactgtacaggcggaataactgcgcgccatggttttgtgtaaatgctgtaaattgcaatgccatgtttctaatctgatgattactcactttccccaaaaaaaaaaaaaaaaaaaa

SEQ ID NO: 7768 - DNA, 785 bp, Sorghum bicolor
  Clone ID: SORBI-28MAY03-CLUS111011_1
gcacgaggcacccgcttagcccgctactcccaactttggtggccccccccggcacccgcggcaccccacacactcccgcacgcggcaccccccctggcagtagcccccgcgtcaccagaccgcgctcccgtgctcaccgccggcatggcaccaggcggccttgcgcgcgtggccctgccggcccccccccacctcggcgccccccgcccgccgccgccccggcacccccgccaccccacctgggtctccgcccagcggttccacccgggtgaccagatcgtgtccaagtactcgccccaagcgcaccacgtggtggaggtgagcaagccccactaccactcctgctccaacgcgagccccatcgccacccacaactccgccaacgccgccaccgccctcgccccccccggcgcccgctacttcatctgccgcttctcccgccactgccccggcggcatgtagggtctgctcgacgtcgtgcccagcgccatctccctcacccccgccggcgcgccctgcgccaactccctcccccccgcccgcacgccctacgccgatgctcccatcgcccccccgcccgccccccccgccgccgccatgatcgccgccggcctcatggcttactagatactctgttgcttgctgcgtatatttagttttcatcattggacattatatatatatatatatatatatatatatatatatattgtattcttttgagttcgcacgacatacatgtatgagatagtgtcagcatacgtatataaatactacatttgatt

SEQ ID NO: 7769 - DNA, 898 bp, Sorghum bicolor
  Clone ID: SORBI-28MAY03-CLUS111270_1
gcacgaggcggacaagcagttgcagtgttgtatgcatctcgcttttatggcttgtgtgttgtggcgcaccagctttccttctaacaaccaccttattacccttataatacccgtcgttgcttgcttcgtactactatcctacggcgtagcagtacagtatccctctagaatcacgtgctgaatgatgactggatgctttttaacgacgtgattctgtgcccaggtgcttctggccagatcagagaggtgtcgtacgcacgtatagtaggtgctgatgcatgctggcccttttttctcttgatgctgcaggtaccacgcgatccaccacaccaagaaggaggccaatttctgtctcttcatgccgctgtttgatctgctgggtggcaccattgatcagcagtcgtgggacatgcacaagaagatgagcgcaggtacacacacgtctggctagtttttgcttatataacatccttttggctgtctgctctccctgcacgtgcccttcgtcctgcggaccttcgcctccacgcccttctccgtgcagctcttcctgctacccatgtggcccttcgccttcctcgtcatgctcgccatgtgggtctggtccaagaccttcgtcatctcctgctacaacctccgcggacggctgcaccagatttgggccgtccccagatacggcttccagtacttcttgccgtttgccaaggacggcatcaacaagcagatcgagctcgccatcctcagggcggacaagatgggcgtcaaggtcctcagccttgcagccctaaacaagaacgaggcgctgaacggcggcggcacgctgttcgtgaacaagcaccctgacctgcgcgtgcgcgtcgtccacggcaacacgctgacggcggcggtgatcctgaac

SEQ ID NO: 7770 - DNA, 723 bp, Sorghum bicolor
  Clone ID: SORBI-28MAY03-CLUS111389_1
gcacgaggcaacactgagcacctcaacaccggcactcagtctcacattcagccatgcgtttcctcaagtctggacgggtgtgcatcgtcacccacggccgctacgccggtgccaaggttgtgatcatctcggtggtcgacagcggcaacaaggcccacccttacggccacgccctggtcgctggtattgagcgatccccccagaagattacccggcgcatgtccaaggctcgccaggagaagcgcagcaaggtcaagcctttcatcaaggtcgccaactacaaccacctcatgcccacccgttacacccttgagcttgagggcctgaagggcgtcgtgtccggcgagaccttcaaggaggtcagccagcgcgaggaggccaagaagaacgtgaagaaggtgctcgaggagcgctacgtgagcggcaagaaccggtggtttttcacccctctgaagttttgatcggtttttctcctcaacggctgggcggtggcgaatggcttggggctgtataccacagcaaatactcatcatggcatgaaaatcgagggcttgctagctgaattcacggattgcaaagggctctaaatggcgttgcgtcaaatatcatgaactagatgcggaaaagagggagcttgtgcggtatgccgtcgagaacggaatgccaatgcctccgctctgccgtgttgtttgcctcttgagtaggccaaaaagatttactcac

SEQ ID NO: 7771 - DNA, 1011 bp, Sorghum bicolor
  Clone ID: SORBI-28MAY03-CLUS11150_1
caggatcggagcagatagacagacagagggttccgtttccgtcgtctcattgagtcagtcagtcagcttcagctacaggtttctcttgtcgtctcctgcttcaattcctcaccgacggcgacgatcgcgcgttcatacaccaggcggtcggtcaggagacgtctgaaatcatacttcagcaagcgtttgtcaatcaggcagatcaacaagggcttaataatcctactaattcagacgaggatgggattcttctcattgtttcttgtggcttcgatgccagtcgtccaagtcctgctcatacgtgccattggagctttcctggcctctggtttctgccacgcgcccacgtcctgcgctcgggggcctttggacctggccgggcctccggtttccgccccgtgctggcggcccgcccgcctcgcgatgtcggtcacgctcgcagacgtcatttcttggtggtttatgccggttaacatagggatcacgttcattattggtggcactctgggttggatagcatgcaacatcttgaagccaccacagcactttaggggattgatcatggccttctgctcagcagggaaccttggaaacctgctactgataattgtcccggctgtatgcgacgaagacgggagcccctttgggaaagatccaagcatttgccgctcacgtggtctctcctactcgtccttgtccatggctctgggtggcatttacatatggacacacacgtacagcctcatgcagaagtcaggcaagctgtatcacaagatgcattccaaaagcatccaatgcccagccgacagcgacgaggagcattcatctgactaccctgacgaggaggcacctcttccgacgtcagttaagcctggcgatcacgagcacggtgaagaaaaccaaatggaggcccctctcttgtcctgtgagagcgaggtcgctgacaaggtgttctggacgaatctgaaggacgctgtccaccagttcatcgaggagctgatggcgccaccc

SEQ ID NO: 7772 - DNA, 525 bp, Sorghum bicolor
  Clone ID: SORBI-28MAY03-CLUS111509_1
gcacgaggcgcgccttgcgccaaacgcatctcagccaaatgcatctcagctgcaggcacaccggatccgcccgccgcgccacgcgctgtcggccgcgccccgccgtgagccgcgccccgcgcgcacgccgttggctgcggcctgcccgctgcccgagccgcgcctacgccggtggccgcagacaggccgcgccccgccgcccgccgcgagccgcgcctacgccggtggccgcgctccgtccgtcgctagcccgcgcacacatcggtggccgccccttcgccaccgtgagcccgctggtcgcgcgcacgccggtggccgcgccccccgccgcgagcccgctgcccgagcggccgcgccggtgcccgctcctctcgatctccgatggccttctccacgtacgcgtcctcgcccgcccgagccgcgactacccccacccagatcagcgcagcaacaaaggaaggaattaaccatgagaatggaagggctgctgtacagcaaggggccgcccggggagcccttcgcctt

SEQ ID NO: 7773 - DNA, 922 bp, Sorghum bicolor
  Clone ID: SORBI-28MAY03-CLUS111893_1
gcacgaggcctcttcctcgccgcgaccaccaccaccaccagcagcagcagcagcatactacttattatatcccctgattcccctgtgtctgttgatccgatccgacgtgggtgcgcggggctacttccggctgggtccggccgccgcgccaatcatcacgctcgccgccatcatgccccccactgcagcggcggcgactccaatctccctcttcctttaacaacccctgtttcctgggagctggacgggcgcgcgcgttcccgcgggggagggagaagcgatcgatcgatcaatcgaccggccgaccggcagtcgggacggacgggagcctccgttccgccctccggtgatgctgatcctggagctgggcatctgggtgctgcccttcacgctgctgctagcgccggcgcgccggatggtgcgcctcgtcgacgagctgcagcggatcttcctcgccgtcgcctgccgccgggcgccgccgcccacgctcggccggctctggagccgcctcgaccgcctcgactccgccaccgtcatgccctgatcagtgtatcgctccgctcttcctcgcttcgtgttcatgtacatggatggatggatgctctgccctgccctgccgcgctgtttttcccttttttgaacaaaaaaaagggcgctcttttgctgtaaacttcacttcttgctgtctgtccagactccgatgtttttttttgttgcagtctgcttctctgcgatccatgtaaaaccctgtaattaggtccaaagaagaggctgccaattgctccttagttcttagcagccatattatcgagttcatcaggttaatggatcctcctctgctgtacagtgtacagagcgaaagaggttaaaagaaaaaaaaactcctttttttcactcagattataaaaaaaaaaaaaaaaaa

SEQ ID NO: 7774 - DNA, 884 bp, Sorghum bicolor
  Clone ID: SORBI-28MAY03-CLUS11208_1
cacccaccttgcattcaattgtttctctttgaattctattgggcccatggttgaaatgttaactggacctagaagatttcttgctgtttatttcagttcggcactggcaggttcactgatgagctatcgctgtagtgcgtcacctgcagttggtgcgtcaggtgccatttttggattggttggcgcccatgcagtttatatgtggagacatagaagattctttgggaattctagggagagtttagaacatattgggcgtgtggttgtcctgaatatgggtatgggcctcctctcaaggggaatcgataactggggccatctgggaggcttgcttggcggagttgccatggcatggttcctaggtccggcatggcaatatcagtatgtggcaaaggatggtagagcggttttcaaagacagggctccagtcctccgactaataaaggggtagacttgtgttgttttgtatgtacttacgagagtattcgtgaaaataatgtggaagagaagcaaaagggagaatggtgaagattcagacataggccgagcaaggaagtggcagaaaaaaaaacttttaactagtttgggtatcgaaacatttcattgcagggctaattgttgaggaaacacacacgaggagcttattgctttgttcggatcgtggcaattgttaaatcttcaaagccgagacgtgttgaggcctgtcaattgtattttcaggtgttccagcccttaacacacattttgtactaaccttaggatctaccgtcaagttctgacctcggacattgactgttactaggtttcttctggtcctgtattgcacgagatgataaaatatgtaaagagtgttctcagcgaacagcgatccataagtgattaag

SEQ ID NO: 7775 - DNA, 961 bp, Sorghum bicolor
  Clone ID: SORBI-28MAY03-CLUS109775_1
gcccgccgctgcagcgtccgagctgggcgtctccgccgcccgccgggtccccgagtcgctccgcgccgccgccacccgcctggccgcccgcccgcgccgccacccctgcagccgcgccacgcgggcccgcccgcacgcggctgccccccatcccccccccgcccgctccccctccctttccccgtcgcccactgcccgggcgcctgcgcccccccgcccgcacccccggtcttccgccttctctcggtctcggcgcccgagtctcccaccccccggggaaagcacctcacccccaaatgaagcacatattcaagattgctgcaatactgatagcaatctcagctatctggattgctctccttgaaacctcaactgttcctcgaagttatacttggctgcttcccatctacttggtagtggctcttggatgctacggcctttttatggttggatttggacttatgttcttcccaacttgtcctcaagaagctgtactactgcaacaggatattgtggaggcaaaggaattcttagcaaagaagggtgttgatgtgggctctgagtgagatcaattttgagtggttgacagtcatgactgtcttgaaggatcaccattctgttccttggaataggttgcttttttggaaactgtagataggaaacatatcattccactatgttcagctattactaacacagttttagtgagttggcatgttacagttatgtttttgtcaatgatgggtctcatattgacttgctggtgtttttcaagttttagaaagtttactgttctaggaatatttggtttctatcttgatttcccgtcagtggaccctttaccaattctgctgttctacgttgcttgtaccctcaagtctctttgaggattcagtgtttgaaatttgtgcagaacttctacagttcttctgttcaatgtggcatgtcacaaattacagtt

SEQ ID NO: 7776 - DNA, 552 bp, Sorghum bicolor
  Clone ID: SORBI-28MAY03-CLUS10985_1
gtttatcaatagaaacatgccctcattacctggcattttcatctgaagaagttccagatggcgatactcgctttaaatgttctcctcccatacgtgatgacacaaacagagaaaatctttggaaagctctacttgatggacacatagacatgctaagttcagaccactcaccatcaactcctgatctcaaactaatggaggaaggcaactttttaagggcatggggaggcatatcatcattgcagtttgtcctcccggtaacatggtcatatgggcgaaagtacggcattactctgaatcagctatcctcatggtggagcgaaaagccagccaagcttgcaggccaaaagaacaagggagctattctaccaggataccatgctgacatagtagtatggaaacccgaaactgagttccaactcgatgacagccatgttatatatcataaacatcagaatatttcggcgtatctaggaaagcaactttctggtaaggtcctgtcaacttttgtgagaggaaaccttgtgtttgctgaagacaagcatgcaaatg

SEQ ID NO: 7777 - DNA, 518 bp, Sorghum bicolor
  Clone ID: SORBI-28MAY03-CLUS110084_1
gcacgagggaaacacagagagcttcctagtccgtgtagtggaggtagccatcaccatcatcagagttcagaaaggagcatcatcgtgggtgcgtcatgtggccggagaagatgaacgcgtgggcgtccatggcagaagacccgctcaagcgcgctgggtcggcatcggcgcatccgtcgaaccctctacggcgctacagcccaacgacgctggcggtcggcggcctcatcgtcgttggcggcctcggctacctcatgttcgggggcaagaagaacgggcgcgaccagcaggctagccgccgggcttagagatggcagtggagatcgtccattagctagcttaccgagatgttccaataatgtgtatgtgttccatatgtgcagaatctcaagtgctttgctcgtgtgctactactatcttactatccgtgtagaacatgccaattttatttactgcgtaaagaagtctcacttgtgacttatcttttattgtttgaaccagaaaaaaaaaaaaaaaaa

SEQ ID NO: 7778 - DNA, 688 bp, Sorghum bicolor
  Clone ID: SORBI-28MAY03-CLUS110311_1
gcacgaggcaggcgctcgcgggcgacgccgtggggaggaagggcgagacggacgagtcggcgtggcagcaggggcaggacgtccggcggccccccgccgcgtcggcccgggagggggcccggcggcccgcgcccgggccagccgtggcggccaagggccgggcggcgacggagaacatctacgggaaggggaagggcgcgacgggcgcgttcggggagaagatggtgatgccgacggacgtggtagagaggaaacgggctgaggcggcggccggtggcggggacggggaggcagctgcggcatcgccgccggcgccggggatcggggacgacgacgtgatgctgcgggtgaaggaggcggaccagatgacggggcaggcgttcaacgacgtcggccccatgggcgaagagggcactggcatgccacggcgacggcgctaagctaccaacctgcctgccttggcggcgccctgcgggcgcggctggccgcttccatggagacgccgggccgggccgacggcccgctgcatcggagaggccagacctagcccacaatgcgctgcccggaatagtgcaacgcaagggatctactctcgcccgcagagacgtacgtaccatcaggcagcgaattcaaaagtgttactgatcatgtttgtctacaaacgcgttacatatactcgtggttgtct

SEQ ID NO: 7779 - DNA, 568 bp, Sorghum bicolor
  Clone ID: SORBI-28MAY03-CLUS110353_1
gcacgtgccggacgcccgcggtgccccgcgcccgcgccggcggcggcggcggcggcctcccggggggcgccggccgccgcggcgcgggccgcgccggggcggcgctgcccgcggtgcccctccggcggccgccccgcgccggcgtcccccgcccgggctcctgcggccgcccggacccctgccgcccctgccccgcgctgacggcgttggtgctccggcggccgccgcgctccgacgagccacgatacgacgacgatgccgccgccgccgacgggagcgccggctctgtggcggacgccgcgaagaggagcttcgagatgggcaaggagacggtggagcaggcggcggaggccacagccagcgccacgtgggacgccgcggagacggccaaggaaaaggtgaagacggccaaggaaaaggtgaagggagcagcctcgccgcccgacggtgctgaactctgagcacagcagaccatgccgcgttcaaattgcttttgtgtttctgtagcatgatgatgtaaaaacactgtaccgcacatgtccgatgtatgtacacgagtctttcccct

SEQ ID NO: 7780 - DNA, 1016 bp, Sorghum bicolor
  Clone ID: SORBI-28MAY03-CLUS110437_1
cgcgccgccaccaccacctcaggcgaccgaagatgatctccccggacgcagcccgcaacgtcgtcggcatcatcggcaatgtcatctccttcggcctcttcctctccccagcgccgacgttctggcggatctacaaggccagggacgtggaggagttcaagccggacccttacctggcgacgctgctcaactgtgcgctctgggtgttctatggcatccccgtcgtccacccaaacagcatcctcgtcgtcaccatcaacggcatcgggctcgtcatcgagggcatctacctcaccatcttcttcatctacgccgacgccaagaagcgcaagaaggcgttcgcaatcctgttcgtggagattctgttcatggtcgccgtggtgctcggcgtgatcctgggcgcgcacacccacgagaagcgctccatgatcgtcggcatcctctgcgtcatcttcggctcggtgatgtacgcctccccactcaccatcatgggtaaagtgatcaagacgaagagcgttgagtacatgcccttcctcctgtcgctggtgaacttcctcaatggctgctgctggacggcctacgcgctcatccgcttcgacctctacgtcacgatccccaacgccctgggcgccttcttcggcctcatccagctgatcctctacttttggtactacaagtcgccccctaagaaggagaagaacgtggagctgccccccgtctccaggaacgttggtggtggcaacgtcactgtcagcgtcgagagatagacgacgtagttgcagcggcactgcccccgcccgtcgagaaagagctcgacgagacgtacttttacccccagtagttttgccatcgctcttatcggatgattgttttaagtgagtgcgtgctagctagttttgcccggtgtgtcatgttagttttgcccggtgtgtcatgtcaagagaacaattaatctatccattcatgtggctgtttgctccctctcatggagatataatcaatcatgtctgattgct

SEQ ID NO: 7781 - DNA, 951 bp, Sorghum bicolor
  unsure (1)..(951): unsure at all n locations
  Clone ID: SORBI-28MAY03-CLUS110506_1
ttttcttcctgcggccgcagcgtgtgacaagcaggccctcccgccaccgcgagctcgcggcggacccgaacgaccgaccgatccgtcgtcgtcctcagttcctcatccatccgggcatccgggttccgccgagcggaggaaggcgccatgaaagctgcggaggacgccacgcgctgccctgagatcccccggcggtgccaccactgcgccgggccactctccaaggacatggaaacgagcagctggacagtacctccgttggttcgagatagcttctccatgattggttcggctcttgggggtatagcaggagcgttttatggtttcaaccatgttatgcctgttgttcgacgccacattaagggtccgatgtggatgcatttttttgttggtgcaccaccagttattgtgttctcttctgcatgtgctggattagcaggtggtacaataccagccaccgcacagctggtttcatcatcctatcatgctgtgtcatcgcactcctttgcccgctcttcttcacatgtagcaaagcatgcaccctcctttgccccctctgcatctcatgacgacatgcacaagaaaagaagctcctcaccattgtaagttattggtgcaacagttcctctacataactcgcctcccttgagaaactatcctcctaactatgcaagactcatcccatcctactctatgaaacatgacttctttatcactccttgccctctttaacgagggatgcttttgtacatggtattttttccccctcgtggatggatgctatatgtgccctgtttataaattttggatatatcttgatgtatagctagcactgggctatgttttgtggtccaataaaagttggtgctgtgaccagtgtacactgagctgaggttcttttgagatattctagcgctggaaagtattgtcacgntccaatggtatggtgag

SEQ ID NO: 7782 - DNA, 1146 bp, Sorghum bicolor
  Clone ID: SORBI-28MAY03-CLUS11051_1
aaaaaccatttcctaattcccccacttcgcccgccattttcctctttataatcctcctcccaccatcaccaccacattagtgttcttgaaagagagagagagagagagagagacaggagtggagagcagagatgagagagagattgagcatgtaacaggctcgcttctcccatctctgtctctctctctctatctcctctactcaagagtcacacaagcaagagaccgagcgagaggatgatgtggtcgcatgagccggcggcggagcagaaggcggcggcggcggcggcgacacggcagcggagctccgtggccaagctgacgacggcctcgtcctcgtccttggcgaacctcctctcggtcttcgtcggggcgaataacagcaactcctcgtcgggctccgcatcgtcggccgagggagagcttcgacgagggcggcggcgtcgggctgggcatcgtcgcggccatgagccacgcctgcctgaccggggctggggccggggtcggggccgagccgatcgccatcggcgccgcggctaggcggcggcgcgcgcgcgaggaggacgagagctacacgtgcgtcatcacgcacgtggccggcgctggcggcggcagcgttcggaagagggtctactttgggttcggcgacggcggtggctggctcgtggaagccgacgacgaggcgccggcgccggcgcccgatttcttgagccggtgctgcctctgtgacaagaggcttgatgggctcgatatctacatgtacagaggggagaaagccttctgcagctcagagtgccgatgccagcagatgctaatggacgaccgcgctgacaagtgtggatcggaagccctcatcaggtcaggcggcgactactcgtactcggtgtcgccgcactccaccccgagtggccttctcgccaagcgtcgcagcagcctagtgtagtgcaaagactactcgatcgccctcaagctgccccactatgagcaaggagtgtctagctagaagagaagagactgaagtctaaacgggcgcggccgtttaaacaaatatgggtcatatacagagtaatttataaaatgagctgattttcttaattatgacatgaataaaagcgagcaagacagttttgaaactatgctttaatt

SEQ ID NO: 7783 - DNA, 604 bp, Sorghum bicolor
  Clone ID: SORBI-28MAY03-CLUS110665_1
gcacgaggacagcacgaattcccatcgactcatatcacgatttcattttttttcatcacaaaataaaaaacccgtgaacacaattcacagtggcatgcagtacacgcgaatcacatggccgatatagaaacagaattaaacaagaggtcaaccaccgcaaccgccgccacaaccgccaccgcagccgccgcctccgcaaccaccaccgccaccgcagccaccaccgccggagtcgagagccgagccgatgatcgcgccggcggccagccctccgacggcgccgacggcgagccccgcggcccccgatccgagcccgctgcggccgggcctctgctgctgctgcgggtacgcgtacccgggtggtggcggctgctgcgccgggtagccgtacgcgcccgcgggcggcggcgggtagccctggccgtagtagtaggcgttgttgttgttctgccggggcggcttcttgacgccctgcgcgcacccgaacgccgcgatggccgccacggccaccgtcgcggccaccgcgaggaccacgatcgccacgggaccgagcgcgtgctgggcggcggcgttgtgctgcgtggccgccgcaccgccctcgtgc

SEQ ID NO: 7784 - DNA, 984 bp, Sorghum bicolor
  unsure (1)..(984): unsure at all n locations
  Clone ID: SORBI-28MAY03-CLUS11085_1
tccaaaaggatatacaattccaagcttggatacacttatcaatcaaggatcgcttaacgtgcaagctggaacagcttttgtggactatgagttccttggagagatcaatacaggcaagctatctgcaacgatggtgaacaagttctcgtgtatagcactagctggagtcgcaacagagtatcttctgtacggacttgcagaaggaggattagctgacatcaataagcttgatggattgctcaagagtttgggtttcacccaaaagaaagctgattcacaggtgaggtgggctgtgctgaacactgtcctcatactgcgtcgccatgaaaaagctagatcgcagcttgcagaggcaatgtctacaggcaagtcagtgggctcttgcatccaagtcatagaagagtgtataagcactgacgatatttaacgcggatgaagttaacagttcacactaatgttcctattatcaacaacagatcaagggtaagcaaggaatgtattctacatgttagtgtgtttggatatgcttaaaatcagattccaggtggaattaggcgagaatcccacccaaacgtctcgattagttttttattctcctgactgcaatgctgagaaaatcatggtttgcactaagcccacaggcttgtttcttccaccgcgaggcttcttttcatcgacatcccttgtccggaggcccctgagccgctgcctgctactctgctagctccctgctcgctctgccaggccgaacgcctccactgcaccacccgctcttgagtgtacgatgaaactggatcggatacatacagatatcagtgaacttgcattctatcccatatattttcttggatctcggacacagctacggatatcgatatctatcacatatacatgtaaaaaaaactgattttgagtattcggatttaaatacggtacgaatattttttgtgacatacagtacggantattaaatatttagatttc

SEQ ID NO: 7785 - DNA, 1111 bp, Sorghum bicolor
  Clone ID: SORBI-28MAY03-CLUS12226_1
gcacgaggccagatgatgatttcccgtacttgttggataatccacctgatcttctgcctagttatattggattgtgtgatgaatttgtatcaattgatgcattgatgaacatgagtagcagatgtggagcattcccacttattgagagtgccacggaagccagtgttgattataagccatgttcatctgaggtggatttgtgctttaattctgaggtattagagtggctcaaccctcatctgttggaggaggatttaccagatcttgttgattttgctgagttaaattcaaatgctgctcctgcaaaaaaagagcaatggaccaggaaggtcactcttgtgcttgatttggatgaaacccttgttcattcaactatggagcattgtgatgacgctgatttcacatttcctgtgttctatgatatgaaagagcatgtggtatatgtgaaaaagaggccacatgtccacatgttcctccaaaggatggttgaaatgtttgaggtagtgatatttacagccagtcaaagtgtttacgcagaccagttgcttgacatgctggatccagagaaaaaacttttctccaagcgtttcttccgggaatcatgtttgttcacagacaatggctacacaaaagatctgactgttgttggagtcgaccttgccaaggttgtcataattgacaacaccccacaggttttccagctgcaagtgaacaatggtataccaatagagagttggtatagtaaccccttggacgaggctttacctcaattgatcccattcttagagacccttgctgtagctgatgatgtccggcctatcattgccaagaagtttggcaacataatagatagttgctaaggtttttgaataagttatagggttagtcttgtttgctcacatagtgaacctagatgacatgttaactggtcgaggtcgtacatttttctctttaaaagcaggttggctcataggattaagagttttggtgcttgggctattccttagaactgtacatatccccaattttgttttgcgactttgtacatagaatgctgtcgaaattgaaagactgagagaaacatgtatgcaaagtttttttgcttttgctc

SEQ ID NO: 7786 - DNA, 695 bp, Sorghum bicolor
  Clone ID: SORBI-28MAY03-CLUS1223_1
taacctcctccgaatcccatcttctgttttcttccattctactactatcttcccccgctgccgttgccggcggaagaagccaatcgacgcgatccccgcctccgacgccaagcccaaccccgcagcccggagccgcgtcctctcctctccatccccgtaccacgaggagacgatcccataggcgacggcgcggtccctccgatccaagcacgcggttttgttcctactataacctctagatgattccatgggaactccaaatgaaatgatggcatactcttccctgtccaaaatggacaccggccagaagggagctgctctgtccaatgtagttgctggaaacaactatccggttcaggattatctttatgagccagcatatgaaccagacttcccagagtatgattcaagagatgacccgtttgctccaacacaagctagtccaaaagtcaatctgaagactgttctaggtgggctggtttcgattgtcacgggtgtaaacaagagtgaggatgacgcatcgcagcaggaaggtttcagcacagacatatcattccttggatctgacaagaatggtgatgtcaatgtgcacccttccgtctgtgttccaagtgccccaccactacttgaagcgaatgctttacaatatagtgcatacagggaggtgttgctagcagatccaccagaatggttgc

SEQ ID NO: 7787 - DNA, 1175 bp, Sorghum bicolor
  Clone ID: SORBI-28MAY03-CLUS122467_1
gcacgaggcctgcatggattgtaattttaatagacataagtgttacaagttcgttgataaatttagggcctacaactaataaaagttgtttatctttgttgtctctcgtttaatctcgtattctaaatcaatactcatataggtgcttcgtaatctttatatgattgtgataaactaaaattaccaattactctatatgtttttcccattcccattcatagtctctgccctttggattgcactttcatgcttatttgacatgtgtttagttaaatccttagcttgggctttgtggttaacatggaaatcaattatactcatcgcttcttgcatacatgtatacatggtctgcactcttcatggtgacacacattatgcagtataccttgtgtttgtttttttatgcagtacgcccgtcggtgccggctgttatttgggcagggcactactccttgccttgtggtcatagctcatggtcttttgctggccttggcttcctttcatggtatctggctggtaaaatcaaagtattcgatcgtaaagggcatgttgcaaaactctgcattgtcctttcccctctgcttcttgcagccttagtggcagtttctcgagttgatgactattggcatcactggcaagatgtatgtactggtggattacttgggttgacagtcgcttccatttgctacctgcagttttttccactaccatctgatgaaaatggattgtggcctcacgcgtatttccgacacattggtgagccagagggtgacaaccaagtgcaacccacgtacatgagccgtcgcagctcgattcataacggttcctttcacagtcctgatgcagtggaaatgaggagcacgagccgagcactggattccatggaagctggtgggagagtccaatgatggaataataacaccaagggccacagaccattgtaaattttgtaatataaccttctagtgcttagtatagcaaagattttgttcgattccttattatgtaacttccaaagcatagaatataaagcacatgtctctggtgagaattcttggctagattccatctccttttggaacatatatttgatatatgacgtcgatgcgtcatgagacacaacacaaagaagcatgagcttatatgtactattttggaggatcttaaaatgcggt

SEQ ID NO: 7788 - DNA, 731 bp, Sorghum bicolor
  Clone ID: SORBI-28MAY03-CLUS1229_1
agcaccgtactagaagccacgccgtgttcagttccggttgctttccttccagaaccagatcccaacaataaatccaagcgtgctccttccctggacactgaatcatcaaggcggagcgtcctttcagcaaaatttcccgagacctcgagcaaaatctggtctggtttggttcaaattcgcctttcttttggggcgttcttacgggccatgtcgcagcacgacgacgacctcgccggagttcattcggaagaaggagaccgccacggcgttgtaatggatgactccgactacgaggacgatgagttggaccaatctactagtaaagcgactgaacacatcacggctatggatgtgaagaaggggaaggatatacaagggatcccctgggacatgatggcgactacaagagacaagtacaggcagtcaaggctgcagcggtatgccaactttgagaacgtacctaattccggaaggatttcagagaaggaatgcatgcctgcagagaaaggccaactctactatgagtttcagcatagcacgaggtcggtgaaatcgaccatccttcatttccagttgagaaatttagtatgggcaacgacaaggcacgatgtgtatcttatgtcaaacttttctgtgcttcattggtcagcactgacttgtaaaaagcaagaagtcattgatcttcaagcacatgtcacaccatgtgagaagcaccatgggaattactatga

SEQ ID NO: 7789 - DNA, 945 bp, Sorghum bicolor
  Clone ID: SORBI-28MAY03-CLUS14531_1
ttcctaagcatgtgtctgttaaggaggctgttcttccttttgagaaattccaagggtgtgacatccttcttggaccagagatgcgcagcactggagaggtgatgggcattgactatgagttctctggtgcctttgcaaaggcacagattgctgctggacagaggctcccagtaagtggcactgtgttccttagcctaaatgatttgacaaaacggcatcttgctgagattgggcgtggattccgggagcttggcttcaacattattgccacatctgggacagctaaagtgctccagcttgagggtgttccagtggagccagtcctaaaaatacatgaggggcgaccgaatgccagagacatgctgaagaatggtcagatacagatcatggtgataacaagctctggtgatgctcttgactctaaagatggcctgcagcttcgtaggcttgccctcgcctacaaggttccaattatcacaaccgtggatggtgcacgtgcctccatagatgccatcaagagcttgaagaacaagtccattgagaccctcgccttgcaagattacttccagactgctgatacttcggcagatttacaagcagcggcacaaactaccccttagtggtatcttttttttccatataatgtgagcctagctcgagccaaaaccacagccaatatgatatttttgtttacggttgcaccagcagcacgcatgcgcaaagacaagcatccagattgtatcggtcacaaacatggctagataaaattggtgttgggctaattgtagttgtactttgtaatgtagggtgatgagcatccgtccacagaataaggctttcccaactgcggttttgatgactatcgtatcccttgtggagatttacactgtatcattgtcgcacaagaaaatgtgcgacacatgatgtattgtatgcatgttatca

SEQ ID NO: 7790 - DNA, 852 bp, Sorghum bicolor
  unsure (1)..(852): unsure at all n locations
  Clone ID: SORBI-28MAY03-CLUS14554_1
tggacataagtggtgcagagtatagagggaaggaggttccactttttgtgctccctacaaggtatctcctcaagctggacaccacaatgacctcttactgcgatatgcaacgagtcctctttgaagaggagcaatcagcatataatcaagctatgcaacaaaatatttgtgatgggaaaattcaccctcttacatccattcaccatacatctacatacaactcctctctctgcaaactaatggagtattgtttgagtccagctgttactacgcttcaggatcgcctgaaggaaaatgaacttcggctatctatgttacaagaggaggctaagcaacttgaggctgatacacaaagcatgagaaataattctcctcgtcgcctcatgaatcatggagctggtggcaacagttcacctatggctcagagcaggcatcctttctccaaccaagggagccctagaagcccgatgggtggcagccggaggagggcttgatgatcctgctccgcctgatgtgttgatgaatattgtccgttgtggcttaaccagatgcttcctgaaaccccagatttgatggacgaagtgcccagacaatagcactgtaccctgtacatacccattgccgtttagcgctgtgctgttgtggaatcccaagggtctcactttgctttgttgtattggggttccttatccggttccggagctgtgccattatcctttcncatggttggcctgagcttatagcctgtacactgtagactctgtactagaggtttacctgaaaggctgaactgccgctgctaagatgtgatgttccncaggcataagcaaagatgaaggttgtctttcttgt

SEQ ID NO: 7791 - DNA, 897 bp, Sorghum bicolor
  Clone ID: SORBI-28MAY03-CLUS14563_1
gcacgaggctttatcacatgtcagcatcctttccaagttttgttgctaacgagtcagtgtccaggttgccacttgttggtctcataagcaattgtcttggatgcatttctgttcaacgagaatcgaagtcttcagatgctaaaggtgtttcaggtgctgtaactgaaagggtccgagaggtttgccaagataagaataccccaatgatgttgttgttccctgagggaactaccacaaatggggattaccttcttccatttaagaccggagcctttcttgcaagtgcaccagtgcagccagtcattttgaaatacccttacaagagatttagtccagcatgggattccatggatggagcacgtcatgtgtttttgctgctctgtcaatttgtaaatcacatggaggtggttcggttgcctgtatactatccttctcaacaagaaaaggaagatcctaagctctacgcaaataacgtcagaaaactgatagcaacggggggcaatttaattctttctaatcttgggctggcggagaagcgcgtgtaccatgcagcactgaatggtagtagtctacctggtgctagtagacatcagaaagatgattaaaagacgttgcgtcgcttcttttgtaaactgaaaggtgaggagcatttaaaatgtaactgtgtgcgtgttttatatttgtaatgcggcgctttctttgtttgtttgaggagcctgttgaataccctcctgatatactacattgtacaaaaacattagccgttatagtttgataaggttcgtgccctcctatgaggtctttcaaatgtcgagggcttgtagtttattcaacagattgaccagatctgaagtctgaaccttgcctgtctacaggtttaatgtgatgtaacttggg

SEQ ID NO: 7792 - DNA, 813 bp, Sorghum bicolor
  Clone ID: SORBI-28MAY03-CLUS14577_1
attgctccctaccctatcggcttctctgttgccacgttggctccatcttcatcttccccagaatatatttcaaccaaagatccatctatcaatcaagtagcatcaccagtggcagcacccgaacctgttggagcaatcttgccaaaaggggtattccctccggataccattatgcgaactcagacttctacaagtgttggcagttcaagccctggtggtggtcgctgatttttctgagctggtgggagtgatcctctcagcacaatttttctatcacttgacacagttctgataggcctctccaatgtgaataagaagctgtggcctctgtagagaagccgcggtgagggtggttttctctaccatcagaataagagagcattgataggttacaagcaagctcgattcacttgcaatttttgcgttcttctgttcatgtccaaaacgggaaaaggaaggtttttgaaggtcaggttccatagcatattgggcgcggtggtgaggctcaggtccgttccctcggtaaataattctcgggcaagaaaattttcgttgttatcaagaaaattttcacatgcagagttactgagttcctccacctttcaaatttcttttttctttttgttttctgtatattgtcacatatatattacatatatatcatgaacagacttgagacatttaactacgtatatataaatgttcatactgggagcaagacgcattgtaatcgccaaaaaaaaagcttaattgaagagatcttgctgtcagtaaaaaaaaaaaaaacaaaaaaaaaaaaaaaaaaggccccta

SEQ ID NO: 7793 - DNA, 962 bp, Sorghum bicolor
  unsure (1)..(962): unsure at all n locations
  Clone ID: SORBI-28MAY03-CLUS14608_1
agacccgccccgccctgttctcgcctgctgcctttctctcttctcggtgtaaaccgtgtggcgcatttcactgttttggtttcctctcccgctctttctttaccccctactccggccaagtgctggaaccaagaaagcctcatgcggtggccggccgaggggcggtagagcggcggagatgggctgggcgcccaggtggctgcgcgggctgctcggcggcggcaagaagagcgccgagacaaagccggtgaaggagaagaagcgctggggattcgggaagtccttccgggaaaagactccggcaccagcgccggcgcggcctccgacgcctccggtgcagcccacggcgacgcctcggcgggggtatgcggcggcgccggatgagggggacgacgagcagagcaagcgtgctatcgcggtggccgcggcgactgcggcggtggcagaggccgccgtcgctgccgcccaggctgcagccgccgtggtgcgtttgacgagcagcgggcggtgcgcgccggccgccgccgccaagcgggaggagtgggctgctgttcggatccaggccgctttccgtggctacctggcgaggcgagcgctgaaggcgttgcgggggctggtgaagctgcaggcgctggtccggggcaacattgtgcggcggcaggcggcggagacgctgcgatgcatgcacgcgctcgtccgcgtccaggcgcgcgcgcgcgcttgccgcgcaattcgttcgcagcgtgtcgcggctcatccggatccaccgacgccggagaagtacgatcaggcgggtgcgcccaggcacggccgttccggctctctgaaggcaaacgcttcgaagacaccgggcggcgagaggctgggcagggagaggtcagaatcttgcgggaggaactggctggaccgctgggtggaggagggacatggcgacgagaagacgncaagatcctgagtggaca

SEQ ID NO: 7794 - DNA, 1053 bp, Sorghum bicolor
  Clone ID: SORBI-28MAY03-CLUS14573_1
ggctgatgatctctagtggtcttttcttgaaagggaaataattttttgcccatgtggctcatgatgaaattgatttctcatataagttggaaatataggctgatgatctttggcggtccagggcatgttcatgtatatatatgtattgttatctatttatttatcatgcttcatcaattccctgaggtcaacatattgcaacttcctcctgggtcccgtcgcatgcccttccgaggactcctcggctccctcccccttcgtatctcctgctctgtgccgtcccccgcatctgtccccgcctccaccctcaccctcgccctcagcgagcgctgtcctcgttccccatcgagttcgccgctgctgccaaccgtgacgccctctccggtcctgggtcggcacgaacccgacctagggtttcgtcccttcattgggtggcagcgccggcaccggtggcccctgccttctcccccaccccacacggcatggccccgtggcatggctcctcgctctggacgacgcgggaggcacgggtttcgtgcggtggcgcgacgtgggtggagaccgccgttggcatggccgcctccctccgcttgaggatgctgttttggggttcatgtttgcatttgagccatgtgcggtgatgagtatggtttacatctacaattgagggaatgggctattgctatgatgattgcgccatatatttggttcctttgcgttctagtgagttcctagttgctgtagcaatctgagttaatatggtgtagggacacaaatagacctgagcaccagtgcagcgcccaagcaattacttggagcagctacgtggtccctctcgctggcagtacacttagtgctgctaatggtgcctaactaaatggtgatattttgtatatgttaccaacttgaatttttttgtaaagggcgctattctcagtgcatgccattgtgcctaactaaaggagatcaaatgatgccattttgggttcatttctgaaggtactcttgttatctacattattaatggtttcttattggactgaattcttatat

SEQ ID NO: 7795 - DNA, 1089 bp, Sorghum bicolor
  Clone ID: SORBI-28MAY03-CLUS124967_1
gaagggacagggaccaggcccccgcgccgcgccgcgcgccgaggcgagcggagcggtacaggtagtaggtggctgggctcgcggggccgtctcgtcgtcccgtcccatccctcccaaaaccgggggcccttctttttctacggctcccaaccccgccccaccaccaaagctcctcccgtagtcccgtcccacccttctgcgctctgcgccaacgaactcgtcgtccgtcgtcgagtcaaaccgcgcccggagccaccagcgaccaaccaaccaaccgagcgcatggaggccgcggcggcgaccgcgctcccgttcgcggcggggtctgcggcggccttccccgctgccgcggggagggtgcggcgggcggcgaggtgcgcgcgtccgcggacgcggcggtccgtggtggcgaagctggagggcgggctcgggaaaggggtgcccacaaccaactacgtggtgccgctcgacaaggccaccgggatgacccgcccgctcgtcgagatcctgcgggacctcaacaagcgcgtcccggacaagatcatcgaccccgacaccgacaccgtccactggtaccatgccaacagaatgcttagcttctatgcaccaggttggtgtggagaagttcgtgatgttatctattctgagaatggaactgtaaccgtggtatatcgggtgatacttaaaggaactgatggagaggcatacagagatgccacgggcacagcacaggtccatgaggggcgcagagaagatgctgttgctgccgcagaggaagctgcattctgcaaagcctgcgcacggttcggttttggcctgtacctgtaccacgaggatgatactcatcacgaagaccacttccattgaggctcagtctgcatcagagttgatcataagttgcaacgtgcgcaggatatgcaccaggagaacttcatgcccagaatcaatttttgctctttgcgtagtatcatattcacaagcgacaaggcatgcttccacctgcatgtgattgtagatacaaagaagcctgtaacttgtttttgttgtactcgctggtggctcggtgccatcctgcaagaacctatgaac

SEQ ID NO: 7796 - DNA, 1327 bp, Sorghum bicolor
  Clone ID: SORBI-28MAY03-CLUS12498_1
gccgctggcgctcccgccgccggcgagcgtgctgatgcacggccatccgcaccgcggcggggaggagacgcccgaggaccgacaccacccgggcgtcgtcgacgccgacgactccgattccgactcggagggctcggagtacgacgaggagcggtcggtgtccccgccccctcccccgcacgcgccgtcgcaccaccacgtgccggcgccggtggcgcagcagcccccgccctacttcgcgacggcgccgcacatgctgctctcgcttggctccggcggcgcgcccggggccgcggtggcagcggccgcgtccgcggcgcagaggctgcaggccccagcaccccagcagctgacgccgtccagcgcgccgccgggccccggacgcgtgggcgcgatgccgatgccccggaagcggttccgcaccaagttcaccgccgagcagaagcagcggatgcaggagctgtcggagcggctcgggtggcggctgcagaagcgcgacgaggccatcgtcgacgagtggtgccgcgacatcggcgtcggcaagggcgtcttcaaggtctggatgcacaacaacaagcacaacttcctgcgcgccgctccaaaccccaggcggcgctgctgcaccgtcgtcattcaacccgtccaggatcacccctccgcctcccgtcctcacctcttccccgaccagcgccacaggcttcaacatcaacggcgccgcctcctcggcgcccaccgtcgtcaccgccgaccacacggacaacgccgccaacggagcttcatcgccgcagtccgcttaaactactagagaagagagggaatggagaatggagagagaaacatgtagcttaatttcagtgatctgatcactcgttttcattttttttttctttagactttccatctgctaagaaattaaccccaagaaagcatgccgccatgcgccatgcctagaaatccaagcttcctcctactgtagtaccgtgtatgcctcttgggatccgatgatgatgttgatgctgattttaggattagattatctcatcccatcccaaccaaaaagaggtactactagtagtagccacccgttcttggttgttgttcttgtcctctctttgattgagctcatcgatctcactcaagagccgtgctcaggggagcaagagcaaggcaaagggttcttgcttctagactcctaggatcccatgctgttgtgctgtggcactggcatgttgcgcgaaacggaagcagcctccgaaagcccttgctcctctcagcactgatccgcacttccgcccataaattaatttgacttggctttggacttgtg

SEQ ID NO: 7797 - DNA, 795 bp, Sorghum bicolor
  Clone ID: SORBI-28MAY03-CLUS12551_1
gcacgaggaggagctccgctcgactacgagacccacgtgcagtatatccagtgcctgaggaagtcaggcaacattgagaagcttcgtgcggcaagggaggagatgaacaagtgctcgccgctcaccccaaagatgtggcaggagtgggctaaggacgagatctcattgagctcgagtgaagaatcttttggtgacattgaaaagctctacgagcgtggggtgcaagaatacctgtccatcaagttatggcgggattaccttgattatgttgaagagcatgatcagtcggtgtctcaatgtacaccttctggcctctccaagatgagaaatttgtttgaaagtgctattactgcaggggggctgcatattactgagggtagcaaactatgggcagcttatagagaatatgagatggccattttgatcaccattgctgatgccaatgatgaggagagggaaaagcaagttcagcgtatacgcacgctattccaccgccagttatctgttcctttggctgatatggaatcaacacttgctgagtataagagctgggaggccgagcaagggaatgcaaatgatccaggtgcagattttgatggtgtcccctcaaatgtcgtatctgcttacaaaaaggccaatgatatgtacaatgaaaggaagcaatacgaggatcaactaagcaatgcaggcacatctgaagctgacaaactgcaggaatttgtgaaatacatcaaatttgaggagtcttctggtgatcctgctcgtgttcaagtcctgtatgagcgagctgtttca

SEQ ID NO: 7798 - DNA, 552 bp, Sorghum bicolor
  Clone ID: SORBI-28MAY03-CLUS12604_1
gccggcggcaacatcctgccgctgcagctgccggcgccgacgacgtcgcgggcgcggcggaccgcgttccacctcctggtcgcgctcggcgaggacggagccgcgtccggggagctgttcctggacgacggcgagtcgccggagatggccggttcgcgcggcaagtggagcctggtgcggttcagctgcgcggcggggcacgacggggttaccgtgaggtcgcacgtggtgcgcgacgcctacgggccgacccggaagctggccatcggcaaggtgatcttcctgggactgcactcgccggcggcgccacagagggagttctccgtgtatgtcaacggcgtgaagacggccaactcgatcggcggcgcgttagggtaccagaggaacggagcattcggcgcagctcaagtggaggggctgtcgctggccgtcggcaaggagttcgagctcaaggtcgtcatgttgtagaaacatgcatggcactcgagcttgttctgaataaaaactgatcaaaagtttgaatttaaattggaaataaaagaatggtatcat

SEQ ID NO: 7799 - DNA, 717 bp, Sorghum bicolor
  Clone ID: SORBI-28MAY03-CLUS1210_1
cgtccgacgagagggttatttgaagatcaagaagctcgctgctcagcactagatgttaaactgttgttactgttttttgttagtgtgcagctaatatctttgaaattaattgcgtgataaaggtcatgtcctctgtaacctgcagctcaacttttttcatcagtgtttattttccatggtctgagcttagaaagtgtgcattctggttgccaagatgcatgaacatctacaagtctatcacttaacacagcttatgtgaacaagatatagcaatcagaagattaaatactaattattgagtcctaaagctagatggttatatatggttatatgtgtcccctcctattatactgccagagttagatcaactgatagactatggtcactagatttgttcctaggtacataatatcgattgaatgctgatctattaatttattgtagtcagtaaaaaatgttgacaacctcatctttttttctggtatttttttcttttttcccgtcttctaggtttccttacctattccctttcattaatattccttcttttgttttcttgcacccatgtttcttgtttgattcataccttaatctgccttcaatggtcatttgatttagcatcgtgcatgtatgggttccctgatattcttattttttttggaactgggtaaaatttatactcagcagcacacacatcattagcaacaagtacctgaa

SEQ ID NO: 7800 - DNA, 1015 bp, Sorghum bicolor
  Clone ID: SORBI-28MAY03-CLUS12120_1
gtgaacaatgcaatcttccttgtcaaagggttagggagcctcgttgttcacatccttgccctttgccatgccatctgagcgattgtccatcttgtaaagtccttgttaaaagaccatgccattgtggtgctatggtgcatgcttttgaatgtgtatattttaacaacttaaatgcaaaggaacagattaaagtaaggacgtgtggcggcccatgtcatagaaaactaccaaattgcccccatctgtgctcagaagtatgtcaccctggtatatgcccatcggttgatcagtgcatgaaaaaggtcaacatccgctgtgcatgcaacactctgaaacaagagtggctatgtcaagatgtcctcaaggaataccgtaagtctggtcgcgatccaaaagaagtacctaaaagtcaatttggagttggcttgcttgcctgcggtgaagactgcaagaagaagctgaaggctccagattcagagttgcatctccggaaaagtcaggagaacaagagccctgctgtggaagtcgtaaatgtgcccaaacgcaggaagcggcgtgagcgtggacaggaagttaaaatctccaaattccaggaagtcaagacttacgtgctgagagtgctactgattattttgctgtcaataatcgttgctgctggtctgtacctgttgtggaaaggcatattctggctttctgactggatgaacgaaatggaagagcagagggcgagacaaaggcatccgaggggtgcaatgttgtaaaaaaatgagagaagagttattttgatcctagagaagagttattttgatcctaataatcggtgttgacatgtggattaattcatagttattagggattcaattctagaggttcatctagtgaaacatgtcaccattttctttctcactttttctcactatacattagcaattgtatgcatgatgtattgttgtattttcattttgctattctgcattattgtaagtcaacaaacgatacagttactatataattc

SEQ ID NO: 7801 - DNA, 690 bp, Sorghum bicolor
  Clone ID: SORBI-28MAY03-CLUS121642_1
cgggaccagggctcgccgcctgcctcctctcggtactgccgggagatcgagcatggcgctcactcgcctcctcgttctcctcctcggcgccgccgcattgcctgtgctcttgttccgcactgcagaggcgcgcgaggtgggcgtgaactacggcagggtggcgaacgacctgccggacccggcggcggtggtgcagctgctcagggacaacggcatcaccatggtgcggatctacgacaccgacgacgcggtgctgaggtcggtcgccaacaccggcatcaagctcatggtgatgctgcccaacgagaacctggccgacgccgcgcggagcccgtcgtacgcggccgactgggcgcggcgccgcgtggctgcctacctcccggccacgcggatccacgccgtctccgtgggcaacgaggtgttcgactcgaggccggacctgacgccgctgctcgtccccgccatgaccaacgtgcacgccgcgctggcgcagctgggcctcgccgacgccatcaaggtgtccacgccgctgtccttcgccgcggtggccgtgtcgtggccgccgtccgcgggcaggttccgggacgacatcgcgcagccggtgatgaggcccatgctcgagttcctgcagcggaccggctcctacctcaccatcaacctctacccttacttcgcctacgccgctcagcc

SEQ ID NO: 7802 - DNA, 1239 bp, Sorghum bicolor
  Clone ID: SORBI-28MAY03-CLUS122_1
cgttcgcaatcagcaagccgcgcatagcactgcctgctgtctggactctggagcctggactgaggtatccaaggcaaggacactcaccaattcaccatccatgtccatggaagcggcggcggcgagctcggttggggctgaattcggtcccgccctcgggttcaggaacatccaccgccgcacccttccttattgttggcgcccgcgttcgccccggccggcctcgcttagcctctgcggaggctggggagcccgtccccgcggcgccatcgccgcggcgtccggcgaccagcggcggcggcagctgggagagctcgaggcggaggcagaagctggctcggccttgggtcctacgaggagcagcccccgcgaggtgagggaggagatggcgcggtgcttcgacctcgtccgccgcctcggcaggggcgccgtctacctcggctcctccagggtcccgcccacgcacccgcacttcctccaaaccaccgagctcgccagagagatagctcggctgctcgactgcaccacatggaccggagctggccctgggctgatggatgctgccatccaaggcgcccttgaggcgggcaagccggtcggcggcttgaagattgcaaaggaggcaggtgaatggacaagctcaggcttccatccttacctgccaccagagacctacctcacatgcaggttcttctcagcgaggaagcatggccttgtggatgctgcggtgcggagcagccctaccgacagaaccgccgtggttgcactgccaggaggggtcgggacgctggacgagttgtttgagatcatggcgctgattcaactagagaggattggatcagcgctcccggtcccgttcttgctcctcaactacgattcttattactccaagctgctggactttctgaatgactgccaggagtggggcacggttgctccgggggaagtggagtcactttggaaggtctgtgatgggaatcatgaagctttggagtaccttgcagagttctacaatgttcctgctgaccaaagaaattaccaaatatcaccacagttgaagcagcacaggacttcgtacgctgcaagctgatcacaggacctcatttgtcgttcctctagctttagcaagtttttcgaagtgaattacatcaaataggcttttagccttggaagcaacattctgagaacagtcgctgtacatttgaattttagttattgattgacaacggttgtgatgaa

SEQ ID NO: 7803 - DNA, 1103 bp, Sorghum bicolor
  Clone ID: SORBI-28MAY03-CLUS122083_1
gcacgagggtcgccatggcggcgggaagagaaaccgacgaacagctgaccgagtatgagaagcagcggctgtcgcggatacgcgaaaacgaggcccgcctcgaggccctgggcctccgcagcctcgcagcttcccctctcctccgcaacccgtcgccgggggcggcaaaggggaagcagaagaagcggtccgccgacgaggacgaggagtacgtcccgtccgatagcggcggcgttgaggaggacgacgagagctcgtcggagagcgcgcaagacgaagaggtggagggagaggggaaatcagcttctaggtcacgcgccaagggaaagaaaaagaaattgtcaaaatctggtaaatctacaaagagcacacctaccaagggtagtgcttctttggctgatgtggtggatgatgatgcagccttacagcaggcaattgctctctccctggcggaatattcagaaaagccagcgactgcattgggtgcagaaacatcaagcacagtaacaggagcgagtgaaagtactccacacaagaacaacagcaaagcatcggttcacgacacagctaagaacaagaagattaaaaagctgggtaagagcaggattcagctgacagaagatgatgtggttgcattcttcttctcatttgacgaagttggtaaaggatatattacgccatgggatcttgaaagaatggctacaataaatgatttcatctggacagattctgagatatctaagatgatccgttgctttgatagtgacagtgatggaaagataaacctcgaggatttccgcagcattgtatctcaatgcaacatgttgcaggagcatgagaagtgaggatgatgttgctggtctgaagatgcttgtactatagttatgcatggtccagcctgtgacattgcatcaacattactggcatagcgggcggacatagagtgagtcaatgaaacccatttgtgtttcccttttagccattgaacataacctttgttgttggagacttgtacaaagtaccatttgacacagggattttatgattcatacatgactgttcctccgtgtaaacaaacagattctgaaaatcacagttgctgc

SEQ ID NO: 7804 - DNA, 485 bp, Sorghum bicolor
  Clone ID: SORBI-28MAY03-CLUS122243_1
cccggccgccgtgacggcgtcgccggccgtgttctcccacaccccggcacccgcctccgccgccggcgccgcctccgcgccttacgtgatgaccgacgaccacagcgggcggagggtccaccacgtgagcccggcggccgccctggggagataccccggcatggcagctggccctgggatggcggtggtggcggagccggtggtcaccgggccggaggacgccctggggctggacctgcagctcagccttgcgcccgccggcttgtgacttggccggtcgtcgacgtgcactgtcgtcgccttggtaaaagagaattgatcacctagtagtactactgctgctgctactaaaaagtctgtactaagatcgatcgtccctgctggctaggtaaatggtaattagcactagtaattatatggtttagttgctgggatttggagagctgcatgcatgtaagccacctgtaagatcccggttctagcta

SEQ ID NO: 7805 - DNA, 783 bp, Sorghum bicolor
  Clone ID: SORBI-28MAY03-CLUS14302_1
cgtgatccaagtgaaggagggggtgtacgaggagtacgtgaccatcaccaggaccatgaagaacgtgaccttcttaggtgacggctccaagaagtccatcgtcaccggcaagaagagcttcgccgacgggatcacgactttcaagacagcaaccttcactgcgcaagccgacgggttcatggcgatcgggatgggtttccagaacacggccggcgcggagaagcaccaggcggtggcgctgctggtgcagtctgacaagtccatcttcctcaactgcaagatggaagggttccaggacacgctgtacgcgcactccaaggcgcagttctaccgcaactgcatcatctccggcacggtggacttcatcttcggcgacgcggcggcggtgttccagaactgcatcctcatcctgcgccgcccgatggacaaccagcagaacatcgtgacggcgcagggccgcgcggacgcgcgcgaggccacggggttcgtgctccagaagtgcgagttccaggcggaggcggcgctccgggacgccggcaagccggccatccgcaactacctgggccggccctggcgcgagtgctcgcgcaccgtcttcatggagtcggagatcccggacttcatcgacaaggccgggtacctgccctggaacggcgacttcgggctcaagacgctgtggtacggcgagttcggcaacaccgggcccggcgcaaacacggcggggcgcgtcaactggccggggttcaagaaggtgatcagcaaggcggacgcgagcaagttcac

SEQ ID NO: 7806 - DNA, 594 bp, Sorghum bicolor
  Clone ID: SORBI-28MAY03-CLUS1440_1
tacaatccgcaaggccggccaacgccaacccccaatcagcaggcaacaacaaaccacccgaccggaccaaggagcagtagcaatgagcggcgccgcggaggaggcgttgctgcgggagtacgtgatcggcgaggagatcgggcgcgggcggttcgggacggtccgccgctgctacgccgcgtccacgggggagccgttcgcgctcaagacgacgcccaaggcggcgctgcgggagctggaggcggacccgctggacctggcgctggcggagcaggagcccaaggtgcacctcctcgcgtcggccgccagccgccacgtggtcgcgctccacgccgccttttaggacgccgacgccgtagatacatagctcgacctctgcccattcgggggagcattcgggcatgtgaacgcacggggccacgaccccgagcccgaggcggcgggcctcgtcgcgcagctcgcggacgcgctggcggggtgccaccgccgcggggtcgcgcaccgcgacgtcaaacccgacaacctcctcttcgacgccagcggcgcgctcaggctcggggacttcggctccgcggactggttcggggacggcag

SEQ ID NO: 7807 - DNA, 917 bp, Sorghum bicolor
  unsure (1)..(917): unsure at all n locations
  Clone ID: SORBI-28MAY03-CLUS14414_1
cccacgcgtccggagctcttcacagaatgatttccccttgaatcaatcactacatagtgcgggctgcttagatgagtcaggttatgctccatgtgcagagaattctgaacaagcaaatcaacagtttgcaacctttgtcaaggtttacaaatctggaaacgtgtgaaggttgctggatatcactagattcagcagctatgatgaacttcgtagtgaggtggggcgtctatttggccttgagggccagttggaagaccctntgagatcaggctggcagcttgtatttgttgacagagaggacatgtccttctagttggcgatgacccgtggcaggaatttgtgaacagcgtgtcctgtataaagatactttcaccggaggaggttcagcagatgggcaagccgggcattcagctcttgagctcggctccttcaagaaggctgagcaatggctgcgacagctatgcgagcatgcaggaatcaagaagcctgagcactgggatggcgccagtgggttcggtcgagttctgaagacagggatgccccatagcccttggctttaggattctccttctgtatgtttctgcagcactagctagttttgcgacttggaacaaagcacatagatcaaacgagctctatgctattccacgtctgatgatgtcctatggtacaggtgccagccatatctggaaaattttgttggtcacctgctgtcgagtatccaactgtggatgcttcgtgctcgtgcccccagctcgccttcttctgccgtgcctgccccctccccgacgtcactattttacgaacgttcagccgaaacgaaaccagcggtcaattcccgacagccatttctttccatttttggaaaatgtatatgttactttttatttttagacagaacaggaatcattctattc

SEQ ID NO: 7808 - DNA, 826 bp, Sorghum bicolor
  Clone ID: SORBI-28MAY03-CLUS14426_1
aatatacaaacgcattgcttggtccatcagaactgattgagatgtgcttgaggagagaccgagagctctcctttaaagcttttgaagtatttgctttgacaagctcatcattccgaagctccaacagaggtcttctagaggcatgctggatgaatgcaactgaccaggatgattgggtaaagctttcagaggcatccacgttagaaggttggagtgacgaactcatcgaagaatctcttcaagcaactgtcctcttcaaagcttccaggttgtgttacagcccggatgctgtggtgtatgatggcacctttgaggatgtgctgcctgtgaagaaagaggatgtccatctgagaggtttggagagcaaatgcttgtcagttgaagaagtgctgatgcagcacaaagattttccagatgctggtaaattgatgatgactgcagtgattttgggcaaggaactaacttttacagccacagaacctgtggagatggactcataaataatagttttagatttctatgatagactgtcaaaacatcgcagtcatttcattgtaattgccgtcgggtagtttcatcatcgtaaaaatcttgtcttggcaacacgggatatgtagttttggttgtttctgctctgcgcagtcacagaaacatgattccgtagcccaagattatcagttcacgccagtttttagcatgagctgagacttctaaacagggtgctttttgttttctggttctggagaggaataccttctgtgttgatcaaattatgtatgtcagcatgaaaagttgttctggagagaaatattttctatatttactt

SEQ ID NO: 7809 - DNA, 872 bp, Sorghum bicolor
  Clone ID: SORBI-28MAY03-CLUS123176_1
gcacgaggcctcttctagcctactagtagctactagtagtgagtcgtaggagtgctagctactaggactgacagactctaccggcgagtgtatgagctttttggtagtgccaagagatcgagcaggaggaggagccgccgggacgacggtagtagtatcagtatgagctgcaacgggtgccgggtgctgcgcaagggctgcagcgaggcctgcgtgctgcgcccctgcctccagtggatcgacgccgccgacgcgcagggccacgccaccgtcttcgtcgccaagttcttcggccgcgcgggcctcctctccttcatctccgccgtcccggacgcgcagcgccctgccttgttccagtcgctgctgtacgaggcggcggggcggaccatcaacccggtgcacggcgcggtggggctgctcggcacggggaactggcacctctgccaggccgccgtcgacaccgtgctgcgcggcggcgccatcggcccgctgccggagctcggcatcaccgggagcgccggcgacctctacgggccccccggcgccgggaccgggcacggcggcggcggcggcaagcgcgccggcggctggtccactttctccacggcgaagcgggtgcggaaggccgctgctactggggcgccgccgccgccgcccgcggcggagccggaggcgtcgtgcgacctacggctgtgcctactcagccccgggtccccgccgccgcctgcgggggacaggagggctcccttcatgcggccgggcacgccgtccatcacctcggacgacgactccgtcaccaccaccaccaccaccaccaccaccggcggcggcggcgacagggagccggtgctgctcaacctttttgcctgatc

SEQ ID NO: 7810 - DNA, 1043 bp, Sorghum bicolor
  Clone ID: SORBI-28MAY03-CLUS123333_1
gcacgaggctggattgtaactgagaaacagttgtttgggaaaagcggtacagattatgattttcattcttgtgaaccacataaagcccgcgaggaacttgaaaatcttcaagctcaacaatccagtcttgagaagagggtcaataagaaagttatggcaatgtttgagaaggcagaggatgagtacaatgatttgatgtcaaagaaaaacatcatcgagaatgacaaggcaaaaatcaagaacgtgatagaggagttggatgagaagaagaaggaaaccttgaaagtcacatggctcaaagtaaacaaggatttcggatctatattcagtactcttttacctggtacaatggcaaaacttgatcctccagaaggtggcactttcttggatggtcttgaagttcgtgtggcatttgggacagtttggaagcagtctctatctgaacttagtggagggcaacggtcccttcttgctcttagtcttatcctggctttgcttctttttaaacctgcaccactttacatattggatgaggttgatgctgctcttgatctgagccacacccaaaacattggtagaatgatcaaggctcatttcccgcactctcagttcatagttgtctctttaaaagagggtatgttcaacaatgccaatgtgatattccgaacaaaatttgttgatggtgtgtccactgtgacacgtacagtgccttcaaaacagagatgatcagtttacacagaatgcacattcttaaggagaactattccacgaaagctgaaccctacaattacttgatgttgtggccgcttgatgcctcaagcccctcgcttgtctggcaatggcatcaaaataggtgctgtaactgtaacctcatgccgtgacgtccatggtgaccttgactgccttctatgttatgcgctttcatctgacccaatgtgtaattagcggttgaactattttgtgttgaagatcgaccttgtaatgtcatgtaacaggcatttattatcagggtcagggatacttctgacttgctaacttacctg

SEQ ID NO: 7811 - DNA, 798 bp, Sorghum bicolor
  Clone ID: SORBI-28MAY03-CLUS123367_1
gcacgaggctcctgtatagttgctgccgatcgatttgcctttctgtgtgtcatcacgtcggtcgggctcaaaataagcatcctcctcctcatctcgtcgatctgattattattatacattgctcgtgccattttcttgtgtctctgtgcgtgcgtgtgtttatttgtccatgcatatcgatccatctctatacatctccaacgacgccaaccgtaccgccggctagtcgtcgtcgtcgtgcgtgggatcgatccgatcctcgccgccggccgctgctcacgagtcacgaccaaggatggacacctcctccggcgacctcaccaacggcggcggcgccacctccagcgcccagacgacaacgaagcctctgaccatgttctacaacggcggcgtcgccgtgttccatctcccacaagataaggcggaggttgtcatgaacatggcggcgggtgaggacggcggcggcggcggccgccacctgcagccaaaccacggcgacgagttgctcgccaagttgagacaagggatgcccgcggcaagcaagatatctctgcagcgtttcttccagaagcgcaaggagaggttgtatgggccttgatcatcatcggctcacagtggagaaccaactcatgataaagataaggaagagcccattttgtttcgttgcacttagaaatgtatatgaagagttgaagacctacttagtaatgtacatatggattccgtcttgttgatcttgtattagtacatgcatgttattattatatactgtctacaacttttgttgtttaaaaatgt

SEQ ID NO: 7812 - DNA, 584 bp, Sorghum bicolor
  unsure (1)..(584): unsure at all n locations
  Clone ID: SORBI-28MAY03-CLUS12378_1
gcacgaggtcaaatccgaaagaagttccggacgcgtgggtgaacccacttgaactggagttccgaagaggagaggaggtcacaaagggtacatatctggcaaaatggtatggctcgaaagtgtttgttaagatacttgacaaagacagcttctcggatgctgatagcataaatgcgttcaaacacgagcttaccttacttgagaaagcacgacatcccaatttggtccaatttgttggagctgtcacacaaaatgtcccgatgatgattgtttcagagtaccatcaaaagggtgatttagccagttatcttgagatgaaaggtcgcttgaagcctcacaaagctataagatttgctcttgaaattgcgaggggactgaattatctccatgagtgcaagcctgacccaatcattcacggacatttgtcaccaaagttgcagcatcatccttcgggccgtcgttggactccttcaggtggctgggtttggatcactgagtttgactaaagtttctgaagacaaagtacaaatggttcagccagttacaaaactagacaatgtatacatcgctcctgaggtctacna

SEQ ID NO: 7813 - DNA, 900 bp, Sorghum bicolor
  Clone ID: SORBI-28MAY03-CLUS12416_1
ctgtgcggcgctcgaggcggccggttccggaagtgagcccgggtggcatcacaggcaccgttccatgccacaggcaaaatacccacaagaacctctcaatcaagaagaacatggcacagtcggcgaagctgctgcttctcctccctgccctccttctgctcctccttgtccaagcgcaaggtgcacggccggcggcggcggcggcgtcgaacgcgacgaagctcaggcccagcagcaagtgcttggcgtcgagcgtgacggtgtcgcagtccaacacgggcgacaaggccgggtacgacccggtgttcgaggtgacggtgcgcaacacctgccgctgcgccgtccgcggcgtctacctccgctccgagggcttcgccagctccgtcgccgtcgacccgcgcctgttccgccgggacgggcgcgactacctcgtcggtgacgggcgccggatcgaggccgccgccgaggtgcgcttccgctacgcctgggaccgtgctttccggatgaccaccgccaccgtgcacgacgactgctcctgaccgtacctgagtcgtcgccgtcgtcctgaatcgatccatggccgccgtcggcgaagataatcgagctggtcaatttggctgccttaccttacctgcgcggcgcagacgagacgagccttcaccgggtgaagtgcagtagctctcctgtaacgagagcaggttttccagtccttgatgaaacggacttgttgtcgtgctggacagggaacttagtacttttatatacacttgtgtttagtgcttagtttgctgaatcatatagtactataatactattccctgtccgaacaaaaatgtaatcttagtatcgtaaactaagtcaatgctagtttatgatatatattaaataaatgcctcgtgc

SEQ ID NO: 7814 - DNA, 945 bp, Sorghum bicolor
  Clone ID: SORBI-28MAY03-CLUS12437_1
ggttcctgatggaactggaggaacactggcaaccgtgactgaattcatggtgaatggctcactgaggaatgttcttttaaggaaagacagaatgcttgatcgtcggagaaaacttaccattgctatggatgcggcgtttgggatggaatacttgcactccaaaagcatagtgcattttgatttgaaatgcgacaatttacttgttaatttgagagatccctcagaggccaatttgcaaggttggagactttgggttgtcaagaatcaagcgcaacactttggtttctggtggtgttcgcggcactcttccatggatggcaccagagctactgaatggtagcagcagcaaagtctctgagaaggtggatgtattctcttttgggatagttttgtgggagatcttgactggtgaggaaccgtatgcaaatatgcattgtggcgctatcataggcggtattgtcagtaacactctccggcctccaatccctgaaaagtgtgaccctgattggcgaaagctgatggagcaatgttggtcggccaaccctgatgctcgcccctcattcaccgaggtcactgacaggttacgagccatgccaccagtgcttcagtcaagaggacaggctccagcgaacagataaaagtgttataacatcagccagcagattatttaactgcagtgggctggatgaacaatcagattctgcactgacccgcgaggctcttatgtgtgcatagagtatatatatatacatgtacttactattggtcatggtgtgtatttctatccctgacgtaaataaatgctttttgaccccatgttgagggtttctgatgtaattacatgtttctgagtgaaaaaagtagcgcaggcgggttgtggtggcctctcgttaacaatttggtgtgtataggttgtgagggtctaccaaaaaaaaaaaaaaaaaa

SEQ ID NO: 7815 - DNA, 589 bp, Sorghum bicolor
  Clone ID: SORBI-28MAY03-CLUS14055_1
gaccacggcaaccgtaccacaccgtgtgccttgatctgccggcctctccattccgactctttgttcgttctgtgcaagaggagggaggagaaaggcagagagaggcctccatatccagataattaacacatacaagctattccagccggttctgatccattgcggttacacacatatatacgcgacataatatatatatatatatcagtcgtcactctcgctctgtcgtcgcggcggccgttccacaagaaacacaccaactccctcgcgcaagaaccaactcgatcccgaaggaagacgaagaagaaggcgatcccatccaccaagcggcggcggcaagcaagatggttaaccttgacgaagtccgcaatgtcgtcggcatcatcggcaacttcatctcgttcggtctgttccttgcgccactgccgacgttcctgacgatcatcaagaagcgcgacgtggaggagttcgtgccggacccctacctcgcgacgttcctcaactgcgcgctgtgggtgttctacgggctccccgtggtgcacccggacagcatcctggtggcaaccatcaacggggacgggcctcgcca

SEQ ID NO: 7816 - DNA, 787 bp, Sorghum bicolor
  Clone ID: SORBI-28MAY03-CLUS1409_1
gtccgatcgcctcgtgcctctcaattccgtctccttctgcagcgattctcgcaggtgcgcagccatgatgatggcgtgtggcctcgccgtcgcccagcctgcggcgtctctcgcgccatccggcaagaggagcctctccggcggccgtcccccatggctgccatctcccagacttttttcagacaagctaataaggagccgcagtgtcgttgccaaggctgcgcaggacagttcagaatcatccgggagcatagtgaaatacgtcaccagttctttcagcactgcggaagacatttttggtctagctggtataggctttgccgcaatagctgcattatgggcttcagtcaacctcattgagatcatcgataagctcccggttcttcctcttctatttgaactggttgggatattagttgcatggcttttcatctacaacaatctcctcttcaagccaaagagggaagaatttctgaagaacatcaaaaactcagtatctcaaatcctggggcagtaacctttgcaggcgacagtagacagcaagcattctgtcatgggttctctgcaaacataccgaatgcaattatgcaatataactgtctgcaagctatgagtgttaccatttttgactctatataagcactaccaattttctgtacaggttagtgtgattaaagccgttttcccagtaccaaaacttggactgcgacctcttgctgtacgagtctaatgaaaacagacacccggattcttcctgtatggaatgcttcggctattcaatttcacg

SEQ ID NO: 7817 - DNA, 800 bp, Sorghum bicolor
  Clone ID: SORBI-28MAY03-CLUS14091_1
cggacgcgtgggcacacactcacctggtgtagccgcaagaaagagattggatactgttactggtgctactactagctctcagaaggcaatgggggcatctgcaaccaggaaggagaaacataaggacccatcgatgcaaattaagggaacaaagtgcataaacaccaccctatccacagaagagcacttgcacaaggagctcactgatccagttgatttgaaatccatggagatgaccgtacctgatcagcatgagccatcttccaatcaaccagaacaagtattcaaagatgatgaggaatccaagaggcatttctctgaagggaaagtagatgccggaactaatgggatccataatggagggcaagatatcaatggtggcgtcaagactatatatgaatgtgggattgttgagaaggaggaggctgatctctcaaaaaagaaggaggaggctgaccgaagtgcagataaggtagtgccgaggactgaagtggctcaagtgtggaggaaggatgatccaaggggcaacgacgtgattgaggaaaccaaaagcaaacttctggaggagaggaagagccgggtgaaggccttggtgggggccttcgaaactgtattgtcattcaaggaatagtgctcaaccttgtctttggatctattgtgtccatctctatattgagtacatcctgtcatgaatatatatgtgatcatgaggaagctgagtgtttataaaaaaaaaaaaaaaaaaaaaaaaaaggacggccgctcgcgatctagaactagtctcgtcctccccgtcggag

SEQ ID NO: 7818 - DNA, 1104 bp, Sorghum bicolor
  Clone ID: SORBI-28MAY03-CLUS14092_1
tcggccacggtgactcgtccccctaagctcccgacattcgctgcctgcctcccatcgcgggtctctttcgcccggtgctgtggcccgatggtcctactcatcaccttcggaggcttgtgaggccccgaggcggggcaaaggcgctgctcgacctgccctcgtgccttccctccagtgttcaccggggccgctgaccccctgtgctctgtgccgtggtaaattggggtgctgtgctggctgtgttcggctggtcctggttgtcacatctcacctctctgtccgcttcgtcgactgctggccctcccctgtcgatggctcctgagggacgtcgaaatgtccccgcgtctgcgaagtgtggcggccccaggcctggcgcaatcctgtggcatctagcctcctgccgtcttccgtcgtgggggttgtgccccttgctacttgtgggtacgcttgggttccacaatagacgactagacattcccaaggatgtcgatcctcaggtggctagcataatatcttcatgctgggataacgatccgagcaaaaggccagcgttctcccagctcttgtctcctctaaagcaactacaacgtttagttgttacagaaagctgctgacatacgtttcctgagacaaatctcaggacacatatattcaggtatttaagctctgtcacagggctaaattttcattttgatgctcgtggaggtatattcagaatctctgcggtatagatgtgttgggcgaaggttctacacatcaccttgtgaaaaatgtgagtctctgaagctgtgcaaaggcgctgctggagaaagcttagtgtgtagtctcaagtgaagaaaagtggcgctgacacgaagtgctctgtgccatggtaaataattgttcagttctggatttgaacgggtgattctgaaaatcagaattcaccacaaagataggatcttgaagttttttcccttaccttacaaaagatgaaaagagaagtcaaaatttcatcgtgtctgcaaaaagttgcagcccgatgccatgtgcaaatgtatatcatgtatactgatgctatcttgcgtctttgtgaatgtgcattttaatacttttggttccctt

SEQ ID NO: 7819 - DNA, 748 bp, Sorghum bicolor
  Clone ID: SORBI-28MAY03-CLUS12697_1
gcacgagggctagatggatggcactgacgggactgtcaggcagcggctctcctttcggtcctcccagatccaggcggacagagtcggggaggcagcggaagcgggagcggaattgggcggtcggatcctgaggggcagcaactgagtctcgagtggactgtgctggatggagagaatcgtggtggggaggagcgggcggagcaaatcgggggcgacatccgaggagagagcgaagaggggaagcggcctgctgccctctgccttcctgtcaaggtttgggcgccccgcctcggcgaggccaaggagaagagagggccggggacggcggtttggcttggcgccgccggcggggcgggcgtgtgggtggaagtgaagcagaagcaacggcggcccacagtggagctcgggaggtcaagactcgagagagagctcgccttcgcttcccttccgttccctaggcaaggcaagggcgcagcgcaaggcaaggctgcaagttgcatttgttccgtgatgagtgaagccgatgatgcgatgcgttgacaggcagaggcagcggcaggacacacatgacattttttttaattccttcatcttgctcgtttgaagcctccaaaaccaaacacccaaatacaacgttgccgctgccataggccagagcaagacgagtttatgcatgcatgcatactcgatttgtccttttcttttatcatcaatccaggagaatactatatggcttcaatttttcttt

SEQ ID NO: 7820 - DNA, 1086 bp, Sorghum bicolor
  Clone ID: SORBI-28MAY03-CLUS14107_1
gcacgaggagtgaaaatcctcactagctacttggatgtactgagggcaaatcatgttccatcaattctggtgcataaacttttcactcaaatattctcactgattgatgttcaactatttaaccgattacttttgcgtcgcgagtgctgttcttttagtaatggggaatatgtgagagctggactagctgaactaaaacattggtccgacaatgctacaagagagtttgcaggttcagcgtgggaggcattgaagcatattagacaagctgtcgatttcctggtgatttctcttaagccaatgagaacattaagagagatacgcactgatgtgtgccctgccctcagcatacaacagctagagcgaatagttagtatgtactgggatgatgtgaatggtacaaacactatttcagcagagtttacatcaagcttgaaatctgcggtacgtgaggaatcaaatatggccacaagtttttctatactgctagatgatgattccagtatacctttttcacttgatgatattacaaagacattgccagtcattgaggtggctgatgatgactttctgccatttgtccatgaaaacccaagctttgcgtttttattgcaaagaggggagtagtcaattttttctcacccacctgtggataagtcaggattcctgcctaggatgtacagtacgcgtgattctttctgtaccaggtagcaaggcattaaagattagatgctaggtgagctttataggcttctgggttttattgatttgtttattgattgtatatttgtattcaggttttccttgccatttttctctctctttgtagtcattttttgggcttgtatactaggggctaagggcagaaggcccttccctgtaagcatagtagcacaaggttttgctgtaggtagggaaagctgtacatgtgttgtaaaggattataaaagggggggaaagtagcgttatcctgctggtgtgtagtgatggctttgtggttcgtgtgttgcttacctttgatcatgtattattagttcgtcatatattatttattgaattagtgtactgcaaaaaaaaaaaaaaaaa

SEQ ID NO: 7821 - DNA, 1061 bp, Sorghum bicolor
  unsure (1)..(1061): unsure at all n locations
  Clone ID: SORBI-28MAY03-CLUS14119_1
gttttaagccacatactcccatagagatctttagcctttaccattactgagaactagttttctaggatagctgagaagagatccaactttatcatgaagctacatgaagtgacaagaagaaatattgtgatgaaatcagcacaatatgcaaagctagcgttcttaggtttgtagaagagttacatttcagcccggtgacctcgtgtggttgcatctacgcaaggatcgatttccccaacaacgtaagagtaagttatcacctagaggtgatggtccattcaaggttctaaaaaagataaatgataatgcatacaaaattgagctgccacctgaatattccaatgttagtccaacattcaatgtcaaagacttgcttccatttgttggtgagcctgagtcgaggacgactccttctcaagagggggaggctgatgaggacatccctagcattcattcatcttcaaatgaaactccacttgatataagtggtccaattacaagaagtagagctaaacaattggagaaggaaattcattctcaggtgaacgctaaccttatgtttaataatcagtttatgttgaatgatcctatacttttgagttcttgtttcaatgtccttaggaatgatggagggtatgaaccagcatgggatgaagatggattcaagcctttggacatctgaaccaagaagcctatcgtgtgcataaataaaatggtggttcattacttctgcatgagaaggcaaccagaagctagatggctgacccatggtacaaattccaagcatcaccacggacagaatacaaggagttacgtggcattctacagatggatgaaagcatctttaagtctatgttgcagcccatcaaacggttcattatttagacttcccaataaagagttatgctcattttagtaactgctgccagaagctgagaagacgcgcgaaccagccacgaaatccactagtggatgtgcatgctgtcatgtattcaaagctgaacgcccctatctatatatatctcttatactagacaatgaaaggacacatnctggctggt

SEQ ID NO: 7822 - DNA, 721 bp, Sorghum bicolor
  Clone ID: SORBI-28MAY03-CLUS14207_1
aacaattattggatgatgatgacgacatggctgatctttacttgtctagaaagttggctggggcatcttcccctgtcagtggttctggtggaccaaattggttccctgcatccccaactattggttcaaaaatatcaagagcaagcagagctagtgcagctactgtgcatggaaatgagaatgacgttgaagagctagagatgttgctagaggcatatttcatgcaaattgatggcacattaaacaaattgacaacgctgagagagtacatcgatgacacagaagattacattaatatccagcttgataaccaccgtaatcagttgattcagctagagttattcttgagttctggtaccgtctgcctgtcgctgtactcattagttgctggagtctttggtatgaatattccgtatacctggaatgacggccatggatacatcttcaaatgggtggttattgtatcagggcttgtttgtgcctttatgtttatctccattgttgcgtatgcgagacacaagggtctcgtcggatcctgaatagctgaaataaccgcgacttgcttccctcaactgtaaatttgagccagtgagcatcgactttgcggggtgattcatctcttgtaccaaattcggtagtatcaaattggagatgttgaataggaactataacaggaaaaagttaatgcaaaaaggaaatatattatgattgccccctgttc

SEQ ID NO: 7823 - DNA, 959 bp, Sorghum bicolor
  Clone ID: SORBI-28MAY03-CLUS14101_1
gcacgaggctcgcgagccgcgactccccatccccatcgtctcgtcgtttcccccgagcgcccagatcccatccctacccgctccgcgcgacgcgaatcacaagcccgcaactcttgggactgcgcgaggcgccccccacccctgcctgcctgacctcggatcaaagcctcctccgtccgccttaatcgcggcaggtcgttcgggcccgggccgtcacgcgggaggggttcatcacccgggagagctcggggctcggctcccttcttctcgggacccccgcgcgcgcaccggctgggtcacctcgacgcggcggccacgcgagtcctggttgcgtgggtcactggatcctgaggcaagaaaaagaaggcttcagtagtcaggtctgggtcaagccatgatggagaggtcgctgctggaggtgctggccacggctgcgcaaggagggaccgaggggacgtcggtgctgagcatgctcaagtatgccgtgcttccatcgccaaggtgttcactgtctgcttcatggggttcctcatggcctccaagtacgtcaacattctccagcccaacggccgcaagcttctcaatgggcttgtgttttcccttctgcttccatgccttatattttcccaattgggtagagcaatcactatcgagaagatgatacaatggtggtatattcctgcaaatattgttgtaggtgcagtatccggctctttgattggatttgttgtggcatctatcatccgacctccatatccatactttaagttcactattatccatataggaataggaaatattggaaatatacctctggtcctcattgcagcgttatgtcgggatccttctaacccatttggtgactctgataaatgcaatcaagatgggaatgcgtatatctcatttggccaatgggttggtgcaattattgtttacacatatgtattcaagatgcttgc

SEQ ID NO: 7824 - DNA, 657 bp, Sorghum bicolor
  Clone ID: SORBI-28MAY03-CLUS14216_1
ccagcgtctgcgcgcatgtggccgttcccctggccgcgcggtccttcctggcaggtggcgtgttccacgcccgcctccgggccctgcgctccctccgggcttctcgacctcgagagatactggtgaacgatgaaggaaattgtgaggagataagcattgcagcacaaccatcccaaagccaattttcagccttctgattgacaaatgttgtggaactaaccttcagcataggagcaagaaaaaatgactgggaagagaggttttttggatgcaactagcagacatctgggagaaacagaagagagctgggaaatgaaggaagctttagaacaaggaatgtttctgaaacttttttgttttggaaaacactttctgaaaatgtgtggtgtacaagaaaattccagggaggtgaaattgctttgctcactgcagcgggaaagggaaagagaaacactagaatctggtgtccagtactatgtgttcttttggttctgtctagtctaaattcttgtaacacgctcttcctatgatggaataatcaattcagcaattccaccgatgattactggttagatcagtcactatgctcaagacggctctgccgcggtctcgtcagttgtctgccgctgtttatccactatctatgactatattggt

SEQ ID NO: 7825 - DNA, 627 bp, Sorghum bicolor
  Clone ID: SORBI-28MAY03-CLUS138_1
cgtccggttttcaccatcactgcattgtgtgcgcatcagcgttgagcaggtgcagctagcaaggcggcgaggatgctggagagccaggcggtgatcggggacacggacatgcggcaggcgatgcagcagtacgcgctccggctcgccgggaaggcgctggacgacttcgaggccgccgactccacggagatcgcacggttcatcaagaaggagttcgatcggtcgtacggccccggatggcagtgcatcgtgggcaccgacttcgggtcgttcgtgacgcaccactccggctgcttcatctacttcggcatcggcaacctggccatcctgctgttcaagggcggcgcggctcctcgcggtgagaccgtcgtcgagaaggcgcggctcacggcgctgaaaactgccgtcgaggcgtgagtggatgagtaatcaccgatgtgtgcaggcctgcaggcagggtagataagttctcctagcatgtaaggtcgtgcttttggtggatggaagttgcctgacttgaaaagtgcaggtcttcatcacatagtaaaaaccgatgttctcaacagcatgtctgctgggtgctggatagacagtgatggcaaatagtagaatattgcatatctttcg

SEQ ID NO: 7826 - DNA, 1123 bp, Sorghum bicolor
  Clone ID: SORBI-28MAY03-CLUS13758_1
atctccccatcgaaacgcttgtggcgatcggcaagctcgcggcgcgtggcagcgggagcgtatacgaggtagaggagagcgagggcgacgcgcggatcgcatcgcagctttgggcggggggaccttgccgcggagatgctggcggtgttcgatcggtcggtggcgtcgagcccggaggggctgcggcagccgggcgccgcgggtggcgacagcgcggcgtgcctcgctgatcggttcagagaggcgcgccccgacgcggtcaccgtcaaccttggcgggtccggcgccatggcctactcctccagcaaacagagccccctcctccccaggttatttggggcggtggataacatattctgcatgttccaaggcacaattgcgaactttgcggtcctcaagcagcaatatggattaagtaaaggtactaatgaggtcaacatcatcattgaggcttacaggaccttgagggacaggggtccttatcctgcagatcaagttgtgagagacattagtggaaaatttgcatttgttctgtacgattgcacgactaagtcggtcttcatggctactgatcccgatggaaacgttccattctactggggcgctgataccgatggccgtcttgtggtctctgacgacatcgatctcgtgaagaaggcctgtggaaaatcctctgccccgtttcccaaaggcttcttcttcacgacgtccggggggctgaagagctacgagcacccgatgaacgaggttaagccggtgccgtgggtggacagcaagggcgaggtgtgcggcacgacgtacacggtcgatgcaagcgccaagaaggagaccaagaccagcattccaagggtcggcagcgccgccgattggtcttcacaatactaacaatctgtttatgttggatcggagcaaaggtagcaggcgtggctatgttcatacggaagccagtcctagtgtttatctgaatagactgttctctataaatcaacacacggagtactggtttggcctttctagagttgtgtatatttaacagagtttattaaaaagatgtatatattttatgacatcaaatatatgtattatgagaatatattttacagtaaaaaaaaaaaaaaaaaaa

SEQ ID NO: 7827 - DNA, 956 bp, Sorghum bicolor
  Clone ID: SORBI-28MAY03-CLUS13837_1
gcacgaggctggagcatcaaaccgagtttgcaatgctcttgcacttctgcagtgtgttgcatcgcaccctgagaccaggatccttttcttaaatgctcatattccactgtacctgtacccattcctcaacactaccagcaaaacgagaccttttgagtacctaaggcttactagcttgggggtcatcggtgctcttgtcaaggttgatgatactgaagtcatcagttttttgctgcaaactgaaataattcctctgtgcttgcgaaccatggagatgggtagtgagctatccaaaactgtgtcaactttcattgtccaaaagattcttctagatgatgttgggctgcgctacatttgtgccactgctgagcgcttctttgctgtaggcagtgttttagcaaacatggttgtttcacttgctgatcaaccctccacaaggctgctgaagcacatcattcgctgttacctcaggctgtcagataaccctagggcctgtgctgcattgcagagctgccttccagacatgctcaaagatgggacattcaataactgtcttagggatgatccagcgacaaggcgctggctccaacagctcctgcacaatgtgacaggcggaggcatgggaggaggtcctcaaccaggcatggatcccatgaacatgggaatatgatatgcggtctagacgttgcaattcacgtcaataacacagcacctctcagtgaattgcaactagagaagatctggccactgtccagaagaaacttagtatggtctgactttctgccggggtaaaaataggaatgttgtgtggtattgtcataagcagttaaagctgatgtgcgcctgtcatgtaatgctgtagaaacaagctcagcaagctgctgcttttgtgttcttgcaccggagctcttgtgcgttgacccttctaaacctgagaacaaaggaggaagaacctg

SEQ ID NO: 7828 - DNA, 707 bp, Sorghum bicolor
  Clone ID: SORBI-28MAY03-CLUS13845_1
gcacgaggctcgtgccgacgcccatgtactcgtccgggtcgtcccactcggatcccgagagcatcgccgagtccagcccgcacccggcgccgcccatgaagaagaaaaagaaggttaagaagccggcgccccccgcgcctgctgcctcttccgacgacaatgacggcgacgcagactacgaggaaggcggcgagcgcgcggagccgcagggcggcgccgtcaggaggtgcacgcattgccagatcgagaagacgccgcagtggcgcgcgggcccgctgggacccaagacgctctgcaacgcctgcggcgtgcgctacaagtccggccgcctgttcccggagtaccgccccgcggcgagccccaccttcgtgccgtccatccactccaactcgcacaagaaggtggtggagatgcgccagaaggctgtccggagcggcgacccgtcgtgcgacctcctgcagttcatccgccgccgggattgacgtcccggcacgacgtcgccggactgtcggtcggtcggtccgtcggtcgttctcgtccccccgtagagctatatatgtatacatattagtatgtatgcatgcatggttgcttcatcagtcgtcgtcgtcgtcgtccatcatggtcatcatcaccacttcaccggtcaccgctatggatcccacccaacccatcatcacatgcattggtttcagtcagcatccatc

SEQ ID NO: 7829 - DNA, 991 bp, Sorghum bicolor
  Clone ID: SORBI-28MAY03-CLUS13882_1
gcacgagggggcggcggagagcgcgtccaccaacaagggcatccatggctcctccctgctcgagctcggcggcggtggcgaccaccagcagtctcacgcggggttctacgacgacgatgaagacgacggcgacgacgcgatgggaaggaggctcaagaaggcgcgcggggacgagccgccggcgccggcgttccaccacgtgcacgacatggccgcgctgcacgcgcaggccgcggcggccgcgaggcagcagcacgaggaggtcagccaccgggagctgctcatgaagttcatggagagcggcggcggcggtggcgccggagcgagggaccaccaccaccatcacgacggcggcgggtactcgctgttcgcgccggggccgtacgggcagttcgccgcggagcccgccgcgttcgcgttcgccgggaacggcggggtgtcgctgacgctcggcctcccgcacggcgcggccggaggcagcgccgccgaacagaccgcgtcgttcctcatgggcaccaccacggccggcaccgacagcggcagccacggcgccggcgctggcggctacgacatgaacatgcagagcaccaagtcgttcgcggcgcagctcatgagggacttcgtggcctagctcgtaggacacgtagcatagcagtcgcccgtccacgcaaattaatcaatctctccatcgattaattaatttagagcttggatagaaataaagggttgttcaagcctaaatatgctttgcatgtataaagcagttaagcttgggctataggttttgggaatgtaaagatgggatatatatcatgggggcgatgcatataggtataggatgataggtaactagtagatacccaaacattgtacaagattttatatgtagatcatagggattggggggtatacagtaaaatatgtgaaagggtatattggaactggacttggaagtaatctgcagtaattcagtatttgttttgcttactgt

SEQ ID NO: 7830 - DNA, 635 bp, Sorghum bicolor
  Clone ID: SORBI-28MAY03-CLUS13906_1
aattttcaaaacgagtccgccacccatataaatatagcctggcctcgccacctcgtccctcaccacaccacaacaaaaccaccgagacaccgagcgtcaaactcgccacccagccagccagcaaaccaccagccgagagagctagctagcaggcaccgtccgtacccatggctcgcgctaccgtcgtcttcgccatcgccgctctcctcttcgtcgccatggccgtggcgccgctggccgctgaggcgaaggagtccgccgacgcccccaccgccgatgcgccggccgatgccagcgggccggtgggtgcccctggcccccagggcgtcgacggcctgtcaggcaacgaggacgacgacgacgactccaccaactgaggccgaccggccgagcacgtcgtctgatatatcgtcggttctgaaaacgaatggcccggttgaatttggaacaggacatggaagaaaaagtgagagcaatgtcatttaatttgaagccatatgtaataatgtgtggtcgtccgtggatatatatgttctttgctctccctcttttttctttctgtttgattttcgatgcgttatatcttgttcttagctcctaattgtaacaactcttgatatcaaggactccaaatt

SEQ ID NO: 7831 - DNA, 678 bp, Sorghum bicolor
  Clone ID: SORBI-28MAY03-CLUS13988_1
tgttcagcactatattccctgtcagctttgttagaccttatgccaattattattcattgcggttaattttaaaaatttacactcatgtgagcagtcaacattatctctgtaaatatattatattttgtctctggattaggattcggacagtcatagtatctgagaacattacctcgctcgaggtgtttgcctcctgccgaggtctcgtgggagcaggtggctgtcatcactcagtacacggcgctcggtcagctagctacggcttgctctgcgctcggggagattaagaatatataattccttggctaatgtggatagggaagtaccaacaacaaccacattcttgcagccttggctgcgattctgggcgaatgaagaaaggagaggggttcagtcaagagatagtattttggtcgtttctcgtggctcctctttcttgcttgtgcagtatttgcacattcttaccactgccaccagattgcttgtgcatgaacttgtctggtgcaggaagtttgtgctagctgttggacttgttattttgctagatcatttttattcatgttttgttgtgattttgtatagagacatgggctgcaacatgtagtttcatgcaagaacagtggaattgatgaacttggtgttttatatatttgtgtacaagcaaaaacaccgaaaaga

SEQ ID NO: 7832 - DNA, 688 bp, Sorghum bicolor
  Clone ID: SORBI-28MAY03-CLUS13980_1
gtttctctccttctcggcttggcttggcttcctcttcctcttcccctccacgcgatcgaaaccgaagcccgaatcaatcctttctccaccaccgttccagccctctccaggcgccccgcgtcgcggagccgcctcgatccgcctccggtctcctctcctcctggtcgccttcccccctttccccgcgcgtgtgcgttggccggctgggttcccgatgagggggttgctggcggtggaggccgcaggcgcggcggcctcggcctcggtgctcaacggcgctgtggactggtggcgtgacgtcaacgagtcgccgctgtggcaggaccgcatcttccacgcgctcgccgtgctctacggcttcgtgtccgtcgtcgcgctgatccaattgatcagaatcgagtgcagggtgccagagtatgggtggacaacgcagaaggtgttccatttcctaaacttcctcgtgaatggagtgaggtccgtcgtgttcgtgctgcgtcgaaatgtgcagctcgtggagcctgagataatacaacatgtgcttctcgatatgcccgggcttgcgttcttcacgacatatgcacttttagtgctcttctgggcagagatttattatcaggcacgtgcaatgtcgactgatgggcttagaccagctttctattggatcaataccgtggtctatgcaattcag

SEQ ID NO: 7833 - DNA, 535 bp, Sorghum bicolor
  Clone ID: SORBI-28MAY03-CLUS13999_1
ctccttcaagctgtggcacgcgcatctgaattactgcaaagccagtgggagcaacactgagagcatcgtggagaatgcgaggcagcgtggcattgagctgaatccgacaccaacatagtgtttgtccctttgatccaaaagctgcctggtgtttttgccaggtggagatgtaggtagtgttgtgttaaactggagatggcgtagatatatcggtgatcatggtatggtggtgactggtgactggtgagatcattttgttctttaggtgcaggtttagtgggacatagtcgtcgatagcttacagcttggtgtttatggagtgatgtggtaagtagtaagtagtggtgaaggatacaggcatatgggggcatataccatacttttggactagacgggctagagaatgtttttttgactctgttatgtttacgtttaccgttctcttggttctctgtcgtcgatgtattagctgcataactgctacttataaacatgatgatcaatggagaaatgaaatgggattattttggggttc

SEQ ID NO: 7834 - DNA, 811 bp, Sorghum bicolor
  Clone ID: SORBI-28MAY03-CLUS14008_1
gcgcgcggatcctctcccccgcggccccgcgccctcgcctgcgtcccgcgccgccgcggcggcgcacgccccggccccgccgccgccgcctccgctccccccgccgtcggccgccgctccccgcgctcgcccgcctccgccccccccgccccgccctacacacctgccgctcccctccagccatggctgtttccgctggggacgcgagccacccatctggaccgggggagcgctccttcgctgcgtgtgacggcgatcgcgacgctccgaagcgatagctgtccgccagttcgagtcagccaggccgacgcgtgcgccgagaccgattgctcgctccgaatggagcatccctccctcgcgcgtgctttctcacgaacccacaagaaccaggcgccttccgatcgctgactcaggcgtccgcgaggagtaagcagctacgtatttccagatgctacttgtgcatgtgagaatcgcgggtggcttctcatgatcagacacaaaccatgccacttccaagagcagagtgcgttccttgttcacccaagctctggcaaacagcttaacctgccagtattcccctgtcgcgaacaagggtaccaagggttctttgttttctatgttggttctcacggaatacctctagtcgttgcacgtttcgagatctggagcattgttccgactgtgcacattgcctgccctggagacacgtactggagtgcctacaagcatggtgttgaacctcccatgtcaagaagaatgcgcagattacttgagcgcaattggatcgccgatttaactttgatcggggcac

SEQ ID NO: 7835 - DNA, 721 bp, Sorghum bicolor
  Clone ID: SORBI-28MAY03-CLUS14292_1
ctagctcctgccatcatcactctcccttccatcgatcgatcgcctttcgctgttcgttcccacattttcttgattattactatcgtttatttctccgggtgggggtcgatcatgagcaaccaaccaaccatggcggcgacggcgcccgtgcgcgcgtgggtggtggtgctggtgttggtgctggcgtgcgcgctgctccagccgcggccgtccgacgccgcggcgcccgccccgcagcaggcggcgccggcggcggtgtcgtcgggcgcggccaagcccaagtgcgtggccggcgccaagaacgacaaggcgtgccgcgtcggcgcgataaacaacccggagaaccaggaggaggaagggtccagcgtgacgctcaaggcgcccgccgccgcgcccgacagcgacgacgacgacggcagcgactacaacgaccccgacgtgcccaacgacgaccagctcatcgtcgtcggacactgaaagctgccccgcgcccgccgccgaccccatgcatggattatgtatgtcatgcatgaagattgatggaaggggatggaccgcccggttaacggatcgatcgatctctctcggtgtcaattcgtgatcttgaccggtcgaaacagatgggacttgcatgtttgtttcattcttgcattgattgttccttgttaactacagtagtagggtgtatggtaaaatcggttaacgcttattaatcacaaag

SEQ ID NO: 7836 - DNA, 693 bp, Sorghum bicolor
  Clone ID: SORBI-28MAY03-CLUS13535_2
gcatgaaagaggaaaagagatggaatcgccaagtacatgaaaactgcagcagtggttgccctagcattgagctggtcagatatgaagccggccagaactccccgcagattgccatctacctggcacgctttgcatgtggactgactgcactacctgcttcgaaggctgtgctactacagccggcgagtgtggtggttgcttgggaggtgctggggaagccgggctaccgctgctcctcatcatgggggttattgtgctcgggcttttcactgtcatcggcatattctacagtgtcctggtcgcgacaatggtcggccagcggatctggcagcgacattatcacattcttgccaaacgaatgctaactaaggagtatgtcgtagaggacgttgatggcgagcgcacagactggtgtcccccgccactacctgcggagcacatcagccagctgaagtccctggggcttctataagctcacgccatcacgtcgatggcaggtgatgaccataagctaggaaccggcgtggcgttacccagctgtacaggaggcgattcaaagcaggaagtcaggcattctgcgttgaaatgtggcaatattgatatctttttttttctctctctttgtacattgtaacggcaaagatttcttcctgacaaaacccaaaaattttataccaagtgaaatcgtacttt

SEQ ID NO: 7837 - DNA, 525 bp, Sorghum bicolor
  Clone ID: LIB3480-061-Q6-K1-G7
cagctgcatctgctggatatgtatcagttttgtttgatgtaggtggaatagttgggggagttctggccggcttcatatctgaccagctcaatgctagggcaaccactgctgcagttttcatgtacttggcgattccatctcttttcctctttcatgcatatggtagtacctcaaaagcgacaaacattggattgatgatgatcagtggcctgtttgttaatggaccttatgctctcataacaactgctgtttctgctgatttgggcactcacaaatcccttaaaggagattctcgtgcattggccacggtaacggcaattatagatgggacaggatctcttggtgctgcattaggaccattcataacgggcttcatttcaaggaaaggatgggattcagtattcataatgcttgcactttgtgcactggttgctgctgtgtcgttgtcaagtcatgtgaaaacagaaattcctcaaatcatccagaagtggagaaatcgatcaaccaatacgcaagatggaaatg

SEQ ID NO: 7838 - DNA, 990 bp, Sorghum bicolor
  Clone ID: SORBI-28MAY03-CLUS13662_1
ggaaaactgagagagccaacaagttctactactgcatgccctattacatgccactaaatcctcctgaagatgaagatggcacagctgtcaccgccatatatcctctagaccccccgatattttgtgatttttacttggaattggatgattacgaggttttagctgctaggatagtcagagatgaggggttgccagaggatgagggggaaaaaattgaggaatttctaaaggagaaggctaaacaaagggaaatagaagtggaacaggctgaagaaaccaggaagaaagctattgaagatatggaccctaagcaaagagaggcatttgaaaacatcaaattttacaaattctatcctgtgaaaaccccggatacacctggtgttaacattgtgaagtcgagatacatcaacaaatattatctcaacgcacattatctgatgtaatggtgttcctgatgtcacatgtttgctaaactgtgattgactaatctatccaactcgaagagttcttgttatagaagtttctggaagctgggtagatcagcttggtgacataagagtgtatatagtctcgtgttagtccattagatacaatgttgcatctgaactcagcgtccgtggagctactgtcacttgtctggacaacccctgagcatcccgtgggcatctgaactctcttttgctgtgtttaacatcctgagcatggattattgtgtagtacgtccggtattggactgaaggggaaaacaatggatccacgtccggtataaactactattgtgttttagtagctgttagggtgcagattatgttctttagggtacggttttggtgaatttgctggtatttgaaccaatgaaatcaactctcttgtatcaggcccggaacagttccagcaggggtggacccacagggtatgccagtagggccacggcataccctatgggtcggtcttctacttatttaacagtgtattataactatatataaa

SEQ ID NO: 7839 - DNA, 751 bp, Sorghum bicolor
  Clone ID: SORBI-28MAY03-CLUS13686_1
gcacgaggaagaagggatggttcggttggggcggcaagaaaggtgccaagggcgatgacaagccaccgaaggtggggagtaaggatgaaacaagtgacccagggaagcaaaaggagaagggcagcgggaagaagaagaagggtggttcatctgctgagtctctaaaacatgaaagcgagtacaagaagggtttaagaccagtgttgtggctgacaccggatttccctctgaagacagatgaactcatccctctgcttgatgtcctagcaaacaaagtgaaggctgtcaggaggcttagggaactcttgacgaccaaacttcctacaggcacatttccagtcaagattgccatcccaattgttccaacgatacgagtcatcgtgacattcacaaagtttgaagaactacagcctctagacgagtttgccaccccaccttcaagcccaacacaatttcaggacgcgaaagccaaagaatcagaaggatcaggctcatggtattcatgggtaaagggtggccgaggtacgcagtccagtgacagtggtgatagccggaattggaaagatgagattgatccgttccacataccatcggactacacctgggttgatgccactgagaagaagcggaggatgaaggcaaagaaagccaagagcaggcggggcacagcccgaaaacagttctcaaagaacacttcggaaggaggccaccatcccatgatggatggcttcgaggagtaaaccacgttttt

SEQ ID NO: 7840 - DNA, 853 bp, Sorghum bicolor
  Clone ID: SORBI-28MAY03-CLUS13689_1
gggctccccagcgtctcggagaagagaagcatcacggcacggcggcggtggcgaggaaggctcccatcccaatcccaacccaaatagcagccgcccaaagaggaggagctccaatcgtcgcgcgggcgtccgtcgtccctccattcatcgatccaatctgcaggaccctgcatcgcggcttcttcgtggaggagaggttgctgtggaacccgccgccagttagccatgtcgtcctccgtgctgagggccgcggccgacagggccatccgcaggcaggccctcacgctgacggacaccgcggcgtccaggatccggcagctccttagcctcaggcagcggccatacctgcggctcggcgtcaaagcgcgaggctgcaacggcctctcctacacgctcaactatgccgatgaaaaggggaagtttgatgagcttgtcgaggagaaaggagtcaaagtattgatcgaccccaaggctttgatgcatgttataggcaccaagatggactatgttgatgatccattaaagtctgagtttgtgttcataaacccaaattccaaaggggagtgtggctgcggtgaatctttcatgactacaggcagcaaagggtcgacgtcatgaggcgtttttcagtgtaaatgcatagcgaagtgtctgcaggctccagctacaggttttcttgcatctgttgcgtcgcagttcatcataatataacacagcagtgggttcgtactggatatgcaactaactcacatgtacttctaaatttcccctcaaatgttgttattacatggtctgattatccatgttctgtatatttgatcactcacgattttaagacctcaaatttgtatga

SEQ ID NO: 7841 - DNA, 794 bp, Sorghum bicolor
  Clone ID: SORBI-28MAY03-CLUS13699_1
acgggccgacggcggggagctccgcctcgcgcccttcagcgacacctgtgccctcgtctccgtgctcttcagcagcctcgggatggccttcaggttcgtcgagatcgagtacgtcaccaaggtgaacgatctcatcggcgccggcaagtcgtaccgcacgctgagcgacatcctcgacaaggacatccagaatgactgcgtgaagaagcaggggagccactcccggaacctgcgcagggtccgcctcggcctcggcctcatcaaggccctcttcgagcagttcctcgccaccgagggttcattgtatgatgctgctacgacagcttacgggcaggtctgcgcgccgtttcatagctgggcaatcaggaaggctgttggtgctggcatgtacacccttccaaccagggagcagttgatagtgcggctgaacgaaactgatttctcggtgcagaaggagatgaggagatacattgatgcttctagtcctatcatagagtacatcgataaccttttcctctcgaggaacattagcctagattggtgaactgatctgaactggactgaagatcaagtctgcagcttgttcacaagctgttgttggtgccatcgatttattctgttggtagttacttattattcagccttgttgggtggtggatggatgctcccttttcttcctttgttgcacgcacggtctcgtgcatgtgttgtacaactgcatgataattctagcatggccattgatattcttgccgcctgtccatatagaaattgatggataatgcaatcgacta

SEQ ID NO: 7842 - DNA, 669 bp, Sorghum bicolor
  Clone ID: SORBI-28MAY03-CLUS13718_1
gcacgagggttcagcccctccgacgcctcccaataaaaacgccaccccgccccccactcgccggagcccggccgccgggatgcctcgagattcgcgcccactcgggatgcgcctcttcggcgtcaccatcgcgccggcgccggcgccggaggcggatccgccggaacgggatccgagtcccaacccgcccgtggcggccagggaggacgtgatgcgcaagtgcaagagcatgggcaacctcgccgctcttggcgctggcgcggacggtggaggaggtggcgcggacggcggaggcgccggcgacgggtacctctccgatggcgggctgatgcagtcgtccgggaagcggcggagggcgcaggagaggaagaaagctgttccttggactgaagaggagcatagaacatttcttgctggtcttgaaaagctagggaagggtgactggaggggcatagcgaaaaattttgttaccaccagaacaccaactcaagttgcaagtcatgctcagaaatattttcttagacaaactaatccaaacaagaagaagcgcagatctagtctttttgacatgatgccaagagagctgtcaccaacaccaaattgccccatattacctccatcaatggcaaaagtacatgacgtggtagctatgacgaaacagctccagga

SEQ ID NO: 7843 - DNA, 1220 bp, Sorghum bicolor
  unsure (1)..(1220): unsure at all n locations
  Clone ID: SORBI-28MAY03-CLUS13720_1
gcacgaggctctcgctgagatgcagcagcttgtggatggagtcataacggaaaacatgttatacccttccgcttcaactgttgatagtagacaaggttatcatggtgaaatgctgccaataacagataacttagatagccgttcattttctcaccatgacatagctagaatgcttgatggtgccaacattgggctaagtgatgtttccagcactccgtttgattcagtgccattcaacgagaccttcacaaattattcagctggattcagagagccaacactccattcttcatttgcctgcttagaggctaacaatctggatgatagctcttgtttgcagacatttacatctgaggctctatacactaaccacctcagccagaagggcgcgggggcactgggtttcactggcatattaacatcagaggtgaacggagatagatataatgatgatagcatcaaacatccactcttgaagcagtcatcattagatctattgacgattgagactcctggtttgaagaaacatgacagcttttcaagatggatgagtaaagaacttgaagaggtggttgatttgggtattaaatccacttctgatgctttctggagtagcattgagacagtgaaggtgcctgatggttctaatgtgctgagtaatgaacagctgggtgcttatgtagtgagcccgtcgctttctcaagatcaactattcagcattctcgatgtttcaccaagttgtgcatatattggtacaaatacaaaggtttcggttactggtacattcttggtgaataaggaacatgtggaaaatcagaagtggtcatgtatgtttggggatgttgaagtaccagctgaggttttgactgatggcaccctacgctgctatgcaccagcacatcaatcaggaagagtcccattttatgtgacctgttcaaacagggtggcttgtagtgaagtgcgagaatttgagtatcgtgattctgatgctcagtacatggagacttctcgttcccaagccaatggtgtaaatgaaatgcatctacatattcgtcttgagaagctactcactttggggccagatgaccatcatatgcttgctataagcagtggtaatgagaaatatgagatagtgaatgctataaatgccttaatgcttgatgggaaatggtcaaatcaagaatcttctgtcaaggaagtagtttccactgctangggcc

SEQ ID NO: 7844 - DNA, 744 bp, Sorghum bicolor
  Clone ID: SORBI-28MAY03-CLUS13736_1
cggatttccttcgtcggaggatcgataaccccgcttcttgtgagaccaaatcaatagagcaacccacaccaatctcgatctcaatcccaattcaatcaccaacctcgatcccaattcaatcgaagtcgcaggtcgcaggatgcctccgccgcgtgagcaccaccagccccaggaggaggaggacgacgacgacacggcaggcgtcgtcaagctcatcagcgcggagggcttcgaattcgtcgtcgacaagaaggccgccatggtctccaacaccctccgcaacatgctcacatcgccaggcggcttctccgagacgcgccagggcgaggtccgcttcccggagatccccacccacatcctcgagaagatctgccagtatttctactggtcgctccattactccagtgggaaggagacagctgagtttcagattgaaccggagatcaccctggagttgatgatggccgcaaactacctggacacttgatggggaacctgagggatctaatcctagtatgttatgaaatatgaaagaacaaagtaatgtatccagcatccactggatgaaatggttgtttttttgctgggtctgatctgatccgagccagagtagtttcgcgcaatgtaacataacaatgtaagcatgacaggggggaagcagaagccaaggaagacatgtgcaatttaaagtgcgtgctactatcaactcttttagttttagaatatacatactctgttactgct

SEQ ID NO: 7845 - DNA, 537 bp, Sorghum bicolor
  Clone ID: SORBI-28MAY03-CLUS13752_1
gtcaggcggcgggcggaacgctcgccaacaaatttaatcccaccaaaaagctaggaaaaagcttttcaacaatggccgccgccgccgccaagaagacggtcctcgtcgtggcggcgctgctgctcgtcgcgctcatcgcgctggaggccgccactccggcgtccgccgtgacggactgcaaggccgggtgcgacgagctcagacgactcggcgtcttcaactgcgagaagaggtgcgaggcgatcgccgcccaggcacagaagggacccaaggacgctagcaagtcgtatttttgacgtccccgtacgttaatgttcctatatatgtatgtatatatacctcatgcatgatgatacaacggcgaggctacatcagtatatatgtatatatatatagcgatcaaccatgcattagagagatcatgcatccttatacatatgtaaatgctggcctgttgtccatgtaatttggtttcccgtgtttcgtttggcgtccgtaatgtaatccatacactcaagaaatggacgttggtggttt

SEQ ID NO: 7846 - DNA, 722 bp, Sorghum bicolor
  Clone ID: SORBI-28MAY03-CLUS13775_1
cccacgcgtccgcccacgcgtccggtagccgagaaaggggacaagcagcagtgaagcagcggaaggcgagagggtcggggcgcgacgaggccaccatgagcactctcaagttctgccgcgaatgcaacaacatgctgtacccgcgggaggacaaggagacgcgcacccttctctacgcgtgccaatcttgcgagcatgaggagattgccactgatacttgtgtgtacaaaagggtatccgtaagcctgttggtgaacccaaagatgtcctgaaggatgcagcaactgatcctagtcttcctcgcaccagaagtgttagatgctataactgcaaccatccagaagctgctttttttcaggccccaacttcgggagagcaagccatgacactgtacttcatctgctgcaacccaagctgcggccacaggtggagggactgagaagggtctgggtctgctaaagcaggtcatagaaggatcactccagaaagcgtagtagttcttggcatgagccttcagtccttcagaagcagtctgtgactggatcagtccttcggaagctgtctgtgactgaccttgatccttcaaaagcgtagtagtactttgctacaaacctgccgtattgctagcctatcacataaatattgtaggtacatgttgtgtcttcaactgacgtttgttggaagcttataagatgtaacttcataacaaaacaattttaggc

SEQ ID NO: 7847 - DNA, 791 bp, Sorghum bicolor
  Clone ID: SORBI-28MAY03-CLUS13394_1
cggacgcgtgggcggacgcgtgggcagaaacttggcgcagactttcttgtcgcatcctctcataagatgtgtggccctacaggcgtcggatttttgcatggtaaatttgagattttgtcatctatggagcctttcttaggtggtggcgaaatgattgcagatgtattccaagacaaatccacatacgctgagcctccctctagatttgaggctggaactcctgcaattggagaagctataggattgggagcggccattgattatttatcatgcattggcatggagcagatccatgaatatgagaaagagttggggacatatctgtatgaaagccttctttctgttccaaatgtccagatatatggtccagcaccttcccaaactgttcaccgtgctccgctgtgttctttcaatattgagaatgttcatcctacagatattgcagaaattcttgatctgcagcacggtgtagcaattcggtcagggcatcattgtgcacagattttgcataggacccttggtatcactgcaagtgctcgtgcaagtcttcacttctacaatacaaaagatgaagtggataccttcatcgatgcgcttaaagccactattgatttcctcacgtctaaatactagtgtggttcgattagtaagttgtccgtttttgtcagtttggtcactctctcatttgagctgctgtacagagaaaaagtatacatatattcggtacaaagaaaacatacagtggacatcttctcaaactgtactgtacttccttatttggcggttcttgt

SEQ ID NO: 7848 - DNA, 1060 bp, Sorghum bicolor
  Clone ID: SORBI-28MAY03-CLUS13398_1
gactgccagagctctaggagaatcattgtttgacaaagagcttggaaaaccaattgggcagcttattgtcatttgtggccggaacaaaacgctaagctcctcactgcaggcacttgaatggaaaataccagtaaaggttaggggatttgaaacccaaatggagaagtggatgggagcttgtgattgcattataacaaaggctggaccgggaaccattgctgaagcgttgataaggggtcttcctataatccttaatgacttcatacctggacaggaagttggcaacgtcccttatgttgtggacaatggtgcaggtgtgttctcgaaaagccctaaggaaactgctaaccttgttgcccgctggtttggtccagattcagaggaactgaaaaaaatgtcagaaaatgcactgaaattggctcagccagaagctgtctttgacattgtcagagacattcatgggctctctcaggagcaaggcgtgatatcacagatctctagttccttgacttcatccttcttcataccatcacctgaaaccacacctctccaacttatctgaaaccatcaagctgtgtctagctaggattctattcttgcaactgtgaacttggcattctcccaacagcgtgacctgaaaaatggaacttcatgcagtctttctcatcagctgttggtactgggattccacaactttcggttcatgtgctcccatggtagttatgggcaggctcgtttgactgacaggttctcgtgtgtgatgatgctggcttcattttaactttgtaaaaaaaaaggaacacattcattcatatcaggtttctggcttcccccgtcatgaaaggggaattggtggtggtggcttgtaaaatacactcaaattttgtgcatggagatgtcagacccttattgtgtatactaactgacgtgatccgttcgtgtaagtggaaaatgtgtataatatgatgacagattgttcgagtggaagtttttttctttttctttttgtctgcagattgatcagaaattgtacctccgctatgttttttttggtgtatga

SEQ ID NO: 7849 - DNA, 563 bp, Sorghum bicolor
  unsure (1)..(563): unsure at all n locations
  Clone ID: SORBI-28MAY03-CLUS134202_1
gcacgaggaacctacgaagctcatcgaaaccgaaggatctcttttccgtgagctcgtcaaagagtactggtcatacacatcgaatggaaatatttaggagaaatcgtgacagtgtacgtttactcactcgctgcagccttgtaaaaagatacaaagaccctgtgctcagacatgcgaagaactcttctgaagtatatgaagaaaaggtatcaggcactttcaggaagtgcttttgttaactagtactagtagttttcaggtgacattttgaaggactttggggcagcttctatttttctggtcaaattgctgcccttcaagcggaacagagggaaacctgtccctaaaaaggaacaaaaggaaaccttcagcattcatttgctgcaatagcgagctaataagaggcaaaatgggtggtaggcacatcaagtctgcagccgtgatactgcattgttcagaaaaatgcttaggcgataggctattccaaggcttcaaactttatggtgtatactttacattcnccaatataagccgaaagtgtgtatataattttggggaaaaaa

SEQ ID NO: 7850 - DNA, 948 bp, Sorghum bicolor
  Clone ID: SORBI-28MAY03-CLUS13473_1
gatgaacctgatcccatcatctgtccggatgcagtatcccaagctgatgatgtgaactggtgggggcacaaatttggattcgttacaggagggtttctaggagcaaaatctcgtaaaaataaatcttcacaaaaagatcctgctaatgtccgccagacatttgcggaggaagatcaagaaaatttatacaatcttgttcaggataaagctacttctggaaagcagggtcttggcatcaaaggcctgccaatgaaagttgctggccaacgttggaagggaaacaaaacttcgtttgttgatagcgatgatgataattcaacccaatccgatgaatattcagaaattgaagagagtgacgataaggaagaacctatcagtgcttctgaatcaatagacacagacaagaatacagaaaaggaattgcttgtggatgctagaccgaaaaccaaggtcaagaaactttgcaaaagaatacttcgtcaggccccatctcagtcaatgaaattgaaggatcttaaggtagccgttgaggaacactcaaatgttgtattctccagcttctcatgtagacgcgaagctctgttgtttctgaagaaaaagcttcaaggaagcaggaaattcaatgtggacggcaagaaagttcatctcgtgtcatgaattgcaaagctaatatgaattctttgggtagtggtgagcattacgttgttggtatccagccctcagatttgttgttgctcgaggttcccaacagacgtaggacacattgagctctgtagtactagtatagataaggagtcaaaccctttcgcagatgcggaggaaaaattttgcaaaatttcgtgaggggcagagttgctaatctgtgtgcagtacatttgatgtatctgtggcttgtctgttttgcatgagatgtacaaactgcaaaattataaattggacttgattgta

SEQ ID NO: 7851 - DNA, 950 bp, Sorghum bicolor
  Clone ID: SORBI-28MAY03-CLUS13411_1
gtgacgtctccgccgtagccgctgccgctgccgctgccgccgccgcatcggcgctgccagcgggcaacgcccagccgctggcgggtcgcgtggccatcgcggcgcacctgtcctccctgggcgcgagcgtggtgctggggtacgcgtcgcgcgccgacgaggcggacgcgctggcggcgtcgctcccgcgcgcggtggccgtgcgggcggacgtctcggacgaggccggcgtgcggtcgctcttcgacgcggcggagtcggcgttcggcgtcggcggcgcgcacatcctggtggccaacgccggggtgaacgacgacacgtacccggccgtggccgacaccaccaccgaggccttcgaccgcgtggtcgccgtcaacctgcgcggcgcgttcctgtgcctccgggaggcggccaaccgcgtcccgcgcggcggcggcgggcggatcgtgcccgtgacgtcgtccgtggtggggagcctcccgccggggtacgcggcgtacacggcgtccaaggcggcggtggaggcgctggtgcggacgatggccaaggagctcagaggcacccgcgtcaccgccaactgcgtcgcgccgggggccacggcctcggacatgttcttcaagggcaagagcgaggacatggtgcggcgcgccgtggagatttgccccatggagaggctcggggagcccggcgacatcgcgccggtggtcgggttcctctgcaccgacgccgccgagtgggtcaacggccaggtcatccgcgccaacggcggctacgtgtgatgtctgatctttagcttctacagcttcttggtgtcgatcatcttcttcttttgtcacgcagtgtttcaccatcttgtaatcaaaccttaagccttatcgttctagcacaaatcggaatgctttcgcgcgtccagacatcgtagcttcgtgttagacatacacaatgttttt

SEQ ID NO: 7852 - DNA, 464 bp, Sorghum bicolor
  Clone ID: LIB3478-057-Q6-K1-H8
ccgagaggtacaatggcagacgctggttacctctccgacgtagccgctgccgctgccggcgtcgcatgggcgctgtcagcgggcaacgcccagccactggcgggtcgcgtggccatcgtgacgggcgcgtcgcggggcatcgggcgcgccatcgcggcgcacctgtcctccctgggcgcgagcgtggtgctggggtacgcgtcgcgcgccgacgaggcggacgcgctggcggcgtcgctcccgcgcgcggtggccgagccggccgacatatctgacgaggccggcgagcggtcgctcttagacgcggaggaatctgcgttcggcgtcagaggcgcgcacattctggtggccaacaccggggtgaacgacaacacgtacccggccgtggccgacaccaccaccgatgcctttgaccgagtggtcgacgacaacctgcgcggtgcgttactgtgccttcgggaggc

SEQ ID NO: 7853 - DNA, 797 bp, Sorghum bicolor
  Clone ID: SORBI-28MAY03-CLUS13489_1
gccggccgggccggggaaactctctttccccttcccggcgccggagtcggagaaggccaccgcggggcgggcgatggacagcaacaacctcctggcggcgtggcaggtcgtgggcccgggcgtcgccggcgccgtattcggagccggctggtggttctgggtcgacgccgtcgtctgcagcgccgccgccgtcccattcctccactacctcccagggttcttcgcctcgttcgccgcgctcatgttcaacgccgtcaaccgggaggacatcggcgatggttactattcaccgtacgacgactccgaatggagggtgaaactctggctttttatttcatatgtggtgtcttttgtctcgttggctggatcagtcggttttttggttcaagatgcgcttacagatacgggaccatctgcgtggactggcactgctggtgtcctgcagtgcgtgtttgttctagtgagtgggttgatctactggacgtgccactctgaagattgacttgagaagtataggtatgaccaagaaagacgcggatgctaaaggggaacatgattcgggcttgttggctgaacggcaattagtgtatcatggtctattgtattccccaagcctcgaagtttggttttagtacaaatatagtcgtgtaccatgctgcttaaaattagtttcgtaagatgttttggagcaagaaacttctagggatgataagtagtcagtaaatatcttgttacattttctccgttgacaaatttctcgtgcaaatttagccaactgtcgtctgctcttgtacatc

SEQ ID NO: 7854 - DNA, 621 bp, Sorghum bicolor
  Clone ID: SORBI-28MAY03-CLUS13495_1
cgccgtttcgtccctggaagctctccctggtcaccaagctccagcaggttagcctgtcttgtggttgttgaggcttgaggggagcttggcgccatggggggcgggaaggacagccacgatccctcgaacgcggacaagggattccacggagggtaccccggtggctacggccagtaccccgccggctaccctgttccaccgggcggcgcataccctcccggccccggacaagggtacccggtgccacctggtgggtacccgcctccgggtggctaccctcagcctggagggtatccgccgtcgcacggcggcgcgtaccctcctggtgccggcgcgtatcctcctggtgcaggcgcgtaccctcccagcggatacccccatcaaccggtctacccacaggctggttatcctggtcactgtccaccgatggctggtcatggtgctatgtacggaggaggccatggtgcagggggttctggaggcttcggggcgatgatggccggaggtgccgccgccgcagcggcggcgtatggagctcacaaggtgtcccacggaggcggccacgggatgtatggccacggccacgcccacggcaaggtcaagcatggcaaggtcaagcac

SEQ ID NO: 7855 - DNA, 666 bp, Sorghum bicolor
  Clone ID: SORBI-28MAY03-CLUS13502_1
ctgcaggaagtaaggagaggtgctgatagagcagaaatatatagcttggctttctcgaataatttgcagtatttgtctgtctcaagcgataaaggaacaatacatgtgttcaatttaaagataaatgtgggatcgactgcaaatgataagcctatgcctgctccagatcctgaagttccccatataagcccccctctttcattcattaagggtgtgttgccgaaatatttccattctgagtggtcagtagctcaattcaggctccatgagggtgagcagtatattgttgcatttggacatgagaagaatactgtggcagttgttggtatggatggaagcttctacagatgccaatttgacccagttaacggaggagaaatgctgcagctggagtgctacaatttcctaaaaccatcggatcaaccgtagcaacatactgtaatcatcatcatgactgctccccctgtaccaaggattgtacagtatctttgtgggccctcggtgacccgagggcaaagcaagagataataatatttttatttgtaaatatatctctgatgtactatgttctgcggaagggctaaaacacccatttgcagacgaacgtaatagaatgcatcgttatttatttatgaataaataaaatagcctagcaatgtttctctc

SEQ ID NO: 7856 - DNA, 796 bp, Sorghum bicolor
  Clone ID: SORBI-28MAY03-CLUS13532_1
aaataaattacatatatacagctatatagcaatggcgggcaggaagatcctcctcctcctcctactttgtgccatggatagggtagcagtggtagtgctcgccgtcgcagggcagcaaggcgccgatccgcgggcactgccggcggagtgggcgacggcgataaagtacaaggccaccatggacgtgaagacgcgccaggctttcgacggcgtggtggctgccgctccggcggagaagcgttcggaggccgtggaagccgtgctgcagcagcagctcaacatggacgtctccctgggcaaggccacggcgtccggcgacgagaacaacttcgtgagcgtggccggcgcgtacgagaaggcggccgacgccgtcatcgcggcgtcgccggcgaacaagctgggcacgatggcgttcgcgtacaacggcgtggtggcgccggacccgggcaggtgcaccgccgccgccgccgccgacaagcccttctgcgagacgtacgccaagacggagaaggccttcgccggggtcatcgccacgggggactcgccgcggacgaggctggggttcacggacgtggtgctcaagcagaggctcgccaccgacgccgccatcaacaaggcgtacgccgagggggacaaggacaagatcgccaaaatccttgctgcctacgcgcaggccgccgacgcggtcgctgccgccgcgcctcctgaaaagctcagagtcatggagcagaccttctcggcggtggccgccgccgctcatcagcctgcagctgctgcaaaagcttaattaataaag

SEQ ID NO: 7857 - DNA, 701 bp, Sorghum bicolor
  Clone ID: SORBI-28MAY03-CLUS13557_1
caagactggcccatctatggaccatactcatgtgagcacagttgtcaaaggcagttttggttaccttgatcctgaatacttccgcaggcagcagctcacagagaaatctgatgtctactcttttggtgttgtgctgtttgaggtcctctgtgcacggcctgccctgaaccctactcttccaaaagaagaagttagcttggcggagtgggcgttgcactgccagaagaagggcattcttgatcagattgttgacccctacctgaagggaaagatagctccacaatgcttcaagaagtttgctgagacagctgagaagtgtgtttctgatcagggtattgaccgcccttcgatgggtgatgtgctctggaacttggagtttgcccttcagatgcaggaaagcgcagaagagagcggaagccttggttgtgggatgtcggacgagggcactccccttgtgatggtcggaaagaaggatccaaatgacccatcgatcgagtcaagcaccaccaccacaaccaccacttctataagcatgggcgatcaaagcgtcgcgagtatggactcagatgggctgacgcctagtgctgtcttctcacagatcatgaaccccaaggggcggtgaggtaaagctcatcccattcgttaccttgcaggcataatttattcattcagcatgtttttcatgagttcgtgctgttgat

SEQ ID NO: 7858 - DNA, 772 bp, Sorghum bicolor
  Clone ID: SORBI-28MAY03-CLUS13634_1
acaacattcagctgttggtatcgttgaagagatatttgaagaaggttcggccatgctatcagaaaggttaggtcctcattcggatggcagaagaacctcaagcttgtttacatgtgcaatctgccaattagacctggagccaagtgaaggcatttcggtgcatgctggatcgatcttctcttccagctccaggccatgggaaggcccattcctatgctcggactgccgtgacaagaaggatgccatggaaggcaaacgacctagtggtgtcaaggttctgtagtatacagcaaccaattaccattgtagctacctgaaaaatcccaccttcctttcctttcttcatgaggatcctttcagggttttacaaatttttctttaattctgggaattcggatgatttagggtgcatcttattttgttctatcttgcgaggaactagccaactatgtaagtagctgttggcaaaaggaaatgtgaagcgagtgaatagggtatgccttcattttcctttctcttttccagtcggaatgggctgactgtaactcgctgctcgcgagtaatgatagctaacctattctttatttgtaactatcttgccttccccctgcacccccaccccccgtagaaaatgcacacgcatttataggtgttcattttttccgttcttgttcgaggcattcttggtcggttagggtcttgtcagcaaaagacttatctctcacctgtaaattttgtagtgtaattttttgtgcgcaaggacaatttttta

SEQ ID NO: 7859 - DNA, 913 bp, Sorghum bicolor
  Clone ID: SORBI-28MAY03-CLUS13101_1
gctactggcccatatccctccttaagaggatttccagagggagagacagaaacaaacggagaggcagagaaaccctttccacgcagattcatccggtccggttcggttcgcttcggttcagaccacgcgggcgcgggcgcgggagagatgagcgcgtcggaggaggacgcggcgcccgctgcggcggatgggggatccggaggcgggagcagcggcgcggggtcgtcggaagggggcgcgcggcgccggttcgacgacaagggcctcgtcgcccgcacctcgctcatcctgtggcacacgcaccagaacgacgtcggcgccgtgcggaagctgctggaggaggacgccgcgctcgtcaacgcccgggactacgacagccgcacgccgctccacgtcgccgcgctccacggctggcacgacgtcgccgagtgcctcatcgccaacggcgccgatgtcaacgcccaagaccgctggcagaacacgccactagctgatgcggagggcgcaaagaggcagtccatgattgagctgctcaaggagcacggtggattgacatatgggaaaactggaagccattttgtaccgatgacgattccaccacttccaatatatgaggctgatttagtgggggataactgtgaattggtcttcacaaaagacgacgttatcggaaagggctctttcggtgaacttctggaagcaaattggcgaggaacacctattgctgtcaagcgcattcttccatccttatctgatgacaggctggtgatccaagactttaagcatgaagtcaacttgctaataaagctgaggcatccaaatattgtccagttccttggagcagttacagaaactaagcctctaatgctaattactgagttttctacgaggaggcgatcttcatcaatatctg

SEQ ID NO: 7860 - DNA, 768 bp, Sorghum bicolor
  Clone ID: SORBI-28MAY03-CLUS13143_1
tggtcaatttctataaagagactacaggtctcgatccaattgcatatattgatgttgtccaccaagagagcacaggaagcttgagctcagttatgccatgggatcgttctctgcgtgaatttgccaaagatgagccatatttgttagctgcagttctttttatcatcctgaaggttgcagcgcacttcatacctgttgtcatgtctcatctgagagctttcttagttgtccgtgtccaaaacttgaacctagggatccgtaggggatcaaaccagctcttggaacgagcattgaatgttcttgatatgaggaggctttggagcaagctgagactgagcaacaaggcaacggacttgaggaagggagcaagtaatgcacgagcttgggcttcctcatttgcttctgtttcactgggtgaaccatcatcttcgagacaagcgtagccattttggagatgtttgttagggtagctgctcacatggtgcaaaactatttaatctttgcttcccatcctgctatgtagcactgtttctgtgcagtcaggaaggggagaaaccttacaggcatgtaaattttgaggacatcatgtgctgttgtatattaggattacctttgcatttgctaatgcaacccctaatcttactgtccattaactagagttatttggccatgtatcatgaacatctttgtaggttttttaggatttctctccgtttgtggtgatgtattggtagtttacactgtaatctccattaaagaacttgttgt

SEQ ID NO: 7861 - DNA, 739 bp, Sorghum bicolor
  Clone ID: SORBI-28MAY03-CLUS13059_1
gctccccttccccaccctgacctcccatcccatctcacccagtgccacctacttcaaagcccatctgagggtggcggcggcagcttcccaccccagctgttaccatgaccgaatccttgtgcggaggaggcacgcatcgtcggcatgacatggacggcgagcagggcgcggaggttggagccatgcctaggtcttcaacaagccctcttcaccagcgataagcacacagtgtggatctgctcctcgtagcgacggccgcggctctgctcctggcagcagcgcgagcgtagttaccagcgacggcagggcgtgcgacacggggcgtggtgggcaggtgcggccgtgcggcgggcggactcggcgtgccactgctgcggtgaccgtcgggctcgggtgtggcgagcagcacgcagggagtagcctcgacccttggtagtcagcacggtgggcagatcctgcacctgcaggttgcagcgggtggcaaggagccaaggacaaaggagcagtgtagggatctatctagattgctgacagctgctactgctgctgctgtgctttcttgaaggttcaagctccagactccagaaagcactccacggctccacgacatggctgctaacggtgagatttgtcctgtattgttttggtatttgtcctgaatcgctatgatattagtatatcaatgtttattatagatggtaatgcactactgctattatttttaccatctcatgcaaag

SEQ ID NO: 7862 - DNA, 343 bp, Sorghum bicolor
  unsure (1)..(343): unsure at all n locations
  Clone ID: LIB3478-052-P1-K1-H8
gagcacccagtccctaacttaagctatttggctatttgcatccggatctgcctctcaccggcgtcggttgcgacggcacaacctggcactagtgtggatctgctcctcgtagcgacggccgcggctctgctcctggcagcagcgcgagcgtagttaccagcgacggcagggcgtgcgacacggggcgtggtgggcaggtgcggccgtgcggcgggcggactcggcgtgccactgctgcggtgaccgtcgggctcgggtgtggcgagcagcacgcanggagtagcctcgacccttggtagtcagcacggtgggcagatcctgcacctgcaggttgcagcgggtg

SEQ ID NO: 7863 - DNA, 912 bp, Sorghum bicolor
  Clone ID: SORBI-28MAY03-CLUS1317_1
gcacgaggatggaataaaaatacttgccaacactgatggacagcgcttgcttaggatgcttgagagtggagcatttgagggctctagaggacctcctcaacaaataaataccaagcctccaattgtcgcccttggtccagtttcaaatgtcagcagtcctatagcagtaaatgccgagcgacctgatcggatcttgcctgcagtgtcgacaagtggcttggcacctatggatccaagcagaactccagatgttaaaccaagaatagcacgtggatctgaaaaggtcaaaacctggaagttggctgacattgttgacaatgggcatcttcgagccctgcatttaacagacacggacacgaacccaagcaaagttgtccgtttgttatatacaaataatggaattgcactcttggctcttggctccaatgctgttcataagttgtggaaatggcaacggggcgacagaaatcctagcggcaagtctactgcatctgttgcccctcacctgtggcaaccagcaaatgggattctgatgacaaatgacactaacgatggcaatccagaagaagcaactgcctgcattgcattgtccaaaaatgactcctatgttatgtctgcctctggtggcaaagtctcgttgttcaatatgatgacattcaaggtcatgactactttcatggcacctccgcctgctgcaactttccttgcattccacccacaagataataatatcatagctattggaatggaggactctaccatccaaatctacaatgtccgcattgatgatgtcaaaagtaagctcaagggacatcagaagaagatcactggactggccttttctcaatcaatgaatgtgctagtatcatcaggcgctgatgctcagctatgtgtgtggagtattgatggttg

SEQ ID NO: 7864 - DNA, 918 bp, Sorghum bicolor
  Clone ID: SORBI-28MAY03-CLUS132050_1
gcacgagggaagcacaagctagaaactagtagtaccacacgtagctatagggtgccccaatggcagccatgcgaacgtgcttggtcgccattgttgtggctctagggtttctcttcctcgagaagccagaagtcacagcggcggcgacggagacgactactgggatgtccgcggagcagcggcaggaggtggagagcctcctgaggcgtgtcaacaagactcctctggcaaccatcgagagcccagatggagatatcatagacgtactgtgtgcacgtctccaaacaacccgcatttgatcatccactactcaagaatcatactatccagatgcggccttcttaccacccaagaagcctaaatcaaaactacaacattacctcccatccaatcacccaaacatggcatcaaaatggcaagtgccctgagaacaccgtaccgatacgaagaaccatggtacaggatgtcctaagggcaagttctatcagcaggtatggcaagaagaggcccaggagtattccgaacctcaattccataaatggccctgacacaccaaatgtattgaatggccaccagcatgctgtagtagctgcacaggataataagtgctatggaaccaaagcctccttcaaatttgtgggatccaacaaattgctcgggcaaaatgatttcagcttgtcacagctctgggtcactgcaggttcctacaacggaaatgacctcaataccattgaagctggatggcaggtcagacctgaagtggaaacataataccggcagtatttttgtcacacccgattttaaagaacaaaaccaggctagccatatgtgtgcccaggaagtccacagatacaacaacagaagcaataatatcaaaaacaatgttatagagcggaaacatacttataattaacacta

SEQ ID NO: 7865 - DNA, 777 bp, Sorghum bicolor
  Clone ID: SORBI-28MAY03-CLUS1322_1
cccacgcgtccgtggagatggtggcattgttggaggctcagattaaagatttgagcccaaacctggattccatagcagagtaccgcacaaaggctcggttgtatggtgaccgtgttgatgagctaaatgctaccactcaggaacgtgatgatctgaaaaagttgtacgatgggttaaggaagagaaggctagatgaattcatggctgggttcaacataatatctctgaaactgaaggagatgtaccagatgattactcttggaggtgatgccgaactggaacttgttgattccttagacccattttcagaaggtgttgtttttagtgtgaggcctccaaagaaaagctggaaaaacattgccaatttatctggtggtgagaagacgcttagttcgctagctttggtgtttgctcttcaccactacaaacctactcccttatatgttatggatgagattgatgctgcgttggactttaagaatgtatcaattgtgggacattatgtgaaagataggaccaaagatgcacagttcatcattataagtctgaggaacaacatgtttgaactagccgacaggttggttggtatttacaagacggacaactgcaccaagagtataacaatcaacccaggaagcttcgccgagaggcatgaaagtagtgtagtatagtgtggctcaagctacgggtccctgcttgctaaaatgtaactaccttagtgtccttcgttaaattaaccactctaaatgtaaccttgtagtatcctcgtggaaccga

SEQ ID NO: 7866 - DNA, 675 bp, Sorghum bicolor
  Clone ID: SORBI-28MAY03-CLUS133272_1
gcacgaggtggtagcatatgatttcgtatgacagtatgggttatatttggccttatgtttggatgggatgaatgtggctcatattcttctggcattattatgatataacatgcaactagctatttttaacctcttcgaattcagactttggagatattgaattgcattgaaaataaggtgaggtgatattttaccaggatggcccttggtttaccgcacaatatgcacatagatgcacatacttgtgttgagcttgtttatgcttcgcattcaaacttttagtggatctgttgttaaccaccctccttcctcgtcttgtttcagaaatacaagcgggggagaagacaagcttgaaggcaactgtcatgcatagacaggcttgaagacaactgtcatgcatagataagtttgaagacaactatcatgcatgcaacccaggtggtgaaattttctgtttcagaaatataagtgggatatacaagctggaattagaatgctaattcttaatatttgctagcaaccacaacattgcacagatttggtttggtccaatctacttctggtaatgtctataccggtttatttttggaaggcttgtttcactatcagttgcttggcgggtcaagcagctcctcatcgaggaagaattaattctgttgaggctggaattgttaa

SEQ ID NO: 7867 - DNA, 1222 bp, Sorghum bicolor
  Clone ID: SORBI-28MAY03-CLUS13354_1
aggaacgacagtactgtggtatcctccgggcggcgtgtcacccccgtgttggcctgccctgcctggcagcacgaccgcatcacggcacggcctccccaagctccccttccccccacctcctcccacccgcgatctccgcgccggcagctcggcacagctccaccaccctcctcctctccgtctccgtgctccctcgccaaacccacccgcccgggatcaaaccaaaccaatcatcatctgactagccaacgccgaagcagctccctccgtcctccccagatccggcgccgcctccgccatcaccaccgcacggcggacacgtcgcctcccccgcgcgatctgatgcaggcgcacgcggtggccagcgacgatgcggtggaagcttaactcctccgtctacaagcgcgtgccgtccagggaaaccgccatggaacccgacgtcgagacgccaatgagaatgacggacggcggcggcggaggcggaggcggtggtggcgctgggccatcgtggcgcatgtccttgccgcatgtctgcgtcgccacgctcacatcgttcctcttcggataccactccggggtggtgaacgagcccttggagagcatctccgctgaccttggcttctctggcaacacgcttgctgaagggctcgtggtgagtatctgcttgggaggagcttttgttgggtgcctcttcagcggctccatcgctgatgggattgggcgacgccgtgcgttccagctcagtgcactgcctatgatcattggtgctgccataagtgctctcaccaatagtttggagggtatgctcttcggaagatttttggtaggaacagggatgggattgggtccaccagttgcttcactttatataacggaggtttctcctcctacagtgaggggtacatatggtagctttgttcagattgcaacctgccttggaattatagtatcactcctaattggtacacctgtcaaagatatcgatagatggtggagagtgtgtttctgggttgccactatcccagcgactttacaagctcttggtatggagttttgtgctgagagcccccagtggctctataagtgtggaagaataagtgaagcagagatgcaatttgaaaagctcctaggcccccttcatgtaaaatctgccatggcagaactttctagatctgaaagaggagatgatggagaaagtgtgaagtactcagagctgttctat

SEQ ID NO: 7868 - DNA, 836 bp, Sorghum bicolor
  Clone ID: SORBI-28MAY03-CLUS133717_1
gcacgaggagcaggtgtccctctgctatgcccctttcagtgacccggcgttcaacgccaccgtccagcggcacggcgtccgtatgtccgacgtcgcctgcctgccgatctccctcgggtggtacggccccaccgaggagaaccgccggctgatcaagatccagtgcttctccgcggagggcacggccaacttctacatgcgccccatcgagggcctcaccgtgctgctggacatggacacgagggaggtcatccgcatctccgaccgcggcggcggcatccccatcccgcccgccgccaacaccgactacaggtatgcccgccacatgcaagaagacgtcggcggcgaccagacgacgtcgaggagtgaggcggggttccagaaggtgcgggcgccgtcgatggagccggggccgtcgtcggggccgggagtggagctggtggacgggcacacggttcggtggggcgggtgggagttccacctcaaggcggacgcgcgcgccggcatggtggtgtcgcgcgcacgggtgcaggaccccggcacgggcgcgcaccgggaggtgctgtacaagggcatggcgtcggagctcttcgtgccgtacatggacccgaccgaggcgtggtacttcaagacgtacatggatgccggcgagtacggcttcggcctgcaggccatgccgctggtgccgctcaacgactgcccacgccacgcacggtacctcgacggcgtgttcgtggccgccgacggccggccctacgtgcgggagaagatgatctgcgtcttcagagcggtacgccggcgaggtcgcgtggagacactcggagagccccatcacc

SEQ ID NO: 7869 - DNA, 638 bp, Sorghum bicolor
  Clone ID: SORBI-28MAY03-CLUS13374_1
tactggaaacagcccgcgcgtccgcaattgctcgcccggcacaaagcgccatggctaccgtgaggggaatccgtgctctctatgcagttgtcgcgctgctacttctcatggcccttcacacaccaggccggctggcgcaggcggccttcccataccgttccctgctccagacctgccagcccagcggctccatccccggccgttccggcaactgcaacacggagaacggctccgagtgctgcaagaacgggcagagctacaccacctacgactgctcgccgcccgtcacgggtagcaccggcgccctactcacgctcaacagcttcgccgagggcggggacggcggcggtgccgccgcctgcacgggggagttctacgacgacagcaagaaggtggtcgcgctgtcaactggctggtacaacggcggtagccggtgtagcaagcacatcgtgatccgcgcgacgagcaacgggaacaccgtgagggcgttggtcgtcgacgagtgcgactccaccgtaggctgcgacaaggaccacaactttgagccgccgtgccggaacaacatcgtcgacgggtcaccggcggtgtgggacgctctggggctcaacacggacgacggccaggcccagatcacatgg

SEQ ID NO: 7870 - DNA, 1114 bp, Sorghum bicolor
  unsure (1)..(1114): unsure at all n locations
  Clone ID: SORBI-28MAY03-CLUS15698_1
cttccaaccaatcatcacaattagttaatatatatagttagcacaaggatgaataatatgctcacaaccaaaccgacaaccttgaccttgatcgaatcctctccaaccaaatgcaagaaaaatagaaccaccgacgactaaaagaaagagaaacatgcacatatatatatgtacgtgtagtgtccgatcggatggcatgtcatgtcatatggagacgctgttgggtatccctttgccggtgatccccttctccttggcgccgacattgccgacgtccgggaagagcagcgtgtagggcaccttggcgggtcccttgcggttcttgagccgcaggtccttgttcctctccgtgacccgcttctccacccgccggaggtcgtcccggaacctgtcgagcagctgcagcacctcgccgtcgtcggtccacgacgcggtggcgcgctggcccaggtagagctcgtcggaggtgtggttggagagcacctcgatgagcgtgaggccgagcgtggtggtgaagcggtcgggcacggtgtcgaggaagaacctgtccgggtcggcctccagctgcgccatctccggggagcccggcagcggcacgaaccggcggcaccgggtgggacggttgggcatgaacccagcgtagccgtactggccgaagttgacggcggcgtgcagcgcggaggcgatccagatgagcgtggacagcgactcggcgaggttggccacggtttcgagcttcagccagcacgccgggtcgcgctgccggtcgccatggccgacgaggcggacctcggcccaccacgcctgcagctccctgtcggtggccaccgcgtcgtcggagctgtagaaatgggcgcagtagctccgcacccagtcgtcgatggcgcgccacacgtncaagccgtccaccgcgtacgggtagtcctccacgagcagcttcaggtccctggtccggngatccatggacgccatgcctcttctgacgagctcgtttgggagggcttggtcggtgaacctccacttggagtagatggacgaggacagctccatgccgtacttncccgggaacagggtcgtcttcaggatgcctcgtgcgttcagcaggacgctcctg

SEQ ID NO: 7871 - DNA, 888 bp, Sorghum bicolor
  Clone ID: SORBI-28MAY03-CLUS157_1
aattcccggccggaccggactttgcattccatcgtcatcgatggccacggccgtccgcctgcagctggtcttccgccccaccaagcccgctgcttctccttgccatcgtcatctcttatcagcatctccggcttggagccggcgtcgagaccacccaagatcaactgtagcagcagcagcagccgcaaccggtggcgggtcgtcgtctccacccccccggcggccccagcaattgcaatcctccagcaccgccatccgcgagagcaagcagcaggtgacgctgaagctgccgcccctcgtccgcaacagctgggtgtgggaggtgcagcagcagcagcagcagcagcaaggccaagagcaagcccccgtgcgcatcctggtggaccccctggtcgtcggcaacctcgacttcggcgcgccctggctgttcgacggcgccaagaagaatcccgaggtgaaagccctcggggtggacgacctcctggcgccggacgcgaggccggacctgctgctcatcacgcagagcctggacgaccactgccacgtccggacgctgacgcagctgtccgccagggcgcctgacctgccggtggtgaccacccccaacgcgcagccagtgctcgactccctgcccacgcccttccgccgtgtcacctacctcgagcccggccagtccaccgtcgtcaaccagcaggtccgggtgctggccaccgcagggcccgtcctggggccgccgtggcagcgccccgagaacggctacatcctcatgcccgccggcgcaggtgatggtgatgagagcggccccggcctcctctactacgagccgcactgcgtgtacgacaggtccttcctggaagacaagcggctgcaggcggacgtcgtcatcac

SEQ ID NO: 7872 - DNA, 652 bp, Sorghum bicolor
  Clone ID: SORBI-28MAY03-CLUS15703_1
tactatgccctgccaactaatgatgggcttctttgcttatgctaaaacgttggagataaaagtggacaagcaggagcttgaagatgcccagtggcacagccgtgaagacatcaagaaagcgttgacgtttgctgaatacgaaaaagctcagagaacaaatgctgccaaggtcaatcagatttgcaagggtgctgagaaagggcagagcctctctggtgacttcaaagtcgaaagtggtgagcctgctccaatgttcgtcccaggacccttcgccattgctcatcaccttatctcagcatgggcttttgagggagtaccaaagctgcctagttccttctcaaatctataagcctggaccctagtgttcagacacatcagatggcaggaactggatccctgggttggaggctcatggattatctctgtgttgttgtgagtgtaattctgatactattcattgccggttgtaataaaatgtcaatagagttaggtacagaagatttcccggaggatttggcatcaacggatatgtatatcctttttttttttttacattttatcctttttgtatcacacgtaacattgcaaagatacaatgatatacaacacaaattgtactcatgcatttatacatatatatattcagaatctg

SEQ ID NO: 7873 - DNA, 605 bp, Sorghum bicolor
  Clone ID: SORBI-28MAY03-CLUS15730_1
tccacgcgtccgtatagatacttggttttagttattatatacagattcatctcgtcatgtaccaaaacactcggcagtaccaatgtgtgacccccatgattcgaggatatgtaccattgtacttcttatctaccatctcttactatttatgcaatccagtaaatttggttagctgttagcctattccaaactattattattgtagacatagattcaaggtcgcaaaagtagagatgcaaacatgccttatctacttatgtccattaccgtctctactgtatttcaaactcatctcttatcttctgtatgcaggcataggttttggcatgttaggtccacagagactcatgcatatctggatgctaagtgtgttcgtaggtggttctaaccatgtgttgcacgtcacagattttaccacacttgatcgatgatcagttgaccacactgcagctctgtctatatcatgatttatatgtgttactttcctcgacctaaattgctccacagagacaatgactcagctgcaaatctgcgttatccttagacctcccaattttggtaatggaatctgcacttcagttacttcgcatctgtttctagaactg

SEQ ID NO: 7874 - DNA, 744 bp, Sorghum bicolor
  Clone ID: SORBI-28MAY03-CLUS15747_1
cagatgacctcccacgcgtccggtggggtggatcgctttaggcgccaatttgctcatttggaagaaggtaccgccaaaggtgaaaaacccagtccacagctgcgacagaatgtttctttgccaagggaaagagtaatcggcaataaacatggagatggcaatgcaggtgataagctagcccatgcctcagtgacggatggcatcagccaaccggtcttgagtgcgaggagtttgctgaagagtgaaagcatcagtgcttccaagtgtataggtgaaaaaccaaagcatgaggaatctgttttggagagcgtggatgaaacggtcgatgatgtgacgaagaaaatccctcaactgaaaacctgatttttctcaagttcactggagcaatgaatagctcgtagtatggcacgttaggttctcaagttgaggatgggcctacggcaagggtctatagccaatgagaccacaagttcttatgccagtaaatctgttgtgatgtaaattttctcccgtttttttgtacttcgtgactgcatacaacctatgtctgactgaatggcttctcgtgttttcctctgtggagccataaccataaccatatcctgtaaattttcagttggaagtggatcttcagctgcagctgatgcatatttgattttcccccagcaagtagtcctaggtattcagttaattttgtgaaattggttatggaaaatttcagttttgatgaaacattaactggtt

SEQ ID NO: 7875 - DNA, 651 bp, Sorghum bicolor
  unsure (1)..(651): unsure at all n locations
  Clone ID: SORBI-28MAY03-CLUS18519_1
gccggcctggttggggatgaagaagaccagttcgcagctccggcagcttagcagcaaccctctcctgatcctcctgttcctcacagtcacagcagcagcagcagccatggcggccgagccggagaagcaggcagcccccgcggcggtacaggagacggccgtgcacatcgtgtacgtcgaccgccccgaggacgccgaccccgaggagttccacctccgcaccctcacccccgtcctcggcagcgagcagaaggccagggacgcagtgctctaccactacaagacggccgccagcggcttctccgcgaagctcaccccccagcaggtcgaggatctcaaggagcaaccaggtgttctccaggttgtgccgagccagacttaccagctccatggtcctggtgggtctggcgctcgccagggcacgacacgcaccatgggccttatgtgaagaagacggacgagaatcaggaagactgtgttttagtatggctgtatagcacaggtctgataaatgtgtataactataagaataagggacgtatcgtctactgtatactgctttacacatgttcagtcctgttctaaagcttgtaatgcactgatgcgtatgatttcaatataatgaccagtatgctaaaaaaaaaanaaaaa

SEQ ID NO: 7876 - DNA, 629 bp, Sorghum bicolor
  Clone ID: SORBI-28MAY03-CLUS18508_1
gccggccgggtcggaacaggaacttgccatgtagttgaagagcttgagaaaatagcaatcgttcatctacttcagcagagggcaataatttcgcttatcggaaatgtgcggcaaatgtctcttatactagaaaagaccggacatgtgctgaggaaaagtggggtcaatgttcagatgatctcgcaaggagcgtccaaggttaacatgtcgctgatagtccatgacagcgaggcaaaggcactcgtagaagcccttcatcaagcgttctttcaagacgatgtcctggcgcaagtcgaagtggagaacctactcgtgggctgatcgacgtaggttgttttgtctctaggcatgttatctcaacaacggcttgaacctatcttttgcatcaaaagtatttgtctttccagcttcccagcgaatgactgcaagactttgcgtttcttgtttccaaacctggttgcagacaccagggaacaccgactgtcagcaagatggcaagcctttgatatagtaattccaagtttccaattgcctctaatccaaatttgtaaggtttgcctaaggttatgagaacattattaatatctgtaacacaaaatagatatactatgaaaataagtctcatgacg

SEQ ID NO: 7877 - DNA, 699 bp, Sorghum bicolor
  Clone ID: SORBI-28MAY03-CLUS18367_1
gcacgaggaagcgctccggggtcttccccatctcgcgctgcgctactgccgcggctgtcccgagtcccgaccaccgtcctccgctccccgcccttcctcttctcctcccgcgatggagacctgcccctcggtgaagaacatcctcttgctggactccgaggggaagcgcgtcgccgtgaagtactacagcgatgactggcctactctctccgcgaagctggccttcgagaagtcggtctttgccaaaacccagaaagcgaatgctggaacggaagctgagattgtaatgtttgatggtcaaattgttgatggagggattgtacttgaaacagaaggaagagagatagctgaaaaggtgtctggtcatggattggagggtgcttcatcagctgagcagactctagtgaatgccctaacgcaagcaagagaacatttcgcgaagtctcttctcatgtgatgctgtgctttatactttggggtgacgatggagtatcaattattgtgtctggacaacatattctttttgttagcaacggagaaagaaaaatgtctgaaatctatgaatgtgtagaatggcatggtgttcctgaaattctcatgttcatttgtaagctttcaaagttgtgtagcatgaatattctaattttgactggctcagttattggtcgttttgttcaacctgttcctgttggaaatggt

SEQ ID NO: 7878 - DNA, 626 bp, Sorghum bicolor
  Clone ID: LIB5047-005-R1-XP1-B2
gccggccgggctggggaccaccgtcctccgctccccgcccttcctcttctcctcccgcgatggagacctgcccctcggtgaagaacatcctcttgctggactccgaggggaagcgcgtcgccgtgaagtactacagcgatgactggcctactctctccgcgaagctggccttcgagaagtcggtctttgccaaaacccagaaagcgaatgctggaacggaagctgagattgtaatgtttgatggtcaaattgtggtatacaagttcatccaagacctgcatttctttgttactggaggagaagaggagaatgagcttattttagcatcagttcttcagggattctctgatgctgtcgaacgacttctcaaaaacatggttgacaaaaggacagcacttgagaatttggacctgatcctgttgtgtcttgatgaaattgttgatggagggattgtacttgaaacagaaggaagagagatagctgaaaaggtgtctggtcatgggttggagggtgcttcatcagctgagcagactctagtgaatgccctaacgcaagcaagagaacatttcgcgaagtctcttctcatgtgatgctgtgctttatactttggggtgacgatggagtat

SEQ ID NO: 7879 - DNA, 730 bp, Sorghum bicolor
  Clone ID: SORBI-28MAY03-CLUS1852_1
gccggcctggccgggcaaaaatcttggagaagtaccagaccaactctggaaagatactgtgggatgagaagcacaagagccttagtgccgagattgatcgtataaagaaagagaacgacaccatgcagattgagctcaggcaccttaaaggtgaagatctaaactcactgcaacccaaagacctgatcatgattgaggaggcacttgataatggactgacgaaccagaatgagaaactgatggagcactgggaaaggcgtgttgcaaacaataagatgatggaagatgagaacaaattgctggcctttaaacttcaccagcaggatattgcactgagcggcagcatgagagagcttgagctgggttatcatcctgaccgggacttggcggcccagatgccaatcaccttccgcgtgcagcccagccatcccaacttgcaggacaacaattagacggctggaataccccccattccacttgccgtctcatttgaagatttcacacaccaccactggcttgtatgtcctctcatgcgttgccaactgtatcttttctttccagtatgtttggatgaatgtataatgtgtgtcagtcgatctttagcacacgttctcagctggtctatcctccttcaggatgggcgcagcagcagaactgcaacgtgagtaacttgggactgtatgactgtgtatccactgcatctgccggacgtgaatctatgcgctactaa

SEQ ID NO: 7880 - DNA, 704 bp, Sorghum bicolor
  Clone ID: SORBI-28MAY03-CLUS18806_1
gcagtggattaaatcactggttgtggccgacgacatcctgccaaagcctccttggttggcattttatcgcaccttgttcaaagtttggtgcagttgacttgtgacatgtgctgcgatatactataacacatgtgacgtttgtgatgtgtatgtgatgtctgtgatatatatgccatctctgtactatgacataaaaaaaaaaaaaaaaaaaaaaaaaaaaaaaaaaaaaaaaaagggtagtttcaatgagactcacttatccttctaccattcctacttagtccaacatcctcacatagctagagctttcaactccttgtcttttgaacataaattcaattgggttgcaaagcacattgcagacaactatcctgggcagtaagggtaagttggatgcttgggatggttcttttgttagtaccacatagaactttatatttgtggtctaagtatgcttgtaccttgctatgtggacgtcttgaacttgctatatattgtgtaagacttgaacttgatgcattgtgcaagcatcagacttgatattgctatgtgtaatgtgcctatggatatggcctaagacttttattgctaatatggcaagactttttatgtggttagaaaaaaaaaaaaaaaaaaggcccctgcatggtgcaagcatggaaaatattgctatgtgttgagcacaaattatatgttggttgctc

SEQ ID NO: 7881 - DNA, 477 bp, Sorghum bicolor
  unsure (1)..(477): unsure at all n locations
  Clone ID: SORBI-28MAY03-CLUS1883_1
atcgccctacgcgcaggcggaaggaagggggagcgcaacactcgcggtcgcggggagagagagagagaccagggggccggtcacacacacgccgaccgcgcgagctagcgagatccccctctcccgctgccggatccgatctcacctgacctcgtcgccgcctgccgtgggagggagaagaggaagaggaagaggaggcggcggagatggcaccggtgtcggcgctcgccaagtacaagctcgtcttcctgggggaccagtccgtcggcaagaccagcatcatcacccgcttcatgtacgacaagttcgacaacacctaccaggctactattggtattgattttctgtacgatgacaatgtaccttgaagatagatctgtgagactccaactctgggatacagctggtcaagaaaggttcaggagtttaattccaagctatatcagagattcttcagntgctgtcatagtattcgat

SEQ ID NO: 7882 - DNA, 837 bp, Sorghum bicolor
  Clone ID: SORBI-28MAY03-CLUS15914_1
cgagaagtggagataatgcagcactcaagcatctcatagatcacttatcagctgaagaaatgcaagagcatgttcggatagcaaaaatgcagtgcctcttcaattcctatccatggacccttacattgaaatcggtgcgccgcctgatcttccacctgcccactacatggaaaggggtttattccgatggagactttatggttcattttgctggtctggatgacaagcaaggttggacgaataagattcttagagagagaggaaattgaagatgagctgatttaaattcagttatagtctaaggagcaatcagaagattatgcaaaggccctgatttatctgatctattcagtggtatacttatagacagtacagcatgtcaggatgccattgtcaatagtcaaaactgtggcatctggaaggtctaaccgggcaaccagaagtttgtgtgaaggccttgactgacatggtatttcgtgttgtacacaccagggcatcaggatgctgctgtcaaaagtcacaatcctgccatgtacacgatctacacagggttcgttcacttcctgttgctagtgttaaaccgttattacccaaacacaacagaagctgcatatcattggcagccctggaggaataatcaacattagcatctgcataacagaactatctaggcaacagactgggttttgtgtaataggctaggacactcccatgctgtacatggtttcatgctaataattgtcattattgattggtctacaagcagtatcgatcagtgacaagcatatgttgtatgtccaaaacattaacagctattaaatcacaatactcccatct

SEQ ID NO: 7883 - DNA, 730 bp, Sorghum bicolor
  Clone ID: SORBI-28MAY03-CLUS15923_1
cggaagcatgaagatcattgcccgcaagaagaacattttcaagctctcacaaggagagtacgttgcggttgagaatctggagaacatctttggtcaaactcctggtgttgattcgatttgggtctacggcaacagcttcgagtcaagcctggttgcagttgtgaaccccaacaagcaagcactggaacgttgggcagagtcgaacggggtaaccggagactttgccacgatatgcgaagaccctaaagcgaaagagttcgtcttgggagaacttacaaagatggggaaagaaaagaagctcaaaggcttcgagctcatcagggctgttcatctggaccccgcaccattcgacatggagcgcgatcttatcaccccaacgtacaagaagaagcggcctcagctgctgaaacactatcagagcatcattgacggtatgtacaagagcatgaagtaggctcggcacagctcgacctgttgcagcacggcaggagaatcaaagtgcactcactgctagccggtgacttcagcaaacagactctaatgtgaatggagattatttattgcgttaaattgtgtcattaaaaagttatgctacatgctgttagctagaaatccctcctgaaattggcgtacatagtggagctgcgtgaatgcgcccgtcagtgtttccatataaatacgcagcaattctgtaattcttttttttagctcaagtaaacagtaattctgc

SEQ ID NO: 7884 - DNA, 676 bp, Sorghum bicolor
  Clone ID: SORBI-28MAY03-CLUS1582_1
ctcgatcatgtactaagctagcccgtcaagggaagacgatataagaagagcaaacatggccatcaccagcagctcctccggccagtgcaactcctgtccatggcgcttcgccacggtaactctcctactagcactagccgccggcagcctcctcccggtaccggcgttggcgcgagggtcctccgaggagcaggaccaccagcagcgtgaggacgacctgatccggggcctgccggggctgccgcccaacgacgacgtgccgttcgacatgtacggtggctacatcaccgtcgacgagcaggctggccgcgcgctctactactggttccaagaggccgaccgcaccgaggtcgaggaccccgacgccgcgccgctcctcctctggctcaacggcgggcctgggtgctcctccatcggcggcggcgcgctcgaggagctcggcgccttccgcgtccacacggacggcgagaggctgttgcgcaatgagttcgcatggaacagagcggcgaacgtgctgttcttggagtcgccggccggcgtggggttctcttacagcaacaccagctccgatcttgtcgtcggcgacaacagaacggcgcatgatgcgtacaagttcctggtgaaatggttcgagaggttcccaaagtacaagtaccgtgatttctacattgctgga

SEQ ID NO: 7885 - DNA, 553 bp, Sorghum bicolor
  Clone ID: LIB5121-008-A1-PF1-F6
actttaagcagctcagtctagctagagcaatagcaaacatgagctcctccggccagtacagctctccacggcgtgccgcgacggcaacgctcctcctagcgctagccgccggcagctttctcctcctgccggcactggcacgagggtcgtcgtcgtcgtcgtcgtttgaggaggaccgcatcagtgccctgccggggcagcccaacgacggcgtggcgttcgacatgtacggcggctacgtcaccgtcgacgagcacgccggccgggcgttctactactggctccaggaggccgaccgcggcgaggtcgaggacccggacaccgcgccgctcctcctctggctcaacggcgggcctgggtgctcctccgtcggctatggtgccatggaggagctcggcgcgttccgcgtccacaccgacggccacaggcttctgctcaacgagtacgcatggaacaaagtggcgaacgtgctgttcttggacgcgccggccggtgcagggttctcttacagcaataccagttccgacttactcgtcgccggtgacgtctccac

SEQ ID NO: 7886 - DNA, 742 bp, Sorghum bicolor
  Clone ID: SORBI-28MAY03-CLUS15953_1
ctgacctccagacgcccgtcggcttcgacgcctatgggtttgggtaccgtgacgtcgatggcgccaaggtgactaaggcttggagggacaagtatgctgatgaggggtatggggaaggagatgtgctggggttctacatttctctccctgatggggagcggtatgaaccgaagcagcctgacctgattcagtacaagggaatgccgtttcatgtgcaagtccccaaggaggagcagaagacgccggaacctgtccctggaagtgagatatgctacttcaaaaatggagtatgtcaaggcagtgccttcaaggacattcctggagggaggtactacccagccgcgtcactgtatacgatgcctaacgaaccaaactgtgttgtcaaattcaactttgggccagactttgagttcttcccccaagactttggaggcctgccagttcctcaaccaatgagcgaggtgcctcatcaggcacatgaagtgaagaacgaggggcctgtggagaatggcgttgctgaaaaaactagctagtgtaattatcatgctgttgtaactagtacccagtgtaaacaccaagcaagcccatggagattatggataagttggctgcagcagttatctgactggattaatgcttgtggtgttactaaatgggttccatctttcctctccttggctgtgttttgatgttattgtggtgttgctgatcgtagagttttttttttttttttcatctgatc

SEQ ID NO: 7887 - DNA, 889 bp, Sorghum bicolor
  Clone ID: SORBI-28MAY03-CLUS15981_1
tgttggccactggacagtatgagaattctttgctggcgagccttgtgaaatttttcattgtgttttggaaagcaagtcattcctggaaaagatgattgtgattgaacacaccttgcctttctttctgcccatacgtgaattagaaagtgatctcttgtcatctaattccattaaattcattgatcatcttgaagaaattttacaggcttatattgacaggagagagcaggttcgtcttatcaaggagctctacgggaaccaaattggcgagctgttccatagtcttccttacaatatgatcgagtttgtattggaggattttgagtgcaaggttacaatcagtatccgatattcggatctactgcagaccctgccgagtcaagcaagggtcttggcttggccacttcgctcggccaagagaatatccacaagaagcagcagtgcatcagctgcgcaaccagtaccttttcacctttcatacgccgaggaagcactcaagaccttgtgtctaccagaagcatacgcagacattgtgctggagctacctcatgctctgaagaggattttctcctctcgggacagtgactgaatcctgacctcaaggtctctgtaagattcacatctcaatcttgggaggtgggacaggtgtttgaagatatattgttgagaatcttgtggtagtatagcctgcagttgtggactgcaattcctgtgaaagcaaggcagacacatttgctccgttgaccgctctaaggtccagcccggggcgaaaaaattttcgagctactgtagcattttcgtttttatgtggcaattattgttcaattatggactaactggactcaaaagattcgtcttgttaattacagataaattgtgtaattagtta

SEQ ID NO: 7888 - DNA, 784 bp, Sorghum bicolor
  Clone ID: SORBI-28MAY03-CLUS15539_1
gcacgaggctgccggccggccagggacgtttccgcctgcgccgcccttctcctccgcgcgacctcctcttccttctctgcggcgggcggcggcgagggagctgcatctgccgtcgcctgtaggagtgggaaaccgatccgttctctccctctgttccacggatccaccctcgcgaacccctgcagttccaggcaggctgtagcgagcgccgcagccgcccgtgacctctccccaaagcacccggttgcagccgagcagctagtagcatgggggaggaagacgatgatcctgactggctccgcgcgtttcaggcaccaagtgtggcaccagtgatgctttcttctgggtcagatggctctcgtgaagctagtcctacaagaaccagtgcatctagagaacaagaaaaaggagaaaagcaggctagtccggatcatgcaggtgatagaggtggcgcttcacaaaataaaagcaaaatctctgcagctactagaagaaaaaccattggcagtaaaaaagagggatcaaccatggataaaaagcaagctaatactcctagacgctcgactccaaagaaggatacggtaacactttcatctgattctgatgcttccctcggaaacagcccttcaagggctggtgaagataatcatgaagaggactcacttagcgctgcaaagagaaaggatgctcagcaaacaaagactaaaaaagcaacggttgctggaaacaaagctggtccagaaacagcagacggagatgctgaggatgatatgccagataaact

SEQ ID NO: 7889 - DNA, 728 bp, Sorghum bicolor
  Clone ID: SORBI-28MAY03-CLUS15542_1
ctgacaccgtggttcagtttttgggtagataataaattaaaaaaaaaggagagagatggcactgtgtcgccgcatggccgcaccattcttcctcgtccttctcatcatcgtcgcggcagagacagcgacggccagggtggtcgtggaggagaagcactgcctgtcgcaaagccactcgttcagtggcatgtgcttcagccacaccaactgcgacaacgtatgcaagacggagaagttcacaggcggcaagtgcaagatggacggcacctcgcgcaagtgcttctgcttaaaattctgctagggaatgacctgcggtacgtcaacaaataaagatttgtgaagcccagccgtcgatcatggcatcacgtcaacctgttgatttgttcctcgccgtctctgtgaggccatggtggtcgccggccggctggttcctccgtgctgatctggtggcagctaccgtacgtttggtttactgaatgtgcgcgcgatcatgcatatttgctagtgtattctatttgcgaaacacgttgtagttaccgtacgttcgttttgctgcatgtgtgcgcggtcatgcatatttgctcttaagttttattagtatgggctgttcgttattttctagtgtattctatttttgaaacacgttctagttaccgtaaatatgtatttgcgttgcttggtggccaacgatttgccttattgtacaaaaaaaaattatatagtttgag

SEQ ID NO: 7890 - DNA, 626 bp, Sorghum bicolor
  unsure (1)..(626): unsure at all n locations
  Clone ID: SORBI-28MAY03-CLUS15620_1
ctttgctccagctggcgctggggtgaatcacaacatcctaatcaccaatatcccattgggctcactcctctatggccagattgctgccatggtatacgatggaaatggccaaaagatgacagtaatggataaccgcactggcattgttgaaaccatgattgtgtgcatggggatgaagtgctactcaaccaccttcttcctgtgggcttgcatcacatttctagggttagcatcaagcatagctctattcatacgaacaaaaccagcttatgctgctgctgctagccggtcaagttgaagcaccttcaccaattttccagtttgcagagaaactcctttatcagttccttactgatttcaagccacagttagcttgtacaaaaattggcttagttctaggtgaaatgggctagatacaatacacaaaatgaataccacggcaagagacatcaagaagatacgaaattatcagcctatcagctggtatgtaaagtactatcagtattaccttcactaggattaatactaacaagtaggcccaaggttggatgaaggcagtttggaatgtttattactgatngactgagacgtgtgcaaaatcgtctgtatttacttgttgtatgtac

SEQ ID NO: 7891 - DNA, 619 bp, Sorghum bicolor
  Clone ID: SORBI-28MAY03-CLUS15536_1
ccgtcgtggcgggcgtcgtcctcggcgcgcacacccacgagaagcggtccctcgtcgtcggctgcctctgcgtcttgttcggcacgctcatgtacgcctccccgctcaccgtcatgaagaaggtcatcgccacccagagcgtcgagtacatgcccttcacgctctcctttgttagcttcctcaatggcatctgctggaccacgtacgcgctcatcagattcgacatcttcatcacgatcccgaacggcatgggaacgctgctgggcttgatgcaactgatactctacttctactactacgggtcgacgcccaagagcagcggaacgacggcgggcatggagctgccggtgaaggccggtgacggcgacagcaattaactagatagtacgctgcctgttgctagatagccgccgccggcaggcttgacgacccttgacgatgatgtccggcggtccatctctgtgtgtgtacgtactcctacgtacgtaggtaggtgtgtggctgtttttacagtagtatatgaacgaaactgcatggcaatgcatgcacaggcgcatgcttgtattgtagggctgaaccgaattgctgtcgttgcaggcgacgaccacgcgtgctaata

SEQ ID NO: 7892 - DNA, 370 bp, Sorghum bicolor
  Clone ID: LIB3480-042-P1-K1-B1
cgacatcttcatcacgatcccgaacggcatgggaacgctgctgggcttgatgcaactgatactctacttctactactacgggtcgacgcccaagagcagcggaacgacggcgggcatggagctgccggtgaaggccggtgacggcgacagcaattaactagatagtacgctgcctgttgctagatagccgccgccggcaggcttgacgacccttgacgatgatgtccggcggtccatctctgtgtgtgtacgtactcctacgtacgtaggcgacgaccacgcgtgctaatataactcgtttgtcacttgttgacttgttggttgtttggaatgtacggagcattcgttctatatatatctcggattctgg

SEQ ID NO: 7893 - DNA, 634 bp, Sorghum bicolor
  Clone ID: SORBI-28MAY03-CLUS15671_1
gccgctggtgatgcagtaccagcccaacatcgaggccaggctacagtaccttcgcgccaacgccggtgacatcctcgtcttctacctcaagaacttcaccgagaggggctacgacctcttcctccgggtgctcgactacgtccggtcgcaggcgtccaaagggtcaagaacacggagattcttctcgttccgaggggaacgggcggagaggccaagcttcgccgacgacgactatgccaccggcggcgaccggagggacgggggaaggcaccgccggccacgtagtggctactagcagaccaagacaccaagtagtcaattgatgtataggatgtgcacagagacagaaacgattactcgcgtaggattaggtaggatcaaatcaagcaaaccattgtgaaccagattgatttgaacacagatggcttatggacaaaacttgtaggattctatcttttcaaagggtaggaaacgtttgattatttgagcaagtatgtttatcatctgacattctgatctcaatgagctcactgatggcaataatggcattaaacaaatcagaatatctgttaattgtaatttgtaacatgccagattgaacggaagaaactttggaagttctgcacaaaattcc

SEQ ID NO: 7894 - DNA, 716 bp, Sorghum bicolor
  Clone ID: SORBI-28MAY03-CLUS15684_1
gcacgaggactcagtctagagctgctctccccacatcacaacatgctgaagttggtcatactgaagcagctgtggatgagaataaacatacgggagcaggggaggttactgctactgtaatggacgatgatgcagtagaaaagagtcatcaagacccaagaacctcagagacctgtagtcctgctgaacctacagacaaagtggagaaacctggaagtgctgatgatgtgactgaaaatcgtccagaaaaagtcccagctgttgagaccagtgatactggtttcgtgtttgaacctggttctgtgcttgtggagttcatgcggaaggaagctgcatgcatagctgcacattccttgcatggacggcgcttcgggaacagaactgtgcatgctggatatgctccatacgatctctacttgcagaaatacccaaggtgattctgcgtttgagactgcttttgctgctcggatgagctatgatgcaaactttgcctatgtgccagtagtttttagagacttcagacttgtagttttgagccttttggatggttgctccggtccagatagtggtaccgttagttgaacgaagtattgggaaatgttgttccacagtagatattggatgaacaataggatactggatagagatactgtagtggttgttaaccatccttcttaactttgctattaatatttttgacatcagtaccaggagat

SEQ ID NO: 7895 - DNA, 1022 bp, Sorghum bicolor
  Clone ID: SORBI-28MAY03-CLUS16192_1
gcacgaggccctccctagctgtgtcctgcctagcggtatcaatacctggctgcagctcaccacccaccaaccacaccacaccagagttcccagctcccatataaccactgatcagcagcaactcaaggctggctggggaagttcagagtgcggctacaccatagtatacctctgtaggcagatcagtgtgtcgttgcagaggagggaagaggaccagccatggcgacctccttccaggggacgaccaccaagtgcaccgcctgcgacaagacggtgtacctcgtcgacaagctcaccgccgacaaccgcatctaccacaaggcctgcttccgctgccaccactgcaagggcaccctcaagcttgccaactacaactccttcgagggagtgctctactgcaggcctcacttcgaccagctgttcaagaggaccgggagtttggacaagagcttcgaaggaactccaaaggttgtcaagccagaaagaaacgttgggaatgagaatgctgttaaagtctcaagcgcctttgctggcaccagagagaaatgtgttggatgcagcaagacagtctatccaattgagaaggttactgtcaacaacactatgtatcacaagagctgcttcaagtgctgccatggaggatgcaccatcagcccttctaactacattgcgcacgaggggaagctctactgcaagcaccaccacattcagctgatcaaagagaagggaaacttcagccagcttgagaatgatcacgagaagacgtcacaggctgggtcactggaggatgaagaagagtattaatcactgagcactatcacagatgaataattaatcttcttgcatttgcttagagcactatatatttctgtggcatggttcgatttcaattttaccaatggagctcatgtgcgttcagagaacaatgaaattatcgtcttgtatctgcatgtaaacctttgttatctttgagtcaaatactctacctgtttcaccaaaaaaaaaaaaaaaaaaggccccaa

SEQ ID NO: 7896 - DNA, 780 bp, Sorghum bicolor
  unsure (1)..(780): unsure at all n locations
  Clone ID: SORBI-28MAY03-CLUS16176_1
ccgggagactctccctcccgcagtcccgctctccagtctccaccgccaccaccgacgccggaatgaaggccgtgccagccgacagcgccgcgtccccggcgccggcgaccaagatcaacatgcccgcggcttccgcggccggcggcgcggaggcggcgctcctcgggaagggccggtacaaggtatgggccttggccgccatcgcgctcctcgcgctctggtccatgtccgccgcctccgtctcgctccgctggtcctcctcgggcgacctcgcatccgtctacggcgacctggacgtcccgctcgccgacgacctcgattccctcgagatggaggagagggagaaattagtggggcgaatgtgggacatgtacacacggaccagtgatgaggtacggcttccacggttctggcaggaggcgtttgaggctgcatacggcagacttgctggcgatgatgtgcaggaagagcccgaattgagcaacagaggtggcagctcaagcagacactgatagagaatgaggtatcggttgccgtgagcaacgaaggtggcttggctgaaaagaaatggcatcaaagtattttgatgtgactattactaaactggttggcttcgcgatctgtacatggtaggtcagcattttgcatttattgcacttaaacaggctactatctgcatctgtaccagcaaaatttacaaggtgcacctatggaaaaaaataacaaaactatcaagttgcactacaatttagtgagagcnaatgcgtatggatccatact

SEQ ID NO: 7897 - DNA, 405 bp, Sorghum bicolor
  Clone ID: LIB3480-055-P1-K1-B3
atgatgtgcaggtgcgtgatgcagctatctctgagattgcccgaatgtcagcccacaaacttgaactcgagcagacactgaatgagaatgaggaagagaatgccgtgagcaacagaggtggcaggtcaaaggcgaattagtagttccacaaatatctgtggcctgaggacctgaagattgcttggctgaaaagccatggcatcaaagtattttgatgaaattattactaaactggttgttcactggatctgtaccaagtagatcaacaaggtgcatttatggcactgtgtaacactactatcgccttgtttagttcgcaaaatttttcaagattccccgtcacatcgaatcttgcggcacatgtatggagcattaaatatacattaaaacaaaaactatttacac

SEQ ID NO: 7898 - DNA, 707 bp, Sorghum bicolor
  Clone ID: SORBI-28MAY03-CLUS1633_1
gcacgagggtcccaagccccgtgccggccgggccgggacaatcccccaaaccccaacaaccatcgcaacaatggcggcgccgcctgtccagcccgtgccacccgcggctgcggcggccgtgaacggggacgcgttccgcctgggcttcgtcggcgcgggcaacctggccgagagcatcgcccgcggcgtggcggcgtcgggcgtcctcccggcctccgccatccgcaccgcgccccaccgccgccccgagcgcggcgaggccttcgcgtccttcggcgcgtgcttgctccaaaccaatgcccaggttgtcgacgacagcgatgtgatcgtcatctctgtgaagcctcagatcgtgaagcaggttctacttgagctgagaccacgcctgtcggaagaaaagcttttggtgtccattgctgccggcatcaagatgcaagatctgcaggattggtctggtcaacgacgtattattagagtaatgcccaacaccccttcagctgttggacaagctgcatcagtcatgtgcttgggagagatggcaactcaggatgatgaaaaccgtgtaaggaaactattcagtgctattggaaaagtttggacagctgaagagaaatattttgatgctgtaactggccctgagcgtagtggtccagcctacattttcttagcaatagaagccatggctgatggtggagttgctgctgggc

SEQ ID NO: 7899 - DNA, 800 bp, Sorghum bicolor
  unsure (1)..(800): unsure at all n locations
  Clone ID: SORBI-28MAY03-CLUS16398_1
gaagaagaccgnngaaactcgagctccatctnaagatgaaaaagaaagagaaagatgcatgtcaaagtgcaaaagggaggaagcaaagatcacagcttgggaaaatctacagaaagcaaaagcagaggcagctattcggaagctggagatgaaacttgaaaagaaaagatcatcgtcaatggacaaaattttaggcaaacttcgctctgctcagaagaaagcacaagacatgcgaagtgtagtttcttctagtgaagatcagtgtagtacgaggacaaccaagaagaaatcttcctttgtcaaaactggcaagcctttcagctgctgctttacctaccgtgcttgctagttgtggcacagttggtgcctctggatccagcaatgaatatagttctattgatactagcagtgtctatctttctcaagagctcttctcaggctacagttatggatgtgaagtcagttggattttgactacatggtctaattgtcaatgagatttgcacaatctgatgaacaagatatcattatggagcagcagatgaagaaagtcattgagcgaaatccactcatgtagctaatggcgtggactcctgaatactgcagtatagtctgcgacaatgaactgtacacccggtagaaaaagtccgtttcatgagcttcatgctagttagaatctgaattgagctgatattcatcccgcttgatgtgtagctttacctggaanttgtgtatgtaacccaaatcatgggcccattacacgtaatgaaaaaaaggtcagggctgcgcctttataatgc

SEQ ID NO: 7900 - DNA, 1064 bp, Sorghum bicolor
  Clone ID: SORBI-28MAY03-CLUS16445_1
gtgtggatgccaatgatactgacggtaatgatatgcaaactgaagatgattacaaacaacttgggctgaaagttgtatccaatttaggtgacgagctacaaaatgtcaggaaggcagcaatcctggatgcagatcaattgacaatgtcagtagcaagccttggccacaagcttggcaaagccaaagaattccttaacacgagcatgaaaagtctggatgaagacagcaggtttcaccacaagctgaagcatttcgcagagcagtctcaaactgatgttgctttgttgctagaggaagagaagaaaatacggtccttggtccggggcactgttgattatttccatgggagtacagggaaagacgatggcctgcggttgtttgtggtagtgcgagatttccttgcaatgctggagaaggtttacaaagaagtgaaagaagcatcaaaagtggctccaaagaaaacaaagacccctcaaccaccccaagcatctttcaatgatcccaggcgcaagctattcccagcaattcaagaccaaaggacagacagttcaagctcaagctctgatgaagacgattagcaaggaaccggttgtcttcccctccaaagtgcactgaatggacccttccaaacaatagtgcggtgatacaaaataaatgaaagttgatggggaatgattaatcaacgctattttggccattcactgatcgacaatcaaattgggaaacctgggcacctggcctgactttacacactgttgtgttggtaatggcaaatcatcagacctgatctggcattcttggccaagggggttgtttggcactctatcccatcgagcaagaaggatgatcatggtcgagacagcacctatctgaaaggtgactggaggaaaatgggcaattcaaaggaaatggaagaaaactgactctagtttagagccggtgtaaatgcaggaggtagtctgactaatactgttcttctgttcactgtacaaatgtaccattgtacaaaacacaaaacacagagaaatgcagcgcagacttgtgaatccgatggctttgtttgt

SEQ ID NO: 7901 - DNA, 712 bp, Sorghum bicolor
  Clone ID: SORBI-28MAY03-CLUS15728_1
cggacgcgtgggttcgcatccgtccgatctaaccgtcccaccgctcaaggcaggcgaggccttgcgcggctgccctggcccctggcgctccgtccctccgcggcaccgtaccgtaccgtccgacccgaccatggctgctgctgacccggtcaagaagccgtccgccggcggcaaggcgacggcggcgccgcccaagtcgtccgactccggcatcatgaggaggctcccgcgcctggcgttcgtcttcttgctggcgctggtgtaccggcagctccaggcgccgccacccaagatccccggaacgcccggcggtcctccggtgacgtcgccgaggatcaggctcaaggacggccggcacctcgcctaccacgagtccggcgtgccccgggagcaggccaagtacaagatcatcttcatgcacgggttcgactcctgcaggtacgacgtgctccgcgtctcgccggagctggcacaggagctgggcatctacctcctctcattcgaccgacccgggtacggcgagagcgacccgcacccgggtcggtcggagaagagcgtcgccttggacatcgagcagctcgccgacgcactggagctcggccccaggttccacctcgtcggcttctccatgggcggcgagatcatgtggagctgcctcaagtacatcccccacaggctttccggggtagcgatcctgggccctgtgggcaac

SEQ ID NO: 7902 - DNA, 1129 bp, Sorghum bicolor
  unsure (1)..(1129): unsure at all n locations
  Clone ID: SORBI-28MAY03-CLUS15807_1
gcacggcgcgggtgcttcgtggcttcggcggcgtgctgcgttactggtgggggtggcacgctccgggaaccttccgcgtgcgctgccccccccgtccggttgccgctcctgcctttcagctccttgcccgctcctctccgtggggctctgtttgtgtccccttgctgtgtggctgccccccctcccaaggcttccggctgcccttgccgtccgcgggcggtgctgggggcttccagttgagccgctgccgggcggcggtttcccccagctccgtgccggttttcggcagggctggcctggggctcggggtcggcgtcgagcggcattggtgttgcctgggttccgatggtgggccggtcgggttgcaccaccgccacttttctgtactcagatacctgatgccacacctatgcaaagcgcactcatttgggctgtgctctccatcgttgtactgatctccctgtctgtcttgtttggctcaccatactcagctggtgttgaatggaaacttctgaaagctaccatgatcacttccatctccatcgggttggggctcatgtcaataataaattttgccactgctcagcttggtgctctgatagtgatcccaatgtgtttgttttctcggcctctgaaggcatcagagatgaatttccttcctcgggcagttttgttggcttcaaatatagcctttgctgtgttgggttttcctccagctgcgttgctgattatgaaaggagtgtccaaggggtcgtggtcgtggacaatagatattggagatttctgggtatggatggagtttctgtgggaatggagcagcgcaacttatctgtacctatttcttgtccatcttccctgctggcttctgtgcatccttgtgttgctgcacccatgtcgccaatcagaatctaagatgaagcaggaatagctgtttggcatccagagtcttttctttggtaaatcttgtaggctagcgtagaaatttctcactttcagaatttttagtctgctgatcatttactcggctacccataatttggaaattatcacccagttggaaaaggcnttgtaacnatgtgtagtatcctggcctcatgtaatggccgcaacatattttaaggcatgtttt

SEQ ID NO: 7903 - DNA, 697 bp, Sorghum bicolor
  Clone ID: SORBI-28MAY03-CLUS15775_1
cccacgcgtccgaagaccttcttcgccgcggggcaggaaaccacggccacgctcctgacctgggccatgttcctgctcgccgtgcacccggagtggcagcacaaagtcagggaggaggtcgtccgggaattctcctgcaccagcgacggcgacggcgacgaggtcccccacgccgatgttctcgccaagctcaagctgctatacatggtgttgctggagacgtcgcgcctgtaccctcccatcgtgtacatacagcggagggctgcatcggacgccgtccttggaggcatcaaggtgccccagggcacggtcatctcgatccccatcgccatgctgcaccgggacaagcaggtctggggcctcgacgccgacgagttcaaccccatgaggttcgagcatggcctcacaaaggccgccaaggatcccaaggcgctgctggctttctccctggggccgagagtgtgcactggccagagcttcggcatcgtggaagtacaggttgtcatggcgatgatcctcaggaggttctccttctccctctccccagagtatgttcacaagcccaagtatctcctgtccttgacacccaagcttgggatgcctctcatcgtcaggattgtggacggctgagaaagattgtaaaagctcgttcttgtgtgtgaaaatcaaaatatatatgatgactagtgtgtgtgat

SEQ ID NO: 7904 - DNA, 639 bp, Sorghum bicolor
  Clone ID: SORBI-28MAY03-CLUS15854_1
atctcatctcactgaagcacgctccagcggtagatccagagctagagaagaagacagcaatggaggtggacggggggaagaagaagatgctggccaccctggtggggtgcaactacgccggcacagagtacgagctgcagggctgcatcaacgacgtccacgccatgcgcgccgtcctcctcgaccgcttcggcttcgcgccggccaacgtcaccgtgctcaccgacgaccacgacgacagcggcggcggcacgatcccgaccggcgccggtgtcaggcgcgcgctgtccgacatggtggcgcgcgcggcgcccggggacgtgctcttcttccacttcagcggccacggcacgctcgtcccgccggtcgtcaccggcagcggccatggtgaccgcgacgacgaggccatcgtgccctgcgacttcaacctcatcacagacgtggacttccgggagctggtggatcgcttgccgcgaggcgccaccttcaccatggtgtccgactcgtgccacagcggcggcctcatcgaccaggagaaggagcagatcggtccgaccaccgccgccgccgactcctacctccacggcggcgcgcgcgccgcccggttcctcccgtacgccgcggtgcttggccacctgt

SEQ ID NO: 7905 - DNA, 711 bp, Sorghum bicolor
  Clone ID: SORBI-28MAY03-CLUS15903_1
gatgatgacccggtacagttgcttgtcttcgctgcttatcctcggttgcgtgggcgatgcagtacctgggttccagccattgcttcgtgggtgtgctcctcgggccttttcttaggctccgtgccttcctcgtgatggcgtgtggtgaggggtccaggtttcctcggtcataatgcagattgaaggactaaaacgccatccaaggtatggagctcgaattgagagcagcacatacaagggcatgtaccatgccttaaaggagattgtcgcaaaggagggatttggaggcctttataagggccttttcccctctttggtgaaatcggccccagctggtgctgtgacatttgtggcatatgaatacatctcagactggatagggagcaaggcaggagttgagtgaattcttgttggatcatggagctgtcaggataccatgacgaaaacttttgcacagcctggacatggatggtgtccagccgtccaggtcaatcgtgaagtgcatacaattcctagagatctgatacatgtaaagccttacatagaaaagagctgttttgtcatttcttattctttaccccaattgcctaatgtggtggtagggcattcgttgccgtgtaaaacaaggctgagtaaaactaacatagtgatcgtgacacatcactcatgacgaaagtcaaaagcagccggcagttttgttgggatcgtgtt

SEQ ID NO: 7906 - DNA, 692 bp, Sorghum bicolor
  Clone ID: SORBI-28MAY03-CLUS16885_1
gccggccgggctgtcgaaagtcggtgactggactctccccttccatggcaaggttgagtatgtacctcagctcaagctctggtttggcctctcagccggtgcccagcaattggctgctgttgacctttctggcatgctggattcttctccccagccactgcggctggtgggaggcccttggaaggagcttgttcatctgccacaggaatggaaggagtgcagggatcctcagtttgtcagcctgggttccggcaggttctgcattgcaaggctcttcacccaagaagctgaagcaggctctggttgtgatcaaatggtcctcaataattttactgtcttgactggcgtggagatcaatagcagtggcaaaggtggcacagggaaattggaactccaaatgaccactcacatatcaagacgtgtcaacaacactagcatcgagacattattctaactaattatggtgcttcgttcaccagactctctgttttatctattatccgtgccttgaggcaacttaattgtcatcatatagaacttagaaatggaagcctgccgctagctgttgcaccatttaatattctcctgtagtgatgcaaaatattacccaattaagtttaagctatcttattaagttgattcccttaccgtttaagtttaaatcggaaaaaaaaaaaaaaaaaaggccccta

SEQ ID NO: 7907 - DNA, 890 bp, Sorghum bicolor
  Clone ID: SORBI-28MAY03-CLUS1681_1
aatgccttgttcttccaggcctatgcgtattggtcctgcagcaagtaggaaaaatacaggaggtgttgttcaagagagagtaccaaattctcaaggagctcagtctgagaatgatcctaacaataccaccatatttgttggtggtcttgaccccaatgtcactgaagataccctaaaacaagttttttctccttatggcgaagtcgtccatgttaagatacctgttgggaagagatgtggttttgttcagttcgttaccagaccttctgctgagcaagcgctgctaatgctgcaaggggccttgattggtgcacagaatgttcggctttcatggggtagaagcctgtcgaacaagcaggctcagcctcagcaggaatccaaccaatggggtgcagcagcggctgctggcgctggtggttactatggtggctatggacaaggttatgaggcttatggcagtgggtatgcacaacctcaggatcctaacatgtatggttatggtgcttatgctggttatcccaattaccaacagcaacaagctgcacagcagccacagcaacaacagtgaggcgtgtttgctccggtaggtcattgggttgtcgagatggaattaattaatattatttcaaggcactcttatattgcattcttgtcaatagaggtggtttcgaaaggctcctgattttgatggtcccatggcccggtctcatctatttatatcacatatgccctgttatgtctatgaacaagtggtgctctactgtgattgctgtgttgagacatgcttaatttctttccctgcttctcggatctattgttatctgtattactgtgtattgcaaatctactgatgctatatgcctatatatgcactgtgccgtttctcgcct

SEQ ID NO: 7908 - DNA, 1220 bp, Sorghum bicolor
  Clone ID: SORBI-28MAY03-CLUS169_1
atgaatttactgaaggactaagaagcagaaaagctaataggatggaagaagctggttcaacaggctcttcttctggaagcaggagattaccaccacctgtaccttcgtcatcttctaaaaaattgcggtctctatctgcattagatgcccgccctgtctcttcgtcaaagagaactccggatgacctagaggaaggtgagattgcaatgtctggggactcacatatggacctccagcagtctgggagctggaatcatgagcgtgatgacggtgaggatgaacaggtactgcaaccaaagataaaacgcaagcgaagtattcgtcttcgtccaaaacctaatgcagaaaagcaggaagatagatctggagaaggggtcttccctcagcatgctgccaggcagcaagacacagttcatcctatagtgaaacagaagcgcaacatgccatctaggaaggtttcaccagcttctaggtcggggaaattgacttacatgtctgggtctggtgagggatctgctgaacgctccaaggaaaattggaacagtaaggccattgattccaccccccctgagttccgtggcacaaagatgtctgacagtatgcaaagaaagtgcaaaaatgtgataagcaagctttggaggaggattgacaaagaaggtcatcaaatcatacctaatatatcttcttggtggcggaggaatgaaaattcctcattcagaggtccggctggtagcaccctggacctacaaaaaatcgaacagcgagttgatggattcgagtatggcgctgtaactgaattcatagcggacatgcaacagatgttgaaaagtgtggttcagcacttcagctataggcatgaggtccggatagaggctgagaccctccataacttatttttcaacataatgaagattgccttcccagattcagacttcagcgaagctaagaatgcaatgtcattttcgaatcctggaggagctgcaagtggtgctgctgcccaatcgtcaaagcacaccgcatcagtccataagcgcagagccagtgccagtgaagcagatcagcatggctcgggacatagcaggcataatcaatccagcgaggttcccagccggccccacagttccagatcagagagagaccccagacattctggatccagcagcagggatcagctccaggatggtgctgggttgttgcaccctagcgatatgttcatcgtt

SEQ ID NO: 7909 - DNA, 776 bp, Sorghum bicolor
  Clone ID: SORBI-28MAY03-CLUS17013_1
gccggccgggccgggtcttcttcttcttcttcttcttcttccttccctataaaacaccctcgccttgccgccgtgcgggcacacatccctcctgaagtcctgatcccttctctctctcgcgcgcgctcgtgctccctgcgtctgcgtgcagcttcccggctcccccactcaccgctgcaggctccgtccggcgacgtcgctcactcactcactcaccggcggcggcaacatgactacttcaaggcgccttgctgacaggaagactgccaagttccagaagaacatcaccaggaggggttccgtccctgagaccactgttaagaagggaaatgactaccctgttggccctgtagtgctcgggttcttcatctttgtcgtcattggatcatcgttgtttcagattatcaggacggcgaccagcggtgggatggcttaaaagccttgtcacatctaatccccagtctagagatctgtttgttatacttgcatccaactagaattgggtagcagctaaaatatcatgtgtcactgcatcctgtattccattcatctggtgatccttgagtctggaactgaactgtaaagcagaatcatgtaccttatatccttatataaagtgataattggatagtaaaaaaaaaaaaaatttaaaaaaaaaaaaaaaaaaaaaaaaaaaagaggttcaatgtaggcaacggtataaaagtcacctcgacaaaatggcaaacacattgttaatcagtacaacgatgaatttcatatcttgagttggttgt

SEQ ID NO: 7910 - DNA, 795 bp, Sorghum bicolor
  Clone ID: SORBI-28MAY03-CLUS15995_1
gttgcatgtttgctggaatgatatttcgcaaggaaccattcttttatggccatgacaaccatgaccaactggtgaagattgcaaaggtccttggaacagatgggctgaatgcttatttgaacaagtatcacattgagctggaccctcaacttgaagctcttgttggaaggcatagtagaaaaccctgggcgaaattcatcaatgctgataaccaacatctagtatcgcctgaggccattgattttctcgataagcttctgcgctatgatcaccaagataggcttactgcacgtgaagctatggcacatccctacttcctccaagtcagagctgtggagaacagtaggtcgagaccacaataatcatggtctacaccctcgcgatggagttgttgctaattcctgagtaccataggctaaaaccatgttcaacaagcatttcgctcttggaatctgggccatgactccatggcagtgaatcaaatagtatgagtcgcatcatgttggcaaccttggcagagcttgttattattgtcttaatcttgggactgtagctttaaacctgcaggttgtgcttgaatggaatgaaatatggaattgtatgtgatctttttagacaaagtgaagagtacaatacaaccctaatcatactgcttgtattatggtgtgctattatgtatgtatgattcttatttatatttcgggtgatagtcattgcggtgaaatacttttgtggatctcacagatgaaaatatgagttgcatctaatgaaaggatgagctctccaatgttttac

SEQ ID NO: 7911 - DNA, 700 bp, Sorghum bicolor
  Clone ID: SORBI-28MAY03-CLUS16052_1
gttgatgcaagcggattggtcaaattagcagattttggacttgcaaaggagatgtcaattttgagccaagcaaaatctagcaagggaactgtctactggatggcccctgaggttgctaaagctaagccacatggacctccagcggatatatggagtcttggctgcacagttttggagatgctgacaggaaaagtgccataccctgatatggaatggacacatgctttgcttaaaattggtaggggaataccaccagaaattcctaaaacattatcagaagatgcgcgtgatttcataaagaagtgtgttcaagcaaatccaaatgacaggccatctgctgctcagctattcgagcacccatttgtgcagcgaccgctgcaacaatatagcacgtgatgttctccttggttgctaacacatttgattgtacataagctgatttaacttacatccgaaagctgttgctgtaatgaggatgaccccttgtcctgtattctgagaatgagcctcaatctgaaggcaacccttgctcactgtaccattttcatgctttgtagtttaggggtgatgtccaaaattgctttaaatctggtaagcacatccagacacttcgaagcagcaatgtttgccctaatgtgggcaatttgtattcggttcaagatggcttatataagtggttcttttgtgcttgtccgccctt

SEQ ID NO: 7912 - DNA, 578 bp, Sorghum bicolor
  Clone ID: SORBI-28MAY03-CLUS16154_1
ctggaccactgcattgggagttgctgcaaagggcgagggctgcagacaaccagctgtttgttgcaacgtgcggtccagctcgagataccagtgcaggttatgttgcttggggacactccacgcttgttggaccttttggagaggtgattgcaacaactgaacatgaggagacgactataatagcagatattgactattcactgattgagcagaggaggcaatttcttcctctgcaacaccaacgtcgtggcgatctctatcagctggtagatgtccagagactgggttctaattagcaagcctggatgtggctgcgaggctgtgacgaagcaggagagcagttgactgtgcaggcttgctcgtactacttcgttcatgagctgcatgtccatgccctgtctactgtctagagatcgatcaacctgatgtgtgaaggtggagccgacggaataaggcgactatagtttgtaccttcagtgtatgtgcctcaagttgccaaataaattgattacttgaacgtatgaagaaaacctctctccatgaaacaaagataaacggaggatttgctccgatttccc

SEQ ID NO: 7913 - DNA, 498 bp, Sorghum bicolor
  Clone ID: SORBI-28MAY03-CLUS15996_1
ctgatggggcacaggcgttatatgtatggaggacatgcaaagacaataaaaccagataaacggaagctagttcaactctttgacaatccaaatatcagatgggatcgattcaagcactacatggaggacatgcgtcggcatagtgagatgaaaggtttgggattaaggaaaccacaggaatccatgtacaaccttcccatgcctgactgcatgtgtcagcaagctgaagcacgatcaaggaacacggcaaggaactaggcatgttccacccttgtatcttgtaagtagccacaccatataacagtaagcaaaggaaaaaaataaatattggttcgagcatagaagagaatatagagatttcaaattgtatggctgttgatatgaatcccttccccccaaaaaaaacagagattcatcagtgaatgttattgtactttgtacataaagacttcaatatttctttgttctggataaattataaagaattgtttttttccg

SEQ ID NO: 7914 - DNA, 344 bp, Sorghum bicolor
  Clone ID: LIB3480-051-P1-K1-H5
gtttgggattaaggaaaccgcaggaatccatgtacaaccttcccatgcctgactgcatgtgtcagcaagctgaagcacgatcaaggaacacggcaaggaactaggcatgttccacccttgtaactggtaagtagccacaccatataacagtaagcaaaaggaaaaataaatattggttcgagcatagaagagaatatagagatttcaaattgtatggctgttgatatgaatcccttccccaaaaaacagagattcatcagtgaatgtaatatatgtgtgaagaaggtactccacagtttattgtactttgtacataaagacttcaatatttctttgttctggat

SEQ ID NO: 7915 - DNA, 556 bp, Sorghum bicolor
  Clone ID: SORBI-28MAY03-CLUS16182_1
gacgaaacagctccagaatagcaacttggaaggagcctcatcttccaacgccgctaatgtagcatctcaagttggaagagatctccccccagttccatcttttaaggcaacaaatatggattcaagtttcagcaaatttagccacatggagcgctactggagaactccctacccattcagaccaatttctagagcccccgaagggacgtcttcatcaactcctgttgctgccaatatagctgttccagcctctcaagctaacctgactgcatgtactagcacattcttgagccagcgaggtgatacttcatcattgcctccgaagggagatcctccatcagaggaggatttggaactgactgttgccccaccctcccaacaaaacatgaccaatatgtcttcccagaatgcggtaggcgtgattcaagtcatctaagctaatatatttttttttctagaagttactgtggctattgagagttgaccgaataaattattaacattctattagcaatacatcaataagagcacgagttataagacggtcattgtctgt

SEQ ID NO: 7916 - DNA, 979 bp, Sorghum bicolor
  Clone ID: SORBI-28MAY03-CLUS17431_1
gccggccgggtccgaaatttctacctctttccgggccgggagaacggcgccgcatcccgactcccgcaatcccacttcgactgacgacttggcggcgacggcaagcgtcgaacggcgaccggcggcggggcaaatcccagctccctacaggctacagggctgcagccttgcgccatcgtcgagtccaggcaacatcggcaactaactctatcggcaacccctcacaaccctcaccgctgctggctgctccaccccgcagtcgccatgggtaaattccgcaagctcggccgcggttactcccaccgtctctccatgctcaggacaatggtgtcgcagctggtgaagcacgagcgcatcgaaaccactgttgccaaggcgaaggaggtccggcggaaggcggatcagatggtgcagctagggaaggagggtactgagcatgcagcaagacgtgctgctgcctttgttcggggtgatgacgtcgttcataagctattcactgagctggcctaccgctacagagatcgagctggtggatacacaagaatgttaagaaccaggatacgtgttggcgatgctgcgccaatggcatacatcgagtttgtggacagggagaatgagcttcgagaggccaaacctgcaacaccgccgccgcctcaacgagtccctcttgatccatggaccaagtcacgtgctagccaacagtgggcaggacctaaaatcaccaagacctcggaatcagacggcttatgagctagtgtatctatgttccataaaaagtttcagttattttgcttaagtagcaggagctttttcatttactggagataactgccgatagaataatttaaactttattatcatattgtatgcttctaattcgccaattgaagattgtaaggctgtaccacacaggtagtttggaacgagaaagatgtatctctgttttgcttattgcagttggaattgtaacagatggatt

SEQ ID NO: 7917 - DNA, 599 bp, Sorghum bicolor
  Clone ID: SORBI-28MAY03-CLUS1755_1
cgagaacggatgtttaagccatcactgtctaccattatctctgagaatccaaaagtggtcactgttgcaccatcagacacagttttgacagcatcaaagaagatgctggaattaaaagtgagttcagcagttgtagcaattgaaaacaaacctgggggaattctaacatctagagatatattgatgcgtgttatcgcccaaaatcttcctcctgagtccactacagtcgaaaaggtcatgactcagagtcctgaatgtgccacagtggacatgccaatccttgatgctcttcacacaatgcatgatggaaaatttttacatttgcctgttctggacagggatggaaatgttgtgactgttgttgatgttcttcacatcactcatgctgcaattgctacggttggaaacagcggggcagctggatccgaggcaacatctgccatgatgcagaggttctgggattcagcaatgtccattggacctcttgatgatgatgatgactcgagaagtgaaggatcgacaaaagttgcatctgaggcaacagatataggaagatcagctttctttccagcttctggtttatcaaacacttttgggtt

SEQ ID NO: 7918 - DNA, 928 bp, Sorghum bicolor
  Clone ID: SORBI-28MAY03-CLUS17559_1
ggctataacccgcgctcccgcttccactcggcgacctccaccggtccaccgcgcatcgaaccccccactagtgccgattcagctgatccctggccgtcgccggccggcgaatcggcaccatggcggtcgtgcgcctccgcggcaacggtgcaaacggcgtcgtccgtccccggccccgcgaccgcggcgcccgcggtgggggcggaagcatggcggggcgcgtggccgtcctcgccttctgtgtcgccgggatctggtccgcctacatctaccagggcgtccttcaggagactctatccacgaagcggttcgggccggaggggcggcggttcgagcacctcgcgttcctcaacttcgcgcagaacgtcctctgcttcgtctggtccttcataatgattaagctgtggtcgggtgggggtagctccaatggccgcgcgccgctatggaagtattggggcgtcagcgtcaccaataccatcgggccgacgatggggatcgaggcgctcaagtacatcagctatccggctcaggtgttggcaaaatcttctaagatgattcctgtaatgttgatgggaacacttctctatggtgtgaagtacacacttccagagtatttttgcacctttcttgttgctggcggtgtgtcctcctttgcgttgttgaagacaggctcgaagacaattaagaagcttgccaaccctaatgcacctcttggctatacattgtgcttcctcaacttagcttttgatgggtatactaactcgacccaagatttaataaaatcaaggtacccaaagacaaacccatgggatataatgccttggcatgaacctctgggggaccatatataatgcttgtattatgtttgctgcgccattaactgtcagtaattgggcctatgcaaatggttttgaggaatttgagattt

SEQ ID NO: 7919 - DNA, 834 bp, Sorghum bicolor
  unsure (1)..(834): unsure at all n locations
  Clone ID: SORBI-28MAY03-CLUS17578_1
gccggccgggccgggaccgttggtctctttccctggcgatctctgcagcaagagtccgggaacgcgccagattcattgaacccacgtttgcaaatctgctggtcattcacgtttgcaaattttctagtcttcatcccgcaccgcacacacaactgcagccagcataaagagaggtaggtgccgaggcgaagctagaagaagacagcacggcacaaagggagaggagcagacgatcgacgatggccagcggcggcgctaacactgtccccctcgccactccctacaagatgggaaaatttgatctttcccacagggtagttctcgcaccactgacgagacagcggtcctacggcaatgttcctcaacctcatgccatactgtattatcaacagagaacgactaaaggaggtcttctaattgctgaggccactggagtgtcagacactgctcaagggtacaaagacacccctggcatttggaccaatgagcaagtcgaagcttggaagccaatcgtagatggggttcatcagaaaggagggatatttttctgtcagatttggcacgtagggagagtctctaattccagttttcagcctaatgggcaggctccaatttcaagcactgataagccactaaaacctcaagtgagagccaatggtgtagatgtggctacttttacacctcctagacgcttagagactgatgaaatccctttggtcatcaatgatttcagggtagctgctagaaatgcaattgaagctgggtttgatggtgttgaaatcatggagctcaggntacttgatttgatcagttctaaggatcagggtcatgatc

SEQ ID NO: 7920 - DNA, 686 bp, Sorghum bicolor
  Clone ID: SORBI-28MAY03-CLUS17564_1
tccggccgggccgggcctatctgccttgtgaaccccaaagacatggcgtttggctgtggacaccagacttgctgtgactgcggacagagtctcgagtcgtgcccaatctgtcgcactcccatcactacaaggataaagctatactagcaagtagtggtttggatcattgccaatgggtggtatactggagccaccctggttcacactagaggatcgggacagcatgtcccatttgcaatcggaacgctggaacggcactctatagatcgattggatctaaggactgcagggacaggcagcatggatcgattggagccgaggattgcggggccgttgatgcatcgctcagggttgtccggtattcatatccaccaggaatgatccgaattgcagcttgccaaaaaaaaaattataaacgagaagaaaaaaagaggaaaacacaaaaaagttgtggtgtggtggagcagacagttgcgtgtagggccatgacacgcctctcagcttggtgccttggttacttatctaacctgcaactctagttgtacataccggaattcgtgcctatctggacttctgtgcccggatttttaggattctccgagatatgttgatttgttctttgcttgcgagagagtaaaattaaaattttatccgcatttttgggaatcgaacaaaaaaattcaatc

SEQ ID NO: 7921 - DNA, 769 bp, Sorghum bicolor
  Clone ID: SORBI-28MAY03-CLUS16549_1
ctcaccatctcatcgcagtggtagccgtgagggtcctgaccgtgaccgttctgaccgagattggatcgttctagccgtgatcgtgacagagaccaagatcgttcaagcagggaccggtatcgttcaagccgagaccttgaccgtgacaaggacgccagagattatcatcgccatgagcgtgatagcagggatcgtgagtattaccggtccaggcgttcagaagaaagacgggacgacagaagggatcatgaaagtagcaggcacaggcgctctaactctcgccaccgaagtcgtagtcgtagtcgtagtcgaagccggagcaggaggagccgaagccggagccggagtcggagcaggaatgagcagcgattgagcccattcagggatgcaaataaagagaaggcagccactgtgtcaagcaacctagcaaagctgaaggacttgtacggtgacataactgagaaggcgcgaggcagtgatgctgaaaagcttcaccgtgattcatgcgctgaggaggtcatcaggctgggaggccctcgatggaggtaacatgagacctgtaaaactgtggtttccactttgttgtgccagcctctctgtgggccttctcgaaaatactcttaatattcccaaacctgatagagccgactgggcgactggtactttggtatcttgacttgttatcacctgcatttgtcattaatggatgttgtttggtatgttattccttattccctctttttacatccttatgaaacgcttacactgc

SEQ ID NO: 7922 - DNA, 625 bp, Sorghum bicolor
  Clone ID: SORBI-28MAY03-CLUS16708_1
aaaagcaacaagtaacagagatctgcatactattgatgagtatgagtctgttatcaagcagttaagggatgaaaatttatcactaaaggaaagattatcaaaggtggaagaatcgttgttgcaagagctagtggtagagcgtgacaagaataagtctttaacagagagggtggaggatctgcaaagacaatttgagtctgcaaccaaggaacaagaagcattgatcgacatattctcagaagagaggaaccgacgagaccaagaagaggagagcctgaggaagaagctgaaggacgcatcttccactatacaggacttgctggagcaactgaatgctgccaggaaaggccgcaaagtttgaggaaataaactagcaacattgctaccctgtctactagggacagtttcagtttgcctatattgcaactagaaaagttgaagccgtcgtagcatgctgtgggggatagggtattgctacatctctagctccttgccgcatcgtggtttagagttgagggttagctgcatatatatagtgccccaggccgtttggacacgttatgcagcagttacctacaggaaacagcttgcgtaattatcctttcattctgttacatcatgtgtc

SEQ ID NO: 7923 - DNA, 578 bp, Sorghum bicolor
  Clone ID: SORBI-28MAY03-CLUS1670_1
tactggatgcaatgtacgtctttgattagtcgcacaatcgcgtccggcataccatcgctcgcgccgctgcaggcgacggccaggagcctccactcccggcgatggccgtgcggtcccggcctcgccgctccgccggccacctttaccacctccgcctcccaaggctcctcttcctcctcccgctcgctctccttctcatcctcttcctcgggcacctccccgcgctcctccgcggcgccaacgcacacggccgccggtgtctgccagacgccactgaccacctcctccccttctcccaccccttgccggatccccgcctcagcatcgccatcgtcaccctcgccgacgaggacgccggcaggccgggcggacggcggtccttccgcggcgtgctggcggcgtccgcgcggaacaagcgcgcctacgcggaggcgcacgggtatggcctcgtcgtgctccccgcgtccgccgtcgaccccagccgcccgcccagctggagcaaggtcctcgcgctgcgttcccacctccgccaccaccactggctcttctggaacgacgcggacacactggttactaac

SEQ ID NO: 7924 - DNA, 1437 bp, Sorghum bicolor
  Clone ID: SORBI-28MAY03-CLUS16746_1
gcacgaggcaaacaaggaagagaagtacaattttctcattatccctatagagctcgtatacttccatggaaaagaaaaatattctgccagaacttcagaggcagttactcttcattgttgaatacaagctctatagggataatgagaaaattattgcaaacaaggaagagaagtacaatttacactgtctctactgatggattctctcttcggaaatctggagtgttaagtataggcgggtcaagtttgaaatggtcaaggtcccttgagaaacattctcaaaaggttaatgaggaagctacacaggcagttgctgaagttgaaagaaagaaaagagaaaagagaaaacgacagtctctccgtaacaaaggaaggaatgatcgatattctgcatcagttgctgccaatcaattaacaaatagcagcagagcatcttcagaatatgtgcgtgtcaacaaaggtaaccaactggtcagaaatccaaagaaagtaatccgcatgctagcaagtgagaaagttcgatggagtttgcacactgttagaagacggttggcaaagaaacagcaatattgtcaattcttcactcgctttggcgagtgtaaaaaatctggtggcaagtgcccctatattcatgaccgagctaaagtggctatctgtactaaatttcttaatggcttgtgttctagtactaggtgcaaactaactcaccaggtcctgccagaaagaatgccagattgttcttactttctgcaagggctctgtaccaacacagcctgtccctataggcatgtgaaagtgaactcgaacgcccctgtttgtgaagattttttgaagggatattgtgctgatggtgatgaggtatttatgatatcactagatttatattgatcttaaatttttgttccgcaccttgcattggagggtaggtaggcacatgatttcttatggaggtagcataaagcttgcttccactggcttgtttttttatcagaattaatatatgtaggttggtgtccttcctttttatattggttctaacatgaaatgttttataggacatagagtgttaaaatatccaccttttagttcctttaggataatctaattcagtggagtgttgattcttcatagataaatagatcagaaaggttgcctccttttgggggaaacctatgctggaaaagcatgctgtctctgctttgtaaaaacacgtctctgctttaaaacagagctttttcatcttttaaacttctggggcctttgatgaacctttatggttctgaatcaagatcactaatcttttcatggacttgaaacaatctctgttacgagcagtgtcgtaaaaagcacagctatgtatgccccgtctttgaggcgacaggagagtgcccacaagaatcaagatgcaagcttcatcacccccagaagaaagacaaa

SEQ ID NO: 7925 - DNA, 745 bp, Sorghum bicolor
  Clone ID: SORBI-28MAY03-CLUS16801_1
aaaggagcagattgaggaggatgttgtgatgcaggaagaagttcaggtggagacagagaaaaagaagaggaagagcactgcggtttctgccgatgacagtcagaaggttgacaagaaggggaaagagaagggtaagcgtggtttggaaaatgagaaggttgacaagaaggggaaagagaagggtaagcgtggtttggaaaatgaggtgaaagaagccagtttggacaagaagaagattaagaaagggaagactgaggagaggaagaagaagaagagcatgaagggtgatggtgaagttggtactgatgaaatacaggaagataagaagatcaagggggagaaatcggatggcaagaccaagaagttgaggaccagggtaagagtataatgttacagctgatattactgttggagatgcctgttcaaatagttgatcgacaatgttcttcatattggcaggctggttattcaaagtatcaatgaattgagttagttataattggtatcagcctgaagaaccataccaggctttacttgagaagaccacctatcacttataccgcagaacttgggttccccagagatttctcctgaagttgtttcttcagttttgttagcttagtagctcaagcctttgtgttaagtatggcgaaactgtttcttgctaagactgtacttcgctcgacttgcaacaattttgtgttgattttctaagaattatgcttatgttgtcctgctctctctg

SEQ ID NO: 7926 - DNA, 670 bp, Sorghum bicolor
  Clone ID: SORBI-28MAY03-CLUS15416_1
cgaattcctgaccctttctccgccccaaaacgcctaaactccaagcaaccgcaaaataaccaccgattccttgcagccccgcgaatcttcggccccttccccacccgacacggcacaccaccactctctgccgcccccccttccttcccctgcgctcctctttgccctccgaatccccgctcgcgaaccctagccggcctccgcgagatggacgaggactgggagctcctcctcgcgtcccccaaggcggcggtggcggccgagccgtacgctggcggcggaggcgggggcggggaggacgacgccggcgccatcaagcacgactacttcgacctcggctccgacgccaagtacccccggagggcgtcgctgtcgaaggggaacgacgaggtggacgaggaggagggtgtggatgaggggcttcttggggcgtcagacaactcgagctgggtggagccggaccctgacgaccttctcttccccggccgcgaccgcgcggcgctctggtcggactcgtcctccgacggggagaggcccgaggtcgaggccaccgatccggtggagcgggccagggaagaggacggcgtcacggtggcagccgcggctgatgggggcgagggggccgtggcgaagggaggaggaagaccggtcccgtggtggaagctgtcgc

SEQ ID NO: 7927 - DNA, 787 bp, Sorghum bicolor
  Clone ID: SORBI-28MAY03-CLUS15485_1
gcacgaggtggacctgacgctcccgggacagcagcagaccctcatcgagagcgtcgcgaacgccgcgaagaagccggtgatccttgtgctgctctgcggcgggcccgtggatgtgagcttcgccaagacgaaccccaagattggtgccatcctgtgggctggataccccggcgaggccggcggcattgccatcgcacaggtcctcttcggagagcacaaccccggtggaaggcttcccgtgacgtggtatccccaagatttcacgaaggtgcccatgacggacatgcggatgcgcgccgacccagccacggggtaccccggccggacgtaccggttctaccgcgggccgaccgtgttcaacttcggctacggcctcagctactccaagtactcccaccgcttcgtcacgaagcccccgccctccatgagcaacgtcgccggcttgaaggcgctggcgacgacggcgggcggcgtggcgacctacgacgtggaggcgatcgggtcggagacgtgcgaccggctcaagttcccggcggtggtgcgggtgcagaaccacgggcccatggacgggaagcacccggtgctggtgttcctgcgctggcccaacgcgacggacggcagcggccggccggccagacagctgatcgggttccagagcctgcacttgagggcgacgcagacggcgcacgtggagttcgaggtgagcccctgcaagcacttcagccgggcgacggaggatggcaggaaggtgatcgatcagggctcgcacttcgtgatggtcggcgac

SEQ ID NO: 7928 - DNA, 898 bp, Sorghum bicolor
  Clone ID: SORBI-28MAY03-CLUS15395_1
gcacgaggtccctcctcaccagacgccgcggccttctctcgagtggcatggcctaggtcgacaggggtggcgctgcggccttggccatctgaggtgttgacgcacggctccagtgtcctaggtaggtatggtggtgaggactcggtagtggtgctgccgtctgccaccagttgagaatgtgagctcagatctgaccacgcctcaattccaaggggaagatggtgtggaaggggaacatggtggaggagggtcgtctgtccttgatccagccgagggcgttgcggagagggtcgcctgtcctcgatccgaccaaggccggtagatccaacgacgtcttctgttggactgccactacttcaccatggtgcggcacgaggcaaaggatggttggtcggtcgaaagtgtcgatctgattcggcgtctactggttcctccgacgggctttgctggccgggcgtcgcaatctgaggtgccttttgtagatgcggccaggatttccctgttgaggtatattcagatggatagtaaccttcgggtgcatcatttccaacaaagcaagtcaaggtgccatgctcaaccatattagctgtgttcagatggataattaccttcttaggtatgaattccttcacaagcctgatctgtgtgtatattagttttgtttactgctacaaacaatgttcctttcctcatatgatctgctcggaattaattcacagaccagttacttgcacaaggatagaccttgggccgactggggacatatatatagcattaaacttaaacatatcattactgcagatgctcggatccttcgcgaagatccaattttgagcaatggggtgctgtctatctttgacattcaatcactttcacactttatttaatactatagggt

SEQ ID NO: 7929 - DNA, 939 bp, Sorghum bicolor
  Clone ID: SORBI-28MAY03-CLUS15534_1
gcacgagggttatcaaacgcatcggtatattgtgctcatgctcttcatgcaatggtcgaaaagtgagttttctcctcatgttgtagtctgctactcttcatgcaatggtaagtgatctatttctcttcatacaaatgctatgttagacatgttgcagtctgcaatatggaaggcaataggcccagcacctcagaagagaacaattagatgcaaagcctgcaaaatttgttattcctccactcatccctaccctgatcagctttcttattaattcctcatatgttgatatatataatatttcactcaggttcattcagcacactccacagtgggaaatttgctttgttttgtgattcatgtcttgaatctaaggaggctaagaataatagcagccacgcagcgccgccgcctcccgccgtcgaactctccttcggcttcgcctcgtcccctctctgcttccgcatcaggaataaaggcgcattcgttgttgaaggaggggagcgatggagcacgggtcgttggacgattcgagctcgtcgacgttctctatcatggaggaggaccataccctggccaactctgtcagattcgtcctcaaccaggacccaagggtcgcattttgtggatacagcattcctcatcctgctgagaacaaagttaacatacgggttcagactacaggagatccagccaaggatgttctgaaagatgcattgcaagacctgatggtgatgtgccagcacataagggggacacttgacactgcagtggctgattttcgagggaacaaaacagcagaagccatggacatcgatttgaacaaaaaatagaaggttccatatggtcattagcaaattgcagaaatacccatatggccgcgtatccttagaccttagtgtgcaactcagttataaattattcagttgtatgggatgtagt

SEQ ID NO: 7930 - DNA, 648 bp, Sorghum bicolor
  Clone ID: SORBI-28MAY03-CLUS17652_1
gccggccgggccggggattcagtttgaagctcctgcgtgcgctcggcagactgcagttgttggcatcgagttgtcactcggctcgctcaggctctgccaactgccatggcggcggcgtccggccgggctccggctgcctgcgcgctcctcctcctcctgcttgctctgggtgtggtcgccgccgccgtagatgccagccaagaggaggagttgtcgccggggagtccttccccagcaccgtccccagcgagctccatagactgcgggagcgcgtgcgcggcgcgatgcgcgctgtcgtcgcggcagaaactgtgcaggagggcgtgcgggtcctgctgcgcccgctgcaactgcgtgccgccgggcaccgccgggaaccacgacgtctgcccctgctacgccgccatcaccacccgcggcgcccgccccaagtgcccttgatcgagcacccttgacgcatgcatgaggccgccgccgcgctccaacgcctctcttgtcttgtgtaccagtagcagtacactaggtagacgcaagtacgtgtacgaacaataatgctatgtcaccgtgcgcgtacgtaaccaacacctgcaatgcaacaccgagccgaccgtctgttgccaagaaaaaaaaaaaaaaaaaagcccccaa

SEQ ID NO: 7931 - DNA, 548 bp, Sorghum bicolor
  unsure (1)..(548): unsure at all n locations
  Clone ID: SORBI-28MAY03-CLUS1711_1
cggaaattcatctgattgcttcgatctattcccagccacccacttcccaccggcacccaaacattcccacgtaacgttaatctccggccgcgatacgataaataccctcccgggaattatctcttctccggcgagacggcagcgagctgagctgagctgagcacgacgaagcccggaccccctcactcaccacgcccggccatggaggactggctcttctactccctcaccacgctcctctgcctcctctgttcactcctgctgcgtgcgcgcaccccaggcagcaaggaccgccatgccgactcctcctccgcgctccctcccctgcccccgggcccgacgccgctgccggtgctgggcccgctgctcttcctcgcgcgccgcgacttcgacatcgagcccgtcctccgccgcatcgcgcgggagcacggcaaggtcttcaccttcgcgccgctgggtccggcgcgcccgggcatcttcgtcgccgaccgcgccgccgcgcaccgngcgctcgtgcagcgcggcgccgtgttcgcctcccgcccgcc

SEQ ID NO: 7932 - DNA, 786 bp, Sorghum bicolor
  Clone ID: SORBI-28MAY03-CLUS17171_1
gccggccgggccggggttcgtcacttgtgctcggcagcggggcaaaggtcctcggctcctcgccgtgcctcccgctgaatctgtgggtggagcttgctgcggaaccagggcggagctgctggggtgtaggtgttgtcctcacgctgctctcaccgtgtgtcgcgcgtggcttcaccgccgtttcccctctcctcgtggtgggtgtattggggcgaggccgttgcgccgcttcccctgttccggtcgccgcagaggagctactgtcgttgctgattcaaggaggtgtcgctgatctgatgaggcgattgctaagaagctggctgagtatataaccacaaaggttgtctccaccatcattggcactggtgattctgttgctgctgttgagaaggctgggatggctgacaaggctttggaatattcttctcctttctgagaatcgttttcttctttgacaagggcctggttgcaatggaaaatattctttcctgtcaggttttggtttgataatttggtctgaaatcaactatgtagttcttcaccaagccaaagaattacaaggttttgcatccgctgcatttgctacttagcacagcgcacggagcagcagcagcagcagcagtgcgcacaatgcagtgcctagcaggcagcagcagcaaaagcagcgccgcatttttgttaacgggctgtggatcttttgttggatatgtcatgtgtaataaaaattgacagattttttgttgtatctatctgtcagttttttccctactatgtggcagcttttca

SEQ ID NO: 7933 - DNA, 676 bp, Sorghum bicolor
  Clone ID: SORBI-28MAY03-CLUS16909_1
gccggccgggccggggtgaccttacgaacccggactggagactggactgcctccctacgggcttttcttctcccgttcacctcgccttgcgcgcgccctctctttctagtgccgacgaccacgacgtaagaccgccgccgcatccctgcgctaggcgcccaggtcttcgtccggcccttcgccagccgcgacgagcacccaccagctgaaagatggatgcgaacaggcgccagagtggaatccaacagttgttggctgcagagcaagaggctcagcagattgtaaatgcagctagggctgctaagtcagcaaggcttaggcaagccaaggaggaggctgagagggaaatagctgaataccgtgcccagatggaggctgaattccagaggaaggttgcagagagcagcggtgactctggtgcaaatgttaaacgtcttgaggaagagacaacagcaaaaattgaacaactcagtcaacaggctgcaagtatatccccagaagtcattcagatgcttctgaggcatgtcaccactgtgaagaactgaatgttgttgtccgcaaatatgcttgcaagttgcaacattgtattatctatctatctatatatttattagcacaagacagtggtaataaatgaaatccacttttagctgcaattcaatgttcttaatcatag

SEQ ID NO: 7934 - DNA, 670 bp, Sorghum bicolor
  Clone ID: LIB5047-008-R1-XP1-F5
gccggcctggccggggactggattgcctactcttttcttctcccgttcacctcgcctcgcgcgcgccctctctttctagtgccgacgacccgacaactgtacgaccgccgccgcatccctactctccagcgacgagcacccaccagctgaaagatggatgcgaacaggcgccagagtggaatccaacagttgttggctgcagagcaagaggctcagcagattgtaaatgcagctagggctgctaagtcagcaaggcttaggcaagccaaggaggaggctgagagggaaatagctgaataccgtgcccagatggaggctgaattccagaggaaggttgcagagagcagcggtgactctggtgcaaatgttaaacgtcttgaggaagagacaacagcaaaaattgaacaactcagtcaacaggctgcaagtatatccccagaagtcattcagatgcttctgaggcatgtcaccactgtgaagaactgaatgttgttgcccgcaaatatgcttgcaagttgcaacattgtattatctatctatctatctatatatatatttattagtacaagaaagtggtaataaatgaaatccacttttagctgtaattctatgttcttaatcatagaataaggtcccgtacaatcaaatactcgttcatcggttggtgcat

SEQ ID NO: 7935 - DNA, 539 bp, Sorghum bicolor
  Clone ID: SORBI-28MAY03-CLUS1721_1
cccacgcgtccgcttaggagttagtaggatccattttttgttctttcttttccccattttttcccttctttcttggacatagagaatcccatccatcttgggcggtcgccgcgccgtcgagggccagccagagctagctcgccatggcggccgtccagtccaacagggcccacccgcaccgccgctccgaggcgtcctccccggcgacctccgtggccgtggcggcggcgagagccgacgacgctcagcgccagcgtcgtccgagggtgccggtgcaggtccgggagcagggcccgctggcggtggggcatcatcatccacaccaccagctgcggcggtcagcggcgttcccgccgcgccgcccaggtgcagtgcctgcagtgcgccgcccttctcagcgctgcgacagcgacctcaacatcagggagcaccgcacctgcagcgaggtggccggcggcaccgcggcgggctgcgccgtcgtgtgctgctgcttcccctgcgtcatggtggaggtcgtggtgctcgccacggtgcgcgcg

SEQ ID NO: 7936 - DNA, 836 bp, Sorghum bicolor
  Clone ID: SORBI-28MAY03-CLUS17313_1
gccggccgggccgggttggatggtaaaagcagtgttgctgcacctatactgcaagaaagaaatgggactgaagttgactcaagcgacgacgaagatgacttctacatgaaccgacaactctccccaatacctccgtctccagtgtccagggagtcttcattccaacaggagactctagtcggcgtggaagtccagaccatgaatgggcacctgtaccctaaaccactggctcaggtgcgtcccgagccaccctcctggcagctctccaggaggccagttgaggaaccgcgtggagaaatatggcgcttctccaggaggcccagcgaggatgggacctctgatgctatggaagcgcatgccattgccccgagagagagcaagaagccagagatccatggggacaacaggttcagcatcccgcggtgcatcgaggtgatgagcgccatggcggagctgtcgccggtcgagaagtcgctggcgcccgacgtcttcttggacgcgagcaaccgggagattttcctctcgctgagtgtagatattaggccaatgtggctgaggcgtaagatgaagagccttgtctagctagcctagctagggatagcgtgagaaattttcgtcggcgtatacttaataaacctgtgctgtactgtagatatatgccttagcttggcaatgagttctggaccattgtatgtacctagtgctaatttatggtgcatgttatgttaaagtcctgcctatgattagcagcaataagttcattatgaatttcagctagaagaataacagtaaatcaaaacttccccttgagtatttaagttgatgaacctgttttg

SEQ ID NO: 7937 - DNA, 847 bp, Sorghum bicolor
  Clone ID: SORBI-28MAY03-CLUS17371_1
gcggccgcttcgaggccggccgggccggcgacaccaaaacacccagagaagaagatactccacggtgcagagagagggagagggagaacgggcgtgtacctgtgtgggggagggctgggggtagggatcctcctcctagtgaacgagcatgtcgccgagggagtggatccacgatgttggcaatggtcccttcatcggggtcatgatattcatcgtgatgatcacggttggatccgtgctctttgccaagtgctgtgttggggatcgggcgtttatgcgcactgggtatgactttgaaggctatgtgatgcgtaagtgccccgtttgtgtcggccttcccaagccaacacatccccgtgtaaaggaggtagatcctcttcagatgactgagattacagtggaagaggcgaggacatcagagccccctgctcctcctcctgctactgctgcacctcctcctcctcctgctgctgctacacctgctcctcctcctgctacatctgctcctcctcctgctgctgctgctacacctgctcctcctcctactgtaactggagcagtaccggtagctaccaaggaggatgaggaagatgagatcaacgaggatgaggaggaggatgatgaggaggaggagtttgattttgatgcatatgaggaagcggaagctctaggccgtctatgagctaggtttgcaaaatttttggggttccttgaaactagtcttcatgtattttttaatatatctttttggaaggcattcaagggtcaacaaatttgatcttggaggatcgagaataatgataagaattggaagtgttattaattttcttatacgtgtggttgggtc

SEQ ID NO: 7938 - DNA, 549 bp, Sorghum bicolor
  Clone ID: SORBI-28MAY03-CLUS1677_1
cttcaggtgagtgcctgcctgggcctgcattcccggtcgctcaggcgtccgtacagtgcatggcggcgtgcaagacggttagttttttgtgaacatgtattccgcgaactctaatcgatgcttgcaggaggccatgagggatccccacgtcgcggcagacgggttcacgtacgaaggcgacgccatcagaggctggctggacggcgggaacgacgcgtcccccgtgaccgggcagccgctcgcgcaccgggagctggcacccaatctcgcgcttgctgccgtgatccaagattacacggtgatgatgatgaagaagcggcggcagtaccgattcggcgattcgcatgacaacaccgttgctgcacttcagtttctttcctctcctgtgggcagtgagcggtgagctgcgcttgccagaatggccaggcatagatcacgccgcgcccatttgcaggttcgtgtacagtttgtggctttgtgcgtacaagcctatattggtggtggaattagaccttgtttagttctaaaaaaattttcaagatcttcggc

SEQ ID NO: 7939 - DNA, 385 bp, Sorghum bicolor
  Clone ID: LIB3478-009-P1-K1-E5
gtccgtcattcagtcgccgtacgagttcgacgaagatcgcgtcccgtcctacttcctctgcccgatccttcaggaggccatgagggatccccacgtcgcggcagacgggttcacgtacgaaggcgacgccatcagaggctggctggacggcgggaacgacgcgtcccccgtgaccgggcagccgctcgcgcaccgggagctggcacccaatctcgcgcttgctgccgtgatccaagattacacggtgatgatgatgaagaagcggcggcagtaccgattcggcgattcgcatgacaacaccgttgctgcacttcagtttctttcctctcctgtgggcagtgagcggtgagctgcgcttgccagaaaatggccaggcatagatcac

SEQ ID NO: 7940 - DNA, 652 bp, Sorghum bicolor
  Clone ID: SORBI-28MAY03-CLUS15052_1
gcacgagggtcgcggcctgcgacatcaggtgctgctccagggacgccacgttcgtgctcaaggaggtggatatggccatcgtcgctgatctcggcgcgctgcagcgcctcccgcggatcgtcggatacggcaacgctgctgacctcgcgctcaccggacgcaagatcaccgccatggaggccaaggagatgggcctcgttaccagggtcttcgattccaagaaagaattggatgccggcgttgcaaatattgccaaagaaattgctgagaagtcggcatgggcggtgatgggaaccaaggcggttttgctgagaagcagggatgtgactgtagaacaaggcctggagcatgtagccacatggaatgcgggtatgatgagatcgaatgatctgaaggaggccatcaaagccttcctggagaagcggaagcctgttttctccaagctgtaatgatcagattcagataccatgcctctacttaacagtgctacgtatctggaaatgaaaaggaataaagtgtgttacgagtagacaagaataccatctctgtcctctgatagcatttgacgaaacatccattcccgtcagggaaaatacttgttctcgtcggagctgtgaagacatttttccatgtcaattgagcttaccaaagt

SEQ ID NO: 7941 - DNA, 743 bp, Sorghum bicolor
  Clone ID: SORBI-28MAY03-CLUS15027_1
gccggccgggctgcgctcgggcatttcttcgtctccctgctcccgccgccgccgtcgccgtcgccgtcgccacttcggactagtgcgtcgctccaccgggtttcggcgtctctccttagcgcgcgacaatggcggagcagacggagaaggctttcttgaagcagcccaaggtgttcctctgttccaagaaggccgccaaggggaacaagcctggcaagggaggaaacaggttctggaagaacattggccttggtttcaagacgcccagggaagccattgaaggaacctacattgataagaaatgcccattcactggcactgtgtctatcaggggtcgcatcatcgccggaacatgccacagtgctaagatgaataggaccatcattgttcgtaggaattatcttcacttcgtcaagaagtaccagaggtatgagaagaggcactccaacatccctgcgcacatttcaccatgcttccgtgtcaaggaaggtgatcatgtgatcattggccagtgcaggccactgtcaaagactgtaagattcaatgtgctcaaagtcattcccgcaggttcaaagagtggagcagtcaagaaggctttcactgccgcctaagatcgatgagtgcatcgtcagtgcctgaaaaagctttgttataacgttttgatgctgcctagcctttttgtttcgtgtctactgtatgtgtacttggaattctaattgaatacatccagagcatggaatcgc

SEQ ID NO: 7942 - DNA, 1046 bp, Sorghum bicolor
  Clone ID: SORBI-28MAY03-CLUS15058_1
cgagcttccaccgccggtcgtcgccctcctcttgcaggtcgtcgcagcaacaaggccgccggacaggatgtcgtggcagacgtacgtcgacgagcacctcatgtgcgagatcgagggccaccacctcacctccgccgccatcatcggccacgacggcaccgtctgggcccagagcaccgcgttcccgcagttcaagcctgaggagatgaccaacatcatgaaggacttcgacgagcccgggttcctggccccgaccggcctcttcctcggccccaccaagtacatggtcatccaaggcgagcccggcgccgtcatccgcgggaagaagggatctggaggcataaccgtgaagaagaccgggcaggcgctggtgatcggcatctacgacgagcccatgacccccgggcagtgcaacatggtggtcgagaggctcggcgactacctcgtagagcaaggcctgtaaatggatgattgcttcaaccccctgcctgcctgtccatgtttcgagcatccagcagcaacgatacgaccgccagcatttagtagtctctatacgcacgcattttttttagtccccacgctctgggattgtgcgtggctccgttaattacctccgatcctccgcccggcatttctctccccccgtccgtcgccgatcaccagagattttttttttcttgtttttgtttgtaatttgttggtgtcgtttttgcaaataattttgtgatttcacccccaaaatttggttgtcgtatgatttgtaaacccggaacaatatatactatatgtgattgaactgctcctacctattcttttgtaacacgggaatatgtatgtatttcgtgcaaaaaaaaaaaaaaaaaaaaaaaaaaaaaaaaaaaaaaaaaaaaaaaaaaaaaaaaaaaaaaaaaaaaaagggcaaaaaataaaaaaattccatagtaaaaattttcttgcatgtaaaaaaataattaattgaataggttaaccaaaaataaaattcatgtgggtaaaataatttacaaaattcttaaacatgtaaaaac

SEQ ID NO: 7943 - DNA, 748 bp, Sorghum bicolor
  Clone ID: SORBI-28MAY03-CLUS15063_1
caagcagagatacttttgaatgcggacagaattgtagttcagacagatggccctatagataacgctgcaggacttcaacgctatgcggactcacttatgaaaaggacggatattgagttcaatgtagtagtaacccaaatgaatgggaaggattactcgtcgaattctgtccatgtatttcacattggaaagctgagaataaaacttcgaaaaggatggtctacaaaggcaagagagtcatattccactatgatgaagttatgtgggagccgtggtggtggtaatgctgcagctagggcagttttctggcaagctaggaaaggcttgtcctacactctagctttcgaaacagacagggacaggaatgctgcaattatgattgctcgcaagtttgcttcgaactgcaatatcgctctcgctggcccaggcgaccaaggcacctgatgaagtgatcatgcgtgttttgacagcgacacagtacataattagggtgtggattggctgattgggtgcttgtcttagtttgtctatttgtgcttgcgagggtagaggttgtacactgcgtgaggctatcccctttccatgtcttatggaggcattgtttttgtttgcctgcctgcagcattagtgacatacttgaaacatgatgtacaaattgatcactgttcttgtgccttacatttgtaatgtttgaaccaaaaaagattggtcattatatagtttctctcgggtcgggaagacttcctgc

SEQ ID NO: 7944 - DNA, 742 bp, Sorghum bicolor
  Clone ID: SORBI-28MAY03-CLUS15115_1
gactagttctagatcgcgagcggctgcccttttttttttttttttctatcaagttcaaccactgaaacacacggttgccaaattcttctatttgactgcaataatcttctggtttctataaggacgtatatccttttacatatcgacaggcacacaactatttcctttgagaggatccagatacattagcacaatagcaccaatgttctacttcccaccccaaaagcagttttaacaagcaagacaagtagtgcctgcaaagatgacgatcagcacgtggaaattatctactgaaacagtgttacatgtcaaaacacaacagctactgggaattctcgtcaggctgggcccaatcgcttcactgtgctacacgtcgtcaaaacaacatactacaaagccgtccttcaccgcggtcctcagagtcatgtgtcctgactactgaacagattgcgcctcaactactgatatcaccgagatggcctcaatttcctattggatctacccctcccctcacacctcggagatgaagacgaggatgctgaggaagctatggctgccactgcagccttatcttttgtgaatgccttgcgcacgtcctctttgagttcagaaaagcgcattctcttgactcgctgatcctctggagtcccagtttcaaggaagatcagatcagtggattcttcgttgaggaacttgtcaagaacgtctgaacaatgtgggaagtatcgtctccctagctcaa

SEQ ID NO: 7945 - DNA, 711 bp, Sorghum bicolor
  unsure (1)..(711): unsure at all n locations
  Clone ID: SORBI-28MAY03-CLUS15246_1
ggatgagaatccaaaatttctaatggcagcatcaacattgctcctaccatttcaacccctgatggtttcagctgtccacactgggataatggaggtttcatttgctaaaagagcatcaatagatccagagctcaagacggcacataacctacacaagatgtcgtctctcttgggaggtgcgctattcatcgctgatgatgtcttcccacaagcttcatatctccatgcagcatggcatctagctgcagcgctgggtgttggcacatgcaataagctgcttgagggacgaagcaggcgagatgcgagatgagtccaagatgaccttcaaccttgctgtaactgctgttatcaacaagctgttgatagcgatatatcaacatatcctcactaaattcagagtacagtgcacttccattgtttgatgttgagcccgaacattggagcaatccttgaggcagattagtgcatcagatattagattatgtggcatcagtttgtgcctgtatttgttgtatgctattgtgtattgtttgtgccaacataaactatactgtttcgaagttggttgtgtacatatatagaaactttggaacgtttggattctattaaacagaaaatcaattgaaattgagcatcaaaaaaaaaaaaaaaagggcggccgccccnnnnnnnnnnnnnnnnnnnnnnnnnnnnnnnnnnnnnnnnnnnnnn

SEQ ID NO: 7946 - DNA, 711 bp, Sorghum bicolor
  Clone ID: SORBI-28MAY03-CLUS15225_1
aagacatgcagcgttcagtgttctgcctgtgcccattgggttgggctccatggagtcccaggctggtggaagcagtggttttcggctgcatcccggtgatcattgccgatgacattgtcctgcccttcgcggatgccatcccgtgggaggagatcggtgtgtttgtcgctgaggaggatgtcccaaagctggacagcatcttgacgtcaatcccaacagatgttatactgaggaaacagcgtctcctcgcaaacccatcgatgaagcaggccatgctgttcccccagcctgctcaggcgggtgatgcattccaccagatcctgaatgggctcgcacgcaagctcccgcatggtgacaacgtcttcttgaagcccggggagagggtcctgaactggaccgccgggccgccaggcgacctgaagccttggtagcatctgcctgccatattactagaactttttggggaaaaaaaaggaagattgaggacatggtgatatatatacgtgcgcctttaagttaccatggctgcatagttctgaccacaaaaaaaaaaaaaatttttgtatgttctttctccttttccctatagctgctatacctgtataccatatatcttcattcctctctctttttgcccctttcactaggtgatgagaatgtcagccttgtcaatcatgtggataccatagtcgaaatctacaacatttactc

SEQ ID NO: 7947 - DNA, 962 bp, Sorghum bicolor
  Clone ID: SORBI-28MAY03-CLUS15292_1
gcgcccacgcgtccggctgctgctatgtccaagcatcctgtttgggtcatgaatgtggttcctgcaaatagaacagagaatactcttggtgtcagcactgagcgaggtttgattggaacatacactgactggtgtgaagccttctctacttatccacgaacatatgatctgatacatggtaatggaatcttcagctcccatattcacaagtgtgggattatcgacatcctggttgagatggatcgcgttctccggccagggggtgccgttatagttcgggacagagctgatgttgttctcaaagtcaagaaggacgccgaccgtctaaaatggagtagtcgagttgttgacactgaaaatgggcctctggatcctgagaagcttctcattgtggacaattccctcccacttcgagggagctaaagtgattactggcaagaaccaagatcagcaggctcttcatgttcatgacaacaggttcttggtcttctcatgtttcgagaaagagccagtggtctgcgaccttactacctgtacaatatgaatgtcttttggcttaaaaagatcccactacatgtacagatgaagcgtatcagctaaacctatacagatgaagggtacaaggatattggctatcctacaatgagagattcagaattgcatgcagatctacatatatgacccgtccaatatattcgagtcactgacgactccacaggatgccatttcttagctccaatctgcaggcctcatttctcatgctctgacgactagctgtgcagctggaaccatgcgatcacgactctgcagatatgtctacattgactgtacttttcctttttggtgggatctcgactctgtagatatatgatacagggactgtactttctttttatggtaaatccattgcctatacatttttatatagtgttgtatattgctgtgttgtacaagcgaagtgg

SEQ ID NO: 7948 - DNA, 661 bp, Sorghum bicolor
  Clone ID: SORBI-28MAY03-CLUS15319_1
aacactccagtgaagcaccatggtacagaagataagacaaacagcaattggtgggcacatgcccctgcatatccttctggtccccagggcagcttcatcgagcctccggaatttggaaatcgatacatgacagatcctcattccagtaatcacagtggcgatacatcagagggaagcatggaggatctagagcagagcaatcgcagaagcagcagcgtgtggaggagcccgcaagctttgtccaagacaagatatatggacgactctgacattgaggaagggctaagcctgcattttgctgatgtccatcagaaggatgaagatgatagacacctggtcatggatcatcaagatcccgcgccagctggtcttccagtaagaataatacctagaagcagtgaccctgtgtaagctggttaaactcaacaggactagttgatgcatgttaacggttgtaatttgtcgtttgaaccacttcagagtcaaatggtgcgtctcgcccataaactggcaaaacagccacagattcttttgtacaggtcagtaacctctgtgtatatatattatatagcctcctgctcagaccagggcgggtaagatagaaacattcttttacaagttggaagggtgcttggttgctgcaatgcaacacaagtgcttt

SEQ ID NO: 7949 - DNA, 814 bp, Sorghum bicolor
  unsure (1)..(814): unsure at all n locations
  Clone ID: SORBI-28MAY03-CLUS15320_1
gcacgagggctaatcgaaagcccaaaagagagagcggagaggaggaagaagacgacgcggcaccatggcgacggcacaggcagcgtcggcggcccctacccaccaccgcgcgtctccagggacttcgccgccgcagccgccgtaccccagcgccgccaggattgccgactccgcctgcgagagagcggagaggaggaagaagacgacgcggcaccatggcgacggcacaggcagcgtcggcggcccctacccaccaccgcgcgtctccagggacttcgccttcgcagccgccgtaccccagcgcccgcacgagggccgactccgcctgcttcccccagtacaccgcctcgctcaagtgtttggaggccaaccaggacaagagcaagtgccagcagcagttcgacgattacaaggagtgcaagaagaaagagagggaggctcggctcgaacggaataaaacaagatcactctttgggtgaacaatggtgtcccatctgagcgatttgctggcgatgtgtaataagtcgtttccagtttcctgatgtgagcgaaatcacggcttgtttggtgtcatgatgatcccttgcgacttgtgcaaggtagggactagtatactggtctgttgtctctaggtgagggagctgtaaggttcgtctgagaacagctcattaacccaatggctatggtgaaagaatcaaatgagtgaggctgtattttgagaacgagcaggtgtcatgaccccccagtttgttcaataaaattgtagccctggatgttgtactccnnanaaaaaaaaaaaaaaaaaaaaaaaaaa

SEQ ID NO: 7950 - DNA, 848 bp, Sorghum bicolor
  Clone ID: SORBI-28MAY03-CLUS14642_1
tgaagatcaggatgatcttaaaaatattagaaagacgattcagcggatagcagcaattcaatatactatcccagacaacattcacatatctgatgattgcagacaactcatttcacgtatctttgttagcaatccattaaggagaatcaccatgagggaaataaaaaaccatccatggtttctaaagaacttgccgagggagctcacagaagcggtgcagttatcctacttcaggagggacaacagtgtctctgctttttcagagcaaacaaccgaagaaatcatgaggattgtcaaggaggcgagaaccttgccaaaatcattgagatcaggctatggctacagtgaagaatgctcagatgtggaggaaaatgaagaggagagcgaacccaaagaggtggaagaagaacatgagcaacaatagagggttagggaggtctgcgaaagcggggagctggatatgacctcactgcacatctaaatgctgcctgtgacgtgtctgaatgtagataattggctttattgtctgctgaatttggtagaatgtatgcaattctggcgtcagatgtagtagtctattaaagccttctccaccctgtaatatatttgttttgttgaactgtatgtgtggtatatgggtttgttctaaaggagcaaggttgtgtacaggcacacctgattgtgtttttggataggaagttctaccgtttgtttgcactctgcagcaaacattttggagtttgtaagctatatgttcgggcatatccggtaaaattggatgaaatgctgcaaattctgtcaaaaaatgagttgtgtaactttgcaaacattgaagataaaagaatttg

SEQ ID NO: 7951 - DNA, 1045 bp, Sorghum bicolor
  Clone ID: SORBI-28MAY03-CLUS14609_1
gccggccatatagagccccctttccttcctcttcgatcccgacgacgccgagcggggggcggcgatggaatactcaggcggcggcgcgacgctgtcggagatgtaccagagcgcgcggcggctgctactctcggcgcgcgacggcgtggcccgcgtcgagcgcctcgcctcggcgcccacttcgtcctcctactcctcggcgccgctcgtcggtggcggcgctgcgggggaccccgcggtcgctgaggaggtgcggcgagaggtggcgcagatccaggggctgtgcgcgcagatggaccggctctggcgatccatccccgccaagggccagcgggacctctggaagagaaaagtggagcagctgtctgaagaggttgattcattgaaggaaacccttgacaagcattctttgcgtcagaaaaaacgaattctggaagcaaaagaaagggctgagctatttgagagagctaatggtgaatcttcacatgtcctccgaatatttgacgacgaagcccaagcgaagcaatcagctcgtaactcctcaagaatgcttgaagaagcttatgagacaggagtggctatccttcacaagtaggctgaccagagggatcgactgaagagtgctcaaaggaaagctttggatgtcctgaacactgttggtctatcgaactctgttttgaagctaatcgagaggcggcaccgtgtggacaagtggatcgcgtatgctggtatgatcatcaccgtagtggtgatgattgcgttttggcggttaacgcattagtgcttgggctgtgtttgttgcatatttctatccgagatatgatatgtacaatgtgcaaatgtgggaaacagggtagattcagatggtgcaaaatttttcgctggcagttatgtttgcctcgccggtccttcgcacgcatggttgatggcgtcatatgtaaaagcagttccttcacggcatagttacaaatccaatgccggccccccaactgggttaaatattcaaattcctttgtacgaaaaaaaaaaaaaaaaaaggccccta

SEQ ID NO: 7952 - DNA, 1218 bp, Sorghum bicolor
  Clone ID: SORBI-28MAY03-CLUS1466_1
gcacgaggctctggtgaggaaatggtggtcaaggtaagaaagccatacacaatcaccacgcggcgggagcggtggacagaggctgagcacaaacggttccttgaagccttgaaactttatggcagagcatggcagcgtatagaagagcatgttgggacaaagacggccgtgcagatcagaagtcacgctcaaaagttcttcaccaagttggaaaaggaagctatgaccaatggtacttctccggggcaagcccttgacattgacatacctccaccacggcctaaaagaaagcctaacaatccatatcctcgaaaaagtggtctcagctctgagacaccaaccaaagattttccaaatgacaagtcagcaaaaccaaatatgcccttgagcaatggaaatgtacaaatggcaggtgatgcatctcttcagaaatttcaaaggaaggagttgtctgaaaaaggaagttgctcagaagttcttaatctcttccgtgatgccccatctgcgtcattttcttcagttaacaaaagctcttcaaatcatggtgcacccaggggggtcgaggcaagtaaaacagaaatccgagatatgaccatcatggaaaataattctcttaaccccaacatgcaagaggatgtaaaggagatcagcgatcatgaaatggaaaggcttaatagtatccaaatcagctctaaatgtgaacattctcacgagggatatttggatctctcaatgcaacaaatgaagctaaagccaaaatctgtggagacaacatatgtggacaaacaaactgcaagagcttcgcactcccacgcggagaaaaatgggacagctagcattctggtcactgcaactgaaggaactcattctgatcaaacaagtgatcaagtgggaatcaatggaagcattaacccatgcatccatccaatgctttcttcagatccaaaatttgatagcagtgccacaccacagcattttcctcataattatgctgcctttgctccaatgatgcagtgcaactgcaaccaagatacctacaggtcattcgtcaatatgtcatccaccttctccagcatgcttgtttccacgttgttgtcaaaccctgccatccatgcagctgccaggctcgcagcatcatactggccagcagctgaaggtaacacacttatcgatccaaatcaagaaaatcctgcagatgatgttcaaggaaggaacata

SEQ ID NO: 7953 - DNA, 713 bp, Sorghum bicolor
  unsure (1)..(713): unsure at all n locations
  Clone ID: SORBI-28MAY03-CLUS14807_1
cagnatcagcagcatgtnnnaaatcagctgcttcaagaagttaagaacactaacggccgcacattgccacagcaaccacggccagatacccctaatgcaaacagtggtatcacatcaggaggtgctaacaccaacagtgctgctaccggagagcaggcacagcgcatcaatagcagcgccgaaaagggtgcagctacggtcggtaccgggcctagtaatgtgatcaacaacagcacagccagcattgtccccagcagaagtaacagtttcaagtcagtaagcagcaatccagctgctgctgccgccgcctccgctgctggaggcaatgccgcgacttcgaaggctgagcccttccacgaatttgatgacttcgagcaactcctcactaatgaattggtgggaaacgagttcttatgggacaattgacagagtacaaagacaccgtactgctcagacttcagtgtaagcgttgagaaacagccttcttggctgctagtatggaaactagcgtgtggcgatggaaagttgcccaggattctagtttctgtttcatttctcttttcgtaggctttgtattgtattgcccttcgggacagttaactgatgtaacatgagatgtgtgagataggagttgcatttggcttgtaaatgtgggagcagtaaccgagttactagaacatatatatttgctgcgggccgcctctgtttgtcaa

SEQ ID NO: 7954 - DNA, 743 bp, Sorghum bicolor
  Clone ID: SORBI-28MAY03-CLUS14895_1
gcttcatggctcttaaaactgtgctgctactcccatatgaagctctgagactgcagtgcctgcagatggtggaggcgaaaatgagggaaggaatcgtgtccacctcatcaaatgctgatgatcatgagctccttgccttggttctttcctctgaaactatgcagaagatcaccatagaagaggcgtactccaaattttctcttacatatgccatcttgtcgggcaccttgcaaggtcattccagactgctctcctcgtacaatggaacgatgaagcaacatctaagatcaacagatctttactgttcggtagagttttgtttccatgttttgtatctgaactggtcctcagagggcagtatctctggctgggttcgtcatctcgagatggatgcacacacatccatccctgggcctgatggatatcactgagaccagtgtgcgacgcttccttcaaggccaggttgcccaagctgagctggtgggaggaagcgatgctgctttcactgacggtgaagtttgtgtaaggcacacaatctccaacctacagtcgaaacttgtttctcttctgcaatccgcattggcagccctcccgaaccaggagttgtaagcagcattagttttgtgtacatttatttaactttacattgttgctgtactgccagtttacctgtaacatataatgtttacttgagatgatggtaaaaggaatagttggagattgcagaatgttttcacaaacct

SEQ ID NO: 7955 - DNA, 674 bp, Sorghum bicolor
  Clone ID: SORBI-28MAY03-CLUS14924_1
gtgaagggcctgtcgcccaaggtgctcacgctggtggagcaggagtccaacaccaacacggcccccttcgcgcagcggttcgcggagacgctggactactatactgccatcttcgagtccatcgacctggcgctgccgagggacgacagggagcggatcaacatcgagcagcactgcttggctcgggagatcgtgaacctggtggcctgcgagggcgaggaacgggtggaacggcacgaggtgttcggcaagtggaaggcgcggctgatgatggccgggttcaggccgtccccgctcagcgcgctggtcaacgccaccatcaagacgctgctgcagagctactcgccggactacaagctcgccgagagggacggcgtgctctacctcgggtggaagaacaggcccctgattgtctcgtcggcatggcactagacattagtgttgacttcagagaatgttgatctgatgggagaatgtttcttgtaactttctaagaacctcgtagtagtttagatatgtttggctgagcactaaaactatatataggaagcctgtagtgatactgagtcggagtagaacacctatagcctgatgctgtgatggcagtcactaccagcctgataatgtgtagtagtaagtttgggtatatgtttcagttaatcagttttgctttg

SEQ ID NO: 7956 - DNA, 779 bp, Sorghum bicolor
  Clone ID: SORBI-28MAY03-CLUS14937_1
gcacgagggccgcttctgctgccgctgccgccgtcacctcccagcagcagcagcagcagcacgtgtaccgccccgtgccgcgcgcgggcggcgtggtcgtgctcccggtggcgccgcctcttgcgccgcggccgccttctcctcctcctcctcctccgccgcagcagcagccgcctccggcgacctccttgtcgctgtccctctccctgccagggctggaccagcagcccgaaccatccccagcgacggcaccgcctcaacctcctgtacagatacatcagcatcaggcagctcctcctcagatgccgccgccgccgccacaagcccaaccgagtccgaggttgccgttccagctgcagccggcgccggcgacgaacctcacgtcgccgcagccggcggcagcagcgccgttcagctcggagttcctgctgatgatgcaggagatgatccggatcgaggtccggaactacatgtccgggtcgggcttcgacccgcgcgccgacggcgcctccgtgcacgccgtgaccaagcgcatgatgggcatggccaagatcgagtagtttcagcagacagcagcagcaggcgtccaagatcaggaaggaatcgccgatcgatccgcggcggccaccgcgtgtatgaaccaagaacagcgtgtacaaaccaaacagaggccgtgccgtgccgtgccgtgcggtgcggcaagtgaagagaagaacgagcgagctccatccatcggcggcttcgcccggccccgcccgccgtcgtttaaacaaattcct

SEQ ID NO: 7957 - DNA, 903 bp, Sorghum bicolor
  Clone ID: SORBI-28MAY03-CLUS14958_1
gcacgagggctggactcgcaggtggtgacggtgacgaggttccagggcggcggcgcgttcaacgtgatcccggactccgtgacgatcggcggcacgttccggtgcttctccagcgaaggcttcctgcggctgaagcggcggatcgaggaggtggtcgtggcgcagtccgcggtgcaccggtgcgcggcgtccgtggacttcggcgccggcgggagcccgctgcttcccccgacggtgaacgccgcctcgctgcacgcgcacttcgaggccgtcgccgccgagacggtcggagcgggcgccgtccgcggcgccatggagccgtgcatgggcagcgaggacttcgcgtccttctcggaggccgtccccgcctcgcacttctacttcgtcgggatcgggaacgaggccatcggggccgtccacgccgcgcactcgccgcacttcttcatcgacgacggcgcgcttccctacggcgccgcgatgcacgccaacctcgccatcgggtacctgcggaaccacgcggcagccagcgggcccgtcggcccccacgacgagctgtagctgtactgcaggctgcagcctttcgcgagcggccacggtgccggcggcgccggcttcgcgctcatggtggcgcgtgcccagcgaagctcgacgagctcaagaaggccaggttgcagttagcgcctgcgatccgtcgagcagtcacgtactcacgtcgggatccgatcgatttgtgcgactgatcttgctgcccaacgcgagggtcgtaaagctggtcaagctcacgatgtgattcatagattgggagctgagatgatgcctgtacagtacaggcgctcctgtccgagctttgttccacgaatagtttgggaaatgaaaggtttcccactctccagtgggcaattt

SEQ ID NO: 7958 - DNA, 705 bp, Sorghum bicolor
  Clone ID: SORBI-28MAY03-CLUS14971_1
caatgcaatggataacgagctcaagatctgggatctgcgcccttacgcaccagagaacaggaacatcaagactcttacaggtcaccagcataactttgagaagaacctgctgaagtgtagctggtcgccggataaccgcaaggtcactgctgggagcgcagaccgcatggtctacatctgggacacaacgtcaaggcgcatcctgtacaagcttcctgggcacaatggttctgtcaacgagactgctttccatcccaccgagccgatcattggatcttgcggcagtgacaagcagatctatcttggggaactttaagggactatcagttctttttcagctagaagatgttcttgtgacactttggtgagtaggagaaaaggaggcatcctgttcatttgccagagttggagtactcgtttggctatcaggatatggatgtcatttgtagattgtcttagcctattcagcccagttgggtctgtggtctgccgttcacaaactgctccatgctttgtaccttctggcattctgatgttaaacttgatgccatgcttgaaggtcactgattgcatgtactgtgtctagaaccatactctccaaaaacttgcccgccttagtgctgtatgccatattgttatcttttctagtcgtctgaaactagttggagaaagtgataccgccttcctggcacgatttgaaagtat

SEQ ID NO: 7959 - DNA, 635 bp, Sorghum bicolor
  Clone ID: SORBI-28MAY03-CLUS14986_1
cccacgcgtccggtccagataacaagattggagcacataaatgccctttctagcaatgtggaatatctggcgtcaagggatgcaacgatcatgggaagcaggaatggccatgcgcctatcttcctctggtacaccctcaacaggaagggctacagaggctttcagaaagaagtccagaagtgcttgagaaatgcacactacctaaaagatcgcctcaaggaagcaggagttggagcaatgcttaacgagctcagcagcacagttgtatttgaaaggccgaaggatgaagaatttgtccgaaggtggcagctcgcttgtgaaggcaatatagctcacgttgtggtgatgcccagtgtcaacattgacaagctagattatttcctgaatgaattagtggagaaacgagcgacttggtaccaggatggaataagtcaacccccctgcattgccagagacgtaggcgtcgagaactgtctgtgtggccttcacaagtagtgtgagccttttgcaagggggttcattcgtgagtcgagttaaagtgttatgttgtactgtatccatgcgttctgtatgtgataataatgtgttccacagtgtagcttatttgttgccatgagaataaaattcttcatttt

SEQ ID NO: 7960 - DNA, 616 bp, Sorghum bicolor
  Clone ID: SORBI-28MAY03-CLUS18082_1
accggccggaccctccacggaccctctgtgtagctctctatccctttcacatccctttttcttcagtccttatactttggagatactttaacggtagtgtccatgttgtaagcaagacgtataaccctgccaatgcgctggacatgtcatgttacggtcatgtacaaaagcgccatgaggctaagggctgcctatttgcatgcgtgctgctgcttctgctgctacgagacctgtgagtgctgcctcgaggccatctgctgctgctgctagttcagcttagacggcatgcatgggcatccatcatcgtggagatgctctctcaatgctagctgtcccgttttgaaataaaatgctgtacttatatgcacgtacactaaaaatgcattaaggtctctgggtgtaatcgtgttaatattgcatcttttagttcatttgagaataatttgggagattaagtcacaagtatatgtattcaaccagtcgctgatatttctctgaatactgtaaagtgtggagaatactacaaagaagatttctgtgtcataaaatcagcctaacatgcgcacttatacattggaaagatcaaacttggaagtcatatgcaaattacacctta

SEQ ID NO: 7961 - DNA, 681 bp, Sorghum bicolor
  unsure (1)..(681): unsure at all n locations
  Clone ID: SORBI-28MAY03-CLUS18239_1
tccggccgggccgccgcttcacacacctcgcgcgcacacagtcaccgtctcgcctcgcagtcgcactagcacacacccgtccccatctctcccggtctcgcgctcctctccgccgaccgccgcgtccggccgcggcaactcgacctgcgacagtcgccatgactacctcaaggcgtcttgctgataggaagatagcacgatttgagaagaatatcacaaagaggggctctgttcctgagacagtcaagaaggcaaatgattatcctgttgggcctattcttcttgggttctttgtcttcgttgtcgttggatcatctctctttcagatcatcaagacagcatcaaacgctggtttcttctgaggagaattggtcatttacttatagtccctcagttaaagtctgaggaacagggttgacatatgcagtttgtcacttattagaaactatacaagtgtatggcgtagcagatactctataatgtcgccattttaatgttgtaccgtggagagttttaagttataatagtcatatatatgtaatggaagtgctaatttaagtcacttggctgacaggaaagatgttgaagtaatacataatacatatctagtaaagttacagttcgacttanntannannnnnnnnnnnnnnnnnnnnnnnnnnnnnnnnnnnnnnnngaana

SEQ ID NO: 7962 - DNA, 653 bp, Sorghum bicolor
  Clone ID: SORBI-28MAY03-CLUS18478_1
ctgtgcggcgctcaggcggcgggtccgagcccaggacgcacgagggcctgacttaggaggaggtagtaggaacgaagaagcaaactaaaccagtgcacacgatgggtggcacctacctgcccctcgccgccctcgtcctcgccaccgccgtcacccttcttgtcgccacatctgccgttccggtggccgccgccgccgccaacaacaacaagtattacagtggcaggatggtcatcatccgcgcaccaggggcaacgacggtcgtcgtctctgctggcggtgctcttaacaagtggcggcggcagcagcagcggcggcggcgcctggtggaggacgaggtggcgccggagttcgtcggcctgctgggggcgggcaacggcggccaagtctcctataatgccgagaacaaggacaggccggtttgcctgccggacggctcgtgcgccgcccggggaggttcgtacacccggccgtgcacgtacaaggaccactgcccgcactgacgtccatgagcacgtagtacgttcgagaggcgatgcatatgcatgcctgtgtgtgtgtgtgtgtgtgggggtgttctcgttgttgcagccgcacaaataagtgaataagtgaaccccagtgcagtatgtacgtgcgtgcgtgctccagca

SEQ ID NO: 7963 - DNA, 749 bp, Sorghum bicolor
  unsure (1)..(749): unsure at all n locations
  Clone ID: SORBI-28MAY03-CLUS2348_1
ccgggacgaaatatacgtcagaaaataaaccggcagcaaatcttttgcagcaccggcagcgctcgattcctgcaatccgccgctccgaatggactcagggtacaacccccggacggtggaggaggtgttccgggacttcaagggccgccgcgccgggataatccgcgcgctcaccactgatgcggaggatttcttcaagcaatgcgacccggaaaaagaaaatttgtgcctgtatgggtttcctaatgagagctgggaagtgaatttgcctgctgaagaggttccacctgagctcccagaaccagcattaggcataaactttgcaagagatggaatgcaggaaaaagagtggttgtccatggttgctgcacacagtgatgcatggttactttctgttgcattttactttggcgctcgatttggtttcaatagaaatgacaggaagcgcctctatagtttgattgatgatcttcccatggcttttgaaattgttagtgggaagagtgaaaccaaggcaccagcaccaccgccaccaacaccaaacagtagtaaccatagcaatatcaaatcgaagtctaacaacaaaaagaaaccatcggagcctaaggtgaagcagacaaagccgcgtgcccctgcagaggaaggcccgggcggtgaggaggaagatggcagtgcaagcgagggcgagcacggngagacgctgtgcggcgcgtgcaaggaaagctacggccccgatgagttttggatct

SEQ ID NO: 7964 - DNA, 654 bp, Sorghum bicolor
  Clone ID: SORBI-28MAY03-CLUS23589_1
ctccccccggattggagttgccagcgagcccgcgacgtccactgagcaccggcgggcgcggccttccacgcgggccggtattccgttctcctgccgcccgcccgcatcgccgctatgaacaacgacggcggcgtcgcagcagacgacgactaccgcggtgcggccgctcgtcgcggcgtctttcccggcgtccacaaccgccggttcagagccgcgctctacctggcggcctggggagtcgctgggatcatatccaccacagtgccaagcctcgcagccaacgcagagcacgtcatggtatactttctcctcctcatggctgccgtgctcctgcttctgctctcaatggctgctgtggatctgccctggctggagacggcggcggctcgcctcgagttccttctcgcggacatgttctagctaggatcagacgaggcacgccagcaatcacaatacttttgctttgtttggtcttctcttcgcgatgcttgcctttttgtgttgtgtgtgtgatatatatgagactggagtatttgtgtgtacataacgtatggattgtaagattgctcctataagtatgatgctaaaccctttcgtaatctctggaactgctgtggattattttgtgtgaaaaaaaaaaaaaaaaaggcccct

SEQ ID NO: 7965 - DNA, 856 bp, Sorghum bicolor
  Clone ID: SORBI-28MAY03-CLUS23698_1
gccgcaacgacgagttctgcagcagcgacgtcgaagtgtgtcttcttggaaccgtagcaccatgtgtgctctatggtagtaatgttgagaggcttgctgctggacaaggcacatttgcaaacagctgtttgccttacactggcctgtatatgcttgggaactctctctttgggtggaactgccttgccccatggttctctcatcccactcgtaccgctattcgacgacgctacaatcttgagggtaactttgaggctttcaccaggcagtgtgggtgctgcggcagtctggtcgaggacgaggagaggcgcgagcacctagaggctgtctgtgaccttgcgacccactacctctgccaccctcgtgccctctgccaggagggacgcgagctgcgccgcagggttccccaccctgggttcaacaatgggcactccgtctttgtcatgatgccacccatggagcagaccatggggcgtggcatgtgagctatttcagctcctgccctaccctagttcgatctgtgcttcctgtgttttcttatctgccgctgttgtcgtctgatatgtcgtttgtttgtcagtaaatacgagtttgtgatatgagaacgtgttgggaactttggattgtggcaaatggatctgtttgctccttattaactgccgcttggattctgaactatatattgtatctcctgtgtcactgtgtttgttcgtggtcctatcgggcctgttagtgtgaagtccattccatcgtacctcaattcgtgtcccaactctcttaaacacacgggacaagagctgaaaaatggttggtgacttgcaaccggatggagatgatcgctagtatttgtgttcgg

SEQ ID NO: 7966 - DNA, 1056 bp, Sorghum bicolor
  Clone ID: SORBI-28MAY03-CLUS23737_1
atcgcacgcggcaacgatcacacagaaacaagcggcgcacaaaggacagcagctagcatgggtccagctcgccacgccgccgtcgggacgctcctcgccgccgtggtgctcctgctctccgccgccgtgccgggcgccagagcgcaggcagaaacagagcatgaagaggggttcagctacatcccgggcgcgcctaacggtccggaaaactggggcaagatcaagccgcagtgggcgaactgcagcgtggggcggatgcagtcccccatcgacctctcccacgagcttgccaagctggtgcaatccctgggctacctgaaaaccttctaccgacccgctgaggccaccatcgtcaacagcggccacgacgtcatggtgagtttcaagggcgacgccgggagcctggtgatcaacggcacgacgtaccacctcaggcagttgcactggcacacccccagcgagcacaccatcgacggccgcaggtacgacatggagctgcacctggtgcaccagaccttggcgaacaagacagcggtgatcggcgtcctctacgagatcggccccatcagggacccattcctgcagatgctagagcccttcatcaggagcatcgagaacacgaaggaccagccgaaggacatcggggttgtagaccccaacggtgcccgcggcagcggcagcgcctactaccgctacatgggctcgctcaccacgccgccctgcaccgagggggtcgtctggaccgtcgtcagaaagattagccccgtggcaaaggaccaggtgaagcttctcagggatgcgctgcaagacggaaatacgatgaacgcgaggccgcttcaggaggtgaacaacagggacatcagcatcttccgccctaagccccatcatcattatcactagtgatgcatcggctgatcaacagagataacatatcacatttcaataccttattatagcagacgacgatatatgtatcttgtaattctctatgtttctatgtacttatgttatggaataatcgagtaattaattaataaataaatggtccactattcg

SEQ ID NO: 7967 - DNA, 928 bp, Sorghum bicolor
  Clone ID: SORBI-28MAY03-CLUS23850_1
gcacgaggcggccttccccgtccgctcaccctccctcgccccgtcggtcgcccgcccgcccgcccgcctcgcaatactttttcgccaccatcgttgaaccttcctcctccaccgctctgaccagggcggcacggccgaggcgcccgtcatcatccttataaatcggcgccgaggcgggccgtcgtctccctcccagaccgcagcagcacagcacgcagccgacggggagagttgagccctgagaagcagagagggcggtagggtgattcgatggcgaagctgtacgtgcaggcggtgccgcccccggatctgaacaggaacacggagtggttcatgtaccccggggtctggaccacctacatcctcatcctcttcttctgctggatcctcgtcctctccgtcttcggctgcgcccccggcacggcgtggacgctcgtcaacctcggccacttcgcgatcacatatcattttttccactggaagaaggggactccatttgctgatgaccaggggatgtataacacattgacatggtgggaacaaatggacaatggcaaacagcttacacgcaaccgaaagtttctgactgcagttcctgtcgttctgtacctcatagcttcccacacgacagattatcagcatcctatgctcttcctcaacaccctagcagtcattgtgctggttgttgccaaactaccaaacatgcacaaggttcggatttttggtatcaatgctggaagctaagcagcagggtcccacggtagaatggtatacacggtatgtttcatacggatcacgggatgtgtttcacctagctctaaactgcttttgccagagtaccagtgtttgagatctgtttgtagatgaaatgtaatcattgtacagttgacatgtttagatccgtaatggtgctatatgttggcaaagc

SEQ ID NO: 7968 - DNA, 622 bp, Sorghum bicolor
  Clone ID: SORBI-28MAY03-CLUS239_1
ccgcaagctgcagctagacagcgacggcgacggcggcggccctttctcccggttccgggacgaggtcgccgccgtgcggcagttcctctaccgcacccagaaggagctcgccgcatgcaccgacgagatgtgcttaaccatggacggctcggcgagctcgtaccagctgctgggcaacttcgccgccggccagcaactctaccggctggaactggaagccgaggaggacggagcttgttccagcatactgttctctgcacctaataataataaaggcgatggcgcttcacaaggagctcaagctcatcaccctcagagagtgaagcttccaacgctgcgtgctacggagcaacatcttgcagcgcttcaatgtacatacgaatatacgtagctggccgggctctagcatgtggacaaatatacatacatttatcctcatgaggtccaggtgcctgcaaagtttaaagaataataacaggtccatgtaggcttcaaaatttccttcatcccatagacgacgtttgatgtccatgggtgtgattctcataggaaagatgaggtccagttggctgcaaaatctggtctatggatcattggatcttaaacatagccggtttatctc

SEQ ID NO: 7969 - DNA, 1161 bp, Sorghum bicolor
  Clone ID: SORBI-28MAY03-CLUS23937_1
aagctccactccggcactgcgagcaacgccgccattgtcgtcgtcgtcgtcgatggccaccgtctcgctcctgcgagccgcggcgctcggtctggtggttctggcgtcggcgctgccggcggcgcggtcatggagcaaagagggtcacatgctcacatgccaaatcgcacaggatctgctcgagcctgacgccgcgcacgccgtgaggaacctgctcccggacgacgtgggcggcgacctgtcggcgctgtgcgtgtggccggaccaggtcaggcactggtacaagtacaagtggacaggcccgctgcacttcatcgacacccctgacaaggcctgcagcttcgactactcgagggactgccacggccccgacggcgccaaggacatgtgcgtcgccggcgccatcgccaacttcacgtcccagctgctgcactacaagcacggcagcgccgaccgcagatacaacctgactgaagcccttctgttcctgtcgcacttcatgggagatgttcatcagccaatgcacgtgggattcaccagcgaccaaggcggcaattccatagagctgcggtggttccggcacaaatccaacctccatcacgtgtgggacagggagatcatacagacagctctcgccgatttctacggcaaggacatggacgccttccgcaagcaactcgagcacaacctcaccaagggtacctggtctgacgatgtgtcggcttggacagactgcgaagacctctcgtcttgcccaaccaagtacgcgaccgagagcatagagctggcgtgcaagtgggcgtacagcggcgtccgtgaaggggaaacactgtccgacgactacttcgactcgaggctcccgatcgtgtcgcggcggatcgcgcagggcggggtgcggctggccatgttcctcaacaggatcttcggcgcgcacaaccgcgacgtgccgccggccgccgccgccgcgtcttgatggacccggccggacccgatcgcgcgcgcgcgacgcgacgcgacgcggctactttgtaaccttaattaacctgatggactcctgctgcgtcagtctaatccatgttaaccacgtacgtcgtgtcttggttacctagctgctgtcatatgattattgattcaagtctgatctcaagaaattgcacgtgg

SEQ ID NO: 7970 - DNA, 895 bp, Sorghum bicolor
  Clone ID: SORBI-28MAY03-CLUS23366_1
actctcactccggcctcctcctccagctttaattcgcagagcgacccccagtccagcgcgcgcgggtagtccacacacacacacaccttcgttcccagttcccaccaatacacagcgattgagccgcgcgccagtggacgcacacacgcggtagctttagcttcgttctcaagcttagcccggccgattctacgcgcgcggagtgttcgtctcgttcgttccggcagcaggcggcgaagtacgacgacgacgaggagctagagagcgaggatgtcgagccgaaggtcgtcgtcgtcgcgtggcaacatctccgaggacgagatcaacgagctcatctccaagctccaggccctgctccccagctcccgccgccgcggctccggccaggcgtcgacgacgaagctgctgaaggagacctgcagctacatcaagagcctccaccgggaggtcgacgacctgagcgaccggctgtcggacctgatgtccactatggaccacaacagccccggcgcggaaatcatccgcagcatcctccgctcctgatcacgtacctcctactgcggcgccggcgccgggccgggggctgcgcgtgagagctagcgaggtcaacgccggcctcgtcgccgacgacgacgaccgcaaccgttctccgcctgatccggctggccacgtgcgggagctgagctcaattagctagggtatatatatatctttctctctacaagtatgtgtatctttctctgccttttacctgtctccctagatctgagatcatgtggctagctccatatcaaaatgtactagctacacgcacacgtatgatggtctctgctaagcttcacactgggtagggtactactagcgcactagggcctaagcaagcttatcccccggc

SEQ ID NO: 7971 - DNA, 771 bp, Sorghum bicolor
  Clone ID: SORBI-28MAY03-CLUS23402_1
ctactggagcagctaattacatacaaatacggtgccccgcggtgtcgccccaggtggtaaacctctctctgtctctctctctgtctctcccgctctctctctctctgattgtgtgtgtgagggtcagaggagctctggagatgacggagagaagagagcttcggctgctgcttgcgctcttgggagtcctgcacctcgttcgtcttgtacctttggcagcgtcgcagtccttcatcggcatcaactacggcgaagtggccgacaacctcccgccgccgtcgtccacggcgcgtctcgtccagtccacaaccatcaccaaggtgcgcctctacgggacggacccggccatcgtctccgcctttgccggcacgggcatctcgctcctgctcggcgccaccaacggcgacatcgccaaccttgcgtcctcgcccgccgccgccgcatcctgggtcgccgcgaacctgccggccaagtcgccggccgtctctaccgtctccgtcggcaacgaggtgctcttcgccgacgcctcgctcgcctcgcagctcgtcccggccatgcagaacctgtacgacgcgctgccgcccaactccagcgtcaaggtctccaccgtgaacgccatggacgtgctcgcgagctccgacccgccctcctccggctcgttcaagccggagctcgcgacggcgctcgacccgctgctggcgttcctgagcaagaccggctcgccgttccttatcaacccgtacccttacttcgcgtacctcagcgacccgc

SEQ ID NO: 7972 - DNA, 926 bp, Sorghum bicolor
  unsure (1)..(926): unsure at all n locations
  Clone ID: SORBI-28MAY03-CLUS23431_1
antttcacaacggttccagccaaccgcttctttcctcgccacccatggccaccgcagcgcgcgccctcgtcgccgcacgcccggcgcggccgctcctcccgtcacggcgcctcccgtcctcctcttccatccgccccccgcggcaacgtggcggcggcgttgggtccgtccgctgcatggcgcggcggccggattcctcatactccccgctgcggtcgggtcagggcggtgaccgtgcgccgacggagatggcgcctctgttccctggctgcgactacgagcactggctcatcgtcatggacaagcccggcggcgagggcgccacgaagcagcaaatgatcgattgctacatccagacccttgcccaggtggtagggagcgaagaggaggcgaagaagaggatatacaatgtgtcctgcgagcgctattttggattcggctgcgaaattgatgaagagacctccaacaaactggaaggccttccaggggttctatttgtgcttcctgactcttatgttgatgctgagaacaaggattatggtgctgagttatttgtgaacggtgaaatcgttcagcgatcgccagaaaggcagagaagggtggagccagtgcctcagagagctcaagatcgaccccggtacagtgaccggacccgctatgtgaagcggagggagaaccagtcttaccagcgatgatgatgctgtttctggagatggaaaatgccacggtttccacaagttgcctaaatgtgatgctggagatgtagcagcaatcccccttccctactacccacatgagaatgacatcccccgcgtgcgctccgctttttaagctatacatgcttatgcatttgggcttgtacctctggttgatatgaacgatgtatccttttaacttcgcatgataatttaaagtcgtctttagtc

SEQ ID NO: 7973 - DNA, 1015 bp, Sorghum bicolor
  Clone ID: SORBI-28MAY03-CLUS23462_1
gctctcccgccaccgagcggtcttctcccccgcgcgcgctcttctcccgcgcacttccctcctacgcgcgcgtcttctcccgcgcacagcaatctcccgcgcgcgctcgaggaggtgaagccgccgtcgccgccaaaatttccaggaagcacgcctctttcatgccccatcccctccaagcctccccgttaatctccaacaatctgctgcctatctcccatcgaggttcatattcagactgatggacggcgaggcaaaagcgcccctagaacccgtcctccatccgctccatccgtccatgctgctgggacatgtggtccggtcgccggatctgctggaatccacgcttaagctggaggcatcggtgttcctcaagatgctagtgttcttcgaactagtgtttcttctgttggtggatggtggcacgaggcatatggttgcaggttatacccaccaggagggttctcaaattttctgcattcatacccatttgctaaccatcctaatggaaatgaaaattttcattttgttggtgctggaatgagtcagtctacagtgccaccaattgaacggggagctacaagaactccctctccagcacaacaacctcatgatacagtggatgatatagtcgatgatttagatgcgcaagaagatgaaacaattaatgttgatgatgattgtcgaactgagaagcgtttgaattggaaggtacctgacgacatacgattggcctttgcttggttgcgatgttcaaaggacccagtagatggaaatgacaagaagacagatgcttatttcctagttcagtcgtatactgctgatggtatatcatatatacgtttggtgatattgttgaggtgtaggggtggatcacacggtagtataccacagctgatcagctttgtttgtgttgcataataaatgtctttatttatagaaactacagttgcaaactttgcattgggaagcatggtttcttgtgatagagtcttcgagatttagactctacagt

SEQ ID NO: 7974 - DNA, 998 bp, Sorghum bicolor
  Clone ID: SORBI-28MAY03-CLUS2334_1
cgtccgaaaaccctatccagcaatttggcatgccaattcctcatactttctaacttggcatatctgcatatctagtgcgcaaatatgcacgccggctccattcttggcatgggactttatcttcatgcttagcgggacttttcgttcgcttagcggaactcttagtttcgataacgggtttgtgggttttggaaacgaaattggccaaactgctggagatgagatctttttttactctctatagtactttaagagttgacaaacaacaagatttgggaaataaattatgacaaacagtgggagatgccaacctttgtttcataacatgattatgcaaccatttttacgcagaaatgtatattggctggttgccacctggctattgcacgatgaaaaactaacttccactgaactataagaaggatagaagagggctaggagggttacaaagatgtccaacagggtggcaaactcaatcctgtctggtgttctgaaggtcactggctttgtcacaagcaccgtgttgaactccaaaccagcacaaaagtttttcaagttaatgcctggcgaagttattcttgcttcacttgatggatttgggaaagtatgggatgctgtagaagtgtctggcaagaacgtgatgcagacatcatcagttgtcacaacttctgttgtaacacacagatacggtgaacaagcaggggaagccacacacaattacctccacgctacaggaaatgctctcggagctgcgtgggctgtattcaagattaggaaagcactcgaccctaagggtaatttgaagaagtcatcttttgtaagccaagcagcgcacactgtagctaaagaatcaattgcgaggcaaaagaagaagtgagctggcctggtcgacagttcgactatgcccgtaatttaatctgttgctcttgtagtatgttagcaataggaactaggaagctagatcttgtgagtttgtgactgttgtcatgaggttttga

SEQ ID NO: 7975 - DNA, 763 bp, Sorghum bicolor
  Clone ID: SORBI-28MAY03-CLUS1766_1
ctgctcacgaatcgcttccaggcaagtttcagtgacgaagtcaatgataaagaacttgcggaattgtcatccaggcagcaagctcactagcttccagctactgaccaggttgcatcaattactatccttcgtgatcattggaaaactactcgggcaatcccactacaacttttcatgctaggaccgctgccggttgactaccaacgaatcgtgcttcacagctattcgggaaatccattgccagcttttcatgaaatggaagctctccgctttttccatttgaaaagtgcttcacagttgcgcatggatgacattcccgtcttgttgagcgagtatggaaggctgctttccacatgagatggcagcttgcctgttgggccctgtcgctggcgcctcactgatcgcgcgcccgaccgaaattgcggagaattttcttgcctgccaaaagcacactcgtggagccattccttgccatcagttagtctgttagtgcaagtcattgtcgcatcagtgatagcgcaccgaactgaattcctttttctttcgaggactgggacgcgcacatatttcgtgcagcctggctgggcactgaatggccatcaacacgtggagctgaggcggcgtggcaagccgcccattccaagaaaacgggtttgtgtgaggttggagttggaggtcacgtcacatgttttcagttttcattctcctgcgcaacatcttaccaaaaggacgctgcattgcattttactatactacctttgtt

SEQ ID NO: 7976 - DNA, 656 bp, Sorghum bicolor
  Clone ID: SORBI-28MAY03-CLUS17789_1
gccggccggtactggaaacgaacaggcagcgtcacgagcgcaactcacttgccacctccgctttgctctgccgctgctgcttcccccttgccacctcaaatccccgccgcgaatctatctttttcttcccccaattcaggcggttctcgctcccagaaggcaagcctgcccagtatggtgggatccgacgcgctgcagtccatcgtctatgcccgtgggtcgctccggctcctcgatcagaggaagctgccgctcgacatggactacatcgacgtcaagaattcagtcgatggctggaatgcaataagagatatggttgtccgtggtgctccagcaatagccatagcagcggcactagcattagctgtcgaagtttctgatttagatttcattggtacgcctggagaagcagcttcttttgtttccaagaaattggaataccttgtatccagccgaccaactgcagtgaacctatctgatgctgcaacaaagctccaaactttggtatcaaaggcagctgaaactgcaaaagattccaaagctatctttcaggcctacattgaggccgcagagacaatgcttgttgatgacgtggcagataataaagctattggctcacatggagctgaatttcttcaaaggcagcttgcaaattc

SEQ ID NO: 7977 - DNA, 1146 bp, Sorghum bicolor
  Clone ID: SORBI-28MAY03-CLUS17908_1
gcacgaggctaaaccccacgccccgctccggcgcctcccgctccggctcctactcccagtcggctagggttctgcgcggccgcttcctcgtcggcgcaatggagttctggggtaaagaagtaaagccaggagccacggtttcttgcgaagttggtaaggccggggttatccacctttcacaggctgcactgggggaaccaaagaaagcgagtgagaatgtcattgtgtctgtcaaaatcgacgataagaaattagtgcttggaaccttatcggttgagaagcatcctcagatttcatgtgatcttgtctttgataaagattttgagctatcccacaattcaaaaacagctagtgttttcttctgtggctacaagtctcctgttcctcagtttgagtcttattctggtgaagacagttcggatgaagagctagaaactgaccaccaaattccaagaaatgaaatttctgcggcaaaggttccagtgaagggtggtataaaagttgaatcatcttccagtgatgatgatgatgatgatttcactgatagtgaaatgtctgatgaagatgactccagtgatgaagatgatgtgtcaactggtgatgattctagtgatgattctggttcggaagaacagactcctaccccaaagaagactgatgtagtagttggcaagaagagagccattcaagctgaggcaccttctggtaagaaggcaaagtctgaacaatctgctcagaaaacaggtgacaagaaggtctcaactcattctgcaaagcagtctagcaagactccagacaaatctacaaagacccccacagctgacaagaagtcccccaaatctggtagccatgcctgcaagtcatgcaacaaatctttcagcagtgcgacaggacttgagtctcatcagaaggcgaagaagcatgaagcctagagcatgtgctgtacctataggttgatcaacttgagttatcaaaattagcggtcttatttttgaacttgaaaatgccaagtttggaacttgcccagtagtcatccgattagtggtcttattatttttgaacttgggaaatgtcaagtttggaacatacccatatatgtgttgagaacatgggaaacgtcaaggttagagcaggctctgttagccc

SEQ ID NO: 7978 - DNA, 911 bp, Sorghum bicolor
  Clone ID: SORBI-28MAY03-CLUS17886_1
tgtgcggcgctcgaggcggccgggtgagcacaccgcaagtagctagctagctagctagtagctactcggagtgacaaacaaagcttgtcgctaacgcgcgccgcagcgtggtgcgtgggcatggcgaccaccacgacggccaaccgcctcggcctcctcctcctcttcgccgtcgtggcgacgacggcagctccggccgtggccgcgggccctgcagcagcagcagccgctacgccgccgtcgccgttgttccggagggtgtacgcgttcggcgactcgttcacggacacggggaacacgcactcgacgacggggccctactcgttcggccacgtgtccagcccgccctacggcgccaccttcttccaccgctccaccaaccgctactccgacggccgcctcgtcgtcgacttcctcgccgagacgctggcgctgccgacctacctcccgccctaccttgttacctccaactcctccggcaacaccaccgccgtcggcgtcaacttcgcggtggccggcgccacggccatcgagcacgacttcttcgcccggaacaacctcagcatcgacgtcacgccgcagtccatcatgacgcagctggactggttcgacgcgcacctccgctccgcctccgccgggaccggcgagaggaccgccgtcgccgacgcgctcttctgggtgggcgagatcggcgccaacgactacgcctacaccgtcatcgcccgcgacaccgtccctcccaagctcgtccgcaccatggccgtgcagagggtgaccgccttcgtcgaggggctgctacagagaggcgccaagtacgtgatcgtgcaggggctgccgctgacggggtgcctgccgctggccatgacgctggcgcgcgccgacgaccgcgacgccgtgggctgcgccgcctc

SEQ ID NO: 7979 - DNA, 526 bp, Sorghum bicolor
  Clone ID: SORBI-28MAY03-CLUS1796_1
gggaaggcgagcgagcatggagctcactaccacgtagctccatcgaggccgcggtctgcgcctcgacgagcactacaacggagacgaagtcgccgccgccgccgtccacgtccaccggcgaggacagcccagggaggacacggcgccgcccctcctccgtccctgggagggcgtggcaaaggccgggacagccagtactcatcacgcgcgcgcgagcttgacgacgactccaccacgcccatgggggtccgacgaacggagctccgtggcgccgcctttggccggccgccaatgcttttttttttccccggaatattggtctaagactctcgctgctcgtggaagaacggatgagagcacccacccctgcttttccttctttgcttcttcctaacccctccagtccaactcttctagttctagactagaaaaatgcatggtacatctgttgaatcacttatttattgttttctttattatctttatattatgtgatgaagttaagggacattataacattcttaag

SEQ ID NO: 7980 - DNA, 798 bp, Sorghum bicolor
  Clone ID: SORBI-28MAY03-CLUS18028_1
tagtacgccgtttccgccatcgttaggcgttacgtccctgaaaggaaaacccaagccaacgatgaccacgacgacagggccaagaaacggggagtgtattccaaggcgaccaccgcccccctctcgcactccaaacagcccccggccatccgtcagcccagagccacaagataacgcaaccaacaagacacagcgagcgagcgagcgaggagaagggagtagcgcgcgcggcgcagcgcggcaaccaggtccaggagaaagggaagcccagttagcctggagccgagaagccgccgagggagcgagggagcagccaggcatggaggagcccgttccggctgatccccccaggattttctggaagtcaaggagatcagccaatggccggagcttgcaacaagaacctgacaaagatgctaccgaagaaactaatgagcaggctcaagaggaacccatgaagaccgacgatgcaacagatactacagctacagctgaggatgtacaaccagacccaaaagctaacttatctgagaagcggaaggctctctttgagcctcttgagccgatcaatggaaagcgcagtgctgaaatgctgcttccaccaccggactttgagcccgcatcatatcctaagggatggctggtgggcaagaaacgtaagctcgtcaatgtagatgttgtggagagcatgaggaggattgcaatccaagaaatgaacagaaaggtttataagatctctagtgggctgatgctacatacctacatgatatcaatgcggcatgcaatgctatttttcta

SEQ ID NO: 7981 - DNA, 574 bp, Sorghum bicolor
  Clone ID: SORBI-28MAY03-CLUS22231_1
ctcgggacgcacgaggagcagctgagcagcagcaggagacatcggagcagcacgtagaccaccagagctcaaacgcagtagtcatcaggatcaggaggagttgctcgatcggctgaaggaaaaacatcggtccatcgatccacccaccgcgcgctctgtcgtcggccaacaatcatggtactgggcttctttgggaggatgctgcggcggcgtcgccgccgtgtcgcctgctgccggcggtaagcaatcgggaggtgatccagaggctaagcagcggcagaagcggggggcaggtgaggggaagatgaacaagggaggcgagcagggagcggcagcagggggcaaggacaaggagaggaggaagaggcgagatgatagcaaggctccaccgatcgtggtgcatcagttccccttccactcgcgccccggcttgctctgaattcctcgattgaattatttctcttcatgttccttttttttgtaattctgtaattactcgcgatctgttgtgtcatccattgagatatatataagaaacactcaatttcccagcaccaaaaaaaaaaaaaaaaaa

SEQ ID NO: 7982 - DNA, 771 bp, Sorghum bicolor
  Clone ID: SORBI-28MAY03-CLUS22547_1
cgcgggcaccctcgcccacccccccctgcccgcgccgcccccccgccccccccccccacgcggcccgcccactcggcctgccgtctcactcccttccggcctgcaggcgcacttgtctctcccgctctcccgccgccgccggctcgtcgaccccctgcggcggagcgagatccatacatccctaggagtggcttcttcttcttcttcttcttcttcttcttcttcttcttcttcttctactgtcgctttcgctccaacatccgaacccataatcacggtgttcctttttgggattgggatagctgcttcaacatccgaactcagccagcttgtttgggattcatgtgccgcgagtggtttgttgcaactgaagccccatcgccaccgccgcagtgttgctaggagccatgtagtgggctgtgcccctgtaggaggtaggatagtggtgacggttagcaccaggtccaggtgaccttcatatgatatctttcttgcttcctgcaagtcgttcctgtacctttcagttaggctagatgtgatccgtctcacacccaagtgggatttcctgaccggactgtccctgaacgtgtatttatgctcccttcactcgtattcaaggtcacctcactgagtgtactatttaactgaacaaaggcacaaagcattgtttccgctgtaccattaagtctcaacccaccagagcgtagtttcagtcgattttgttgcaaccgtcaagcatttgcaatgtcagtgtaattgttctgccaattg

SEQ ID NO: 7983 - DNA, 750 bp, Sorghum bicolor
  Clone ID: SORBI-28MAY03-CLUS2237_1
cgtgcggtaaataatagtttcaccatcgagtgtggagatgttacagatgccagctttcaagaatacaggctcagtagaggttccatagctggcattcttactcttgatacagtggcagactatcttccgagaaggggacccctgaagcagagaaggacaggtattgcatatatagcaaatgtggcagtgcgaaaggaggagcgtcggaaaggaattgctaaaatgttagtccaagaagcagaggcacgggcaaggagttggggatgccggtcaatggcattgcattgtgatgtaaacaacatagctgccctacgtctgtacaaaaatcaaggtttcaaatgcatccgtgtaccagaaggagctaaatggcctgaacccaagatagctaaaggagtgcaatacaacttcatgatgaagctagtgcccaaggcttgacctgtataagatctgaccaggaaaaagaaaagatttgagtctgtagattctgcacagatgcacaatttgctccattcatgtgtacagcatttggtatatagttgaggctactttgtaaatggtatatatcagcttacgtattgatccaaagtggtgagggtgttggtgttcaaaccagcccgtactagctgttggggggaaatgaactaaagcatacttcacttgtcttattgtgtgtaattcttgagattctacaggatgccagccttgctgctggggcgaagttctaaatttttgtaaaaaaaaagggcgggc

SEQ ID NO: 7984 - DNA, 778 bp, Sorghum bicolor
  Clone ID: SORBI-28MAY03-CLUS22789_1
ccgggatcaccacctaattttccatcaaatttcaatctccatccatcgatccctctcgaacccggcccgatggcctccgacgccgccgccgagccctcctccggcgtcacccagcccccgcgctacgccatcggttacgcgctcgcgccgaagaagcagcagagctttatccagccgtcgctggtggcccaggcggcggcgcgcggcatggacctcgtccccgtggatgcgtcgcggcccctggcggagcaagggcccttccacctcctcatccacaagctctacggggacgactggcgcgcccagctcgtggccttcgccgcgcggcacccggccgtccccgtcgtcgacccgccccacgccatcgaccgcctccacaaccgcatctccatgctccaggtcgtctccgagctcgaccacgccgccgaccaggacagcaccttcggcatccccagccaggtcgtcgtctacgacgccgccgcgctcgccgactccgggctccttgccgcgctccgcttcccgctcatcgccaagcccctcgtcgccgacggcaccgccaagtcccacaagatgtcgctcgtctaccaccacgagggcctcgccaagctccgcccgccgctcgtgctccaggagttcgtcaaccacggcggcgtcatcttcaaggtctacgtcgtcggcggccacgtcacttgcgtcaagcgccgcagcctgcccgacgtgtcccccgaggacgacgcatccgcccagggatccgtctccttctcccaggtctccacct

SEQ ID NO: 7985 - DNA, 1048 bp, Sorghum bicolor
  unsure (1)..(1048): unsure at all n locations
  Clone ID: SORBI-28MAY03-CLUS2263_1
aaacnatggtccaggaagggcttacttctactgggtcaccagagagcaaggatccttngagtggttcaaaggagtcatgaatgaggtggccgagagcgatcacagtaatgttatagagatgcacaattacctgaccagcgtgtatgaagaaggcgatgcaaggtcagctctgatgcgtccggtccagtcacttcagcatgccaaaaacggcgtggatatcgtctccggcagcaaaatccgaacacattttgcaagaccaaactggagaaaggtattctctgatttggccaatgcacacaggaactctcgcataggagttttctattgtggatctccaacgctcacaaaacagctaaaggatctttcgaaagaattcagccagacaaccacaactaggttccatttccacaaggagaacttctgagaccacatatacttgaagcttcgacggattgaaaacataattgtataggaaagaatacgatagcattggcatagcagatttagttttacaagttttgatgtccgcggggttggacaaaatatgtgtacaaagctagatgtcaccttgatacatagattctgaaatgcttcaaatatctaaattggagaagtgaaactactttcttcctagaataaccgagttccagatcgtgggctttgagcacgcaaattctctcttttcagtttttccgcccgagctgtcattgcattgcgaatgagggcgctgttctgattcctagaagattcttgggtatcatcttgcactggcacaagcgccagagaatctggggcgttttcggcgctctggggattcctggtttttggaggcctgcctctttttttaggctgaatattagcagggaaggggataatatgttttcgaggcctgcccctctttctagggtgattactagcctgcaagcgtgcttgagcatttccttctggtatgacagtcactaactggccactcatgtcattgggcatagaagctggaagcaaacccgccatctgattgtttgcatcatttccctgggatattgcaact

SEQ ID NO: 7986 - DNA, 997 bp, Sorghum bicolor
  Clone ID: SORBI-28MAY03-CLUS2270_1
gccggccgggccgggaaacttacgctgtgcttgggagagttgagctaatggaacagggcaagagagccaaggtgctgtgcctgcatggcttccgcacaagtgggagtttcttgaagaagcagatcagcaaatggcacccttccatatttcagcagtttgagatggtcttccctgatggcatcttcccagctggtggaaagtcagagatagagggcatatttccgccgccgtacttcgagtggttccagttcaataaggaattcactgaatacacaaatctggatgagtgcatttcatatctatgtgattacatggtgaaaaatggaccttttgatggcctgctcggattctcccagggcgcaacactttcggcccttttgataggctaccaagcacagggcaaggtgctgagtgatcatccaccaattaagttcatggtctcaatatctgggagcaagttcagggacccaagcatctgtgacgtcgcctacaaagacccgatcaaggtcaaatcagtgcattttattggagaaaaggactggctcaaggtaccttccgaggagctggcttctgcctttgatgaacctctcatcataaggcatcctcaaggccacactgtccctaggcttgacgatgtgtctgtgaaacagctttctgaatggagctcatgcattctggaagaccccaagaatgcaaatgttcccgaggctttagattcaggcaaaccatctgataaggaggctactggtgcggaattcgaggccttacattcaggcaaaccatctgataaggaggctactggtgcggaattagcagaaaacctggtgaaagcttgaggaatgcccactttcatggcatggttgcatttgaaacttgtaccgtttttgctatgatctgagtagtgtgtggaacttgtttgatcgcatgtgtattgcattggcaaaacaataaatcgttatctagagctacaactgaaacaaatggattcagacattca

SEQ ID NO: 7987 - DNA, 1000 bp, Sorghum bicolor
  unsure (1)..(1000): unsure at all n locations
  Clone ID: SORBI-28MAY03-CLUS229_1
acataagnggntactngcctggacggattgntttcttcttggttaactgtcatctgacgcctcgtcctatcctgctaacaagacatggcgaatgtgtggttattgtcagaggaagaattggntggagactggtggggggggggattgttgttttctctattcaagaaagcttgcaagctttgtggagaagcgactgaagtccgagcggactgcctctatatggactagcacactccagagaacaatattaacagcacatccgatcattggttttccaaagatacaatggcgtgctcttgacgagataaatgctggggtatgtgatgggatgacatacgatgaaataaagaaaagtaaacctgaagaatatgaatcacgaagaaaagacaagctgaggtatcgttatccaagaggagaatcctaccttgacgtcattcaaagattagaacctgtaataattgagcttgaacggcagcgtgctccagttgtagtcatagctcaccaggctgtgttaagagcactttatgcatattttgcggacaaaccactcgaggaagtcccaaatattgagatacctctgcatacaataattgagatacaaatgggtgttgctggtgttcaagaaaaacggtacaaactcatggacgcaattcatcccacagcggggttgtaagaaacaatgccttctaaaagcaatggcggcacaaataaattttgtgatgatatacgcatcacaacattcaatcaattagaagctatagttcgaagtggaatattacccccctaggtttagctcatagatgatttgacatttgacttacaaattttggcgggttatgtactcttcgtaattcatgagttctgagcatgttaagtcaggtatgagttttaagcaagtttattcaggtcctcaagactcggggctcgtgccgaagacattttttttgtaacgaactccctttcanaaaatatttacatttttttattggaaaatatttac

SEQ ID NO: 7988 - DNA, 1216 bp, Sorghum bicolor
  Clone ID: SORBI-28MAY03-CLUS23029_1
ccgggctagtctcgaagtttcggtgacgaatctttagcgcataaacgcgagctgagccggctcgagcctcggcttcgaatccccggcgacctccctccacgaagcagcttcctccggtcgcctgctgggcctcggacctgcgagaagcttccggcgccagcccatcgagcaccgcaatggcgtccggcggagcggccatctcggcggggccgacgccaccgtcggcgacggcgacggcggtggagtggcaccagcggccgccgaacccgaagaaccccgtggtgttcttcgacgtgaccatcgggtccatccccgccggccgcatcaagatggagctcctcgccgacatcgcccccaagaccgcggagaacttccggcagttctgcactggggagcatagaaaaaatgctttgccacagggttataagggctgtcaattccatagagtgatcaaagatttcatgattcagggtggtgacttcttgaagaatgatggtactggatgcacatcaatctatggtaccaaatttgatgatgaaaattttattgcaaagcatacagggcctggactgctctcaatggcaaacagtggaattaactctaatggatctcagttctttataacatgtgcgaagtgtgactggcttgacaacaaacatgtggtatttgggagagtgcttggagacggtttgctcgtcgtgaggaagattgaaaatgttgcaactggagcgaataacaaaccaaagcttgcctgcattataagcgagtgcggtgaaatgtagcttgatccctgaatgcggctaattgtggactcttggacgctgctgatgtagacccggtttggttgatgcgactacttgagctgtggaaacgatatagagcatgtaatgaagtactgaagcatatcaaatttacattgagggaagcatattgtgtccatgcaacctgtagaataatactccaaagagaaaaactaatgttcttgtttgacttggtagttggatcttctattctgatgaacatgtttgatcctattgttcctggtttagttagcaggaagtttactatggtgtgcttcaatgattcaggaagcaaagcaagcaatttttggattcagctctggcccaaggaatccagaagtgaaacttgcctattctggtctctgtccatgggtaccatcaagtaatgtacttgcgtgcttgtgccattttatttt

SEQ ID NO: 7989 - DNA, 744 bp, Sorghum bicolor
  unsure (1)..(744): unsure at all n locations
  Clone ID: SORBI-28MAY03-CLUS23344_1
ngattcncctgccactgtcggggtgtcgaggcctcagatatttcggctccaacctttggaggcaggcaaaaccgcacagggcaccagagtgttggtacgcagcgcgcggtacggcgtatggccacccacttcgtcctcaacaccggcgcgaagatcccgtcggtcgggctcggcacctggcagtccgacaatggactcgtcggcgacgccgtctatgccgccgtgaaggcaggttacaggcacatcgactgtgctcaagcatacaacaacgagaaagaggtcgggtttggtctcaagaaagtgctggacgagggcatagtcaagcgtgaagatctcttcatcacctccaaactctggaacaccaaccatgcgccggaggacgtcccggttgcgctggacggcacactcaagaacctgcaaactgactacgtggatctttacctcatacattggccggtgagaatgaagaaagacgccgggttcggcccgcagagcgtggtcccgtcagatatccccgcgacgtgggcggcgatggagaagctgtacgacgccggcaaggcgcgcgccatcggcgtcagcaacttctcgagcaagaagctagcggacctgctcgccgtggcgcgcgtgcccccggccgtcgaccaggtggagtgccaccccgtgtggcagcagggcaagctccgcgccttctgcgttggcaacgggatccacctctccgcttactcgccgttgggggtcgcggga

SEQ ID NO: 7990 - DNA, 1017 bp, Sorghum bicolor
  Clone ID: SORBI-28MAY03-CLUS23040_1
ctccgtgtccatcaacagccgccgcaccctcacaatccaggtctagatcgagagtgggggtcccgtgagatctcgagttcggtcacgtgctatggggcgatcacggacccgtggcggtaaggcggcgagcggtgcggtggccggcgactctggcctcaaggccgggctctccatcagtttccttctctacagctccgtcagtttcgactttcgagagggggtggttagggttcggtggtgtgcgatggggatctgtcgccttgaggcgagtgcgtcggagtccggtgactctggcctcaagaggaaacaggcgaaggtcaaagaggaggaagatcgtaagattctgatgctcaagtcggaggagggtaagatcctgaagctcaagaaggaggctatggcggcgaacgaggagatgagcgaggccacaagggaggagctttccctctacatgcctgtggtgagggcggccgagccgtctgggaagaagacgaagaaggtgctggtcaggaagttggtgcctatggaggagatctattgtctgttggcaatgccctgcccaattaaagctaatcacctgactgaagaacagctggccgagcatcccaagagattccaagactggtaccacgaagaaatgaatatcgctaagaaactgcgtgactaccatcaggccctcattgaccagtactcggaatatggctatgcggtggacgaatctgagacagaggtcactgatgatgaagacgaagatggcgacaactagcaagctaaaggcaacaatcaaagggctgaggtcaataacttgcaaggagtcaggaggcgtgtgtgtgtctgcaagatcctccatctaccataagtcaagttgcacccgtgtcgcgttcgtggtgtgatccactgcacctactctaagtgtctgcttatcatctggtacattgttagctacttggttattccctatatgtttgcatgctactgctcattcccatgctatgctataaaaaaaaaaaaaaaggccct

SEQ ID NO: 7991 - DNA, 746 bp, Sorghum bicolor
  Clone ID: SORBI-28MAY03-CLUS21377_1
gcacgagtcccgttcgcgtctctgcgtctctcccttttcccgtcccgtgctctctcgcgcgcccccccggcatattccctctcgcgcgtgcgcaaccgcccggccgccgccgccgcgccgccctgcttcaggtgtctatatgtccattgggaccttctctggcgacgagcgcgaaccggtgagatatcggaacactggaacgttgatggggggagggtgaagctaaagggtaaagcggtagaagtgtgggatggagaagagaagaaaaagaaaaagaaggagtaacagggcgagcagtcgtcccagagtgggcacgagcacaaagagctgcacaaagggggaagccctgaattaccaactgatcccaacaacgagctgtttgaagctgacaagatcggagtgtaagggagtcctaatccggtttatgttcatctcacacctgcagagcgacgctacatagaacaaaagcagaagattgacatgcagaagctggccaaagttgccaacaagtcgcacagggaccgcatccaggacttcaaccagtacctggcaaacctcagcgagcactacgacatccccaaagttggccctggttaacatatacgcacaaacaattgtatgctcggtctatccagctttatgttggcatgttatgcattaattttatgtgttggaacaccacctgttgctactatgagacaaatttcaaaacctgctaataagtattttgatcgtgggtttaagct

SEQ ID NO: 7992 - DNA, 853 bp, Sorghum bicolor
  unsure (1)..(853): unsure at all n locations
  Clone ID: SORBI-28MAY03-CLUS21562_1
ccgggtttggggattacttcgtcggcccgggcctcgaacaactcatcgagcagctcgccgagaacgaccccaaccgctacggcacgccgccggctgccaagtcggccctctcctcgctccccgatgttgtcgtgactcacaccatggttgcagctgcggagggcgctgagtgcgccgtctgcaaggaggatttctcgcctggggaggtggccaagcagatgccctgcaagcacatctaccacaccgactgcatcgtgccgtggcttgagcttcacaactcgtgccccatctgccgctttgagctgcccactgatgatcctgattatgaggggcggaagggctctaatcctcctcagccggctgttggtattgctgctgctgctgcggcatctgggagctctactgctgctgatggacaaatggaggagaggcaggataatccaagggtggttgagaggaggttcaatgtgtcgctgccatggccgttcagtggattgagtgggcaaacatcgcagcaggatgggaacaatggaggcagtggtagcaactcacaaggcagtggctcgcaagatggtggcccacccagcagcaagaattgatcacaaatcagctggaggttcaccttttggcgatctgttgaaaagtctatgcagtatttatgtgtcaccatgactatacctacaggaatttacagtctgtttgttgtggaacaatcgtttgtctttagttctcttgctgttcgttaggtcatcatgcagacaaggcgcaaaaaactgcccccgcagcagaatctgcgcgttgagactttgtgtagatttattggatgatcttggtntgtgaaatggtgatcccc

SEQ ID NO: 7993 - DNA, 781 bp, Sorghum bicolor
  Clone ID: SORBI-28MAY03-CLUS21591_1
ccgggattttctaactcgactattgtgggagagagacacagaatcggaaaaggaatccatggcggcgccgctggcgaggagggcggggcgctccgcggcggcggcgctatggggcgcggctaggggcttcgcgtcggtggggtccgacatcgtctcggccgcgcccggcgtgtcgctgcagaaggcgcggtcctgggacgagggcgtcgccaccaagttcgccaccacgcctctcaaggacatcttctacgggaagaaggtggtcatcttcggcttgcccggtgcatatacaggggtttgttcacaagcacatgttcctagttacaagaagaatattgacaagttgaaagcaaaaggaatcgactctgttatctgtgtagctgtgaatgatccatatgtcctgaatggatgggcagaaaagctagaggccaaagatgcaattgagttctacggtgactttgatgggagtttccacaaaagcttggatttggagatagacctttctgctgctttgcttggccgccgttctcacaggtggtcagcctttgttgacaatggtaagatcaagtctttcaatgttgaggaagtaccgtccgactttaaggtttctagtgcagaggtgatcctggaccagatctgagcttgtcaatgaacttgggctatctatcttcagtttgtggggcatacttcctctgcagctgcgaataaattaaatctcttacgacccgtgtaataagatgtttagataccctgcgcccagactaaaggaatcagagtgtat

SEQ ID NO: 7994 - DNA, 751 bp, Sorghum bicolor
  Clone ID: SORBI-28MAY03-CLUS21642_1
cggcgatgtagctgtttcttaccgtagctgccaacttttgtgtatgtgctatatgaacccgggaacccgctttgcagcagagatttgttccgtatttctgctgccagtagtcaccctacagctattccccaggcagcaggcaggcaagctagctacaagcaagggcgcggcgcaaacaaataatagcaagtgcgatcatcctttgatccatcttgctaataagcctgcccgccgcccttcgatcttcctcatctccgacgttccgttcggcaacgccgccacacatcgatcaagtcgcgatggagatgaagaaggtcgcctgcgccgtccttgtcgctgccgcctcggccaccgtggctctcgccgctgaggccccggcgcccgcccctaccagcgcctcctcggccgccgccttcccggccgtcggcgccgtgctgggcgcctccgtgctctccttcttcgcctactacctgcagtagaattcgaggaggaggatcggaggaagagaccaggaggctgctggctgccattgcctgcattcggttggattctgtttttatatatatgctatatatatattaatgtatgtataccttaatttgggtctgaacatgtcgattgatccattcatttttttttgctttgccttgtctcccctttctgttaatctcgatctgtaaagaggggagaatgggagacactatttgtttggacatgacaattggaaattaatcaatacccatttgttagt

SEQ ID NO: 7995 - DNA, 1033 bp, Sorghum bicolor
  unsure (1)..(1033): unsure at all n locations
  Clone ID: SORBI-28MAY03-CLUS21674_1
ccgggacgatcgatacatatatatacgcaagcaggtagcatgccaagaacaaggatctcaaccaaattcttgtgaacaatacacaccatcatcttttcctaccaccataccatgatcgccatgatcctcgaggtcacacagcagctttgccaagacaggctactcacgttgtccactaacaacctaccacccatccatcacctcctggttttcttactcataaccgtcgtaactgtcaagtatcttatccgacatccacgcagagtgtaccttgttgagtacacttgcttcggtcctgactcaaagtaccgagttgccccagcctccatgatcgagtattttcacctagcaaatttgcttgacgatgataacatttccttcctaagcaatatttatagacgctctggccttggtgacgagacatgcctcccctcttcatatcattacatccctttcattcctagtttgagcatggctcgtatggaggcagagctggtcatcttcacggtcattgatgacctatttgctaaggcatcaatcgaacctagtaaaattgacatactgattgtcaattgcagcgccatgacgatggtaccatccatgactgacatgatcataaacagatacaagctgcgtcgcgatatacaaaacatgcaattgtctgggatggggtgcagtgctggattgatcgccgttgggctcgcaagcaacctcttgcaaatcatgccctacggtgcaaacgcgctggtggtatctacggagaacgtgacttgcaactactatgtagggaagaagagatcgatgcaactgaccaacatcctgtttcgcatgggaggcgccgctgttttactctcgaattctagtgccaatgctcggtttcagcttctgcacactgtccggaaatcaactgctgcccaggataacgcgtaccactgtgttttccatgaggaagacgacgaggggaacctaggtcttaatttgtctaagaatcttgtggccgtccctggtgaggcgctcaaggccaacatcanca

SEQ ID NO: 7996 - DNA, 964 bp, Sorghum bicolor
  Clone ID: SORBI-28MAY03-CLUS21782_1
gcaccgcgccgcgcggcgcgcacacagtatatcactgcggttccggcagaagtccccgcaaaaagccaacaagcgctgctgcccccgctgcggtctcacggtcacgggtgggtggttttggggggagcaggacgcaacgccgggaggatgcagtcgctgcaggacaaggcgtcggagtggagcggcgtggcggccgccgatgccttcgccatcgacgacgtcaacctattcgagtccctcggcggcaccccgcagcccttcgtcgacctctccaccaatttctacaccagggtttttgaggacgaagaggagtggttccgggagatattcgcggggtcgaagaaggaggatgccatccagaaccagtatgagttcctgatccagcgcatgggcggcccgcctctcttctcccagaggagaggacaccctgcccttataggacgacatcgaccattcttggttacccaccgagctgcagagcggtggctacaccacatgcaacaagctttggatacaactgaaagcatagatgtggactcaaaaaccaaaatgatgaatttttttaggcacactgcttactttcttgttgctggcaatgagatgacagggcaacacggccatggaagtaacctagcaatcatgcaacaagtaaaccagctgagtgactattttagggaaagagctggtaaccattggaataattactgataagcctttattccagatacactgctttgctgtccacgcgcacagccagtcatgttcctgactgactcttagtacaagtttacaagtttctggagcacttacagatctagtggacgatccatgatattctttttacacgttctgcacttgcacatgttttaccagccatgttccctgaggctactacagcttccaggtgtagactgagagcggggcctgtacctcttttctattaatgaaattagtacacaatcgt

SEQ ID NO: 7997 - DNA, 588 bp, Sorghum bicolor
  Clone ID: SORBI-28MAY03-CLUS21721_1
ccgggatgaaagccgggaagagaaaaataactccgaaaagaaagagacgccgaaaattcgaaggggaaggggaaagcaaagcaaatggcggaggccgagggaaaagcaaagcaaatggcggagggcccgagcaagatcgaatccatgaggaagtgggtcgtcgaccacaagctccgagccgtaggttgcctctggctaggtgggatcagcagttcgatcgcctacaactggtcgcggcccaatatgaagactagcgtcaagatcatccacgcaaggttgcatgcacaaggtctaaccctagctgcattagttggttctgcatgcgtggagtactatgacaataagtatggttcttctgggccaaaggtggacaaatacacaagccaatacctggcccatgcgcataaagattaagatctccatgttggttcctgcataccggattaattttggactcaactctgggtgctcatgacccgcccgtcgatgctggatgtttattctttttgttgtcttattaattacaaaatgatggtgtacttaccagggaaatgataatgagggtataatgcagatattgtcgtatcc

SEQ ID NO: 7998 - DNA, 877 bp, Sorghum bicolor
  Clone ID: SORBI-28MAY03-CLUS21979_1
atctccagcctcatctgcctgtagtctgtatgctccttctccaggatccttcgtccctgcagctcggatccttcaagtgttcttctccaggtcggtgcttctaacaagaggtttattcctgaaattttcgcttgctgcagccatgcctgtgcctattcagtgttacgtctgctgagttccgggatccatctcacagcctcatctgcctgtagtctgtatgctccttctccaggatccttcgtccctgcagctcggatccttcaagtgttcttctccagtagaagaagcctcgatttgtagcagttcagatctgtagccccttgcctccttgaaggtcatcagaaatggcgaacctgcagagccagccgagtcttgcgagtacattaccaacaaacctaccggtgaccttcatgaaggaaattaccagtgatttctctgttgagcgaatacttggccaatctgtttttggaaaagtttatcagggggttcttccagaagggggccgcatgattgctgtgaagaggcttgctgaaaacgcaccagtgccgtctggcataacatttgaaactgaggttacaaatcttatggcacttaaacatcaaaatatagtagagctggttcactactgccacgaatcgcagaagaaagtggttcagcataatggaagatatgtgattgtggacgtcatcgaaagctgtctttgctacagatatctaccaaaggggagtcttgacaactatcttctttatgcagacactgctacatcaataaactgggacatacggttcaagatagttaaggggatctgccagggtttacatttccttcataagaattagtttgtggggctcttatcatatgaatcttgtgcctaact

SEQ ID NO: 7999 - DNA, 783 bp, Sorghum bicolor
  Clone ID: SORBI-28MAY03-CLUS22071_1
ttgctcgaacgggggaggagcctcgtggcttgtacggtggtagagtcacagacaacgacgccgaagcgcatcgattcgccgaccggccgttccccctcgtcgccgcagcacagccgccggctggccagcgggcaggctgcttcgatgggctctcccacgcggccgcggaggacgaccggtttcgctctcctcctggtgctcctgttcctctcgccgctcgcgtcagctggacaaccaaaaggcgtatgtgtttcaccaggtggacggttccctgccttctcgtctgaaggcaagcctccaggaagagcacccaaggggcgcagagatctagcactttgtaggatattccgtcagaatacatgttgcgatgtgacgcagacatttcctgctctggtctcagtgagaaaccttgcattgactggtgaaggcagtcaagaatgtattcatttgtgggaattgctcgagtgctcaatatgtgatccacgagtgggtgtcagacctggacctcctgttgtatgcgcatcattctgtgatatggtcttcaaagcttgttcagaatcatacttctctgtagatatgaaaacacaggccttgtctccttgtggtttaggtgacatcctttgtggcaaagcacataaatgggtctctaatggcacggagttatgccgtcttgctggtttctctgttcaagtttctgagacagctctgatggagttgatgacactttctgctatggtgggaaaagcaagttggatccatctctgattcatggacttcttcaaa

SEQ ID NO: 8000 - DNA, 659 bp, Sorghum bicolor
  Clone ID: SORBI-28MAY03-CLUS22113_1
cctagcgatatgttcatcgttaagaagaaaagacaagatcgggcaaggagcagcattgggtccccctccagttcaggccgagctggacctctctcaccagccaaccctgggcggccaggcccagtcccctcacccagaggtgccaggacgcccttccaaagggatccacacccatctcagcagtcgatgcattccgctggatggggcgcgcattcagatcaaggaggaagttcttcagcacccggcattggagacatccagtgggcaaagcctgccaagagactgaggaccgacagcggcaagaggcggccgagcctaatgtgaggattctttgcatcgcggtgtgcattctctggcaatcttgatttgcctggcctatgaaatgtgggctgcactggtgggggcttgttcgtgtaattttggcacacagctgagttcgttcttgcatatatgagcccctacatgctggggcttttgttgttgtggacatgaagaaatgtggaagggtagtgttattgttcctgtatgttattagcttcataaatgtgtaaagggaactcttatggttgtaggtggtgcaaacaactagaaaatgcatccacgcagcaatgaaggcattggcgcacccgcccttgataataattagttttttttttccc

SEQ ID NO: 8001 - DNA, 720 bp, Sorghum bicolor
  Clone ID: SORBI-28MAY03-CLUS22155_1
gcacgaggccccggcgcagcgcagggccacctgcaaccgacagactgataggaaagaggacaggagaggaagaagatgagcagaggagggagcagcgggggtggccggagctctctcagctacctcttcgagccggaggaaaccatcctgtatcgcactcacacgacggccaaatccaacctggaaaccaagaagtctccagatactaacagcagcagtgtcaaggatgacaacaaggcgatcggagctgaagcagttcattctcctcccaagagagaagtctccaaccccatactctcgtctcataaacctccttgcaacatctaccataccagccagttaagccacaacaactctgggcttcttatcactgaccgaccttcgacgagggtacgctgtgcaccaggaggagcgtcctcgcttgggtttctgttcggagaggagcatgagaaataatagacgatctcagtctaatctacaagagagtttggctgcatgcgtatgcaccgctgttgttgggtttcataacagttactggaacggcgatctgatttacagagagtggctgtagcatatgtaaattatgcgtgcttgtgtttcgacagtctgtgttccgctttttacctcgtgtgtatatttatgcatgttcgtatttattttggtcacaaatatttgatgtaactttgttgctgcccaggtatataagtcctatatatattg

SEQ ID NO: 8002 - DNA, 845 bp, Sorghum bicolor
  Clone ID: SORBI-28MAY03-CLUS20779_1
gccggccgggcaaatgatcgaccttcgtccactcctagcattcccgagtctttcgcaacccgtcaagatgctcatccccaaggccgaccgcaagaagatccacgagtacctcttccgagggggagttctggttgctaagaaggacttcaaccttcccaagcacggcgagatcgacactaagaatctctacgttgtcaaggcttgccagtctttgacctcgcgcggttacctcaagacccgcttctcgtggcaatggtactactacaccctcacccctgagggtctcgactacctccgcgaatggctccacctccctgccgagatcgttccccagacccacatcaagcagcagcgctctgctcctccccggggtatgctcggcggtgatgaccgtgagcgccgtggtggaggccgtggtggacgtggcggtgaccgtggtggtgaccgcgacggctaccgccgccgtgacgccggcgagaaggctgagggcggcgcccctggcgagttcaagcccgagttccgtggtggctttggccgtggacgtggtgctgctcctgcttcgtaagcagttgaggactttctggagtaaggctagatacggtttcatcttcatgtcgggctttactgcattacaaaatgggatcggaaacggcgaaatgaccggatgatactacgaatggatcgcttgtctaagttgcgatgacgcagtcttggacgaccatgtccccaaaaaaaaaaaaaaaaatgccccctaacgtcaatcttttcagtgatgtgagacgagacctctatgtttatgccaaacgcccatcgaggcacgtctgaatgaacgatccgtgccgctc

SEQ ID NO: 8003 - DNA, 1014 bp, Sorghum bicolor
  Clone ID: SORBI-28MAY03-CLUS2081_1
gcacgaggatcccaacgcgccgcggttcgtgctgtgggaggggaaagtgaggcccgtgccatccaagcccgccgacctcccgttcttcgatctcatgagcatccctggcaagctcagggccggtctcggcgcgcttggcatccgcccgcctcctccaggccgcgaggagtcagtggaggagtttgtgcgccgcaacctcggtgctgaggtctttggcccccggattgagcctttctgctcaggtgtctatgctggtgatccttccaagctcagtatgaaggctgcatttgggaaggtgtggcggttagaagaagctggaggtagtattattggtggaaccatcaagacgattcaggagagaggcaagaatccaaaaccaccgagggatccccgccttccgaagccaaaagggcagacagttgcatctttcaggaagggtcttgccatgcttccaaatgccatcacatccagcttgcgcggggctgtctagctatcatcgatactctcgtgcggttcttaatcgtccggcaaggggtatgttttggagtatgatacaccagaaggggttgttttggtgcaggctaaaagtgttatcatgaccattccatcatatgttgctagcgacattttgcgtccactttcaggtgatgctgcagatgctctatcaagattctattatccaccagttgctgctgtaacggtttcgtatccaaaggaagcaattagaaaagaatgcttaattgatggggaactccagggttttggccagttgcatccacgtagtcaaggagttgagacattaggaacaatatacagctcatcactctttccaaatcgtgctcctgctggtagggtgttacttctaaactacataggaggtgctacaaacacaggaattgtttccaagactgaaagtgagctggtagaagcagttgaccgtgacctccgaaaaatgcttataaattctacagcagtggaccctttagtccttggtgtccgagtttgggcacaagc

SEQ ID NO: 8004 - DNA, 993 bp, Sorghum bicolor
  Clone ID: SORBI-28MAY03-CLUS20858_1
gccggccgggctcgggaagaagccgtacccgcacagccttcttcgcccgcagagagagaacaaagaaagggacaacggcgtaaaatggtcgatgccggcgacacaccggctggagcgccgccgcgagctcacgaggaggagcaggcgggaacgccggcgtatggttcggtggtcctcggcggcaccttcgaccgcctccatgacggccaccgccgccttctcaaggcctccgcggatttggcgagggaccggatcgtggtcggcgtctgcacggggcctatgctcgccaagaaggagtatgcggagctgattgagcccgttgacaagcgcatcaagggtgtggaggattacattaagtctataaagccagaactgatagtacaagtggaacctattgaggatccttatggcccatccaccactgatgaaaagttggatgccattattgtcagtaaggagacattaaatggtggacttgctgtaaatagaaaaagagaagagaaagggttcccactgttgaaggttgaggttgttgatctcctttctggtggtgtagaggggggaaaattgagttcttctgctttaagcaaacttgaggcagagcaagctcagcaaagtgaaacaaaaactgctagccttgaagtttcttaggaaggaatatgaatacttgaatctggttacctgaatacacaattacgggggtgatctgctacaagctcagtgtgaacaaaaatgtgatcagagctgatggtttgtgcctgtctggaggaataatctttgaacactggcccatggccctgtaacagtatcattctaaccttatatataaaatcaagcctggcagtcatagactcccctactaaccaaatttacagattttgtattggcaatgccttctgactgtaaaaaggaaatatccttgggttagtataaatgtctacaatagtggcaaagctacaaatgaacatggttctcattcacaagagttcgtgc

SEQ ID NO: 8005 - DNA, 1363 bp, Sorghum bicolor
  unsure (1)..(1363): unsure at all n locations
  Clone ID: SORBI-28MAY03-CLUS20871_1
gccggccgggctgggcagatatcagtcctagcacatgcccaaagagtgattctcctgctgatcctaactccatgtcgtttgatgaatctaaagcacttgcacaagccttacaggagaagatggaagcacttatgctcttctcacaggaacaagaaagatacctattagaaaaacagagagacctgattgttattgaagaactccagaagaacttatctcaagttaaagatgaaaaggtgaaggtcctgatggaattagcaaaactgaaagaacaatatttgctattgaagggttctgctgtgaaggaaggtcatgatactggtgattcatctaaagtcattcctgggcatgaccaacaagggatgctgaagactatgctgaagaggacatctttaagacactggatgagaaaagaaagtagtactattggacatgggagctctgatggaaatgatcatacagtttgcaaagagcattcagtggatgttgcaaggttaagagttgaaaattctacgcttcttgaaggtgttggtactgttgagcgtctcacttcttcagtgcatagactgcatattgtgcttttgaaggcttatgatgatatcaagtcagctgattctttggagagtaccttcgaagcgctcaacagtcttataactgaagcaaacgttatgaagacagctcttaatgtggttcttccagtaagctggtctggggattcatcagatgcaattacatatgaagctctgtgcgaaccatctgattcacctaaatcaaagtctggtaaagtagacccgctctcttctgcaggcatggagatggtggagctactaatattggctgctgagattctcaaggagagctttctggtgaagaaataaggcctccatgtaagaacgagtctggctctccttgtttgtttagaagcatgcaatttaatccttaaattaatttttgggtgtatatacttaaaactgattgctaaaagtgcactagtagattatttcggatgtagagaaaaagccaaatgtgttctgtaatttagggttcgctgatattgctgtgtcctgtgttggtacactaaagggttaaagacttaagaaccctgtgtgcaaaattcagtttacaagcaaagatcaaagatagatggatgtctggtctccgtcgcaagccctcggtggactgtgttcgttggctttttaggggttgtcatcctcgtgtgctatttcctgggtacatgctgagttgggcttgatgcagtgggttggtttcttgtggaatttgcatattgtttagcctcaaacaggcacngggtgattgtattttttccagaatttattttagaatttaacgacatcttccagtg

SEQ ID NO: 8006 - DNA, 634 bp, Sorghum bicolor
  Clone ID: SORBI-28MAY03-CLUS2098_1
acgaccacaccatcactcgctcgtctcgaacgcacgctcgccacagccatcagccactcactcactagctagcttccagcagcagcagccatcagccactctcgcacaatgccggccatggtggaggaggaggtcgtcaggggggcagcggcggcgcccgagccggagccgcacttcctggtggtgaccttcccggcaatgggccacatcaacccggcgcgccacctcgcgcgccgcctgctgcgcgccacgggggcgcgggtcaccgtctccacgtccgtgttcgcgctccgcaagatgttcccgggcgccgccgccgagacggagccggagggccaccgcgacgcctcgggggtgtggtacgtgccctactccgacggctacgacgacgggttcgacaaagccgtgcacgacgccacgcactacatggaccagatcaagctcgaggggtcgcgcacgctggggaacgtcctcgaccgcctccgcgacgccggcaggcccgtcacgctcgtcgtgtacacgctgctgctgtcgtgggtggccgacgtggcgcgcgcccacgccgtgcccgccgcgctctactggatccagccggccaccgtgctcgccgcctacctccacttcttccgcgcca

SEQ ID NO: 8007 - DNA, 702 bp, Sorghum bicolor
  Clone ID: SORBI-28MAY03-CLUS210_1
gcacgaggagcttcccaaaactcttcttgctcagctcagtcacctgacctccaccgttccttcgtcgtcgctctcggtccacctaccgaaggagcgcgacatgcagacggtacgaggtgtggtgctgcagcacctccggctccgcgcggcgcctgccatcgctgcacgtggaggcagcgggaggccggcgctgtacgggttcgctcgggggatgagcgcgccggcgggccaggaggacagtaagggaagcagcagccccgaccccgagagggacatcaggacgcgcgtcgttaacctggtcaagaagttcgacaagatcgacgccgacaaggtgactgagactgcagacttccaaaaggacctgagcttggacagtttagaccgggtggaacttgttatggcttttgaacaagagttctccattgagattcctgatgacaaggctgacaagctaacctgctgtgcggatgttgcaaaatacatcatatcggaatctcaaatcagcgataaaagtgccggtggctcctgaggggcagatgaaagcgagtgcaatgtttctttttgtgcttaaatgaatcttggttagaaagggtgatttatgcgcagggtttcttttcactttttccagtatggaaggaaatgctcttcaaatgccttatatagtctgttaatgtgaaaatatctctaccttggtagtttatt

SEQ ID NO: 8008 - DNA, 1064 bp, Sorghum bicolor
  Clone ID: SORBI-28MAY03-CLUS2114_1
ctcggccaggcgatggttgacttctcagggatggtggatgacgagttccttcagagattgagcatagagaagggcacgagaaaggtcataaaccatgaggagaggggacgggtcttgcgtgccatggatgggtgcagctacaaggctgcagctggaggctccctgcccaactcgctcgtggcgctggcaaggcttggtagtagccagtctgctggctaccctgagcttaaaattgctatggccggtagtgtgggcagtgacccactaggtagtttctacagggcgaagttgcgccgtgctaatgtgcacttcttgtctaagccggtcaaagatggaacaactggaactgtaattgttctaacaacgccggacgcacagcgaactatgcttgcgtatcagggtacttcgtcaactctgagttacgattcagacttggccagtttagtgtctaaatcaaatgtactaattgcgtccggttatctatttgagctgcctcatacaattgaagctatcaggcaagcgtgtgaagatgctcacaagaatggtgcactcattgctgttactgcatcagatgtatcttgcatcaagcgttgctacaatgacttccgggatattgtaggaaactatgcagatatactgttcgccaacgccaatgaagcaagggccttctgcgagctaccctcaacagagagccccatgtcagccacaagatacttaagccactcagttcccctagtatccgtgactgacggcatgcatggctcctacattggggtgaaaggtgaagcaatatacatccctccaccatcctgcatacccgtggacacttgtggcgctggcgacgcatacgcttctgggattctgtacggcatcctccggggtgcttctgatctgaaaggcataggactactggcctcgcgggtagctgctgttgtcgtcgggcagcaaggcacacgcctgcgggttcaggatgccgacagactggctgaatcgtttgcgcatcacctggatagcttggagttctgctcagatgtttgaatagatcactttgcaaacacgtctga

SEQ ID NO: 8009 - DNA, 1002 bp, Sorghum bicolor
  Clone ID: SORBI-28MAY03-CLUS21191_1
ccgggtgaagatctatttctattcaaagatcatttgaggctttctttctgaaagcctatgttttggctgactcaggagttgatccttcttattccgcgactgttatctcgcttcttgaagatgcattgaaatgtccttcagaccggcttcggaagggtcaggcattgaataaccttggtggtgtctatgttgattgtggaaagttagactcagcagctgattgctatacaagtgcattgaagattcgacacactagagcccatcaaggtcttgctcgtgttcattttctcagaaacaacagggaagctgcatatgaagagatgacaaagttgatagaaaaagctaaaaacaacgcttcggcttatgagaaacgctcagaatattgcgaacgagaacagactatgacagatttgcaaacagtgacccaattagatcctttacgcgtttatccatacagatatcgagcagcagtgctgatggatagccacaaggagaacgatgcaatagcggagctcagccgtgcgatatccttcaaagccgacctgcacttgctgcatctccgggcggctttccatgagcacatcggggatgtaccaagcgctctccgtgattgtagagccgccctctccttggacccaaatcaccaggagatgttggagcttcagaaacgtgtgaacagccaagagccctgacacgttgtggtgctatattgtgtattgtataccacgattcatgccactttggtgtgtctcatgagtcatgacagccttgacctcattcttttttttcctcatttcgctattaattaattaatccccgtaatgtgatgttttcaggaagaaagtaacagaaaaaaaaagagaacaagttctatgaaagcaggcattgataatgctttttaactcaatgcctgtggcctctgtagaagtaatgtgctaatcactgaattgtatcctgaaaaagtgatatcgtgcataatgtaattttcagttctttctctct

SEQ ID NO: 8010 - DNA, 653 bp, Sorghum bicolor
  Clone ID: SORBI-28MAY03-CLUS21227_1
aggcacagcgtcgaacgcctggatcaggccgatgtctacagccctggtgctggaaggatcacacgcctgaccagccacaagttcccaattctcaacctcatacagatgagcgcagttcgagtagacctgtatcaggacgccatcctgtcaccgttctggaacttcaacgcccacagtgccatgtacaccatcagaggctgtgccagggttcaggtcgccagcgacaacgggacgacggtgttcgacggcgtgcttcgtgctgggcagctgctcatcataccccagggctaccttgtcgccaccaaggcgcaaggagaagggtttcagtacatctccttcgagacgaaccaaaactccatggtcagccacatcgccgggaagaactccctcttgagcgatttgccggtcggcgtcatcgccagctcctatggcgtctcgatggaggaagctgcagagctgaagaacagtaggaagcatgagctcgctgtgtttactactcctcctggtggcagctatgatcaaggtcatgttggcagcgcccaacagtaggcacctgagagtgatctacctgaataagtactcgtggacatgtaataaacaaagcttgttcatgggtaaactgcatgtctgctgcatggatgagtctttcaacc

SEQ ID NO: 8011 - DNA, 678 bp, Sorghum bicolor
  Clone ID: SORBI-28MAY03-CLUS2137_1
cgtccggattcccggtcgccccgcgtcgcccaaggagaacaaaatctgccggccggcgtcgggctcgccatcatcccctgcgttcgacggaacgacggccagaaccccaacagtggaggaagctagaagagtccggagagagagcatggccagcaggagcttcctgatccggtcccccaaggaggaggagtccaacgccgccgtcagagaggctgtactactgggagcaaagaacggtgcgatagctggtactgtggtggcggttcccacgttggttggctgccgtgttcttccttgggctaaggctaatctcaactacactgcacaagcactcatcatatccgcagcctgtatctctggcttcttcatcactgctgacaaaaccattctacggaatgcacgacaaaacaccattgggaagcttgacaagtcaacttgatgcagagatgtatctgagaaggttctctggttgatagggtaccttttgccccatatgcagtgtcaccatttccctttgtggacaagcaaattttcggtgtttagctactcaagccaaaggttgtgttgtaaagacatgctacctgatggacccaactattgtatccagtttactcccaatttgaatcagaataaaagatggtgctatgggttgcaaaaaaaaaaaaaaaaaagccccta

SEQ ID NO: 8012 - DNA, 628 bp, Sorghum bicolor
  unsure (1)..(628): unsure at all n locations
  Clone ID: SORBI-28MAY03-CLUS19862_1
gccggccgggcttcgagtcgcggctcggtcttcttctcccgtacgactccgttcctcaccgtgttcctccttctctgttccccttctccacgaacccaatccctagaatccatccagcgttgattcccctcttgagccgacatcacagcccacgatggagcagcctagcacggtggcctgaggtctactgcttctagtgctctggaggctcagttcgatggcggcgtccaactctgaagccatggccgggaagtggagtcgcggccccatgaaggcaacttccagtgcctcgagctcgacggctagcggtagaagggagtgccccttttgccatgttgctttggtccacatccggagcaagaaaccagcgaccaggggtttctgttctagcagctgtatttgtaggttttataggtgtgatgattggtgtggttgttgctggtatctggaagtgattagactgtaccaagttattttaggaagtaatgttttgtgtgtcctgaatgttcccagaattgaattgaatgaatgtatggttctgattgaatgactaaatgttaccagaattatgcaatgctatataggcaatctgaaatataatagaattgttccaaganattgttctttt

SEQ ID NO: 8013 - DNA, 1166 bp, Sorghum bicolor
  Clone ID: SORBI-28MAY03-CLUS19906_1
gtgcggcgctcaggcggcgggtgcgaccttcctccactattccggtcaacccttctccgcctccgcggctccgcctccgcctcctcacgccgctatgccgccagccagtagcctcagcgccgaccagctcagcttcttcgaggccaatggttacctcgtgatggactcgttctcgagcgcggaggaggtgcgggagatgcgggaccgcatggccgagcttgtagctgggttcgatggcgccaactccgccgtcttctccaccaaggatcatcgccagttgaaggatgattacttctttaaaagtgcagagaatatctctttcttctttgaggaaaaggcgtttggagatgatggatgcttgaaacagccaaaagaactttcaattaataaagttgggcatgcattacatgaacttgatcccgtgttcaaaaagttttctttctcggagagtgttgcaagcttgttctcttctttaggctacaagaggcctgcagtcattcaatctatgtacatctttaagcaaccaggtattggtggtgaggtggtgccgcaccaggataatacattcctttacacggaacctcgaacatgcacagggttgtggcttgcacttgaagatgcaacaatgaacaatggttgcctgtgggcaattccaggatcacataaaaagggtttggtgaggcgtatgatcagagatgaaaatggtacacattttgatcggccctccccagcctatgatcagaaagaatttgtgcccctggaagtaaaatctggtgatttggtagttatacatggagatcttatacatcagagttttgagaacctttctccagcgtcaagacatgcattgagcttacatgtagttgatactgaaggatgtgaatggtccaaagacaactggatacagaggaaaacggcccctgagccgctttatgtgtcttagcaaaaccagttaccagtagtgcagtaaaacaacaaagattcccagcaagtgatttgtggaccgcttctttgcacaacaaaataaaatgggggaatcaagctgggccatgctgtttccgtctcacctgtaaacatgtaaattgtaaaatactcttgctactgtggtgccgtcattgacatatcatatttttttaatgcgtcccaataaatgtcccagttattgt

SEQ ID NO: 8014 - DNA, 531 bp, Sorghum bicolor
  unsure (1)..(531): unsure at all n locations
  Clone ID: SORBI-28MAY03-CLUS1994_1
gcacgagggcacaccgcgcagcaacgaaaagttgaacaggaaccagccaacaagctttgctactgtggtttcgagcggcggcggcggcggcggccgagaagagaagagagagagagagggaggcgagcatggccgaccacaaggaggagcccgtgctggagtctgtgatggacaagatcaccgagaagttccacggcggggactccacgtcgtcgtctgactcggacgacgagaagaagaagaaggggtcctcgtcggcgtcggcagcggaggccgtgaaggccaagatgtatcgcctcttcggccgcgagaggcccgtccactccgtcctcggcggcggcaagcctgccgatctcgtcctatggaggaacaagaagatctcaggcggggtacttgctggtgccacggccatctggctcctgttcgaggttatggagtaccatctcctcaccttgctgtgccactgtctcatcctctcgctagccatcctcttnctgtggtctaatgcctncacgttcattaacaagtcgc

SEQ ID NO: 8015 - DNA, 796 bp, Sorghum bicolor
  Clone ID: SORBI-28MAY03-CLUS19956_1
gccggccgggccggggagacggtggacgcatataaggaaagaaggttgattttgacatgaggggcattttcaaggagaccatcgccagcacctcaagaatgtgtacccctggacagagtggaacatgttctcctgtaatgggtggtgtgccaatccatcacgatgtccagatggttgatggtgccccagatgatttcgcctttgggagcagcagcaacggcaacaacgaatcacctggtcttgtgaaggcatgggagggggaacggatacacgaggagtgcgcctcggacgagcatgagctggagctcacccttgggagctcgaagactcgtgcagatccctcctgatcatgctacaagagtcaagtcttcacctgggtttttactttcatctttattcggacggcactcttctattttatgagttcagtgtttgtagaaagagagaagggattcagagatcttatcacagtcctctggagatgatatccatcctctttcaaggatctgaacttattctagcctaagcaaattgttaacttatttataaaaaaaaaaaatcatttcttctttgtctccctcaagaaatgaaaaggaaaaaaaatgcaagggaaaagagtgcttgcaggggaccttagacaggtcggagaactggtcatccgtcagcagtagctgagatccctgtggcattcatgtgcccttgtaaattagctccagttgtccttgatatgactattatcgttgtacttgtgtcgaaagggggtacattgtatggatcattcattggttctgtcggc

SEQ ID NO: 8016 - DNA, 547 bp, Sorghum bicolor
  Clone ID: SORBI-28MAY03-CLUS20074_1
gtccggcctgctcctcgtctctgggcctttcaagatcaatggagtgccgatccgccgtgtgaaccggacctatgtcattgctacatccaccaaggttgacatctctggtgttgatgtcgcaaagtttgatgacaagtactttgccagggagaagaagcagaaggcgaagaagaccgagggcgagctttttgagacagagaaggagacatccaagtctctgcctgacttcaagaaggatgaccagaaggctgtggatgctgctctgatcaaggctattgaggctgtcccagagctgaaaacctatcttggcgcccggttctctctcagggatggtgacaagccccatgagatggtcttctaagcttttagttttggagttcggaggaagtcgttttgcctgtgtgctctcttgtacttcagagttttgtaccccgggtagcgaatatttcattctgattgaagtctgcctgtcaaatattatgagaagatctaagaaagttttatccttgttggtggttcggaaaaaaaaaaaaaaaaaaggccccta

SEQ ID NO: 8017 - DNA, 747 bp, Sorghum bicolor
  Clone ID: SORBI-28MAY03-CLUS20151_1
tgtggctgaagacgaaaacaagctggaggaggttccacagtctgaggctgagaagggcaaggagggtgaaccaactgaagcggaggagcctgaagataaggagatgacattggaagaatatgagaaagtattggaggagaaaaggaaagctttacttggactaaagcctgaagagagaaaggttgaggtggacaaggagttgcagtccatgcaacagctttcagtgaaaaagggtgctgatgagattttcatcaagctgggttctgacaaggataagaagaaagagaacacagaaagggatgaacgtgccaagaagtctgtcagtatcaatgaattcctgaagccagctgagggtgaaaggtactacagccctggtggccggggtcgtggtcgtggcagaggccgtggtgaccgcggcggtttccgtggtgggtacagccctcgggaggtcgcagctgcgccagcaccggcaattcaagatcaagcacagtttccctcactcggtgggaagtgaacgctcccaagcccaagctgctatgaactcaattgcatatgaactcaattgcactagtgtccttgcacctatccgatgcattagtactgtactgccgctctatatcagagccaggtgtttgtcacacggttaagcttatgtaacttttaaattttcaataggatgcctgcatgtcctgtggtaccgttctcggttaaaaaaaaaaacaaaaaaaaaaaaaaaaaaggccccta

SEQ ID NO: 8018 - DNA, 503 bp, Sorghum bicolor
  Clone ID: SORBI-28MAY03-CLUS20562_1
aaaatccggcggccccggttgcgcgctccagcacccatcaccgcgaagaacacaaacacaagtagggttaggaaggcgacgcggcggcggcggcgggctgcgagcggcgagagcgcgagagtagtaggagggatcggccatgacggggaaggcgaagccgaagaagcacacggcgaaggagatcgccgcgaagatcgacgcggcgacgacgaaccgtggcggcggcaaggccgggcaggcggaccggctggggcaggacaagggcgggcacgcgaagctggcgtgcccgctctgccgcaccccggcgcccgacatcaagtccatgcagatccaccacgaggcgcgccaccccaagctccccttcgagccggagaagctcctcaacctgcactcctccgccccagccgccgccgccgccgccgccgccgccgaggccaccacctccaagcccaagcccggcgtccgcggcagcctccagaagcagcttgctgtcttgcctgcct

SEQ ID NO: 8019 - DNA, 688 bp, Sorghum bicolor
  Clone ID: SORBI-28MAY03-CLUS20039_1
gcggccggcttcaaagtctgcgcttgctctcgctcccgcacgagacgactgttgggccgccgccgccctaggtcaggtgctgaggctttccttggtctcttcgccggcgacgagcacctaccaggcacgcttctaaatccggagttgtcagcgttcgcttgaggtgccaaaccagagcacaccatcatgcaggctagcgatagattcaacataaactctcagcttgagcatcttcaagccaaatatgttggtacagggcatgctgatttgtccagatttgaatgggctgtaaacatccagagagacagctatgcctcttatattggacactatccaatgctagcatattttgccattgctgagaatgaatcgatcggaagagaacgttacaatttcatgcagaaaatgctgcttccttgtggcctccctcctgagagagacgaggattgagggactggtgcatagctttagtgtttccaatggggtgtttgcttttgaataaccatactaagaatagccaccatggactatgttgtgtacttgtgttaaatctcgtatgcctttgacttgttttccatcggtctctattgtgatacataaatatttggaacttgtatgcattctgtcagtgtactattgtagtattcttaatgaaatgctggttctatcaaaaaaaaaaaaaaaaaaa

SEQ ID NO: 8020 - DNA, 672 bp, Sorghum bicolor
  Clone ID: LIB5048-011-R1-XP1-A11
ccggggtgacccgtcctcctcctgtccagtctcgcagcagccgcggggggcgcagccgcgcaggcagttcgtcgcccggtgttcccctcgtttcccgtccaggtccagcggccgtcctctcctccgtgccagccctcggagcctcgccagcgcgcctctgaatccggagttgcccattcacttgaggtgcccgaccagaagacaccatcatgcaggctagcgacagattcaacataaactctcagcttgagcatcttcaagccaaatatgttggtacagggcatgctgatttgtccagatttgaatgggctgtaaacatccagagagacagctatgcctcttatattgggcactatccaatgctagcatattttgccattgctgagaatgaatcgattggaagagaacgttacaatttcatgcagaaaatgctgcttccttgtggcctccctcctgagagagacgaagattgagggactggcgcatagcttcagtgtttccaatggtgttgcttttgaaggaccatactaagattagccaccgtggtactatgtgcgacttgtgttatatctcgtatgcctttgactttggtctctattatgatacataaatattcggaacttgtacgcattctatcagtgtactaatgttaacgaaatgctggttccgccc

SEQ ID NO: 8021 - DNA, 643 bp, Sorghum bicolor
  Clone ID: SORBI-28MAY03-CLUS20597_1
gccggccggttcggggatttcgctcccaccgcaccaccggagagttcctttcccggtttttccccccagccccgccgcgccgcaaaaatctcccccagcgcaccgattaatcatcagccgacacacagccggggagcgagatgattctggtggcgatcgtggcggagctgctggaggagtacacggcgctggtggcgcgggtgctggagcagctgctccacggcgcgcccttcccgcgccgcatgcgcttcctcatgctccggagcctccccttcgccgcgccgccgctcccgccgccgccgccaccgcacgcgctccacgtcgccacccgcgcctgactgagcccgcgccctgacgtcgctcttctggtatacaggagcactgttcgtctgtgtccttcgccgtgtgtttacttgctgtaattctcagtcatggaaagaaagggtcgtagtaaatctgcagtggctccgcggctcctcctcgttgtctgaatgtcccgttcagaagcttcagctagagcagcagttccagtccacggatctgctatgtaaattctctacttaatttgtccaagtaattgtagtgattgatgaacagcagattcggagttgtgcttttgcaaaaaaaaaaaaaaaaaaaaaaa

SEQ ID NO: 8022 - DNA, 521 bp, Sorghum bicolor
  Clone ID: SORBI-28MAY03-CLUS19529_1
gtaggggctgcaagaacaagactgacattgtccaagtacacataccctatgcttgtaagcttctgttccaggagcttatggcaatggccattgctcccagaatgcttacccatgatatgaagacagggaaggatcagaagaagcgctgaatgtgtatcacatgagatgtgtaaccggaactcttgctccattgttatattcctggttcacacgatataataccccgttgaggaacttctttgtggtcacttgttttctgatttggagtttggttcttcacgaacaatggacaggccattagtcttttgatccctatctgtgttcgtgttgtctgaggatctgtgccaacagatcgttgagttaattttgtacattaggaatgtgctgcaatgtattaatctgtgtgagtacaaagactttgggggcacaaaggtgccattttggacacttggtgtaactgtacgttaatactaattgctatgccattacaattgcaaaaaaaaaaaaaaaaaaggccccta

SEQ ID NO: 8023 - DNA, 732 bp, Sorghum bicolor
  Clone ID: SORBI-28MAY03-CLUS1955_1
tgcagaagctgtcgaccaagcagccgagcctggagagccgacagttggtgctacaggagatcgccgccgagaaagggatcaccgtgcgcatctacgagcctccctgcgatgactcggggcgttccaaccacaaccacaggaagacgaagcacggtgacgagaggatcagcaggacggcaccagttgatgaccgggacgaggacatttccggcgactcggcgcagaggtacaaggacgtggaagcggcagctcaggccgcgttcgagtcggccgcctcggcagccgccgccgcgaaggccgccatggagctctcgcgaggggagcccagggggcccggtgacaggaggaggatgcagatggatcctgagatcgagaaacaagatgggccgcttgatggaaggagatctgagaagattgggcttgatcggaattgcagctcagaggttgagatcgtgccggaggacgaggcaaatcatggcaacgttgcagtgaacgaactgaaacagcaggagcctgcaaagggaaagccggcatcggtcagaacgaagtggggattttagcggcatccagatggcaacacaggagatggttttcttgattgattttgtcagtatatattggaagttaatttttcactgatgcatgtagttagatcttatggtatatgctcataccatataggagtatatagttaatggtggccaaaaaggaaaaaaaaagacttgagatttg

SEQ ID NO: 8024 - DNA, 840 bp, Sorghum bicolor
  unsure (1)..(840): unsure at all n locations
  Clone ID: SORBI-28MAY03-CLUS19288_1
gccggccgggtggatcccccccttatatacagatacagcccgtccggttccccaatccccgcatcgcctctatcgcctgtgccccctgccacctcgccgccggcatgacgacggggtcgaccccgggttcgccaccctctcaaggctctcagagaaagcggggttctaccaaagattctgttggcttgtatgcagtgcaatgctataagtgctacaaatggagtacggttccaaaagcttcgtgagaacttcactaaggatccatggttctgcagcagacgaccagactgctcttgtgcagatgatgctgacattgagtatgacagcagccgcatctgggttttggacaatcccaacataccaaagcctccaccagggacagagaggctagtgattttgaggagtgactacagcaaaatggacacatattatgtaatgcccaatgggaagcgtgcaaggtgtgctggtgatgtggataagtttctggaggcaaatccagagtacaaaaacagcatatctgcttcagatttcagctttgcaccacccaaggttgttgaggagactgtttctcacaactctgcctggaaggctgccaaggccaagaagcagaaggcaaggcacaaaagtgattgatgctctgaactgtgcctcatgtttaggtgatagtcccctcaagatcatgccccatcctatctagtatacttgtctatctggactgaagctttttggctctgcatgctctgctgcaaccgaaaccctgtgtcttaattcctgnngaatatctgagatgtttaataagtgctgtagacctgctcttttataattagctgcttggacctt

SEQ ID NO: 8025 - DNA, 561 bp, Sorghum bicolor
  Clone ID: SORBI-28MAY03-CLUS19650_1
gccggctcggccgcccggcccaccagtgccaagctcaaaaaaaaaaaaaaagatcaccgcgaagaacacaaacacaagtagggttaggaaggcgccgccgccgccgccgccgccgaggccaccacctccaagcccaagcccggcgtccgcggcagcctcaagaagtagcttgctgtcttgcctgcctgcttggggtaattcccttcgatttcagtcccatccatcgacccgatctataatcaatcaaactaccgacctctggactctggtccggtggccgctgccgcagtcggcctgcggtgtactattagtctactgctgcttttcgttgttatactgctggtacatgtgttatgtgatatatgtgtcaactatatagcaatctcgtcgctggcaactaggcatgtttaactgtgttgctgctctgggatgccggcgatggctgctagtactgttaatgtcgatcgggtctccttgaacaatggcggaaatctgttgcttgttactttcttctgatggcaagtgaaagttcacgaaaaaaaaaaaaaaaaaaggccccta

SEQ ID NO: 8026 - DNA, 941 bp, Sorghum bicolor
  unsure (1)..(941): unsure at all n locations
  Clone ID: SORBI-28MAY03-CLUS19562_1
ctgtgcggcgctcaggcggcgggtcanaaacttcttcctcgccgcttctgctttctgatccggtcgcatccaacgcgcgcgacctggtgaaccaggacgcaccctctccaccgtgccacgattcctttcttctccgtctccgcgtagcaatcagagaaagagatcgatcggccgcaggagggagcagcgacagcagcagagagatcgccggccgagagaggaaggaaacaagagatggacgagatcatgaacaaggtgggcgcttactggctggggcagagggccaacaaggagatctcctcggccagcgacgaccttgaatcgctgtcgaccagcgtcggggacggggcgaaatggctggtgaacaagctgaaaggcaagatgcagaagccgctggcggagctgctcaaggagcacggcctccccgtgggcctgttcccgcgggaggcgaccaactacgagttgtcgccggagacgcggcgcctgacggtgtacatcccgtccccgtgcgaggtcgggtaccgcgacggctccgagctgcggttcgacgccacggtgtccggcacgctgggcgagggccgcctcacggaggtggaggggatcaagaccaaggtgctcgtctgggccagggtcaccgccgtcaaggccgacgccgccaaggtccacttcaccgccgggatcaagaggtcgcgcagcagggaagcctacgaggtcgtcaggggcggcatcaccgtcgacgagttctagcttttattttgccatcgcggctcggatcggatggatatggatggacgagcttcatctttgcttgctgcacgctgagatggttgcttgcaggaataaattctacattcattagctagctgagagatttgcgtgccctgtaatcgtgtgttttgtgcttcgctgtgagtatttaattaacacctggaaggatcaaa

SEQ ID NO: 8027 - DNA, 588 bp, Sorghum bicolor
  Clone ID: SORBI-28MAY03-CLUS19657_1
gagaaaggaagcataaaagctcaaactcaaagaaaaaggagggtaggagaactacttttgactcaggagatgaatatagcaaggatgaaacgtcgaatggccacgatgctgagcaaggtaactggagtgcatttcaaaatttcttgttgagagcagaagaaagaacaagatctagtgaaacagaactggagcaggccattcacgaagaagaatcatggcatgagttgacgtgagatggagaaccgaaataccaaatatcttgatccatcgtgccactcgctagcccagtgacctgcctactagaacaaatgagggcgcccaacaaatgaatggcatctcaaaaggcttcttgtacagaaaaaggaaatggctggtctgtagcattgcctgcttccaaggtttgtgatggaaaatcaattatctttcaatggcatggcgttgtacttccaattttaacataattatttcattctttaattgagggtggcttgtaatagctgtaaacctgggttttttttggcgatgctgagctatattctgggtgtatttatggaacggaaagaaaaaaaaaaaaaaaaaaggccccta

SEQ ID NO: 8028 - DNA, 486 bp, Sorghum bicolor
  Clone ID: SORBI-28MAY03-CLUS19680_1
ccgtcttctactacgagatcctcaactcgcccgaccgcgcatgctccctcgccaagcaggccttcgacgaagctatttcggagctggatactcttggggaagagtcctacaaggatagcaccctcatcatgcagctcctacgtgacaacctcaccttgtggacttctgacatgcaggaggatggcagtgatgaaatgagggatgcaagcaagcctgatgatgagtagtagtgagaccatccaagtgactgccatctctgtctcttaagtcttaacccttgggggtagtcgtgatgcttgtacaaggaccattttcgttgtgtcctttatcatcgggtctgcttacctttcgttttgttatattgctattgtggtcccccatgtatcatttcaccttgcaactggaaccctgttactgttagtgtgtgggaaagaataacataagccctctgttaactagtaaaaaaaaaaaaaaaaaaggccccta

SEQ ID NO: 8029 - DNA, 625 bp, Sorghum bicolor
  Clone ID: SORBI-28MAY03-CLUS19728_1
gccggccgggttgcgccgtctgggtgtggccgtctcgcttcgcccactccctcccccagatctccaagaccaggagcccggggaaaccaccgcgcccgcagcgatgtcggcgagcagcgcgcccgtagacgcctcgggggagccgatcccgacgtcgtcggtgctgatggcggcgtcgaagcacatcgcagtccggtgccgcccggagaacgtcgccttcctcaactgcaagaagaaggaccctaaccccgagaagtgcctcgagaagggacgtcaggtcacacgttgcgtccttagcctgttgaaagaacttcaccaaaagtgtcctaaggaaatggatgagtatgctggttgcatgtattactacaccaacgaattcgacttctgccgtaaggaacagcaagcttttgaggaagcctgccccatttccgagtagatcttgagagttttacttccagtggtcttcgcaaaaaaaaaaaaaaaaacctaaactacgacttcatgatgtcccatgtttgttgtcctcatggaaattttactggtgaatgaatagcacaccctggagctattcaccccatttcccccctgaatttttttcaaacttgaattgacgcagccatatgct

SEQ ID NO: 8030 - DNA, 734 bp, Sorghum bicolor
  Clone ID: SORBI-28MAY03-CLUS19809_1
tatggcttctcatggattgtactcgttgttatggttcttcttttcaagcttttcactgcaactccgaacaagtcgacagccttgccgacttttattcggtttctgcagggcgtccttgctattgggataattgcaggaattgttcttcttatcgtgctcacatcattcactattgctgatttatttgcaagtgcacttgcttttatagcaactggctggtgtatcctatgtctggccgtcacatggaaaaaggtagtgaaaacccttcggctatgggattcagtccgtgagattgcaaggatgtacgatgcaggaatgggcgccatcatctttgtgcccatcgtcttcttctcatggttcccctttgtgtcaacattccagtcacgtttccttttcaatcaagcgtttagtcgtggcctggagatctccctcatcctggcagggaacaaggcgaatcagcagacatgaaaagcctcgccgcatcagttttcctgttgtacattcttaaaattactgagctgcttagttagtttgaacaatttagtgagctcgatttgaacgacagctttgtacataattgcccctgtaatttcgacactaattatgcggagacagagctacggcagtagatatgagcaggtgtatggcgacctgatcttaacgaatcctctcttctccgatggtaaagcatccgagcaacacttcagcaaaaaaaaaaaaaaaaaaggtcccta

SEQ ID NO: 8031 - DNA, 889 bp, Sorghum bicolor
  Clone ID: SORBI-28MAY03-CLUS19825_1
gccggccgggttccggaagacgcctcgccctcttccctcctctctcctgccgtcgtcctgcgtcccaattgggcaattccccaaacctaactaggctttaccaccgcgggagctgccatgggtggccagatgccggacgccgacgagaaggcccgctcggcggacacctcctcgtcctcttacggctacccgccgtcggcgccgccgcagcaccagcaccagtacggcaccttcgggcccccgtccggggcctctgggcagtttccgcagccggcggtcgggttcccccagccggcgccgccgcccggtatgcagcactacccgcagcagccgccggcgtcgtatgcggtctacccgcccccgcagcaaccctacgcggccgccgcgccgtactacgcccaaggctaccaggtcgcgcaaggttatattcctgttgttgaaggaaggcctgttagaatgcgacctcttccatgttgtggccttggcatgggatggtttctgtttatacttgggttcttctttgctgccattccatggtatattggagcttttgtgctgatttgtgtccgagtacatgattacagggagaaaccaggatatgttgcttgcactattgctgcttcgcttgctgcaattgctgtgctgcttggcgccacaaaaggagcggaggtgtggtgagaattatgccttcaatcaccagcggtctgtttaatgtaaatgtttgttactcggctactttgttatctgtgttgtacatgccgtgttgtgcgtagaggatagggtggaacaagattgatgtacgctcctattcgttgtttgacatataaatttgtaaaatggagtagtatgaatgcccctcattttaattgtttaatgtaaaattgcctgt

SEQ ID NO: 8032 - DNA, 707 bp, Sorghum bicolor
  Clone ID: SORBI-28MAY03-CLUS18865_1
gccggccgggccgggacctctcaccaagagccaggcctagccgtctcttaccgcagaggcgaattcatttaccgacgcggcgactccgatcacccaccaccgctgcccgccgtcctcctctgacgccgccggcgccggggctagcccgtcggggagccatgtcgcggtccttgagcatgagggggagcatgaggtcgcgccgcgacctgcctcctcccgagaagacaattgaaaggcttgagagtatggtggatggaggaaatttctatgaagctcaacaaatgtacaagtcaaccagtgcaaggtatattactgctcagaagtattcagaagccttggacatccttcaatcaggcgctttggtacaattgaagcatgggcaggttacctgtggtggtgaacttgctgtcctctttgttgaaaccctcatcacaggagagtttccatatggtgaacaaatttttgatcgtatcagaaagatgtatgaggcattcccaaggataactgttccacatttccttggagatgactatgatgatgaggggcatcaattatctgaagctatttctgctgccaaagtacgtgcagagagttgttcatcattcctgaaagctgcaatcaggtggtctgctgagtttgggacatcaagaaatggttctcctgagctgcacgttatgttagcagaatacatatattcagaatctcca

SEQ ID NO: 8033 - DNA, 649 bp, Sorghum bicolor
  Clone ID: SORBI-28MAY03-CLUS1895_1
gcacgagggaggttgcaagtgacttgctggacagacaaggtcccatctacagagaagacactgcagtcccacgcgtccggtctggggagacagcagataccctcatggctcttgattatgcactagaaaatggagctctttgtgttggcataacaaatactgttggaagcacactgtctagaaaaacacactgcggagttcatatcaatgctggttgtgagattggtgttgccagtacaaaggcatatacaagtcaaatagtagccatggcgatgatggcgttggctattggatccgatcaaatatctactcaagctagaagggaaactatcatcagtggacttaccaacctttcaagcaatgttagcgaagttctcaaactagatgttgaaatgaaggaacttgcctcgtcgctgatcgattcagagtcgctcctcgtgttcggaagaggctacaactatgccaccgcgctggagggtgctctgaaagtcaaggaggttgcgctgatgcacagcgaaggcatgcttgctggcgagatgaagcatgggccgctggccctggtggacgagaaccttaccatcattgtcattgcgactcgcgacgcatgcttcaggaagcaggagtcggtgattcagtaactcctttcgtg

SEQ ID NO: 8034 - DNA, 870 bp, Sorghum bicolor
  Clone ID: SORBI-28MAY03-CLUS18887_1
gccggcctggccggggaataagatacatgcacaccactcctgatacctaaacaaggtgaaaccgggaaataaggcggagaaaagaaaagagtggtactgtcctctagcatcagtcacgccaagtctatacaatgaggaacgtatacctgacaagtgctattttcctgataattatgatcatttattcaaccaccccatcatgccaaggccaagaccaactcgatgattggcattatcaccacagctcaccaccgccgccaccaacaggatcaacactaccgcgtagtttgtctgaaatgtcgcaccatcatcaccatcatgggtcgccaccaccaatgccgccatcaccacctcgcagtttgatacagacattacaccatcaccaccataggtcgcccccgccaccctcagtgccgtcgtcaccaccacgccacttgtttgagacactgcaccatcatcaccacaagtcacctccgccaccaccagtaacgtcattgccatcgagaagtttgtttgagatggcacactggcaccaccacgccatttgtccgagacgtcgcgccattatcaccacccgtctacaccgccgccaccactgccagcatcaccaccacgtcatttgtttgagacatcccaccatcatcaacacaagtcatctccaccaccgcatgtgccatcgtcaccaccacaccttgtctgagacgttatcaccaaaccaaaggcagataaagataaagtccgtgacatgctacactgctacaacaattgtatgaagctgtccacattaagctacttcttgttgcagacaggaagttgcccagattaagcactgtaatgagcatttgtttgatgcggagctcaataaagtgg

SEQ ID NO: 8035 - DNA, 688 bp, Sorghum bicolor
  Clone ID: SORBI-28MAY03-CLUS18965_1
gtgcggcgctcaggcggcgggccgggacacccgcccccgcaccaccgccaaaaccctagccactcccccgccgccgcctcctccttcgtctaccgtccgcaccagcccatggaggaagacgccatctcgacgctcatggacatcgacgactcgccgctcagcgccgcgggggccggattcctcgacgaggaggacggggacggggagatgttcctggctccgcaccgcgcgggccgcggtggcggcggtggcgagacccgcgggcccctcctcttctccgggttcttcaacagcttcgacggcgccgacttcgacgacgacgacctcgcctgagggaactaaccgcccggttcggtaacggaggttgttcgtgggtcgcgatccgtgttatgtcgatatcgtgatgggctctcttaattagcgtatcggttcagactcgtttgagcaatctgaagatgtttagggatcaatataaatacctttgtgccctgtggttcgtggatcaaagtgcatgtgttcttccgtatccttttggaacaaaagctccattgttttgatctcctgaagttgggttgggggaaaaacaccccggggggggggggcccccccccccccccccttttttttataaaacccccccccccccccccggggaaaaaaaaaaaaaaaaaaaacccccccccttttt

SEQ ID NO: 8036 - DNA, 762 bp, Sorghum bicolor
  Clone ID: SORBI-28MAY03-CLUS18968_1
tctggagagtccagagccgcagagcgcagagcgtggcgtccttgcgccccaccccaccctctctctatccatggcggtcccccgcggatgcctcctccgcctgctcgccgtcgccgtgttcctcgcgttcctctgctgccgcggcgaggcggcggtgagggagctcaaggtcgggtactacgcggagacgtgcccggaggcggaggacatcgtccgcgagaccatggcgcgcgcgcgggcacgcgaggcccgcagcgtcgcctccgtcatgcgcctccagttccacgactgcttcgtcaacgggtgcgacggctccgtgctgatggacgccacgccgacgatgcccggcgagaaggaggcgctgtccaacatcgactccctgcgctcgttcgaggtcgtcgacgagatcaaggaggcgctggaggagcgctgccccggcgtcgtctcctgcgccgacatcgtcatcatggccgcccgcgacgccgttgtcctgaccggtgggcccaactgggaggtgcgtctcgggcgcgatgacagcctgacggcgagccaggaggactcggataacatcatgccgagcccgcgcgccaacgcgagctctctcatccgcctcttcgcggggctcaacctcagcgtcaccgacctcgtcgcgctctcgggctcgcactccatcggcgaggcccgctgcttctccatcgtcttccgcctctacaaccagtccggatccggccgcccggaccccacatggacgccgcctaccgc

SEQ ID NO: 8037 - DNA, 910 bp, Sorghum bicolor
  Clone ID: SORBI-28MAY03-CLUS18995_1
cggccgggccgggcatctcacttgggatctgccttgatcaatcttctagtcctagctaccttgttcgttcctcattgattgatccatcgatccctggtcgtagctgctgcaatggcttccggtggcgcgtcactggccttggccgcgctcctcctcgtgagctgcacctcggcagcggcggcgaccaagtacaccgtcggggacgcgtccggctggacgaccaccggcgattacgccacctgggccagcggcaagaagttcaaagtcggcgacactctcgagttcaaatacgccggcggggcgcacacggtggacgaggtgagcgcggcggactacgccgcctgctcctccagcaaggcgctcagcagcgacagcgccggcagcacgaccgtgacgctcaagaccgccggcaagcactacttcatctgcggcgtcgcgggccactgcagcagcggcatgaagctcgtcgtggacgtggccaaggcggtgtccgccgccccggcgccggcgccggccgaggccccggcgccggccgcgtccgcggacaccaccccagacgcccccgacgccacgccgtcgaccccctcgagctccggcgtcacgcccaagaccaagagcccagtcacggacctctcgccgccgggcaagaagtccacctccacctccggcgccaccgggctcagcgccgcggcgtgggccggattgggccttgctgggctcgtggccctgcatctcggcgcgttctagggcccgctgggctgaccagggtggaggcagtgctgtttgttcttaggcacgtcatggattcgtgtattggttgagggacttggctagttattacttaccagagatttcttttgattcagggaacttttattggtgcttttgctgtgctggtggctgtatgtag

SEQ ID NO: 8038 - DNA, 805 bp, Sorghum bicolor
  unsure (1)..(805): unsure at all n locations
  Clone ID: SORBI-28MAY03-CLUS1900_1
tcacccacctccgcaatggtgggggcagtgagagcagcaagtgtgcacagatttgcaaggttttngaggatgcatacaagtctgagttcagcatcataatggtggaggaggtcgaaaggttactggagtatgtagccattggaccacgtttttcaaacttgatctctcaaactcttctggtcctcctcaagagggttcctcctaagggaaaaaacttgcttgtgattggaacaacaagcgaggttggcttcctagaatctgttggaatgtgtgatgtgttctctgtgacataccatgttcccaaactgaaaaaggaggatgccaaaaaggtattgcatcgtcttgatgtgttcgatgatggagatcttgatgcagcagcagaagcactggatgatatgccaatcaaaaagctgtacacacgtggtgggatggctgcacaggggccaaccggaggaagtgcagaagcaatttataccggagaggacaagatagatatcaaccatttcttcagcatcttgagtgatattatccgttactaagctcgcatggagccgaaatgggcccctaggtgtccagtaggaagatgcacctatgtttcatcaccccgtgtggcatcctcacagcgtgtagagtggtttgatgtgttgtttttgtttgatgcgccgaccagagctgtgggatttgatcatagtcgagctacacgatatagcatttttgtattgtatgaatgacgatgtttatacagttgataacgggatccagctgtacacctcaggacagaaatgattatgattctcctttttat

SEQ ID NO: 8039 - DNA, 700 bp, Sorghum bicolor
  unsure (1)..(700): unsure at all n locations
  Clone ID: SORBI-28MAY03-CLUS19042_1
ggccggccgggtcgcaagcttctcgaggactgctacctagcatagacaagttcacccaagatgcaaatcttcgtcaagaccctcacgggcaagaccatcacgctcgaggtcgagtcctcggacacgatcgacaacgtcaagtccaagatccaggacaaggagggtatcccccctgaccagcaacgactcatcttcgccggcaagcagctcgaggatggccgaaccctttcggactacaacatccagaaggagtcgaccctccacctcgtgctccgactgcgaggaggtatggccaagaagaggaagaagaagaactacaccacccccaagaagatcaagcacaagaggaagaaggtcaagatggccatcctcaagtactacaaggtcggatccgacggcaagatccagcgactccgacgagagtgccctgccccgacctgtggtgccggtgtcttcatggcttggcacaaggaccgacaggcctgcggaaagtgtggtcttacctacactttcgagcctggaaccaagcccactgccgcttaatcgcgcagtgatctagttcacctcgcccccctttggcggtctggtcgcatcttttatctcggtagatgtatgcaccatgatttgcctcgaaaaaaaaaaaaaaaaaaggcccctannnnnnnnnnnnnnnnnnnnnnnnnnnnnnnnnnnnnnnnnn

SEQ ID NO: 8040 - DNA, 662 bp, Sorghum bicolor
  Clone ID: SORBI-28MAY03-CLUS19123_1
gccggccgatgttattgggcttgactggacagtggacatgtctgatggaaggaggcgccttggtaatggaattagtgtacaagggaatgtggatccagcatttctgttctcaccattaccagtactgactgatgaaattcatagggttgtgaaatcagctggtccaaaaggtcatatacttaacctgggccatggtgtacttcagaaaacacctgaagaagctgtagcacatttctttgatgtcacaaggagcttgagatatgacacccttttccaaggttctgttgccgaagaactgcagcctgttgcttgacagtggcaatggcattcccatcttccatcaagtagtctatttgatctgccatatatcatctagagtcacagtagattcctagtgtcgtctgcattctacctttcaagagacactcattttgttgaagcctgaatatgtcttgtagagatcggcagcagagcaaatgcaattttattcactgtttaaaaaaacaattattcctaagactgaagaagggatgcatgatgcatgcaacctggttttgaagtagagctggggggctggatgagccagctcagatcgcttattgagccagaaggccagctcagctcaggcttgtttgagcatttatctaaagttttagaatggt

SEQ ID NO: 8041 - DNA, 861 bp, Sorghum bicolor
  Clone ID: SORBI-28MAY03-CLUS19129_1
gccggccgggtccagacctctcttcattcccaacacacactaaatagcataccaataccataacaactttggattcatcatcatcagcacaaaagcacagacagacacggtcgagatcgaggacatgaggctcgcaagaatcgcgatggccgccatggaggacggcggcggcgcgtcgtcgtcgtcgtcgtcgatgcagcagcagatgccggccgccatggcgtacgcggggcgcgtgcagccgccaccgttctggtcgacgccgacgccgtacctcttcatcggcttcgcggtggtgatggcgctcatcgccgtggcgctggccgtgctcctctgctcccgccgcaaggaggaggaggaagcggcaggccgccgcggcaccggcgcggagccgggcgtcatgtctgtcgtgcgcgtgctcacgccgctcgacagggaggacgccatgcccaaggtgctcgtcgtcatggccgggcacagcgcgccgtcgttcctcgccagcgccgcgccgtttgccaccagcttcactactcacgccgccgccgacggggccgccaagccgccgcagcagcacggcagcggcggcaaggacggcaaggacgccgccttcgccgccgtgtagtagcctttccctgccgctcggcgccccccgatcgacctgccggccgtgtgcaagagatcgatcgaacgagagcgcccgcgcatggacgtgaaaaaaaaatagactaagctggatgatcatcggagaagcgattttgttctgacttttttttttgttttgctttcgtattagtgcagttctgtgacgtacgtgcaatgctgatctgcatagcttctgccatgtaaaatgagaagatgtgt

SEQ ID NO: 8042 - DNA, 841 bp, Sorghum bicolor
  Clone ID: SORBI-28MAY03-CLUS19250_1
gccgggccgggcgtggtactcctcccctcgcagtacatcatcagcgttctccaggaagagcacacatggctgagaaggtgtccacgttggtcgtgacactcaaccatggctgctgccgctgcttcaccaagatccggaaaactgtctgcaagctgcaagaaaccgaggacatccgggtgatttcctacgacgaggtgtccgggacggtgacgatctctggcgccttcgacccgctggtgctcccctgcaagctccggcgcaaggcgggctgtgtgatcagggacatccagctcgtggcggcagaactgcggctcacaccgcagccaccaccgcgtccggcgcagcgaccagccatgctactaccaaatccgtcgtgctcgtgctgctgcggcatctgctggtgcaggaactacggctgctgctactgcggttgccagccctgcgcctgcttcgtgaaccacccgccgtgctatgggctgccgttggggcagtacccaaagatggtagtcgcctgcgaggaggtgtcgtctccggcgtgcatgatcatgtgatgtttgcttgtcttgaggagacgtcgtcgtctccagcagtccagcgtgaaaggacttgctattgctagttattagtttgtcatctcgtgtttcgagttgttactgtggttttagtcttttgtggaaagaacgttgttactgtggtcctgtaatctgtagtttatagtggaaagcaccgagcaacatggaagggtgatcaaagagttactgtggttcttaatgaaagggataacgcatgcatccttgtttagtttaaaaaaaaaaaaaaaaaaaaaaaacatactgacttt

SEQ ID NO: 8043 - DNA, 844 bp, Sorghum bicolor
  Clone ID: SORBI-28MAY03-CLUS19194_1
ggacgaggcagccggccggagatgccggccccaattattggttgattcgacatgacagctttttaaaaaaaaaactaccaatttaccaaagaagcgagatggcccggcttcaccacctgtctctcgtccccgccacgtccctcctcctcctgctgctgctacccgtcgtcctcgcagccgcctccgcagcagcggaggagccacagatcaggatcagcgtgcagtaccctaccgaggaggaggcgcggtggctggaccgctggtcggagaagtaccaggcgcagggcgccgcctccggcttctccgtccacccggccaccgacgaggagtcggcgtacctgaacagcatcttcgacaacggcaagaagagagcggccagtggtgaccactcccacggcggcggcggcggcggcggcggcgcacccgccggcttcgacggccacatcgagttcgacgacgacgaccatccgtttggtaggatcgtcgtggacaccgtccactctcgcgcgagctcgtccgagaccaacgatggtgatctgcagaaccaccacgagcctcactctcacgcagagtataatgctgacgacgtcaaggatctttaggagcactgaacttgttcaatcgagcccgtcgattgtcatgaagggaataatatggaggattgctgggaggagttcgtgtttcattaattagtctgttttagtagctagctagtatggcgtcgcagccagcaggggtcgtcctcctttctgatgtgtgcgtggtagtctcagctttagttgcaataattttctttctttcttggctaatataaatcgtgtgcagagatctcctgcaagttcct

SEQ ID NO: 8044 - DNA, 1275 bp, Sorghum bicolor
  Clone ID: SORBI-28MAY03-CLUS2446_1
gccgagcgcctcgccgcatccgccgccaccctccgcgcctcggccgccgccgccgccaccccgtccgcgcgccgcgcggcgcgggccagccgcgcgttcttcccgccctcgccggcgtcgtcggctcgcgcgcgcgttggcctccgcgccgcgccgtctccgctcccgcagaaggcgagggcagtgaggtgcgcggctgtggcggcggcgtctgacgtggctcaggtgaaggccgcgcgcgaggacatcagggagcttctcaggacgactcactgccaccccatcctggtacgtctaggatggcatgatgctggtacatcgtccgagaatattgaggagtggccacaacgaggtggagctaatggaagcttaagatttgatgttgagttgaaacatggagccaatgctggtctgataaatgctctaaagcttatccaaccaattaaggacaagtacccgagtatcacttatgcagatctatttcagttggcaagtgctacagcaattgaggaagctggtggcccaaagattccgatgaaatacggacgagttgatgttacaggacctgagcagtgcccacctgaagggaagcttcctgatgctggcccaagttcacctgctgaccacttgagggaggtattctacagaatgggccttgatgacaaggaaattgttgccttgtctggagcacatacacttggaaggtccaggcctgaacggagtggctgggggaaaccagaaacaaaatatactaaaaatggtcctggtgcacctggtgggcaatcatggacagttgagtggctgagatttgataacagttacttcaaggatatcaaagagaaacgagatcaggatcttctggtcctacctacagatgctgctttatttgaggacccaaacttcaaggtctatgcggagaaatatgcagaggaccaagacgcattcttcagtgactacgctgaggctcatgctaaactgagcaatttgggtgcgaagttccaaccaccgcagggattctctttggatgattagtgcagcaccagagctccagtccgtgaaacagctcaatgctgtccttcaacaggatcaagattcaagaggaaacatacaattcattgctcttctacatatcatcatcgtacaagatggaccggctttccatgatgctatatatgagtcttaccaatttagcaagatttggaaccaacgagcttgcaaataaaagaactgacacagtgacactacataaataacagagccattgtgacaaatgag

SEQ ID NO: 8045 - DNA, 1058 bp, Sorghum bicolor
  Clone ID: SORBI-28MAY03-CLUS24507_1
ctttgtggagacgaagcgggaagctgattcactgaggtattttctacagtcaaaaggtttcccagcaacagcaatccatggtgacagaacacaacaggagcgggagagcgcactgaaatccttcaagagtggcaccactcctataatggtcgccactgatgtagcttcaaggggtctggatgtcccgaacgtggctcatgtgatcaattacgatctccccagcaccagcgaggattacgtccacaggatcggaagaactgggagagctggaaaggctgggattgccaccgctttcttcaccgagtcgaaccaccccctggcaaagggcctgctggagctgatgactgaggcgaagcgggatgtgcctgagtggctcgtggagtatgcaaacaggccgtgctatggagggtccagctatggcggaagaggccgaaggggcggcggagggtttggcggaagagactatcgacgcagcagtgattatggctatggggttgacgatagtggctattccagccgcggtggcagctactctggtggtggcggctattccagccgcggtggcagctactctgccggcggttctcgtggtggtcgcgcaaactatagtggtggtggagcttcctacggatcaagtgctcctcctccccggtactacccgtcgtaccccatgggcaccactgacatcagcgcctctggctgggactagtcaatgcccacgcgtatccttaatgcacatgccatatagatactttatatatatagccctacgtctgtagtagctcggtctttctctggtccttttgccttgccggccctcgtctagtcctgtcatatatacattgccatggccctgttgcacaggggcaagcttggcggtcgggaactttggggtgcctttttgtgtcagtgtggtgtgagtgttgcgacgatgaacccacttggtggttggttggactcgaaggttatacatatgcataacattggctgtaacggtggcaagtgatactgctgtttttggtattcaatccaagagctgtccagtacttgctggtact

SEQ ID NO: 8046 - DNA, 578 bp, Sorghum bicolor
  Clone ID: SORBI-28MAY03-CLUS24399_1
cggccccgcccttcgcgctgcgcgccggccgccgcccccgcgtcggcgccgtcgtcgggttcatccgcggcgcgcctgcccgggcctcgcagccggggcgccgtcctcctccgccgccgcggcgtccccgccgcccgccccgctcccggccctcccccgcccggtgcgcgccgtccccccccccttcgtcggcgccaccatctggagcttcgggctgccctgctcctcccccggccccgcctgccgctgcctgcccgtcccgcgcgtcggccccggcggcctcggcgtggcgccgctcctggtcgtggccggggtccccgccaaggcgccccgccgtggctgggccccgtccacctccacgtcaccccgctcccgctggctgcccccgatcttccctcctcccccgtcccccgggctgcccccggtccttccgctccgtgccgtcgccgcggcggttgcggcaccgtcgttccgtgccgcctcctcgtcggttgtgccaccgtagtactctgggtgctgcaatgggtttttcctccgacctggcgcccgtggaccttggataaaagtacgaccaatag

SEQ ID NO: 8047 - DNA, 642 bp, Sorghum bicolor
  Clone ID: SORBI-28MAY03-CLUS24590_1
aagagggaagagcaccaaggacttcccggcgcccgttcaggatccacatccttcccgagcgagttcttggttgacctcttcctcttcgaccacctcctagggtatgcatgcactgcacccccgttccccctttctccgtttcccttttctctgaagaagaaatctgtgattattgtgtcctggtttacgagattagttgttttgctgagtatgtgctaggctactgcgctgaatttgtgtgtcgatcttgcttttttcttttaatcaaggtcagccctgtcaatgaacaaaaggtcgttattccccccccagaagtttgcgatcatgcttgattttttgttagatatcgtttttcttgtctggatcttagtatgactgttgttcgtgaggctgttaagtaatcgtaatcagactgggtacggtttgctggccctgaattccaacagtcagcttgctctggtttcagaggatttatgttcggcaaaattttgatcatggctgtacagaaagaattaatcttgatggaaataatttagatgaaatccttcatgacatgaaagcatgtcatcttatgcccccttgctttgcttattctacagttatgtgaagccaaagatagtgacctaagcggatcagtactac

SEQ ID NO: 8048 - DNA, 694 bp, Sorghum bicolor
  Clone ID: SORBI-28MAY03-CLUS24591_1
gcacgaggcatgtgcacgcagaagccgccgcatgactactcccagcagctctacgagaagtaccgcggctcgtgcgaggaatacatcacatccatggtcttaccttcacttagggagaagcatgatgagtttatgttgagagagcttgtaaaaaggtggtcaaaccataaagtaatggttcggtggctgtcacgcttcttccattatcttgatcgttacttcatttcccgaagatcactgccaccgcttagagaagtcgggcttagttgtttcagagacttggtatatcaagagatcaaaggaaaagtaaaaagtgctgtgatatctttgattgaccgagaacgtgagggtgaacaaatagatagggcactattgaagaatgtcctcgatatatttgttgaaattggtttgggtactatggagtgctatgaaaatgattttgaagatttcttgctcaaagatactgcagattactactctatcaaagcccaatcctggatccttgaggattcttgtccggattacatgctaaaggctgaagaatgcctgaaaagggaaaaggaacgagtttctcactatttgcattctagcagtgagcagaagttactggagaaagtgcagcatgaactgctaactcagtatgctagccaactcttggagaaggagcattctggatgtcatgcactacttcgtg

SEQ ID NO: 8049 - DNA, 642 bp, Sorghum bicolor
  Clone ID: SORBI-28MAY03-CLUS27218_1
gaggtggcgcggcccaccaaggcgtaccgcgccgtgctgcagcgtctgccgtcggtgttcgtcgggcgggacgatcgcctgcgcctcctggtggcggccgccgccgacgcggcgcgcgccagcctgaagaagcgcggcctccacctgccgccgtggcgcaagctcgagtacatgcgcgccaagtggctgtccccgtacgatcgcgaggctccacctccgcctgaggccaccaccggtgaactcgccggcaacggcgagggaggtgggcccagtgcttaatcatcaccgaggtcgtttttggaataattttctttcttttttgctctttgttcttcgggaatttgcagtgtggtccttgcgtgtacagggactggacgcaaatgtcctgctttgtttttttttccacgctttcttttattctttctttccttttcacccttttgatgggtgtctattccccgcggcgtagtagttgtagtaagtagtgccggtaattatggaggagagaaaaggcacaaaaaaattgtagctttagtttgatgatgaagagataaaagaaaaaggagattccggacagagacctgtctgattcttttggtctcaatcgttgttccaggcagcggaacctgacaacgaacaaag

SEQ ID NO: 8050 - DNA, 743 bp, Sorghum bicolor
  Clone ID: SORBI-28MAY03-CLUS29880_1
gaaaacaaaagagaggctgcaggcagttgaggaactgaaaggacaagctgatgctggaactgtggtagacgctaatattgctgaaaagttggcacaacttaagaatcaaattgcaacacttgaaaaacgtgaagaaagatacaaggcggtgtttgcggagaggatctcagtcttccggaaagcctgctgctccctttttggttacaagatagtgatgaatgatcagcagcagtcaaatgggatccctgtaacacgctttattctgcagtcagtttacgcccaaagcgatgatgaaaagcttgagtttgactatgaatcaggaagcactaatatcgtggtcaatgactacacgtcccaacacgaaattgctcagcaggtcgacatcttcataaggaggatgaactccataccagccttcactgccaacctgacaatggagtctttcaacaaaagaagtatatgctgaagacatgaaactagtgtcagggcacattgctggatgtttgtttgtttagaatgatcctccattgatgtgaaaagtatatatatgagcactcacatggatgggtgaaaactgcttctaccaattgaaattgatgctggggttttggttctttatcccatgtatcctgtcttaacaaggcgtacatgggtattacggggcatggcgacataatgttgaagcttatgggttgtctatagtgtagctaccagttaactaggaatgctttacttgattcgca

SEQ ID NO: 8051 - DNA, 683 bp, Sorghum bicolor
  Clone ID: SORBI-28MAY03-CLUS29858_1
aacaacaatgcttaaaggagaaactgaagaaattgggaaacttgttgaaaagaccgcgcggcgaaaatatggagttgaaaatgtaaacgatcacttcatggccttcaatactatttgtgatgccactcaggaaagacaagatgctatgtatcagctggtgaaagagaaagttgatcttattcttgttattggaggatggaattcaagtaacacctctcatctgcaagaaattggagaactcagtggaatcccatcctactggattgacagtgaacaaaggattggaccaggaaacatgattagctacaagttaaatcatggtgaacttgttgagaaagagaactggttacccgaggggcctattaccattggtgttacttcaggtgcctcaactccggacaaggttgttgaggatgcccttcagaaggtatttgagatcaagcgtcaggaaattttgcaggttgcataaattttaagcagagatttgtgtaagagcggaatagctttggcttggcaaaggttactagaaccgttgcacaggcaatgtttgtacagtagcaaaggatgtaacggtttaggcacgaatactaccacgaggcactatccttgtgctggaatttacagtctggtggaaacgaaaatgttgttatcattggtctgaataaaagttgcagcagctttct

SEQ ID NO: 8052 - DNA, 901 bp, Sorghum bicolor
  unsure (1)..(901): unsure at all n locations
  Clone ID: SORBI-28MAY03-CLUS2992_1
gtgcgaagctgaaaaatctgcanaacaggctcgagcaggtgtcaaaagatgataaggctgcaaagttggaggctatgaaccggaagaaccgtgctgataacttcaagaatgcttcagaaatgaaacctgtaaatacatctttgaaggcaggagaggctggttatgaccctttctcaaggaggtggacaagatcaagaaactattatgcatcaaagccaggaggagataatgctgaagaaactgccaacgggtccagtagtgatgtagtgcctatcaatgaagatataaagagcaaggctcaaactggtacagcagccacaacagcagctcaagtggcagcagctgacgccgggaagctcactgataccaatgcaccagtggatctgggaacagaatcaaatgtactgcatacatttgagcttcctatatcattgtctgctctgcaagagtttggtggagccaagggcctgtttgatggttacatggcaaggaggcagaagatagaagctacaatggggtacaaagtgcctgacaacgatggaaggagacatgctttaaccctgagtgtgagtgattacaaaaggcgacggggtcttctctgaagggtatctgtgattgtgctgggtgctcaacggattcaactatccgcctggtttcagcacctctatattgctgtgacaattgtccagatcatctgcattttgccttatcttcctagaagtaacacataaaacatgcagtgtatacaatttcttttcataaatattacctgatgtatgactgattatgttgctgacatcatgtttatatctgtggattgtgttatcatcgtatccttgttagctgcaaaaaatggattccataatttgttgaattaaatccaatgcagctttcttttttc

SEQ ID NO: 8053 - DNA, 951 bp, Sorghum bicolor
  Clone ID: SORBI-28MAY03-CLUS2993_1
acgcgtccgcggacgcgtcaaccaacgcgtgacctgagcaagcgcaagcgaccaacgcacgcatcgattgagcaaacttgggacgacagcaatctcccttcagttccgttccgttccgttccatggacaaggtgctggcgttctcgatcctgagcgcgtcgccggccgacatctccgcgggcgccggctccggcgggagctgggcgcggctgtcgtggcggaggtgcgccgacgaccagcaggccgccgccgccgccgtggcgggacgacaacgggaggagcaggaggaagacaaggacaagcgaggctcgtgctcccgctcccggggaggaggaagagcggctcctgcggcggcgccgcggttcgcgccggagttcgacggcatcgactgcttcgagaccatcgtgtcgcactgatttcaaccaatcatcactacggctcgggagacgcacgcacacgcccttgatgagttgacctcgtcgtcaccattgattattttttcttcaacatatttttatagactctgatctgacatctgaggatgcagaattgctgatcgatcgatccatcgatggagcgatcagcgtgtgtgtgtgtgtgtgttcattgtctcaacaatagcgtaattgagaccgtgtgttgtgtaggctagtactcacttatcaagaggaacattgttattctcctctgcattcttatgtaaccactaatcaattttgtgtgcacagttcatcgatccctctcgcaaccgcacaagctttgcctccagttccaggcaccgacaactcaggatactttgcctttgcgatcgctgataatatgataatgtaattccgaattctttcaggtggggctctcaccctccggtgacgtcttcaaaaaaaaaatacctgaaaatttgacaataccatttgtgtttatctagaaaagatgtagtttcatatgtcaaaa

SEQ ID NO: 8054 - DNA, 534 bp, Sorghum bicolor
  Clone ID: SORBI-28MAY03-CLUS29956_1
tccaagcgcgcggcaagcccgtccctctcctccccgtgacccgtcgctcgcctccggcctccccaaccccaaagttcagttccctgccgcagatcaaaaccctagcaaacccctcctcccacgcggctcggtcggccatggcttcccccgcgctcggatctcaggtggccgccgctgcctcggtgcccgtcggttcggattgttgcttcaagggcaccgcgctcaagggtaacagtaatctaaacttccggaacaagccatgcattgggatggcactagcatggaaaaacaagacccaacaatcgcgacatctgaacaaggtcttctgcatgtctgttcaacaagcaagcagaagcaaagttgctgttaaacccattgagctggagaatgcaaaggagccaccacttaacttatacaaaccaaaggaaccttacacggccacaattgtctctgttgagaggattgtaggacccaaagctcctggtgagacatgccacattgtcattgatcatggtggcaatgttccgtactggg

SEQ ID NO: 8055 - DNA, 1094 bp, Sorghum bicolor
  unsure (1)..(1094): unsure at all n locations
  Clone ID: SORBI-28MAY03-CLUS29991_1
gcacgaggaccgtgtgggccacgcgataaatacctcaagaaggaagcgctgtggccttacctccaagaatttgtcgatggagctcttgcgcatatcctgaacatgtccaaggctctgggagagcaggttggaaatgggaagccagtactgccttacgtgatacatggacactatgccgatgctggagatgttgctgctctcctctccggtgcgctgaatgtgcccatggtgctcactggtcactcacttgggaggaacaagctggagcaactgctgaagcaagggcgcatgtctaaagcggagatagattcaacctacaagatcatgaggcgtatcgagggtgaggagctgtccctggatgcgtcagagcnttgtcatcacgagcacaaggcaggagattgatgaacagtggggattatacgatggatttgacgtcaagcttgagaaagtgttgagagcccgggcgaggcgtggggttagctgccatggtcgtttcatgcctaggatggtggtgattcctccaggaatggacttcagcaatgttattcctgaagacattgatggggatggtgacagcaaagatgatatcgttggtttggaggttgcctcacccaagtcaatgcctccaatttgggctgaggtgatgcggttcctaaccaaccctcacaagccgatgatcctcgctttgtcaaggccagacccgaagaagaacatcactaccctcgtcaaagcgtttggagagtgccgcccactcagggaacttgcaaaccttactctgatcatggggaacagagatgacatcgacgaaatgtctgctgggaatgccagtgtcctcaccacagttctgaagctgattgacaagtatgatctgtatggaagtgtggccttccctaagcatcacaatcaggctgatgtcccagagatctaccgcctcgcggccaaaatgaagggcgtcttcatcaaccctgctctcgttgagccgttcggtctcaccctgatcgaggctgcggcacacggacttccaatagtcgctaccaagaatggtggtccagtcgacattacaactgcactgaacaatggactgctcgttgacc

SEQ ID NO: 8056 - DNA, 879 bp, Sorghum bicolor
  Clone ID: SORBI-28MAY03-CLUS25243_1
ggatttgcttgtagagaatgtcccacgcatgttaatagttaggggatatacaagagatgttgtcacatttttcacatgattatacatataaacttcccacctggagactctagtgccgtctggctgttgtactatcttagcagagactggatacaacaagattcaagcgtggattctaccactgaaatgacaagccctcaccttgaaggcaacccgatgagatgtcagatgtgcagagctgttgttcgcttattgggttcgtgaactattgaactgcagtgtcttcattcttttctggatttaaaagatccacatagcgagctttgcttcttacagattttgtagttatcatatataaacacttaccatctagtacgcatacttacatgctggcccaatgacagaaatgcaatccttgtatgggtgtaaaaactgacggaccttttgagatgagcggagctgcaaattttgaatggctaccacaaatgaattttggctgtgctttgtcgcaaattcttgaatggtacaagatttggagatacattgctcaatgaggggtgctactttacccggttactttctggatataatgaatcatatttctctctactaagttttgttgaatgctgatgtacacgtcatcttcagctaatacaatacatgtatcgagtgctgtttgtgctaggtctatttagatcagctaggagtaattactagttgaagttaggttaaaaaatagttcaaatcagctaagattagctagtttttttttgtaggtaagattggctacctagttggctaacaactgattggaggcttggtcaaaaaattagcttgcctacaaacgtgttgtttggatgaaatatggttaatttagct

SEQ ID NO: 8057 - DNA, 974 bp, Sorghum bicolor
  Clone ID: SORBI-28MAY03-CLUS25259_1
gcacgaggcaaccctgttgccatacagacgatcaagggataccttttggttgctagccatgataaaatccttgtcttcaacacctcgtctcagtattatggtagagttggtgcgcctcggccgctgtttgctacatccatcaaggacatcaaatctgtgtttgcgggttctggtggtgtactgcccactgaatcagctgggaagcctgttattgcggcagaccgggagaagctggtgatcttgggtcttggggatggccatattgccatctataggtccaacttcccggtgtacaagccagagagcaatgctgtggtatggagtggaccggcgctgcttttcctcctattcttgattggcatttggcaagtatatgtgaaaaagaaggattctttgggatggacaccagaggagacattcaacacctctgtaacagcaccaacagggagccttctgaatcatccaactagtgacagagcctttgcagacagcgcggcaagaagtagtgatcggggctatgtagatggaacatcaagagccagtgatagaagctatgtggatgccactacaagaactaccgaccgaggctattctgatactactagggctgtggatctgcggggtggagcgttgaggagtgctccaagaaggtatgtgtcccctactagatatgcagggacatctggaatccaataccgaccagcttcggctgagcctggtcttaggggtactcctgagatcaagtaccgggggccaggtatggagccccctggtttccccaagaaaagggaaccgttgttctcgaacaatcaggctggagtagatgatcatgttgattgaggctttggctaggtcagtgttggcagtcccttaaattttgatctcattttgaaggtccttcgcggtgccagtgatcaacatgtgctgttgtatgttgtaactcaaaagaatgttgtattgtacaagcacattac

SEQ ID NO: 8058 - DNA, 589 bp, Sorghum bicolor
  Clone ID: SORBI-28MAY03-CLUS25318_1
gacaaagaggtcaccttggggttctcgtagaattgtacgcactggagatttgccagttgctggtgttctcccatgctcccatgtctaccatgctgagtgtttagagcggaccactcccaaggggcagaagcatgaccctccttgccctgtgtgtgacaagctggctggtaaagataccgagcagtggtcgatttgcaggttaaaaaatggattcccaagattacgttcactaggggaagggccttctcgagtttggagctgtgctcatgctggagattgtgttgctggggctgtacagataccaagatcaaatagcatcaagctcttgagtcggagtggtcacaagaggcatgcatcttcgaagggagagcccagcaaagactgggctgaaacatcaaaaaatgattacatgtaacttcctaatgcactcagtaggttatattcatgacctcgcattgttatggttgcaaggttatgtatacttacggatgttttcatggcgtaatggtccagctaggaaatgacatagatatgcctgtgtagctgactaaatttatctatcatcagttatcagggttgctatctgtgc

SEQ ID NO: 8059 - DNA, 634 bp, Sorghum bicolor
  Clone ID: SORBI-28MAY03-CLUS25280_1
gggctacgggaggggtgagttcagttacaggtcggattatggtggcagaagtggtggcagaggtggcccagcacgtggagctgatgtcggctaccagagggttgaccatgctggatatgctggtggtcgtggtggccgcacagcagctgctggtgcccctgcaaaatgagggacaacatagttgttgcacgtctcttgagagtgtttggtggccctcagattattttgaagttggcatagagcttcatcaattggttgagtgcgggattaccagaaaagcctggatacagattataagggttcctgttctcgatcactatttttgcaggcaacaaaagcgaaaaaagtgattactaattgagtaattgtagattagccacctattcagatgtagttctagttttggtcgtcggctgatgtgccttcttgtcatttttgcaacgcatcatctaggtttttgtttctgctattattcatttattgtgtcgatttgagttgatagtttttttgtttggactgttggaataagtgacaatttagagtagttaaatagtagctaggttggggatttacatgtttatttgcaatatgtcgacgctgttcaccaattcgctgttcactgcttttcctttgt

SEQ ID NO: 8060 - DNA, 687 bp, Sorghum bicolor
  unsure (1)..(687): unsure at all n locations
  Clone ID: SORBI-28MAY03-CLUS25835_1
gcgcgagcggcaccaggagcaggcacgagcagccttaatctgccacctcctccagacccggcgagcaccaccaccagtctgtgcgtcaccagaataatggcgtcgtcgctcaagttcacggtgcggaggcgtccggcggtgctggtggcgccggcgtccccgacgccgcgggagctgaagcggctctcggacatcgacgaccaggacggcctccggttccacatccccgtcatccagttctaccgccggagcgcgctcatgggcgggcgggaccccgcgccggtcatccgggacgccgtggccagggcgctcgtgcactactacccgttcgccgggcggctcagggagctgcaagcgcgcaagctcgccgtggagtgcaccggcgagggcgtgctgttcatcgaggccgacgccgacgtccgcctcgaccacttcggcgacgcgctgcagccgccgttcccgtgcctcgacgagctcatcttcgacgtccccggctcgtcccaggtcctcggctcgccgctcctcctcttccaggtgacgcggctggcgtgtgggggcttcatcttgggtgtgcggctgcaccacacgatggcggacgcgcaggggctggtgcagttcctgggcgccgtggcggagctggcgcgtggcgcggcggcgccnacggtccggccggtctggtgccgagag

SEQ ID NO: 8061 - DNA, 745 bp, Sorghum bicolor
  Clone ID: SORBI-28MAY03-CLUS24123_1
gtttcccaagggattagtggatccttggtcgacgtcgccggcgggctcggcggcgctacccaggccatcgcaaaggcgttcccgcacatcgaatgtagtgtgctcgatctcccaaacgctgtcgccgttgctccgactgacaccgacgtgaagtacatcgccggcgacatgtttgagagcgttccatcggcaaatgttgtcttcctcaagtgggttctgcatgattggggtgacgctgaatgtgtcaagatattgaagaactgcaagaaggctataccatctgaaggagggaaggtgataataatggatatcgtggttggagcagggtcatccgaccagaagaatgtagagacgcaagtcttgtttgatctctttatcatgactatcaatggagccgaacgagatgagaaagagtggaagaagatcatttttgaagccggatttaggtcttacaagataatgcctgttctgggtgtccgatcgatcatcgaggtctacccatagaattgaagtttaagcataggacaatggacaagtgctgttgtgggcggccgtgttgcaggttgcagcgcacaggttgacagcaaagaaaggttgttcaaacttgaaagcgtccagccacacagttatttgcatcacgtgctgatgcattatagtcgttgatgttaaaccatgtgagtgctagtggtactactttgtgtttgcatgtaataattttgccaacatactgatgtctattttactg

SEQ ID NO: 8062 - DNA, 1154 bp, Sorghum bicolor
  Clone ID: SORBI-28MAY03-CLUS24372_1
cacttgcattgtcagagtcagaagctaaagttagtcttcaatctgacattgatcgctttataaatgagaagataatagttgcagataaggtcattgttagtcatgctgtcacgaaaatcagagatgacgatgtcctattgacatttgggtcagcctctgttgttgaaatgatttttgaccatgctcatgaacttggaaagaaattccgtgttgtggtggtagattctcgtccaaaccatgagggacaaatattgttgcgccaattagttgcaaagggtatcagttgcacatacacacacataaatgctgtatcatacatcatgcatgaggttacaagagtgtttttgggtgcctcttcagtactatcaaatggtactgtctactccagagttgggacagctttggttgctatggttgcacatgcttttggagttcctgttctagtgtgctgtgaggcatacaagtttcatgagagggttcaacttgattctatatgctttaatgaacttggtgacccagatgctatttcaagagttcctagggatgcaagtttgagccatctcaaaaactgggctgagaacgaaaatcttcatcttctgaatcttaagtatgatatcaccccttctgattatgtttcaatgctcataacagattatggaatgctcccacctactagtgtaccagtcattgtaagagagtaccgcagggagcacgtttggatatagaagccactgttttccttgtttagtttgaggtatgatagtctgaacagcttttgctgccttagtggaatggtgtgagcatatcaacacatgtttatatctcagttttgcaaccgccgaattggttgttttctcctgtattttctctctgctaatgagtcgaagcaatcaacataaaattttgcatttacttataccattgctaatgggagtataacctatgaatctccccgtcataattgtcttctgatagcactcttttgtgttagtgatgttcctgtttgccatgagaatatttgactattttctctatcatttgtccaaaatttctcactgtcacacaaattatactcattacacatcataaacatcaacacgtttttatttgtatttagttaaagttagatttaaatatttttttggacggatgga

SEQ ID NO: 8063 - DNA, 770 bp, Sorghum bicolor
  Clone ID: SORBI-28MAY03-CLUS24254_1
ctgagaagtgtattggtgatgccccggtagaaagtgagaaacatggtgatagtgaatcattgagcagggatggcaaaagcatttctggcaatgtgaatgcgaagaaccaaatatcaagggaggatctaaaagaagcattcaaaaaatttggaactgttcggtatgtggacttcagcatcggggatgattcaggataccttcgctttgaagattctaaggcagctgaaaaggcccgcatgtctgctgtacttgctgatgaaggtggcttcataattaaagaccacattgttactttggagcccgtgactggtgaagctgagaaggattattggaacagaattcgcggtattcaaggaaagtacaaggatagtagaagctacaagggaagggctttaaagaaccagagaggaggaaagcatttcaatgggaagcgagatagaaaccccgattcggagaagaattctaacaaggcccagaaggttgaagctgctgcgtgaagttaacttaggtaccttagctcgacttgagaagtaacatgttatgccagcatgatcgacttcactagtctctaagtttggctatcatttttattttggtcgttttgccaccttactcgatgtttatctctatgctataatccttttgtaatggctttactgtgttatggggtcacccaatggcgtgtaaattgaacgcaccaagttaggcttcccttacgaaactgtatagcctttctattcttccactagcaaatttgcccacttgtctcg

SEQ ID NO: 8064 - DNA, 915 bp, Sorghum bicolor
  Clone ID: SORBI-28MAY03-CLUS2424_1
gcgaaaagtgaagtccatgtgtttattcggcagaagaaagttttaagaggatttgatgaagaggttagagatttcgtcgctgaacagatgtctttaaggggcatcacatttcatacagaagagagccctcaagctataactaaatcaaatgatggtctgttatctctgaaaactgtctttggcaatgaacctaccaaaccagattacagaactataccttctgctgtgttctcccaaccaccaattggacaagttggttttactgaggagcaggcaatcgaagagtatggagatgttgatgtctttgttgccaacttcaggcctctcaaggccactctgtctggactacctgatcgtgtactaatgaagattcttgtgtgcgctacatcaaacaaagttgtaggagtgcacatgtgtggtgatgatgcacctgagataattcagggaattgcgattgctgttaaagctgggtgacaaaacaagattttgatgccaccattggcattcacccaacatctgctgaggaattcgtcacaatgaggagtgcaactagaaaaattcggaaaaaatctgcagatcaggtagaatctaaagatgaggttgtaagtaagcagtagataccaatttttcctaggaggtgttctcgggggaactattcctgttgcaggacaacagctggacggaattttggaattacacgtgcagagtagcagaaataactgctaggaatttctggaaattcatgttagggaaccagcgattctgtatcgtagtatggctgtacatacctgtccgctgagctattatcctattcctttgtcttgtacgttggaataaaatgcagcaaatgcttgccttacggtcaggaaatttgtaataagtacaaggaaatgcgccttcctaagcatttgctat

SEQ ID NO: 8065 - DNA, 458 bp, Sorghum bicolor
  Clone ID: LIB3481-009-Q6-K1-A1
cgcgtccgatttcatacagaagagagccctcaagctataacctaaatcaaatgatggtctgttatctctgaagacaaataaagaaacttttggtgggttctcacatgtaatggtcgcaaccaggtcgcagaccaaatacaaagttgcaatccttgtagaaccttggactggaagaggtgggggtcgaaatggataagaatggtgcgatagtggttgatgagtattctcgtacctcagttgattccatttgggctgtgggagatgttaccaatagggtcaacctgacaccagttgcactgatggagggtggggcatttgcgaaaactgtctttggcaatgaacctaccaaaccagattacagaactataccttctgctgtgttctcccaaccaccaattggacaagttggtcttactgaggagcaggcaatcgaagagtatggagatgttgatgtcttt

SEQ ID NO: 8066 - DNA, 1258 bp, Sorghum bicolor
  unsure (1)..(1258): unsure at all n locations
  Clone ID: SORBI-28MAY03-CLUS24377_1
cggccggcgtccctgcgggagggaggtgcaangccgaaccagcccgccaatggcagctgcgcggcggccgggggcgacgaagcccaagggcggcggcggcgggggcgcggggaggccttcttcctgctctacacgcctttctggctcactctctgcctcggtgtcgtcgtccccttcaagctctacgagaggttcacggagctggagtacctgatccttggcttggtgtccaccgtgccggcgttcctcatccccctattcctcgtagggaaggcagatagtgttagaaatttcaaagatcgatactgggtcaaggctaatatttggattataatttttagctatgttggtaactacttctggacacattatttcttcacagttcttggcgcgtcatatacttttccatcatggaggatgaataatgtaccccatacgacgtttctcctgacccatgcttgtttcctgttctatcatatggcatcaaatatgacactccgtagattacgtcactctgcagctcacttaccacagtctattcgctggttatttgaagctgcatggattttagcactgtcatacttcatagcgtacttggagaccctagccattgcaaatttcccatactatgaatttgttgaccgggatataatgtacaaagtaggttccttgttctacgcaatatacttcatcgtcagcttcccaatgttttcaaggattgatgaaaaagatgagaagtggaacctatccagggtagctgttgactctctgggcgcagcgatgctcgtcacgataatactcgacctatggcgcatatttttggggccaatagttcctatcccagagtcgaggcagtgtggtcaaccggggctcgcatggttccaagtgcagaacgaaagcacctgattcagcgaagctgcaagttctgcgtttccacatcatcatctagcattcatcatgactgataaaaatctgcctcggctgcaccaaacagatgatggcattgacatgatgttctctcacaaaaatgatgacatgaggtgtaactatagagcgtgaatatgcttgttgtcttgtatgttttgtatcatgttcatggcatgcccgtagtactgaggctgattttcttttaaggctgcatagcaacagttaaagtttttaatagagttttctgcagagtaatcatgtacgagctagccttgcatcaccgagcactgtgttccttaacaatgttgaagaaaggtgactgattgagtgg

SEQ ID NO: 8067 - DNA, 849 bp, Sorghum bicolor
  Clone ID: SORBI-28MAY03-CLUS24395_1
gcacgagggaaagaacacaacaattagctagcagatcaaacaactagcgacaaagatttgttagtgatccgtgctgatcagatggctaagatcgctgccgtcgccgccacggcggcgctgtgcctcgcggccctggtggccgtggccgtcggccaaggcgtggtcgagcggcagaggctcaaggacctgcagtgctggcaagaggtccaggagaacccgctcggcgcgtgccggcaggtgctcgaccggcagctcaccggcggcatgcgctacggcatcggcccgttccggtggggcaccgggctccggatgcggtgctgccagcagctccaggacgtgagccgcgagtgccgctgcgccgccatccggagcatggtcaggggctacgaggagaccatgccgccgctggagaaaggctggtgggggcagcagccgcagccgggctacgactacccctgcagccaggcaggagagggatacggctacggtgagagtggccagcagcagatgtacccaccgtgtcgtcccggcaccgggcaaaaaatcgcccgcgtgaagcttacaaaggccaggcagtacgccgcagggatgccgatgatgtgccggctgtcggagccccaggagtgcagcgtcttctccggcggcgaccagtactactagggtaagagtgagtcggcgcgccgtgcaagacgcatgtgcgcgtccaaatcctgaacctgaataatgtactaactctgaggaataaataaggggatgttttttttatgaaacataaataaggggatgttgccagatagcactggcacggttcgtgtaataaaaagggttcagaaatagttcaaagtagtc

SEQ ID NO: 8068 - DNA, 460 bp, Sorghum bicolor
  unsure (1)..(460): unsure at all n locations
  Clone ID: SORBI-28MAY03-CLUS25476_1
gcacgagggagacggcgaagtcgttccccaatccatcgaaaccctagcgcgcaatccccggcttcccacgccgtatcgccgtcgccatgggcaagaagcgaaagctcgagcccaaatcggcggcagccgtcaagccggttaaggcctcccagaccaccaccaaggcctcctcggccgccgccaccgctaaggccgccggtctatccgcggttctcgcccctgctgaggtggccatggagaagctgccccagggggcaggcggcgagggggaggaggtagaggaggaaatcgaggaggaggtggaggttgaggaggaggtggaagtggaagaggaagatggngagggcgacccggnctcgatccaggcgctcctggattcgttccccaaggaccagctcgtcgagctgctacgcgacgctgccgtcgctcacggcgacgtgctatctgccatccggcacgt

SEQ ID NO: 8069 - DNA, 663 bp, Sorghum bicolor
  Clone ID: SORBI-28MAY03-CLUS25489_1
gcacgagggcgcccggcgcggatggcggaggatgggaggatgccggagggggagaagaagcaggcggcgatggacgggcggaaggacggggtggcgcgggaggtcatccggatggagcgggaggccgtcatccccatcctcaagcccaagctcatcatgcgcctcgcatacctcatagagcatgaggctgatcgaaacgagttcctgaagctgtgcaagaaggtggagtacaccatcagggcctggtacctcctccagttcgaagacctcatgcaactgtactcactgtttgatcctgtttctggtgagaagaggttagagcaacagaacctgacatcagaggaaatcgagaccctcgaattcaatttcatgacatatctttttcaggtgatggaaaagagcaacttcaagttgttatcagatgaagagtacgatattgcacaatctggaaaatatttgttgaatcttccgatcaaagttgatgaatctaagctagacaagaagttgttgacgagatattttaaagaacacccacatgacaatctaccagaatttgcagacaagtatatcatctttcgtcggggcattggaattgatcgaacaaccgactactttttcattgagaaagtagatgtaatgatatcccgagcttggagctcattg

SEQ ID NO: 8070 - DNA, 730 bp, Sorghum bicolor
  unsure (1)..(730): unsure at all n locations
  Clone ID: SORBI-28MAY03-CLUS25494_1
gcacgaggttggagagtactatagcagagttgtggtagccctttctttgggtgttgcacttttgggaccattactttttaagtggcctttttttggtaactcaggtaatcctctaatgtctcactgctgtgttggtcctgtcatatacttatataaaacatattaggttcttctgatagttctacaaccaatatgctttgccgctttggtacatttcatactgatgattttgatttgcggctcgtggcgttctgtggctcttgcgccctggcgtccactgcctctgttctggccttttcttgggtccgcaggggttcaatttaccgtggattaggacttatggtggctgcatctccctgtgcattggctgtagctccactggcatatgcaactgcaatcagttctcttgctagtaagggaattttgttgaaaggtggtcatgtcttggatgctctttcgtcttgtcagtctattgcctttgataagacaggcacattaacaactgggaagcttatgtgcaaggcaattgagcctatccatggacatttgggtgtgaaaaatggtcacagtaatccttcttgctgcactccaaactgtgaaagtgaggcactagctgttgctgcagccatggagaaaggaacaacgcatcctatcggaagggctgttgtagaccactctgttggaaaggaccttccagtggtagctgtagaaagttntgaatgcctacctg

SEQ ID NO: 8071 - DNA, 1164 bp, Sorghum bicolor
  Clone ID: SORBI-28MAY03-CLUS25499_1
gcacgaggcgccgtggatggggtccagtcgcctggccgtgtgtcacccgccaacatggaggatgccggcggcgcggccgctgggcacgccgcgcgaccgccgctcgccggctcccgcagcggtttccgccgcctcggcctccgtggcatgaagcagcgcctcctcgtcgtggccaaccgcctccctgtttccgccaaccgccgcggcgaggaccactggtcgcttgagatcagcgccggcggcctcgtgagcgccctgcttggggtgaaggacgtcgacgcgaaatggattggctgggcgggcgtcaacgttccagacgaggttggccagcgagccctcaccaaagctcttgccgagaagagatgcataccagtgttcctggatgaggagattgtgcaccagtactacaatgggtattgcaacaacatcctgtggccgctgttccactacctaggactaccacaggaggacaggctggcaacaacgaggaactttgagtcacagttcgacgcgtacaagcgtgctaaccagatgtttgctgatgtcgtgtaccagcactaccaggagggggatgtaatctggtgccatgactaccacctcatgttcctgcccaagtgcctcaaggaccatgacatcaatatgaaagtcggttggttcctgcacacgccattcccatcatcagagatttaccgaacacgctcgtcccgcggcgggccgcttcgctcggtgcggcgtgctggtttagccggatttcatacttacgactatgcgaggcattttgtgagtgcttgcactagaatacttggacttgagggtacccctgagggtgtggaagatcaaggaagactaaccagggttgcagcggttcctatcgggactgacgctgttcggtgccagcgggcttcgcggcctccagctgtattgtggcccttctgccattccccacaacgttttgctggtcgaaaggtaatgcttggtgttgatcgacttgacatgattaagggaattccacaaaagattttggcctttgaaaagtttcttgaggaaaacccagactggaacgacaaagttgttctactgcagattgctgtgccaacaagaactgacgtccctgagtatcaaaagctaacaagccaagtgcatgaaattgttgggcgcataaac

SEQ ID NO: 8072 - DNA, 676 bp, Sorghum bicolor
  Clone ID: SORBI-28MAY03-CLUS24632_1
gcacgagggttttttcaaacgcgaagaaaagctcgagaagcggagcaggaggggggaaaagatgaacaggagagggcctcgtcgctaaaaccctagcgcagcggcgcgggcgcggatgcacctcgctctcctcctcccccgcattcgcctctcgccggccgccatgtccagcacccgctccgcctccgcctccaggctgctggtccgcgccgacctcaacccagttgtacgagaagtcaaacgcgaatccagtgtttcttttgacatttcaaagcccgaagcaactgcttctgttaagaggaaaagggtgaaacgagaacttgaattaaatggggagcatcataagaagcagtttggtgttgtccctgacatcgaggattttcgatatgaaaaggccaaaacattgacagcgtcaagtaaggcaacagcatcttcggtcaaggtggagaaaaaggtcagagtttcttcagtaataaaagttggagctccagataactgggaggcagttcttggaggcattaaaagcatgaggttatctggtgaagcccccgtagatacgaagggctgtgaaaaggctggttctctccttccacccaaggtctgtagatttgcagttctgatatcaactatgatgtcaagccagacaaaagatgaagttacgcatgctgctgtggaa

SEQ ID NO: 8073 - DNA, 1100 bp, Sorghum bicolor
  Clone ID: SORBI-28MAY03-CLUS24646_1
gcacgaggcgcagttcctactaccaattgtgttttagtacactcaaccctcaaaccccatggatcccaagttcaatggcgactggagtgccaatgagatcgagatggtgagatcaatcatagctagtcacgacgccaacagcagttgcaccaacaacaggaatgctaagcactatggcattgtagatgagctccatgctagattcccaaggaagaataagcgtcaggtaattgacttgtatgttgatcttgtggttgagatgctaaatgcaatggagatgagcagcaaccaactgcctatgatgagcaacgaccttgtggtcgacaattttggagtgatggtggagaacccaggcatgcacagcatggatctgtttcctagttacttaatagatgagatgaaggcaaagaggacggtggaggaacaacaccataggcaagttgttgttcctcaagaggacaagcaacgcgcaaggaggttttggactctggctgagcacaggaatttcctgcttggcttgcgagcgtatggacgtggtaattggaaaaacatctccaaggacttcgtcaccactaaaacgccagtgcaagtctccagccatgcacagaagttctttcgtaggcaggagagcaccacaaagaagcagcgctacagcatcaatgacgtcagcctctatgacgctaagctatgggtgcaggacaactcctctagctgggaggctttcactagcaatgcttacaacccatactcttatggctttggtggccagctcaccatggacaacctcacacaggtttattcagccagtcaggcgagcaacaaccagacactcacctggactggagatcagcagacatcgagtccttctgcagctcctacgacggaggaggatgggacccaaatggaatggaccaattattattagcttggagactgtgtccctaagtggtgaatagacatgagcaacataatgtagtagttgctacatatggtttagtatatcctatgatgcatggacacctatctcgttgaagacaatatgtatggtagttttaagtgtttgtacctcaaatagttcccattgtacatgcactttgcaa

SEQ ID NO: 8074 - DNA, 1034 bp, Sorghum bicolor
  Clone ID: SORBI-28MAY03-CLUS24652_1
ggaatatctgcgcgtcgccgcgaacgaacgcacacgagggagacgagcgcacgcacacagccatcaccggctttgggagccgcagagagaggaatcgcacgggacgcgcggtcggtgcgtggtttggtttcgccggaagcgccgttggatcaggaaggatagagggaggagggcagatggcgggggatcggctgagctgggcggggctgctgaaatggagcctctcctacgtcgacggggcggggccgtcccgcgccgtcagcgaggaggagcggcggtggctggcggaggcggtggagcggcacatgatgatggacgtggtgagccggatgagggagattgcgctgctcatgagcaccccgcccgccgtcctggaggcgcagggcatcacccacgacgacatcgaagatttgctgagtgagctgcaggtgcatgtggagtctatcgacatggcaaatgatttgcattctgttggtgggttggttccagttatcaagtacctcagaaattctaatgcccgtatccgagcgaaagcagctgatgtggtaacaacagtggttcagaacaatccgaccagccagcagttggtcatggaagctagtggttttgaacctctcttatccaatttcagatcagatcctgaccttactgctcggataaaagctcttggtgcactatcttctctgatacggaacaacaaaccaggagtttctgcatttcgtttagccaacggatatacaggactaagagatgcattgaattcagaaagtgcaaggtttcagaggaaagcgttgagtctgactcactatctgctcagcgaaagccattcagattgttcagtatttgcacagttaggtttcccccaccttatgatgcgtttggcatccagcgatgactctggtgttcgagaggcagcattagggggcttgcttgagctagcaagggacacaacacttggaaataggagtctactagcagaacatgacaggttacggcggcttctctgtggacgtatggaaagcataaggacgatg

SEQ ID NO: 8075 - DNA, 645 bp, Sorghum bicolor
  Clone ID: SORBI-28MAY03-CLUS2475_1
aagcaaaaggtgataaactgacgggatcatctggcttcaataatgtaaccggatatatatttggcaataatgcttcgtctgaaaagattccgatgactacacctgtcttcactcaagcttctgacgacacactttcagatgtatccatccagatagttctgccaatgaacaaagacttggacagtttaccagctccaaatacagcagttactttgcggaaggtagaaggaggcattgctgcagtgaaaaaattcagtggacgaccaaaagaagaaattgtactgcagaaggagaaggatctacggtcccagttacttaatgatggattgaagcctcatccaggctgtttgcttgcacgctacaatgatcccaggacaaagagcttcttaatgaggaacgaggtgctcatacggctaattgacttcacactggagttgtaaacgacaatactggcaacagattgatgtaatacgctgggtttggagcttccagtgcgtcattagaaaggacaaatgatgtagatggcagatgaggtttatgtaaatgtaaattttgaaaggtaataaactacatgctaaaacgataggccatttagatttgtttatagaccaaaatattgaattgacaaaagaaggaaaaccttag

SEQ ID NO: 8076 - DNA, 805 bp, Sorghum bicolor
  Clone ID: SORBI-28MAY03-CLUS24843_1
gatgctatagtgaggactgatgagaccacgcttgcgaatcttatcaaacctgttggattctatcagagaaaggcacagttcataaaagaagcttctaaaatttgtcttgatcgttttggaggggatatcccagattctctgaatgagctgcttgctctgcgtcgtgggggcccttctttggctcatttggtgatgagcattgcttggaagaatactcaaggaatctgcgttgacactcatgtgcatcgcatttctaatcgacttgggtgggtttttcgggaaggaacaaaacagaaaactacgacaccagaacagacaagaatttctctagagaaatggctacccaaggatgagtgggaacctataaatccattactggttggatttgggcaaactatctgtactccactgaggcccaaatgcgacaactgtggcatcaataacctttgcccttctgctttcaaggaatcatcaagcccaaatccaaagcaaaagaaaacaaggtctccatagaactcttgactatgactggtctgacaccgaagtgagataatattttgggttgtccgtcggtggttaatattatggggttttcttttggtcgatctatgcaccgaagtgagataatatttttggttgtccgtcggtggttaatattatggggttttcatttggtcgatctattgttggatcaccttggtgccataccattggcatttggcaagtcatgtatctttttgtataccagtaaattgttcaagacggtataaagacacgttttgctaccagtcactgtaaaaattac

SEQ ID NO: 8077 - DNA, 673 bp, Sorghum bicolor
  Clone ID: SORBI-28MAY03-CLUS2497_1
gtccgggataccttctttctgtgaaagcatacactgtttttgccactcatatggaacgcttgtcagaacttgcaacaatgtatccaaatgtgaagatcctccattttgaagttgacttaagaaatgaccgcttggatttcaagttccgcctaaaggatggcgtccgacgggtaccgcactatgggcttctgctggccagagtagctggtatccctacttcagtgattgacacctcaacaagtatcacttcacagatcacggagcaggaaatgacaaggatggatgccaactgcgaggagtaccggtcgcttcagatgacgtaccaggttgtgcagcggcttatctgcctgaagtactcaaaccatgacgaagactacatccgtgaagcactgcagaatctcaaggagagctatgctgcaggccggctaacataagatgttctccttggatccatcatccaatgtatatgttcctctgtcaatgcgaaactatcttggggcacatggcacatcagttgttatctcacatgtaatgcagcatcttatcccttttttcatatagatgattacaaagcaagacagagcatgtgaatgtctagagcaaagcgattattatgaattagcctagctcttacaaaaagaattaccggaaaagatgaaacgccaaacaaaga

SEQ ID NO: 8078 - DNA, 643 bp, Sorghum bicolor
  Clone ID: SORBI-28MAY03-CLUS25725_1
gcacgaggacacgcagcggcggcgacatctgcatctgcatctcgcacctcgagtcgtctcccctgccctgccttgccttgatcccgccgccgggagccgggagccatgtctccctccggcgagctgctggcctccatctcctctgccctcgccgtcgccttcgtcctcctcgcctgcgtcgagctcggcgacgccgccgccgccgtcggcgtctaccgcctcatccagtacgacctcgccggcgccccgctcggctcccgcgccgcggtcatcaaccaccacgccgccgcgctcccgctccccgccggcgcggacctctcccgctccgccctcgtcgcgccgctcctcgacctcccgctctccttcctcagagagtacctggtggagaaaaaacatctggggggattgctcattctgctcccgacaaaccgcggcggtgataaggacagtgcagatgacaaggggaaggtcaaaggtgtactgactgagctggagaagttgcttgtgcatgaacaacttccatatccagtgtactttgctttgcacgacgacagttttgataacctgctggcagatatccataaaattgcctcttcaggtcaaccagcctctgcaacaacaggaggttacaaacttgtcgtgt

SEQ ID NO: 8079 - DNA, 679 bp, Sorghum bicolor
  Clone ID: SORBI-28MAY03-CLUS25750_1
gcacgaggcctcaacgccgacctcgtcggcttccatacctttgactacgcgcgccacttcctgtccgcgtgctcgcggctgctcggcctcgactaccaatccaagcgcggttacatcggcatcgagtactacggccgcaccgtgacggtcaagatactccccgtcgggatcgacatgggccagctcagatcggtggtctcggcgccggagacggaggatgtggtgcggcgggtgaccgagacgtacaaggggcggcgcctcatggtcggcgtcgacgacgtcgatctgttcaaggggatcgggctcaagttcctggcgatggagcagctgctcgtagagcaccgggagctccgcggccgcgccgtgctcgtgcagatcgccaaccctgcgcgcagcgaggggcgcgacgtgcagggcgtgcaggacgaagccagggccatcagcgcccgggtcaatgcgcgttttggcacccccggctacacgccgatcgtgctcatcgacggcccggtgacgcctcaggagaaggctgcctactacgcggccgccgagtgctgcgtcgtgagcgccgtgcgcgacgggctcaaccggattccctacatctacacggtgtgccggcaggagagcaccgcgctcggagacgacgcgcccaagcggagcgtcatcgtgctctccgagttcg

SEQ ID NO: 8080 - DNA, 381 bp, Sorghum bicolor
  Clone ID: SORBI-28MAY03-CLUS25773_1
gcacgaggcgccgcttccgcatcacgcagacaagcaagcaaagctagcgaccaacccaccccaccgcccgcgagctcagactcagattcccctcgcgcaccgtcccgttcggccccacagcccagcgagagggcctgccagcagcagcagcaggcagcagccagccatgtgcggcggcgccatcctgtcggacatcatcccgccgccgccgcggcgggtcacggcgggccacctctggccggagagcaagaagccgaggaggggcgccggggccggaaggaggagggccgggccccccgtggaggaggaggaggaggaggaggacttcaaggccgacttcgaggtgttcgaggtggagtccggcgagtcggagctcgagtc

SEQ ID NO: 8081 - DNA, 822 bp, Sorghum bicolor
  unsure (1)..(822): unsure at all n locations
  Clone ID: SORBI-28MAY03-CLUS25803_1
gcacgaggatccctgcccacagataaaccactggtacacgtcacacgtgaccttcgcaaaatcgcaggtcgcaatcaagctgcgtgtgctcccctccgtgtcctcgcccttcggtttgccgcccgccgccgccgaggcctcctcttcgacggctgctccttgacgggttgaccccacggaggcggcgctcggcggtggccctgtcagggggaacacatccccgagcccatggccaaccgcgacgctgcagctggcaagctcaccgtcgcggagaccttctccagcctcagggagcaaggcaagattgcattcatcccattcatcactgcgggtgatcctgacctggcaaccacatcaaaagcattgaagatcctcaattcctgtggttcggatgtgatagaggttggtgtaccatactcggatccactggctgatggaccagttattcaggcttctgcaacacgggcgcttaagaaaggcactacactcgattctgtaatagagatgctgaagggggttacacccgagctttcttgccccattgttcttttcacatactacaatccaattctaaaacgtggtgtgggaaacttcatggctactatcagacaagctggcatacatggacttgtagtgcctgatcttcctttggaggagacagcgttgctgaggagcgaggccattatgcacaacatagagctggtgctgcttacacaccaaccacaccaacagataggatgaaggaaatcgcaaaagcttcagaaggatttctcantcttgtgagtgctgtaggggttactggtgcacgctcaaacggaanac

SEQ ID NO: 8082 - DNA, 600 bp, Sorghum bicolor
  Clone ID: SORBI-28MAY03-CLUS25336_1
accaaaaagtgttgaaaaccagaatactacaaaggacttggagaacataaagaacatgatattggagagcctgtcaaagatagaacatgttcccagcactcaattccatgacaggccgtcagaccctgaagctccagaggagaaagaggaggacatggataagaggccagctcagcgcagcagattatggagcggaggagcttatgactctgatacagaggatcctgacaacctgaaaagtgagagtaaagacgtaactgccaacttgcagatgaaggatgaaccaaaaaatgatctgtagaagttttggaagtgcccgagttaccgaggtttcaatgggatcgtcgacatgcatgctgaagagcggggacgcatctgaacctatgtgcgctgctatcggcccctgtgcaaatgtaacactgaatgtttttcctgcgtgttggtaactagatctggccatctggcgcgtccgaaactattgaggtgaaggagctaactgactattcccgcatgagttactgtagcatgcatgtaatcattagtccattaaattcttaaacttttgttgtctgtgatggtaagctggattgctctttcttt

SEQ ID NO: 8083 - DNA, 646 bp, Sorghum bicolor
  Clone ID: SORBI-28MAY03-CLUS25359_1
gcttctgggacgtaatgtcaaatgaagaggtatgtgaagttgctcggaagcggatacttctgtggcacaaaaagaatggcacaagttcatcatcagccccacgggttggtgattccgcagacccagctgctcaagcggctgctgaatgcttgtcaaagcttgctgttcagaaggggagcaaagacaacatcactgtcgttgtagttgacctgaaagcacaccgcaagttcaagagcaaaacctaaccatgatggcttgatggacaattatagcgacaagttgctaggaacctagatttggagaatccaaatttggtcagtttagcacgctgccttagtacattacttagcccagttctttattttctcagttctttttaagccatttgggctgccaagggctgtattcaccatatatggtacagattgcgaaatccgtgtcagggttttatgtttcctgaccctggtgacggtcctgttttcattcttctttcttcgttgccctgtattctttttgtctaagctgggcgtccatgtatctggcaatgtatatttgagcttgtagggtacaaaagaaacgaagtgttataaagggtctgtatcctgcctgcctgaatttgggaaatctatcaattgcattagctggt

SEQ ID NO: 8084 - DNA, 976 bp, Sorghum bicolor
  Clone ID: SORBI-28MAY03-CLUS25402_1
gcacgaggcaaaggcacgtcagcggtaagcgcaaagggactcagattgtcaatggcggaggctgttgccgcggctgccgggtggccggcagatgaagaggcgcggccgctcaaggtggtcttcggctccccggcgaagtacttcaccgacgcggcgccgatcgggaacggccgcctcggcgccatggtctggggcggcgtcgaatctgagaggctccagcttaaccatgacactctatggacaggtgggcctggtaattatacaaatcccaaagcacctgctgttctttctaaagtaaggagctttgttgataatggaaagtaccctgaagccacagctgctgcatatgatctgtctggtgaccaaacacaggtctttcaacctcttggggatattgatctggtctttgggaagaacatcaagtacacaaattacaaacgagagctagatcttcacactgcaacagtcaccgtcacatatactgttggggagatagtctactcaagggaacatttctccctcaaatccacatcaagtcattgcaactaaaatctctgcaaacaaaccgggaaatgtctctttcacagtgtctttaactactacactaaaccacaagattcgtgtaacacatgcaaatgaaataatcatggagggtagctgtccaggcgaaagacctcaagagggcaacactgctgctgatcctcccattggaattaaattttgtgcaattctttatgtgcagataaatggtgccaatagcacagtggaagtattgaatgataacatgctgaaacttgattgtgccgactctgttgttttacttcttgcagccactacttcatttgaaagtgcattcatcaaaccctcagaatctaaattggatccaacagtgtctgctcttacaacattaagtattgctaggagcacgtcgtattcacagctaacagcctaccacattgatgattaccagactctt

SEQ ID NO: 8085 - DNA, 604 bp, Sorghum bicolor
  Clone ID: SORBI-28MAY03-CLUS25434_1
tgacctactgtctctctcctatcactcccaattctccctctctctcttccccatccgggccagccaaccctagcgcggcggcgatggcgtcggacccggcccctgacgacgcggccgcggcagagaacggccacggcaacgacaacggccacggcaacggcaacggcaacggcaacggcaacggcccgtccccgaagcgggcccggtcggtgatctcggcggacgagatccgcaccgagttcgcgcaccacgacgccgccgtggcgcgcgtcaacaacggcagcttcggctgctgcccggcctcggtcctcgccgcgcaggcccactggcagggcctcttcctcgcgcagcccgacgccttctacttccacggcctccagcagggcctcctccgctcgcgcgccgccgtcgccgaggcggtgggcgccggcgacgtctccgaggtctccctcgtcgacaacgccaccacggctgccgccatcgtcctgcagcacgcggcctggagcttcgccgagggccgcttcgcgagcggggatgccgtgctcatgctccactacgcctacggtgcggtcaagaagtccatccacgcctatgtcgcgcgcgc

SEQ ID NO: 8086 - DNA, 698 bp, Sorghum bicolor
  Clone ID: SORBI-28MAY03-CLUS2538_1
agcagatggtgaggccgcgcgccgtcgccgtcgccaccgctgggtcgcgccacggccacggcggccacgccttctcctgcagcttcctcaaggcctgcttcctctgcaagcgggagctcagccctgacaaggacgtgtatatgtatagaggcgaccaggggttctgcagcgaggagtgccggtggcagcagatcctggtggacgagcgggaggcggcgacggcgacgagcaagcaggagctgcagcggcgagggcaggcggcggggcaggcccgccactacagcccccaccccacgcccatccggggcaggccgccgccgaggaagacacttgccgtagcctagctagaggtccttccagtcgcctaataaaccgatagcgctgagaaggacgaaacaagtctgatggtggatgacaagaacagcactactactgctgctactagcgagtacggtctactactggagtgaagtgtggttaaaaatccactcttctaatcaccgagaggatgagcactactagaggcgtcaccatcaaccaataaccaatgaagctgcaagtgtatatatatatatactgtatcataaatatatagtgatgtgtgatgcatgctgtagttgtggttatatatacttattatatcatatatagtgatgcatgagctgagaggtggggttggaaaataaaaagggacttaa

SEQ ID NO: 8087 - DNA, 475 bp, Sorghum bicolor
  unsure (1)..(475): unsure at all n locations
  Clone ID: LIB3481-011-Q6-K1-B3
tgccgtccgaataaaccgatagcgctgagaaggacgaaacaagtctgatggtggatgacaagaacagcactactactgctgctactagcgagtacggtctactactggagtgaagtgtggttaaaaatccactcttctaatcaccgagaggatgagcactactagaggcgtcaccatcaaccaataaccaattactgtatcataaatatatagtgatgtgtgatgcatgctgtagttgtggttatatatacttattatatcatatatagtgatgcatgagctgagaggtggggttggaaataaaaagggacttagctaccagcagagagagaagttgattgggtgttttttctaaagctttttttgcatgttgcaatcttgaagctaaagctgtactgtagcatgctcttgttacaaaattacatncagttgattntttagtanagcatgggaaagaaaggtgaggcattgcaaa

SEQ ID NO: 8088 - DNA, 815 bp, Sorghum bicolor
  Clone ID: SORBI-28MAY03-CLUS2547_1
cgtccgctcgtccagatgaaccagctctctcttctccaccgcgccctccacctacatcgcctccctcccggacgcggccatggcctcaccgccaccgccgtcgtccgagctcggctctcctcctctgaacccaccccacatcagcacgcaaagcgccacctcgccgtagcacgtcctcacgagagcatcgcggcagctacggatcaggagagccaccaccacccgcgtcaagagctcgcggcgggcggcggcggcggcaggaccaggacgtgcgcgctgccgacgtgggcgctcatcggcggcatcacggcgggcgtggccgtggcgctggcgctgtctgcggggccgggggccggccccgccctggcgctggggccgccggagggccccctggtggaggagttctgggacaacatgcggcggtacgcgctgtacgtggtgacggtgagcaccggggtggcgtacgcggtgctgcagcccatcgtggagctgctcaagaaccccgtcaccgcgctgctcatcgtcgccgtcctcgccggcagcggcttcctcgtctcgcaggtgctcaatgccatggtcggcaactccgacttcatctacaggtacgagtagggtaggcgagtgtgtgtggcgctgaggcctctcctccctgtgcccgagaatggagatagagatgaaacgtgtgacgtgtcagcgaatcattcgacggtgtaataagtgtgtaatctattcggttcttcttcgagttcggcttccttttccagctagaacaggaacgtggttgaaattgaagtgtgttgcatcgttatggaggt

SEQ ID NO: 8089 - DNA, 874 bp, Sorghum bicolor
  Clone ID: SORBI-28MAY03-CLUS26029_1
gcacgaggttttaatgaggaagaatttgagagaagtacagcagcagcagcatctgcagctgctatgaaagaggccatggataaagcagaggcaaagttcaaacatgccaaggaagtacgagaaagagaacgtgatgcgaagcttagaaatagagaacaacaggaacaagatactgtaacaaggtcatatggccaggatcgtgaggaaaaagacagaaaggaaagactagaacaagaaagggagatgaggcagaatgcggatggcggcctggagccctcacggcttggatcactgctgctgctgttaaaaaagtgtacagaaaagcaacattatgtatccatcctgacaaggtgcagcaaaagggtgccaatctccaacagaaatatatcgctgagaaggtttttgatctcctcaaggaggcgtggaacaaattcaactctgaagagctcttctaaacagcctcatgactgaatatagcatcacccctcagggtctgcacagggtactctgagaagaaagtcacaagctggagcaacttgaggttggtccggggggaaaccatgaaccgaccaagcgaaacctgagcaccgttgtttgtttcattcccccaattttcttttccaattgtatgttgattcaatgacaactcacagcgacatgtggcagctgcccaagctggacctcatccagtaggtgtacattagtgccctgttttgtactatttatcctgggctgtatgtaccatcagagcgggtgcttctgaggccagtgttgtgattttggattaggtacagggtttatttacatggagagccggtttacttgataatgatgaatgttgcttgtctgatgccatgggcatctttcggttgtc

SEQ ID NO: 8090 - DNA, 1164 bp, Sorghum bicolor
  Clone ID: SORBI-28MAY03-CLUS26035_1
gatgtttgctcacatcattttgcaactgcaaattcctagtaaccagaccctatgtctagactttaaagcccagtggaacaccacctatcttatgctgctggcagctctggattataagcaggcattcaccatgctggagaaatgtaacgataactacaatcaagcaccttcggcagtggactgggagaaagtcgaggttgcttgcaggtatctgaagctgttgtacgactctgcaaacagcattatggcaacagaagatccaacttcacacatatttttccatgaggcttggacaattcagagagagatttcaaatgccacagatgatcaagattctatttccggtacaatcacaaaaggcatgcatgagatatttgacaagtattggagagattgcaatgttgtgctggccattgctgttgtgatggatccccgtttcaaaatgaagattgttgagttcagttactccaaaatctatggtctgatgaagggctctaagtatgtcaagttggtggatgatgctgtacatgagctctacaaagagtatgttagacagccacttccgtcgacgccagcccatgttgagcaagaggtcactggcgctctgcctgacaataagaacaacattccaacagatcctacttccactggcaatctactgtcaggcttcgacacgtacctttcagaggtagccctgagccagatctcaaagtcagagctagatcagtacttggaagaagccctggtcccacgcatgctggagtttgacattctgatgtggtggaaggttaatgccgtcaggtacccaacactctcgaggatggcccaagatgtccttgcaataccggtgtccaccgttggtcgtggcagctccgtgttcgcagctgggacggaagccaagatgcttgacgactaccagagctcactgcaccctgaaaccttggaggcactgttctgcgcaaaagattggttacagcattcctctcctgctgctccatagacacccagtcttgtgtcggtgaagaagtgaagacgaagagggtttccatgtagttctactgttctagtggtagctgatctttgcatgtcgaagtagcaggcttccatataagatggtcgttaggaaatgttttagcggtgggttaatatcgtggctgaatgcac

SEQ ID NO: 8091 - DNA, 731 bp, Sorghum bicolor
  Clone ID: SORBI-28MAY03-CLUS26064_1
tccagagtacagattccaaccaaaggtgccactttccaggcatgctgtgatggtggggctcttagtcctgtggtattgctcagggtgcagcagatgcatagtttgtacgtataatataagtagcatagctaaatcatgatctatcagaatttaaaactgagttgaagatctggtttaagtattcgttgaaaggtttaacgcatgaaccaaggacgcaatgacaagcttgatagcctgaaagtgaaaagggatggtctttgcaacatgtataattgcaacatgtataatgtccatcccatcttgtttattggccgcagctgctttattcctacctatgctagactgtgaggcacttagaatgctcaggcgtcaccatacagatgggtttctgctttctccattggtacaattgtgagctaatgctttggattaaactaatcacagcggtttgttcgggtatttgtgcgcctggctgtagttaatcatggactaaaagccttcctatgcacttgtgcccgtccccagatcgacactttgggggtatggctacatgtatagtcctaacagattgtcggcatattgtgttctcctttttgctgtatactagtactttgtaacatgcatgcagaggctacttattcagtgccgttcgctaattgtgcctatgaaatgttttgagctgtatatggaatggatggtgataaataaatgagccatatcgaaagatcaaa

SEQ ID NO: 8092 - DNA, 599 bp, Sorghum bicolor
  Clone ID: SORBI-28MAY03-CLUS26069_1
gcctactgatgtgtgcgcatcgtctattataacccaaggcaagccgccgactcttctcgaccttgcagcgccgtgcccccgccatacctcatgtttcggccgaggggattcccgtctgctccttccgcgtcccctggaggtccctgccgactatggcatcagcgccagggtcctgtacaaacgtgcggacagcccgtcgaccataaggcctagcaaactgcacaatggtgtcctgcgggccctcagtcgcaaccgtccctctggccgcaacatgatgcttctcgggacttgccaagacggtgagccgtgcgttgttgatcaagaccaagcttttgaagaccagcaggctcaggagagctttgagcaagggtatgataatgaagatgactggaatgaggattatcggtatgagtactaggtttggagtcaaccagtcaacagtgtccctgtgtggagcttccgtcgagagcgttgtttactttatgctatcatttttgtatgagactatgtgattttttatgtcccgctatgtaataaacactgcaatggtacatttttgatttgtctacttatgtgtgcgactgtttttggggcacata

SEQ ID NO: 8093 - DNA, 760 bp, Sorghum bicolor
  Clone ID: SORBI-28MAY03-CLUS26078_1
gaaagaaattgcattgatggaagtaaagatgaagcgtctttgtgagctgctagatgaggcctttgtgaggacaaaggaaaatgcggagaagaagcttactttgacgtatgaagagatggaagcagaacgggaggaggaggaggtgcaagctgactctgagagtgatgatgaagagcaacaaatctacaatcctctcaagttgccaatgggttgggatggcaagcctatcccctattggctgtacaagctacatggccttgggcaggaattcaagtgtgagatatgtggaaaccatagctattgggggcgaagggcttatgagcgtcatttcaaggaatggcgtcatcagcatgggatgcgatgccttggcattcccaatactaagaatttcaatgaaattacatccatcgatgaagcgaaagcgctctgggagaaaattcaagcacgacaaggggtgaacaagtggcggccagacctagaggaagagtacgaggatcaagaaggcaacatctacaacaagaagacatacactgacctgcagcgtcaaggcctgatctagggctccagctggttaagttgttgggatttgttcagaactctatctcatatggttgtaattgtaactctggatatattgtgccatttggcatacggtttatatgtagtaagatgatcccccggagctcgtgtgaattttcctggtcgtccataactatgttatgttttacattttactagcaaacattactgttgcaatgca

SEQ ID NO: 8094 - DNA, 921 bp, Sorghum bicolor
  Clone ID: SORBI-28MAY03-CLUS25521_1
gcacgagggttatcatgatatctcaggctagcagtgaacattcagtatgctttgctgttccagaaaaggaagttgctgcggtttctgctgcattacatgttaggtttcgtgaggcattagcagcagggaggttatctaaggttgaagttattaaaggttgcagcattctggctgctgttggactgaggatggctagcactcctggagtcagtgcaatactttttgatgcattagccaaggcaaacattaatgttcgagcaatagctcaaggttgcagtgaatacaatattactgttgtattgaagcaagaagattgtgtaagggctctgagagctgctcactcaaggttcttcctctccaaaaccacacttgctgttgggatcataggacctggtttaattggtggaacactccttaaccagctgaaggatcaggctgctgttcttaaggaaaatatgaacattgatctacgtgtcattggaataactggttcaagtacaatgcttttgagcgacacgggaatagacttaacccagtggaaacagcttctacaaaaggaagcagaaccagctaatattgatagttttgttcatcatttatctgataatcatatatttccaaacaaagttttggtggactgcacagcggatacaagtgtggcatcccattattacgattggttaaagaagggtattcatgtcatcacgccgaataagaaagcaaattctgggccacttgatcggtacctgaaattacggactctgcagcgtgcctcatacactcattacttttatgaagcaactgttggtgctggcctcccaatcattagcaccctgcgaggtcttctggagacgggtgataagatactgcgtattgagggcattttcagtggaactttgagttatatatttaacaatttcg

SEQ ID NO: 8095 - DNA, 652 bp, Sorghum bicolor
  Clone ID: SORBI-28MAY03-CLUS25590_1
gatggtacgcattggtggaggagttttccctgtaatcaaagagccagattaccttgttaatggggagtatcgtattgacaagggggcagcaccaaaaatgctgaactgcctaatgtacaagctttgttactaccgatttggagaacttaccacggaatatggaaagcctccagggtatgatcgtgtaagaggagtggagattggcaacaaagacataaaacttgaatacttggaggaggcatttacaacttcaaactggatagtgcgcatatacaaggtgaaacccccaaagaacaggtcctgaggcatcttcgctagtgaaatggttagagctattacctcagacaagtacattattgtcaaaaatctgagtggcagatggcggggtggttgttattggcacctgctttggcgagactgactagtagccatagcatcagttcagctcaaaagtcaagaagatctttcccctcatttggtttaggtgtgatgggtgtcattcagaaccaagtgtgacaacagcgagtactttttgattgttaagcatgtcatgaccgaactttgaaagtttttgtaggcgcagtgacatatttgagtagaaaacttgtctttgatcaatgcaaggcaatgcaaattttccagcactaagccc

SEQ ID NO: 8096 - DNA, 602 bp, Sorghum bicolor
  Clone ID: SORBI-28MAY03-CLUS25616_1
gagacaccaaagcccgaagataaagacactgatcaggaagtcaaagatgagctatgatcgcaagctgtttccctagcttgaccttactgacagaaagtttgatgccttggcagtcagcagttcaggacactggcacatagctagtggagtgcagagggatagtttaacgcaggtacctgtctacaatttgtcaaaaagactatacctggaatcctggaccacgttgattttgcgcctgaagtttttgccatcaaacatgcaacacaatttaggtattttgtttacaccaatagtttcaatacctttaacccaatcaaatgtggggacgctacgtcctgtatggctatcttgtcagaataggttagcaagtcagccagctggggtgaagaactcgtctgctctctgctgcatacacatacactgtaatggtcaacaattcatacatttaagatctttgagacgctgtagaatttattggctgccactcgaaagctaacagcaaggtggcagctaaaatgcccgagaattttgtagtagtcatcaaatgggtgtttgaaagactcagtaagacaataataatgcctctggcatgtaatttgtgt

SEQ ID NO: 8097 - DNA, 729 bp, Sorghum bicolor
  Clone ID: SORBI-28MAY03-CLUS25617_1
gaggggaggttcgcaaaactagctgcagactttttggtttctccttgactgagaagatcttgccagcagatgatgatggcgtcaaggaagtgagctatgagcctgagtgccagaacccacggatgctggatctgtttgggtacaactgctcaaccccgagtgctgctcttccggctctgtgtgctgcccccattggaatgtgatgctacttcaataaggttgccgagtatttccatgtattcttagaagttttactttcccagtaccccagtgtacttcataagctgccttttgacatcattccctctattggtctgcctcaagctaagcagtcatttgcacaaataaacgaaggattgttggtgaaccactcctcgcctggcctcaccctgccatgcaagctattgtggttagtctcaggatatccagagacactgcattgtaacttatgtggctgatccttcagaactgtagtgctatttgctttaaaagtacttggctcgcagattttagattcatgggaaggtttgtcagctttaatgtaccgtctatgtatctttaaatcagctcctgactttttttagctctcacaatcacaagccctggttgcagtcgcctaggccgtgtgattgtatcagatgtaaggcaaatgctatgttttaagctctgttgcttagggatctttattctgggggattgggggggaatactcggttcttcatggcaggc

SEQ ID NO: 8098 - DNA, 577 bp, Sorghum bicolor
  Clone ID: SORBI-28MAY03-CLUS2555_2
cgtccgcgacgtcgacggcatcttcgacccgccctactacgagtggttccagttcgacaagagttttatggagtacaggaatttcgacaagtgcctggcctacatcgaagagctgatgataagagatggccccttcgatggattgatgggtttctcccaggtaagcaagcagcaaagttcgacatcacttcccattcagttttctgtggtgatgaaccagttttgttcgattgacggttgcggcgtgcgattcgatggattgatgggtttctcccagggttcctacctatctgcggcgcttccggggctccaagaacaggtgagatcatggttcatagtactaaatacgtacagggcgtcaagactcgaagcacagcaggctcttcagctttgctgctgccagttctttactgtcgctttgtgttttcatggcaggggcttgccctgactagagttcccaagatcaagtacctcatcatcatcggtggcggcaagttccagtccccgacggttgccgagaaggcgtacgccaacaaggtggcatgcccctcgcttcacttcattggtgacaacgact

SEQ ID NO: 8099 - DNA, 951 bp, Sorghum bicolor
  Clone ID: SORBI-28MAY03-CLUS2555_1
gcacgaggcccgcctcggttcctccgatccacgcgcccgcccgcccgcctgcctgcctcccggatccgccgcgatgggcagcctcggcgccgacgcggagccgcagggcgcgaggcggcggccgcggttcctgtgcctgcacgggttccgcaccagcgccgagatcatgcgcaagcaggtgctcggcaagtggcccgccgacgtcacggcgcgcctcgacctcgtcttcgccgacgcgccgttccccgccgagggcaagtccgacgtcgacggcatcttcgacccgccctactacgagtggttccagttcgacaagagttttatggagtacaggaatttcgacaagtgcctggcctacatcgaagagctgatgataagagatggccccttcgatggattgatgggtttctcccagggttcctacctatctgcggcgcttccggggctccaagaacaggggcttgccctgactagagttcccaagatcaagtacctcatcatcatcggtggcggcaagttccagtccccgacggttgccgagaaggcgtacgccaacaaggtggcatgcccctcgcttcacttcattggtgacaacgacttcctgaaagtccatggtgaaaagctcatagaatcattcgtggacccattcctcattcgtcacccaaagggccacacagttccaaggctcgatgacgagagcctagcggtcatgctccgtttccttgagaagattgagggggaagtacttgagtattcatccaaagataagattgagggggaggtacttgagtattcatccaaagatgtcaacgaaaatgaggaagtgtgcttgtgataaagactttatagaccattagtatctgatgttggcgaaaaagctatacttgtatttatttatttatagaataaacatacgataccttgatataaacatacgatacctcgattttc

SEQ ID NO: 8100 - DNA, 720 bp, Sorghum bicolor
  Clone ID: SORBI-28MAY03-CLUS25675_1
cacgcacacatcaatctgttgcgccagaggagtcatcagaagggaacattatccgtcgaagggggcgcttccaggttacgtcagatagtatttctcaaaaggtagctacatcagcctgcagcagcagtagcaggataaacctaccaattgaagcagcacaatcaaatcccaagtcgcctgcaattcttccaactttgcaattcttgatgcagcaaaatactatgcaaaaggaagtactcagtaggctgatttcttcaattgaggaaacatctgacgattctttagcaaggacaagcagttcatatcagtcttctggaggacctgccagagaaaaggaattgcattcatatgttctccagttgcagcgaagtgtcactgaacttgctgaggaagtgcaaagattaaagctccaaaacaatcagcttgagcagcagatcaatgtattgtcaagaaaagatgaaaggtcgcaaacacaggataaccgacaatgatgatatgccccttctgccacactgtataattcagttccccaattttgaactttgttagaaaattatttgtattctgtctgcagtcagggttgtatcattgtaagctgtaagtatttagcgaagggtgaaatcatagtaattttgatttgtacagctttgtttggttaaccaggaagaaatagttctctttggtttttaggtaatgtgctgataatattgttttgcgggg

SEQ ID NO: 8101 - DNA, 723 bp, Sorghum bicolor
  Clone ID: SORBI-28MAY03-CLUS26423_1
gttgaattggactcagagatcatgcttgttggctacaatgacagctccttttcgcacatattagttctcaggcttgctgatcttgtcttgggtaggactgtgcctgtgaagagcatcggtgatcatgtcttctttgttggtgcaaggagcctgtgtgtctcacccaactggctgccttcaattggcggcaactccattgtatgcttccatgctggagagaactatctcgcgcaataccatctcggctgtggaacttggtctgtggccagtgatggacacctcatgcttaaccccccaccgcgtccctgtagcctcattcatcacatctttacctgctgcgatcggcaattctggaacaaaggattgatgttttgcttcaagatagaacccaaatggtgggcgatgtcgaggatgagggttggggcgtgaaggctttcatggagaagatggtccagataacttcatttgcatcaaaagcagaagggagcggggtttccgtcctttgcgtgtatttccacggtgaatctacttgtttgcaactgcatctaccggtgtctgctcactgatgaacgtacagcgatgcccaaaatcatgtgataactgtaactgtgtggcttgagatatttgtcagtaaaccacgaatagtgctgtgttacctgctgcgttgattttgcaagttcccttgtgtcctttaagcaaattggcttttgtggagccggttat

SEQ ID NO: 8102 - DNA, 634 bp, Sorghum bicolor
  Clone ID: SORBI-28MAY03-CLUS26363_1
taatttttttttttttttttgcaatgaacgacattcagagcttgggttagaaccgtaacaagtgcacagcatggcacggggttcaacaatgatcacaccatgtacaacatgacagccctattgctagaaatgcgtctcaagtacctaaaaaaccaaaatggcctgttacatcggggctagaaatgaaaaaaagaaaaacaaagttatattacaagcacaacgcagggcatgcattgattgcacatggcgcctaagaccagctgattgtggcaccaagacatgatcgaaccgaatctggatttgccttttggacttcggttgatgccatggctcagtcgtggtagaaaatcttccgtcttgatctatcaaaatttcatggtgcttaggtgttgagacaaatgttaagccacctaggatccaattgcaatttgcctcatgatgatattggctcataaggaaaagaaagccatggatgtttcaatgcttctgaggcacttgggcgcttctttgggttcacctctagaaggtacgcaacaaactcaataaacccttgatcagccatgggcaaacggtgccgcaaggatgtctttttcggaatcaagtattcaagcctgttactttcctgatttctttc

SEQ ID NO: 8103 - DNA, 855 bp, Sorghum bicolor
  Clone ID: SORBI-28MAY03-CLUS26498_1
agcacatatatatggcattcatctcatcacaaactcaaatccacatatatatcacatcacaagcacacaatatctcacatacactacgacataaacataataggttcaatatccatcttcacaggtcgatagtcgttcacagtccatcacatgtccatcaagtggcgaaaaagataaacaaactagagctagggtggaaactgagtgcctggtgaaggaaaaagcaccgtcctgcctgcttgcgcctgagatgggttattcgaacccgccgacggaggcgggctagcgaaaacttgcggcggtggagtgaactgcggcgcttgtacaccggtgaggtggccaatgttgtgcaggtacgccataatctccgccaactgcttggcctgcctttcccgctcggcccgctcggcctgtcgttcccgctcagccttctcagtcctcgccgctaggtctcgcagctcctaagccatcctctcgttctcggcctatggtgccggtgaggtaagggtagcggggcggtagagagtcggtgcagtggcgagtcgatgcggtgcaggaagacccgcaacgccgacgaagacgatcggggtcgccgagtcactcgcacaagtcccacgacgcggcggcgtcgccctccgccggcagcggtgccgagggctggcggcacgggagacgcgtgcgcgggggccggggcaccgagggcgggcggcacaggatgctcgatccgtcgggcgcgtgcgtgcgacccgcgctggcgagcaggggagtggagggcgggcgcggggcctgctggccggagcggagcggcgggggcgcagggccacggcggcgcggtggcgcgttggcgcctcgtgc

SEQ ID NO: 8104 - DNA, 609 bp, Sorghum bicolor
  Clone ID: SORBI-28MAY03-CLUS26641_1
cgcgctcttcgccgagctcaccgaccgcatcgtgccggtggcgatcaacaccaaggagagcatgttccacggctccaccgtgcgcgggttcaagctcatggacccttacttcttcttcatgaacccgcggccgacgtacgagatcacgttcctgacccagctccccaaggacctcacatgcagcggcggcaagtcgcccatcgaggtggccaactacatccagaagacgctcagcggacagcttggcttcgagtgcaccaccatcacgcgcaaggagaagtacggcatactcgctggaacggacggccgtgtcccgtccaagaacaaggacaaggagaaggagaagaactaacggccaacgtcgtcatcgctgctgcccgcccagcacactgccgttacgagtactgctgaaatttattccaattaattgttccttgtcgagaagttggccaattactcattgtttttaaaaggaccatgtgatgtgggccgtgtactagtacaagcttgatgatcatataattattatctacaagttcttcctcttcggaagaagggcaaaagtgttgttaggcccgtcttaatacaaagtttcgttgcatagtttcc

SEQ ID NO: 8105 - DNA, 884 bp, Sorghum bicolor
  Clone ID: SORBI-28MAY03-CLUS270_1
ggaagacagagagagaagagagagatgcggtaacccaagaactgctcttatgcatgaagtagccataagcattactattagggtttcatgcagggcaaagcagctggtttctgccgcctgaacgccgccggaatctgcgaggtcttcccgagcagcgtcatcgcataaggcagccggcacggcaatgccggttccccttgccccgtatccgactcctccggtgccattcacgccgcctaatggggcccaaagccagcttgtctgcaccgggtgccggaatctcctcatgtatccagctggtgcgacgtctgtctgctgtgccgtttgcagcaccgtcactgccgtgccggctccaggaactgagatggcacagttagtttgtggaggatgccacactctcctgatgtacatacgtggtgcgactagtgtacaatgttcttgctgccacaccgttaacctggctatggaagcaaatcaagttgcgcatgtaaactgcgggaactgccgtatgctgctcatgtaccagtatggagctaggtctgtgaaatgcgcagtctgcaattttgtgacatcagttggggcctcacctggtgcagagcagaagcccagcagctgatgatagtgtccctgaaaatactgagatcacctatgaaggcagcttctgaaaggatgctttgagtgcacatgcatagagttcttccctgaagcaattcttttttttctctcctcatctccattctcccccatccacttctgcgttccttcgatgaatctggcgaacccgcagaataaatgagagttttggaaataactagggctcaacctcgtcgacttgtccgtaaaatcaaatgagacatatataaacctatggtattttctctgtt

SEQ ID NO: 8106 - DNA, 543 bp, Sorghum bicolor
  Clone ID: SORBI-28MAY03-CLUS25875_1
cgcggctgctcgtccgcgacatcgaatttcacagccgcccccgcgagatcccggccttcgttctcttcccccgagaggtgccgcaatggctgggaaaggcgggccgaccaacttggagaaggagcagatgtttgggatggcagagaaggagatggagtacagagttgatcttttcaataggcttacacagacctgtttcgacaagtgcattgagaaaaggtataaagaagctgagctcaatatgggcgagaacagttgcattgatcgatgtgtttcaaagtattggcaggtgactaatttagttggtcagatgcttgggaaccgtcctcagatgtgaactgagaagcactagttccattttgtagctattgctctgtttcttctttttggttggctttagagtgcctacacctgctactaagtacaccaatacagcaccagacatgctaatgcgccaccgctttaaagaaaaatcacggtgtcttaccctttccagtgatgcgcattctctctgaatcatgaacatggaacatgcctgtataa

SEQ ID NO: 8107 - DNA, 674 bp, Sorghum bicolor
  Clone ID: SORBI-28MAY03-CLUS25921_1
tctgaatcaaaatctctctttgctgatcaagctgaagcagtttgtgcaacttcaaagaatcaattcaaagaaaatgttgatgataatcttatatctggtgttcttgatggatttgcactcacctctgaaactgagggagatggaatattatcgggttccaagaatcaagacgttgctgatgttacatgtcacgatattttagatgctctacacgatggcaaagcattgttgggcagacgaatgtgaagctgttatggggcatcaattaggggcacaggggccacaggatcaattagaggcatttgatgagttacagataggattagatttgggtcaattagagataggattggatatgatttgttacgatttgattaggccttccttaggtggcctggggtcctctctctataagagaggtgaggtgatgtaccaaggaggggaatgaagaaaaaacaaacaatccgattcccccaaatactctagagcctgttcgcagtctcccttcatgctgactttgttcggccatcttcgtggcaacagttatccatatccccaaatgatctgaggatcagaacagaagctaattattaccgtcggcctttttcagcaggttattggcctggccttttatttgaggctcacggattactctaatgttttttatgagtatt

SEQ ID NO: 8108 - DNA, 698 bp, Sorghum bicolor
  Clone ID: SORBI-28MAY03-CLUS25935_1
tctatgtacttttgatggaactcatggtgttagtgctggtatccgaagtgtggtagatgttgaagctgggaaatcaaatggcctcttcaatgatgcaatgtgcaatgcctgtgagacagctgttgtatggatgcagagccaacttgcacagaaccaaactcaggatctagtgttgcagtacgctcgtcggctatgtgaacggattcctagccctatgggagaatcatctgtggactgcagcagacttgcatccatgcctgacattgccttcatcattgggggtagaaagtttgcgctcaaaccagaacaatatatcctgaaggttggtgagggagctgctacccaatgcattagtggtttcacagctatggacattcctcctccccgtggtcctctttggatcttgggcgatgtattcatgggagcctaccacacagtctttgactacggcaacctgaaggttggcttcgcagaggccgcataagatggcccccatggcgatcgaactatgccatgtaacgcaagcatgtatgtaatatatatattacatgctcaataatgcttatgtgatctgaggtgatacctcctgtctgtttcaactggctaatatatttgtcaagttagggtttgaagctaatttcgtggctgttgtgaacttgtgatgtttgtgcttgcctctagactctagtattatatat

SEQ ID NO: 8109 - DNA, 715 bp, Sorghum bicolor
  Clone ID: SORBI-28MAY03-CLUS26027_1
gcccaccgagtacatgctgatcccctatctggcgtggtgttcaccaatgaatcaatcctcaccatctgccgtgagggcctcgtcaaaatctgggttcgaccagaccagagtgaaaacaatcaacaatcaaatccttcagagtttgttttaggccctgtctcaaaggatagggcgatcacatcttcgaataaagcaagtagctccagcttcaagaagccatcgtctgttcttgttgcatgacgaatcaacaggatgattcttgtgggtatttctgcttaacgtggcatcagtggacatggatcttacttattccatgattgatggcacgtgaaacttcaaggggaggctgcaagtattgaaggtgcacgagggtttgtagatgttcccaggaagcagggccagtgttgccggttttgtggcatggaagaataatgggatatgctcttgtacagacacataaaattgtataaattcactgtggccgttccatagtcatacccaccaaaagatgattggacgcgaccatgtatccattttagctggtagatatggtatccttaagctttgttacttctaggaggcttgtaattatgatttatgaatcatgatatttaagggatgctccagtcttgcctgtaagttttgttaatatttccttttgcattttgtcaattattaaagtggaaaaccatccccccttgtaaattgtttttat

SEQ ID NO: 8110 - DNA, 535 bp, Sorghum bicolor
  Clone ID: SORBI-28MAY03-CLUS25994_1
ctccttcccccgcggaacccctcccccacccgcccggccctccaacccggctctgggcctgcactccgataggcacagagccgttgaaggcgatcttcgacagtggcagcacccccgcctgcttgcctgtcactcgtcacgctcagctcggtcctgcgcggcaccccgctctcccctcctcgtcactccctcaggtgcccgggcctgcgctgcccctgcgctggcatgctccttatccctgccttgctgcgctccacaccccgagacatctcaaggcacgggccgctcgggattttggccttggagtcaccgtggctcgcgtcgatgccatcgccaggcgcgcatggaccccagccccatgcggcgatcttcccgcgcccctggctgcccgcatttcgcgccccgctgctcccgtgtaaagttgccggcggcggggatgagaacttgcagaaggtggggttgtgagcaagcaactctataaacaagaaacttgtgtgtgtacctcctggtcactggtctggctccctcctgatca

SEQ ID NO: 8111 - DNA, 645 bp, Sorghum bicolor
  Clone ID: SORBI-28MAY03-CLUS26892_1
ggagggaccacagcaaaaccgaagacaagcatgcttcttgcaccacctccaggtgcagctgggaagcttcgatctcctcttccgcctccacctaacgaccctgcagctgcaaggatgaattctggacatactgcaggaatcagggctccaaaagaacccacgaagagaaataatgatcctttttcagatctttctgctataaagcaaaatctaccttcatcggctgaacccggacaaacaaagagcacaggagctggatgggcagcattctaatgatggatgcatgatctattgtttgtttatctgaagaaggggaatgggtagctgaagtactgaacaagactttgatctggcctgcgaaattgaatggttaaaaatgactgatcagcgttccagttccagttgtcaaccgagaaataaaacattttccagagttgtgttacccatctcgccacatgaatggatgttcagaatatctggatatagatacagctcccttcttgattatcttattcgtgctatgtttcacaaaccaataccagaatcatactgacctcgatgtgtatgttccggcgaaagattgaaaatactgttacaagtgcggcaaaagaatgtttgcagtattcagtcagttttctcaagttc

SEQ ID NO: 8112 - DNA, 628 bp, Sorghum bicolor
  Clone ID: SORBI-28MAY03-CLUS26933_1
ggcagcaggtcgattgggaaggatttggcatagggagttccgtgttgtcatcagaaccttcagctatccaagttccatcaaaggaagccgagcctgacccgcacctggaagtggaacgaagcacgtctccagccccaagtgcagcaatctctcacaatgttgctgctccacactggttccagcgtcacgtagatccttttgagctcatggggttcgctgcacgtggcctgatcaagaatgacaaattctttgaggaaggttacagggaactacaacaatcggctactactatgaacacttggtggatttctcgtgccaacaatgctgcacaccgatggagcactgcttgactgaggccacactttcgccctccctttgtacatagcttgcgggcagttttgatagactccaattctctcgttcatggagtcggtgaaaattagggttatgtgtcgactatacaatgtcttacagaggtgggcgtatgattgtactttaggtaaatgtcaatgtcatcctccatctacactagaggaatgggcaacacgatatttcaagttataggagacctcgaggttttgatacacatgtagcagataatcgtcatcgaccaaagacgcgacacaat

SEQ ID NO: 8113 - DNA, 553 bp, Sorghum bicolor
  Clone ID: SORBI-28MAY03-CLUS26934_1
atggtggcgatgagattgaagtgaaggatatagttgagaggctaatgactgacaccacaaaggctgacaaagatagactgccaaaaactggttgtgatcccaactgggagcatggtctgagctccatcttcatcgaggtgcaaactgaccaaggcctctacgggacacggagcacagctgttttatcagtgaactatgatggtgaagctagcttgtacgagaagtaccttgagagtggtatatggaaggatcacacagtgaattaccagatagagtagtaggcaatgcacaggaaaagctggcaaccaaaaataaatagagacacaattgtgaatttcattctttccctgatcctgagtcacctttcagaactatctaagatcccatcatgatgccaattacattatttactgtaagcagatttgtcacttgacaataaaatgtcaagcagaagtgtaagtttaaatatatacaccaaatatataaatttacagactttgtgtaagatcagtttttcttgccttcttggacatgtttactcgagaaaaaaaaa

SEQ ID NO: 8114 - DNA, 508 bp, Sorghum bicolor
  Clone ID: SORBI-28MAY03-CLUS26993_1
gcacgaggctgctctcctcgtcctcgcaccttcttccacctctgctctctgctctgctctcccagccaccgagggagaacagagtcgctagtagctgctgcttggctcccttcccttccccaccacaaggcttccttcgattccatcggatcaagaccagctccctgcttgcttgatcaggaggcagaggctgtagctagatgacgaagcagggcgtggtggtgccggtgccggaggcggccgtggcggtgccgcccaacacggcgccgctgttccagtacccgccgccgcgggccgcgccgggcatcgccgtgcgcaagaagtacctgcagatgggcgccgccgccggtgccggcgccggggcgcgcatcggcggcggcggctgggtggagtccatgcgcgcgtcctcgcccacgcacgccagggcggccgccgcgctcgccgcgggcgtcgacgaggagcgctacgccgagtggatggtgaagcacccgtcggcgctgggcatgtt

SEQ ID NO: 8115 - DNA, 712 bp, Sorghum bicolor
  Clone ID: SORBI-28MAY03-CLUS26096_1
gcacgagggtcaattcttaatctggatttggatcacccatttcttgctcaagccattcaagcatttgaccatttgaggattaggctgggaggctccttgcaagaccgagttgtttatgatgcacgaggagaaagtccatgctccccattcacaaatgcatccaatggcttgtttggtttctcagttggttgccttggtatggataggtgggacaaactgaatgatctattccagagaacaggagcacttgtcacatttggcgtgaatgcactctacgggaggtataatgttcggcgttccatctgggcaggcaaatggaactccactaatgcatatgattttgtaaaatacacaatctcaaagggatacccagttggctcatgggaatttggcaatgagctgagtgggcatggaatcggagcaaaagttgatgctaaactttatggaaaggatgtaattgaatttaaatccatccttcggcaattgtacaaggcaccactgtcccagccactccttttagccccaggagggttctttgatcaacagtggtattctcagctacttgagacttcaggtcatggtgttgttaatgccttatctcaccatgtatataatcttggtggagggaatgatgttcatcttataaggaagatattagacccaaagtacttagatcgtgctgaagatacttacagagacatgcaacttacca

SEQ ID NO: 8116 - DNA, 740 bp, Sorghum bicolor
  unsure (1)..(740): unsure at all n locations
  Clone ID: SORBI-28MAY03-CLUS2611_1
caatgctgattttaccttagaagttttcttcgtccggaaaaatcacacagtgtatgtgagaaaaaggccttacctgaaaatgtttcttgagaaggttgctcagatgtttgaggtcgtcattttcacagctagtcagagaatctatgctgagcaacttatagataaacttgatcctgatggaaaatatatctcacggcgtatttatcgtgaatcttgtatattctctgacggttgctatacaaaggacctgacaattctgaggatcgacttggcaaaagttgcaatagttgacaatactccacaggttttccagttgcaagtggataacggcataccaattaagagctggtttgatgacccctcagatcaggaattgatcgagttactccctttcctggagagccttgtggattcagaggacgtgaggccaataatttcgaagacctttcatgacaaacttgagcagaattagtttaggaggcatacagatgtatcatcgagtgaacctgtcgctgaagttagcttcgctccacatggtgcaggccattcttgggaagttaggtataggatcaagattcaccatttatgttatgttagctgttacaaatagcaagcataaactgcgggttgtcgatgaaaatggcttgtatatgtatgtccctttgggtttaccgtgtcacagatcattgtacagagacgaacaatagtgctgaataaagtgatctgagtgcaattntgct

SEQ ID NO: 8117 - DNA, 758 bp, Sorghum bicolor
  Clone ID: SORBI-28MAY03-CLUS26138_1
acacacaccccgcggccggcctcggcgcctcgcccgataggtcgccggcccgcctctcgccacgctcccaccctcctgcccccgcgcgccacgaccagccgcctccagcagcagcgatgccgcccccgtccctcctgcacctccactcccgcgccccgcttcagccccgccccttcaggatgaactcccgggcagctccgagcagggtcgtcgtctgctccgttgcgtccgccgaggggttcatctccgcagcgccgatcctccttcccgacggtccttggaagcaggtagaaggcggcgttactgctgcgaaggggttcaaggcagcgggcatctatggtgggttgcgtgccaagggcgagaagcctgacttggcactggtcacctgcgacgtcgacgcaactgtagcaggaacatttacaacaaacgtcgttgccgctgcacctgttttgtattgcaagcatgcccttagtacatcgaaaacaggtcgtgctgtgttaattaatgctgggcaagcaaatgctgcaactggtgatcttggctatcaggatgcagtggatagtgcagatgctgttgccaagcttctcaatgtgagcacagataacatattgattcagtctactggtgtcattggtcaaaggataaaaaaggaggcacttttaaattcgctacctagacttgtgggctcgctgtcttcttcagttcagggagcgaattctgctgctgtggccattacaactacagaccttgttagcaag

SEQ ID NO: 8118 - DNA, 882 bp, Sorghum bicolor
  Clone ID: SORBI-28MAY03-CLUS26144_1
gcacgagggtccacgccaccaaccgcggaggcgaaccaaaccaaccgcgcgcccaggccgcccgccctccccccaccctaccaacccgcgtcgtcgtcggcaatggcggccatggcgaccaaggccaccgtgtcgctggacctcgccgcgggaccgcgccaccaccaccgcccgagctcggcggcgcgcccgtcagcccgccccgccgcttctgccgccgtccgcgggctgagggcgcgcgggctccgcgtggtccccttggcggcggcggcggcacccgcggtgcaggcgggcgccgaggagatcgtgctgcagcccatcaaggagatctccggcaccgtcaagctgcccgggtccaagtcgctgtccaaccggatcctcctgctcgccgccctgtccgaggggacaacagtggttgataacctgttgaacagtgaggatgttcactacatgcttggggccttgaacactcttgggctctctgtcgaagcagacaaagttgccaaaagagctgttgttgttggctgtggtggaaagttcccagttgaggacgctaaagaggaagtgcagctcttcttggggaatgctggaactgcaatgcggccattgacagcagctgttactgctgctggtggaaatgcaacttacgtgcttgatggagtaccaagaatgagggagagacccatcggcgacttggttgtcggattgaagcagcttggtgcggacgttgattgtttccttggcactgactgcccacccgttcgtatcaatggaattggagggctacctggcggcaaggttaagctctctggctccatcagcagtcagtacttgagtgccttgctgatggctgctcctttggctcttggggatgtggagatt

SEQ ID NO: 8119 - DNA, 784 bp, Sorghum bicolor
  unsure (1)..(784): unsure at all n locations
  Clone ID: SORBI-28MAY03-CLUS26300_1
gcncnnngggaaagggatgcgaggttgaaggagaaggaggagatcgagaaggtcaggaatatgaccgaggaggagcgtcgggaatgggagcggaagaatccgaagccacttcgtcagacgacgaaacagaagtggaaattcatgcagaagtattatcacaaaggtgccttcttccaggaaggtgctgatgatgttatccagtcagctggtaaagatgatatctacacccgtgatttctctgaacccactggagaagataaaatggataagagcatcctgcccaaggtcatgcaagtcaaacatttcgggcgcagcggcagaacgaaatggacacatcttgttaatgaggacactacagattggaatgcaccatggtcaacaaatgggcctctgcgagcaaagtataatgcaaaaatggctggcatgaatgcgcctatagctaaaccaaagggaagtaagaagctgaaggactgggatacaaaatgagatgccaggtgagctggcattgtttaagccttattgccatacaagcactacctagccaacaagtgcaagcaatgcttattcagatgctttcttctcgttttgactgcacaaaccatgtgagctttatgtaatctgttaaagtgtcccactagtatgatttacgtcctgctctctgctgtgtgtgtaacatgtgctctaatgtgcgcttggcaacccatcgttcttgtaactcggtcttatttgtttctctttttctaagagagagagagagagagagaaaacttactagctttggctt

SEQ ID NO: 8120 - DNA, 1498 bp, Sorghum bicolor
  Clone ID: SORBI-28MAY03-CLUS2632_1
cgtccgcccacgcgtccggagcgatgtgaagaagtccatgaaaatagcaatggacaacaaggaggcgatcctgggaagcattcctgcagagcataaagaagagggtgccaagctatatacttcactactcgaagagaagggtggtttccagactctcttgaaatatatcaaggagaatgatcctgacaaactttctatagcacttgcttcgtcacttgatattgttgctgaattggagctgttacaggcccctggtctgtccttcctcctgccccagcagtacttagaatatccaaggctaacaggaagaggagttgttgaattcacagttgaaaaaggtgacggttcaacattctttccaactggtggcggtgaaccgaaaagtgttgctacgattcaggtcattattgatgggtactctgccccactgactgctggaaactttgcaaaaatggtcttggatggggcatatgacggggtaacacttaaatgtgcaagccaggcaattattgccgataatgagactggaaaaaatgggtatactgttccattagaggtcaagccagcaggacaattcgaaccattgtacagaactccgctaagcattcaggatggagaattgccagtcctgccgatgtcggtgtatggtgctgttgccatggcacatagtgtggattcagatgaatactcctcaccaacacagttctttttctatctttatgacaagagaaactctggcttaggaggaatatcgtttgatgagggacagttttcagttttcgggtataccacggatggaagagatgttctatcgcagattaagaccggggataaaattcgttctgccaagcttgtacaaggcagggaacgccttgtgctgccatcaatagcccccgaagagagctgatattatcgaccccaagcatttgcagcattcttttacactgatcaggcaaccaacattttgtatatccaagccactaaacctgaccagacagtttatagtcaaatacgaccaagtatatagcgtatagtataagaatcgttgtacatgaaaccaattttcttgtgtaatcgatacatcggaatctgaacagcctggaatgcttattcgacaggtatgtcacggtgccagggagttgccggcggtgtgcatctctcgttgagccaggccaggatgtcgccgcggacacgctcgatgttctcgtccggttccccaaatagcaaggagtggagcatcccgtcgtatatcttgatagtcttgtccttgctggcggcggcggcgtacagggcgcggctgatttccgggtcagtaacctcgtcggcgctgccgtgcacgacaaggaacgtgatgctgacctcgccgagacgcttgcccagctcgtcggtggcacgcaacagctcgacgacggtgccgagcctggggcggccgttgtagcgcacagggttgcgggctgcaatgatgcgcttggcgggcaccttgacggacttctcgatg

SEQ ID NO: 8121 - DNA, 556 bp, Sorghum bicolor
  Clone ID: SORBI-28MAY03-CLUS24225_1
ttataccacatggtgaagctgttactgtggagagctttctggcttggagagaacgttttgaagctgacctggccttacagcgtgctaaacttatgccagattcagctcttacagccccaaaggaaaagaaactcacaggacggcagtattttgaaagtggaaggcatgcagtgaaaggagcaagcacagttgctgatgaagatgaagaagaggaggaagacattgaatttgatgaggattttgaagacgatgaagaggacatgcttgagcattacttagccgaacaatcagggaagtcaacagcttaaccttcgaggccaaacaaagtaccttttcgggcacagctttaccttaggaagccaaatgtggttatatgttgcaagtgtagctctagagcccactattttgtgatgcttctcatcatttggttgtatctgaatggatgctttcaagctctatcaagtggctgtgggctcattaatatataagctgaaggaattagaagatcaaagctgcctaatacttggccgtataatttactgttttttgatcggtt

SEQ ID NO: 8122 - DNA, 820 bp, Sorghum bicolor
  Clone ID: SORBI-28MAY03-CLUS27027_1
gcctcccatatccatactcccccgcgcccgtcaccaccaacctcccgtcgcgtatattataactacacctcgccgccccactctccactgccaactcgcagcgcacgaggctcctctgctcccacacactccttccccggggcctggcagtgagatcgagcctcgatccatcgagcactatagtagcaaagacacaagatggtggcgtcgtatcgcagtcgcaggttcaagcccatcgaggagtgctgctcggaggggcggtcggagcagacggtggccgccgacctggacggcacgctgctcatctcccggagcgcgttcccctactacctcctcgtggcgctcgaggccgggagcgtcctccgcgccgtgctgctgctcctgtccgtgcctttcgtctacgtcacctacatcttcttctccgagtcgctggccatcagcacgctcgtctacatctccgtcgcggggctcaaggtgcgcagcatcgagatggtggcgcgctccgtgctccccaggttctacgcgggcgacgtgcacccggagagctggagggtgttcaactccttcggcaagcgctacatcatcaccgccagccccaggatcatggtcgagcccttcgccagggccttcctcggcgccgacaaggtcgtcgggaccgagctcgaggtcggcaagaacggcaaggccacggggttcatggtcaagcccggcgtgctcgtcggcgaccacaagaagaaggccgtcgtcaaggagctgggcgacgccgtgcccgacgtcggcatgggggatagggagaccgacttcgactcatgtccatctg

SEQ ID NO: 8123 - DNA, 809 bp, Sorghum bicolor
  Clone ID: SORBI-28MAY03-CLUS2708_1
tgcctggaaaaacttcgcaacagtctgatgtggctgacagagaacccagtcctgctaatcctgtgaccaattccgatctggatgttgtatcacagaccacagatgaagtaaaggctgaaacacctgccacagaaaaggcgggtcaagttgagaaaatcgtttcaggtaaaggaaaggaaaacaaagggaaagacatcgtgagaaattcatacaagacagaacttgcaaggcaaattttgctcagtttcattgtgaagtcagtgcatgacagtttaggttccgcccaagctgaaccagacaggaagtcaagtggatcagatgaagctagtaatgaacagagcagcaacctaggcaagaatgcttctggtcgcaaagattcagataagcaagagaaagccatggaggttcctaagggtctgaaggatacagagggatttacagtcgtttcaaaacgtcgaaggcggccacagccattcatgaaccccataaatggcctctattctcagccgtctattacctctgtcagttaaggtcattgcattttcaaagatctgcaatattttggaagatggaccttttgcgtttgcttagagggttggtagcagaattttgccctatccaagtgagcagcgagcatgtagtcaaaatgtacaaaaattttcggagataccctttgtaataaaaatctgctatagtctgcagtagctgtagcgcagaataaaatgttcctttgtatgttatataggacagaatcttaggaaattgtagcagatgttaagttaatccaatattccagtagagcttctctt

SEQ ID NO: 8124 - DNA, 1158 bp, Sorghum bicolor
  Clone ID: SORBI-28MAY03-CLUS26656_1
ttcgcacgaggggaaggctctatgaacctaatagtagaagtaaatcttctgggggcagagatgatgttgagcacttggagggtcacattgctggtttagaacctatgaatttcataacatttgcatcaccacatttgggttctagtggaaacaaacagattcttccaccagctaccttttttatgtggcctgcctttccttgagcgaagagcttcagaaactgcacatttgattgttgggagaactggaaagcatctattccttacagacaatgatgatggtagacgcccactcctccttcgaatggttgatgactctggtgatttacagttcagatcagctttgcgttctttcaaacggcgcgtagcatatgctaatgccaattttgaccatatggttggatggagaacatcatcaatccgacgtcagcatgagttgccaaaacatcgtcttcttgttcgtgatgaaaagtatccgcatattgtttatgttgaaaaggaagttacagacaacaatggaacagaagcccatgctgatctttatgatccagaagaggagatgataagaggccttacgcaagttccatgggaacgtgttgatgtgagcttccagaaaagcagccaaagattagttgcgcataacacaattcaggttaaaagctattggctaaactcggatggagcagacgtgatcaaccacatgatggataatttcatcgtctaatccatggaggcatggagcctacatcgtctattgaaatttattgatcagtgaccattcaattttgccttggccaatttttccttctaggttgcagctctccagttccccatcccaggtaatatggttgattctttaggcccgtttgcagagcagagccccaatgcttctgatcctgcaccatcagcgacgctagctcgttcaactgtatcataatctgccccctcctttgtataattgtattccgcaactaagctagtaaatagatgttgctgcaaatagaattctcctgtttggttcaacactggagttcaacttcaaactgaaacttgtcattcttgtgacccatcgacgtgcttattgggcacagtacggtacttcaatcaagttttttttggaacttttttttttggtaaaatatgaattgtacgtaccata

SEQ ID NO: 8125 - DNA, 609 bp, Sorghum bicolor
  Clone ID: SORBI-28MAY03-CLUS26723_1
gtcgtagtattacgtgaagggcatcaggatataggatccatagctacagatccctcagctattgccatcgtttgctggaaaggaaagaccaacttgtgtgtcatggtttctccactagatgggaaagaactgcttgagaggatttcattgcgttttgggctgaaaatccccaaaggggataaagagaaacccagcgaggagattgctggatcagacgagctgcttgattgtgccactgaggtggacgatcaagaatgttttcctgaaagcaaagcatcggacatcgaaatatcagatgctaaggatgctgactagcttttgtttttatgccacttactacacctattacacaggaggtagatgtatcctctgagttggctattggttttcagtcacttaagttgctaaaggagagatagtcgcccacatgggaatgatagcacatgatatagaccctaaacacctggtaatcgtgcttggtggcacacgggcaccacatctgtaaacttatagcctgttgttttttcttcttagaggacgtatcacattcgattttaaaattttgcactgaacgcaatccagtaaagtttgagactgagaatacttttg

SEQ ID NO: 8126 - DNA, 1339 bp, Sorghum bicolor
  Clone ID: SORBI-28MAY03-CLUS26672_1
tggtcgcggtcgggcgcctcgttcttgtccgactcggcctcgtcctcgtcgaccacaaccacttcctcgtgctcctcgtcaggttcgttctcgccgttccttcgtctggactcgccaccgttcggcgggttcgacctcggcctcggcgagggcttattcagccacctgctgccgctgccgctgccgcggccgccgtcgaagaagtccaagcacggcgccaagggcagcaagcacaagcccaagaagcgcgggcgcaagccgaagcatctgcctccgcaccacccgtcggcaggcggcggcgcggccgcgtcgcagcagcccgggcccagcgaccgccgctgcagccactgtggcgtgcagaagaccccgcagtggcgcgcggggcccgagggcgccaagacgctgtgcaatgcgtgcggtgtccgctacaagtcagggcggctcctgcccgagtaccgcccggcgtgcagccccacgttcgagagcagcatccactccaactcccaccgcaaggtgctcgagatgcgccgcaagaaggaaggcgacatggtcgccaacgccgcgccggccgtggcgtcgttctaagccgctgctgcgcccaccctgtgactgagcatcagcaaggaggctggccacctagcggtggctgtacattttttttctctctccgggccgtaatagccttgtaccgtacctgaactcccctcccatgtctcttgcttggtagtatcgtcgtcgctaggagtctcccggttgggttaattagagtttaggagtctggattaggtcaggttaggtttagctttggttgcggttagggttctactgcgagagcagcggcgcagcaactagcgcagaacttttaattcctagcatttctaaaggcagtttcttcttccttttgacgagctagctgtaggagtgagtagcttgtttggtgcatccatcaatggtcgagccggactgctgggtacggactggtgctgatgttggaaaggtagaagatgagatgaggctgatggatcgatcggtcgcccaaggaggaagaagagtgcaccttgcacttggactggtatgtattgggacaggtgcttgtggcgtgcaccctttcggttacatcacatggtgttgtcacccgtaacgacatgatatgcttagttagcagagcagagtggtgatagcgaggtgttgaagcaagcatttaggcttgcaacttgcaacctttgcaattgtgtgaggtagttcactgtagtccgtcgtagagtttagaatggaccaatggagcagtaaagctgtaagctcctcccttggttgtgttgtgcgacacactgccgcttta

SEQ ID NO: 8127 - DNA, 635 bp, Sorghum bicolor
  Clone ID: SORBI-28MAY03-CLUS2676_1
ctactggaaccgcaaagccgttcgagacatgggcgccggtggcgagctggacgccttcgacgccggccgctgcgcggacgggtacgcgctgggcctcgccgtgggccggcggttcgccgaggtcatcaggagccggatgcggcaggacctcgtgctccgggagcagctgctgccgttcgcgtcgacggcggaggcgcagccactcctcgccgcgctccagtccgccaacagggagaggtacccacggtactgggacgagctggtgggcaccgccgacggcagcggcgtcccgctcctccacgtcatcctggtcaacttcaggaaggaggtcctgccgttcatcccgaaggaggagggaggtgatcgcacccgggaagaggaggaggcggaggccgacggcgactgctccgacgtcctcatcgtcagcgactccacggcgatcgccgcgcacaacgaggacgggaacgtcgcgctgctcggccacacgtaccttgtgcgggctacgctgccggacggcgcgtccttcaccgcctacacctacgccggcgagctcccgagctgcgccttcgggttcaacaccaacggagtggccttcacgctcgactcggttcctccggtgaacgacgagatcgtcg

SEQ ID NO: 8128 - DNA, 1026 bp, Sorghum bicolor
  Clone ID: SORBI-28MAY03-CLUS26792_1
gcacgagggagacctatcgccggagagccaccgaatccaccgcatcggagagagtagaggttagcattaggcggaggtcaagatggtgtgcatccggcaggcgaccatcgacgacctgctggcgatgcaggcgtgcaacctgatgtgcctgccggagaactaccagatgaagtactacctctaccacatgctgtcgtggccgcagctcctcttcgtcgccgaggactacggcggccgcatcgtgggctacgtgctcgccaagatggaggaggacccctccgagccctgccacggccacatcacctccctggcggtcctccgctctcaccgcaagctcggtctcgccaccaagctcatgtccgccgcgcaggccgccatggaccaggtcttcggtgccgagtacgtctccctccacgtccggcgatccaaccgcgccgccttcaacctctacacctccaccctcgggtaccagatccacgacatcgaggccaagtactacgccgatggggaggacgcgtacgatatgcgcaagcctctccggcagccgcagccgaagaagcatcaccatcaccaccaccaccaccacggccccggtgggtgctgctcgcacgacgcacctgcggcggcaactggttctcagtcttctagttcgccggataagaaggctaacacttgacggaggactcatatctacagagaggagtcgccaagctcatttgaatttctataagcatcttttctctcaccggaagataaaagattgtagcgttcttttcctaataggatggaaaagatctgtactgtgattatttgtgtactttcttggtccattcctcaaatcgtctgacctaatctttgtaatcagtgagaatggcaagcaaatatactttgacattgtattgtctgtaaaaacatgtgctccaccgtggttctcacagtttatttgattagtcatccctgacaatttggtcagattttatacagcaagactataatacaagttggaacctgagatgctgttgtttt

SEQ ID NO: 8129 - DNA, 687 bp, Sorghum bicolor
  Clone ID: SORBI-28MAY03-CLUS26814_1
ctggtcgcgacggaggaccagctggggctctccatcttcgtgctgctgccgcagttcgtgctgatgggcctcgccgacgcgttccttgtggtgggcaagctcgagttcttctacgaccaggcgccggagggcatgaagagcctgggcaccgccatgtccctcacggcgtacggcatcggcaacttcctcagcagcttgctgctgtccacggtgacgcgcatcacaagaaagcgcggcaatgcctgggtgaaaaacaacatcaacgactccaacctcgactactactacgccttcctcaccgtgctcggcggcgtcaacttcgccgccttcctcgtgctcagcaccatgtacaggtacaaggccgagtccaccgacaccatcgacattgtcatcggcctggagaccgagaaagccaagcttcaggcagagccactgggttgacgacactagctctgtggtgcctgcgctgtgaaggcgaagaagagcagccattcatatccacgtgttttgtgtatcgcgctgtgaagcgtagaaaccactttgcagctcctatatcacttcccttgtaaaaaagcacaggatttacacccattagtagtggttgtgtgatggcatcggatcggccagaagccctgacgaagcccgcctcacttcacaggaaaaaattagagtaaagaacaccaaaaa

SEQ ID NO: 8130 - DNA, 608 bp, Sorghum bicolor
  Clone ID: SORBI-28MAY03-CLUS27373_1
gcacgagggagaggcacgaggcagagcagaggcttcaagtccgggagggaggagacaggtccagtccagcagctcaccgttctctattgctgctcgagaacgagaagagctagctctcgtcttgcttgctagaacttgtcaaggttcagttcagtccaatggcgtcgagcagcagagccgtgcgcttcttcaagctgctgctcctggcgtgcctcctcagcctctgcgagctgtcccaaggcaaggacaagaagccattcttcaccttgaagaacctcccgccgctccagaaggccagcagctacccggcggggtgcgcgacgacgtacgactacatcatcgtcggcggcggcaccgcggggtgcccgctggcggcgacgctgtcgctccggtacaaggtgctgctgctggagcgcggaggctccccgtacggcaaccgcaacgtctcctacatggagaacttccacatcgggctgatgaacatggcgccggactcgccgtcgcaggccttcatctccaccgacggcgtcatcaatgccagggccagggtgttgggcggtggaacctgcatcaatgccggcttctacagccgggccagctcaagcttt

SEQ ID NO: 8131 - DNA, 668 bp, Sorghum bicolor
  unsure (1)..(668): unsure at all n locations
  Clone ID: SORBI-28MAY03-CLUS2754_1
tggcacgaggctttttatctctaggacactgattgcagaagcagaaaaggctgctgatgctctggaaactgctgcagcgatgaacccttttgctcaagcatcacttatagaagctagaaaacttgttacagaggcaagaatatcacttgaatgtgttgatgatgaagggcctcaggaaactgcttccaatgatgcgtcagggagctcagctttattgaaccgtcaccgtcatggattggagacgcagaatggaagtaatttgttgaatcaagagaataaacctgtaaatgggatggaatttcctccaagcaatgttaatggcctcggtttccattttgatgtatctgaactcagcggaacaaagcaactataccagaggatagagaattccatggaaagggcttttcttctcccttcggcttcgtcaaagcttaaaagtgcaaatggagatttcggaataatagatctacatgtgaggcagtcgatggtcaatgacacggcaaagcatgatggcaccgcagctgaatcagcagaaactcgtcctccaaggacacaagagctagaagcagatcctnccaggtctgaagaaaagctggaacaagggaagattgccctcgggggacactcgaagaagacacaccctcatctgaagaaaaggctaagatgag

SEQ ID NO: 8132 - DNA, 521 bp, Sorghum bicolor
  Clone ID: SORBI-28MAY03-CLUS27569_1
gcacgaggggaagccatccaggctgagattgaggagagctgcccacggggcaatggagactttggccagtcagggtatagcccggttgttttcatcgatcgtgatgtgtcaagtgttgagaagattgcctattatacgatagcggaatgtgtggtggtgactgctgtgagggatgggatgaacttgacaccatatgagtacattgtcagtaggcagggtgcaccaggatctgagtcagtatcagaggtgagtgggccaaagaagagcatgctggttgtgtcagagtttattggctgctcaccgtcactgagtggtgctattagggttaacccatggaatatagaggcaactgcagaggcgatgaatgaggccatttcaatgccagaacaggaaaaacagttgaggcatgagaagcattaccgttatgtcagcagccatgatgttgctttttggtcaaggagcttcatcctagacttgcaaagggcttgtcaggaccactttaagaggacttgttggggcat

SEQ ID NO: 8133 - DNA, 1231 bp, Sorghum bicolor
  Clone ID: SORBI-28MAY03-CLUS27594_1
aagaaagagaaagatgtgtgggaaacccaaacccccgtgaccggcaacggctcgaacgccacacaacacaaatcacaaatcacaaatgcagtcgctccacctctccccggcgccgccaaggccgcccctcccgacgctgaggcggcggccggtgtcctctgccgtggcttcggcgccggcgccgaagccacacttcttctccgctcccagtcttgcggctgctgtcggtggtacctcattctatgccgccgccggaatctccttgccgccgcgcgacctcaccgccgcggctgcagcaggggctggggcggcggcgtccagtccttctgaccctagacctctcgccgcggaggccgagtctgaccccagccctctctccgcggaggccgtggccgaactcgccaagctggctcaggttagcaaaaaactagagaaaacagcacggcattttaagaatttgggtaccctggggttttggtctcagttagtgtgtacatttgtttctgctgggattctgtcattctctgctgttgctacagggaatgtaacagctcccttcacattctgtgcaactgcagttggcatcgtcatggccttcatctcagtcttccagtcatatggttacatccgcctttctgaaaggcttaaaagaacagcaaatgaaccttctaaggctcctgcacgtgcagatgtggttaagaatctgagaaacagtatcgtgcttaatgttgttggaatggctgctgcagttcttggcctgcaggcaactgtaggtactttggtaggcaaagcactcactacgtcagcagtgccctactaccagggaatagcccctggacagagtcccgttcttgctttagatatctttcttgttcaggcttcagccaacacaatcctttcacatttccttgggatatccagctcactggagctacttcggtctgtaacattgtcccaaacagaagctgccccagtgccaaaaccggcattgcgctctgtaacattgtctcaaacagaagctgccccagtgccaaaaccagcacgagcgtggctgcaaagtcctcctgagtcctgagtcctgaccttaagagtatatcaccagtttttttggttgtcttttatattgtatagtccaacgcggaccatggatctccgctcgttttgaaccatatgatcttaaatcgatctaagtttgaatgacagcttccaaacatacgaaagctgcctcacg

SEQ ID NO: 8134 - DNA, 999 bp, Sorghum bicolor
  Clone ID: SORBI-28MAY03-CLUS27661_1
cttctcatatggcctgtcaattctggttctgagagctcagtttggctgatggttcagtggaatcatatggaggagaaggaagcatggcaccttcaagctatttcatgacagctagatcagatctcctggttaaattcagtgtgcgtgaacaggattccactatgcttccaaatgaacagttgacctatgctggtgctggccagactgatctgttacctggtgatactctatctagggataagctttgtgaaaatcttctggagcttcaacgactgcagaataacagcaatctgcagagtaatttagtggccccaggagtgcttcagcacaattcaacacctggggtctttcatccacagttgaatactcctggactttcagaactgcctcatgccttatctagttcaattgatagtaatggaagtgaagtttctgcttttcttgctgatgtaaatgctgtttcttcagccccaactttgtgttcagcattccaaaatgcttcttcgttcatggaaccagtgaatctagaagctttcagttttcaaggagcacaaagtgattctgttttgaacaaaacaagccattcaaatgggaatatctcagtgtttgacagtgctaccttggcatcacttcatgacagcaaagaatttatcactggtaggctcccctcatttgctagtgtcaaggaagcaaacctagcttctagtggtttcaagactcagaagcaggagcaaaatgcaatgtgcaacgttcctctccctgctttcactgcacgtaatcaaatgtcagttgctgcaacgcaaggagcactgatccctcaaaagattccttcatggatcaatgaaaacaaaagtgagggtcctgttagccatccttctgatgtacaaacccaaccaaattcggctggaaatggtgttggcgtgaagccacgagtaagggctcgtcgtggacaggcaactgatcctcacagtattgctgaacggcttcgcagagagaaaa

SEQ ID NO: 8135 - DNA, 688 bp, Sorghum bicolor
  Clone ID: SORBI-28MAY03-CLUS2868_1
gggcaagggtttgcgtgcgaagtgggcaggggcagcggcagcttcggttccgccgttccggagatggggtccggcatgagcagcgcccggcggcgcggctccggcctcgaggcgtcaagggggatgctgcccctgctggcgctgcaggtgctcatcgagtacggccgcgcgggcgcctcccgcccgcccgtcacggccgcgctgctcgccgccaactcgctcatctacctccgccccggcgcgctcgatggggtcctgccctcgctctcgcgcgtctccttcaacccgcagctcatcgtcgagtatggcgacttggtgcgcttcttcctgtccccgttctaccacttgagtgaaagccacctcttctacaacatgacatctctcctgtggaagggcattcagctcgagacatccatgggtagcaccgagtttgcttccatgtctgccgtgctgcttggcctgtcgcagggtatcacgctgctcctctccagaggcttgctcttgctcggtgacgataccgcgtactatgatcagcatgctgttggattctctggtattctgtttgccatgaaggttgtgctgaacgcctggtcagacgatttcgtgtatctgcatgggatgattcttccctcgaaatatgctgcctgggcagagttgatcctcatccaggttttcattcctgggacat

SEQ ID NO: 8136 - DNA, 978 bp, Sorghum bicolor
  Clone ID: SORBI-28MAY03-CLUS33630_1
gcacgggggtcgggcgcccccggggtggacgcctggtggcctctggtcatccctcctggggcggggcatcgcggctccatcagcaacccagtgggacggcatcgcagttgggtttggggcttggcagagcgtggcacgacggtccttccctgcccagcgcctttggccgtgcccctctggcgggccagttttcgagtgtggtggcgcctgtcgtccctccccgcgttggcctcctcccgacgctccgctagccattgcgggcgcacccacggattcggcctctagtcctcctctcccgcagccctcaccggctcctcgctcgggcgcttcagctttgcgcgccgcccgcggtgcagctagagaagaacaaaggcaaccgagggtggcgatctatgagcagcgccggtcttccacggcacaggtcctggtcgatccccctcgctgtgcctggtatgcccgcccgcccgccggcccccgtcctgttcccgctctcaactcaaaggaaatcggtggccttccttgcaagcttgaaggcattttggagtccccagttgttaatggataccgtaacaagtgtgagttctctgtagccttttccgttgtccgcactttggccctggcattttggctcagctattgctggggaggcctggccgctggtggggtaccggtggactgtccttgtgtcgctgggatctcctgcgtattcccccggacgttcctcgttttgctgctatctgcaggcctcccgttgcccggcaagattgacaactctgggttttggcgccaactcacacgccgcactgcgagatggttatgctttttgagaggtgaaggatggttatgatgcctcaaattcttgttagagattttgacctatatatatgtcgaggaccatatcagttttcctcactttggtccatacattttgtaacatctatttgattgagaagccatgacagttgatggttactgttg

SEQ ID NO: 8137 - DNA, 898 bp, Sorghum bicolor
  Clone ID: SORBI-28MAY03-CLUS33629_1
gcacgcgccggcgtcgtcggcggcggcggcagagcggagcggagcgagcgcgaggcgcggggccgcatcgaacgggaggagggagaacgcctcggctcctccccaacaccacacctcctctttccgacaagcgaagcgagatgccgctgtacgactgcatgctgctggtgaagccgacggtgaccagggaggtcgtagcggacctggtgacccgggtggcgcgccgcgcctgccagcgcaacggggtcgtcaccgacgtcaagtccttcggcaaggtcaacctcggctacggcatcaagaagctcgacggccgccacttccagggccaacttatgcaaatgaccatgatggttccaccttcgttcccacaagaacttcactatctgaacaaggaggacaggctgcttcgctggctggtcgtcaagcacagagacgcggtatatggactggagttcatcaacgaggatgacgggaggaacgagctgagcggttacagccaggctcatacgaaggatgactatgatatcgagtttgactctgatgatgaccgctgggacgacgatgactcagacgacgacgacgagtatgcaatcgaggaggaggaagagaaggaggagaagcagaagtagaactgcttcgccaggtttctgcagtctcatctgtattggcagatgcgttttctttgaaaccaagtgttgtctttgtaatatctcttgactttttttataacgttgtaggataggatgagaggcagaacctatcaacttgattttaacacacttttgcattgtcgatcatgcttgtcattagatgtttcaggcgtgctctgcttcttggttggaagcatggtgtataacgtcgttctacggctgctgacagtcactaccaggttatacag

SEQ ID NO: 8138 - DNA, 735 bp, Sorghum bicolor
  Clone ID: SORBI-28MAY03-CLUS33643_1
gcacgaggctcacccctgcttcctcgggcggcggcgccgccgccgtttggcccccccgcgcggccggcccccccccctcacagttccaggcttccggttccggctcacccctgcttcctcgggcggcggcgccgccgccgtttggcgcacgcgcgatgccggcgacggcggaggactccccggcgatacggaagctggggcagctcttccggctgaccgaagtatacctctgggacgattcgtatggcgctggacctcacgatggacggaagaactggcgctcggcggaggctgctctcgtggactctcatacagataaaacatgcaatgaagcatccaatggcactgacaaaggccatttgtttgttgaagatttggaattggccaacctcatgggttctttggggcttcctgtttcattcagcacaagtaaagtgaacaagaacacaggcaacaagggaaagaaaaaaggaagacaagcactgctcaaagcagcaaagactcaaatcaatgatgctgtgaggatatgtgccaatactgaagatagagaaagtgctgttgaatcattggatgttatggcgcacatgcactcatgcaatttatctgggactccgctgggtcacaatgaaccctgccatgatgacactgacaagatgcttagggaagacagtccttgtgttgaagaacaagaagagtctggctgtagcaccatctattcttctgacaaagccccta

SEQ ID NO: 8139 - DNA, 662 bp, Sorghum bicolor
  Clone ID: SORBI-28MAY03-CLUS33648_1
gcacgaggccggccttcttctcccaccggccagacgcccccacttctccaaaaatccgagaacacctcgggctcccgagcaggagagagagcaatgcaacgggccatccggaaagccgcggctgcggcaaggcgagcgctgtcggcggcggcggcgagggcatcgtccgctcctccccgcggcggacacctcgcgcctggctggggcgccacaactaggtggctctgcagcgggcgggaggcgctgagctacgacgtggtcatcgtgggcgccgggcccgcggggctcgccgccgcgatccggctgaagcagctctgccgcgccgctgacgccgacctctccgtctgcgtcctggagaagggctccgaagtcggggctcatgtgctgtccgggaatgtgtttgagccccgagccttggacgagctcattcccaactggaggcaagaggattctccaatcagagttcctgtctcatctgacaagttctggctgttaacaaagaaccaagcatggacactgccatctccatttgacaacaaaggaaactacgtgatcagcttgagccaattggtgcgatggatgggcacaaaagctgaagagttgggtgttgaagtatatccaggttttgctgctagtgagttacaggagtcgcaaccaatgat

SEQ ID NO: 8140 - DNA, 619 bp, Sorghum bicolor
  Clone ID: SORBI-28MAY03-CLUS27836_1
gcacgagggccaacaactgctctcccaagtcccaagccgaagaaccctaggcggtgccggcgcatacggcatcatcccccaccgtagtggcagcgatctccaactccaatagcagaggaggctccgtagaggcggaaaggcgcgaggcttccgtcgagatcgcatcagcagaagcaacgcaggcgtcggcgtgcgacaggagaggacggagatgacgcagaagcagaccctgttcaaggggcagagcaagaagaagaccatccctcccaaccgccacggcaaggcgccccatgttcgtaaagggaagagggccgtcaagcccacaaagttcaccaaggacatggacgccgacaaggaactcaccaagttcatcaaccagtgcaacgaaataaaagctgcaaatcttgctagcaaagagggcggtgacctcaacatattgaaggctgatggcgatcaatctaaatcaaagaagtaggaagtcagcaactgaagttgagtatgtgaaacgtgatatgtagtaggtaatgcgatgtgttctgctgaagaaattcagttccatatggctgggtagatgaatctgtttagcgcaaagtgacggtgtaactgcaaccatgcaacc

SEQ ID NO: 8141 - DNA, 842 bp, Sorghum bicolor
  Clone ID: SORBI-28MAY03-CLUS27858_1
gttttaagtttctgtatagtcatgccacaatagcacgaggctcagtaccaccattccacacggtggataaaatgtacactcgaaattcaaaaggtaaatgaatgaggaaatttagaatgaaagtatacgtcaggtagctatagttattacttgacacaatcagtactataggtaatagagttgcgggcgaggctgcttcttctgttgcaagcttcctacggcatttccaagcctcagaagcagcaacagagttgcgggcgaggctgcttcttctgttgcaagcttcctacggcatttccaagcctcggaagcagtacgttctgctaaaactgaagagtagagcaaccaaagtttcaagcagggccatgcccagacctcttctctcttggtggtatcttcagcaaatgcttcatggtgtcatatgcggtgaaaccaatggccactgagggcaccaccttgatgtaattcaggctcaagccagcaaataattgtttccagccctgtgtttgtttaatggacaaaagaccctggaatgtgcctgttattcgtggcccaccaaattgttcatgatgttgctgactctgaacctgcatctgcctcctgacaacatctaatggataagtaagagtctgtccaaataaaccagcagcggcaccacacgacagcttcaatgttactgaacttctgtaatcttctggtacatgtgccttcagtccttcatatatgtagaacttaagaccagcataaggaagtatccccatgagcgttggacctacacctcggtaaagagcccgtgctccaccttctgagtaaacacctctaaagacatcaattcctcgtgc

SEQ ID NO: 8142 - DNA, 489 bp, Sorghum bicolor
  Clone ID: SORBI-28MAY03-CLUS27866_1
ggccgccgaatcggacgcggtggcttccgcatcaacagtcaggttgatctttacgcccccgactcggaagacgaagatgccatggaggtggctgcggaggtggctccgggcatgaaggtggccgcggaggcgcctccggccgtggagctgcctcgggaggtgcaggcgcgattggagatggtgcttgctaccatcgatccagtgtaccatgatgtcttcatcagcttgtacaaggttatagtgcccgctttcttcaaatgcaactagtagttcttttgccgtgtgttgatgtgggatgtagtagtgcttttgtacgatgatgactgttttatgggacgatgtagtgcttttgtagggtgatgcaatgcttatgggcatgatgtcctacaggtaggacattgacacgttgtactgcttatgtgggataatgaactgcatatgtctgaataaataagtccattgtctgaaaaaaaaaaaaaaaaaaaaaaa

SEQ ID NO: 8143 - DNA, 645 bp, Sorghum bicolor
  Clone ID: SORBI-28MAY03-CLUS27867_1
cgaagttttgttagggcatctataaccgcctccggtttaggcgggcagcccggcaggtagacgtccacaggaattcacttatcgactccccgaacagtactataggaatccgtactgaacatgccccctgtaatactacaggctcccatagcaatgacgtatttcggttcaggcatttgctcatataatcgcactaaagatggagccattttcattgttaccgtaccggctgtgaaaattaggtttaggtccgcttgcctaggacttgatcttcttggtaccaatccataatgatcaaagtagaatcgcaagcctgaagcaaattcaatgaaacaacaacaggtaccatatagaatagaaggggccataaacaggagagtcttgaccaattcgaaagatcatttggtgtagttgaaataacggaattggaagttgtttggtcaagtataggaaattaatataagaatgaataactttctccattttcttggaatcttttatttatcttaatattcattccattcaggccattccaatgctcgcaagcacgaaaaagcttctatttttaaacggaaacgcccaatacatcgaaactcattacccatggataaagcaaagccagtcgagaaaaaaaaaaaaaaaaaa

SEQ ID NO: 8144 - DNA, 1053 bp, Sorghum bicolor
  Clone ID: SORBI-28MAY03-CLUS27256_1
ctgatataagaaacgaaaagaaatcaaatactgaaaaggattgtaggagctcaggcatgtcctctacaagagtcgggaaatcttgcatggatagccctgatgattcagctgatttagtttcaccaaaagagacaactgcatttcaaaagaacgtcaagctttctcacgaaaacaaagaaaacttgaatggaattactgatcaaggagaaaatgaaggcaatgcaaagcattctacagggattcttactaagagcagtgtcgacaaccacaatactcctaagcatggtccaaattttcaaagtcaggggctaaataccagtgcgcaggtgtctaactctaaagacataatattttctagatcaaagccatcagaacttcttgttgataaatctgcagcctgcgttgatgcagattatgagtatgtgaacatattggctgatactccaggtattaaaagaggcttagaatctccttctgcatggaagtctcctttgttcacaccattcccggatgcatacttcatgagcccagctagcagagcttttgatgccttaggattggtgaagcagattaatgagcagagtgctgctgctgtggaggaagcacatgaagttctggcaagtggaggcccatggaaacgacataacaaggaaaactctgacaaagaaaatatagaaaatacaactttgaagcatgaacatgtaacaagcaaacctccatccatactcatggcagaggcacgggtgctcgatttcaatgaatgctccacacctgtgaggaagaaagaagataagaaatcggaaatagctttaggaggatcttcaagctcccctgttacttcctcgtatcttcggatgaatttgcggtagctctttgagggatgctgttgttcagtatgtacatgtctgttgttcctataaataccatttgaaatacacattccaattagtaccttattctttgtgctttggcaccccaaatgtcaattttaaaaggaaacattttttcggtaatgttaagatttgtcatgtgtcacttgaattaagttaattt

SEQ ID NO: 8145 - DNA, 608 bp, Sorghum bicolor
  Clone ID: SORBI-28MAY03-CLUS27287_1
gaagagacaaccccaccagaagcacgtcggtcaaaaaaaaaagagagagaggagaaaaccctaggcgcaccgatcgaagaggagtgcatcgccggcgacgggtacgtgtatgcctgcggcgatccccagagaaggccaagaccgacgcctcctcgagtgacgctgccgctgccactcctactgccgccgagcccgatccgcttctgtactgtgctgactgctgatatgagggccgcgcagatcgatccgtccctcgccgcgccgcccaagtcgcggctcaagcgcctcttcgagcgccaggtgctgcgggtctcgccggccgagcgcctcccgtcggcgcctcccggtggcggggagaagcaggatgaggtgtcggagcccagctcgctgtgcctggacggcatggtgcggagcttcctggaggacggaggcggcgccgccgagcggggagctgctgcgcggtgctgcaactgcttccacgccggcgacacgtccgacgacgaggacggccccgctgcagccgacgccgcagccgctgacatcgcggagaccatcaaggggctcgtccactgcgccagcctccgggagcggaactcctagccgacgtc

SEQ ID NO: 8146 - DNA, 853 bp, Sorghum bicolor
  Clone ID: SORBI-28MAY03-CLUS27301_1
gcacgagggggatgtcctccatggcatacagggcctggaacttcacaggccttgctctccccaatgatctcatcaacagaggtgtggcaaaaggggacgcgaagaagccagagacgctggagctggtgataaaggacgactacccatacgcggcggacgggctcgaaatgtgggcggcgatcaaggactgggtggcggactactgcgccatctactacggcgacgacggcacagcctggaccggtgctccgcgccgcgccccacgccgccaccggctgcgcgcagcgccgccgccggcgcctctgcccgatcgggccccccctcgcctcgcggccggtgccggatccggaggtgacggtgacggtggcggagtcggacttcctggagagcgtcacgccggtggccgaggcgctcgggttcatgtccatctcctcgggcccgctggggctggtggggacggaggtgtacctggggcagcggccggacacggagcagtggacgagcgagcggagcgcggccgaggcgctggcggtgttccgggcgaggttggaggaggtcgcggggaacatcgagaggcggaacgctgaccctgcgttgaagaaccggacggggcccgtggaggtgccctatacgctgctcaagccgacggcacagcctggaccggtgctccgtggcatacccaacagcatcaccgtttgagcggagcgccgccgtagccaactgtgtacgatatgtggactcgtggagtatcatcgtcggaataataaggtggactactggccgtaatagttggcgtttgtagaccggcgctagcttgcgtgaaattctccaccacacaaaataaataaatacg

SEQ ID NO: 8147 - DNA, 661 bp, Sorghum bicolor
  Clone ID: SORBI-28MAY03-CLUS27357_1
gtgcggtgccgtcctccttcctccctcccagacccaggcttccagttccagccccacctcgcctctcccctccccaaaccctacacctcggcccccggccttcggccttcgccgtccccggctcaccgccgcccaaaccccataccgcagcgccagcgccagcgccaaaccgtaccctgccgtgcggtcggccgcgcgcgcggacggccaccccccacggcgccgccgcccgccgccgccgcctttgatgtctcccacctgcgacctcggcttcctctggccccggtcgcagaagagctcctcccaagaggtcatccccggagcggccgcttccggcgcccagcgattggcctccccaccgcagccgagatgagcggcggcggcggtgagaagatgttgctgtttgggtcctttacagaggacgagactaagttgttccagggtcagcctctcaaaagcccaactaaaagcaccagcaaagaatgtgagcggatggagatccagtttggcaccctgaacttttcagtgctgaatttagagaagatatctatttcaagtgttgttcttccagcaaaatcagcaaatggcgataccagtgccatcacaaaggagaatccatgcggtaatgaaaagaaagctgcaggatcaagccttccaaatg

SEQ ID NO: 8148 - DNA, 605 bp, Sorghum bicolor
  Clone ID: SORBI-28MAY03-CLUS27369_1
gcacgaggccgactttttcttcccttcccttcccttccccgcacgacgagtgacgacgacaatccccccaaccccacgccgcggagccgcaccaaatctcacccgcatcgtctaggctccccgctcggctcgtgccgcgaaatttcttgtttccgtccctcagtgcctgagttcgcgacccgtctcgtccgccggcttcgctcgccgacgtccgccggtttcggccgtcgccgcgggggttcgcgaaccgtctggcctgtcggctattccccccgggggtttcaggtttaagcattcgccgtcgtctcttcctcccgcgcctgcgcaccttcagccggtggtggaggtttcgggcctcggcctggcccccctgctccgagtcctcgccacctccgcgcacctgatgagcctggggcgcgcgggctggggctcccgctgcgtcggcacccgcgcgccgccgccgccgccccgcctccgccctcccgcgaggtcccgcgcccccgccgcgccccgtcccccccgccgccgccgctgcgccgcgtgcgtccagacacgatgagctgcggcagcgacgggtgccgtgacggcggcagcagcggcagcga

SEQ ID NO: 8149 - DNA, 826 bp, Sorghum bicolor
  Clone ID: SORBI-28MAY03-CLUS28601_1
gcacgaggctgggctgggccgcgcctctcctcccctgcctcgcgacccgatccgctctgctccgccccgcccccccccccgcccccacccccccccccgcgccctgcccccacccccgccccgaccgcccatggccgccaccgcggcctcctcggccgccgccgacgccgcgtcgaactccgatgaggaagcaaactatgaggagtacatcccagtcgccaagcgccgggccatggaggccgagcgcctccgccagctccgcctcaacaagtcggcgccgacctccgccgcctccaccctcccgctgccgcctcctccgcctcttttgccggcgcaggcctccgttcccgacgccgccgcgaagcccagcctcctcgtcaaggccacgcagcttaagcgcgccgccccggaggtgaccgccacggcgctccgcgtcctccccgagggcgcactcggtgagaatctctcagacaacaaatccctcaggtcagtccgtgagatcgccaagggcatcatctacacggactcgatccagaccgggtggaagccgcccctccgcctccgccgcatgccgctcgccaaagccaacgagctccgccgcaagtggcatatcatcgtcgatggtgacgatgtcccgccgcctgcgcgtgattttcgggacctccgcctcccggagcccatgctccggaagctgcgcgagaggggcatcgtccagcccacgcccatccaggtgcagggtctgcctgttgtgctctctgggcgtgacatgataggcatcgctttcacggggtcggggaaaactctggtgttcgtgctgccgcttatc

SEQ ID NO: 8150 - DNA, 701 bp, Sorghum bicolor
  Clone ID: SORBI-28MAY03-CLUS2861_1
cccggcgctcgcgcgcttcgacctgcagggcatccggaggaagtccgacgtgctcaaggagcgcttcaaccagatgttcgccaggatcatagagcagaggatcagcgccgagcgcgccggcggcgagccccccgcgcccgacttcttggagtacatgctcaagctcgagaaggaaggcggcgacggcaagacatccttcaccatgaccaacgtcaaggcactgctcatggacatggtggtcggaggtacagaaaccacgtcgaacactgtggagtgggcgatggcggagctgatgcagaagccggagctgatggcaaaggtgcggcaggagctggacgcggtggtgggcagggacgcggtagtggaggagtcgcacctcccgcagctgcactacctgcacgcggtgctcaaggagacgctgcggctgcacccggcgctgccgctgatggtgccgcactgccccagcgccgacgccacggtgggcggctaccgcgtcccggcggggtgccgcgtgttcgtcaacgtgtgggcgatcatgagggaccccgccgtgtggaaggacccgcaggagttcattccggagaggttcctgggcggcggctaaaggcgcaagtgggacttcaacggcagcgagatggactacctcccgttcgggtccgggcgcatgatcttcgctgggaacgccatggccgaccggatga

SEQ ID NO: 8151 - DNA, 694 bp, Sorghum bicolor
  Clone ID: SORBI-28MAY03-CLUS28630_1
atctacctctctccacttgcgcttcctctgcctctccctccagctcctctgctccgctccgctccgctcggcctcggcgtgcggtgctcggctcgctgcggctcggtccggcgcgaaggacaccatgtcggcctcggcgtcgtcgccgccggcgggagaggagaacaagcaggaggcggcgccagtcaggcactgcaagggcgtcaacgacctcgacaaggtcgtgctccgcgaggtccggggcagctccgcagaggtgtacttgtacggtgggcatgtgacatcatggaaagatgagcatggagacgagttactttttgttagcaataaggctattttcaagcctccaaaagctatacgtggaggaataccgatctgctttccacagttttccaactttgggaatctggaacaacatggatttgcaaggaatagaacatggtgtgttgatgatgatcctccaccatttccagtgccaacctccaatacagcttttgtggacttgatcctcaaacctactgaagaggatttgaagatctggcctcatagttttgagtaccgcctgagggttgcacttagtcctggtggtgatttgatgctaacttcacgtataagagacactaatgcagatgggaagtcattctctttcacttttgcataccacacatacttcaagatttctgatatcagtgag

SEQ ID NO: 8152 - DNA, 882 bp, Sorghum bicolor
  Clone ID: SORBI-28MAY03-CLUS28675_1
ttcggcacgaggaccgtcggtccaccacttttccccgcgcccaccacgcggcgccgcccgagcacgaccatggcgtcgccgtccatccccgccgctctccgccacccgcacctccccgccggtggaggccttctttttcactcgtccggggacccaacctcgcgctccgcgctctcgtttaggataggagacatgccaatgagaaggtgtcagacagatgttggtcctgttttggctgcaaggagtcctggtttgggcaacgttgacaatctccatcagagttcaagcttgtctaggagctgggatttgaaccgcaagattgatgatgaccacgatgtactcatagaatgtagggatgttcataagtcatttggagacaaacatgtattaagaggtgtcagtttcaagattagacatggtgaagcagtcgggataattggaccttcaggaacaggcaagtcaactattttgaaggttatggcagggctgctagccccagacaagggtgatgtaatcatttgtggaaagaaaagacatggtttagttagtgacgaggatatggagggtgtccgcattggtttggtctttcaaagtgctgcactttttgattctctcacagttcgcgaaaatgttggattccttttatatgaaaattcaagcttacccgaggaccacattggtaaattagtaacagaaactttggctgcagtaggactaaagggtgttgaagatcgtatgccatctgaattgtctggtggcatgaaaaagcgcgttgctctagcacgttcgataatatttgatgatacaaaggatgtagtcgagccagaggtccttttatatgacgaacctacagctgggctcgacccgattgcatcaactgtc

SEQ ID NO: 8153 - DNA, 920 bp, Sorghum bicolor
  Clone ID: SORBI-28MAY03-CLUS27718_1
gcacgaggtttctttctggcacgagggtgtgcttgggagtccttgcaatttgaataaaccaagatcttaccatgactgcaattttagagagacgcgaaagtacaagcctgtggggtcgcttctgcaactggataactagcaccgaaaaccgtctttacattggatggttcggtgttttgatgatccctaccttattgaccgcaacttccgtatttattatcgccttcatcgctgctcctccagtagatattgatggtattcgtgagcctgtttctggttctttactttatggaaacaatattatctctggtgctattattcctacttctgcggcgatcggattgcatttttacccaatttgggaagctgcatctgttgatgaatggttatacaatggcggtccttatgagctaattgttctacacttcttacttggtgtagcttgttatatgggtcgtgagtgggaacttagtttccgtctgggtatgcgcccttggattgctgttgcatattcagctcctgttgcagctgctactgctggtttcttgatttaccctattggtcaaggaagtttctctgatggcctgcccttgggcagggccggctctctggatcttcacagcttcgacctggaactcaaacaagagagattgggtccatgccagctgtctccagtaacacagtgtggaatcctgttgctacaaacaagatgaagcactctgtttctacgcctaatcttgtgtctggtggctcctctgcccaagcatcatcaagttctgcttatggtagccacagaagtcaggatcctcctcaaggtaaccaaactttgcctgttgcagaggatctccgtgctgcaaacaaatctctggttgaaagaatgcgctctgctctgggaatggatgaggacaggtactctgcat

SEQ ID NO: 8154 - DNA, 1252 bp, Sorghum bicolor
  unsure (1)..(1252): unsure at all n locations
  Clone ID: SORBI-28MAY03-CLUS27727_1
gcacgagggtgaactccacctgatgtcaaacaggctcaatatgatcatgaccccagatggaaagtttgtacaaggtttcaatacactgtggctcctaaatttagaagataatcacattgattcatgggatgaaattgtgaaactttcttacttaagaagtttggaacaactccatttgaacaaaaacaggttaaagcatgtgaagtatccatctaatctttcaccagatggacctcttgatgatacagctgctgtgccatttgaaaatttgcaagttcttttgttaggatctaatgacatagacgacttctcttcagtgggtgcgctctacccgctcccttgtttaagggatgtcaggctttctgataatcctatagctgatcctgccaagggtggtgctcctcgttttttgtgcttgctgctcgacttgggaaagttggaatactaaatggcagtgaggtttgcccacgctcacggaaggaatctcaaggacgatatatccgccttgttatgggaaaaatagaatcaaatgacctagaagagatcaaacggctgcaccctagatttgctgaactgaagtcctttcatggtattgaagatgagaagccaacttcaagcacatcgctgccacaaaagatggcttctggtcttatgagtgttacattgaaatgtgtggggccatcaatgggtgaaaagcaaccactgacaaagaaactgcctgctacaacaactgtgactcgggaagttgaaatctttgtgcgaaagcttccttgaaccgaaggacgtcatcctgagactgtctgtccaataagagcgatgccctctaccacaacttctggaggaggacacggcctctctcatggagcttggaattggctcgggcgcgaccatatattgttgtggatgaagacttgaagagagctagccagtcgtcttcagagacgtcaggcaactatatggcgcaaactatacttcagctgttattagtcttgaagagagagaggagagctgacgacgctcttcgttgtccatgtcctgtatatttctctctgcggaaatggtgcacttgatgaatattgtggggggtttgggctacaaaatggatcagcactgtaacaatattttgacaacggttatttgtttttgacaagttttttctcccttcgccaatggtaatgaagggatgggtaagcctatgtcttttgtgatgctcaatttgtaaggttccttgatatgaaaccgngaacttgct

SEQ ID NO: 8155 - DNA, 750 bp, Sorghum bicolor
  Clone ID: SORBI-28MAY03-CLUS27777_1
gcaacccgaaggccaaatcacaccagtgaagtgcagactggcgcgcccccctcatctccatcctgggcagtcaaatccgaacccacagcgagaaatggcggcggcggcgctccgaccggcgatcctccgccgcatccggctctcccccaccccgtccctcgccctcgcggccgccggggcaggggcgtcgtcccacccgcacgcgctggcgcggtggctcgcgcggcccatgtcctcgcacgacgcgcacctcacccgcgaggaagtcgtcgaccgcgtcctcgacgtcctcaagagccaccccaaggtcgacccctccaaggtgaccccggaggcgcacttcgagaaggatctggggctggacagcctggacaccgtcgaggtggtcatggccatcgaggaggagttcaagctcgagattcccgacatggaggccgacaagatcgactcgctcccgctggccatcgagtacgtcgccaaccaccccatggccggctgagcctctgctcgccagaggggaggtgaggcttctcttggttttgtttccgagggcaaataatcggccggagtggcacaggaaaacttgtccctggtgctctgcattgcttcaggtgacgaatgatgatgtcgaaatggaacattaacattttgtttttttttattacgatgcaatgcaatgttagattgctgttttttgtgtgtgcgtgttatatctatatactggttgttgacaaaagagtctggttgatt

SEQ ID NO: 8156 - DNA, 654 bp, Sorghum bicolor
  Clone ID: SORBI-28MAY03-CLUS27801_1
gttctcgcccccccttgtcgcggagcagagcgagcagcggacctctccagggagcgcgccgcggacggaggtcagcgaagatgcccgggctcacggcgccgtccgactacgcggaggagccgccgcgtcacccggccctcaagatcaactccaaggagccattcaacgctgagcctcaccgatcagcgctagtcgcatcatacatcaccccagtggatttcttctacaagaggaaccatggacccatccctaaagtcgaggacctctcaagatacactgttaccatttctggtctcatcaacaagtctattcagctatccatgggtgacatttgggctcttccaaagtacaatgtcacagcaactttacagtgtgcgggaaacaggaggactgcgatgagtaatgtacggaaagtgagaggtgttggatgggacatatctgctcttggaactgcaacttggggaggtgccaaactatctgatgtccttgagctagttagaataccaaaactcagttcagtcacatctctaggcgggaagcacgttgagtttgttagcgttgacaagtgtaaagaggaaaaaggtggtccttataaggcatctattccattgaagcaggcaacagatcctgatgctgatgtattacttgcatatg

SEQ ID NO: 8157 - DNA, 515 bp, Sorghum bicolor
  Clone ID: SORBI-28MAY03-CLUS27816_1
gcacgaggctctacttcactaggatcgtcgtgtatgcgctcaagacggttgccagctacaagtaccggtgggtgagcgttttggcagaggagatggccaccctggcgttctacctgttcatgttctacacattcaggccggccgagaagagccactacttctctctcgatgaagatgaagaagaggccgcagagatggtgctccgagaagaggaattcgagctatgaggagatgcagcgagtgattcatacgagagtctccatgccacgttcgtttgatcttcactccctgtgatcttgatcatacttcaaatgcccggccggacacggctttgtatgtaccgatgggatgtgagatcgttttgttcttcttgtagatttcagatttttactagtattttactgatgaaacacagattacttaacttataccaccatgttcaagaagttttcttgcttgcaatgcaatcagcagcaactactcctgtttcggcacaaaaaaaaaaaaaaaaaaaa

SEQ ID NO: 8158 - DNA, 681 bp, Sorghum bicolor
  Clone ID: SORBI-28MAY03-CLUS27822_1
ccggaagccgctgctggtggccgagttcggcaagtcgcgcagggaccccgggtacagcggcgacggccagcgcgacgccgtgttcgccgcggtgtacgccaaggtctacaactcggcgcgcgccggcgggcccgcggcgggcgcgctcttctggcagctcctcacggaggggatggactcgtacggggacggctacgaggtcgtcctccggcaggcgccgtccaccaccggagtcatcacgacgcagagccggaggctgcaggggctcgtcagggcgttcgtgcgcgcgcgtaaggtccagcgcgggaagaccggcaagggcgccaagggcggcggcaactgaaagtgatgggctgcagtctgcagatcggggtggagaacgcgtctttgtcgtgcgtttgggggtcgtattacgtgtgtggcgagataagttgaagagtgtgtgtgtgggtgtatcgatgtctcctcgagatgatttgaagattcatccgggaggcaaggagttgtgtacgtgtaggtggcgtcgtcctccgtgtcttgtgttcttgtggatcacgagaggagccaagttacatgcaaaggctgtggaagaactatgaagcagcctctgctagtaaggttacaacttcttatgatttatatggagagaacccttcttttctaaaaaaaaaaaaaaaaaaa

SEQ ID NO: 8159 - DNA, 422 bp, Sorghum bicolor
  Clone ID: SORBI-28MAY03-CLUS28816_1
gcacgaggcctcgcctcactttcattctgcgcccccgccggtggagctccacgacccacgcgccatggccgcgaagcaccagcagcagcaccacttcctgatcgtcacgtacccggcgcaggggcacatcaccccggcgcgtcacctcgcgcgccgcctcgccagcgcgtgccccggcggcgcgcgcgtcaccatctgcgccccgctgtcggcgttccggaagatgttcccgggcgccgccgccgctgtggctgtgacgggggaggagtgtggcggcgacggcgacggcgacggcgacgagagcgtcgcgtacgtggcctactcggacggctacgacggcgggttcgacgtcgccgtggacagctacgcgaggtacatggaggaggcgagggcggcggggtctcggtcgctggcccgtgtgc

SEQ ID NO: 8160 - DNA, 1159 bp, Sorghum bicolor
  Clone ID: SORBI-28MAY03-CLUS28861_1
gcacgaggctagcacctgcactccatatgggtccgcggtcggcgatgggatgttcgtccttgccgtcctcccgtgctctgtggctcacgacggccgtcgtcgcggcgctcgccgccggcgcgcaggcgtcgctgtcgccggggttctacgacgcgacgtgcccggggctgcagcccatcgtgcgccgcgtcgtggcgcgggccgtccagatggagccgcgcatgggggcgtccctcctccgcctcttgttccacgactgcttcgtcaatggctgcgacgcctccgtcttgctggacgacgtgcccggtagcttcgtcggggagaagaacgcgggtcccaacgccaactcgctgcgcgggttcgaggtcatcgacgccatcaaggcgcaggtcgaggcgtcctgcaacgccaccgtctcctgcgccgacatcgtcgccctcgccgcgcgcgacgccgtcaacctgctcggtgggccgaggtggtcggtgccgctaggccggcgagacgcgcggaacacgagcgcgaacgcggcgaacgccaacctaccgccgccggacgcgagcctaccgacgctgctgtccatgttcggcgccaagggcctggacgcgcgggacctgacggcgctgtcgggggcgcacacggtggggcgcgcccgctgcgtggtgttccgctcccacatctacaacgacacggccaccaccaacgccaccttcgcggcggagctccggagcaccgtctgcccctacacgggcggcgacgccaacctggcgccgctgaagctgcaggcgcccgacgtcttcgacaacggctacttccgggacctggtcacccgccgcgtgctgctgcggtccgaccaggcgctgtacgacggcggcaacggcaccacggacgcgctcgtgcgcgcctacgccgccaacgggacggcgttcgccgccgacttcgccgccgccatggtcaggatggggaacctgggaccgcctgccgggagcgccgccgccgccgccaccgaggtccggctcaactgccggcgagtgaactgatccagttgctgcgcgcgcggtgccactgcgttgcattaattgatcggtggaattacagttacttcttggtgtacacttttgcttcgattcacagaatgacagaagtacgtagtatgaat

SEQ ID NO: 8161 - DNA, 1106 bp, Sorghum bicolor
  unsure (1)..(1106): unsure at all n locations
  Clone ID: SORBI-28MAY03-CLUS2889_1
gcacgaggtccacctccactccgtcttcctcaccgacgccgcgctgcgccggatggtcgccgcctgcccccgcctccgggagctccgtctgcgttactgccgccgcctgcgccgcgtcgacttcagcaacgtcggggtgcccaacctcaggagcttcaccgtcgtcgactgctcccgcaccaccgagctgcgggtcccggtcgcgctccgcctccggtccttccgcttcagcggcgccttcctctccagcaacatcctctctggcgccaagggctctcttgagcatctctacctctgctctggcgggccagagaccggccttcccacaaccaacttgctgtacgcagttcctcgcctatcgaacctcactgtcctcaccctctgcagcattgccctccagtatgtttcttccacagccaaggctgtaacggagagcaacctgcatagtctgagggagctccatttgctcatgttcgggatggccaactccaaccttgctgacatctatagcttcctcaagacctgcccgtgtcctcagttggagcgcctctttgtgcagctcccgacaaataccggtgatgcattcacggagaatttcttgaaggtggcggaggaggacccaccaaaaggtggattagaaaacctttgcttagccaagatgacaaatttcaaggggcaccgtaatgagatgcaactagtaggatttctgcttagaaagtctagtagtctgaagaaactatttctgattgctcctaaggaggatcaccctcaaggactccgcaagattcagtcagatatgctgcctgatcttctaaaaaaagaaatattgcatctggaaagagcttcagcaaatacccagatatttttcnagtgagccctgatgctcagacccagccattgcattcggaggtctttgtcaggttttagcttgaaatgagcaaatgttgtagtagtccagtttctgctcctatagttttagatttctagctgttagataacagacatggggaaaaagtgtactgcaaggcatacacagtttgatatatgttttactttttgcaattcatattacattattactaaggaagtcactcatgcatagtggt

SEQ ID NO: 8162 - DNA, 1026 bp, Sorghum bicolor
  Clone ID: SORBI-28MAY03-CLUS2894_1
gccggccggtttccgagcgtttgtccgtgtctgtgctgtgtccatggcgacgcagctcgcgacccgcggcctccccctcgcctctcgcggccggtcttcctgcgccgcctcctgctcctcgtgcccgccctcgtctccccggctcggtcgccggcctagccgccggttccgctgctcctcgccacaggtcgatgcagcggcggcaccgccggcgaagggcggcgagtaccggccctccttcgcggacgacctcctcctcgccttcttccggagcaagatggtggaggaggttggatgggattccgaaaagcctgggtatgctgggctaatggaggtagcaaaccgtctcatggtcaagggaaagagtgctatggagactgagcaagctgctgtccgagtactacagtcattgtttccacctgtcttgcttgttctttacaaagctcttttatcgccaattgctaatggtcaactagctgccatgatgcttgctagagcgactgcgctttcatgccaatggttgatgggcccatgctcagttaattcagtcactctgcctgatggaaaatcttggtcaagtggggtgttcgttgagaaatgcaagtatctggaagagagcaaatgtcttggcatttgcatcaacacatgcaaactaccaactcagactttcttcaaagatcacatgggcgttgatttgtacatggagccaaattttgaagactatagctgccagttcaacttcggggtgccgcctccacctcttgatactgacaaagccctcaaggaaccgtgcttggacatctgcacaaatgcgaggcgacgcagagaactagggagaaatagtagcccagatgagctcagttgcccccaagtttaatatgcaccttgcacatcatagataagaatataagatgtcataacccggtaatggtataggtacccttgctttgattattgcacattgggcaaggtgtgttactcaactctgacagtcttcgttcagcaatgtcgagtaattttggcaat

SEQ ID NO: 8163 - DNA, 655 bp, Sorghum bicolor
  Clone ID: SORBI-28MAY03-CLUS28991_1
gttgcagcctaaccggcatggatagccagagttctatgcacccacttgacccggcattttgccggccaatgaattcgcaacatcctttcctcaacggtgttagtgatgctgcatctcaggtcgggactttctggcaagacgaccttcaaagcgtagttcacatggatatcgggcaaagtcaggagatcgctcccacctcttcgaatagctacaacggttcactgcaaacagtccacatgaaaatggagctttgacatagacgaaattcagtccaaagctcgacgcccctgtatatacagaagagagcacagcttgcagcggaagcactctgagattcaacctaacaacgttgggccctagcagtgttttagcttctaattttccccctggtgtaatgattctttgaacaagatgtgaagatcaccacgctggcggttggtcgcctgttttagctgcaagatcgcccgcaaggaatgaaatgcggtgcattgcatcccagtatattctcaatcagacccttatgctcccctcaagcgagagggaagaagacctgtaatatcatttgtattgccattatatttgtagctgatatatatatttaagatccctattcctgtcattcctgatctcctgaagatgaaatccccgttcccga

SEQ ID NO: 8164 - DNA, 760 bp, Sorghum bicolor
  Clone ID: SORBI-28MAY03-CLUS27877_1
gaccgacccttctctagcgtcgttggcggcggcggagcaggtgccagcgcacggcgtcagggaccatggcgccgccggcggagccacgccgaccgtacaagagaccggccatctccgaccagcagcgccgccgggagcttgccctccaggcgcagtccgcccggcgcgccgacgcccaggcgcgcgcccgcgccctcgccacttccctcctcaccacccaggcccctgccgcagccacccgtcgccacgaggaggaagagtacgacgagcatgtggaggaggatcaagagcacgagctcaccgtcgctggcgtcgcggcggcggcggccgcctccaggctccgcggcgccgacgcgcgccggtggttcgcgcgccagatcatgcttcctgagtggatggtcgatgccccgccccacctctccaccgactggcatgtgtttgcacgaccttctggcaaacgatgtttggttgtgtcatccaatggcatgacgatcagcagggttcgtaacgggtccatccttcatcgcttcccttcggctctaccgaatggatcaaagagagatatttctggcccagcgagctcgtactccattcttgattgcatttttcatgagcctgatgaaacatactatatcattgatatgatctgttggagaggctattcgctatatgactgcactgccgagttcaggtttttctgggtcaactctaagatcgcagaaacttctgctggtgatcctccgtcaacgtaccatagata

SEQ ID NO: 8165 - DNA, 709 bp, Sorghum bicolor
  Clone ID: SORBI-28MAY03-CLUS27880_1
gcacgaggcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctgctagtgatttgtaatgaaccctacatgtacataggagaactctagacccgcccccctgatcgtgatcctcgtacgttgtacagtaggtggtgtatagtattagtatgtagtatagtttatgagtgatgagatgtgctgctatgacagtgtataaaaatgcgggaaggcaggagctgggttatttcccagcactgcatcgtctggtctcctagtagtagtagttttatttgtgtggacatgttacatgatcttacaaggctgggacacgtggcaagaggctgctggttttgtcggtgagatgatgtgacagtcatttgtctctcgtgaccagttacttagcttgttattactagtattatgtacctgtatctgtatgcatattattaaataatatgcacgagacatgcagtaacttttttcccctatctaa

SEQ ID NO: 8166 - DNA, 793 bp, Sorghum bicolor
  Clone ID: SORBI-28MAY03-CLUS27985_1
gatgaacgtgaattgaagagggagaggcgaaaacaatctaacagggagtctgcaaggagatctaggttacgcaagcagcaagagtgtgaggaactagccaggaaggtagctgacccaacaactgagaatagtgctctcagagcagaacttgacaacctcaagaaggcttgccaagacatggaagcagaaaattcacgtctattgggtggaatggctcactcccagggaccaagtgtcacaaccacattgggaatgagcattgacccaccaaaggtgcagcatcatgatgatgagggccagctccacaagaaatctagtaataacagcaacgggaactatgcgggagtcagccacaaaccggaggctaacactaggtgagagagacaaaggtggtgaggaaagtgacaaagatgagatgaggtgtttcttatctaaccacaacacccatcatcaatcagtgtgttttttcttagcaaagctgtcgttttagtcctcacagcccgctgggggccatgtagagtcgccccactgcagccatgtattatttatggctcgtcgcggtgtgctttgtgtctttgtgtgttgtgtaaacctattgatgtagctattgtaacaaacctagagagcctagagtttttaatgtttgctaactcctgatgagggatgtaaccggccaatttggtgcctgatcgatggttagatgaaatgcgagcaaatatcatttgatagcctgcctcgctttgttgtttggatggttgcaactttgtgggagagaattttatatgggttattg

SEQ ID NO: 8167 - DNA, 697 bp, Sorghum bicolor
  Clone ID: SORBI-28MAY03-CLUS28373_1
ctgctgtggacccccagttctactcagagcgtttcttgaagttcatccagaccgtcttccctgagaattcatagctcagcatccaatacttgtttgaaagatgctcactcgctgccgttttgttagtgatgttggccaagcacatgaaacctcatctgcatgacagttcatgtcttcaaaattggagcttgcaagcatcagaaaaacactacactctcttcagtgcatacctgttccttcttggatgaactagcgtgcatgttccttcctggatgaactggcaagaagaatggccaacaagatgagattcgtcagggcaattttgcagaagcaaattgatcttctcttggttttgtcccgagcccctgggatcagcttgctagcttcgcggagtaggcatggcatactggtctggagcaaggctatcctgtgagttgtgaggattctactgacaacggcgccatggaagtctgggaatcactatgtttatatttatatctcgacagttgcagaaagctaaaccaggagcagcttttgcctctgggtcgtgttttcatatgttaaggtgctatatggaggctatttgtaataagaacctaaaaatatgcatcaatatcaaatccatttttgtaggacaaaaaaaaaagggaatatgtattgcaaaatgaaaagaaatggaagcaagaataagaaggcc

SEQ ID NO: 8168 - DNA, 1225 bp, Sorghum bicolor
  Clone ID: SORBI-28MAY03-CLUS28471_1
aaaagaaaatctaaacattttgctgaaggatgatgatggacaagctcttgcaggaggatctgctttgcttcacagagaaactggtgctcatataataggtacaagtaggagtactgaagaaagaagtggagagtgcaatcacttgagggacaaagccatcactttggacctactgttgggtactggcaattccataacaaatagtgatattggggatttatacaaagaaaacactgatgatatcctcatagacaatcaaggagccaatgaagcttgtgagcagttttataaggcaaagcagccttctggaagttcttccaaagaccagaacatttctgctgcagcagaaatgaagaataattctccaccagtggaactgaagaacactagtgctgcagttaaagttgagagcatttatgctccagttgaagtagatagcacttctgcaccagcattggagcaagagtcattccttgaaaagtcaccctcgaggaagcctgtctcccctgggaacaagcaggagctggaacctaagacaaggcagaagaagaaagtctctttctttaccaagaagcagaggaaagaggcctccagaactcctgatgcaaaggaaaaaactgagggcatgtcctcagctgcaaagaaccaaaggagcacggcctctgatgtagcaaaggagaaaactgaaagcacaccctctgctgcaacaggtccaggtggaaagaagcgtaaatctggaattgaacctgcaaatgcagagaagccatcctcagcagtgaagaagcagaaaactgggaagccatcctcagcagctacaagggcgccaaaggctaaaaatgcaggcccagcaacaaagaagcaggagactgaaagctcatcctccacagagaagaccgcgagtgcccccctgaagttgcaggttgagaaggctgtactggttgtaaatagcaggaggagccaaagggtccgtaagcccaaagtttttgctgaatgaagaagcagatagaatcgtcttaggctctctggtgtgtatgtatcttgtagcctcgccaccaaaatcggtggccatatcaacataggaagtgctggatcgccgcacaagttagactttagtgtacatatatcagctctgcctaggtggaagaaagtctcacccaaattgtagatttgtggttggtgtttttaacccttctcttctggggtaccagattaacaatgtcatgct

SEQ ID NO: 8169 - DNA, 910 bp, Sorghum bicolor
  Clone ID: SORBI-28MAY03-CLUS2845_1
tcgccgaaggcatcaagttcaccgcaggatacctccagagcacgggcctgaacctccaagagctctgcgtgagagcagcactcgcaggtctgtgcttccatggctatcagaagctctcgtacttgatcttgtcgcgagtgtcaccggtgacacactccgtcgccaactgcgtaaagcgtgtggttgtgatcgtctcctccgttctgttcttcagcacccctatttcgcctgtcaatgcactaggaactggtgctgcattagcaggtgttttcctttactctaggttgacgagaaccaagaagccaaaggatgcataagcagggatgaaaaagattacagtagttcatgagaaattacaggtttttgaggtatagagatttgatcaagattagaatctcaatgacgatacgaacaagcattgtttctacccagttgtacacttgtaccacagggaacaggcaacagctatttgcagagttacaagaaccatgaacgaatatattctcaagtttcaccagacatggacgtggtgttctctagccatattatatgattattaggattacgtcagaccacggcaaacagctgtctacgtcattgtgtggcagtccacgcgacacaaatcagcaagacgctgacgcatgggcagaagcagtatgatacatatacaagtgcaacttgttgagattccgaggtccaaaccgagcagcctctgtagcggctacaaaactcgcatgagcagagtcacatacgtgtaggatgatccttcaacacatgtaataacgtccgctcaattcaatataaaaccatgcgggcagcatttacaaacaaaaaaaaaaaaaaaagggcgttttgtcagttttggatggagatgctgaaaactgacaccacctgttttcactatatgcat

SEQ ID NO: 8170 - DNA, 853 bp, Sorghum bicolor
  Clone ID: SORBI-28MAY03-CLUS2922_1
cgtccgcccacgcgtccggacgacatacttcaaaccatttgctggatattatttctcgggtgatggctgcagcagggataaagatggttaccactggctgactggaagagttgatgatgttatcaatgtgagtggacaccggattgggacagccgaagttgagtctgctctggtttcacatccaaaatgtgccgaggccgctgttgttggtattgatcacgaggttaaaggtcagggaatatatgctttcgtgactttggtagatggtgttccctacagtgacgatctacggaaaagcctcgttatgacggtccgcagtcagattggcgcgtttgctgctcctgacaagatccactgggcacctgggctcccaaagacgcgaagtgggaagatcatgcgaagaatcttacgaaaaatcgcatccaggcaactagatgagctcggagacacgagcacgcttgctgaccccggtgttgtggaccagctgattgtgctcagtgacagctaatctatcggctatggggggaagacatgatcactgcctgcactatatcacctgaaaaattcagcttgtatgatgcgaggtctgttgggcccagctttctcttgattgcttcggtgtcgtggggatggcaacaaaagagagatgctgcaaacttggggattgatgcggacatggacatgcggtgcgtctgtaaattgttgggtcgcagtcacagatatatacagtatacactagtaaataacgttataaattgtatgtgcgagttttggctaaaatgtttaatgataaatctcgcattttatggctgcaacatacaggattcaggaagaagattcttaggtgttcttg

SEQ ID NO: 8171 - DNA, 800 bp, Sorghum bicolor
  Clone ID: SORBI-28MAY03-CLUS29251_1
aacaaatggagagaatagaaaaatggaatagtggtgaaaaaattggtgaaagggctgcatctgaatggcttttcatagttccttggggccttcgtaaagtacttaattatatagtgaagaaatacaataatccagtaatttatattactgagaatggcatggatgatgaagatgatcaatccgcaacacttgaccaggtcctaaatgacacgacaagagtcggttacttcaaaggatacctcaattcagttgcacaagccatcaaggacggagctgatatccgtgggtactttgcgtggtcattcctggacaactttgagtgggctatgggctacaccaagaggtttggtatagtttacgtcgattacaagaatgggctgtccaggcatcctaaagcatcggccctgtggttctcgcgcttcctgaagggcgaggctgccgaaaacaaacctgatacaaactgagcgaacagcccgcagcaagtacagaacattacatatacacacactacacgtctcttctgttgttgtatcttacagtgagcaccggtgtatgtatgtatgtacgtaatagtctcagatgtgcttcctgcctatacctagtctgtcattgatccaacactagctgaaatgtattctccgagaatcagagcctcagcaccaataagctttgaattcatgccaggcagcagtcacagatagctcacacttgtcttctgaacacccatgcattcggcattattacactgtactgtcactgttgtactattcacctgtaagtaaggctgtatggcattaccg

SEQ ID NO: 8172 - DNA, 872 bp, Sorghum bicolor
  Clone ID: SORBI-28MAY03-CLUS29296_1
ataaaaaaggatgagaaggcatatcatgttaacttgcttaattaccattccaacatggttgaaaccttgaagaattggaggaagagatggctaagttgcggtgatacagagaatttcttcagggataaccctggtaatcagatgcaaggagttatgcagctgaaagctactaagagtgtaatgcccatgaaggttgcacaaagaattgatgtttcaaagtttatgtcatacatcaaggttagtagaacacagctcaaccatataaagagactgaagcaatctggggatggtattcagaccaaacatgtttcacgtgtaattggtggccttgataaatcccatgtaaaaccatatggagctttactagaggatgaacagaggagactgcgtgagcattggttgaaaatgtcttgcaatgatctacctgctttctttgaggttcttagggaaaggaaggtgctgatggagaaatcaagaaagttattaggccttgagcttgaacagaagaatgtatctgtcttgagaaaggttcgctgtgacttgcccttcaaatctttatcttaagtcctctatttttgtcctgagggaagtcatttacttgaatgtataaaaaaatacagtggatgataccagtttatgcttacttctgttatgtatcttgcccttttacaatgtatcatagcattcccccctatagatgagaatccctgacttaaagatactgaatttgtaatagaggcatttagtatgaaagctgtaggtaatatttcattatgaatggggaattaccctgcagggttcccttatttgtataagttaattatattgtcccattctttgttgtaattttcataatgaaaataaattccttt

SEQ ID NO: 8173 - DNA, 641 bp, Sorghum bicolor
  Clone ID: SORBI-28MAY03-CLUS29387_1
ctgccccccccgtggcggccgcggcggtgcccgcaccgactgggccatgcacgaataccgcctcctccccgccggcctcaacctccacggctgcgccgccaacgcgcctccgcccactaatgtgagctcccttgccggtggtggcgcggcggccgactgggtggtctgccgcattttcaggagggccaggccggcccaccgcgcccgccttgttggcggcagggaagaagaagaagagcacgcggcggaggagagcccgtcgtccccgtcgtcgtgcgtcaccgacgcctccgaggccatggaccaggaagaggatgacggcgacgaagggagcagctgcagcgtcgcctcctctaattgagactgagtagaagagttggctagcccgtcgatcaaatcacgggcgccatgttctaattgccgtagaaccctcatcagtacctagtagcaatcaatagagagaagaagatcgagctccaacaaaccatgaacaacaacaacaaccaaaaaaagaaaagaaaagctaagagctttggtgctatgttgttgttggagactcgtcgcgaaatccaatccagagtgttaattagcgagaaattaatcagttccctttcggcaattaatcaccatttcatacctgt

SEQ ID NO: 8174 - DNA, 814 bp, Sorghum bicolor
  Clone ID: SORBI-28MAY03-CLUS29347_1
gcgtgcttctggtaaagttccaggagtagctgatgaacctcctgcccatgaacataatcaagcacccagacaatcgagccaacagaacatgtcaggccaccatggctatgaccaccctcatccggagaagcaaaactataggatgccaccaaatgaagcaagggatggcactgctaatagcaacgaaggtcccaatgtatcatcctcgatgatggatgcaatgaagaagataaacaaggataaggtgaaagcggccctggagaagcggaggaaatcgaaaggtgacctttcaagaaaggctgatgtgatggatgatgatgacctcattgagagggagctggaacatggcgtggagttggctgtcgaggatgagaagatcaagcaggagagaaggcagggctggcctcatcctgcacaccgtgtagaccaccagagcaccaaccgtgagaatactgaagagggtgagctgtccatggacagtcaggaataccattctccggagcatgacaatcggaagagaaaggatgcacatgagcaccggaactatgatcgtgacgaaagggaccttaaaaggttaaggtcttgagagtttcatgttgtttggactataacatgatgtggaacctatctttctgtcactggtgtacttgatgcttatttgctgtgctgggggatttgaactgtgacatatataagttaagatggtttccccacggatcatgtatgtgttaagccatgttggcaattgagatgacgctgtgacttgagtattcaacaggtttatgctggaaacaatactattaaggaagctaca

SEQ ID NO: 8175 - DNA, 975 bp, Sorghum bicolor
  Clone ID: SORBI-28MAY03-CLUS28692_1
ccgagacggcacgaggaaccagtggaagtgggatctctctctctcgctctgtcgtctccgccgcgactccgcaccaaatcccctggcccccaaaaattttgctagggtttggtggggaggaaatctaggcatccagccgcccaggcccagcaatccgatagaatccgctcgttggagaggccatgagctcggcgcaggatccgttctacatcgtccgggaggagatccaggactcgattgataaactgcaaagtaccttccaccgctgggagcaaactgcttcaaacacaggagaatatgttcatttgacaaaggagcttctgaccagctgtgaaagcatcgagtggcaggtagatgagctggagaagacaatctcagtcgcatcaagggatccagcatactatggacttgatgaagttgagctttccagacgaagaaactggactggttctgctcgtaagcaggttggtacagtcaagagagctattgaaaagggcaagagcaatgcagcaacttcaaaataccaggatacaagcaggcccaaccactattctgcccaagacaatgatgactttatttcttcagaatcagataggcagcttctactcatgaggcagcaggatgaagaacttgatgagctcagtgaaagtgtccaaaggattggtggcgtagggctaaccatacacgaagagctgtctggacaggaaaggatccttaatgacttaagcttggagatggagactacttccaacagacttgactttgtgcagaaaagagtggccatggtgatgaagaaggctggcatcaagggtcagatcatgttgatcgcattcctggttgttctgttcattattcttttcgtttcggtgttcttgacatagccaagcgcaccaggggcctcagttttcctccatttgtcgtgcctccctactgtaagttgcggtgaaacataaccttgtacggagtaccgatcct

SEQ ID NO: 8176 - DNA, 840 bp, Sorghum bicolor
  Clone ID: SORBI-28MAY03-CLUS28741_1
gcacgagggtcgcgaggactggtccgccgacgagttccagcggaacgtcgtcaaggagcgcgagggcaagcgcccgctcctgacgggcgatgtgagcctgaccatgcgcgacgggcgcgcccccgggggcgagctccagttcacggacaactcgtcctgggtccgctgccgcaagttccgcatcgcggtacgcgcggtccccggcaccacctgcggcgacggcgcccggatccaggaggccatgacggaggccttcatggtcagggaccaccgcggcgagctctaccgcaagcactacccgcccgtcctcgccgacgacgtctggaggctggagaagatcggcaaggaaggcgcgttccacaggaagctcaagcgcagcaacgtcggcaacgtgcaggagttcgtccggatgctcatggtgaagcccgacgagctgcgcgcgattctgggcgacggcatgaccgaccgtatgtgggaggcgacgaccaaccacgccaagacctgcctccccggcgaccaggtgtacgcgcacgtcacacagcacggcaccatctacctgaactccatcttcgacatcctgagggtcgacaccagcggcgtcgagtggccgctgcagcagctcaacaggggacagacgatgatggtgcagcagatgctgctggacgcgtacgagcaccgccacagcctgcaggaggccgaagccttcatgctccatggccacgccgccaacaacaacgttccactgctgcagaatgcagcagcacatgtcgcgctgccggcgccggcggacaccccgctctggttcccgaacgccgcggagatggacttccccgtcgacga

SEQ ID NO: 8177 - DNA, 654 bp, Sorghum bicolor
  Clone ID: SORBI-28MAY03-CLUS2876_1
tttcttaacagtacaggtagtttgttgaatgttacaaactagtgtacatcattataggtcagagggtggaaccagtaggaatttgtcgatatgaagctttggattaggttaagcagtcacgaccaagttacatcgcacttgtaagttcttctggaatcaacacaagtatgaccacaccatcatgtgtcgttttagtgggcagtatgagatttcttctcgccagtagcaaaaggtgttgagcagagagcacctggagtgatgacaggggaacaatacgagctcatatccggtcaaatgtgatttttgttggttcaaggtcaatgctagtttttcatgttgcttcaaccacacagaagggatggtggtttttggtatcctgaataattctacagttagaaggcaggagatatctcagtctcctagacgacattggaccatagagattttcctttgtttcgctcttatttttgttcagcggtggaattcccaagtactttgaggtagccttgtgtgtaatctgtcctcaaatttgcaacatgtatatttgtttcataataactcaaatctgcattagcttctttgggttctgatgtttaattactttctgaactctgtaattttgttacgtgagtaatgaaattcagtttcgacggc

SEQ ID NO: 8178 - DNA, 702 bp, Sorghum bicolor
  Clone ID: SORBI-28MAY03-CLUS28796_1
atctggaacgagaacagttgaccagaacgtttggggggagatacgcaacttcaagaagtgcctgctgaagatgtttgcgcagcaggacaaggatgtggtgtttatggagactgtcataagcctggccagacaacggagacactgcatgattgagtgcatccctgtcccttctgaagtgtcaagcaatgccccaatgtacttcaaaaaggctatcgatgaagctgaagaagaatggacccaacatgagatgaagaaggttatcccgacaagtgcaagccgcaacctgaggcaagtcattccagagaactttgcctacttccatgtggagttcgggttggaccgtggctttgttcatgtaatagatgatgagagcaagttcagtgctggatttggattgaatgtcattagagggatgctccagttgccagaggaggacatgcaccgtcgtcgaaggcacgagtccatggataaccagaggcaggctgttgctagcttcatgaaggactgggagccctttgattggacgaagcaacttgattgaatgtgaatacagttttgagaacacttgcttgcacgacttgtactaaaaagttttgtaggaaacttgtattgatgtataactgtatttgtcttgtcacccaacattatgttttcctgttcttgctgtaaaatgatattgctcagtcaatagcatttaaactg

SEQ ID NO: 8179 - DNA, 754 bp, Sorghum bicolor
  Clone ID: SORBI-28MAY03-CLUS28798_1
gcgcattgtatcactatcatcgtcgttattagctgacacagtcacacagatcatgcagatcttccaagtgacgacgatgatcctgcagcctcggttactctcatggttcttctccacactcctgctcacacaactgatgatggcgtctactgcggcggcggagtcgacggtgaaagtgagcaccaccccgatcttccctcagatcccactgggccaggcgaggaaggacttccaagttctgctgcgcgtcgaggcaccgacagcggcggtgcgtcccgaggcgcgcgtccccatcgacgtcgtcgccgtgctcgatgtcagcggcagcatgaatgacccggccgcagtgccaccggagaggaggccgacgacgtcgaggctggacctgctgaagacggccgccaagttcatggtggccaaactcgaagacggagatcgcctctccatcgtagcgttcaatgatcgacccgtcaaagaacttagctccggcttgctgtacatgtccgccgacggccggagaaaagccatgaagagtgtggaccagctcgaggcccgtggcggcaccgcgctcgtgccggccttcgaggaggcggtgaaggtcctggatgggcgggtgggagacggtcgcaaccgcctgggtttcatcgtcctcctcaccgacggcgaggacacgagcgggttcacgctgagcgagcggcgccgtgaggtgatccgtggcgccctcggcaggtaccccgtccacaccttgggcctg

SEQ ID NO: 8180 - DNA, 666 bp, Sorghum bicolor
  Clone ID: SORBI-28MAY03-CLUS29556_1
atcatgctgctacatcaagcatccttagagtgtttaatcataaaagatcttccgcaaatgtgatcacgtcatcctctggcctctctcttagtgtcctcacaatacaatcactccttgcttgtggtgctgtattccttcacgcatatgcagaagggcttgcacttggtgtagcggctcgcaaggcttatggccttggccgttacatggttctcccagcctccctccatggtcttccgcggggtgctgctgctgcaagctgtgtgtatggtgctacagatagctggcgtggagcccttgcagctgctgctttgacagggtttgcagcaccaagcgctgccatcagcgcaatccttgcaaagattgactatgatggacttgactactggatggtaatagcatgtggggcactaatccccagctttggccgtgtcttcaggcgctcactgcggttgggcatgcggaagagcattgttggcctgctgataggtattgcatttgcctccgtgtgcttgatgtcgactagattcatctgtttgcacactccttactgtaactcggctccagaagcagtcacataactcatgctggcctgtgctgttgtaaaacacatgtaatactagtgtaatgacaatacaaaggatgtggaaggttatatatatgccatcg

SEQ ID NO: 8181 - DNA, 1001 bp, Sorghum bicolor
  Clone ID: SORBI-28MAY03-CLUS29538_1
tttccgtaggactgatgaatctttactgcaagaaagtactaaaggaaattggcaagatggtgcgacagctgtatgcgtttggatcctaggacagacggttgtagttgcgaatgctggagatgctaaagcagtattggctcgttctgtttcaaccgagggtgaaggtatggttctcgtgccctaaaggcgactgtgcgcccttgttttgccttgcgttcttaatgccctctttccactggggccctccccactccccaaggctggaggttctgttggttctaatggaagattacaaggtcgtattgaagtatcaagggcatttggtgatcgccaatttaagaaggttgggtgggttcagcttcctccctcccgcttcctctcccctacttagtatgttcatttcatcattctagggtgcgatggcttttggggggtatttgggccaggcgatgctgttgaatttgttcagaatcagctgaaggagacctcatcagccacgctcgcagtgcgccgcctcgtgaaggaagctattcgcgagaggcgatgcaaggataactgcactgctgttttggtcgtcttcaagcactagcgatcggcctaattcccttatgctctcgtcaggcctagaaagaattagctgataaagaacaatgtttgaagtgtagctagttggacttggaactcttgctttgtcagtttcgatttgatgtgacctattattacaccatccatactcatttggttcctctccctgcattcctgtttatagcttgtgttggctttccgtggctcaaaattttttactacatatctagacagtgtatatctagtgcacagtaaaaattatgtgcctagaaaagtcaaaagacctatagtttgaaacagagggagtagaaatcaaacttttggaacactcagtttcaaaaagttactggtacttgtttgtcaactctgtataccagaattaaccagggtttatattccaactagagtttggtggg

SEQ ID NO: 8182 - DNA, 695 bp, Sorghum bicolor
  Clone ID: SORBI-28MAY03-CLUS29595_1
ttcaggattatgacgcagttatgaataaaggctttttccatgggtattcattcatcacagttttgatgattctgaaccatgcactgagtggaattgctgtttcaatggtgatgaaatatgctgataacatagtcaaggtttattcaacttcagttgcaatgcttctgacagcagttgtctctgtcttcttgttcagcttccgtttatccctcgcgttcttacttggatccacggttgtgtctgtctcggtgtacctgcactcaattggaaaacttcaaccacaaaaataaggtttgtttagtcactggttactgactgctcctcatctgtcagtaattactggataacgcaaaggattggtgaagatggaatctgggattcattattggtgtttggtgctttgaggctagaagcaaagctttagtggagatgagatttgattgcatagttaacctgtggtaaaaagtaagacccagaaatgtatttttggaggggttctagctattatctggtcacagttttttcttctcctatcaagtcaagttcgttaatcgctaaccgcatcgttgcctagtttttgagatatcaatcacacatttattgtaatgctagtgttttgaaatactaggtagcacaaaattgttgtattgaaccggtcgccttttgattctaatgtatagaattaccattctttt

SEQ ID NO: 8183 - DNA, 692 bp, Sorghum bicolor
  Clone ID: SORBI-28MAY03-CLUS29598_1
gcgatctcaatgataatctcttgctggccaaactggtatgtctagattctgttgtcgctgcccacagatgcctgctccgtcaaggtaaataaatggcgatagaaagtgcgtgcaagcttcatctcgcaccttgggatttcagagctagccacaatctataacaaagcagtgcaagattttccacaaatgatacttcctggagtgtgcatggccacggggatggttgaaatcagagtttgcagcacagactggaatgaatcttcctaccatggatccgttgtctgcatgttgagaaaggggagagaaaaaagagcatgtttggtgggaggtgcaaatcgcgggagcaatgattgagcttttgtttggttcagggggatggattactggatgctgacacagatacatgaacgagcctttctgttgtaacttattttagtgcaaaatgatgttgtcttctcccacatctgcttcaccagtcaccacctccttgcttgttgttttcctgcctccttcctaccttccctgtatgattgccccgctagtagtactttctctcaaatagaaaagagtaatgtgaggctttgtcccctgtctcctcgtgtaagcacaatttgtacttgtctgtaaggatgcatatttgtatgtactccatctgtttaactattactacgaaagagtacaattgtttgtgc

SEQ ID NO: 8184 - DNA, 725 bp, Sorghum bicolor
  Clone ID: SORBI-28MAY03-CLUS29627_1
ttttgacccatacaaggtcactattggttctgaagaattgaaggctaatcatgccattgttcagcatgtagagatactatctgagagtcagaagtataacaagctggttaatctactggaggatataatggatggtagccgaattttaatatttatggacaccaagaagggatgcgatcagattactagacagcttcgaatggatggttggcctgctttgtctatccatggtgacaagagccaagcagaacgggattgggtgctttctgaatttaagtcagggaaaagtcctattatgccagccactgatgttgctgcccgaggcttagatgtcaaggatgtgaagtatgtcattaactatgattttccggggtcgcttgaggattatgttcatcgtattggacgaactggcagagcaggtgcaaaaggaacagcttactcctttttcactgcagctaatgccagatttgccaaggaacttattagtattctggaagaagctggacaaaaggtcagctctgagttagctgctatgggtcgtggtgcacctcccccttcttcaggttaccgtgatagatatagggggtatgggggtggccgatcatagagttgacattcacatgcttagttgatgctaagattaatgctttacctttgtttgtggatggatatgttgttttggcgcactgaacattttgactagtattcggtaaagatggattcat

SEQ ID NO: 8185 - DNA, 664 bp, Sorghum bicolor
  Clone ID: SORBI-28MAY03-CLUS29018_1
cgacgacgtggttgtccccattccccaagccaacaacagcttcgcctaccagtggcctggccaagcgttccacatggcaggttaacaagtgcatgcactggatgggaaggcccccaaagaagatgaaaaagtgactcactcaagtgaagaagatcacttgcaaggttccagcaataggatgtacattaacaaaatactgctacgtggtcatataagtccccgatcacgatcatgtgtgtctgtctgtgtgtccaagtaaccgcagggtttaagggtaggtgaaacttgagcggcccttcactgcatcgctggacgtgtgccaagcatccgcgagcagcgagaagtggcgagcaagtgcaagattcttttgtttaattcgtatgctttgttgtaattttctcagttttccgttcagtcagcctggttcttgtaaaatggcgttctgcatgctctgctcccaaggatgagttgcatgtaaatgtaactgtcagagcagcgacgcttggggctggcgaactggtgtgtggtatgcctaaaagggcttagcagtagaactggttgggtaaaaacatgcagttctgctttctgctttgacattttcatcacaagtttttgtgtcctgtaaacatcaaggtcgtaataaagaaaggaaaccgcctttttt

SEQ ID NO: 8186 - DNA, 683 bp, Sorghum bicolor
  Clone ID: SORBI-28MAY03-CLUS2912_1
tatattttactagtcaataaataactctaacataatggtgtccaaatgaatccagtgattctcttgagtttgtgatatcttgtgggattcaataaaatttgaatctgtgttcgagccggcaaccatgcttctgtgatactccatttgttctggttctgaacaagtatgaccttttcgaggagaagatcaaccgtgcccccatctctagctgtgagtggttcaatgacttctgcccagtgcggacgaaccacaacaaccagtcgctggctcatcaggcatactactacatcgccatgaagttcaaggacctgtactttgcgcagacgaaccggaagcttttcgtgtggcaggctcgtgcccgtgagcgccagactgtggacgaagcattcaagtacgtaagggaggttctcaagtgggaggaggagaaagacgagaactactaccaggaggaatcgttctacagcacgactgagatgagctcctccccgttcatcagagcggaatgagatggcaggcacttgctgattttattttattagctgatttcgtgtggtacatacagatgcaaaaatcaatcattatcagtgtatattatttaattgatttgcttattcgtatcgtaattggtattggttgtgtatcttagtgctaaggcatataagaatcaaagaaatgtgtggtta

SEQ ID NO: 8187 - DNA, 631 bp, Sorghum bicolor
  Clone ID: SORBI-28MAY03-CLUS29032_1
ttgaccctgctgatgcaaccttgttcgccaataggagcctttgtaggcttcgcatgggtgatgggaggaaggctttgacagatgctgtagcttgcaagtctatgagacctggctggtcaaaagcttgctaccgtgaaggagctgcccgaatggtactgaaggactatgaaaaagcatgtggtgcttttcttgatggcctgaaactggagccagggaatgcagagatcgaatccgctttatgggaggctttggaatccttgaagatatctcacaaaaaagagaaagaatagcttggttaatttagatgtcagaaagttgtacagaacctgcactagtagtctccttaaaagatggagctgccctcttttgctgttgaccaagccacatgtgaagttctgaagtgaagtctggaagagacggagtgttttgggtaaccattatatgaccttttgctaattatacgcttggtcttgtgatatatccaagaaagaactgaaagagggagcatgcccactcaatcacattttgagagcacttatgtcaaatttgtaagctagaccagaatgacatcagcgttatcggagttcatggtgggtttggtttggtgcccaagctggctgaaccaaaattg

SEQ ID NO: 8188 - DNA, 819 bp, Sorghum bicolor
  Clone ID: SORBI-28MAY03-CLUS29141_1
gccctcgcgctcccccctggcacccccgacgaccatgcggtggcccgggccgcgtcccggcccccggggggcgcgtacgggtcggccccgcgcgcgtgcgccggcctggtggctgtccgccccaccccggcgccgttccgctttaccaattgagcccaccggaggacttgactctgggtctgatgcttatcaagccggcgaacgcattcagcactggcaacccagacgacgaagcggtgacgagggacgagaagctgctcacggaggaagggtacgggtcggcccggcgcgtgttcgtcgtggtggaggaagacgcgcgccatcccggcggagttccagcgccgcatggtggcgcagagccccggcgtcgaggtgaggacggagatcaccggagctgaccacatggctatgctctcgcggccagtggagctggttcagctcctcgtcagcattgccgaccaatcggaagagtgaagaatgaatcaaacatcgtgtttctgctggcgtagtgcggtgcgttcaccaaaatcggcccatcgatcgacagaactagatatgtagtgcaatttccggatttgttttcctagaactgatgtacttcttgttgcagaaaacccatttgttggttactctgtcagctcctagatcatgtctgctactctgcttcatcttcagatgcaaccatgcaaaaggaaatgggaaactaaactctgtcaggagatgcaaatagcccatggaggaaaccaaacaaagcgagaaaattaagatgaaacagttagccgtgttagtttaccttcataattgtaagaatggccgaca

SEQ ID NO: 8189 - DNA, 642 bp, Sorghum bicolor
  Clone ID: SORBI-28MAY03-CLUS29145_1
gcacgaggggggcttcctccaaagtaccaggctacaattgcatcacaagatagtttgtcaacagtgggaaagaagccaaactcagccttcaaagccatcgttgaggagcacagcccgtcatcatctattccttcctccggtgaagctataagtagcgtcacggcagcaagtccaccatcttcgtctttggctcacagaacagctacccttggtcccgcgggagatcaaagcattttaggcagggctgcttcaagggcgaacagcatgggggacgtggaaaggaagatgatgcaggagatgccgggcgtgttcaccaaggggctgcccaatggcaacagggttgaaggcttcctgtataaatacaggaaaggagaagatgtcagaatcgtatgcatctgccatggaagcttccttactccttcggagtttgtggaacacgccggagccggcaaagtagacaacccgctgcgacacattgtcgtcaaccctacccctaccccaaacctgtgaaccttcgccagcagacctgtgcaggcgtcgtgtagagtcagccttcagcctagcgtcgagtagtctcattgtcagattgtgtttgtggtgcagtgcttacttatgcccgattaaattggtgggcattaggta

SEQ ID NO: 8190 - DNA, 1226 bp, Sorghum bicolor
  Clone ID: SORBI-28MAY03-CLUS29216_1
gcacgaggatcacagcagctcaaagcattcgtcaagcaggatcaaccagggacctagtcatccttgttgatgagaccataagcgatcaccaccggagaggcttggaagctgcagggtggaaggtcagaataatccaaagaatcaggaatccgaaagcagagcgtgatgcatacaacgagtggaactacagcaagttcaggctgtggcagctgactgactacgacaagatcatcttcatagatgcagacctcctcatcctgaggaatgttgacttcctgtttgcaatgccagagatcacagcaactggcaacaatgcaacactcttcaactccggtgtcatggtcatagagccttccaactgcacattccagctgctgatggaccatatcaacgagataacttcatacaatggcggggaccagggatacctgaatgagatattcacctggtggcaccgcatccccaagcacatgaactttctgaagcacttctgggagggcgacagccaggccatgaaggcgaagaagactcagctgtttggcgcagacccaccaatcctctatgttctccactaccttggcctgaagccatggttgtgcttcaaagactatgactgcaactggaacaacgccggaatgcgtgaatttgcaagcgacgtcgcacatgcccgatggtggaaggtgcacgacaagatgccccggaagctccagtcctactgcctgctgaggtcacggcagaaggccagcctggagtgggaccggaggcaggctgagaaggccaactctgaagatggccattggcgccgcaacatcacggacaccaggctgaagacatgctttgagaagttctgcttctgggagagcatgctctggcattggggcgagaacaataacaggacgaagagcatccccatggcagtgaagacggcgagcttggcaaggtcatgatctgtagaatacaaacacccgatattgcaaccatacatgcatagcaatagcttgtataggtagctatgcttaggtcttcgctatacaaaatacaccactccctgttgctgtcatggctgcagctctatgtcgctgccagcctgcctcgacggctaacaattcttttgggttgactcttggctgctgaaataagtttcaggtaaatgtaaagttccctgctgaaattatgtgagcgggggagaaatgatttgtgtacagggcgccaaataaaaattggtt

SEQ ID NO: 8191 - DNA, 543 bp, Sorghum bicolor
  Clone ID: SORBI-28MAY03-CLUS29774_1
tttctttcttcagtccccagtttgtttgaagcagctagcgtttgaacttcttgagctgcttgttctttccgcatttccggagttggatggctcggtgaggaagtggcatgaagataaacagaaattctgcgccgagtaatgttttcctagtgatgaatttgtcacggagcaacagtttttcaaacacgcattgtctttccagagtcgtggcctgattctctgtaaataaggtggttttagagcactgcttgtcgatatctcagtttgtagtgggtggctttgtgcagtgtgaatccagttagatagcaacgagtaaaggtgcgagaatggtccctttttccccctgggccatggcaggacggttttttggtatacgtaatgctccctgaaaggaaagaggttggcggcgcaatattttttggctttagtgtaggatggacaggtggattctttcttagttttttatatactttttttttctctttttggtggtacccaacttgtgtaaatctgcatagtgataaatgaagtttggaggtgttc

SEQ ID NO: 8192 - DNA, 1133 bp, Sorghum bicolor
  Clone ID: SORBI-28MAY03-CLUS2980_1
aaagattgatcctgatgataccactggcttgaaaccacccaatgtctatggaagcattgaattcaagaatgttgatttctcttttcctgctcgccctgacattcttgtgctgagtaattttaatcttaaagtgagtggtgggcaaacagttgcagtggttggggtttcaggatcagggaaaagcactgttatttctttgatcgagagattctatgacccagtttctggtcaagtcctactggatggtcgagatctgaaatcatttaaccttagatggttgcgtagccacatgggcctgattcagcaagatccagttattttctcaacaacaataagagaaaatattatttatgcaaggcacaatgcaacagaggctgagatgaaggaagctgcaaggatagcaaatgctcatcatttcatcagcagcttgccacatggatatgacactcatgtcggaatgagaggggttgatctaacacctgggcaaaagcaacggattgccattgctagggtggttttgaagaatgcacctatattgttgttggatgaggccagctctgcaattgagtccgaatcaagtagagtggtacaggaagctctcgacactctagttatgggtaacaagacaacaattctcattgcgcacagggcagcaatgatgaagcatgtggataacattgttgtcctaaatggtggtaggatagttgagcagggcacacatgactctctgatggaccagaacggtctatatgttagattgatgcaaccccattttggcaagggtcttcgccagcatcggctaatgtaattattgttgggcttgttaggtgtaaattatcctagggcatgatcaggtttccttctgctcttggtgcagccattcaggcgccctttttggcacatgaaagtgctggaagttgccgccctgctgatgctgttctcagtaagcggaatgctgacctgatcttgacaaaaaaaattagcttgcagattcaggtaagtaactgtgttgaaactgtagggcacaactcattctggaaatagttagcaagtttggagggcattgtaatttttgtaatatatgagttgaaacattctttcagaggctcgtgcttgtgatgtctctcgcctct

SEQ ID NO: 8193 - DNA, 629 bp, Sorghum bicolor
  Clone ID: SORBI-28MAY03-CLUS29805_1
tcggcagcataggaactatgaatttgcaaggaagatgttattaaggtcgttggaattgtgtcctggatatgcaccagccagcaataacctgggccttgtatttgtcgctgagggccgttgggaggatgctagaagctgttttgagaaagctctgcaatctgatcccctacttgatgcggccaaatcgaacttgtcaaaagtccttgcattgtctaagaaacagtagaacaagactacaaagaagacctaactcctaaggaaatttccactggagcctcggagttcaaacacggaagcgtggtcaccaaatctctgttctgaagtgtctcaaggggcaattcaaatttgatgcttggtgcttctgtactgcactactgctcacaggtgtaggaagtttcagaagtgcagattctaagacggcagttggttttgaccgaggggctgcccttgatttttagaagctacacaggctccgaagtagctgtgatgtgttcttaaagagtcgcatcggcgcaggaagggccctgattttgaagttcttgtgtagttaaatttcgatgtaagcctgtaacaagcctgtatgtgaacggcttccgttagctgatgtatataaataaataatatactcc

SEQ ID NO: 8194 - DNA, 758 bp, Sorghum bicolor
  Clone ID: SORBI-28MAY03-CLUS29839_1
caactggctcagcgtatattgagtttttgcacaaagaatcagcagagcaggcgttaaccctgaacgggacatcatttatgtcacgcattttgaaggttgttcggaaaagctccactgaagcaacccaattgcctggcttggcccgtccttcttggggatcaccatttgcttcaaggctcattagaactgcatacccaaggccaacgtttcctggtgcaatccgtggacgactgccactcaggggtgttgcccggagtttgcagtggaagcgcggtgctgctgattctgcagatgctggaaaacctagtcaaactgcacctgcagctcctgccaatcagtcggtcaccccgaccatacgaagcttcacctacacacgcacggagccaaaaccaaatgacggtgcgatggcatgactgctcagctgaagcatgccgcagctcctgatgaatctcgcagaaagagctcgtgtttgacctctgttttgtagttcgtttcagctgcttttggtaaatatttaagtagctgcagatgttagtttgtagcaggctggtttttgtggacctcgacctttgagcaatattctgtgagaggtttcctgtgctggtttttccccgtcggcacccatgctgtgctggctggctgttcggagttcgtggatggagagtaaaatataaaagtagtagtaaaggaaaagccgaccgcgataggaacgttgaaccatttgttattatttatcgagggattattatttgcccccc

SEQ ID NO: 8195 - DNA, 705 bp, Sorghum bicolor
  Clone ID: SORBI-28MAY03-CLUS29393_1
gcacgaggaactagtccctggtttctaccgtttgcatacgttgctgtggctgcatacttctgcagcttggtggagtcactgcaatgtggtgatactgctaaaaaaattagagtggtggaacgcacaaaggatgtggcttttcagaagaatcacctcatacctcttggccgccatcgacacaatccgcagattgcttggtatcactgagtcaggattcaccctgacagcgaaggtaactgattcgcaggccctagagaggtacaagaaggggatgatggagttcgggtccttctccgcaatgtttgtgatcattacaaccgtcgcactgcttaacctggcatgcatgatgctcggggtgacaaaagttttgctgcataaaggtgcgatgagtttgggagctatgtttgtgcaggctgttctatgtgcgctactagtagcactgaatttcccagtgtatgaagcagtgttcctccgcaaggacagtggcagattaccagcttctgtcagtctaatttcgctctgcattgtaatgccattatgtatattgccaaccaacttctaggtgtgaagctggtgaagatatatatgtttttgaaatccgatggtgaaagttataagaatggtacagtgtatatttccaagagaacttaaacagctgtaacatgttcctctacagatcagaaaacgttgccgcattttgttgtc

SEQ ID NO: 8196 - DNA, 778 bp, Sorghum bicolor
  Clone ID: SORBI-28MAY03-CLUS29452_1
aagccaaaaatagaataaataagaagagcaaataaaaacttacttgataaattaggaggaactcccccaagctggatgttgacgtcggtcttgccccgcgtcccggttccgctgcgtgcgtgcgttgttgttgtatcttgtctcagttcttgtactgcagcggcatggtcctggttccatttttgttgctcttccaggagtcgtccatgttctgcttgcgtgttctggatgtcgaggagggtgttctcggtacgagtgaagaaagcaccggcctcttgatagtagtcattcgtgaaagcgtaggaggcgtcggagtatcgtcctgcatcaaattggggcggaggtctggatcctgaagctccatatggatcagtggagtacctgcccgtatggaaaggcgggtttgtccactggtggtcttggctctccggccatgtctcctctattggctcttgtggttgcgcatgtcgagcccatgggtctcgaaggactcaggggttgtaatcgcaataatgcaggtgcgctgcttcttctggtccaggatcagctccataccaggtgcgttctcgatgtgtggtcatcctttcagatgccactcgctgtggagctctctggttcactggtgttgctgcaatctcaatcaaaaagttttgcacagcgttgaggccaaggttcgggttaggtaaccctcgcgcgcctttatcatcatatagcaaatatattatattcccctctttctttaacatccgagtctgtctaaatgttcgagagaacaagt

SEQ ID NO: 8197 - DNA, 500 bp, Sorghum bicolor
  Clone ID: SORBI-28MAY03-CLUS29490_1
ggaaactttccagataaaggagggtgacttcctaacatttgatgctttgaggcaagcagctcaatgtgttggccgtgtgattcgctccaaagctgattatgggatgatgatatttgctgacaagagatacagtcggcatgataaacggtctaagttgcctgggtggatactctcgcatttgcatgatgcgcacctaaatctgagcactgatatggctctccacatagctcgtgagtttctccggaggatggcacagccatatgacaagacgggaagcggtggcaagaaaacactgttgaccgaggaggatctgcagaatatggcgcaggacggcatggagatgtaaaatcagggatgagatgagagtctttaagaggtgttgttgggtactgttgtacaaaaatttttgtagccattttatggtggtagataaacttgtttgaagcatcggttcaaacctcatgatgcatgccaaattaatattactcatgttcacacgg

SEQ ID NO: 8198 - DNA, 717 bp, Sorghum bicolor
  Clone ID: SORBI-28MAY03-CLUS29473_1
tatgctggagagactgccacatcaaagaaaaagaggagaaccccagcctggtgtgatagaatactatggcatggagatggtattgcacagttatcgtacttccggggggagtctcaattctctgaccatcgtcctgtttgtggaacatttattgttgatgctgaaaggctagatggcaaatcaaagaggcgctcatcaaacactaacattagaatcggtgctgaagagctgttaccgacaagcaacaagcataactaaggtgctggggcctaaatcaccgattaaaactaggtttttgtgtgactcgggaacacaacactgcagaaccttcgcaaggacgcctaggtatctgttcctcagggaaattttatgtgaccaaagaagtatgattagatatcatatgattattattatgttgttgtacaacatgtaatcgcgtacagtttcgaaaggagtagctagtcattagtttatattgtatacctgtaaaatttccctcacaaggttgttttggttcatttctgtacttctttcttttgtacttttcaaagttgaacagagtaaccaaaggatgttttcctttcttttctgtactgtacaaagtttgtattttgacctttgtttgtagggtcaagttttgagtttgtctaggacagactacagagtctcactggaaggagacattattttaattgtatatcatttattccatatctt

SEQ ID NO: 8199 - DNA, 916 bp, Sorghum bicolor
  Clone ID: SORBI-28MAY03-CLUS29491_1
atagatatatgaggaaggaattgcagagcttgtacctggtgttttgttcattgatgaggtccacatgttggatatcgaatgcttttcttatcttaatcgtgcactggagagccctttatcaccaattgtgatacttgctacgaataggggaatatgtaatgtaagaggaactgatatgacaagtccacatggtataccagtggatcttctagataggttggtgattattcggacagaaacatatggccctgctgagatgatacagatattggctatccgagcacaagtggaggagattgatatcgatgaagaaagtcttgcttatttaggcgagatcggacagcagacatctttgagacatgctattcagttgctatcacctgccagcgtggttgcaaagactaatggaagagaaaagatctgcaaggctgatcttgaggaagttagtggtctctatttggatgccaaatcttcggctcgtctgctccaggagcaacaagacagatacatcccctagatttctcctgttgtagaaagctcgaagaaaatgtagttgccagctcaaggccatgtagcatcgatctgcttcacatctgggggaagttatttttgtagtgccagcttatggcttcggtttgtctccagagaggacttggttccggtatattgcttgtccacatactgttccctaattaaagacacaattggtgcaggttgcgcccgcgcgctctcgcccctgcgtagattagctatcggtgcaggaattgccgtgtgtattttcacccttgctaatggatgtccagaatctttgtgcccacgggttgtattggttggccctcattggtcccgctcctagctttgtaaccatggatagtatttttacgctatgcaacttctatgacatttttctcacaaa

SEQ ID NO: 8200 - DNA, 1174 bp, Sorghum bicolor
  Clone ID: SORBI-28MAY03-CLUS29997_1
gcacgagggagtggtccagtccgcctccagccggctacagatctccagctcgcgcggtccagctctgagctccctcctctcctctccttctcctccacgcccggtcgtgaatcgtcgcttgctctggagagagcttgtagatttttttttgggttcttttggagttttcgctccccaaccttttcctggttcggtttcctgtgtacgggaattttcggttggttggtcattttcccgcaacttctctttggtttctgcgcgagagcgccgtcttgtttcctgctgctacgccccgttgactcgggcgggcattccgtcgagcaccttccgtgcggcggcggcgggtggcggttcctggtttccgcgcggcgctcctcttgatgccgctgctgtggcaggcgcagggttctagcggatggaatgcaacggctgctacgcgctgaagtcgagaaggttcgtcgcgatcgctgatgcggggttcgaggatgctgcggacggcgacaccgattttggtgacacgatgagtcttgcgcacaaggagaaggttgtcgaggaaaccgtggagatggaggaggaggagcaggggctcgtggggaaatctaaccagctcccctacaaggatgatgatgattttgattttgttcttcctgggagtagtaagcagcgcgcgtcaacatcaggagagatgcctctgtctggcaaaatggacccgaggttagacaggtctggaagcaatggaacaagcaaggtccctagactgggttcaatgcttgggacagccagcatggctggatttggcaaggcagtggagattctagacacattaggctgcttgatgacgaccttgagctcagatggtggctttgtttccagatccaagaccaaagggtgcaagatatcaattcttgcttttgaggttgccaacacaatacttaaaggtgctagtattatgcaatctctctcagaagacactgtcacatacttcaaacgagttgtgcttccttctgaaggtgtacagaatttggtttccagtgacatgagtgaagtgatgcgaattacagcaaatgacaaaagagaggagctgagaatattttctcaagagattgttaggttcgggaaccgttgtaaagatccccagtggcataacctggatcggtactttgtgaagttagaa

SEQ ID NO: 8201 - DNA, 560 bp, Sorghum bicolor
  Clone ID: SORBI-28MAY03-CLUS30004_1
gcacgaggcccagatccccctcctctcacctctcacgcccccccgcctcgtccccgcatttcgccaacgagaggagagagtggccatggcgtcatccgctgccgcctcctcctcggcttccgcgctcgtccgcctcccggggccgggccacctgcgcgcactgccacgaagcgggtggcgagaccacaggcggccccgtcgcgcgatagtgcggtgctcgttcgcgccggtggagacggcgcggataaaggtggtgggcgtcggcggcggcggcaacaacgccgtcaaccgcatgatcggcagcggcctgcagggtattgaattttatgctataaacaccgattcccaagcccttattaattcacaagcgcaatatcctctgcaaattggagagcagttgactcgtggactaggtactggtggaaatccaaatttgggagagcaggctgctgaggaatcaagagaagccatagccactgccctgagggattcagatcttgtcttcataacagctgggatgggagggggtactggatctggtgctgctccagttgttgccc

SEQ ID NO: 8202 - DNA, 478 bp, Sorghum bicolor
  Clone ID: SORBI-28MAY03-CLUS30010_1
gcacgagggttgcacgaggctcgcctccagcgggcatctctggccttcgccggaagcagagagaagctagaaatggcgatcaaaatggataagacgtccatcatcgtttgctcagtgatcggctctctaggattgttgagtgccatcctgggattctcggcagagggcacaaagctcactccatataccacactgctgtaccgcgacgactgcctctacccgcggaacccgtcctccggtctagggctctctgctgccagcttcctcgtcgtacttaaattaaccttcgccgctttgagttcttcctccggctgcagccggtccccctccatctcttctcagtccaagggcatcgtccccatcctctttgccgtgctctcatcgttggcggcggtgttccccgccccgccctgcctgcttggtgccgcgtggacccccatcgtcatgctccatatgcatgcagccatataccatactg

SEQ ID NO: 8203 - DNA, 676 bp, Sorghum bicolor
  Clone ID: SORBI-28MAY03-CLUS30028_1
gcacgaggcgcttccaccgaccaccgttcaccgccgccgtcctgcactcctgctccacactacacacactcctcggctccgtgccaccgaccgccggatcccacccaccagccttcccacacgcagcgagcggcagctgcagctctcctaggtctctcgacccccacgcgattaagcgattcaaagtcggagcgtggcggagaggcggcaatggagtacaggagggtgaaggatcaggagatttatgatgatttatctcagaaggatgtggaaagcctgagtgggaggacactatctagcgccaacactagtggtctcagctctacaggaggtgcaaaaggcaagtctagttggaagctaaagtctgttgtcactcttgcattgacattactaacaagttctcaggcaatattaattgtgtggtcaaaaagagctggaaagtatgaatatagtgtcacaacagctaatttttccgtggaggctctaaaatgccttctatcactagctgctctttttaggacgtggaaccgccatggtgtcactgatgataataggttaaccacatcttttgatgaagtgggtgtatatccaattcctgccgttctttacatggtaaagaacttattgcagtactatatctttgcctatgtggacgcaccagcttatcagatcttga

SEQ ID NO: 8204 - DNA, 575 bp, Sorghum bicolor
  Clone ID: SORBI-28MAY03-CLUS29641_1
actacgatgggctcataggcatcgacaagcagcatcacacgactggtacaggctttatcaaagtggagagacccaatggcggcaccttcagtgcgacgactaacggctactcatctgccagctttgtccgctgcacgagcaatcctgcaacaaatgattggataccatcttctgagacggtcatccctgcttcgaacaagcccagcaggagcgactcctgagtcctgaccagacttgacttgccttcaattcaagtgctgtgaattgcttacctatcttttcaaagataataaaatgcactgcttctgtgtgatactagactgatagtagtggaggacgagaagaggtcgagactcgacactctagaagtactggaaggaaatcatattgccgggcgcataggtttgagacgagatgttactacttcaacgaaggatgtgtacgggtgccttgctgcacctgcacactgctgtttgagtgttgataatggactacagaccctgaatgaatgtgactatgtgaattgtttggtacttattcgcaaaagcaaaagagaatagtttggtactttgatg

SEQ ID NO: 8205 - DNA, 573 bp, Sorghum bicolor
  Clone ID: SORBI-28MAY03-CLUS29659_1
gcctactctctcaagaacaccatcaacgagggcaagctcagcatctccgacgacgacaagcagaagatccagggcaaggtcgaggagatcatcagctggctcgacaacaaccaaaccgccggcaaggacgagtacgagtcccagcagaaggaactcgaggcgattgccaaccccatcatctccgctgcctacggtggtgctgctcctggtggtgctcctgagggtgccgcccctggcggtggtgcccgcagcgctgacgaggtcgaggagaagcccgaggagctcgactaaatgccttgaaaaaatgatgatatccttgttctctttttttacctttctcttttgatgtttgaggcgaatattttcttatttactttttaaacctttccttgtctgtttgcctttttacgggtggcttaacgaaattatgggtttcctttttcttttctgggtgcatagattccgagtcagttttccagatgcatatgactttcgtggcaggattttgcttgggaggaaaaagttccataggaatacgtggtgttcttaattaatggaaatgatgttaacttc

SEQ ID NO: 8206 - DNA, 887 bp, Sorghum bicolor
  Clone ID: SORBI-28MAY03-CLUS2969_1
cggcacagcaagatcttcctcaagtttcccagcaagttctggcccgtgggcgaggggaagcattcttcgtgtacgccagcagccggcgcggctactacggatgtggcagtcgttcgagcggagatccgggcgccaacgtgctcctggtcaccgtcaccgacgacgagtcgcggcggatcgagcagcagagcgacaaccacaccaaggccgaggtggcggcggtgctgcgcgacatgttccccgacgccgacgtgccggcgccggaggagatcgacatctacgtgccgcgctggtggtccaaccgattcttcaagggctcctactccaactggcccatcggcgtcagccgctacgagtacgaccagctcagggctccggttgggagggtctacttcactggtgagcacaccagcgagcgctacaacggttatgtccatggagcataccttgcaggtatcgactctgcaaacatcctcatcaaccacatcttcaagaacgaggagtacaaggtccgtggcaagtacgagcccgacgaccaaattgcaaaggctaaatgaacgacgacgaggcgtgcccatgccagatgccttacgccaagcggtcagctcgtctcgagagaacaataaattaaaactgccgagatttcgagcgcaattcagcaggctgccctgcaccgtgtctgctgctcatgccctgtgtttctgtgtgtgttttggcaggtcgtgtgatgtcctgtggaataaatgtagaggccctcgaggcttgaggccagatgttctgttctgtttgcgcagcactgggatcatttatgcacgtttcacatgcaaatgcaaatataatgacacatagtgggagtacacagtaatacaaaaaaaaaaaaaaaaaaa

SEQ ID NO: 8207 - DNA, 675 bp, Sorghum bicolor
  Clone ID: SORBI-28MAY03-CLUS29702_1
ccccgccacgaagggccacctggtcgagtccgacggggaggtcctgttcgtccggccagtgcttgcgttctcggacgaagtcggcgccgccggcggcgggacaaggctctgcaaccacgacgctgctgtgttcctggccatcctgggcttcgaggtgtacaggctagacatgaaggacagacgacgctgggcaaaggtggagaagctgccaggcgaccgggcgcttttcgtgagccccgggtcgtcgccgttcgtggtgcgctcgtcggagacggcgggctgccggagcaactgcatctacttcgtcggcaacagatggtactgctccttgtgcaacagggacgccggcaaagcctggggcgtgtactccatggaagaccgggaggtattgtttgagcatgctgtaaccgagccgggaccatgctcggcggcgacgtggttcttacctcgtgtagtctaagggcatgggttattttgtcagcagccgtcgcgtaatggatgggatcgctcgcagtgactcagtagcgagcttgcatgcacaaacagggcaaggcccatgtaactggtgtgtgttcatagaaaaggcatccaatgtataaacaagaatataattttctatgaaagggtatgaatagaacagcctcagtagcacctgaggtatgggctcgatttccc

SEQ ID NO: 8208 - DNA, 675 bp, Sorghum bicolor
  Clone ID: SORBI-28MAY03-CLUS29720_1
atcctggtccagacagacgatggccataaacacaggagaggaagccacggtgatatcatctttttgacaagccggggagaggtgacttcgtactcccctgggctgcttggccacgatgcagtatggagatggcaagtatcatcaggggcaacatggtccaacctcccatctccatcgggaatgatggagaacatagtggtgcctaccttgaaggctttctccctgcgcgcctacgacccgaaagaggtgatcatcgccggcggcgaccaggaagccgtggtgctctctccatctggtagcatattggccatgatcgagctcccagcgccccccactcacgcgctgcttctggaggatttctctggtgacggtctcactgacatcattctggtaacgtccggtggaatatatggattcgtgcagacaaggcagcctggggctcttttcttcagcacgctcgtggggtgcctgatagttgtgatcggcgtgatatttgtgtctctgcacctcaactcgtccaacggcggcaaacccagggcatcctcggctgaatacagatgatgtagagaaacggtttattgtgtggtgtatgagacattgagacgaccgtggttttgatatgatgctaggtaaagagacttttggtaatcctatgttatagtttatttaaccaaa

SEQ ID NO: 8209 - DNA, 698 bp, Sorghum bicolor
  Clone ID: SORBI-28MAY03-CLUS29736_1
caagcgcacttgattgtgcttacttatacattcctcgtgcaagattactaagcttgggattggaggccctcttgttactctggatggggatgttgttggcatgaacttctatgataagaagataggaacccctttcctgttatggccagacattgcagaaattttagcatcgtttgagaaaagaagtaagacgggagaaattttcaatgatatctctggtgtgcctttgtggaaactggacggggatcacagtaataggtttaacaggtggcctgtgcccatgccatgctggcggtgtcctgattatgtggatgaggataaatttgatgctaatgatcgcgagtactgctacgtgaagggagtgaaattcaggctcttataaacgcactcacgcccttgattcttctctccatatcgttgcacctatgccacttgttatggtcctcttgttgcttaagtctacgtgctgcttctgtttcttagaattatcttgtgctatgtcgtgtaatagcatgcactgtgactaattagtttccattactgttttgggcccaagacagtattctgcatttggacatttttgggcatgttcggacttctggattctttgaaagagatcgaaagcaacctgtttggttccttggcatttgggggcagaactattctgtctatgatagctgtggtgttttcatcgtttc

SEQ ID NO: 8210 - DNA, 689 bp, Sorghum bicolor
  Clone ID: SORBI-28MAY03-CLUS33734_1
agcagcagcctgcagccggagagcgagaggcaaagtactccagagaagagctggcagatatgaagagcggcagctgcaggcacgtcttcctcgtgggctcgcggcagctgcttcttgtggcgccatggcagggcgagacggcagcagcagctcgagctctcaacttcaccaggcaggattttcccagggccttcgtctttggggccggcacatcagcttatcagtacgaaggggcaaccgatgaagatggaaggagcccaagcatatgggacacgtttactcatgcagggaggatgccggacaaaagcactggcgatctaggggcagacggctaccacaaatacaaggaagatgtggaattgatgagtgatactggcctggaggcctaccgcttctccatttcttggtccaggcttcttccaagaggaagaggacccatcaaccccaagggtcttcagtattacaacaacctcatcaatgagctaatcaaacggggaatcgagatacacgtgaccctgtaccacctggatttccctcagatcctggaggacgagtaccatggctggctcagccccagggtggtggaggacttcacggcgtacgcggacgtgtgcttccgggagttcggcgaccgggtgaagcactggacgaccatggacgagccgaacgtgatctccatcgcggcctac

SEQ ID NO: 8211 - DNA, 933 bp, Sorghum bicolor
  Clone ID: SORBI-28MAY03-CLUS30250_1
aggtggggcccacgcccccgcttcttcttagctgcttggcctccgccggtcagtacagtctccgcctccccggcggccaccgccgcacctcctccccttccttccacgctccactctcctagcgcacccgcctctatgggccccgttcgactcgtcgtacctcctcctcctcgccgccgtcttcgccaccgcgggcgtgggcgaggcggtgtacatcccctacaacacgtcggcgggggtggtgccggggaagctcaacgtgcacgtcgtgccgcacacccacgacgacgtcggctggctcaagaccgtggaccagtactacgtcggatccaacaactcaatccagggggcatgcgtgcagaacgtgctggattcgctcatcccggcgctgctcaaggacgagaaccgaaagttcatctatgttgagcaggcattcttccaaagatggtggaggaaccagaatgacatgatcaaggatacggtgaaagggctcatcagctctggacggctggaattaataaatggtggcatgtgcatgcatgatgaggcggctgtacactacattgacatgatcgatcagactacacttgggcacaggtacagcatggcggtggtcggcctggtcccgcggctgggccgcccgcttctgccgcttgcgcactccgcccttctggctcacctccttgctgcactggtgggctgggtccccttctatttcttccggattgattaccaagaccgtgatacacggaagggaacaaaagaacttgaggttgtatggaggggctccaagaccttgggctcatcagctgatatctttgctggcatctttccaaaaaactacgaaccacctcctggtgaattttattttgaagttgatgataattcccctgttgtccagcatgatccccttccttttcgattataatgttg

SEQ ID NO: 8212 - DNA, 854 bp, Sorghum bicolor
  Clone ID: SORBI-28MAY03-CLUS30268_1
ttcgagtacacacggggagcgggggaagggaagccaagaacaagcaggcgatagtcgtcttcgtgcgcgctggtgggtgttgacagagagaaagagagaggaaaggtcggattttgttttacggctgcgctgaggagagatgttgagggcggtggcgaggtgctgcggtcactggccgccgggcgccgcggcggcggacgggatgctgtggcagacggaactgcggccgcacgcggcgggggagttctcgatggccgcggcgcaggccaacgtgaccatggaggaccaggcgcaggtgctggcctccccggccgccaccctcgtcggcgtctacgacggacacggcggggcggacgcatcccggttcctccgatcccgactcttcccccatgtccaacgcttcgcgagggagcaagggggcatgagcgcggaggcgattcggagcgcgttcggcgcggccgaggaggagttccataagcaggtgaggcaggagtggacgaagcggccgcggctggctgctgtgggctcatgctgcctgctcggggccatctccggggacacgctgtacgtggccaacgccggggactcccgcgccgtgctcggccgtcgagtggtcggcggtgggggtggccgtcgccgaacggctgtccaccgagcacaacgcggcgtccgaggaggtgcggcgggagctcaccgcgctcaaccccgacgacgcgcagatcgtggtgcacgccagaggggcgtggagggtgaaggggataattcaggtgtcaagatccattggcgatttttatctgaagaaaccagagtatagcttggaccccttgtttcggcaagttggcgcccctattcca

SEQ ID NO: 8213 - DNA, 743 bp, Sorghum bicolor
  Clone ID: SORBI-28MAY03-CLUS3036_1
gcgcccctcttttgcgcagctcggcgcgtgcgggggccacgcccacgcggcggcgtccgcgtcgcgcggcgcggcagggcggaggcccccgagcgtggcggcgatgtcgtcgtcgacgccgccgccggggcccgtgcagaagtcggaggaggagtggcaggccatcctcacgccggagcagttcaacatcctacgccgcaagggcaccgagtaccctggaacgggtgaatatgacaagttctttgaggagggcatttataaatgtgctggatgtggaactcccttatacaaatcatctacaaagttcaactcagggtgtggctggccggcattctatgagggacttcctggggccataaaacagacgccggaccctgatgggaggcggacagagatcacatgtactgcctgtggaggacatttggggcatatattcaaaggggaggggtttaaaacgcctaccaacgagcgacactgtgttaacagcatttcgcttaagttcactccatcctaggaggaagcctgacggcagatgaaccccaacctgaaactcaacaacagaataactgcttggcctctgttggttgctttcatattgtatagtgagttatgagatggaatttgttattccatgatcatttctaatatgctgtaacaaattttcaatcacaagtggtgatctttgttgataaatcacgtgtacttctgcggttctttcttgttaaaaaaaaaaaaaaaaaaaa

SEQ ID NO: 8214 - DNA, 627 bp, Sorghum bicolor
  Clone ID: SORBI-28MAY03-CLUS30400_1
gcacgaggctacagccaagagattatcaccacgagggaactgaagaacttggtgaatgatatactccagcattatccagatcttatggaagggtttaatgaattcttggagcattgtgaaaatatagatggatttcttgccggtgtcttcaacaaaaggccaactgcgagagttgttaaaactgaggataaagaaaaggatagagatagggacagggaggaccgcgagggagatcgggaaaaggaaagagagaaggaacgagaaaggctcgataaaggatcaacattcaattcaaaggaaggttctagtcacaaacctcctatgttctctggcaaagagaagtacaatctatccaaaccaatatcagagcttgatctctcaaactgtcaacgctgcactccgagttatcggcttctacctaaaaattatcccatgcccccggccagcaacaggactgatcttggagcctctgttctgaatgatcactgggtgtcagtgacatcaggaagtgaagattattcatttaagcacatgcggaagaatcagtatgaggaaagcttatttcgatgcgaggatgacaggtttgagttggatatgctgttggaatcagttaatgcagcgactaag

SEQ ID NO: 8215 - DNA, 512 bp, Sorghum bicolor
  Clone ID: SORBI-28MAY03-CLUS30420_1
gcacgaggcgacctcagggcgctggcggcgccggggtgcttccgggccccgcggacgtcgtgcctcgaggtcgccgtgtactacctgggcacgaggggcgcttcttctcgctgcggcggcgtcgtcgctgccgcctgcaggaggaagcggctggtcggcgtgttcagggtggagctcgcgtcgtcggagtggcgggacggcaagcccgtgctgctccaccatgggtgggccggcatcggcaagggggaggccagcgccaggccggagctccacctcagggtgaagctggaggctgacccccgctacatcttccagtttgacgatgacatcgcgctcaacccgcaggtcgtccagctccatggcagcatccggcagcccgtgttcagctgcaagttcatccgcgacaggcggccgtctcagagtgacccgttgggcggcggcgggcagtactggtcgagctccagcagcgaggagaaggacatggagatggtgaggcgggagaggaaggggtg

SEQ ID NO: 8216 - DNA, 505 bp, Sorghum bicolor
  Clone ID: SORBI-28MAY03-CLUS36574_1
gcacgagggcccccccggctcgcacgcacccctcagattccttctcaattcggttcgcgcacgaatccgccctgaggttccaaaccctagcttcctctcatcctccacgaaccctagatccaaaatctaacccccgtcatcctcttatcgccgtgcttgacgcttctctctgcagtcgataccgccgcggaccgcccggtttaattctcctctacccgagatctcgaggaaggatgggagaggcgaaggacaacgaggtgtacgaggaggacctcgtcgactatgaggaagaggtggagaatgtcgtcgacggcgccgccaccaacggctccgcagatgtcgtcaagaaggggtacgtggggatccacagctcgggcttcagagacttcctgctcaagccggagcttctccgcgccattcaggactgcgggtttgagcatccttccgaagtgcaacatgagtgcatccctcatgctattcttggaatggatgtcatctgtcaagc

SEQ ID NO: 8217 - DNA, 589 bp, Sorghum bicolor
  Clone ID: SORBI-28MAY03-CLUS36596_1
gcccgccgcctccgccgcccagcgcgcctccgcgccccccgcacgacgccaggtcttcgtaggcccattcccccgctcttcgtcggctccttcaatccgccggcgacgagcacccatcagaggctgggaactccaaagaggaacagggtccatggaggctggaggcgcaggaaatggttcgaatggggcggcgcagacaaaggggagtgggggtgatggctccaccaagacgccgccgccacttcccccttgctgtgtcaaggcgagagccgcggcacctgagtctgaggccaagtgccatgccaccgtggtttcgggatggttcaccgagccacgatcacactgcggtaaagccagcaaggttcagtattacaataatccaatgtggccaggagaggcccattccttgaaagtggagaagatattgtaccaggggaaatcaccataccaggaagtcctagtctttgagtcgtcaacctatgggaaagtccttgtgcttgatggtattgttcaattgaccgataaggatgaatgtgcataccaggaaatgattactcacctccctctttgttcaattccatcccctaaa

SEQ ID NO: 8218 - DNA, 1157 bp, Sorghum bicolor
  Clone ID: SORBI-28MAY03-CLUS36612_1
gcacgaggggcttccctccaaggcagccttcctttctgcaggcgcgcaggccgcaggggcagctccccgtcttctttatcactagccgatcgccgcagcgctcctcggtggacagagcggccgcctcgccgctccgtcacagcctccgccgcctctcctcctcctattccgcggctaccccgctcgctggggccgcccgcttcctcgcgccctcctccgagggtcggctctccgcactcacctcgtctcgcctcctcgggtcggcgccgtgccggtgctgctcaggcgccgggatcgccgagcggcctgcgtctgcgtggcgcggactcgccaccatggctgacggtaatagccgctttgggcatgtgctgacaagcctcccaaagcccggtggtggagagtacgggaagtactacagcttaccagccctgaatgatcctaggatagaaagattgccatattctatccggtatctactggagtcagccatccgcaactgtgacggatttcagattacagagaaggatgtcgaaaacatcattgattgggagaatactgctcccaagctggtggagatacctttcaagcctgcccgtgtgcttctgcaggattttactggtgtcccagctatcgtagatcttgcaagcatgcgcgatgctatggctcaactgggcgatgatcctggcaagattgatcccatgattccagtggatctagtcattgatcattcggtacaggctgatgtggtaaaatcagagaatgccctccaagctaatatgcaacgcgaattcgacaggaacaaggagcgcttcgccttccttcggtggggctctacggcattcaataatatgcttattgttccaccaggttcaggaattgttcaccaggtgaatcttgaatatcttggacgagttgttttcaatacggatggcattttatatcttgacagtgtgctgggaacggattctcacactactatgattgatggaatgggggttgctggctggggtgttgggggaattgaagcagaagcaacaatgcttggtcagccaatgagcatggtcttgcccagtgtagttggatttaaactgacagggaaattgcgtgatggtgttactgcaaccgacttagtcctgacagtgacacatattcttagg

SEQ ID NO: 8219 - DNA, 821 bp, Sorghum bicolor
  Clone ID: SORBI-28MAY03-CLUS36613_1
gcacgaggcacaagccaaaccgaaacagccttccgccggattggaaactaccagatgctaccggcgctactaatccagcgttgcccgccgtaggaatctctgattagcgcctcaattaacgatccgtgtcttgttgcacaattatatagccaccatttgacaagataggggaggtggagcagccaagaacgcaaggagggggaagggaagggagagagaggaaaagattaggaaagggaggggataaactgagggaagccaagaagaacacaagaagaatcaatcggccggattgcacccgacttcctgggcgattttttttcttctagcgatccgatcgaagcagtccaatcgctgtgaagacccgattccgttcggcggcagccatgaggttgatttctctgtttggtctgtcaggacagtgatgggcatggttcatcccaggttcctggttgcttgctcagggtcgaagctgtgcttcatctccagttgctgcagtagccgcgcaaagatgatgatatcttttcttcggaggcggccagagtgtagttgtacccttcctatattgattgagttcagtagataattcttggacatcagttggtattctgggggactgaaatacggattctgcaggacatcaaaaggacttgaataactaaattttaggtggtattccaaactaggttgcgatgggtttaccccaaccttcaacagtcaaggatgatgcgccaacaacattgcgcacctctatttcttgccctccacattttggaggtgttagtgcctgtgatttggatgggcttccttcaggaagctct

SEQ ID NO: 8220 - DNA, 787 bp, Sorghum bicolor
  Clone ID: SORBI-28MAY03-CLUS3664_1
gcacgagggtcaggaaaacatggaggaatcaacaaaaactgaaaatggaagcttgaggagtagcctgaatgactcaacaaacacaaaggctcccaaagaggatactctaggagaagaacaaacaggactcgtgcttgaatctttacctgaagacaaaagtgttgatgcagtgtctgagcaagcacctttgttgacagaatcaggaatgactgatgccaatgacttgtctagcgatactgcaagtgttcagaaccctgtgtctgcaaaagaagacaaacccactgaatctgccaacattgaggccacatgttctactgatattcaactggagaacgaagaagtagataagaacgaagaggagcagcatgcaaacacagccacagatgaagtttctgaagagaatgtagaaagttcacatgtaaatctgcagaaaatcacaagctccgaagtaacatctaatgaactagcaactcaaattactgaaccagtttgtgacactcagacaattttggctcatgaaaaggaaatatctgaagaaaactttccaacagcagtcgaaattcaggctgatggtccaaacttgcagatcaaccaagataagcaagatgaagtggctgacaacgaatctgcaatggagcttgaaaaggttggggaatctaattttcaggaacaccaggaaattggtactgagcaaaagtctcctgaagagattgatgaaggaggccagcaacttttggctaagaaagagattctgacccatgaactagatgtgcatgagacagtcgaa

SEQ ID NO: 8221 - DNA, 603 bp, Sorghum bicolor
  Clone ID: SORBI-28MAY03-CLUS30553_1
ctgacgatgcaggagcggcccaaggacagcggcggcaccgacgccgccgtccacgcgacgttcagactcgtcccgcagggcacgaactcgacggccgctgcgacgctcgagccgttggacatgccggggatggtggtcacggacacgctcacggtgtccgcggagaagagctcgggtgctctcttcaacgtcgtgccgggactcgccggcgcgcccggctcggtgtccctggagctagggtccaggccagggtgcttcttggtcgccggcggcagcggcgagaaggtccaggttggctgtaccggtggtgtaaagaagcacggcaacggcggcggcgactggttccggcaggcggcgagcttcgcgcgggccgagccgatgcgacggtaccgcccgatgagcttcgccgcgaggggcgtcaggaggagcttcctcctggagccattgttcaccttgagggacgagttctacaccatctacttcaaccttgtagcgtgacaggagacgggaaaaaaaatgttggattggaggtcgagtggcggacaataatgtttagagaaaagaaaatggtttccttatacaccgaatgaaacgatccgtgcc

SEQ ID NO: 8222 - DNA, 627 bp, Sorghum bicolor
  Clone ID: SORBI-28MAY03-CLUS30559_1
gaaataatgaacgtgtagaacacgcagaaggtgacaaagctcaggaagctaaccataatgagaacagtgcaaatgtagaaatccatgctgatggagacggcgaagcaaaagaaggcgatataaatgcagaacagagtcaagcagacggtggcagcaataatacggctgaagatgctgagcacaatgagaacaccaaagttgatgatgccaattcaagcaagaatggtactgccgagaatggaaagactgatgttgatgtgaaaggcaacagcgatggcacagctgaaggaagcccgctagcgtgatgaggtgggcgtagattgcaagagagttcgaataagatcccgcttatgtagattgtaagagagttgatgtagggtcccacgtgagagactatcactgatgccctaactcttgtatgatagcttatcatgcagagccatggcaagtgtaaggtctagaagcctagaacctagagatggccagattgtttgtattgtaaaatatgcacgggtctagcttgctcttgatgtgtatagcactggactactggaaacctagaccagggaatccatccagttgcgctgttgtatgttggaaccaagcaattcagagcaggatggttcc

SEQ ID NO: 8223 - DNA, 681 bp, Sorghum bicolor
  Clone ID: SORBI-28MAY03-CLUS30589_1
taaatgaaatgatgaggcaaagagcggcggaagtcgccgcaaatgaatagttgcctctgtacaggtatactttatggaaagaggataggaagtatgaagggttgcactcctcactcccacaccgagaaagcttgggatggttgaattataggattggtaggtaaagaacagccgcttcacatgtatttcttatgacgaaggtctcggtcgccctttgcctatggttaacaacagataggttcgggagccgcccgccttcctccaaagagctgaagcagcagggtgcaccgtaggctgtaactgttcgtttgcaccctctccagtgctaaccagctacaccctgcttactgcactgatgttgtcgtcgactgggcgcgttacaacccttgggtgtggtgaattctttgatttgacctgtactagctgaactgatcttctcgctgctgcttgctgatggtgtataataggtgtctctggacagttgtcagtcgtgtattgcagaaaatttggtgtagctgttgttcccccctctccagtctcttcttgtctcagttcaggagagggtataggttaaaaaagggtaaaaagggctgggcgttattggacaagtatttgtttatttctgccccccattttgtaggactcatctttgttaaaatataaagcaaacgtaaatcctcc

SEQ ID NO: 8224 - DNA, 867 bp, Sorghum bicolor
  Clone ID: SORBI-28MAY03-CLUS30641_1
agtcagaatcagctcgcgcctccccttcccacctccactcgtttcgctcctctgattctctcccccccgcaccaccgccaccgccacgaccgccgccggcagccccgcccccacccacgcgcgggcgcaatgctggtggcgtcgctcaggccggggccttcccccgcggccttccccgcttccgcccggaggagcccagttcccttcctccccttccctgcccgcctgcaccaccggtccctgctgctctccgcaaccgccgagggaaccggcgcccccgccggccagggtgacgcctcggatgcgccagtcgacgaggcgcgcctgccgcagttcgctgtggactgggaagctgcgcgcacttacaaggaccaggggaacattctcacgctgccggtgctgagggccaatagcggcgggcttatcgtcaggttcaactccctgcaggggttcgtgcccaaccctctcctcagccccgcgcactggtgtgaagaccccaaaaggcccatccaagatattacaaaagacctagtaggaacgtccatttctgtcaaggttgctgaagtgaatgaggaggaaaggaagcttgtcttctctgagaaggatgctagttggtcaacatactcttctctaataaagattggcgacatctatgatggaattgtgggctcagtgtttccctatggtgcatttgttcacctgcgatttcctgatggaccatatcatcttactggtcttgtacatatctccgaggtgtcttgggatcttgtccaagacgtccaggattttctaaacgaaggggacgctgtcaaggtcatagttgtgaacattgatacggcaaagtcaaggatagctttatctatcaaa

SEQ ID NO: 8225 - DNA, 612 bp, Sorghum bicolor
  Clone ID: SORBI-28MAY03-CLUS30672_1
gcacgaggcccacccccgccggccacttcccccaacccgtccctccggctcctccgccattttttccctgtcgcggtaagcgatagggttcggcctccgtcctctaaatccgccctcggatccagtgctgctgctgcttctcttcctcttcttcgtttcgcttctagcttccggcgttctcggagcaaagcttcggcttcgtcgacggcgttcttggtcttttgcggcttgacatgtcttcgttccagggatacagaggcgatgcggttctcgccggcgtccggtcgcggaagcgcgtgttcgcgacggcggccgctgagcccgtgacggcagcggcgcccaagaggcagaagcgcagggatgagccgtccctggacgcgctgccggacgagtgcctcttcgaggtcctgcgccgcgtgcagggcgcccgcgcgcgctgcgcgtcggcctgcgtctcccgccgctggctcgcgctcctcgccggcatccgcgcctccgaggccgtgctggccccggctgcccccgccgtgccggacctcaaccaggagtacctcagcgaggacgacgaggccgatctgatggacctcgacggcgacgtccgcgagaggacgc

SEQ ID NO: 8226 - DNA, 1436 bp, Sorghum bicolor
  Clone ID: SORBI-28MAY03-CLUS30019_1
gcacgaggctgaagttcatgccaatgctgcggaaattctatgtgcagttactcggtgtgcacctccatctcttgctgcgaaaatatgcagtccaagttttgttgggaggttgttccatcatgctcttgaagaatcaagacccaaatctgttctggttcattcactgtcagtgtgcatatctttgctggatccgaaaagactagcatcagcttcgtatcaagcattcagaagcaacttaactcatggggcattggtcacggccagtccagagacagttgacggtatgcttgagagtctaggcaacttgctgaagttattggacacttcggctgctgaaagcctcgtgccaacaacttatggatgtttacgcccacctcttgggaaacatcgtctgaagattgtagaattcatctctgtgctgcttacaattggaagtgagactgctgaaaaagagctaattaggcagtcagcaataaagcgctcgattgatttattctttgagtatccatataacaactttttgcaccatcatgttgagaatataatcgtttcttgccttgagggtaaaagacctgaagttgttgatcatgttcttcatgaatgtgatattgttggtaaaattcttgtttcagaaaggctttcatctttgtcgattgagtctaatgggcctactgttccctctgaagggaaaacacctccaagaattggaaatgttggtcacatgacgagaatagccaataagcttattcagttgggcaacagtaacaacacaatccaggctcacttatgggaaaataatgagtgggttgaatggcaaacaagcgcgcgggtcaaacgcaatgaagtggagaatgtttatcattgggcttgtgggcgcccgacatcattacatgaccgtggtagggacagtgatgatgatgacttccgggacagggattacgatgtggcagctcttgctaataatttaagtcaggcatttcgttatgggatatacagcaatgatgacattgaagaggcacaaggatcacttgaacgagatgatgaggatgtgtattttgatgatgaatcagctgaggtggtgatatcttctttgcgactgggagatgaccaggacggctccctctttacaaattcaaactggttcacatttgatggagagagaggcattgatgaccgtacatctgcctctgttccttcatcatcacccaattctgaggagatttcaccagagaccgaggaagctgatgatggtaaagtaattggcactgaggatgaaatggaaacagtatatcttggaaatggtagtgctgaggaggtaaaagatgtagcagaatgtactgaacaggcaaactgttgtactgaggatgagcgattgaaaaatacagaagggatggagcggcatccagatgcttcaaataatgataccgacatatgca

SEQ ID NO: 8227 - DNA, 602 bp, Sorghum bicolor
  Clone ID: SORBI-28MAY03-CLUS30036_1
gctgcccgtcccatctgctccggacagagcctcgttccacaccgccggcgacctttttcctcctccgctcgaggagtgggccgggccaacggagggagaccatatgggcgcggaggcagggcatacgcagcagcagcctccctcctccctccgacccggcagggaggcggcggcggcggcggcgccacccgcggtgctggggctgcagctctcggcgctgatcgaccacgtcgcgcgcgtcgactggtccctcctcgaccgcgtctctggcgaccgcggcggctcgcagcaggtgtccattgaggagctgaatcatattcttgatgaagtgaatgcccacatccttccttcccgcaatgatctcactccaataactacaatagccggtggaagtgttgccaacacaatccgtgggctatcagctggttttgggatatcaactggaataattggagcttgtggagatgacaaccagggccgtttgtttgtcaacaatatgagctttagtggtgtagatctcacaagattaagggccaaaaaagggcacaccgctcagtgtgtgtgcttggtcgatgcaagcggcaatcgcaccatgcggccat

SEQ ID NO: 8228 - DNA, 614 bp, Sorghum bicolor
  Clone ID: SORBI-28MAY03-CLUS30053_1
gcacgaggcaccactaaagctcttgcgcgcggcggagaaacccaagtgaagcccccgcgaggcgagagcgaggagagggaaaggggggagaggcgaggtagcggactagcgggatggcgtccccggggttggtggccgcggcgctgctggtggcggcgctggcggcgttctgcggcacggacccgctgcggatgggcagcatggtggacttcccggggttcgaggcgcacttcgtccacctacccgatcccgccgagatgccgccgcacgcggacgaacgggagcggctccgtggggccgaggtgcggttccgcggcgaggtgcagggccccgagagcgtcgccttcgacccgcagggccgcgggccgtacacgggcgtcgccgacggccgggtcgtcttctgggacggcgagaggtgggtccccttcgcgacggcctccccgcgttggacgcaggagctctgcggcgggcccaaggcctcgccgctggagtacctccccaatgagcacatctgcggccgtccgctcgggctccgtttcgataagaagaccggggacctgtacatcgccgacgcctacttcggcctgctcaaggtcggccccgagggcgggctg

SEQ ID NO: 8229 - DNA, 977 bp, Sorghum bicolor
  unsure (1)..(977): unsure at all n locations
  Clone ID: SORBI-28MAY03-CLUS30086_1
gcacgagggtcccaaggaggccggcttctgcctttggttactacatccagatccttgttcaagaccaaaagcaaaagagatgctcgggggtgacttgataaatgagggtcgggatttgtccttgttagatcaggcaccagtttccatcagtgaagatgacactgaatctagtttgctgtttaacttcctttctcaactgaaagaagaaaaggagatgctggctgccaaattatcagcagagcttggaagcttagaaacagatatcacagaggttgagagaagacactcagcaagaatgagattgagtttagaggacacggatgtactgccaagttctggtgttttgtcaggagcttctgtgagtgccgttcaaggtgcattgctgtcaggtttgctaccgacatcgtgcaagtcaagtgtatatgaggagagggtaatgagagatttggtgcagcttgaaaatgcatattactccatgaggtcctctgtggacaccagtgaaactaatgcaatcaaacgtccagataacgaggctttgagggttcgtgaaaatttccatcaacttcacagtgattttgatgctaagggtgagaaaacagaccgtcttggatgcttttttgatggtttatgcaaatatgcccggcacagtaggtttgaggtccgaggaattctgaagaatgcagatatacttaactctccgaatgtcatctgttcattgagttttggtagggatgaagaatattttgctgctgctggagtttcaaagaaaataaaaatatttgaatttgatgcactcttaaatgatcgtgttgatattcattacccactggtagagatgcctagcaagtccaagcttagctgtgtcagttggaacaactatataaagaactacctggcatcaacagactatgatggcactgttcagctatgggatgccagctctggtcaaggattcacacagtttacagagcaccggn

SEQ ID NO: 8230 - DNA, 899 bp, Sorghum bicolor
  Clone ID: SORBI-28MAY03-CLUS30184_1
gcacgagggcgtcgccccactctccccccccgcgtcgaactcgcctggctcctagtcccgtcccacttggagcgaattttgcccggggtgagagaggcggcggccatgtcggggcgaggctctctgccggagggctcgctctttcttggattggacagctccactcaatcgctgaaagctacggtgctcaacaatgagttaacaatagtagcttctgaaattgttaattttgactctgaattgccgcactacaaaactgaaggtggggtgtacagagaccccgcagatgatggccacattttttcaccaaccattatgtgggtggaagctctggagctgctgcttgagaagctaaaaccaaagatcaacttcggtaaggtagtggctgtctcagggagtgggcagcaacatggcagcgtttattggaagaagggcagccatgctgtgttgtcctccttggatgctagtaagagcctgttatcgcagctcaaggatgcattttctacgatgaactcaccgatatggatggatagtagcacaactaagcaatgcagagaaatagagaatgcagttggaggtgcactggagttagcaaaactgacaggatctcgtgcctatgaaagattcactggtcctcagataaggaagatctatcagacagaacctgatgtttatgaagatactgagagaatatctttggtgagctcgttcatggcatctatccttgttggaagctatgcaagtattgatgaaactgatggtgcggggatgaacttgatggatataaaccaacagatctggtcaaaatctgttctataggcaactgctcctggacttgaagcaaagcttgaaaatctagcaccagcgtattcagctgctggccgaatcgctccttattt

SEQ ID NO: 8231 - DNA, 726 bp, Sorghum bicolor
  Clone ID: SORBI-28MAY03-CLUS30212_1
gcacgaggctacatcttccgcgacccgcgttggggccgaggccaggagacccccggcgaggacccgctgctcaccagcaagtacgccgtcggctacgtcacggggctgcaggacgccggctccggttccggcagcctcaaggtcgccgcctgctgcaagcactacaccgcctacgacgtcgacaactggaagggcgtcgagcgctataccttcaacgccgtggtgtcgcagcaggatctggacgacacgttccagcccccgttcaagagctgcgtggtggacgggaacgtggccagcgtcatgtgctcctacaaccaggtcaacgggaagcccacctgcgccgacaaggatctcctgtctggtgtcatcagaggcgactggaagctcaacgggtacatttcgtcagactgcgactcggtcgatgtgctgtacaacaaccagcactacaccaaaacccccgaggacgcagctgccatctcgatcaaagcagggctggacctgaactgcggcaacttcctggcgcagcacacggtggcggccgtgcaggccggcaagctgtcggagtccgacgtcgaccgggccatcaccaataacttcatcacgctcatgcggctgggcttcttcgacggcgatccacggaagctgccgttcggcaaccttggcccgagcgacgtgtgcacgtcctccaaccaggagctggctcgcgaggccgcgcgccagggcatc

SEQ ID NO: 8232 - DNA, 1285 bp, Sorghum bicolor
  Clone ID: SORBI-28MAY03-CLUS30777_1
gcacgaggcggagtaggtgcagcagagcagacgcagagcggcacagcaatggcggaggctcgtaactacgacagtattgtcaacaggaatgagatcacggacgctgcggcttcggcgttcgccaaccccgagcagatcccggagaagtacgtccgaaccgaggaggtcctcgacggcgtcgtcgtcggtgaggacgagcgctacgagctgccggtcgtcgacatggccaggctcctcgacccggagctgtcggcgtcggagatcgccaagcttggcgatgcctgcagaaactggggtttctttcagctgacaaaccatggagttgacgaagaagtggtacagcgaatgaaagacagtgcccggcggttcttcagcttgccgctggaaagcaaggccaaagtggccgtccgaggaaacggcttcgaaggattcgggcaccactacagcagagcgtccagtggtaagctggactgggcggagagcatgatcctcgtcacgcagccagtccacgacaggaacatggaaatgtggcctacaaatccacccacgttcagggacgcgcttgaggtttactctgtggagatgatcgacctggcaatgaagctcctgggtttcatggcggccgacctcggggtggagcaggaggcgctcctggacgccttcacggggaagcggcagagcatggcgatccactcctacccgccgtgccgccaccgggagaaggtgatgggcatcacgccgcacacggacgggctgggactgacgctgctgctgcacgtcgacgacacgccgggcctgcagatccgcaaggacggcaggtggttccccgtgcgcccgctgccgggcgccttcgtcgtcaacgtcgccgacatcctggacgtgctcaccaacggcgcctacgccagcgtcgagcacagggtgctcccggacgccgagaggggccggaccaccgtcgtgatattccaggaggcgtccgtcggcggcctggtggcgccgctgccggggctcctcctcgaggagggcggcgcccacgcgcggtacagatccatcgagattgaggagtacatcaagggaaacttcaacgcgctggagcacgggacacggttcatcgagagcctcaggatatagtagagtcgtcatcgtctgtggattctcgcacgcgtcaaaacagatgtactagttgctccttcagttcgaaaataattgctcaactcatatttcaacgagccaaccaatcttaaaacatatctgtatcttctatatcttgctctaatattattttttc

SEQ ID NO: 8233 - DNA, 587 bp, Sorghum bicolor
  Clone ID: SORBI-28MAY03-CLUS30844_1
attagcaaagcatgggagagtttccatgatgtcaagatcagtgacagaagtctcatatggaattcagacttgattgagaccatagaattggaaaacctgctaataaatgcatgcataaccatgtattcagcagaggctcgcaaagagagcagaggagctcatgcccgtgaagatttttcgacaagagatgatgagagctggatgaagcacaccctagggtattgggagaacgagaaggttagactagcctacaggccagttcacatgaataccttggacgatgaagttcaatctttcccaccgaaagcacgtgtttactaatctaatcggaacatgcctgctaatgttctggctcgtcccagaaagatataccacactactcacagctgatggtgtatcttctttcggggttaaaaatctaataaaccggggaccctgtatggttgtgtcctctccgattgtaagaactgtagctaaattgccaacactggagaggttttcccaatctccctgctgcatatatttggtcacgggtcacaatgttgtttttttacaccagtaaaatattagtcgtgcagcctttcaca

SEQ ID NO: 8234 - DNA, 666 bp, Sorghum bicolor
  Clone ID: SORBI-28MAY03-CLUS30866_1
tggagttgtgaaggttactggttatttcacaagctcgctggcgaactcgaaagctggcaagaagttcttcaacatgttgcctggagagattgttcttgcttcacttgatggatttggaaagatttgcgacgccgtggaggtggctggaaagaatgttttgtccacatcatcaactgtgacgactgggctagtatctcacaagtacggagacaaagctgctgccgcaacaaacgaagggctggacgccgccggccatgccatcgggacggcgtgggccgtgttcaagatccggcaggccttgaaccccaagagcgtcctgaaacccacgacgctggccaagtccaccatcaaggccaatgttgctgagcttcgcgcaaagcacggcagcaagtagttcactcctgccaccgttcgtaactggctagctgcagtgatctcgagaacgaaggatgtgcccagcaagtctttgagcaaagctgccaccgtttccagtcacagcaagtctttgagcttcatctcgttctgtcacgacacggatgcactgcttcgagcagcagcgttcccttgtaaatttgtgtgctgaaagcctgaaactgaaactgaaagcttactctgctcttgtgagactgcccttctcatgccgatgttaaagctttattgctgctc

SEQ ID NO: 8235 - DNA, 1062 bp, Sorghum bicolor
  Clone ID: SORBI-28MAY03-CLUS30875_1
gcacgaggctctaactcctgaagcgcgggggctgatgttgagggccctgggctacagaagggatgtccacatctatgttgcttctggtgagatatacggaggggcaaggtactctggcacccctcaaagcgctcttccccaatctccatacaaaagaaacactgtctagccaagaggagctggctccattctctaaagttctcttctcgcatggctgcactcgatttcattgtctgtgatgaaagtgatgcttttgtggctaacaacatcggcaacatggccaaaattctggctgggcgaaggaggtactttggccacaagagaacgatccggccaaatgccaaacggctctatcccttattcttgaacaggggaaacatgtcatgggatgcattcgcctcacaggtgcgaactatccagaaaggatatatgggagagcctatggaaatcacaccaggaagaggcgaatttcatgccaaccctgccgcctgtatatgtgaaaagagcggccgaaactcagtaatagtcaagtccatttctggaagtacccaggaacctgtaactgacaccagaataaggaaagccattgacattggtagaccaccataccctgtttatactgacgaagaggcagatggatctgatacagaagaagatccagatagcagcgggagaggagaggtgattgacactgaacctgacgatgattctgtggtcagacaggaggatcctgagctagaggagatcctgtcagattagttcagttgtgcggctatttcctccggttaagctatgcaaatctgactttgcatatacatgtgttgtatgtggcagaaatttcatggtttggacatctccgaactagcctagatctgcagccactggtgtacatagattttgtggtgtgcagctgtccatcctctttcccctagctgaatgagggcatgatcatgtttgtcacctcagcaagccagatttttcctccttttcttaacatcccgccatcgctaatccctcatgaaaatgtgtatatcctgcttagttttcttaacatctgttttt

SEQ ID NO: 8236 - DNA, 698 bp, Sorghum bicolor
  Clone ID: SORBI-28MAY03-CLUS30922_1
tttggtgtattgggtgtccggaacgcatggtatgacccaagcaaagtaactgatcatgtcatacaaggttacacaaagcctctaaaatccaagggttgggagacagctcttctggagcacaccatatccatgatcatagattctgcatctgcatcaagagcaccagtttcaaagaggctttctgagatctcatgcccagtgctagtggtgacaggtgacactgaccgcatcgttcctgcttggaatgctgagcgtgtagcacgcgctatacctggagcaacgtttgaggtgatcaagagttgcggtcacttgccccaggaggaaagacctgaggaattcctctctgtccttgaaaaatttctacggacaatgtttgcaaatccaaatgaacaagtatttcaagcagctgtatgacgagttttgtatgatatctacatgcaaacacggagtcacagactggagataagaagaaaaattgtagtaacacaagagaacagttatagattggcagctcttaattgtggacaatttagggttctaattggaactctattgcattgttcatttgtagatgacatttgatagaactggtaccatatagagaataactgaactgtatcaacctcccttcaatcattcttgtgaatgtagttggaaatgtacattatatctctcttgattaagcgattttattggtt

SEQ ID NO: 8237 - DNA, 761 bp, Sorghum bicolor
  unsure (1)..(761): unsure at all n locations
  Clone ID: SORBI-28MAY03-CLUS30440_1
gcacgaggctggcgcggcggtgccccgtgccccagcctcttctccccgtctcgcgcgacctcacaagcgcgaaccccgcgaagccgccaagccacgacggaactgccccccctcgacctcgacctgccgcacgagggtcctccgacgcctagggttttctaccgggcgccgctgccggggatgcaggtgggcccgcgcaggtagcccggccgccttcggacccaccgccgccgccgcgcgccatgtcgctcctgcggcggcggaagcagccgcagccgccgccgccgccctcggacggcgacgggtccgaccacgacgacagcgacaaggggaagaagccgtcctcgtcctcgtcctccgcgccgccgtccaaggaggccacgaggcggaccaaggccaagtggtcgtgcgtggacagctgctgctggctggtcgggtgcgtgtgctccgcctggtggctgctgctctttctctacaacgcgatgccggcctcgttcccgcagtatgtcacggaggccatcacggggccgctcccggaccctcccggggtcaagctgcagaaggaggggctccgtgttaagcaccccgtcgtcttcgtccccggcatcgtcaccggagggctcgagctatgggagggccaccagtgcgccgaggggctcttccgcaagcggctatggggcggcacatttggtgacgtatacaagagacctctatgctgggttgaacatatgtctntgggacacgaaacaggattagacana

SEQ ID NO: 8238 - DNA, 720 bp, Sorghum bicolor
  Clone ID: SORBI-28MAY03-CLUS30419_1
gcacgaggccctgctttactctcggttcctccgttcctctccatcacaggagcacgagacgcgcgccacagtaagggtaaaaaaaacaacacatggcggcggcgaacggggacgccagccacggcggcggcggggtaccgcgcccgacgaaccccatggtgacgccgctgctcaccgacctctaccagttcaccatggcctacgcctactggaaggccggcaagcacctcgaccgcgcagtttttgatctctacttccggaaaagtccatttggcggtgagttcaccatctttggtggcctcgaggaatgtataaggttcattgctaacttcaagttcacggaggatgaaatcaaatttctgcgatctgtcatgcctacatgtgaggatggcttctttgagtacctccgttcgattgactgctcagatgtggaggtttatgccatacccgagggttatgttgtgttccctaaagttccactgatgagaattgaaggacctgttgctgttggcccccggcgtggtactccatttctaagtctggtcaactatgcttctctggttaccacaaatgcggcaagacaccgacttgtagctggaaagtcaaagaatttacttgaatttggacttcgacgggctcaagggcctgatggaggaatcagtgcatcaagatattgttatatgggaggctttgatgcaacaagcaatgttgcagcaggga

SEQ ID NO: 8239 - DNA, 827 bp, Sorghum bicolor
  Clone ID: SORBI-28MAY03-CLUS30461_1
gcacgaggtggaaatctagataatataaagcttatggaagctttggtgaagtacctccacagatttggtcatttgtcttgctcagcatctgatgttgaaatttaccttcacatgctatccaacaatgagttgtctgagctgctagatgaaatcactagatcttttgatgcatcatcaatttcagttaacacactgggttcgacgcacgaggttttcaaggtccaggaacttttgggaactttattcacaaaatcaacttcagaacttcagggcattgcaaaaagaatggttgataccttttacaaaaatctgcctctctcaaatgacttggatcctcaggaaagcatgtatggtgaagaacttttgtcaatggccagcagtatccttgtgcagctatactggcgcaccagggacttaggatacctacttgaagcagttttgatactggagtttggattgactgttcgcaagtatgtctggcaatacaagattactctggtgcatctttactcttacctgggggcacttcctttagcacataaatggtacacaaccttggaagtgaaaaacattcttctagagtctgttttgcaccacatcttgccacaaatgttaaattctcccttcttgcaacatgctgccgatcttgttaaggattatttgaaatttatggatgatcatttgaaagaatctgctgatcttacgtgtctcgcatatagacaccgtacttactcaaaggtaattgagtttgttcaatttaaagatcgcttgcatcgctccatgcaatatctttctgtaaagtcagattctgttatgctacatctgga

SEQ ID NO: 8240 - DNA, 929 bp, Sorghum bicolor
  unsure (1)..(929): unsure at all n locations
  Clone ID: SORBI-28MAY03-CLUS30505_1
gcacgaggccgatgacggcgccgacaaatctactctagggttcggcccagcaggaggacgcccggggcctggacttgctgcctttttcttcctcgccggccttacctttgctgccgtctccatcagaagcagtggcaaccacgcagctgcaaaaatgcaaaacttgcctgcagagactgctgccacggaatcttactctgattatcactcccacaaagaggatgatgctatcagtgtcagggaagaagatgcccaagcttccttaccaacggattgggaggaaaacaatgacagccttgatgaaacaaaaagtacagatgaattcctggcgcctcttctacagtcaaacgaggaggttcctggggtgcaagctgaacatgaagtggggcacccggcacgaggcactgaacctgttactaacggtaatcatcttgtcggtgaagaagtgcagcagtttgacaatctcattgcatccgatggtaatcaaaatccagcatcacctcctctgcccatctcatcagaatatgctcaggtttcttttgcaccatctagcacacttgatgctgcagacccctcggagggaattcctaacgtagaagaaacatcagatctcaaaatggccttgccagaaaacgagcatttggatgaaactttaacttcagatgcaatggtgctagattcagatggtgttgtgctcatccaagatatcgctgacagtgccgttgctgctgcatttcacccagaagacaaaggtgtcgagcagaacccacaaactcatgacaaagatgaattttctccatccggattgcctgattatatggaacatgtaangtgccgaagagatgcatccacttggatcaaatgagttatctatggctacagggactagtgagccaggagatggggaggaaactatagtagaagatctg

SEQ ID NO: 8241 - DNA, 964 bp, Sorghum bicolor
  Clone ID: SORBI-28MAY03-CLUS3055_1
gccgctgcctctctcctgtccccgtcctgcgcgctcttccgccgccttccctgcgcgtcgcacatctcctcgtcgcacttcaagaggttcgaccgggttcgccggttctcgcccgccgccatgtcgactttctcagggccaaaggaggcgccagcgaataacccggggctccaaaccgaggtcgaccccgccaccaagggctacttcttgcagcaaacgatgttacgtgtgaaggacccaaaagtgagccttgacttctactcacgtgtgatgggcatgtcgttgctgaaaaggttggattttgaagagatgaaattcagtttgtattttcttggcgtccgggatgtgacctcagcccctgacaatcatatcaagcggactgaatggacttttaggcaaaaagctactcttgagctcacccacaactggggcacggaaaatgaccctgaattcaaaggttaccataatgggaactcagaccctcgtggttttggtcatataggagtaactgtggatgatgtccacaaggcatgtgaacgctttgaacgtcttggggttgagtttgtgaagaaacctgatgatggaaaaatcaaaggcatcgccttcatcaaagatcctgacggttactggatcgaaatctttgaccacaccattgggacggtgacttcttcagcatcatgaagtgctgttcttcacatatttaaggaggctttgtgtccagattctttatacctgtcattgtgaactacagtttccttgtatggtgcacaagaacatacaactctgggcatatcaggagcttcttttgatatgggtgtctggagtctggactcggataaagggctagaatctgcttactccttgtatcttgttgcattaataatatactatgcacgaactatgttgaggaatgaccagtagtgttggaaataaaataagttcattttaacatatcattatattt

SEQ ID NO: 8242 - DNA, 866 bp, Sorghum bicolor
  Clone ID: SORBI-28MAY03-CLUS3132_1
cggtccggatcccggtcgaccacgcgtcctggcggcggcggcatggacgcgatgccgccggcgttcaaggccgaggcggcggcgtgggcggtgccacgtgacggcgtggtgtccccaggagcaggtgctgcggcacccggccgtgggctgcttcctgacccacagcgggtggaactcgacgtgcgagagcgtggccgccggcgtgcccatggtgtgctggccgggcttctcggaccagtacaccaactgcaagtacgcctgcgaggtgtggggcgtcggcgtccggctggagtcagcggtggagagggagcaggcaaccatgcgcgtcaggaaggtgatggcgaccgaggagatgcggaagagcgcggccaggtggaaggaggtggcggaggctgctgccggccccggcggctcgtcgcgcgagaacctgctgagcatggtgagagcgctcagccgcccacccaatgcaactcatcagacgctcgatcaagagctcaaagaccagtagttacaattgaccggaatcatgaagccccaattgttgatgatcgatgggcatcaaaaatttgactcgcctaataaagcaatcgttgattgattttccacgttgttggagttggtcgtgatcgaggagcgttctagctggacaccgcagttggtcagagcgcatgctgcacctccacagcggcgagcattcgtgccatgacggcgtgggctccggcgacgcggccatggatggcgggctgcggccgacggtgagtccgtgtttataacgtgtgtttccttctttgacctcccacttcttttgtctatctttggctcggctgttgattaccctaccctgtcgctttcagtgcggcagcatc

SEQ ID NO: 8243 - DNA, 1195 bp, Sorghum bicolor
  Clone ID: SORBI-28MAY03-CLUS31320_1
aaaagagagaggggaagggtcagacacacacgcagaccagtagccccacgaccaccaccaccacccccgccgcagcggcaacaaactgctgctgccgaaccaaccggggggatggagagggacgccactgccttctgcccgccgccgcagcccgcgccggctgccccggtttcggtgccgcccgcgacggtgctgggcgccggtggtggagcggttgcggcggcggcagggcacggccgaggcggcggcggaggaggaggaggaggaggaggagggaggcagtatcgcggcgttcggatgcgcaagtggggcaagtgggtggcggagatccgcgagccgaacaagcggtcgcggatctggctgggttcctactccaccgccgtcgccgccgcgcgcgcctacgacacggccgtgttctacctccgcggccgctccgcgcggctcaacttccccgaccagctcgacggcgcggcggtggccgataaccccgagggccacagggacggcggcgcgggggcggggctcacggccgccgccatccgcaagaaggcggccgaggtcggcgcccgcgtcgacgcgctccactgcggcgttggcgttggcctcgctggcggcggtgctgcctctccgcagccgctgtcgtcccaccatcgccgccgccccaagaaccccgacctcaaccgggagcccaccccggacacctcagacgacgagtgatttcgtcgtcgttcttcttctccctcatccatctactactctcctagtccttaggcaaaactactcacctaaggggtagctagctagctagctagacagcagtagcaagtaaagcaggcaaccagatggcgccagggacgcagcgcaaggtgttcggtggaatgcggatgagctcggaggtggccaataatggagccgcgacgtcgacgtcagggccggaaaccgtagtaagtagtaggaggagcctagcgtgctagccgtgccgtttgcccggagtcgacgtcgacggacggcgacggcgacggcgacggctctagcacaccagtagcaggagacagacgggtgcgtgcgtgcgtgtcagtgtatgcgggcatgtagctatgcaagacggctatgtacctctccccttcacataaagacgtgggtaaagaaaaaaaaaaagatactcccggcaagcaagatgggcaacagtttcgtc

SEQ ID NO: 8244 - DNA, 908 bp, Sorghum bicolor
  Clone ID: SORBI-28MAY03-CLUS31378_1
ggagcccaaggtggcgcggggcttcctcagcctgtacaagacggccggggagaaagtcaagagcctgtcggacgaggtgatggaggaggtgcggcgcctcatggacaagtacaagggcgaggagctcagcatcacgatcgtcggacacagcctcggcgccgccctggcgctcctcgtcgccgacgaggtcgccacgtccatccccgacgcgccccccgtcgccgtcgtctccttcgggggccccaaggtgggcaacgccgccttcgtcgataggctcgccagcagcggcaaggtcaacgtcctgcgcatcgtcaacgccggcgacgtcgtcaccaaggtgcccggggtggcgccgcggctgccgcacaagaaggagcagtaccagcacgtgggcgccgagctccggatcgacagcaagaactcgccgtgcctccgcccggacgccgggcccgcgtgccgccacgacctggaggcgtacctgcacctcatcgacggcttcacggggacggggcgcccgtttcggcacgacgcgcgccgcagcgtcatccgcctcctgcagctgcagaggggaaacgtcaagaaggagtacgtgaaccgtgcgcgcgagctcggcgtcgaccccgccgcgccggcggacgtcggccggagcatggcgtacggcaactgcgccgtcgccagcccctcgtgagggatcaaatcattattacgtctccttcggtggatcgtcttgtaaattttgtaggagaaagaagaattctttcgttagttgcgggtgcgagctgggaaagatgaacatctcccattttccgtttcgtttcgttttgacatcgacgcatgtgtacagggaaaaaaaatcaagcaagcgcaagtgcgcgcgcagcacaatcaataagtgaaagcgtgacctt

SEQ ID NO: 8245 - DNA, 1031 bp, Sorghum bicolor
  Clone ID: SORBI-28MAY03-CLUS3172_1
gcacgagggttggtgtccttgacgccatgccatcgagtaacttgaaacctgaaaatgaggatgaggaacttgatgagaagaggatttacaggactacttatatgttcagtgccaccatgcctcctgctgtggagcgtcttgctaggaagtatctccgaaacccagttgttgtgacaattggtacagctggcaaggccactgatctgatcacccagaatgtgatcatggtgaaggagtctgagaagatgccacggctccagaagatactcacagatctccgtcagaagacagccattgtgttctgcaatactaagaagacagcggacatgcgcgctaaggatctggacaaggcaggcttccgcgtcacaaccctgcatggtgggaagtcacaagaccagagagagatcagccttgatggatttagaaaccgtcggttcaatgttcttgtggctactgatgttgcagggcgtggtattgatattcctgatgttgcacacgtgattaactatgagatgcctagttcagtcgacacatacacacatcgcattggaaggacaggtcgtgctggaaagaagggagtggcaacttcatttttaactctggagaacactgatattttctttgatctgaaacagatgcttatacagagcaacagtcctgtgccacctgaacttgcaaggcatgaggcatcaaaatttaagccaggctcgattcctgatagacctccaaggcgaaatgatacagtctttgcaaatcattgaagcaatctacctcagaagggactgaagatcttttggactgagctcaacttctaccatagagggagggatctagattagtatttatgaggtataaaactttttatggttagaaatatgtacttatgaggtccaaaaaggcaaaaactatgatcattagacttggttttatttatgtttggaaactggcctcattgtcgtaaccttagtatgttttggtggtggcttagctgtggacatgtgtatcatatcataatttttgtgctattctgc

SEQ ID NO: 8246 - DNA, 791 bp, Sorghum bicolor
  Clone ID: SORBI-28MAY03-CLUS3201_1
cactaaggtgcaagctgatggggtgatagttgctacaccaactggcagcacagcatattctactgcagcagggggatcaatggttcatccaaatgtcccatgcatgctgtttactccaatctgccctcactcactgtcatttagacctgtcatccttccggattctgcccggcttgaattaaagataccagatgaggcaagaagcaatgcatgggtttcatttgatggcaaaaggaggcagcaactgtcaagaggagactctgttcgaatatccatgagtcagcacccactcccaactgttaataaatctgaccaaacgggtgattggttccgcagcctgatcaggtgcctcaactggaacgagagattggaccagaaggcactatagacactagaatttttttttgttgctgtacatatctatctagatttacataccgaaatagttttgtttttctgtcaacatgtataatgtgtaacatcaaagagctttgcacataaagagctccatagcttattgcgctggcattgcagtggcaccacatgttacgataacatggtccatgtctgtaaatcaaccacatatatatggggctatgtgtttttacccctgttaacaggggtctaaaaaaaaaaaaaaaaaaaaaaaaaaaaaaaaaaaaaaaaaaaaaaaaaaaaaagaaaaaaaaaaaaaattttcatggtgtcactgtgttgtgatgaaaggaaaatgaaaaaaaaaaagtgggtgtcagtttgatctcaaaaaaaaaaaaaaaaaaaggccccta

SEQ ID NO: 8247 - DNA, 734 bp, Sorghum bicolor
  Clone ID: SORBI-28MAY03-CLUS30680_1
tactggaaatcgttcccttcatcccacacccgctcggccgatcctgccacgcgcgacctgcgagtctgcgactgcgtcaagtcctagcggcggcggcgcgcggtgcccagcccttgccccggcggcgggcggccgacgcacctcggctcctccccgcggcacctcgtccccttgcggccgcccctaggtggccagccccatctccatcctcccagccgaccggccccagccaggctacgccgggttgccccttgcggccttgccccaccccccatttggcaccaagcatcatgtcggaaagaggtcgcttggcaaggcgattgagtgatgatcgcagggcgtaccatgaaggccttcgagttgacgatcccagaggttatcctgaagtccttgtggttggggatcgtaggggctactctgacatccgtgtggttcaagaacgtcggggctatcctgacccccgtctgcttgaggaacgcaggggctaccctggtgttcgtatggttgatgatcataggggctatcctggcagtcgtgggcttgatgaacgtagggcctatcctgagatccatgaaggcccacgcatgaggggagctccacaccctcacccagctgtcttagaggatgagctcgagttacaggaagttgaactccggaggcttttggcacataactgggctctggttcaggaccgtgaagtgttaagcagggaaataccagctggaaaagatgag

SEQ ID NO: 8248 - DNA, 484 bp, Sorghum bicolor
  Clone ID: SORBI-28MAY03-CLUS30681_1
gacgaggctccccccaggcccaaacctccgatccctatttcttcctccactccgacacaaatcctccgaaccggccgccgcggagaaatggggcggcgccgccggttcgcgcagctggacgacgacgacgacgacgacgaagaggacgtgcccatcaagttcaagccctcgggtggtgcctcctcctcgggcgccaaccccaggaagccacagccgcagccgcagcagcgccgccgagtcgccgctgacgacgacgaggacgaggaggaagtggaactcgaggaggaagaggacgacgagaaggatctcgaggcgatgcgacgggccgaggaggaggagcgccgcgagcaggaggccgagacgaagacccgccgccgccggggacggcccaagcgccgccgcgacccggagagcgaggaggaggagcccgacaaggtggcgccgcacgaggaggagccccgcgaggaggagaacacggaggcgg

SEQ ID NO: 8249 - DNA, 918 bp, Sorghum bicolor
  Clone ID: SORBI-28MAY03-CLUS307_1
cgttcgggtttagcccctgtaagactttttgttttgttttgattaattaattaatataatgatacgcagctctcctgcgtgttcgagaaaaaaaagggcaagaaaggaagaaaagagcgaaaaggtgcagtaaagttctaggatgacatgtatttggaaagaagttgagaatgctaaaacaagtgtggggggggagagggagtgtcacagattaaaaaaaattcccttcagacattttgttgtctgtcttggtaaatgattatgcccaagtgctaattttgccaataatataaccctaggggtgttagctacttggttagtggctcctaaactagcttgcaggcatattttgccaccatacaatgaggattgctggaaaaggcttcacacaggggaggcctatttgcagtccatggggggatgcaaccgttgtcagatgatcaacctgtatcagagctcagggcaggtgatcaagtcaaaggaaccgctggcaactttagcatcatatagacgaaaacagggaaagattttgtttggcgtcctgttgaactatgaagacggcatggaaggagaagatgatgccattgtagagagatggctcaaagtggggcaagaggtgtatccttctacataaagacttctgtacatgtgtacccagaagtttctcctgcataagaggctgacgggcaacagttagttatatacgtgaaaaatatggactttctgatataccatgtatgtaataattttattttcatgcctgtatgtaataacacatacgcgcttgaggcctgtattcagaaacaaacatatagaaaacaaatatacagcaatacaacatacaaggaattgtaaaaatatgtaaagctcaaaatggaaaacaaatatatagacaaatgtaaatctttggctagtctg

SEQ ID NO: 8250 - DNA, 737 bp, Sorghum bicolor
  Clone ID: SORBI-28MAY03-CLUS30724_1
agagacaggtgtgcagggcaggatcataaacgtatcatccattgcgcataaaagaagtgatggtacatgctttgagttgaacaagctaaacgataaggataggtaccagccgttcattgcatatgcacattcaaaattagccaatattctccacgcaaatgagttgtccaggcgttttcaggaagaaggatgcaatctgacagcgaattccctgcatcctggagtaatcatcaccaatatcattcgctatgttgcaggaaacaacagtgcgctgatttcggttctgtcccctgtagcaaatctttttctgaagagcgtaccccagggagctgcaactacttgctacctggcattacaccctaatgtcaaagatgtaactggtaaatactttgcggactgcaatgaagcaacgccgactgctgtcgcaagagattcagagctggcgaagaggctatggtcgttcagcgaagaacttgtagggaccaatgcagatatgtcacagacgacacaggcaagtgaagaagaggacgtacaagcgaaagacgttttccaagaccagtagtgtaatagctctagctgtgttttctactagtaattcttgtacctgtattgtgggcccaaatggccagtgactgtaatggtacgtaagtgcccaagagttgtaagagaagggatattcatcagacattcaatcaagaaacgaagcggctgaggcaggtcctctccgttgttccccc

SEQ ID NO: 8251 - DNA, 1282 bp, Sorghum bicolor
  Clone ID: SORBI-28MAY03-CLUS30730_1
gcacgaggctacatcaccggaatgacgacctcctccgaccctgccgccaccccggcgccgcagtctccgggcgtcggcggcgtggccctctcgtcctgcatcggcgacctcctccgtttcgtcctctcctcccacaccggcgcctgccccggtgacgacctggccgcgttccccctctcgccgtcctactgcgtccgcctcgtcaacgacggcgaactgttcgggaagctggaggcctctattcagcggtgcctcgaggaggggcggctcccgggaccgcccgcagtggtcgggattccggctgcggaggaggggccggaggagagagggtgggagctgctgctgctggagaaaggcgccgagttgaagcggatgtatgatgctgttgactttgagttgcatgttcaggaaccctacttcactcaactcagagctggagccaagaaggttgaagggagattagcgactggtaactacaaccggattacacaaggttctttgctgctattcaataaatgcctgttgcttaacattgaggcagttaggaagtacagttcattctctgagatgctggaagcagagataatctcaaatgtccttcctggtatttcatcaattgtagaaggtgtgaaagtatataggaaattctatacagaggaaaaggagaactcttctggagttttagcgatatcagtttcaaagccaacatctcaaccttacataaccatgactgatatccttgctggattgggctatgatggattgggtagactccttggtatggccaaaacagctggaactgttccagatggactacctcctccaagatctgcactgttatcatcttgtctgccaccactccaaccttccctggcaccctgttctggcactgtcggtgccagggcgtggtccaagcctgttctctggcggagggtgcgagggcggggccccttcatgggcactggtgcgggcaaggaccgtggggcatctgtaaccggtgtcgctttgttgcgggcctcctgttgctccagtgtccagcggtcgcgaccctatggtcctgtttttgaaatccgtgtgcatgaaggttatggcgccagatggtctcaagatggttcaaagttcattggattcttggagccctacaccccagaaggctatgctaaaggatggaaacactagcactagccagatgcctagatcttgatctgtattagctgtcttgtctatcagggttcatttgcatctctgaacgatactggtctgctcaaataaagagacgatc

SEQ ID NO: 8252 - DNA, 877 bp, Sorghum bicolor
  Clone ID: SORBI-28MAY03-CLUS3074_1
gcagcaggggtttattcgttttgggtacttgtttcgaagagaagcagatttccacgaggcgaaggctgagtgagcaggagatgaggagcccggtgccggagcgtagcctcatcatcgagagcgatgacgacgacgacacccaatccgctgtcgccaccaactggacaggacacgggcacggccacgacgaggaggagccggagcgtgagcccggttcggactctgactcttcgtcgtcgtcttcgtcctgcgccaccccacgccgcggcccaagctcccccgcctacacccagcaatggccgcagagttacaggcaatcgattgacattcttagtagcgtgcactcatccaatctgagctttttggggactccaacgctgagcagactgtcaaattctttccttgccatcaccgattcttttcggggcaaagcccctgaaacaatctcaaactttgtcaagccacttcttggtcccacatcaagtgatgagcagcagcagcagcagcatgaagatacccgaaagagttctcagtacattatgccctcaagaaaatcatctttggaacaaatccctgaggatcaaaagccactggtagttggtcatgaggcgtctcgtaatcgaaattgctcttacacccagggagtgatgaatggaataaatgttctatgtggcgtgggaatcctatcaacaccttatgccatcaaacaagggggttggattgggctggtgatactctgtttatttgctttgcttgcatggtacactggcgtgctcctgcgtcattgcctggacagcaaggagggcctcgagacatacccagatattggccatgcagcctttggcagcacaggtcgcatagttatctcgataatact

SEQ ID NO: 8253 - DNA, 754 bp, Sorghum bicolor
  Clone ID: SORBI-28MAY03-CLUS32350_1
gcacgaggatgactttcagaagttcaactctggagagtaccaagtcattttgcgcaaggagttgacaaagagtgatgtcgcaaattctgggcgaattgtgcttcccaagaaggatgctgaggctggtcttccaccattggtgcaaggggatcctctgatactgcagatggatgacatggtgcttccgattatatggaaatttaagtatagattttggccaaacaacaaaagcagaatgtatattctggaagctgcaggtgaattcgtgaagacacatggccttcaggcaggggatgcactcattatctacaaaaactccgtgcctggcaaatttattattcgtggggagaagtccattcagcagacaaacccctagacacaatttgatgtgactggcaccatcagatatggcgttcaaggatacaccataagttcacaatcaaatggttattgacttatgtaatgtttcaccatcacattgagataagtcaaaaaggagaatcacgagtctgagacaccgcgtggatggagaaagggaggaagaaattttgggagacattggaagtgctgccagtgagcctacatctaagctcagaacaagtggtttatgttttttttccctctaattcggtcgtgtttggatgcttgagtcctgcattgcattctggagaacattcgtagtcttttttttttgtaaatattttggatctataagataaaggaagcggtctggaacttactcagattctgatgc

SEQ ID NO: 8254 - DNA, 927 bp, Sorghum bicolor
  Clone ID: SORBI-28MAY03-CLUS32411_1
tggaaatgttattgatatctgccctgttggggctcttacatccaagccatttgcatttaaagctcggaactgggaattgaagggcaccgagactattgatgttactgatgctgtgggatccaacataagagttgacagcagaggacctgaagttatgcgcattgttccacgtctcaatgaggacattaatgaggaatggatatcggacaaaacacgggtttgttatgatggtctaaagaggcaaagactaaatgaccctatgatccgtggtcctgatggcaggtttaaggccgtcacgtggcgtgatgctcttgcagttgttgctgaggttttgcatcaagttaaaccagaagaaataaccggagttgctggaaaactttctgatgcagaatccatgatggcactgaaagattttgttaacagaatgggttcagataaggtgctatgtgagggaaatggtcccaatcctccagcagatctgcgatctaactacctaatgaatactagcatcgctgggcttgaaaaggccgatgtcttccttttggttggcactcagccaagggtggaagctgctatggtcaatgccaggattcggaagactgttaaagcaacacaagcaaaggtgggctacattggtcctccagctgacttcaactatgaccatgatcatcttggcacaggaccacagacccttgttgagattgcagagggacgtcatcctttctgttcagtactgcaatcagccaagaaccctgtcatcattgctggagctggattatttgaacgtgaagaccaggatgccctattctcaactattgagactgtagccaagaagttcaatgtgacaagaccagactggaatggacttaacgtcctgttgctccatgctgcacaggccgcagctcttgatcttgggcttgttgctaa

SEQ ID NO: 8255 - DNA, 821 bp, Sorghum bicolor
  Clone ID: SORBI-28MAY03-CLUS32790_1
cagatagtgaagatgagccaacagaaatttgcttctaatgttgttgagaagtgtcttacttttggtaatcctgagcaacgccagattgtgatcaatgaaatgcttggcacaactgatgagaatgagccgttgcaggcaatgatgaaagaccagtttgcaaactatgtggtgcagaaggttctagagatatgtgatgaccagaaccgtgaattgattctttcccgtatcaaggtccacttgaatgcactgaaaagatacacctacgggaagcatattgtggcacgtgttgagaagcttattgccgcaggagaacggcgcattggcgccccatcctcctgctgagaaattggttaggttacagaataacacctgtacagacagacagaagatagcgaggccttagctttttactattaccagtagtcggtaatattgagcgagtacaactgcagaagttaaaaaaggctcccgaatcctttgatgtaaataaaggagagcctctggaaataaataaaaagaatgaaaaaagatgaagagatttttacttgtccttgaggaaagagttgtatatttgtatggtttattttcccctcttgaagcagcaggataaagaagtgcagaatattgtggaagaagcaaagcaattagcagaaggataaatgttttaggatcaatagatgatgggaagcaaggacagctgtagattatcctttttccttgggtttcatcagtcactgtataagtaaggttcatggtgatgttaatctctgtaaagcctgccttcagtttactgacatttttctgaaatcaaatcaaacgca

SEQ ID NO: 8256 - DNA, 714 bp, Sorghum bicolor
  Clone ID: SORBI-28MAY03-CLUS32798_1
gcacgaggctcatcttcaacacggacaagaaccactcggtggtgcagacgcggaacgggacgctatacaagagctgcgactacaacgactcgggccccgacgacaccgtcgagtggtccgccgcggcgccggagttcagcaaggacgccgtcaccgtcgccgtgccgctcctcaaggaggggcgcgcctacttcttctcgggcaactacgacggcgagcagtgcgagagcgggcagcgcttcgccatcgacgtggcccacggccagggcctgccgcctgacctcaggccccccgtcgccgacgcgccggcgccctcctcctccgcagggaccgccgacggcggcgcggccgcgctcgacttcagccaccccaagaatgtcaccacgcccagctccgcggacgacgacggcggcggcgaaccgagcggtggtggcaccacctccggctcctcctccacttgtcggactcttgccagccagctgaggtcccctctggccgtgaccgtgacgctgctcatcaccttgctcttcgtgatgtaggtggcatacgttagtctctcctttgtttgtgtggtgcttgggcctgatcattaatttatttactgtactagctagctagtcaaatagaatggtttctatatgtagatgaaatgttttcacttgtatattctgctggctatttatttgatttgtaccgtgtttcatataataataa

SEQ ID NO: 8257 - DNA, 613 bp, Sorghum bicolor
  Clone ID: SORBI-28MAY03-CLUS32875_1
ctcgccggccctgtcggacgtggtggccgagagggccgacgtgcgggcgcacgtgccggacgccgggcaccagcagcaccatcacctgcaccagcaccagcaccagcatcacttcttcatgccacacccgcagttcctgcacgggttcagcctgctgccgggcaaccccgaagcggtggctgccaatggcaacggcggcggcagcagcagcgctagcgtcgctgccggcaacggtgacgagatagcgctggcgatggcggcggcggcggaggcgcacgcggcggggtgcatgctgccgctgtcggtgttcaactaggcaggcaagcaggcgtatagccaggcgaggtagggcttaaacaatagtagattaatccgggtgcttatctagtgttaagatcgatctcattgtcacgatgattgagatgaaccgatcaacacgtactacgtgctgctgttcttcaggatttcctgttcccatctcttttggttacatcatgctcctgcatttcctgctggggaatagtattagtagctgtgcttggtactgtagggtttgcagaatcctgcttggtttgtgtatgcaatgcaatgatgggggagcatataatataag

SEQ ID NO: 8258 - DNA, 447 bp, Sorghum bicolor
  Clone ID: SORBI-28MAY03-CLUS31152_1
gcacgaggctcgatctctccccaacatcgtgagccgtgactcctcctcgatctctcccccactcaagatcaccagggcgactcctcgatttcttcctcatgtcgcccctcctacttgatgctggaggagcaagcgcaggggagccgttcaaaccatgcggaccgacgctgggcaaaggcgaggccgcggcaaaggcgtcatagggcggggacgtcgcaaggctggtgaggccgcgcggtgggggcgtgggctgctgcccgtcgggcgaggacgcacgccgccggccaccgccacccctttcctgccgctggaggagcaagcgcaggggagctgtcaaggccgcccggatagccgccgggcaaggcgaggccgcgacagaggcgtcacagcctcacaagatgcggacgcggcaaggccgatgaggcgcgtcacagcgaggcgaaactg

SEQ ID NO: 8259 - DNA, 569 bp, Sorghum bicolor
  unsure (1)..(569): unsure at all n locations
  Clone ID: SORBI-28MAY03-CLUS31214_1
gcagctcagatgggccagttcatgaaattcgaagagtttgcagatacatcgtcagggagtgtcaattcatcatcgtcagcatcaataccagaactgccacggctgcatgctgatgtctgcagttccatgttcttctgttgaggtgattttagtttgaccgttgtggggtagggctacttctttctgaaggagaaccttatatgttggtacacagcaggttaactgttttgtgaagaaaccaagtaggttgttagttgtcgcaaagcacgagggccagcatattttggagcagttttgggctcccccccaccccaccccaaaatgtaggtacagcttccagattttaggtagcctggacgtttgcatctgcaggtttttcgattggaatctagaagattttagggatattgagagagtagagccagacctttgaggtgaaggatacttggttaaatgatctttctgttaatccccaaaatgcgtgtgcattgggggggtataaaaatgagttaaaatttctgtatctcgcatggcatccaattgtactcgagtgtttgtgctgtnnaaaa

SEQ ID NO: 8260 - DNA, 687 bp, Sorghum bicolor
  Clone ID: SORBI-28MAY03-CLUS31255_1
gcacgaggctagtctcgagtcttttcttgataggatggtttctcaacttcggtcaacatgcaagtactacactggatatcccaaggacctagggccatcaagaattataccattcacatctgagcgtcagtttgtgcagctattacatgaaggcaggcctgtagttgttgcctttactattaagtgcacatatacacagcatcttgataaagtactggaagaggctgcggctaagttttacccacatatcaagtttgtccgagttgagtgcccgaagtacccagggttttgcctcacaaggcaaagaaatgaatatccatttgttgaagtattttacaacccagaacaggctgcaagccaaggaaagagcgtggatcctaacatcactaagtattctgtaaaagtgctacctttcaactatgaccagagcgtgtatggatttcgagaatatttcaggaagcatggtttcaagtattctgaaacaaactaatctgccttaagagtagtcctagggaactattgcagttgtttggaattggaatgtcgtgccttaactcttgttcattcaagaagtggctgtcatgtattcatgtatacggggtactgtccatgcctatagattagctttgccatacctatgaaccattggatttagttaattatttatacctctcaaagacatacaga

SEQ ID NO: 8261 - DNA, 631 bp, Sorghum bicolor
  Clone ID: SORBI-28MAY03-CLUS31233_1
gttgagatcgtctttcaaaatacagagaacttcgtgcagtcgtggcacattgacggttacgcgttttgggtcgtcgggatggatggaggacagtggacaccggctagtcgtcagggatacaaccttagagacgccattgctcggtacacattgcaggtgtaccctcagtcatggacagctatctacatgccgctggacaacgtggggatgtggaacgtgaggtcggagagctgggccaggcagtacctcggccagcagttctacctccgcgtctactcgccagcgaactcgtggcgggacgagaacccgatccccaagaacgcactgctctgcggccgggcctctggccgccggacgaggcctctctgaagctgaagccctgaacccaagacggcaagaccttgtttgtttctggcaacgaaggggtggccggaacttccagggatttgttgaacagagataattggggtgttcagattgctgaacagagttccgttttgtggcgctgatgatcaaccagctcatatattatttagcaattgtagttaaaacattcccggtggatttgttgtatgggaagctttctcgcttcctcgctcacatcattgatgatgataatgataatattcat

SEQ ID NO: 8262 - DNA, 550 bp, Sorghum bicolor
  Clone ID: SORBI-28MAY03-CLUS31257_1
gcacgaggtgcactgttccagcgtgagatagagaaagagagagagagagagagagcaaggatggcgtctctgcttagcctgtacggaagcggcggccggaggaggatgagccgcagtagtggcacggcggcgccggtgaggcggctgctgaggagactgaggtccagcttcggccggagcgcggcgcggccaaggcgaagaagcgcggtgaggttcgggtacgacctgcacagctactcccagaacttcgacgacggcgttgcctcgtcagctccggcggccatggcttgtgcgtagctaggattctagaaccagccaatcaggattctgcttctcttatgtgtaaataactatagccaagatattagtgtggcttaatgcttcctcactgagagattgaccgagtccagggttaatttccggtgattagctatctactgtaggttcgttagttgttgtatatacaagttgtttcgtctgtgtaataagctacccacaagacagcagttctatgcctgccatagatcaacacacaaggggatttaaaaaa

SEQ ID NO: 8263 - DNA, 425 bp, Sorghum bicolor
  Clone ID: SORBI-28MAY03-CLUS33061_1
gcacggcgcgaggcagagagagaacacacacagacacatccatacatacagtttgcggtatagctaggaaggatcatatcgagctagcaacgccaagcatggcggtgaaggtgtgggtgttcgtcgtggcactgatgttcatcggtgtagtagtagtagtagggcttggagctgacgacggcagcagtagggatggcgccggcagccttagccgctgtcgtctgagctcgcccaactaccatggcgctctggcaaaggccatcctgttcttcgaggggcagcggtcggggcggctgccggcgaaccagagggtcaagtggcgcggggactcggcgctcaccgacggccaacccgaaaacgtgaacttgacgggcgggtactacgacgccggagacaaccggaagttcggtttcccgatggcgttc

SEQ ID NO: 8264 - DNA, 1061 bp, Sorghum bicolor
  Clone ID: SORBI-28MAY03-CLUS33113_1
gcacgaggcacagatctccccacctctctctctctctgcccttgctgtcaccgtcgctcgcgctcgcccaagtcgtcgctccccggtcggcagtcgccgcgccgctcagctccgacgcgagctgagcgacgcaaccgcgcgcgcgtctccctcctccgctccgctcggcgctgctctgcgcggcgccgctggactgctacggggacacgggatctgactggcggctccgggcttggggaaggcgtggaggcgatgcagaggcaggggcggcacctggagcggtccaactcgaagcgagcgctcgaccatggcgccggcggtgacgacgacgaccgcccgtctaagcgcccgcgtgtccccgcgctcgccagtgtcctcgtggaagcactcaaggtagacagtttacagaagctttgctcatcactggagccaattctgcgcagagttgtcagtgaagaagtagagcgtgctttagccaaattgggtcctgcaggtcctgctaggatccaaggaaggagctctcccaaacgaattgaaggccctgatggtagaaacctccagcttcagtttaggactaggtgctcccggccactctttactggaggcaaagtagaaggcgagcagggagcagcaattcatgttgtgctgcttgatgcgaacactggacatgttgtcacttcaggacccgagtcatctgtgaaactggacattctggtacttgagggtgattttaataaagaggaagacgagggttggaccgaagaagactttgaaagtcacattgttaaagaacgagaaggcaagagacctcttttaactggagacctgcagataacccttaaagaaggtgttgggactataggagagcttattttcactgacaattccagctggataagaagccgaaaatttagacttgggttgagagtctcctcagggttctgtgaaggaattcgtgttatggaagcaaaaacagaggcttttactgttaaagatcacagaggcgaattgtataagaagcactatcctcctgcactaaaggatgaggtatggagattagc

SEQ ID NO: 8265 - DNA, 610 bp, Sorghum bicolor
  Clone ID: SORBI-28MAY03-CLUS33114_1
agcctccgcctctcctcctgctcccggccgccgcgcgcgctctctctctccctctctaagtgcggcgactggttggggtaccgccgccgccctacgccaggtgccgaggccttcgccgatctattcgctggcgaagagcgcccaccaggtgtggtgcaggagcaggagtagatcgccgccacagaaccctcgctgcgaccatggcgactttcgcgaaacctgagaacgcactcaagagagctgaagaattaatccatgttgggcaaaagcaggcagccctgcaggctttacatgatctcattacctcgaaaaggtacaggtcatggcagaagcctctcgaaaagatcatgatgaagtatgtagaactctgtgtagacctgaggaaaggtagatatgcaaaagatggtcttattcagtataggattgtctgccagcaagtgaacgtgtcatccttggaggatgtcataaagcacttcatgcagctttccaatgagaaagctgaacaagctaagagtcaggcagaagccctggaagatgctctggatgttgaagatctggaagcagacaagcgacctgaggacctcatgctcagttttgttagtggggagaa

SEQ ID NO: 8266 - DNA, 656 bp, Sorghum bicolor
  unsure (1)..(656): unsure at all n locations
  Clone ID: SORBI-28MAY03-CLUS33244_1
aaaaggcagagagagtagagagggagcttgtcagcccaagagaaggttccttcccctccttccccaccttgccctcaaccccccatcatcctctcacatccgattgtgccctgtcgctctgcggttctcggcatccaagatttggctggccggccggcggtggctccaggagcgggacaaagactggatttttccggccatggaggcgtggcctgatccgttcaggcccgggcggtggagtggcttcctcaccaggtctgattcgtattggttcaaatgatctgggcggcttgattggttgcttcagcttccgcttccgccgggggatcggagctagggctgtggtttcttggccggctggtggattcgtcggcttgggatcttgggggttgttggttcagcacacgagccgaaggtctgcgtagatcccctcttcgcttccttgaccgatttgtgctgctggggttttggttagttggttctggtgggagatgattaagcagatccttggcaggctgccgaggaagccggggaaggctggggatagccgggaagctgctgctgcggggaatggaactgaaccgcccagtgccgactggggcgcgggtgtatcactccnatgagccgttaccggcattcaaagatgtgccagcttc

SEQ ID NO: 8267 - DNA, 1010 bp, Sorghum bicolor
  Clone ID: SORBI-28MAY03-CLUS3327_1
cgtccggctgagcactacttcaacatgatgaaggaagagtacaaaatagagcctgttgtggaccactacgggtgcatgattgacatgtttgtgcgcttgggacaattagacgatgcattttccttcatcaaaaggaccgggtttgaaccaaatgaagccatttggtctagcttggttgctggatgccggagccatggaaacatggaccttgccttctatgcagctgatagactgctcgagctccagccaaaaggagttgaaacctatgtcttactgttgaacatgtacatttctaatgagagatggcatgatgtggctagagtgcggaagctgatgaaacaggaagatcttgggattctcagagaccgcagctggatcacaatcaaagacaaggtctatttcttcagagctaatgataagactcacgaacttagtgatgagctgtatcaactgctggagaatttgcttgagaaagctaagaccattgggtttgaaccataccagaacgctgagttatctgatagcgaggatgacgagaagcctcctgcaggttcagtaaaacaccacagtgagaggttagctgttgcactggggctgatccaaacacctccaggtgcaacagttcgtgtcacaaaaaacattaccatgtgcagggactgccacagctcaattaaatttttttcattgcttgtgaacagagagattgttgtccgagacagtaaacggcttcacaagttcaaggatggacgatgctcttgtggagattttggtgcactactatgagtacaggaatctgtagattttgctgatcactctacagtggtctatatatttttctccagaagcaagttttgttcagtcaacatctgtaacatatgaccagaaactcaaatcatatttgtcgaatatgctcacatgggttagcaatataggatggtgaatatagtgttgtaaaagctggcctaaccggatctcactttgttatttttaattcacaatttggcattctt

SEQ ID NO: 8268 - DNA, 1168 bp, Sorghum bicolor
  Clone ID: SORBI-28MAY03-CLUS3145_1
gcgcacgaatcatattttatcgtgcatcccttattctgtctgtgactctacatataaattatgaatgctaattagagtctagaagaggaacatcttgtatatccgggggggcgtcaaatgacaaaagttgtatgtattgatttctttcagctggaatagaagcatggaactactggcctgcagatatgcaggcgctggaacaactgctaagataataagaaatagtcatatgtgctgccaagaattcgtgtcaatcggttgcatcatcacagggaacacccagctgtttcattcatggggatgcccgtccgcccacgcgtccggttggctgcttctttatgtctatgttcacgatttctgtggctttaggttggattcaattaaattggccgcatgtgtgcttccatgggtctgaagaatacacttaaatttttttggggggctcatgtttttaaaaggcgatgagattagcgctttaggcttgcgccttactgctcctattttacaaaaaaaatcatgtatttcatttcattcgaactcaaagattaattgcacgtctgtttgtttttaactagagccattttgttcagttagtaagtatccatatgcatttttttagctacaggacttcaaagttttacatttatttctatgttaaacatgtttttgattgcatcatctttgtacagtgaaactgacacatgaagactaaaacaacaatttttgcaaacagagctcgtttcagacgtcactcttgttttgtccgccctggcctcgcggctgcccagccccgactggcccgtttgggcaaggccttctgcccgacgcccgttctgggtccgccgcgatgctggttgcctgcccgcctccggatcggttggccgttgtttcccggcagcagccttcagccccttccttccgcacaacgcctcgtctgggtctgcggccttgcttcctactttgccgccatggtatgcctctcgcttttcagctccgaagccatcatcgtccccgacctttctccgatcggctcggccagctccacgtgcttttttcctttcacgcacgtattttttcctctctataatcagctccaaagacatcaaggtctatgacctttcacctatgtactaagccatcaacaatgtaatcataatatacacgtcaa

SEQ ID NO: 8269 - DNA, 628 bp, Sorghum bicolor
  Clone ID: SORBI-28MAY03-CLUS32033_1
cgtggacgtgccccaagtaccgcgtcacgttcgacgcgtcggtgatctggggcctgatcggccccgggcggctcttcggccggcacggtctctaccgcaacctggtgtggctgttcctggtcggcgcggtgctccccgtgccggtgtggctgctgagcagggcgttcccggagaagaagtggatcgcgctcatcaacgtgcccgtcatctcgtacggcttcgccgggatgccgccggccacgcccaccaacatcgccacatggctggtgacgggcaccatcttcaacttcttcgtcttcaggtaccgcaaggcgtggtggcagaagtacaactacgtgctctcggcggcgctcgacgccggcaccgccttcatgggggtgctcatcttcttcgcgctccagaacgcgcaccacgacctcaagtggtggggcacggaggtggatcactgcccgctcgcctcctgccccactgcgccgggcatcgccgtcaagggatgcccggtcttctgaatgttccaagctaagcggcgtagtaagcagtgtgtgtaacagtgtaaggaaatgtttgctacgggagccatggattcagccgggcatcgtttaaccgatgcagtgctttaccactcgtg

SEQ ID NO: 8270 - DNA, 529 bp, Sorghum bicolor
  Clone ID: SORBI-28MAY03-CLUS3211_1
cgtccgcctgctatgtacaagaagaatgttctaacgacaagatgagagaactcttgtcagcagatctgaccaagttggatgaggccatatgggatacagctgttgagatgaggaataatatcatggcttggagctggacagacgatagcagttcatgtgacattcacaaggtctcacactccatagtaagctacaccaaggtgctgtgggccaattgcaagtcagtgaatcgcattctacatgccgcggttctccgcggtgagtttgtgtcggagaacaaaaacttgaaccatgtgaccaacctcatcacacagatggtctcttcactagagagagagccttccacaaattcatccccggggtccttcccagatgagagcctcaggttcctattcttgatcaacaatttcaaggaaggattatccctttattttgatcaagggactcatcccttacaaacaagctagtttttgctcttagtttgatctttttggtttcctttttggtttcttaagatagttgtctgtct

SEQ ID NO: 8271 - DNA, 415 bp, Sorghum bicolor
  Clone ID: SORBI-28MAY03-CLUS32140_1
gcacgcgccaccgccaccgccgcaacagctcgagtcgctcgtcagatcctccgagcaccacagctccggctccgcccccgtcgccatgggtaaggttcacggatcgttggcccgcgctgggaaggtgcgtgggcagacgcccaaggtggcgaagcaggacaagaagaagaagccccgcggccgcgcgcacaagcgcatgcagtacaaccgccgcttcgtgaccgccgtcgtcggcttcggcaagaagcgcggccccaactcctcggagaagtagatctagctatggcttgtgtttttgttccccactagtttctttgtactgatcgcaagttgaagacttgtgctattatctgtatcgatgttactgcaatactatcaagtatgatgctgttactgcaaaaaaaaaaaaaaaaaa

SEQ ID NO: 8272 - DNA, 734 bp, Sorghum bicolor
  Clone ID: SORBI-28MAY03-CLUS3225_1
gtttttgtgccgtgcggtcacatgtgttgctgtatggcatgctcttcacatttgacaaactgcccaccttgccggagaagaattgaccaagctgtcagaaccttccgccattgatggtgatatatgatgcaaaaaactgtcatggtacaccacgtgtactgcttctgaaaccaattgattcttggaagtgcgctgctgtcagccatcaacatgaactgctctactgggacgaagcagcttcaatgagtttgcttctcgaacagaacagcgactgatgcaagttgcaagctcataattggcagttaagatactctagatagtgccaatgggtgctcttgcctgtaatgttctacaactgtgtacaggacgctcttgtgtaaatgcacataggctagcagcttgcttattgacaacactgataatggtaatatttattgttgcccgatgggcatttgtgcaaaggaatagcaaaatcagctcgtttagttgtgataatcgatttttctgatgatgagtgggaatgagaggcgccttttgggggtttcttttgtgcccagttgtatttggcaggatcataggaaacagaagatttgtaatatgttgtatattttaaggctcattttgtagcctgtactgtatgtgaaaactccatgttgacacattagttctctccatgcatgttccgtgctgatttacagacgtgcaataaggtataacactggctgactttcagg

SEQ ID NO: 8273 - DNA, 797 bp, Sorghum bicolor
  Clone ID: SORBI-28MAY03-CLUS3234_1
gccggccgggtcgggtgcaatggcttggcctggaactatgtacatcggaaccttcctggttggactcggatatggagctcattgggctattgtaccagctgctgtttctgaactttttggtgtaaaacacttcggtgcaatgtacaacttcctcacagttgcaaaccccacagggtcactcatcttctcaggccttattgctagtaatttgtatgactatgaagctgagaaacaagcacagcgccatcagataacagcattgacatctccaagattgcttcacaacatgggttttcttgcagatggaccactgacgtgtgaaggagctgtctgcttttttgtcagttcactgattatgtcagtgttctgtgttgttggagctggcttaagcctcatggttatttacagaaccaaaagggtttatactcacctctacagttcaaaccgcacatgaaacttccatggatcggatatgtcgtttcctcttgttgttccatgtaccataaattttgcatatatgtgtcatatacacacaaaattaaactttgcctgtatattatctattcatttcagaggttttaccacatgaactgctgtccccaaatataaatttacatgcctcatgtgtcagatagccaggctgtagttcaagcttggaccatgaattctgtaataaaggctttgtactaagacatacatgtccattcagctccggctctactgtaatattcttttgtgtgcataatagaatcttctatgattctggcaaatctaaaagctctagtgtgtttctcttt

SEQ ID NO: 8274 - DNA, 1271 bp, Sorghum bicolor
  Clone ID: SORBI-28MAY03-CLUS33462_1
gcacgaggggaatgctgaatcctctggctatgaaatggggcaggaacattcaaaccaggtttttgcttctgatggttctcagagtttgaagtcttctgtttgggggcgaatagcatcaaaaagaaaaccaggaggtagtaacacagctaaaagtacatcaacaagtatcactggaaaccaaaaaagtgattatgatgagatgactctcagcagcgcccgggtaaaatctgctgctaaggatactaatggtcaacccaattcaagaatatatggagatgtgggccggcaaagtaatcgagctgctcagaaagcatcccgtacactatatgtacatggaattccccaagaaagcaacagatgggatgctcttctatcgcattttcagaagtttggtcaagtaatagatatttatattccatctaacagtgaaaaagcttttgtccagttctcgagaagggaagaagctgaagctgctctaaaagctccagatgctgttatgggcaaccgctttataaagctatggtgggccaacagagatagaattcttgatgtgggagagggcagaatctctggaaagtcttcccagttgcctactatgctggctaattctttccccaacagagtcaaggaaaatgttcaatcaacagctccaaggcccagttctggatcttctgctgaaccgttgagttctggtacaccaggttctaaaatgctgccagcaagtaatacaaaaccagtaccaccccatgctcctaaaaggcaagaaagtctagaactattggaagaactacgtaaaaaacaagagatcttagctcagaagcgtgatgagttccgccgccagttagagaaacttgcaaaacaaaaaggttcagcaaactcagttaagcatgcagaggctggtggaaaagaaattgcttctaatgatgcatcagaagtaacggatgcaaggtccatgagggctgaaggggcacaggagattgctggttcattggaaaagagaagttctggagagtttgcttcatgctctcaaaagtctgctgcgacatccacacagaaatcagcagtggttacaaaacagactactctgccagcaccacctcagaataggtttaagcttgacaatcgaaccacatcattcagaattcttccaccattgccacttgaaattgcaaatgaatctgtcttggcagaccatttctcatcatttggggagctttcgtcagttgtcctggaggatactgaagcccataaccatgatgcaaccctaaaac

SEQ ID NO: 8275 - DNA, 718 bp, Sorghum bicolor
  Clone ID: SORBI-28MAY03-CLUS33478_1
gcacgaggaccgcctccgcggggacgcggcgcgcctcaacttccccgacaacgcggcgtccagggcgccgctcgaccccgccgtcgacgccaagctccaggccatctgcgccaccatcgccgccgcgtcgtccaagggcggcgccagggccaagcagagcaaggcgatgccgatcaacgcgcccgtcctggaagcgacggcggcgtgtccgagcaacagctcctccgacgaaggctccgggtcggacgaggagatgtcctcccggacgacgacgacgccggtggttgtggcgccgccggtggtagcggacatggggcagctggacttcagcgaggcgccgtgggacgaggccgagagcttcgttctccgcaagtacccgtcctacgagatcgactgggacgcgctgctctccaactaaaacagtcgccgatcatcagacgtgctgctgtatgttgtagttgagtagtggctgcagtagtaagtagctccgtcgatcgtccggccgccgcagatgaggttttaggcaatctgcaggccgccggccggcacctgtgtactagtagtgatcaagtaggttttgtttgttcagtttggtccccggacctcgccggcgtttttgtgaccggcgtccccgctccggatgtaaaatgtttagatgtgagagtgcacagcattggtgtactggtctgtctgtaaaaaaaaaaaaaaaggatctgta

SEQ ID NO: 8276 - DNA, 813 bp, Sorghum bicolor
  Clone ID: SORBI-28MAY03-CLUS33553_1
gcacgaggtaccagctgatgcgacaggttccactccacactttgggagaaggggatctgaactaggtccaactcatgttttagttgttcgtggcttggatgaaaatgctgatgaggaaatgcttcggtacgaatttgctaagcacgaggcaataaaggatatccgccttgttcgggataagtttactcatgtgtctagaggttttgctttcgttcatttccattcggtggaagatgctacgaaagctctggaagctacaaatgggactacacttgagaaaaacggtcaggttttgcgtgtagcatatgctaaaagtacacatggacctgcatcgggcggttcgcagtcaaacagccttgctgcggctgccattgaggctgcatcatttgctcagcagtatgatgccataggttgggctccaaaagagtacaatcctgatgacaaacagaacagcaactctgaatctcaaaaagatggtggtacaacacagtcgggatttgtttgggatgaaaaatctggttactactatgattctgcatctggattctattatgatggaactactggcctttactatgacagcaactctggagtttggtattcgtacgatcaacagactcaacaatatgtcccttgtaatgaccagaacaatactaaggcagccggggaggcagccagtgaaaacactaagacctcagatagtaatagtggcaaaaaggttgtgatctctgcgccagctgccacaactaaacaaagtgagaaaacttcacttcctgatgctgttcaagctgctgcaaatgcagcactggctgc

SEQ ID NO: 8277 - DNA, 610 bp, Sorghum bicolor
  unsure (1)..(610): unsure at all n locations
  Clone ID: SORBI-28MAY03-CLUS33579_1
gcacgaggcaaaagggccactgcgggagacggagcacggcgacgccccggcggcgaggaagaggaggaggaggagggatacgacggcgagggaggagctgtctctctccacgcgcgggagcgctgaccctagctgccaacctcgcggaagcaccggattgtgagggaggccgaggggagacgggcggcgaggcgtctcgaggaggcgggggcgggatggcggcgccggggaagggtcccgcggccccgtccgcggccctgttcttcagccccctccgcaagctcgcgctcaagtaccaccccgacaagaaccccgacaacgaggaggccaacaagcgcttcgccgagatcaacaatgcatatgaggtgttgacggaccaggagaagaggaagatctatgaccggtacggcgaggaggggttgaagcagttccaaggtgggagaggcggtggcggcggaatgaatattcaggatatctttagcagcttttttggtggtggtggtggtgggatggaanaggangaagaacaaattgtaaaaggcaatgaggtgattgttgaactggatgcttcattagaggacttgtacatgggcggttcattaaaggtttg

SEQ ID NO: 8278 - DNA, 676 bp, Sorghum bicolor
  Clone ID: SORBI-28MAY03-CLUS33587_1
gcacgaggcctcctcgccatcgcaattcgcacctgtcgcctccgccgcgcccccccccccctcgcggcccgcaccagtcaccagcgcatcgcctctccccgccatttggcccggaacccctcgcgacctcatctcctcctcgtcatcccacgcgtagagttcgtcagggtcgcctccagtggatctcgagaagtccgatttcccaggcgctgctgttaccttgggtggagctcggaccgcggattagtgggattttgaagggagacggtgtttactgacttcctttcactactcataccaaatcctttgtttcgagtcggaagcaactgattttgggcgtcgcggcttaagaataatttcttccagcccggatacatattcgtacttggattcagcgtatgcattttttatgctgacataggatgtgctccaccatctgtgaactccctctagttgcacaaaccaaccactgcagtgctctctctctcttcgaatcaggctaatgggtagcgcttgccaagctggcatggacgggccttcccgcaaggatgtgttggggatagggaatgtcgccttagagaatggccaccatgaggttggagctgatgcagatgaatggagggaaaaggaagaggacttggccaatgggcacagtgcgccaccgggcatgcattat

SEQ ID NO: 8279 - DNA, 1018 bp, Sorghum bicolor
  Clone ID: SORBI-28MAY03-CLUS32843_1
ttgaagctgatgccttcttccctgggtttcacatgatgggagtggttggccagactactcaaatttggtcatggggcaccggttatacaaaacaccttccggtataacctacaggcctgacagaaagattattgctgcgctgtttgaagatgttaatgatcatcggtatcatccaccgcggaattggacgattgctgcacgtgagcacctcaacaggagtgcaagtgtggaaggcatcgtgtcatcagctatgttgtcaagacctgtatcttttctcgcccaccctttgccagagtgctcttgcagaacgccaaagtcacctggtgttcaaccggtgaaagacagcaatggcagattcctatttggaggtgaggaagagtgtcctgattggatggcacgcagccttgcaacagcgtctgccaggaataatgaacctcaaaatgaggactatgaggatgagttgcctgaagatggctctagatcagacacacaggaatctgacagaactgactcgaataaatcttcggagcaagatgaagagatggatccggatgattagagagatgtgtggagcatggatttatggcacaccttttaactgctaccagctccaggctactcaagcaagaaaagcatacactcaggacttcctggaccagcaggaatcatcttgcattgcagcagcgcatcagcatctggagtagccccaggatgacaaggtcatccagcgtgggagcttgcctggatcgtactcggtatacaaccaggcttgaatacgaaactaacactttggttctcttcttccttcacgtcttactcatttttttgtttattacatttttgtgggtacagcccaaagaaattgtttctgtacaaatgtcttaactgggaacgcattattttttgagtgagtttgatatctagcatttatgaggtaatgagattggcttatggtggacagatgtgcacctgtaaaatacaggacaggcattgccgttttgtcccacgcaattgatgt

SEQ ID NO: 8280 - DNA, 773 bp, Sorghum bicolor
  Clone ID: SORBI-28MAY03-CLUS32923_1
gcacgagggccgagcaccgacgctgcagacatctctctccccgcctcgcgccgcctcgccagagcaggtcggctcgcctccggatatgcaggagccgctgtccaactccgacggtgggcacgactccgccactgagagcgccagctcgcgcgagacatggccaagggagcctggcaagagtggcggtgccggtggtcctcctgtggcggcagcaccgataacggcgctgaggatagctgatagcaaggagaaggaggtggttggtaatggcgtcgctgagatgcaggccatctggagtaggatgccgagtgccagtcggatgactatcagggaggtcgctcgagaacgggtggaccttgttgctgagaagatgaagggtatgagtgacgagctgctggacgagaccaagaccgagctgcggtcgattctggaagggagtggtggtccgcaccagattcaggagttcatgtacctgcagaagcttgttcagggcagggttgatctcaccctgcccgtccttttgatggctcaccacgtgcagctggagatcctggttgccatcaagactgggatacaggcgttcttgcatccgagcgtcgacataccccagagctgcctcgctgagattttcctgtacaagaggtgccgcaacattgcctgccagagtgctgtgcccgctgaggagtgcaagtgcaacatatgcagcaacaggaatgggttttgtaatctctgcatgtgcgtgatctgcaataagtttgattttgaggtcaata

SEQ ID NO: 8281 - DNA, 645 bp, Sorghum bicolor
  Clone ID: SORBI-28MAY03-CLUS32981_1
atccgtcgcggtccgccgcacgggtgcgcgcatctcggcggcagcaagctgaccgcgggaggaagaaacacacatcacaccctagctcctaatccaaatactatactctttctttctctctcccctcgcggctccatttctcctcccccctcgccgtgcgggagaagcgcgtgaaccgccgcctcagctccgtctcgccgtggtcgcagttagccgccgtggacgcagctgtgactttaggcaattgttggaacatcgaggatttgctgatggctgatgctgtcacaatggatgattctgctgcaagcaccagtgggttgggggacaaggatcacagtgtctctgctgattccctttctgagtggcgctcccgtgagcatgttgataatgggatcccttcaacatccccccccttttgggacaccgatagtgaagacgatgatcctgggcctagaccttcagatttatttgggagatatacttggaaaattgaaaacttttcaaaggagaagaagagagaaatgaaaagtgaaccatttgaagctggtggctacaagtggtatattctagtttaccctcagggatgcgatgtctccaatcacttgtcattgtttctttgcgttgctgatcatgaaaaacttctcc

SEQ ID NO: 8282 - DNA, 907 bp, Sorghum bicolor
  Clone ID: SORBI-28MAY03-CLUS33031_1
gcacggggcgagagcgcgccacggcaaagaagatgctgccgaggagggcgagagaccccgccgccggcgtcttgacgatccttcctgccatcctgctcctggcagtggcggcggcgatggccatggcggcggcggaggaagcgttgccgatgccgatggaggtctacttcacgcccgcggagctggcgcgcattgcggggtacggcgaggagccggtgtcgtcggtgtccgtgtccgggcagctcacctgcgagctctgcctccgccccggctcccaactcctcgccttggacatgccaggtgctaaggtagcagtaacctgcaaaagtgatcggactcccagcaaccaattggatagcttcgcatttgctacgacggatgagtatggcaacttcaccatcgatctccctccccagctccacgccacgccagacctggagaaggcctgcaccgtcaaggtgctccagctcccggcagactcctgccggctccgccaccgcaccggcgacacctatggcctcaggctgtcatctgtagaagacggcgtccgagcctacactgctggggtgatacggcttcaagacagcgatacgccgtccgatcattgtgtgggtgtggagcacatgtctgagagaagatgaacagttgatcgaaaccgaagccataggatacgctaggtgcatggtatatatgccaaacgaagagttcacgtttgtatggatttttgaagggaaggttaaacacgaagatacatgacatgttgactgggcctctggtatagcaggaatcaagcatgtaaaaaaaatgtaggccaatatttgtatagttcttactttagtaacgataaatgtgcatgaatcagacaagagttcttatctcttgtgtagtagaaaagtcactactgacg

SEQ ID NO: 8283 - DNA, 672 bp, Sorghum bicolor
  unsure (1)..(672): unsure at all n locations
  Clone ID: SORBI-28MAY03-CLUS33017_1
gcacgaggctcccattcttgcctacctctctctctctctctcatggtcgttttttcctcgcggggacgagtcggcgagcagggtcgcccttcgccaggtcttcaccgggcgcttggccagcgatttgcacccgccagaattgcagggagattgtcctctgattgaaagacatgtttgggcgtgctccaaggaggagcaacaacaccaagtactatgaggtccttggtgtctccaatactgcaagccaggatgagcttaaaaaggcataccggaaggctgctataaagagccaccctgacaagggtggagacccagaaaagtttaaagaattatctcaagcttatgaggtgcttagtgacccagaaaagagggagatatacgatcaatatggggaggatggtctcaaggagggaatgggaggaggcagtgattaccataatccgtttgacatatttgagcagttttttgggggtggtgcctttggggggagtagctcaagggtacgcaggcaaaaacgtggtgacgatgtggtgcattcattgaaggtttctttagaagatgtgtacaatggggctaccaagagactatcgttatcacggaatgttctctgctcaaaatgcaaggggaaaggaaccatgtctggagcacctgnaacatgctatggatgtcatg

SEQ ID NO: 8284 - DNA, 681 bp, Sorghum bicolor
  Clone ID: SORBI-28MAY03-CLUS33036_1
cccttctcttcgatctccccctctcttctctctctctctccggccggccatcagttccagcgactgcggccttcgttcgtccccgcagtcagccgccgccgccgccgcgcacgaggcaagaaaccaaaccgcgcctgatcctccctcctcttccgatcgatccccaggcagcggaaaagcggagcaccgggagctgaagcggttatccctcgtctccgtcaactggcatcccacaaccaagcaaagcaagatgggcggtttcgtggatcccttcgtcccggaatctgcttggccacaggacaccatgttcatcggctcatcctggccagcagcaggccctgcagggacgtacctgggaggagcaggagctgctgcaccagatcagcttcacctccagaacgtctcctcctcctccacaggagcgctcttgaacggcagcgccaaggagatcgtgtcgctgtcgccggtggaggagctgcacgagcagttcctgagcgcgcacctgccgctgccggcggacgacgtggcgccgcagggcctcaactttgaagtggactcggtggttctgagcacgccctgcgcaatatcgctcgccgacagcgcacctgtggtgtgctgcagctccaacgacagcagcgggagcgagcagtccggcctgccgccgttcctcctcctcggggt

SEQ ID NO: 8285 - DNA, 909 bp, Sorghum bicolor
  Clone ID: SORBI-28MAY03-CLUS33679_1
gcacgagggcatccgccacgcggcgggggagcgcctcgccgccttcggcgacaaccggcgagaagctccgtcgaaggacctgctccttgcttcttctcgtaatctgggcacgcagctccgttgacgaatccaccggctgcctcaacacctcctccgacgccaaaccctagtctgggctggcgggtccagcaccgtcgcctactcaaggagctctgcagtaaaggaagtgtatagtcaccatggttcatttcaagaataggtacatggtggtggaggtctttatagatgcagctagaggtgaacaggaccctgtaatcctcacccaatttaatataacaaaagttataagggacagcattcagctcaacttcggggagtgtggcctagctggatctcttggatcattgcaagttaagtatgttaatcctgtaacaaagctctgcattgtccgtgtatcacgtgaagaccaccagaaagtttgggctgctatgacaatggtgaggtgcattgggaagatccctgttgcattcaacttgctcgacatgagtggaagcatcagggcttgcaagaaagctgcgctggagtgtgatgaagcgaaatttgaacaatacaaggtggctgctggtgatcgtatcacggcagagatcatccagtcggtagagagctgctttgagaagattagaggactagagagctagcaaaaagaaaaaactatctcccctcctgtttttgtttcgttatctctgcccctaaacgaaattaaaggatgaaacggcacattcagccatctagcattgagcgcacacctttgtatggtctgaagagtgaaagagggaggaacttgtatatatttgcatcgctgatatttgatattcagttggtcccgaaatgaagggaaaggaggtgttc

SEQ ID NO: 8286 - DNA, 1032 bp, Sorghum bicolor
  Clone ID: SORBI-28MAY03-CLUS33736_1
gatgttgaatcgaagatcatttgcttgaaatatctaccgaaagaaaaggttctgcctttcggctccaaggataacttatgggagatgggtgacactggtccttgtgggccatgtactgaaattcattttgatcgtgctcgcggccgtgatgctgcttccttagttaacaatgatgatccaacttgtatcgagatatggaacctcgtattcattcagttcaatagggaggcagatggctcattgagacctttgccagcaaaacatgtggacactgggatgggctttgagcgtttaacttctatccttcagaataaaatgagcaactatgatacagatgtattcatgccaatatttgatgccattcaccaattggccggcgatggaattcagccatactctggtaaagtaggttctgatgatattggcaaagttgacatggcttacagagtagttgctgaccacataagaaccctttctttcgctatcgctgatggttctcaacctggtaatgagggaagagagtatgttctgaggcgcatacttaggcgagctgtccactttggccatcagaaattgaaggcaaagcaaggattttttagctcgcttgtaaatgtttttgtccaattgatgggtgatgtatttcctgagttaaaagacaatgaaaagaagatcaaagatattattagagatgaagaagaaagctttgagaacactctagcaaagggttatgaaaaatttaagaaagctgcagatgctgttaaggataatggtggaactgtacttagtggccaggatgcttttgttctttgggacacttacggttatccaattgatttgactgaggtcatggcaatcgactacgggctgactgttgataaggagggttttaatgcttctatggaagaagcgaggcaaaaagctagaaatgctcgtaacaagtctggaggaaagtctattgctttggatgcgaatgctacagcacatttgcgcaaacaggggcttgccagcacggatgataacccaaagtttctg

SEQ ID NO: 8287 - DNA, 653 bp, Sorghum bicolor
  Clone ID: SORBI-28MAY03-CLUS33752_1
acgtgggcggcgccggcgacgtgcacgcggtggccgtgaagggcgagcgctccgcggggtggcaggcgctgtcgcgcaactggggccagaactggcagagcaacacgctcctggacgggcaagcgctctcgttccgcgtcaccaccagcgacggccgctccgtggtctccaacaacgccgccccccgcggctgggccttcggccagaccttcagcggcgcccagttcaactgaacacccgacaccccgttcgttcccgcagcgtcgtcgtcttgtcgacgcagtggtggtagtaccagtagttcgtcggtcgtggtagagtcgtcggtccacccccaattggagcttgccgagagaggcgccatggttttatgagtggtgcatctcgcattggctcctgggaattaccagtagttttaggcctagtattagcgcaggttttatcgtgctgggcatggtgtgtgttggcgttcctgggttgtttcggcttgggaattggaagtggtggtaaaggctggcttggagattaacggaggcaggccgccttgtatcacccgccaattaagcgttttgggcctcatggtgatggcctcttttgagaagagatgttttgtggttgtgggttatcaagtgcggttgtaataaacctataac

SEQ ID NO: 8288 - DNA, 551 bp, Sorghum bicolor
  Clone ID: SORBI-28MAY03-CLUS33830_1
agccgctttagacgagaaggcaatgacctgcatgcaacagtcacaatatccctggtgcaagctctggttggtttcgagaagaccatcaagcatcttgacaaccatctggtagaaattggcaccaagggcatcaccaaaccgaaggagatcaggaagttcaaaggtgaaggcatgccactataccaaagcaacaagaaaggtgacctgtatgtgacattcgaggtgttgttcccgaaaaccctaaccgatgaccagaaggcaaagcttaaggatgttctcgtgtagaccattgctttcacatctatgctactgatagttttgaggcgagcgcctcgaggaaaattttccaagtagcttgcataggaagcagcagctgctgcgattcttgtatgtgattttgcattgcaaatacttgcagcctggtcttcttttccgtttcccttttggttttgtcatgcgcccttaacagctcagtgtagttttagaaagcacaacaaaattgtaccaggatatttgtacttttggagttctgaatacatagatggtgaaca

SEQ ID NO: 8289 - DNA, 801 bp, Sorghum bicolor
  Clone ID: SORBI-28MAY03-CLUS33252_1
gcacgagggagacccagctcaggctcgcagctcgacagcggcctaagctcgcccgcgcctccccgttgtccgccctaacccccgccgtcgttgcgtcatctccggccgctcccccgctcccacctccatggcgtcgaagcaggcggtggcgagcgaagcccttgcggcccaaatctacggcatgtctcgctccgagatgtacgacatgatgtccaagatgaagaccatgatcgaccacgaccaggagacggtgcgccgcatgctcgtcaacaacccggatgtcacccgagcgctctttcgggcgcaagtggtccttggaatggtgaaaacaccaaaaactgcacaatcttcagacatggtcccacccacagcagtggcaacagcacctccctcagtcaaaactactgcaccagatcatgtcagcttgcctccgcccccattacctgctaaccagcagagtgttgctcaactttctgccccgtttccatctggcttgtctaatgtgggaacgaccatggacattcctactatttcagcaaacccaccacaaccaatacaagcaaaaggctaccctatccatcagatgccttcatcagctcctcagccatctcaacatccaaacatggccctgcctcatgctcctccacagtattccaatcttccatcacatatacctatagttcatagtcagccacagcaacctttgcaaagtcctgcaatatataatcaacagttgcaaccacctttgccccaaatgtctaggccactatctatgcagcccttttctcatcagatgcatcc

SEQ ID NO: 8290 - DNA, 742 bp, Sorghum bicolor
  Clone ID: SORBI-28MAY03-CLUS33325_1
gacgcgcacgaggatcacatccgcggcggcggcagcacagtgcgcggtcactccactcgtggctgccagtcaccgcgcacacatcgtggtggccatggctgcttcccctgtcctgctcgtcgccgccgcgctctgcctctgcgcgttgttgttcggagcaggggaggcggcgacgaagggggcggaggaggcggcagcagcagcgtcgtcggcattccgcagcagggcgactgacccaaacatggaggtgaagttcgacttctcgccgttcctcatccagtacaagagcggccgcgtgcagcggttcatgggcacgacgttcgtcccggcgtccatggactcgcgcaccggggtggcctccagggacgtggtcgtggaccacgggacggggctcgcggtgcgcctgtaccggccgagccgccgcgccgtggccgccggtgccggaggcgggaggaggctccccgtgctcgtctacttccacggcggcgcgttcgtggtggagtcggcgttcgaccccgtgtaccacaactacctgaacgcgctgacggccaaggccggggtcatcgcggtgtcggtcaactaccgcctggcgccggagcacccgctcccggcggcgtacgacgacgcgtggacggcgctgtcgtgggtgctcgacaacgcgcgccgcggcggcgacccctggctcgccaagcacggcgacgcctcccgcctgttcctcgccggcgacagcgccggcggcaac

SEQ ID NO: 8291 - DNA, 886 bp, Sorghum bicolor
  unsure (1)..(886): unsure at all n locations
  Clone ID: SORBI-28MAY03-CLUS33355_1
gcacgagggaccgaccgggcgaggagacagagaaaaggcccgcccaccgtcgcctcggcagtcgccttcctccctcctcttcgagttcctgaatcccaaccaagggttgttatctgtctttgtagccgaagaaacagtcctgaaaaagaatggagagctcctcagctaggagcaatgtttctgagaggaatcacctgggttatgcgagaagcacatctatggattccactggtcctccgttagctggtaggtctggctcgatgttaagtaggagaagtagcagacagagctcaaggggatccatcagcctctcaagggagatgggggactccatactgagctcaatgaggcattctcttcagtcggcggatcaattgctaggagacattgatagctcagttctggctcagctcattgaaagtggtcgagttctatcacccgaaggcgatgttgatgaggatacagcaaggatctctgagcataataagattggccctcttccagatgaagcaataaagcaaaacaatgaaaaatttgcatcagcacttgtatcttcagcagagacaaaagatactatttctaacatcctagcagattcatctaccaaggttgaaccatataagctttctctgaggcttgactatgctgcttacatgatccatttagctgtctttggctttctcggggtattcacaaggtatgggctccaaaagctgtttggcccagactgcttggcactcacctcagaccaaagcccactttaccctgaccttccatctaatatgcttggatctttcttgatgggttggtttggtatcatattcaaggctgatatacgatacatatntgaccatcttatcgttggaatcacaactggatacatggg

SEQ ID NO: 8292 - DNA, 825 bp, Sorghum bicolor
  Clone ID: SORBI-28MAY03-CLUS33356_1
gccccgccgctccccccgccctcccccacccccccgccccccccccgcgccccctccctcacccgcccccccccccccccccccccgcccgccccgcaccccccccgccccgtccccgccccggtctccgtccttgacacgggcgcgcacccgtccgcctccgactgaccggagccgactcgaccttgttcaggagggagggagagcccgaaccgcggcggggcgggagggctccttttagtttgccccgccggagggccagccgccccatgggccggtcgcctgagcgcgctacgtatcagctcatcgaccggcggaaagggcgccgcgggttctccgtgctgcgcctcgctctggtgccgctatcattgctgggaacctctgtcgtggtgtctccgcgtgggcgggtggccgcgccgtggccaccgccgcgtcctggctctccttggatagtccctcccttccatcccactgcggccgtgtctctgccgtcgttgggtggtccacctcgtggaagttcggcggtgccggttgtcactttgtccggcgttagggggccgtctggatggtcattcctccgttggccccaaataccctggctaagatccccggtgggtgaggcgcccccctcttggcgtgcgccgcgaccccgtggcactactccagaccgctctttgttgccccagctatgaacacattaatgtggaacaacccattcacagagcgtcatcttcaaacgatcaaccaactgggcataatcttgatccccccagttaccaaaaggttggcttgtggcgatcacgggaatggtgcaatggatgaaac

SEQ ID NO: 8293 - DNA, 733 bp, Sorghum bicolor
  Clone ID: SORBI-28MAY03-CLUS33364_1
cctactggagaaaaacaaatccggcggcgcgtggaaaaaaaatccacagggagagagaaaaaaaaaaattcctctcacctccaccaaccctagccaatcctcctgctgcgccatgacgcgggacggcgtgcctccggcggcgcccccgccggtggccggctccggctctggcggcgcggtggcggcggcgggcgacgggcccaggcggtgctcgcagtgcgggcaccacgggcacaacgcgcgcacctgcaccgcgcggcccgtcaagctcttcggcgtgcgcatcggggacaagcccatccggaagagcgccagtatggggaacatcgcgcacctcgctgcggagggcagcggaggaggaggaggcggcggcggtagcagggaggaagggtacggcgccgatggggagcgtccgcacaagaagcgaggtgaggcatggactgaagaggagcacaagaagtttctacttggcttgaataagctagggaaaggtgattggcgtggtatatcccgcaattatgttatttcaaggacacctactcaagtggctagccatgcacaaaagtatttcaatcgccaaacaaatgtgcatagaagaaagagaagatcgcccctggtccaggtcgcgggtgccgcctcgcctgatcagcttccgctctcacgttcatcgtcacaagaagtggagcagcaacatttagatgatccacagcctgttgcagccctgcctgcccct

SEQ ID NO: 8294 - DNA, 623 bp, Sorghum bicolor
  Clone ID: SORBI-28MAY03-CLUS36788_1
cttaagcgtggtgatgttgagcgtggccaggtggtgtgtaaacctggtagtctgaagacatacaaaaagtttgaggcagaaatatacgtcctgacaaaggatgagggtggccgccacactcactttatgacaaactacagtccccaattctacttcaggactgctgatgtcactggaaaggttgagttgcttggtgaaacgaagatggttttgcccggtgacaatgttactgcgaattttgagttgatatcacctgttcctcttgaacctgggcaaagatttgcactgagggaaggtgggagaacagttggtgcaggagttgtctccaaagttattagctaatcagtttccattttcttctgcggtagcaatttagcaaacaaatgaatgttgatatgtccgaccgggttagaaacgagagcaaaggaccggttttgcatttttcttggaatgcatgagcacaaaggcagagctggctggcctggccaccattctggacagtaccttctgttttcttgttgaggtgtggtgctgtgtaacaccacagttagtttggttgacacgcatgttgggcataactcattgattgaataagactagtatcataagcatattttctagcc

SEQ ID NO: 8295 - DNA, 705 bp, Sorghum bicolor
  Clone ID: SORBI-28MAY03-CLUS34028_1
gcacgaggagcgcgcggccgtcccctcccgcgcccgggcgggggggtgtgttgcgggagaagaagcgagggggagagagctaaactagggttcaggggattcggggccgagaggtgcacgatgagcatcgtgcccaaggagacgattgaggtcatcgctcaggcccgcggcatccccagcctcggcgccgatgtcgccgtcgcgctcgcccctgacgtcgaataccgcctccgcgagatcatgcaggaatccattaaatgtatgcggcatgcaaagcggactgttctgacggcggatgatgttgacagtgccctgggcctcaggaatgttgagcctgtgtatggatttgcttctggtgatccattgcgttttaagagagctgttgggcataaggatctcttctatcttgatgatcgggaggtagacttcaaagagattattgaagctcctctgcctaaagcccccctggacacatcagttgtagcccattggctagcgattgagggggtacagcctgcaataccagagaatcctgctattgacgcaattgtaccatcaactgaaaataaaaggtctgagcatgggaaggatgatggacttacaattgatgtcaagcttcctgttaagcatgtattatctagagaattacagatgtactttgataaaatagctgagcttactatgagtagatctgatacgtccctt

SEQ ID NO: 8296 - DNA, 743 bp, Sorghum bicolor
  Clone ID: SORBI-28MAY03-CLUS34059_1
gtctcgcgacgccacgacgccccccgcggccaagccagtctgcagttctgcaccacgcggcggctccacgcagcaccgcccgcgaccccgagctacgccgaacctgcgagaaaccccccggcaaaaacccggcgatttcggtgcaccgcgcacctcgcgcctcgttcccgccaccctgcacgccatggccggggccattctccgccgccttaccccgaccgccgccaccagcccgcgcgtggcgccgctactacccctgctcgtcgcccggggtgtctccgactccacggacgcgatcaccgtggagacctcggtccccttcaagtcccacatcgtggacgcgccgtcgcgcgaggcgaccaccacggcgagggagctgctatctttcttccgcgacatgtcgctgatgcgtcgcgccgagatcgcggcggactcgctgtacaaggcgaagctcatccggggcttctgccacctctacgacgggcaggaggcggtggccgtgggcatggaggccgccatcacgcgcgccgacgccatcatcacggcctaccgcgaccactgcgcctacctcgcgcggggtggggacctcgtcgccgccttcgccgagctcatgggccgccgggacggatgctccaggggcaagggaggctccatgcacttctacaagcgcgacgccaacttcttcggcggccatggcatcgtcggcgcgcaggtgccgcttggctgcggcatcgccttcgcgc

SEQ ID NO: 8297 - DNA, 785 bp, Sorghum bicolor
  Clone ID: SORBI-28MAY03-CLUS34111_1
atctcctcccgtctcccctcctctcctctccttcctccgcccacaaaaacatttgggttctcccccttccgactgctactgccgctgcctcctccccctttccgcctgccttcgctctccccccctcccgccccccccccacttctcctccgtctagggtttcccccgcccgccgccgccgccgttgcccgatccgaggcagatgccgcccgcagcagccatggcgctgccgtcccaggccccgtctaactcaggggatccgctgtacccggagctctggcgcgcctgcgccggcccgctcgtcaccgtccctcgcgtcggcgacctcgtcttctactttccccagggacacatcgagcaggtggaggcgtccatgaaccaggtcgccgggaaccagatgcgcctctacgatctgccctccaagctgctctgccgcgtgctcaacgtcgagcttaaggcggagacggacaccgacgaggtctacgcgcagatcatgctcatgccagagcccgagcaaaccgatgtggcggctgagaaggcgagttctgcgtccgctgcgtcgccgaggccagcagtgaggtccttctgcaagacgctcaccgcctccgacaccagcacacacggaggcttctctgtgctgcgccgccacgcagacgagtgcctcccaccactggatatgacgcagtcgcctcccacacaggagctggtggcgaaggatctgcatggcatggagtggcgcttccgccacatctttcgcgggcaacccaggaggcatctccttcaga

SEQ ID NO: 8298 - DNA, 1200 bp, Sorghum bicolor
  Clone ID: SORBI-28MAY03-CLUS34127_1
gcacgaggctatctctcgtctcccgcccgccgaattaaaactctcgacctgccaagccgcaccgaaccctaggtcccgatccggcgtctcgcccgtgctgcttggatcggacgggtgtgttggatcggatcggcggcgggatgacgatcccgagcgcggaggggttcctccaggcgtcgagctgcctcccttgcacggcggcggaggagcgggaggtcgttgacgcgctcaccagggaggccgagaagaatgtcaagcacggggatctccgctatctcgtctcgcagagctggtggatggagtggcaaggttatgtgggcatattcagtcatggagagaatggcaccgagcagtttcctcaggctatgaatagacctggagagattgataactcgaagcttgtttcggcagaaaggatcaatggtagtgaagagccagagcttcaaaggaccttgagagaaggggagcactatactttggtgccgcaagaagtttggcaaaggctatatgaatggtataaaggtggaccagaaatccctagaaaagttatttttgacaatccaattgacaagacttacatagtggatgtctaccctctctgtctaaaactaattgatggaagggacagttgtcaaaaagttttcagaataagtagaaaggccaaagttcatgagcttgccccaggggtttgctcactcatgtcagtagagcagtccgagattgtcatctgggattattaccaaaggtcaaagggcaaaaagttgcttaatcaaaatgagacactagaagaagctcaacttactatggaccaggagatcctcttggagatgaagctgggcgagagcagttcaggtttcagtacaagatccacaaatgatgaattagcattaattccattagaaccctccacatcatcattttctattgctggagggcctacattttcaaagggtttttcatctgggattggttctagtttttcacaagataatagcttcagtcctttattaagggatagtgaagatggttacaatagtctcagcaatggaactaaagatggcactcatggattgagtggattacataacttgggtaatacatgcttcatgaatagtgccatacaatccttggttcatacacctccactggtacagtactttttggaggactatacttgtgaaataaacacagaaaatccac

SEQ ID NO: 8299 - DNA, 602 bp, Sorghum bicolor
  Clone ID: SORBI-28MAY03-CLUS34124_1
gcacgagccccaggggccgacgatcccctggactcgtccccgtcggcgtccgccgccgccgctgctgccggcggagtctgctccgcccccgccccagcgctccggccgcggcgggagccatttgagtacgggctcctgccgatccccaagctggtcttcccggagggcacgctgacgcaaaccctatcccagctgaaggagaggctcgcgccggggggaccgcgggtgggcgccgcagcgctcgctgatgcgctgcagatccctgccgagcaggcggccctggcgctcgggacgctcgctgcggtgctgcccgcggaggatccggagctcggcgaggatggcgcggggaatgccgacctccgcgacctgcttcttttcatctacatccagtcctacaagcgcctcgtgccgcgcgcgcacaaggactcgcccgccgtcgcggatgtttggccgtccacctccgccttcgatggatacctctccgcgctatcgccgatccagtttgtacgcagcaatagtcgccgttttatgccttcacaagcagatgaagaatctcatcaactgtcatatttacaaaagcatatggccaacattctaacact

SEQ ID NO: 8300 - DNA, 763 bp, Sorghum bicolor
  Clone ID: SORBI-28MAY03-CLUS40105_1
tgcggcgccggttgcccctcgaggtcattcgatatattgtgttggtgaagacatgtgaggatatcactatatatatttctttcattgtctaatgctttgatttgtgtttgttatcttggtctatagtggcatctaaacgggagttattgttttgcaggaacatgtattgcttgacccacctgtctggtctgcccgtgcatctcctgaaggtcctggtcacggtggtcagtgccattacgctccatcctcactcgtcctggcttgccaccgtcgcggtggattgtgtgtcgcagctggggagcccgtggggggcgtttttgtcgcagcctctgcttccccatcaggcctgtgcgtttagggtgttggcgtagccacgttcgtctttggcccgcgcttccaatcggctgtactgggccttccgatgtaggtccctgagaggggcgtcataggcatggcccccctgccgctcaggttcccccttgcctcccttcctgtggatcctgtgctggtgttagggatccctcgatggtctattctcaacgcttacttttcttttgtatcagtcctgtacgtttaggtagtatgcttatccccatttgtctttgaaccgctgattaaataggctgtattttgctttacaatttagataactgataggtgctaaatagttatggactccttggtgcttatgttgccccatgtcttactaccattgtatcctgtactagttttagggatctttcaatggtgtaaacacaaagct

SEQ ID NO: 8301 - DNA, 521 bp, Sorghum bicolor
  Clone ID: SORBI-28MAY03-CLUS40257_1
cttgagggctccgtgaagacaacaaaattgaagatcacatggctagcagatatagaggagctagtccccctctcattggttgaatttgattatctcatcagcaagaaaaagctagaggaggaagatgacttccttgagaatctcaacccttgcactcgacgagagatcccagcccttggagatgcaaacatgaggaacctcaagcgtggagagataatacagctcgagaggaaaggctactataggtgtgatgccccttttatcagatcgtcgaaaccggtggttctgtttgccatcccagatggccggcagcaggcctcgcttaactaggcatggtgaccaatattgttgcattgtacactttaatattgtactgtgattaggttttactcgcagtggatgtctttcactgctagatggccaggtatatcctgccaaccaagcagagcagccattttgattttggtcgatggtacttttacctgagcttgaagattcttatacttttctagcagtgcctt

SEQ ID NO: 8302 - DNA, 713 bp, Sorghum bicolor
  Clone ID: SORBI-28MAY03-CLUS40304_1
ttgtacaagatgacgcagacaaaacacttcctttctgcatgaaggctgattttccagtgagatctgtggatgatgtgaaacattttttcaagcctttgagtctgcaattcgagaaacgatttttcttctccagaaccttcaacattcgtcctgaagattacttggtcatcagtgataagggcaatgtctgcctgggggtgctcgatggaacaacgattggttatgattcagtaataatagtcggagatgtttctcttcgtggaaaattgattgcttatgacaatgataagaatgaggtcgggtggattgattcagactgcagcaaccctcaacaaagcaggattccttccttcctgcgacgagcgttgcacaaccaacttctgtaaatactacacagatgctactgtgaaatcggctgaccatgcttgttcttacagacgtacaatcctgtgtctgaattctgaaactgccatggaaatggaaccctcctcttctttggctataatcgtgtggcggaatgtaactataagatagaagaatggttacaagacgaggaaatagaaagaaaaggtagataagcatagctaggatattgtactttgtattcccgttgtctgtatatagtcaaaagaagcagtcatgtttgctatgttgtagagatctctcactttgtaagattcaagtggggaagcataatcgatagcagttgtggt

SEQ ID NO: 8303 - DNA, 783 bp, Sorghum bicolor
  Clone ID: SORBI-28MAY03-CLUS40400_1
ggtgccagcgttccaggattattaggcggcatgacgatggctcgtttgatgctgagctcgagattggattcaagttccttgttgaaagctatgtctcccatgtggagatggagaagcccaggtatatcaagacgacagcatctgaaagtggactttttgatcatttgataaacgtttgggaatttaagcctggtcctgttccagggacatgtgacctctacttcttagtcgattttaagtttcaatcaccactttatcgtcaggttgcatcgatgttcttcaaggaagttgtttcacgactagtgagctcacttaatgaccgttgttttagaatatatggacctgctgttccagtgcttgaaaatacttatggacaaggaagatgaagccgttatgattcaattttgaaggatatacccttcgcagatccctggggattccttgtagtcaaggcataatccttccttttatgattggcggtagtgccatttagggcatcgtcaggcaagaggttgtcttaaggaaattcatcagttttgagtttacattcatggctatttgctgaggttatttttttcatcgcaattagtaaatttgttcccccatgtataacaaaggaatggccatttctcacgattatttacccagccattcagtcaatcagattctgatgttctgtctgtcgaagcgtatgcattcaaaactctccgttcacaagtgtgtttgttacacctcgtcatgaacaaaaaatggtatccagaggccaagtttctacgttagaaa

SEQ ID NO: 8304 - DNA, 962 bp, Sorghum bicolor
  Clone ID: SORBI-28MAY03-CLUS4041_1
cgtccggtagtttaattaggatgttctttttagcagagacatttatgtgcccatgaggcaagattctactacatgggcagggcatggtcccgtcaatatgttctcatcatgagtaaatggcagcatttatggttaatttcgttgaagattttcagataactatattactctaatgcctcattaggtcattaattgggtgttgaggcatggaaggggctctatcagagcatcaggtcaacatagaacggcaatggaccagctatgtgacttataaatatggtgaaggagaaaacatactgaactctggtcactggtacatctgaaattttgctcaatatgatgctagatagataaaataaacccccctgctgtgtagtggattatcaatctaatatatgatagttgtgtcaaaaaaagatgatagttgcattttatcttcatgatggttaattggttatttgtggcaggggagacaagtctattgagttaggcaatgaggatgagggctgctatatcacgtcctattgataattgcagatgggcaagtaccatgttaaatcattatactagaactgacaagaagtatggtggactaagtttatcatatgaagacgttgggtcaagttcttgcagtcacaggttgtcatcgagtaccataggaaagtttgtgcctttgtgccttcggagacttgcctgtctactgttttgtatggccaaagctggttgcctcatggaattagttgggtcatttcttatgtacaattatactcgtgtagtcaatgtatttaatcttaagaacaatccgtatactatgtagtatctgtttatgtactgttaggagtcttctaggtaacagctccttgagtagatgttttgtagcataagttgtatctaaagtttgtaaagaatttgattgcttcataagttgtatctaaagcttctaataaagaatttgattactg

SEQ ID NO: 8305 - DNA, 1465 bp, Sorghum bicolor
  Clone ID: SORBI-28MAY03-CLUS34320_1
gcacgaggcagaagtccaaactcccccccccccagaatcccagccctggctgctccaccgagctcccatccatggctcctgccttcttccttctaccgctcctactcggccagatccttctctgtgccgccgtcgacagcatcaactcctccacacccttgtccggcgcgcagaagattgtgtctaagggcaacaagttcaccttgggcttctacaccccaccccaaggtaccaccacctcctccaatcccagcaactactacatcgccatatggtacagcaacatacaactgcagacgacggtgtggatggccaaccccgatgtgccggtggctgacccaaccactgccgccttgaccatcggcagtgacggcaatctcgtcctccaatcccagaatcgcctgctgtggtcgacgaacgtaagtattagctccaattccaccgtcgctgttctccaggacatcggtagcctcgacctcatagatgccaccaattcatccatggtttactggcgaagcatagatcatcccacaaacacttggcttcctgggggcaagcttggactgaacaagaccactggtgtgagccagcggcttgttccatggagtaacactgccaaccccttacctgggccgttctcactggagttggatccaagaggcacgacacaatacttcattcagtggaatgattccataacatactggaccagtggtccttggaatggaaacatctttagccttgtgccagagatgacctctggttacaactataacttccagttcatcaataatgtcaccgagagctacttcatctactcaatgaaggacaacaacatcatctcgaggttcatcatcgatgtggatgggcagatcaagcagctgacatgggtgcctgcctcccagtcatggatcttgttctggtcccagccaaggacacagtgtgaggtgtacgcactttgcggggcctatggtagctgcaacctcaatgcactgccattctgccactgcatcagggggttcagccagaaggttcagagtgattgggacctccaggattacagtggcgggtgccgaacttcagttcgagaacatctcccatgctgaagcaaagagagttctcaagtcccagtctgacatcgacccatccgagcagcaatatctccttgagtactacagccttgtgaaggagggcaaaaccaactacatctccaccactgctttccacgatgttactggcgagcatccgactgagccggagaatttcttcaagatctatgagggagagatgaggcctaagaagaaggctaagcatgagcatacgtgatgaatggtagtaccttgaagaggaagctgttgaagatattcaccacatccagattttgagcttgaaaaattgacctctagtaggtgctcatagtctgaggctcaaggactaaacggggttatttattattcatgcaatt

SEQ ID NO: 8306 - DNA, 839 bp, Sorghum bicolor
  Clone ID: SORBI-28MAY03-CLUS34321_1
gcgtgctttcgcttcttcctctcgcagtcgcagcagcccgggcaggcagcttcgaatcgaagcggaatcgaagcccacaccagcagcaggcagcagcgcccacttgcctggagcgcgagagcaaatcgcggcggcgctcgtgcccgtgcctcccgcgcgcccgaaccctagcgcaaccaccagatccggagatcccgcgcgggcggaggcgggaccggaccccaacccactgactcaactcgactcaactcacccccccggccgcacccgccaatgccgccttctcggcgctgatccgatcccgccgcgccgccgccgccgccgccgacgacacccgccccccatggattccgctcggagctggctccagaagctgcagccgcgggacaaggacagggagcggggcgccaaggcgccggcgtcggcgtcccccaacggcggcggcggcggctccgcgaggatggccgccgcggcggcgggggaggaggaggcgctgtctagcgccaccaagcagaaggtggcggcggccaagcagtacatcgagaaccactacaagtcgcagatgaagtcgctccaggagcgcaaggagaggcgttggatgttggagaggaagctagcagatgcagatgtatctcaagaggagcaaaacaatatcctgaaagatttagaaaaaaaggagacagaatacatgcgcctacgaaggcataaaatgggcgttgatgactttgaattgctcaccattattgggagaggtgcatttggggaggtgagactttgtagagaaaaagctacatccaatgtatatgcaatgaaaaagcttaagaagtctgaaatgttac

SEQ ID NO: 8307 - DNA, 643 bp, Sorghum bicolor
  Clone ID: SORBI-28MAY03-CLUS34370_1
gcacgagggaagaagtgagcctccgccctccgctagtctgcctccacccgccgccgccgccatggcgctccgccgcatcaccccgcggaggagacccgttctccccgtcccccgtgccttcttctcctcgagccccccgttccctccgcccccgcctccggcgaacggcgaccccgacgccgcccattccccgtcctcctctccgccccccaaccccggcgcgccgcggaacccgtcgccctcgctcttccgggacatcaaagatcgcctccgcttgtctcccacgtcgcgcggcgctccttcttcgaaaccgtccgttcaagatgtccgccggttgctcggggagttccgcccaaccggcagcccgccgatccctccgtccccctccgctcccggagccgacccctccttcatggacctgctcaagaagaacagcgtcgcccagggcgccaacgctgggcagagggtgaccgacctcggtgccatccgagagagtctgaagcgctccccgccgcggacgccgcgtcgtccgccgacgccgtatttgactccgcagagcaacatcttcaacccggagctacagaggaacttgaaggctgtaggtgcggggaaggaagagaaggactctaccattgcccttttg

SEQ ID NO: 8308 - DNA, 724 bp, Sorghum bicolor
  Clone ID: SORBI-28MAY03-CLUS34401_1
ctactggacgcgcacgaggccacctttaccctccgccgctaaaaccctagaacctacccacccccacggcccgccgccatgtcgtccgcgacgccggccgtcgcatcccccgcctctgagcactccaaatcgaagaagaagaagcacaagtcgaaggacgaccccgccgccgctgccgccgctgacccgccgtcgctcgccgaggccgaggagaagactgatggctacctcatcaagccgcagtcccttgtgccgtccctcgacacctccacctggccgctcctcctgaagaactacgaccgcctcaacgtccgcaccggccactacaccccgctcccctccggccactcgccgctcaagcgccccctcgccgagcatctccgttacggcgtcatcaacctcgacaagccgtcgaacccttcctcccacgaggtggtcgcctggatcaagcgcatcctccgcgccgagaagaccggtcacagcggcacgctcgaccccaaggtcaccggcaacctcatcgtctgcatcgaccgcgccacgcgcctcgtcaagtcgcagcagggcgccggcaaggagtacgtctgcgtcgcccgcttccacgccgccgtgccggacaccgcgcgagtggcccgcgcgctagaggcgctcactggcgcggtgttccagcgcccgccgcttatctctgcagtcaagcgccagctcagggtgcggacaatctacgaga

SEQ ID NO: 8309 - DNA, 1326 bp, Sorghum bicolor
  Clone ID: SORBI-28MAY03-CLUS34430_1
gcacgaggagatagagaaactcagaaagaaaatgaaagaacaagatcttcaggaactttatggtgttttagaatctggcactgaacgagacctattatcatcttctactgattccaggaatttaaccattgacgaaacatcaaagatctcatgtaaagatgcaggccagtgttcagattacattgacaagaattatagttatgctgggatgcataatggtgctcagtgtattacgggcaagagtggagaccatgagaaaactggtggtgctttgtgggatattttccgaagagaagattctgacaagctacaagattatcttaggaaacatgccaaagaattccggcatatcaattgcaatcctgtgaaacaggttattcacccaattcacgatcagattttctacttaactgaggagcataagagaaagctcaaggaagaatatggtgttgaaccctggacgtttgagcagaggcttggtgaagcggtttttattcctgctggatgtcctcaccaagtgaggaatctgaagtcttgcatcaaggttgcaatggactttgtttccccagaaaacgtcgatgagtgcataaaactgactggagagtttaggcgacttccacctggtcacagggctaaagaggataaactggagattaagaagattgctcttcatgctctgaaccaagtaataaatttcttggatcctttctctgaggggttgaagagtggagctgcccaacccaagaataaaaaagaagctgatgctgatgctgaagcacagaagaagcctaaaaggggtcgcccatgtcgcaagtcgaacgatgaagctactgacgataagcccaaaaagaagcctggtcgtcccagaggtgagaagagcggagacggcaagtccaaagatggtgctgttgatgagaagcctcctaaaatgcagggcaatcgcctgaaaggctctagcaagcggtaggtgattgatcggttcactgctgacagggaaagtaaggcatggtggctgcactgacccaacctggacgtaggtattttggaagcaggtagattctagaatagaccgggcattttgtcacccctagacgccattgtgggctgtggcgtctggcttttgttcatatgtggtgattgccggccggcaccattctggaagaaccatgctaggtgctcgctgtacaagactcttcatgtagcgggctatggtgattggcagttccgcatgtctgttgctgatattggtagtaattgacctgaatagatgtggtcatttgaactctctggattctggttttatatatccaatccattggcgaggcg

SEQ ID NO: 8310 - DNA, 655 bp, Sorghum bicolor
  Clone ID: SORBI-28MAY03-CLUS3444_1
cgtgcgcgacggtcgaccgaaagaaacagccgtggctgatattcatcgctcatcgcgtcctcggctactcctccggttacttctacggcagagacggatcgtttgctgagccaatgtcccggcaaagcctccagaagctctggcagaagtatagggtggacttggcgttctacggccatgtccacaactacgagaggacatgccctgtctatgaggaacaatgcatgagctcagagaagttccactactcgggcaccatgaacggcaccatccacgtagtcgttgggggcggcggcagccacctgagcaacttcacaatccaggtcccggcgtggagcgtatacagggagatggactacggcttcgtcaagctcacggcgttcaattactcgtcccttctgtacgagtacaaacggtccagcgatggcgaggtgtacgatagcttcactttgcacagagagtacagggacgtgttagcgtgcgtcaaggacagctgccctccgactttaaaatcgacatgacatgcagccattcagttttctgaacgtggcgctgcttctgcgtgtaactgtgagtgactaattaatttggtcgtcgaccgacccacctatatataaattctacattgaaataaagagcatattatattgacgct

SEQ ID NO: 8311 - DNA, 674 bp, Sorghum bicolor
  Clone ID: SORBI-28MAY03-CLUS33843_1
tacaagaacccccccgcctgcttcccggcgcgcgcgcaacggcttcgctccatcatgcccggggttctatgagatcctgagcctaacaggctcgtacaacctggccgagggctcacaagcacagggacagggccagcagagcggcgggctcagcgtcacgctctgcagccctgaaaggaatgtgatcggaggtgttttgggcggcccactggtagctgcaagcaccgtgcaggtggtgctggggacttttcaccagggagggtcgagatccaagtccaagaaagccgggaagctgcagcagcagcagcaggcggccacggcgacagcggcggccttcagctccgactcgctcaccggcggccaggaggcgtcgcccagctccgggcacaaccaaaatctaacgccgccgccctccgtgacgggagggtggcccacctccgggatatttgacacgagaagttccagcattgatatcaactcatctagaggctagctcatttgtcgataattccagctctcgagaaattttctattttcgcacaagaatacccgaaaccatacttcgaaatagcttattcggttcttttttttgagtataagtaaattcttatagaattcactaggcatcgctcaatgttgcgacctgtgttattatttttagcatattcgattcc

SEQ ID NO: 8312 - DNA, 785 bp, Sorghum bicolor
  Clone ID: SORBI-28MAY03-CLUS33883_1
gcaaagaaaagggaggcagcttatatagtaacatttgcaaaacgagagcaggagattgcagaactgaagtctgcagttagagatttaaaaacacaattgaggccaccgtcaatgcagacaaggagattattgcttgatccagcaattcacgaggaatttacacgtttgaagaatcttgtggaggagaaagagagaaaaataaaggagctacaggacaatgttgctgccgtcaattttactccatccagcaaactgggaaaaatgctaatggctaaatgtagaacattgcaagaggaaaatgaagagattggggcgatggcatcggaaggaaaaatccatgagcttggaatgaaaattgcagttctgaagtctcagaacaatgagctcaggaatcaatttgatgttttgtataaacacatggatggtgtaacaaatgacgtggagagatcaaacgaaatggtgtcgatcctgcaagagcagttagaagctaaggatttagagctagctagattgaaggagacgctttcccagaaagaaggtacccaagatgcaccggtggaagagagagacgaagctggagatgatcagaaggcagcttcagacccactgcaagtgaaagtggaaagttaagggagtttaggctttgatgaagtgtgtttgttgagactcccgatgtgcgaaatgtaatagcatactaaactttgtgaaaccgggtacagtaaaaaacatttgggtgttattggcaggtggttttactgatctgacccgttggggctagctttgtg

SEQ ID NO: 8313 - DNA, 713 bp, Sorghum bicolor
  Clone ID: SORBI-28MAY03-CLUS33886_1
tgcaactgcattcacgcgctgcccaaaatatccaaggactcgtaccactctcctgctccccgggccccgcctgcgggaagtactccggcgagaacccgcaggccgcgggcgtgcagcccacgaatggctccatggtctacctcggcggcgagcagctcgccaccggcgccgcctccgcccgtgcgtcgcagctgttcctcctagccgccgccgccgccgccgccctcgctgtcgtcgcgctgctctgagcttgccgacatcaaggtgtgaaaatggcggcacaggagtcatcgttgtacagcagctagctagcgcacccgctggtgtgttttgtccttatcagccacggctcttccggctgcacgggggcagcgataagattcgacaagagaaatggaagggcaaaaggctgacgagtgacgacagtgctgctactacggctaaccgaggagaaaacaacgatatctctgcgcaccggatggcatcgttctatactttctaggtagcttatgtcgtagggtttaggataactggtagcatgtgttaacctttgcattcttctactacgcttcctcgatttgttgggccgaaacgatgtatcatatccgtcgttgttcgccgggcactcgtgctatagattattattacagctatgatgattgtttaaactttacccgtgaaaaggacgaaacggtaaaatcaattatcataga

SEQ ID NO: 8314 - DNA, 988 bp, Sorghum bicolor
  Clone ID: SORBI-28MAY03-CLUS33947_1
gccactcttgtatgtgcatcaattgctactcgtacacggacatgcttcttgcaatgctgggctctagagattcaaggaaaacggccagaagcactggatgaacttgtgaagctttgtagaattcattacatattgcctccagaggacaattctgcagagatggaaatggtgtctgctggactagaaaagaatttgcatgttgccgagagggttcaccttctatatctatacaggagcatttgtactgctggtaacttaaaaacagctgcagaggctcttggtctgagtttgccagatgaatgagagtataccgaaggattatgcttacatttgtagtccgagttgcaatgcccattcatcaaccacagaccaaggcattgaagcccctgacgcagttttggtattcctactttcttaacatgcagtatgctaccaagacaagaatcagcatagtgcagatttccttctcatcagattcttagggacaatccggaggcccaaaacctaatgctgaatcaattgatccgttcatggacctttaatatagatgggtgctctttaattcaccactcctaatagcaaactcatatatatattaaagatgatcggtttatagtacttaagttcaccgaacccctccaccgccacgccggtgtccgcagtggtgttggcgttttggacagctgatctggcatcagaacataaaaaaaaaagctaaatgcattgatgacaaacgagagtatagtctaggagagcagagactgtaagtactttgggaacgtgcgagatggtagacgaaacacttgctagctctagtagttttttatgcttctttttcctccacgtcggaagtgacatcaggcggcgacttcgctggtctgttggcggtgccctaatatcgtggttataaatgtattgagagtcgtgctctactctggtggtcattgattactgaagcaaagaaagtccctgaccataaaaagtccct

SEQ ID NO: 8315 - DNA, 641 bp, Sorghum bicolor
  Clone ID: SORBI-28MAY03-CLUS33980_1
atccaagaaaatggctatggggcgttcttcaatgattccattcatgaccatgagagagcggagtacttgagtggctacattggcagtgcactcgctgcacttaggaatggagccaatgtgaagggatacttcgtttggtcattcctggatgtatttgagctgcttgcaggctacatttcccgattcggcctctatcatgttgattttcaggatccggcgctgccaagggagccaaaattctcagcccagtggtatggcaaatttttgaggagcgaaatcggaataaacatggagaacattatcagtactgatgatgcacgctcacatgctgaacaatgagtctactagcagcacatatatgccagaggaaaagaatgcttcttatccattctttttcacaggtcacagaagcattatttttaacagtttcttatatttagtcaggctcagagtttcagtgtttatgaatcatagccataggtacacacccctttagctgcagcttatatgcaccacaggaacagttgtcatcatgacacacttgtcactactgatacgaataatacagagagaaattactcttgcaaactgtaaaacctgttatagctttatggtaataaaactggggaaagctgttattc

SEQ ID NO: 8316 - DNA, 709 bp, Sorghum bicolor
  unsure (1)..(709): unsure at all n locations
  Clone ID: SORBI-28MAY03-CLUS34548_1
gtagcacacatccagctgatcatcgtgaccaagttcatcgagaaggtgcagcaggacattcctggacacggagtgaaggaacagctgcagaccctgtgcaacgtgtacgcgctgtacatccttcacaagcacctgggcgacttcctggcgaccgggtgcatcacacccaggcagggagctctggcaaacgagcagctggtgggcaagctgtacgcgcaggtgcggccgaatgcagtggcgctggtggatgcgttcaactacacggaccactacctggggtctgtgctggggcggtacgacggggacgtgtacccggcgctgtacgaggaggcgtggaaggacccgctcaaccagacggtggtgccggagggctaccacgactacctccgccccctcatcaagcagcagttactgaagctctcgaggctctgaattctctctctctctctctctctctcttcttctgtctgacgtacgttggggttcatgaatttcatcatcatcagttttaatagtactgtactggagtcaggagtgagtaataagcgggtgagctagcgagcatatctctgctgctcgaatttgtatcctagatagaagaaaatgctgttactgaatgaatcaaggattgaattggtgcaggcatgcaatgctccttcagcactgacattcttgttcctgttccaaanttataactttctccaggtct

SEQ ID NO: 8317 - DNA, 694 bp, Sorghum bicolor
  Clone ID: SORBI-28MAY03-CLUS3459_1
ctacattgcttctctctctctctctctctctctctctctctctctctccagtctccattgagctcttagattcttgcttgaggtgcagtggcaaggcgcactactacaaacaagctgatcagctgatgctcggtggcttcaggatcttgccaaggttttcgaggtcccattttgcttctcccctgggcttgcagttgcgtttgagtgcacctctgaggctttgattggcccacgcgctccgtacttaagctctccgcctcgtccatggcgttgcagctctcaagacttgctgtctcctgctagctgctgcttctactccatctagctgaaaagagtgtagttggtcttgaattcttggtccggtgctgttggaaatgttcttgaggtcgaagacccaggaggtgatcctgcgcaggagatcgaggtcaatgaacagcgccggcgcgcagaggagccacgtccccgatcaggccgcgagctcgtcgaccgttccatgcgacggcgacagtggcggggccggggcagacgccgccggcagcaagagtgccgctgcacgtgccctgttcgcctccccgaggctgctgcactcatcctccctgcccgccggcaccctcgccttcgccaagagccccgcgcgggacgccgagtccgacacggccttcctcatgagcccgacgtccgtgctcgacgcggc

SEQ ID NO: 8318 - DNA, 749 bp, Sorghum bicolor
  unsure (1)..(749): unsure at all n locations
  Clone ID: SORBI-28MAY03-CLUS34605_1
tctctttcaactgacgaccctctacanattcacctgacaaaggaacctttggttgaagaatacagtattgctgcttcactttggaagctgagctcatgtgacctgtgtgaaatcgctagaaattctgtctaccagtctggcttctctcacaggctcaagtctcactggattgggagaaactactacagaaggggtccggagggcaatgacatccaccagacaaatgttcctcacatcagggttgaatttcgacacactatctggaaagaagaaatggagctgatacattttggaaatgttaaactacccgaagaaattgacaggtgaagaagagtagggaattgtgatggcgtggcagtgaagtctggcagtggctgtaactgtaagggaggagaaaaggtgtcaacatgatcctgccttcgatgaatctcttgtttgcagaggtattatggctgatgtcgccaagtcatactagtatactcactccgtgcctaggccacaccatatatgaagaataagccggaaagcacctagtatttagaagcgttgaatccagatgtgccatgaggtgggaggcaacgcatcatgtactttcgttacgtttatatacgtgtactgctgtaatggtggatcgacgaatgtctgtcatctagtgttttgttagccaaattgcatggtaaattaattagtttcccagaaaaaaacttatgctttatactaatgatgaataaaaggaaatctttaatggg

SEQ ID NO: 8319 - DNA, 706 bp, Sorghum bicolor
  Clone ID: SORBI-28MAY03-CLUS34726_1
gatgcagagatatgatgatgaagcatatgctgcttatgatgagctattttcttatgcttgccccaagttcattacaccatcacctccagttctggaccagccactaacaaactataaccaggatgcataccgccttcagttgaagttgtttctctatgaagtaaagcagcagcagttgctttctgggatccggagttatctaaagctatattcaacaataacaattagcaaacttgcccaatatatggaaatggatgaagcaacactaaggtcaatcctgatgacatacaagcacaaaatgcatgcagttgacagtgacgggaagatagtatcgagtgcagactttgacttctacattgttgaggatgttattcatgttgtggagtccaaacctaccaagcgtcatggtgattactttttgagacaaattttgaagtttgaggaaatgattggtgaactggagaaagtacagcttgactgaacctcatagcgatcatggagagaaatgccactgcttcctttttgctttttgctaatataggaagaagtgtttatgatggatgtcattagcaagttatgtttgtgccttttgtactccatgcgacttagttggaaaccctttttttctttttgctgaaatcgactttgaaagaccgttgaggccattagctgagtcgtgatacttatttgggttgcccagttgcct

SEQ ID NO: 8320 - DNA, 625 bp, Sorghum bicolor
  Clone ID: SORBI-28MAY03-CLUS34763_1
tcagcagttagcattattgagacagactgtgaagtggactttgcacctcctcttgattataaagaacctgagaaaccacgacaaccaacagttcctgcaggcaaggcacctgctgaagatggaaacactgtagtggaggatgaaccaaaattcaaaccatttactggttctggaaagaggttggatggaaaagcctcaaaactgcaatcatctgtgggtccttccactgcactttctgcaccttcagattcaaacaaaagaggaaaccagcaaatgtcagcaccggcagcttcgggagctagcaattacagtcgacagaaaactggaaagcttgtttttggttcaagtgcaagcaacaataaggaaccacaaaaggctcctgttaaagaggaggaacccgcgaaaaaggacgagcccaggttccaagccttcagcgggaagagctactcattgaaacgttagctgctacaatagccttacaaatttgttgctacccttttgtttcgtgcatggtgttcttgcacctggccaccatgtagatatgactataaattgaattatgtatgatggaaatatggccatctgtccatttaagctcaaaaaattaaaacagtgctattatcct

SEQ ID NO: 8321 - DNA, 1025 bp, Sorghum bicolor
  Clone ID: SORBI-28MAY03-CLUS3479_1
ttcctttcgtaatatactaaagcaatgattgcttaagctttggagctttaaatttgttgctgttagtcagttgtgaacttggttcattttctttgtgattggtttaagcagcacatgagcagcagacctgagagaactaggctaacgtgcaacccattctgttctgagttaattaaatttccagaggattttccggttaatttttctagcctcgatttcttattttgcgtctagtttggtcgtttgggctccgttttgagttccgttttttgcactgggtttctacgtccggaaatattttatctaagtgctcttgtcacaggtggacttgggtaatttagtttcgggactctcgcttgtgcttgggagtgattttgggacagcggccaaatattttcgagagaaaatttgaggctcccattcaccctcctctggtcgccgttttcggtccttcaataccaatcaaaccagttcctgagccaaccgaacatcttcttcaaaagcagctattatatcatcatgcatgccaattgacgaaaggtctacaattcaccgcacgacacatggacaaactactattttctaatgtgggtctagctagcttgttatattatatggaggctctcatggaagtgaaggatcctttcagaggtagtggcaggcgtcctctcttttctacggtggcggtgatggtggctgaatcgcatttcgtctgacctaggtccttggaggtgagtggatgcgtggtttccaggcaggttggccattgaccaaataagctccaaaggtttatttcatcagaagtgcactctgctgctagatctactttatggcgctacgaacgcatgatctctgaatgtctcctattttctacgaacacaactttcagcatgttctatggggcaactcggcaggcatccagtccccttaggtcttgtttagttctaaaaagattttggatttcggtactgtagcatttttgtttttttatttgataaatattagccaatcatggactaacggtc

SEQ ID NO: 8322 - DNA, 812 bp, Sorghum bicolor
  Clone ID: SORBI-28MAY03-CLUS34132_1
gcacgaggggcggacgtccacggcgacccatcctaagaaaaaaaaaaagccagggcggcgaaaaccctcaaaccctaatcctttcgttccccatggcggacgctgacgccgcgccgccaacgccgcctccggaggtattagtccccgaggagcatctcgccgccgtcgaatccgccgtcgccgcggtgcaggaggaggtggccgcgacggccgaagtcgataacaagcggaagctggaggacgtcagcgccgacgcggaggcgaacggcaccggcgaggacgccaagcgcctgcgcgtggacggcgagcccgacgtcgccacaggagcaggggttgagctgcagaaagacggctcctccgtgaatgtggaggagcccgcagctgcggaggataaggttgctcccaccgatggggcggcgatggatggtgataacggcgcggcagccgctcctgctccagattcggcttctgatgagaagccgcttgaagcagcagctgaagctccccagcaggaaggtgatgcagcaactgaagctccccagcaggaaggtgatgcagcaactgatgcacaggatatttctcgtaagatcgaagtgcccaacagcaaggttggtgtcctcattggaaaatctggtgagacaattaggaacttgcaatcgagctcaggtgcacagatccaaatcaccaaggacgctgatgtggacccaaataccctgactcggtcagttgaactagttggaacccttggaagtgttgataaagcagagcagcttattaagtgtgtcatagctgaggctgaggctggcggttcc

SEQ ID NO: 8323 - DNA, 634 bp, Sorghum bicolor
  Clone ID: SORBI-28MAY03-CLUS34138_1
gcacgaggctccatcaccgccttcggggacgtgctgcagctcgcgcggtcctcacaggaggcgctcgccgctacgggcgtctccgcacgaggccatgatgtaggtgggaagaatagttctgaccgctcttttatggctgatcttgtctactggattgctcagaatccgccaccagttcattttttccttatatctggggataaagattttgcaaacatcttgcatcgtttgcgaatgagcaactacaatgtactgcttgcttgtcctagttctgctaccagtgtactgtgcagtgcagcaacaatcatgtggccttgggatggtttagttagaggggaggatttgtcaccaaaacgttttaaccacccaccggatggtttacatggatcttggtatggtcactgccaaggagcccttgatgacccctccctggagaaggaatcgaaggaacccatcaatgtagcatctgatccaaagcatttttcagtaccatctgataccaagcctagctcagcccctaaatatgtaacaaatgcaattctagaggtactacgttcatatcctgaagggatgaggatctcagaactccgaggacagcttataaagaacagtattgatcttgatacagattttt

SEQ ID NO: 8324 - DNA, 700 bp, Sorghum bicolor
  Clone ID: SORBI-28MAY03-CLUS34161_1
gagacaaagggaaacgaaggaagcggagaggtggtgcaggactggcagggaagtttgaggtttctagcagccacagtgggaactcaacaccgtcttcaccattgtcgcaaagttcaaccccaaaacaagagttggtctttttccggggcaccatcagagccaaagcatggaaataaactcgagactgggttcgatgtcgaggcaaccacatcatcaactggcactaagcatgacaagaaaacttggtcgcaagtcgctaaggaacagcctcgctcgcgttcagcctcgcctggagctggaatgacatcacctccatctcctgcactgaccgccactgcatggcactcaccatcattggcgacatcttccccgatcactccacactgtcgtgctcctggctccaacctgatgaaagacaaggctgtgaagagagacgtcggtgcgccgaagaaagacttcacctacgacatatggggagaccatttccctggaaacctgctggtgatcgcaagggaggccgcaccatgcaagatgcctgacgcttctgaaggcgcctcctatagcttgtttgctagagagccccagaccctcatgatgaagccatctgcaccgccgcccatgtctcgcggccgcggctcgccgccgtctgatgtagcatctggttatggaataaaatgatcctgaaagctgaaataatttg

SEQ ID NO: 8325 - DNA, 784 bp, Sorghum bicolor
  Clone ID: SORBI-28MAY03-CLUS34193_1
atccaaacctgtatgtggacgggaaggtttgtttaagtctcttaaatacttggactggcagagggaatgaagtgtgggataaatcatcatcaagtattctccaagtgctagtttcacttcagggattggttctcaatgaaaaaccctattttaatgaggctgggtatgagaagcaagttggtactgttgaaggggagaagaatgcagtgccgtataatgagaatacatacctgctgagcgtgaaatctatgctgtatatattgagacggcctcctttgcattttgaggattttgtgaagagccatttccgcaagcgtggccactacatccttaaagcttgtgaggcctatttgcaaggaaatgttgtgggcactctcactgacgacgcatgccccaccgagagaagcaaggagcactcgagctctgttggcttcaagcttgcactagcaaagattctccctcggctgattacagccctgaaggacactggagccgactgcgaccaatacgagccccttgggaaaacagaaacagttagagaaagctgatcattgagtgatttgtacttggatctactgtttttttggttcagaaagatggtgactccatcaggctgttttcctacaaatgtacattcaaagtttgttgtttcagtcaaacatttggaaaatatggctccaaatgatttatttgatatacatggaactgagctaccctgtacagttgatgtttttgttaaacttgcagggtctttaaactttataaatgccagggaatcgttggc

SEQ ID NO: 8326 - DNA, 646 bp, Sorghum bicolor
  Clone ID: SORBI-28MAY03-CLUS34305_1
tggccttaggaaaggctcaaacgtcttcaaaactatcgcataagcagtactctttcgtgtcggactctggggaagacagtgagccggataagctagttgagagcgtcttgggcagtctgcaaaaagcacgggcctcaaagttgcacaattgaacatctgctgccatttgcaaaaaagtcggctcgcttcgcttgtcctcaaattgaagcggtcagcctgatatctttttaaaatccaccatggtccttgcttggtcgcctcatatcaaacaaaggcgcactttttgtggctataatctcattagtctgacaacatatgctagtaagctacggattggcaggagttatccaaaagagcaactttcgtttttgcaacataacgaagcttgtttatggcgccatggctgattgttaccaacggcgactacgagcaagcatcagccagcgagactggtgaatcaagttcatcatttactcagattaggcttaggccttaataactggtatgttagcattgggtaccactaccacatctggctagagaccgccacctgtttctgtttcttttttctgcagggcgtttgtccgcccaattgacacgctcatttccctcataaattggttaacacggcggtttagatgagtcc

SEQ ID NO: 8327 - DNA, 1033 bp, Sorghum bicolor
  Clone ID: SORBI-28MAY03-CLUS34998_1
gagctatgagtcaacatggctcccttacatgggaggcccgcataaagattcttcttgggactgcgaaagcgcttgcttacttgcatgaggcaattgaacccaaagttgtgcaccgtgatatcaaatccagcaatattttgattgatgatgagttcgagtcccacgtggcagatttcggtttagccaagcttcttggtgctggaaagagtcatgtaaccactagggttatgggtacctttgggtatgtggcaccagagtatgcaaacactggactcttgaatgaaaagagtgacatttacagctttggagttgttctcctagaagcaattaccggaagggatcctgttgactatggccgcccaccaaacgaggtgaatctagttgactggctaaaaatgatggttgccagcaggcggtcagaagaagtagtggatcccaccatagagacacgaccttcgacgagagctctaaagcgtgcacttttgacagctctgaggtgtgtggatccagactcagagaagagaccaaagatgggtcaagttgtccggatgctggaatcagatgatccaattcctcgaggggacagaagatctaagcaccaccgtggagggagcacagaaatggattcgcaaagggacaactctgacacggagaagagcgataatccagattcgaaacctagcaggagcagagcatcctcgtccaaatgagcacaccagcatttcacctattacagtcttcagtacattgcatggaccagactacttccgttttacattgctgacgaattggtaactgaaagctctgaagcttgaatacaccgagctgaagaaagatctacttttcttttcttttttgttgtaacgatttatgatttatttgtagagaaggtattggtttttttacttatcaatgtgtgcttaccggtgatcttgacaattgctgctgtaagtttttaacattgtgtacaggcgtagcatcatgaatactggcggaatcccccgtaatatttgtaatgataatgtttcagttg

SEQ ID NO: 8328 - DNA, 1250 bp, Sorghum bicolor
  unsure (1)..(1250): unsure at all n locations
  Clone ID: SORBI-28MAY03-CLUS35055_1
gcacgagggccgccgccgccctaggccaggtgctgaggttttccctggtctcttcgccggcggcgagcacccaccagatggctctgaatgatcgtctgaacaaatttaaacagcagcaagagaggtgccagaatactctatctagcatttttgcaagccagacttcgatttcaacgtcaaaacatgttccagggattcaaccagtcaatgccccattggctcctataaaaccactgcatcctattaaattctcaaatgatacggaaaggctgcagcacatcaattcagtaaggaagtctgctgtgggagtacagatcaagttagtggttgaactgctttataagacaaggcaatcatttacagcaaagcaagtaaacgaagctacctatgttgatattcatggtaacaaggctgtatctgacagcttaaggaataatcccaaagttttatttgatgggactcgtttctcttacaagccaaagcatattttgacaggaagagatgaattgcttggtttgatcaaggagaaagagtgtggccttcctgttgaggacatcaaagatgcttatccatctgtattggaagatttgcaggctctgaaagcatcaggtgatgtctggtggctatcaagcacccagtcccaggaagacatggcgtactttaacgaccctcgatataatatcacggtcgacaatgacctgaaggagctattcctgaagacagagctgccacgggacatgctggacgttgagaaggagataaagaagagtggcgagaagccaatgaccaacacgaccaagcggcgcgcattagcccagatccttgacgctgcacccaagaccaagaccaagggcagcaagaagaagcagcgtcgcctcacggggaagagcaaggggctaacgaacatacatatgccggaactgtgcgatgcttgagccgtcggctggcgctagcaaatggagcacgatacggccgagctggcaaacggtttacaagcgatttttgtgccagatttatggtgcttaaccgagtgaacggtaacactagttcccgtccgttaggatctttgaatcgggtatcgagttaccgattcgcccaattttttagtccagttgacatgttctttttcttttgagtcgctttagcaaacgagacgtaatgaaaatatttgtgcagtgctctaatactacacccaggaaaagcgcaatgggcctgaagcctgttggacactttggactggtttncgggtt

SEQ ID NO: 8329 - DNA, 694 bp, Sorghum bicolor
  Clone ID: SORBI-28MAY03-CLUS35073_1
tcccccggccccccgtccccatcttccaccctgcccctgccgcccgtggcgatcatggacagcatggcgtgcagcagccccggccggtgagcatgatgggcctcttggaagtggcgagccggccccttgataactatatgaagcagaacggcctgacgagcctggtgggggagcaaggaggtggcagctccagcacggccacggtcccgccaggtccggtggagagtgaggagcggacgtccaacgagggccgcgtcacatcagcatcagcagagcgggaaccggacgccatggccattgacgaggctggcgagaaccagcaggacaaggctgccgacgatgctgctgctcctgctgctacttgacggcgtgcgtgcgtctgtgactgatgggtgttgtcagtgtgctttgccgtgtgtatcttatcggctcctcttggtttttttcaggaaaagctggtgagttttgatgtgaaagttctaaatcaaatttctgtggggtttgggtttcatggagttgcttctcctcgaggctcgcgtaacccccgggctcctatgaccctctgtaaccaacccccagggttgtatgttgtaaaagttctgtaaccaccgtgctcttgtgttggttggtgttgtaatcaaataacgcttaaaccctttggcttcaataacccacatatacttgatttgtactg

SEQ ID NO: 8330 - DNA, 657 bp, Sorghum bicolor
  Clone ID: SORBI-28MAY03-CLUS35147_1
gtaaaccttatgacagttcacgtccacgagctgaacaacatctagtgcgatgggccacttctcaactctatgatatcgatgccatagcgaagatggttgatccctccattcgaggacaatgttctgaaaaggcattatcccgttttgctgacattattagcagctgtattcagcatgaaccagaattcaggccaccaatgtctgaagttgtccaagacttaactcgcatggtaagtagtgtatcaagggcttccatgtagacgatcgatcccttaaggaatgggaaaatgtggaggcccgtgcttagaattcaagaatgcacctcgctttggagcttcttgctagattcagttatctctggccatgttgcaagacgcctttgatgattattgatgcgggagtacagtagcaggatgcaaggactgcaccgtgttttgtccactgccagtaatgctcctctgaatctgtggtcaaattatagttcaaagctattgttgtaactccgtagtctgcacaatacatttctcagtgccccggttccagatcacttggtgtgattatgcgtggttatctagaccatatgtaaataccaagacgtcaaacaaatatattagagtttgctcgtgttaaaggtcactccgtgttgacaatttgttt

SEQ ID NO: 8331 - DNA, 976 bp, Sorghum bicolor
  Clone ID: SORBI-28MAY03-CLUS35150_1
gcacgaggtgacaagaaaatgcaggagatgtttgatgacagttactatgatgctgatgatgttgatcctgagtttggaagtggtgtggagatggatctggagaagccggattttgacaaagaagacgaattgctcgggcttcctaagggatgggctagtgaccagtcaaaagaagagtctactgccgctgatgcgaaaggtgcaaaagggaagatctctctcaaagacaaggtggagcttgagaaagagatggaggagtactacaagttagactatgaggacactattggagatatcaagactcggttcaagtataaacaggttaagcccaacagttttggtctgagtgcctgtgatatattgacatcagatgacaaggatttgaaccagtatgtttccattaagaagctagctccttacagagaggatgaatggaaggttacgcatcataagatgcagagcaaggatttgatccttggaggccagaaggaagggaagaaggacaaatctgtcaagaaatctaggtctgaggaaggcggccctagttcttcaaaaacagagaaagacaggctgacaaatgggcaagagtcaacagatgacaagaaaaagactacccgaagtgagcgaaggaagcgtcgtaatgctgacctaaagatatccgatgatcgattagcggcatttggaaagacaaattcgaagcgtcacaagagccattgactttctgagattcatctaagtacatctgaggaattttgctgttctttttatgcattatggatcggtcaaagtcttaggtttagcagtccttgcttctattttgggagatgcaaaactagtgttgtcctagtagaaacatctgtttatttcgtcaaaaaaagaaacatctgtttctctgtgagttttgcagacattgtgttgtgcacctccatttgtggaccatatctaatgtaattgccctgcaatttgttgtgtactc

SEQ ID NO: 8332 - DNA, 782 bp, Sorghum bicolor
  Clone ID: SORBI-28MAY03-CLUS35218_1
gcacgaggcgatgaaattgagaaggccgatccagcagtgtttaatgttcttctccagcttcttgatgatggtttgttgactgatggtaaaggcagaattgttgattttaaaaataccatcatcattatgacttcaaatcttggagctgagtacctaatggaagcaatatctggtgaaaaaacaatggaggctgcacgtgaccttgtcattaagcaggcacagaaacatttcagacctgagttcctgaacaggctgagcgagcttgtggtatttgagccactatcccaagataaaaggagggaggttgctaacattcatatgaaaggcatcattgctcgtgcagcaaataagggcatcactctatccgcaagcgatgctgctttggatgtagtcttgtcagagtcagacgacccacattatggtgcaaggccaatcaggaggtggttgcaaaagaatgtgatgacaaagctctcagagatgctttttaaaggagaaattgatgcagatactgctgtcattattgatgcttgtgatgataagaaatgtctgaagtatgaagtcgtgaagaacgtgccaacaagcgaggctctgcaccgtcgacttgttgtggagattcctagtgactccgacagtgacgatgacctatagccaaccaaaatgaagaggatagccatatcatcttctggggaataaattttcaagcttctgccatgctgggaaattaatcattatatatttagtatagttaggttgctatgaacttggtgagaattcccttataa

SEQ ID NO: 8333 - DNA, 1336 bp, Sorghum bicolor
  Clone ID: SORBI-28MAY03-CLUS34463_1
gcacgaggacgctgcgggcgttcgtcgtcagcgcgctgctcgccgtcatgttcagcgtcatcgtcatgaagctcaacctcaccacggggatcatcccttccctcaacgtctccgcggggctgctcggcttcttcttcgtccgcatgtggaccgccgccgtcgagcggatgggattcctccgccagcccttcaccaggcaggagaacaccgtcatccagacctgcgtcgtctccgcctacggcatcgccttcagcggtggctttggcagctatctatttggaatgagtgacaaaatagctaatcaagcaacagaggctaaagatgctaataacataaaggatcctcaccttggatggatgatagggttcctattccttgtcagttttattggtctctttgcgcttgtgcccctgggaaagattatgattgttgactacaagctgacctatccaagtggcacagccactgcatatctcatcaacggttttcacacacctgagggagccaagcttgcaaagaagcaagtaaagacgttgggcaagtacttcgtgttcagctttttctggggcctttttcagtggttctacactgcaggggatgagtgtggattcaaaaatttcccaacattgggccttgaagcttataacaataggttctactttgacttctctcctacgtacgttggagttggcatgatctgcccgtacatcgttaatgtgtctgttctactgggtggtattctctcatggggtgtaatgtggccccccagggccaagaagaaggggagttggtacccggctaacctcgaagactcaagtctacatgggctgcaggcttacagggttttcatttccattgctttgatccttggggatggtttatacaacttcattaaggtgctgatccgcacaattgcgggcttcatatcaatggtgcagcaaaattcaaaaatcatgcttcctgtttcagacaatggcagttccatgtccagtaccgaagctgtatcctttgacgatgaacgtcgcattgagatttttctgaaagatcaaattcccaagtcagttgcatatgggggctatgttgcagttgccgcaatatctatcggcacccttcctcagatcttcccgcagcttaagtggtactacattttggttgcctatgtcgtggcacctgtcctggccttctgcaacgcttatggaagtggcctcactgattggtctctcgcctccacctacggcaagctcgccatcttcgtgttcggtgcatgggccgggctctcgcaaggtggcgtgctcgttgggctcgctgcttgtggtgtcatgatgagcatcgtgtc

SEQ ID NO: 8334 - DNA, 891 bp, Sorghum bicolor
  unsure (1)..(891): unsure at all n locations
  Clone ID: SORBI-28MAY03-CLUS34480_1
gccccgcgcccccgccccccgccccccctccccccgccgcgcccccccccttcgcccccgcccccggcctccccccggccgcgcccccccccgccgccgtcccggacgcccccaactccgtcccggtccccctgtaccccctcgtccggcacctgtaccgccacgtccgccaccagatcgtcgacggcggcctccagcgcctcgccggccgcctcctccgcctcgccccccgcccctcccccgacgcccccgccccctccgccgacgccgtccccgcctgccgcgaccgcgaccacgtcttcctcctcctctaccgcgagctctggtaccgccacgcccacgcccgcctctccccgctcaccgccgcgcaccgcgccgagtcatggaccaactactgcgacctcttcagcgtcgtcctccacggcgtcgtcaacatgcagctgcccaaccagtggctctgggacatggtcgacgagttcgtctaccagttccagagcttctgccagtaccgcgccaagctcaagaccaagacggaggacgagctcagccagctcaagcagttcgaaaaggcctggaacgtctacggggtcctcaactacctgaaggcgctggtcgagaagtccatgatcacgcagatcctcgagagggagaaggagggcctggagcagttcaccgccacagatggttacgactacgagggtggcagcaacgtgctcaaagtgctcggctactacagcatgattggcctcctcaggatacactgcctcctcggggattaccacactggcctcaagtgcctcgcgcccatcgacctcaaccagcaaggggtctacaccattgtcattgggagccacatctncaccatctaccactatggcttcgccaacctta

SEQ ID NO: 8335 - DNA, 770 bp, Sorghum bicolor
  Clone ID: SORBI-28MAY03-CLUS3451_1
cccgagtctaaggcaacaactgaaagtgtgtatagtgctgccttggctctcggaattgctaaccaactcacgaacatactccgggatgttggagaggatgctacaagagggaggatatatttaccacaagatgagctcgcacaggcagggctctctgatgaggacatcttcaagggggtcgtcacaaaccgatggagaaacttcatgaagaggcagatcaagagggcgaggatgttttttgaggaggcagagagaggggtaactgagctctcacaggctagcagatggccagtatgggcttccctgttgctgtacaggcaaatcctggatgagattgaagcgaacgactacaacaacttcacaaagagggcctatgttggtaaagggaaaaaattgctggcacttcctgtggcatatgggaaatcgctactgctaccgtgttcattgagaaatacccaaacctagccgccagagaagctgcaaagaaaggggttcaggttaggctagatagaaattaaatagggcaatgtcatcacatcagacctgatgaaaatagacaacctggtgaattggtggggtatcatacgaattgttgggatcaggtacagcacagattaaagccaacctagatggatgtggaacattatattcgcatgtatatcctcttattaattaggagcaaaaaggtaactccactctccaggaaagaaccaacatggtatacttttttctcatcccaaatttgagggaaaaacaatggtgacgctcgt

SEQ ID NO: 8336 - DNA, 1452 bp, Sorghum bicolor
  unsure (1)..(1452): unsure at all n locations
  Clone ID: SORBI-28MAY03-CLUS3452_1
ccctctgctcaccgatctcaccaccaccanagggcggcgccttctcctcccggcgagcgacggcggcggcgggagagggaggggagatggcggggtggcttaaggcgctagcgtacagcgccggtggtgtggcggtggccggcctagcggcgctggttgcgctgcaggagcgcctcgtctacgtgcccgtgctcccgggcctgccgcgcgcgtaccccatcacccccgcccgcctcggcctcatctacgaggatatctggctccgcaccgtggacggcgtgcgcctccactcctggttcatccgccactcccccacgcgtccgggtccaacctttctgttcttccaagaaaatgctggcaacatcgctcaccgtttggaatttgttcgactaatgatgcagcgactacagtgcaatgtttttatgctttcttatagagggtatggtgagagtgatggttatccttctcagaaagggatcacgtatgatgcacaggctgcacttgatcatctagctcagaggaaggacattgacacaaccaggatagttatctttggaagatctttaggaggtgctgttggagcagttcttgccaaaaacaatcctgacaaggtggccgctctaatactggaaaatacatttacatccatactggacatggctggtattatgcttccattcttaagatggttcataggtgggagctcttctaaaggtccaaaacttctgaactgtgttgttcgctctccatggaatacacttgatattgttggacaggtcaaacaacccattctcttcctttctggattgcaagatgaactagtcccccctccacacatgaagatgctatatgacaaagcctctgatcataacagaaattgcagatttgttgattttcctagtggtatgcatatggatacccggatgtctggaggggaccgctactggaggacaatccaattgttcttggatcaatacgctcctggagtacagaatcgtgatgtcagctttaaaagtgaaattactgaggatgatgaagctgctgattgaccggaacatctggatcagacttctttttccgaatttctgtttcctgatgttgtggcaatttatgtcaccaatgaactgaagctcactgcaaacaattaattcaggcaattattctgctccattgtacctgaagcaaccgaagttgtgaatatttttcgaggatattctccatcatgctctgccgcttcatttgtacctggaacttatagttatttgtccatgaaccgaatatatcctcttgattaaatgtacgaatggcatttttttttctttgctagtatccgtaacattcctggaaatgtggctgtacgacagcccgatacaggctgtaagcttgttggctcaactatttggttttgtgattttgattgtttgctaccaatgtgattcctttttgccttgt

SEQ ID NO: 8337 - DNA, 677 bp, Sorghum bicolor
  Clone ID: SORBI-28MAY03-CLUS35357_1
gcacgaggcccccccacctcctctcgatttgttccgatggccgccgccgcccgtcgcagccctacccgcgccgccgccgcaggaggacccgccgcggcgccgacgcagcagcgatcggtgctgcgggtggcgtcgtccgccgcgtcggcttcctcgtcgtccgcccgcacgcggaggggtgcggccgcaatgcagccggccaaggcggtggccgcggaggcggcgtcccccgcggtggagatggggaacggcgcggcggtcgcggggatgcagaggcccgacgccatggggaggttcgggaagttcggcgggaagtatgtccccgagacgctcatgcacgcgctcaccgagctcgagaacgccttccacgcgctcgccaccgacgaagagttccagaaagaacttgacggtattctcaaggactatgttggacgtgagagccccctctattttgcggagcgcctgacggagcactacaagcgcgccgatggcacaggcccgctcatctacctcaagagggaggaccttaaccacaccggtgcccacaagatcaacaatgccgtggcgcaggccttgctcgccaagcgacttgggaagcagcgcatcattgctgagacaggggctggtcagcacggtgtcgccactgccaccgtgtgcgcccgttttgggctgcagtg

SEQ ID NO: 8338 - DNA, 672 bp, Sorghum bicolor
  Clone ID: SORBI-28MAY03-CLUS35378_1
caccggctccgccgccgcggatcggtgtccgtcgtgcctccgcgttctcttccgccggcgcaactccagccgccgcgtgcctcttctctccccacccgatgcgggcccccgcccccccccccccgcgcctcccccgccccgccgggcccccgccctccccgcccgcgccgcgcccccgcccccgcccccgcggcgcggccccgccccgccccgggatccccgccctcctcggcgtcgccgctcctcccctcgccgcgcgaccgcctgagccgcgccttccacctgcacggcttccttgccggtcggtgtgctcccctgttcgcgcccccgggcggtgcgatgaccccgccgctacggcctcctacctccactgtgtggacaccggctccggggcttgggctggtggtgtttttgatgttccaattaggaaggatattgttcaccgggtagtaaggtggcagcttgctaaaagacagcaggggacacactcaacggaagctttctgtgcaccgggtggcacgggggcagcgccctacaagccagcaggggccgcacgcgcccggcacggcccgcggcgtgggccccaccgccgcggtgccgcacccgcgcatgggccctggccgcgcacccctgcgatcacgccgcggtccccagtacggcgtctagggctta

SEQ ID NO: 8339 - DNA, 742 bp, Sorghum bicolor
  Clone ID: SORBI-28MAY03-CLUS35391_1
gcacgaggcagtagagtaggactgtaggagtagtaggagtgcgcgaggagcagttctcatttctcaagaggaaacaaaccggacaacaagctgctgctccctagtattacgttacgactcgagtcggtcgagtgctcatcacttgtactagtagctccgatccatccgctgacggctgacctcatctcttcttccttgttccatgctgagcgttagagcgtgtgcagtggtggacagacgaggcgtggccatggctcgtagtaactagcaggcatggagctggcctggagctgctgctgtttcttgctcgccacctgcgcgcgcgcgctccgacggttgctccagctccccgcgctcctctgctgcgaggccatggtgtgggcggtcaccttcctcgccttccccctccgcatgctcaccgccgtcgacagggagcgcaagttggggcgcctggttgcggagatgcaggcgcagatggacgacctggcgtgggagaacacggcgctggaggacaggctgcgggcggcgctccgcgaccaggaggccctggcggcggtccttgacgagatggaggacgagcacgacgacgcccttgccaggatccatgtcctcgagacccagctcaaggcgctgaggcaggagaacatgcggctgaacgagcacaaggggaaatccaagtgggacaagctcgcggggcaggcggcggcgcgtcacggcagcggcggcggcaaccgcgcgtccg

SEQ ID NO: 8340 - DNA, 958 bp, Sorghum bicolor
  Clone ID: SORBI-28MAY03-CLUS35394_1
atatatatgcagttataatatttggccaattaggcagagattagagagggactggggagggaaattttgtacagggaagagagagagagggtagttgatgggaagggtttgatgtgattgcgctttcttttctctttgcttcctggatccaaccgccgccgccgcgtcctctcgtcgttgtttccgtgttcttggatcggatgccttcatctgcctagatcggagcaagagcaaggcgcgcggtgtaaatcccggcacgaggaagaacaggaggagaggggatcgaggccgctccgtcccgtcttgcttgttcttgccgcgtacggttctttcaagaacccgcggcggggatggatctctacgacaagagggaggacatggcgttgcaagacggggactactgccttgcgccccgggcttcgcggggcggatgcgaggtggacttacagtgggcggatggcctcgtcgaaggcgccgggcggaagcggtgcgccctggaagacttcgaggacgaggtccaggaaatggacgaggtggatggcggtggcaagcgcagcaagccgccgtcgccgcaaccgcacacaccagatattcgtgaagcccatgcccccagccgccgccgccgcaccgtggtggccggtggtggggagcacagcggtggtgggggtgacctcataggagaaatcggccgggacctgtccatcaactgcctcctccggctgtctcggtcagagtatggctcagtggcttcgctgaatcatgatttccggtctctggttcgaggaggggagatctacaggctgcgacggcagaataacattgccgagcattgggtgtacttctcctgtaatgttttggagtgggatgcctatgacccctaccgcaagcgttggatctcggtgcccaagatgccgcctgatgagtgcttcatgtgctcggataaggagtctttggctgt

SEQ ID NO: 8341 - DNA, 661 bp, Sorghum bicolor
  Clone ID: SORBI-28MAY03-CLUS35499_1
actccgcccgccccccaacccctcgtttttcctctgcgcatttcctcgtttccagctgccttccaggcaacgacgcctcgcctccccgcccattccattcccggaccgaatccccctcgaaacggtcaaagccaaaaaccaaccgcgcgcggcggcggtaacgagaacgagacgcgcttgctgaatcaggagtaggagagtcgccggcgagcagcaatgccttactgcgaggtgggcagttacgccgacggcgacaagtgggagggcgtccgcctcttctaccgccgctacggccgcggcgcgaccaaggtgctcctcatcatcggattggcggggacgcacgactcgtggggcccgcagataaaggggctgaccgggtcgctggagcccgccgacgacgaggccgtgcggccggacgaggaggccggtgtcggcgcggccggagcggcggaggcggcccccgcggaagcggacgaggccgccggcggcggcgatggcatcgaggtctgctgtttcgacaaccgaggcgtcggccgcagctccgtgctccccaacaaatcctactactcgacggcaatcatggcgacggatgccttggccttgatggatcatttggggtggaagaaagctcacgtctttggccactccatgggtgccatga

SEQ ID NO: 8342 - DNA, 958 bp, Sorghum bicolor
  Clone ID: SORBI-28MAY03-CLUS34830_1
gcacgaggtgcaggttcgcccatgtctctggggcaagctgatggcaaaggcagcggcaaccacgggaatggcggcaatgcctcccatttggaggatgtcaccggcatccaagagaggatgagcagtactagtagcgttgcaatgagtgctcctgctgctgcctctgcaactgctgatgcagaaggcaagcacgaggagcagcagggagagggtggtgatggcagccccaagcagaagcaggcagtcaaccctggggaagaggagaaggtggaatatggtcctgtgacagcaacacccaatgctgcttgtggattccaagaaagtggcgtggtggagcacattttgcctgacagcccctttgcatcccccgccaaggcctccattgatactgttactgctgcaactgttcagaatggtagcatcagcaacagcagccctcatcatctggcttcggcccttttcccagctgtatccacccttgagctgcccccatacaactcctgcttttttcaggtgcccaggttttctcctgggcatgaagccattgggctgtgaatagtggagcaaaaaggggtctcctttcctctaatctgggaggattcactatgatggccccatcatcaagcaagcgtagaaaagcgtagaaaagcttttaacaaatactttggaggtgtatcttcttcttcagagtggagggaacagcaacagcaacaacagaagaaacaacaagtctaggttgttttagctctaggcctataataataagtacatgatagttaagtaagtactagtcatcataaataatagtagtagtagtcgtcgtcgtcgtttagtagctcctaccggtatctatcaaggagatgatgatgaaaggtccatctcgtcgtatgctcgtttgtggcatggatctcactgttatgatgatgatactggtaattaaaactgtagtagatggtgt

SEQ ID NO: 8343 - DNA, 667 bp, Sorghum bicolor
  Clone ID: SORBI-28MAY03-CLUS34820_1
tattcttgttgagctttgcacgggcgaggcgttattccagactcatgaaaacttggaacatctggctatgatggagagggttctcggacctttgccataccatatgcttaagagggcagatcggcactctgacaaatacatcagaaaaggacgcttgaattggcctgagggttgcacttcacgggagagtatgaaagctgtgatgaaattgtccaggcttcagaatctggtgatgcaaaatgtggatcaggctgcaggagatttcattgaccttttgcaagggctgctcaagtatgattcagcagaccgtttaacagcagaagaggcgttgaggcatcccttcttcaccgaagggtttgggcaaagaagatgatattccttgtagcccatcttcaccgaagggtttggtcttactatttggcagccttcttcaccgaagggtttgggcgaagaagatatattccttgcagagcctaccgtatttgtctgacttgatctctttgtatctgacagtccgtacttggcgttttaactgcccagtggggtatatgtaggcggtagatagaccaatctgtatgtaaagctgtaatgaagttgtttcaatcttatttgaaacatcgtgtaactaaagttgtgtataataaagggaagccaaatgatttcccct

SEQ ID NO: 8344 - DNA, 757 bp, Sorghum bicolor
  Clone ID: SORBI-28MAY03-CLUS34879_1
atactgctccagcccaagcagcatcattgttagtattgggcccttttgtggacttctggttgaccaacaaaagagttgatgcttttaactacacatcaatagttacgttctttattgtgttgtcatgcataattgcggttgggaccaacctaagccaattcatatgcattggaagattcacggccgtctcattccaagttctaggccacatgaagacggttcttgtgttgacattggggttccttttctttgggaaagagggactcaatttccatgtcgcccttggcatgcttctggctgtgatcggcatgatctggtatgggaatgcatcgtcgaaacctgggggcaaagagcgccaggtttactccacaccgagtgagaaaactcagaagcatggggtactgtcatcgcaatctgagctcgaccagaaggtctgaaataaagatggggacggtgctccaaacgggtacccgcggtttttctctagtgtaacttaatgaactaaatgggaaaaaatgagggagaaaattgtatatttagttcatttagtagaaccgcgcgggtatccatttggagggccatccccattttagtctgaaatgagacacgcaaaggcatccagcgcttgttgagcattgatcaacatgattttatttttaatacttttttggagggagatgtttctatagaattgtaggccatagcagaaagagtgtacctgggcaaaaagcccatgactttacgtttccagcgagta

SEQ ID NO: 8345 - DNA, 709 bp, Sorghum bicolor
  Clone ID: SORBI-28MAY03-CLUS34839_1
cacggtcctcatcagttactgctacaccacatgtctcagaagccaatgttgctactaaggcactagctgcctcggacaatgtaaaattatctgctgcctcatcggggaccagcaacggaatgaaggaagaggcatcccctactaaggaagcacttgatgttacatcgtttcggcaacgtgctgaggctctcgaagggcttctggagctttccgcggatctgctggagaatcaaaggctggaggagctagccattgttctcaagccttttgggaagaataaggtgtccccacgagaaaccgctatctggctggccagaagtttcaaagggatgatgagtgacgaagcaggtcgcacgtcgctatgagcgcaattttgtgtgtgtttgtttggttggtttcacttgtgctcggagagtcggagtaaatcggtgccgcttgatttggtaatagcagtgctctgagttactcaaagttgattgcattgacaacagctcgtggagttgcgtgttctttccttttttattttatatttttgagaagacagcttgtggtctctcttgccaccttttcccttttctgattgctccattctttttggcgtatgttgtacatagccaagaacttagaactgtaaacagcaataaagcttgcctccagtgtcatcgaaaaaagaaaatactattaagctgaatgaaccttgaatcttctg

SEQ ID NO: 8346 - DNA, 1009 bp, Sorghum bicolor
  Clone ID: SORBI-28MAY03-CLUS34899_1
gcacgagggagagagaggttcttgaggttcatattgagaaaggaatgcagcatggccaaaagattgtgttccagggtgaagctgatcaagctcctgacacagtgacaggagacattgttttcgtcttgcaagttaaagagcacccaagattcaagaggaaatatgatgacctgttcatcgagcacacaatctctctcacagaggctttatgtggattccagttcattctgacccatcttgatggtaggcagcttctaatcaagtccaatcctggtgaaattattcagcctggtcaacacaaggccataaatgatgagggtatgccccagcatggtaggtccttcatgaagggccgtctctttgtggaattcaatgtcgagttcccagaatctggtgccctctcacctgaccaatgccgggcacttgagaaggtcttgccacagaggcccagggcccaattgtcagacatggaggtggatcagtgcgaggagaccatcatgcatgatgtcaacatggaagaggagatgaggcgcaggaagcaccaaaggcggcaggaagcatacaacgaagatgaggaggatgctggtccgtcgagggtacagtgtgcccagcagtaagacgtgacaccgcgtttcacgcatgctttatcataagtgataataacccaacaccgatttgtggagtttgtgcatgaaaaatttatatggtatatgtgtgacacttattgtcagtcattagggatatacaagcagttgccagctaggcatttgtattggtcaaagtatgtaaacataatgtggtgataatgacggcttggttaggacttggggatatggtttgttaaacttaccgttggtgctatctttgcttcaacagaatgctggtggcctgctgctgggaacctgtgacttggcatgtcagcatttgagatgtgaacctgaaactgtcatgtcagcgtttgagatgtgagaatctgaaactggtactatgtaaatgcggtgaaacatca

SEQ ID NO: 8347 - DNA, 1062 bp, Sorghum bicolor
  Clone ID: SORBI-28MAY03-CLUS34021_1
ctgacaagggcaagaaagggtcaccggcggcggcgaagggcaagggcaagggcgagaagcggcagcggcagccgcgcttcgccttcatgaccaagagcgaggtcgaccacctcgaggacggctaccggtggcgcaagtacggccagaaggccgtcaagaacagcccataccccaggagctactaccggtgcacgacgcagaagtgccccgtgaagaagcgggtggagcggtcgtaccaggacccggcggtggtgatcaccacgtacgagggcaagcacacgcacccgatcccggccacgctccgcggcagcacccacctcctcgccgcgcagttgcacggcggtcaccaccaccaccaccacctcggcggcgccttcccgccgccggccccgctcccgcagcagatggcgggcgcgccgttcgggcgggcaggcggcggaggcggaggcgtcatcgacatgctggggctcctgcccccgcgcaacaacaaccacgccgccatgccgccgcccgtgggcctcgcgtcgtcccgcggcatgagcggcggcggtccgatgagcaccgtggcaggcgcgacggcagcgacggccgccgccaccactacctcgtcgtcgtctcctccctcgctccagatgcagcacttcatggcgcaggacttcgggctcctgcaggacatgctgccgtccttcgtccacggcaatggcggcaacgtccagccctgaattcgatcaattggtcatcaccgccacaagcagcaagctaatgaggaaggaagctagctacttagataaagagatagtacttaatttggttcttgttaatgcccttaacctctttaatttttccttttttttcaccgatttgctcctctagatgggtcatatcggttcttgatttgttttttcctaatactgctgtgctgcgagacacatgccgctacagagttttctggcgccggccgggtctcgtaccgtttcttatgatgatgatctagtagctagtccttgcaggtagtactagcggtgttcttgtacatgtacctaatcaactcaacccccaggc

SEQ ID NO: 8348 - DNA, 709 bp, Sorghum bicolor
  Clone ID: SORBI-28MAY03-CLUS35856_1
tttctaccagatttactccctatcagccacaaggcttggtcgctgatgagttcccacacctagacatcatcaacgacttgttggatgaggagcagagtgacaggagaagggttcttcaacctggttttgttcaacaattctctatgcctaatggtgccagcacacctgagtatggtttgtttagtgagccatacctgtttgaccagtctgagcaatactttgacgaggagcctccaaggttttatagtccattgagcagtgctcctcggaggctgagggaccggagctattcacactttgatctcccatcatactccagcagcagccagtttgatgatctgatgatgagtcagtggccatacagccgcactgacatctccatgcctagttttgagtcagacacaagtggctacccttatcaggcgcaggatttcccgagttcagctaatagagcaagcaggtacccatcgtatcgccctgccaatgggcattgagagttttaatggttgcattgataataatgtgtggtcgagtccatgctgttcgcttctgagctgagtgtaattgtaatagttccccatagcagtgatataaagaatggttcctcagtttccttgttaaatcaatagttacatctttttccccccttttactatagttccgttttgcccaatggtaataaatctaagtcggttaaaatgatctggct

SEQ ID NO: 8349 - DNA, 1491 bp, Sorghum bicolor
  unsure (1)..(1491): unsure at all n locations
  Clone ID: SORBI-28MAY03-CLUS3564_1
cgtgcgcccacgcgtccgcccacgcgtccgggagtcgtattcgtctggtgttgatgtactgctctcattgcgagatcttcagctaggagcgagaggagatctgaaagtgattgtcccaggacgaangaggcagttcattcttggtgaacaggaaacttcgctatattgctataaggctattttattggacgccaagaagcaaacagaaacatttgtgtaccactgtggagtttttattgtgcctaaggctcgggctcaggaatggttattttcttcagaagaaggacagtggcatgttgttgaaagtgcaagggctgcccgtctaattatggttttcttggacagcagacatgcaaatatcgacatggatattattaagaaggattnatctccccttgttaaggaattagaacctggaaatcctgaagaggaggcccctataccgttcatgatggcaggtgatggtggtaaacaaagacatattctgcacgaggcacaaccaaagggcagagccttggccaacgctagagcttctgcagtgtgtgtgtgtgtgctgttctcaccccttcttctacctctagccatagtgaatgtgtgtgctggtaagcttagtgcgtacttgtgtagggcagcaagggaccaacacccccacccctcaccccctcaaaaaaaaaaaattcccccttcccttttccttctttctccctgtgaactgggtgcttcttttctggctgcttgtgaggtccagaaccctgaggcctgaacagctatgtctcattcgtattactaaccctcacaggctcaaggccataccatcacagttatcttcttagttagagtgtctaattataactgagttgcatacctgcgcagccgtcgctgctgatctttggcgttccccgcgggaggcaacttcagaaataactggtccaatggttgtggaagatgttgtctatgaaaatgctgatggagaccaaggttccatgtctgagaaaatgttccggcgccttatttttggaagaagttctggtttagtgcaatctgaagccttgctaatcagagatcctcccagtgatgagatagacagaaaaaacaaaagtgcatctgcgacatctaaaaaaagaaggaaccagaaaaagggatccaagaacagtctgagaattgaccatagatttcttggtagctcatatcacagcagtatcatatctgggctttctttagttgcatcttctctaagtgttgctgcttcatctggtggaaaggtcagcaccactgttataggccttggtgctggttgtttaccaatgtttctccgtggatgtctgccttccgtagatgttgaggtggttgagttggaccccttggtggctgagctagcaaagaaatattttggcttttcaatggatgagcagttgaagttgcatttgggggatggcatcaagttcattgaagacagtgttgctgcaaatcattcagtaaatggcagtgcca

SEQ ID NO: 8350 - DNA, 1051 bp, Sorghum bicolor
  Clone ID: SORBI-28MAY03-CLUS35869_1
ccggtttagagaataaagaggggtgctccggggtgggctgagagagcggaaggaaggcacgagggagccggcgatgagcgggtggagctggctctgctgtggccgatccaaagccggaggcagcgatgtccggctccccgagcccttccagctgccggcgcccttgcccgattggccgcaaggtggggggctcgcctcgcgccccacccgccgccgtgcccttggcgggcttcgttttgccgttcgccccgattggtggtcctgcccggtggcggctgtgtcggagccgctccgtatgcccgttgctgtcccctgccttgcgcgcttcgccctcccgcggggccgccccttacagggatttcttcttgtggcaagggaagtggctagccaccaagttattaatagcaagcccgcccttgagaaaccattagattactcccttgtttggaccagtgctgacttaaatgaagatggcaacagcgaatgtggttgcatctggttgccatgtccaccgaatgggtataaagcccttggctatgtggttactaaaggaccaaagaagccctcactggaagcagttcgatgtgtgcgagatgacctaacagacacatgtgacaatttccgttcaattgtaaatatggataatgcatgccagatttggaagacaaggccttgccaccgaggagtgagagggcacggtataccggttggtactttctcctgtgcaactgattcaacagatagcgatgaatcaagcactccctgcttgaaaaatgttgacccaaatttgagatccatgcctaatttagagcagatcaatgctctgatcaagcactatggcccaactgttttcttccacccacaagagacatacttaccatcatcagtctcttggttctttgagaatggagcgacattgtacaagaaagatgcaaaaatgggagatgcaatactccctggtggcttgaacctgcctgttggtgggacaaatgatggtgagtactggattgatctccctgacgatgacaggaaggagcttgtcagagatggc

SEQ ID NO: 8351 - DNA, 578 bp, Sorghum bicolor
  Clone ID: SORBI-28MAY03-CLUS35870_1
gcacgaggggaaggccgtggaagcaaaggcgcgcgcagcggcgcatgggagcacaccaccagggaacaaatacaccttcaggtgacctccctccgatcgccgactgaatctacctcgcttcgtgcctccagttccaccccgggcccgccgaatctgagctcgggatcgcctcttcccgctgcaatgggggccgattccgaggacgccgtcaagcagctcagcctccttatggagcaagtggaggccccgctgaagagatcgtttcagaatatgcaccagggctatctcaaagaaactctggtgcgtttccttaaggctagagagtggaatgtatcaaaggctcataaaatgattgtagattctttgaattggaggattcaaaatgaaattgatagtgtgctggagagacctatagtcccagtagatttgtacagatcaatacgtgattcacaacttattggcctgtcaggatacacaaaggagggtctcccagtttttggcattggtgttggacatagcacatatgacaaagcttcggtccactactatgtgcaatcacatatccagattaatgagta

SEQ ID NO: 8352 - DNA, 604 bp, Sorghum bicolor
  Clone ID: SORBI-28MAY03-CLUS35885_1
gcacgaggggcacgtctgccgcgccgatcctcccccagctcagcgcagctcagctccgcctcgccaccactccgccactccccaccgcgccccttcatcccggatctcggcatgggcgccgccaccaccaacggctcggcggaccccgcgcccgcgccggtgccggcgctcaagttcctcatctacgggcgcacgggctggatcgggggcctgctgggcggcctctgcgcggcgcgcgggatccccttcgcgtacggcgccggcaggctcgagagccgcgcgtcgctcgaggccgacatcgacgccgcgtcgcccacgcacgtgttcaacgccgcgggcgtcacgggccgccccaacgtcgactggtgcgagacgcaccgcgccgagaccatccgcgccaacgtcgtgggcacgctcacgctcgccgacgtctgccggggccgcgggctcgtcctcatcaactacgccacgggatgcatcttcgagtacgacgagggccacccgctcggctccgggctcggattcaaggaggaggacacgcccaacttcgtcggatcattctactccaaaactaaggccatggttgaggagctgctcaagaact

SEQ ID NO: 8353 - DNA, 687 bp, Sorghum bicolor
  Clone ID: SORBI-28MAY03-CLUS3525_1
gccatctcgaaaaaggagataacgtctcggctctcattactgcggaattctatagtagggatcaatttcctggatttggaagaccttttgtgttcaatgcagagatcttaaaaagagttggacgtacatctgaagccaaagattcagctcgagtggctctgaaatcaccatggtggacacttggctgcagttacgaagaggctgctgaactagctgggtgggaggatgagcagctcgagtttataagagagaaggtaactgaggagggtaagcgtgaggatctgaagaaaggaaaggctccagaacaggtggttcttgacgaggcggcattcttaatggatttagcgtctgtggatggtaactgggatgaggtcgtggatcggattgctgagtgttacagagaagctgggcttcatgacattgcaaatttcattgcctacagggaatagatgttagattccctatggtctacaatgttgttcaagaaattttggttctttcatgctctgatatttattcttatataagagaagaagacccaatgcctacattacagcagtccttttttttctcttgtcagttagtgatcagcaccataatttcatgcctgtatagctctgaattgtacttttgccatttaaattttcatgcttattcaggattaatatgtgcctagagcgcattttt

SEQ ID NO: 8354 - DNA, 634 bp, Sorghum bicolor
  Clone ID: SORBI-28MAY03-CLUS35262_1
gcacgaggctcaaagcacgagggcgagacgccggagcggaatgcatcgaggcatcgagcacgcccctgaaatggtggagccgcctcgcgtcgccggctgctcgacaaactggagggaggaggcggatgagcggcttcggcgcctccactccctcctcttcggcgccgacgcggcgctcgagcacggggacgtcatgttggcacaggcgctcgcgctccgcctcctcggcttcctcgactgccaggccctagccgcaggcgcaggccccgaggacgccgccttcgtcgcgcccattcgcgccgcggcttccgctcggctagccgccgcctcacgcgcccgcgtccctgactccgaccgtgcagcttttgagctcgcaagaacagatgttggctgtgtttttgcaaagcagggtgacaataatgttgaaagaatccagtgttcgaagtatttccaagctcttcttcagaaggctaaagcgaatgcttctgaacaactgaatgcaacatgccaagagttctcggttcaatgggctccatgcgttgatgaaagccaagctgacatggaaaatgagaagctaagcatcagggattcaaagttaatgctgcaaacgaagttggcatcattatatagtagc

SEQ ID NO: 8355 - DNA, 752 bp, Sorghum bicolor
  Clone ID: SORBI-28MAY03-CLUS35327_1
agctgctctggttttggttctcttccagccagccaccgcaaagcgcgcagcaaagctggcctcactctgacagctcagctcctcccaagctccctatatctctcctccgatcccccctgcccgcctccccggcataacacaacaatctctgtctctctcttcccctcactctctctctctgcagcgcgcagctttcaaagcgttgggagagatggcagaggagacgcagccagaggccgccgccgccgccgccgccgccgcgccccccgcggccgaggtggtcgtgaccgaggcggtggcggcggaggtggaggtgcctgcggcggcggaagccgaagccgagcccgagacggagaagaaagctgatgaggcggcggtcaccgccgatgacgcgggggaggggaccggctcgttcaaggaggagagcaacctggtggaggacctgcccgacccggagaagaaggcgctcgacgagttcaagcagctgatcgctgctgccctcgccgccggtgagttcaacctgcctcccccgccgccgccgccgaaggccaaggaggaacccaaggccgaggagacgaagacggaggaagccaagacccacgaggcgaagacggaggaagccaagaccgaggagccggtcaaagaagagcccaaggccgaggccgaggctgcggcggaggagcccaaggccgaggtggctgcggatgccccggctgaggaggtcaagacggaggtgccgccgccagaggagg

SEQ ID NO: 8356 - DNA, 737 bp, Sorghum bicolor
  Clone ID: SORBI-28MAY03-CLUS35355_1
ctgatccagctttctattccacccgcaccagcagcatctcgggggaaaaaagaggaaaattttggagaaaattcccattggcccagaatactcaggcgcacgccgcgaccttcgctcccgtctccggtctccgcctgctccccgttcccccaactatcgggagcgctcccgatttgcgggagccacagagggagagagggcccctccgctagccgccgcctgcgccgccgcggatcagcgccgtcgccgatcggaggccctcgcttcccccggcgggcggcgcgagccgggagatggacggcggcgcgggcgcgggccggaggagcgtctcctcgtcctccggatccaggaggaggctcccgcccgccgagaacgggcacggccatgacgccccgccgccctccaggcgcgcctccgtctccctctcccgcggcccctccacgacactgaccagcgagaggaccgtgaaaaggctgaggctgtccaaggcgctgacgataccggatcacacgaccgtgcacgaggcttgtcggaggatggcatcacgcagggtcgacgccgtcttgctgaccgactccaatgctttgctctgtgggatccttaccgacaaggacataaccacaagggtgattgcccgtgagatgaagatggaagagacaccggtctctaaggttatgacaagaaaccctgtatttgttcacgcggacacgcttgcagtcgaggcgttgcaaaagatg

SEQ ID NO: 8357 - DNA, 698 bp, Sorghum bicolor
  Clone ID: SORBI-28MAY03-CLUS36324_1
aggtaatgctgcatttaaggaaaagcaatggcaaaaggcagtaaatttctatactgaagcaataaagttaaatggaaaagtggctacatactacagcaacagagctgctgcctttctagaactaactagctaccgtcaggctgaggcagattgcacaagtgccatcgaccttgatccaaagagcgtgaaagcttatttacggagaggcactgcaagggagatgctaggttattataaggatgccgttgatgatttcaaccatgcccttgttctagaaccaatgaacaagacggctggtgttgccattaacaggttaaagaagctgtttccgtaaatatgaagttgaattgtttctgcatgaaggtgtgatgacctcagattttgtgcacacacaagttgtgcgtgtccggggggctgggattgaagtacctgagttcaaccgactcatgctgctacagatgctctatgctctcacaaggtaccaaatgatcacagcttgagctagtgtgagtacacagagatcagattaagggtcaatttagctgtttcttcccccccaaagttttggaaaagcaaaataaaactcaagttttgggagttgatcatagactcatcatagtaaacaatgtcttcaaaagtggtttacgggtgaccgcgatccccaccatgtataatatgggttcgccaattatttgttg

SEQ ID NO: 8358 - DNA, 809 bp, Sorghum bicolor
  unsure (1)..(809): unsure at all n locations
  Clone ID: SORBI-28MAY03-CLUS3636_1
cctcctggcagacatcaactggtgagcggtcgtctcgcgggctccctcgcgcctcccctcctcgccgccggcgtcctggccgccgcggcgccgccccccccccccgccgccctcctcgcccccgcggcgccgctcccggccccccccccgcccccctcccccccgccccccctcccccccccgccgccgccacccccgccgccccccctcatcctcctccccgggccgggggcgctgcgcgtgcgggcgctggccgcgccggcgggcgggtgcggcgccgcgcccgccggcgggccgctgcgcgcacccgccggccgccggggccccgtgcagggccaccagggacgggtggctgcagcggatgcacccgaacaacgggtcctgggagcggtggcgcttcgtcggtggcacggggctgcgcggggtcgcgccgtccgccgacggcaccatgctcgtctgcgatgccgacaagggacttttgagagtcggggaggaaggagtgacccttcttgcgtcggaggtcgagggcaccacgatcaggttcgcggacgcggcgatcgaggcctccgacggcacggtgtacttcagcgacgccagcaccaggttcggcttcgacaggtggttctacgacttcttggagtcccgcgtcaccggccgactcctccggtacgacccgcgcaacggcgagacgtccgttgtgctcgaccgcctcagttgcgccaacggcgtcgccctgtcgagggacgagacatttgtggtcgtctgcgagacgtgaggttcatgtgcctgaaagtgtggctgaangggag

SEQ ID NO: 8359 - DNA, 461 bp, Sorghum bicolor
  Clone ID: SORBI-28MAY03-CLUS3638_1
caacggcaaccccgcggcggcctcgccggaggatgaggaggaggaagccggcggcgcgctgcggctgtgctcgcaggcgctgtgcggtcgtcccgagacgcggcggcacgagttcaggcggtgctcggtgtgcggcgtggtgaactactgctcccgcgcgtgccaggcgctgcactggaagatggcgcacaaggcggagtgcacgcccgcggaccggtggctcgacgtcgccgtaggcggcggcgtcggcggcggcgccgcggtgcagcccaacgccaacgccaatgccgacgcggcggcggccccggctccgtgacgccccgtgcgcacgcgcgcgcggcggggcggggccggcgtcgtcagtttcctctcgcagcaacgtccagtttttactgctcccccctgccttccgtccgttctttctctctctctctttttttttttcttgtcgtttactcgcc

SEQ ID NO: 8360 - DNA, 834 bp, Sorghum bicolor
  Clone ID: SORBI-28MAY03-CLUS36394_1
gtggaagatgctgttgtagttgcacttggccaacatcgcagacctagcatagttcgtcagttcacatcagatttcaaatcacctggtgaacctaaatacttggaggcatttgatcttagcccagaagaggctgaagatgttagctttaagcaggcctggcttatatacttctggagaagagccaaaactcatggtgttgaggaagatattgctgatgaccggcttcagttttggattgggcgcaacgcacaagctccaaattctcatgatgctatagatgtggagaggggtctaacagagctgaggaaattgggcatagagcagcaattgtgggagggctcgcgagcagatatagatcaagcttctttggcgatggagaatcagtaagaatttgctaattttccatggctgtgtatcatcccagttttggagaaacgggaactttggttcccagcaggtctcggccctttgcatcatcaagtatcagtcacagaatagtgctccgagcttggggtgtgaccgatggactttgtccaaattccgatgagtttgtgtagtgcatgtgcaagccattcttctgttgttattaaaatagctttgtgaaatgtgtaatagctttgcgttggcaagagaaaacgatgacaacgacgacctcacttccagcaattgtgaattctgtgattatcccaccttgtttattctctgctgtcgagctcaacttctccgcaccaaggaacgtgcgtgttcctgcaacaatattgaacgagatgattttgtataattctctgggtagtatgagttttaacattctataaaaccatccctgttcaatcc

SEQ ID NO: 8361 - DNA, 1482 bp, Sorghum bicolor
  Clone ID: SORBI-28MAY03-CLUS35510_1
gtttccttccattccaaccgaattctggtttatgcgggcggaattccataaggtcctcctcccttcgcccctccaaatcctctgcagatttctcatggcagccgacgtctccatccccactcgatccgcctccaccacccgctaattcctcctcgttctagtcccctgcctctctcctgcgccgactcgtcttcttcctcgcgtcactcccctgccgctgctgctgacgctgctgccgggaagaccaaatcattcccgtcaagttgttttaggtgattggtgctttcaacctggtggtactcaaggagggcacgtcggtcaagatggcatgtccaaggggaaggacatcattgcccctttgtttctttctgatgatttgcctcatggctcagctgggagcttccaatgttgtactcatggcgaacaacactaccctgtcgttcgatgatgttgaggcaacttttactccagcagtgaaaggttcaggtgtaaatggtgtcctttatgctgtggaacctatggatgcatgcagtccattgagaacaaaagcgattgaaggctctgcctcaccatttgcattggttataagaggtggttgccaattcgatgacaaaggtagaaatgcacagaatgctggattcaaggctgctgtagtgtatgataatgaagacaacggcatccttgtttcaatggctggaagctcgtctggagtccacatttatgcagtgttcgtctctaaggcatcaggcgaggaattgaagaaatattcaagccaaactgatgcagagttgtggataataccaacatatgagaactcagcttggtcaatcatggcaatttcattcatatcactgcttgctatgtctgctatcctagctgcttgtttctttgtgaggagacaccagataagacgggacagagctcgacttccccaagttcggcacgtccacggaatgagcagtcaattagttaaagcaatgccaagccttattttcacaaaagtgcaagaagacaactgtacatcagcaacatgcgccatttgcttagaagactacagtgttggagaaaagctaagagtgctaccatgtcgacacaagttccatgcagcttgtgtggacctatggctcacctcctggagaacattctgccctgtatgcaagcgggacgcaaatgctggaacatcaaaccttcctgtatcagagtctacccctttgctttcatcatctgccattcccttaccagaatcaactgctttggcttccttccggtctacagtagcagcatctccccccaggccaatcagccggcatccttcatcacagtccatatcccgcaattactccatttcgggttccagtatccctcgcacccctaaccctaggttttatgcaaactcatctcctttctgcacccttgcaaatatgtcatcctcatggtctcgcacttcgcaccttgcatctgctcactctttgtgcggtggcc

SEQ ID NO: 8362 - DNA, 705 bp, Sorghum bicolor
  Clone ID: SORBI-28MAY03-CLUS35584_1
ctgctcaagaactacgagaatgtatgcacccttcgtgtaaggatgcctatttcatcggatctctccaaccctcgcaatttcattaccaaaatcacccgatatgacaaggttgttaacatcccaaattcaatgacaatattggatgagcttcttcccatctcaattgaaatggcaaagagaaacctcactggaatatggaacttcacaaaccctggggtggtgagccacaatgaaatactagagatgtacagagattacattgatccaagcttctcctggaaaaacttcaacttggaggagcaagcaaaggtcatagttgcaccaaggagcaacaatgagcttgatcaaaccaaattgaagagagagttcccagagcttttgtcaatcaaggagtcactgatcaaatatgtttttgaaccaaattgtaagacgtccaaggcttgagaaatggagctgcacacaactgtatgttgatgctattttgttccatcggaattgacatttctctccggggatctcaataagtacaccccctgtttcgtgtgcaatgtatttgattgaaacagatagatttcttataggggatgtcatgccatactcctttatactttcagattattaaacagagcaagacaaggtgtaatttagctcaactttcgtatgactcctagtatcctagggaccattatgaataccatgcgttgg

SEQ ID NO: 8363 - DNA, 847 bp, Sorghum bicolor
  Clone ID: SORBI-28MAY03-CLUS3562_1
ttccctgtcgacagcgagtccgctacaagatgctgttggaaaggcaatttgtaaaacgtttctgatgcacgtttcttcatttgttcactgatagtattaataagctcttcgagatgggtagtagaaaagttaacttttttaatccttctgatactgttgcatacgaaaattcggctacgtcttggagatagtgtgcttcgattaggggagaatacagcatcgagacaaattttgggtgttaggagcagcactaacaagactaataaagatgatgatgaggcttcacaaaatgatggatctactaggagaactaggtctccaacttgggaagcagaaaagatcacaaatccaattgatcgtatagtggcccatttgctgattcatagaaattgctacaaggttgcaacaccaacaaacaaggaaatcatatcctcaaccccctttaaaatagaacctgatccgaagttaaccttgggtactcctaggttgccaacacaagatccaggagatgtccgagccaatgtgtggcccctgccacaatagcgccacattttctctccggccagcattaacatcacccgctttactcgatccgccgtttgtgtcccgccctatctggtgccgtccttcgctcgggccttcagttgctgtttccttcttccgctcagaatcaaaatgatagcaaatccaatgattatggcaatctgctgatcacctggggttccggagatctcttgtgtaatatgtaaccatttcaacattgtagcatcctttttttttcatcctgtaagaacatctcagactgtattggaacctacgattgtgtcgagccctaaaaggagcaaac

SEQ ID NO: 8364 - DNA, 1355 bp, Sorghum bicolor
  unsure (1)..(1355): unsure at all n locations
  Clone ID: SORBI-28MAY03-CLUS35625_1
acttctcactgtcatggtgccggtgccctctccgtctcctccttctttaacaaggcaccaccaccaccagcacctctccagacgaacgaacaaaaagaggcctcgcacctcgctcgctcgctcgccttcctgctgtgcttctgcttccccagcgacagcgagtctcctcaacctcagcccctcccctcccttcgccgccgcctgcgactccgatgccgccgccgctcgaggcgcgcgacttcctcggcgccggcgccacctcgtcgtgctgctcgtcgtcctgctcctccggcggcgatgggacggtgccgcacctcgcgctgcggctcgggctcccggggtccgactcccccggccgaggcgcgcaggcggagcacgcccacgtggacgccgcgctcaccctcggccccgcccccgcccccgcgccgcccaggggaggcgccaagcgcgggttcgccgactccctcgaccggtccgcgaagcgggacggtgctgcggcggatgacgacgctgctgggggcgtaactggggaggataaggnggtagctgcggccgctgccggagctccgccggctgccaaggcacaagttgttggatggccacctgttaggagctaccgaaagaatacactagctgcaagtgccacaaagacaaaggtggaagatgaaggtaggagtgaggcgggatgctgttatgttaaggtcagcatggatggagccccatacctaaggaaggtagacctcaagacctattcaagctatgagaatctctcgcttggtctggagaaaatgttcagctgcttcatcactggtcaaaacagttcttgcaagacatcaagaagggataggtttactgatggttctagggctgatgcccttcaggaccaagaatatgtccttacttacgaagataaagatgctgactggatgcttgttggtgatctgccctgggacttgttcaccacaatttgtcggaaactaagaatcatgagaggctctgatgctgctggcatggctccaagatcactggaacagatagctcggaacaaataaggaatgttgcccgacagacacagtctgaactaaggacagagtttacatggcgctgaagggagcgatgttttatgcgaagtgcttcggttaagtcttcttttcacatgtgcagtgagatctgtggcctactgtaagacgcccattttgcccacgaggttgtcacgtgttattgtagatggtcgcttttgtctgtgaaagatcaaatccggtagcctactgcttcctctatgatactttcatctgtatccggaagtttgtacttcatttncctataacagtaaaaaaagtgcccatttgtccagt

SEQ ID NO: 8365 - DNA, 805 bp, Sorghum bicolor
  Clone ID: SORBI-28MAY03-CLUS35671_1
gcacctccattcggcttccggcgaggcccctggatcttccgaccggtgtcccaccattctactcacatgtcaggcggcgcgtcctttggggaagagttcccaggtgtcgtcaatcctcttgatggagttgagtggatacaggataactccaatgggttaacggggatgtaccagtattttgtgaaggttgttccaacaatctacacagatatcagggggcgcaagatttactcaaatcagttttctgtgacagagcactttagagaggcaattggctatcctaggcctccacctggtgtatatttcttctatgaattttcaccaattaaggttgattttactgaagaaaatacatcgcttcttcacttcctgacaaacatatgtgctattgttggaggtattttcactgttgctggcatcatagattctttcgtgtaccatggtcatcgtgccatcaagaaaaagatggagcttggaaagcttggataactacaattgttggcatatagcaattaggaccatagtgaaaacgagtttaacttgtgctgcactgcctcgaaaggttgacgaggacaattgaagagggattttgatccgctgtgatgcatctgtagtcattcagacttgttagcttgtctgaagcctagagctccacatttttaattggtttccttgctgcagaccgccgaggcctgtagacaagtagtcgtggatacgctgctccattaccggaaaactctcttgagcagaagcatcactgccagccaaacgttttgtgttattggccaagtatattgcaagggca

SEQ ID NO: 8366 - DNA, 723 bp, Sorghum bicolor
  Clone ID: SORBI-28MAY03-CLUS35684_1
gcacgaggctcgagtccgcactccgcagcagaactcgccgcagaatccgccgcacgcaagcacactctccagtcaccgtccgcttctccagatccgccaatctcccccttctccaccgccgccacgatcccaatggctcgcttcgccgtggtcgccgccgccatcgtggccctcctcgccgtgaccgccgcggcacaggcccccgccgccaccccgacgccggcgcccaggatggctccgctgccgcctcctccagcgcggtccccggccaccgccccggctccggccgccaagccgcccaccgccgcggcgccgtccccgctggcatctcccccggccccgcccaccgccgacggccctgcgccgtccgtcgcggtgaccccgacctcctccgtctcctcttcccccaccggcgcccccaccgtcgcgcccgccggcagcggcgccgcctcccacgcctccgctctcggattcgtcgctgtcgccggcgcgatcgcagccgccgtcgtgttctagacgcgcggcgtcgtgatgggcggtgctgtttatactacagttatcgtttttcttttgttttggtgtgcgtcggtgattctttctttagatactcctgagagagcagaggttatgtgagggattctagtgggtgtagcgtcgagctgttacatatgaatttcatgattcacgacccagatgattattaatggaattttttcatttgtt

SEQ ID NO: 8367 - DNA, 576 bp, Sorghum bicolor
  Clone ID: SORBI-28MAY03-CLUS36801_1
cttatcataaaaaagaagtatcagggaactaatgactgctttgtgttcaccaacgtagatggccgtcctgttatatgccatccaacaggtgctaataactattttacgttttgttctcccgactatttggcaatgggaggtggtggtcacttcgcactttatctcgatggagaccttgtgactggttctagttccacttccgagacttttaacaacccatgcttatcccatacccaggaattcaaaatcaaagatgtggagctttggggcttcgtcaatgcttccaagtatgaagagatgctcacggtctgccgcaccgaaaagcaaggaatttggaatctgtgacccttttggagttacactaagctgttgattgatggtgtgaggtgtcaaccgatcctccggtgtggcttgtacagttttgtagtaaccgtttgtatagcatgtagaggagagtttccatagggagtgagaagttgaaacatgaagagttttgctttgtaaatactaaatgccatttatagaaaatactgtgtggtactactagtacactaatagctaactgcataatttcat

SEQ ID NO: 8368 - DNA, 668 bp, Sorghum bicolor
  Clone ID: SORBI-28MAY03-CLUS36819_1
tcggtgcagggattcaggggatattcatgctggtgtcaggttacttcagacttccgcatgacatcccaaagcccttctggaggtaccccatgtcctacgtcagcttccactactgggcattgcagggccagtaccagaacgacctgaagggcctgctgttcgacaaccaggacgacgagctgcccaagatccccggggagttcatcctggagaacgtgttccagatcgacgtgaaccggtccaagtggctggacctggccgtgctgttcagcatgatcgtcatctaccgcctgctcttcttcgtgatgatcaagatcagcgaggacgtgaccccctgggtgcgccgctacatcgcgcagcggcgggtgcagaaccggcggcagcgcaaggtggagctggccaccagaacgccgtcgctccgcgggtacgtggtcgacgtggccagcctgccggccgatcacccgtgattccgtgaagcgcgcgagaactggatatcagtatcacacaaagcctaaaccggaactgataacagtacagtagtactgcaacattccaatatgaatgtgttaattaagtttagtagcaaccgcttaagctgtaatagagtgttgtttgatgcactgctaagatgtatgtatatcaccagcttgatgcaagttttctctgtt

SEQ ID NO: 8369 - DNA, 865 bp, Sorghum bicolor
  Clone ID: SORBI-28MAY03-CLUS37000_1
ggccatcgaatcttacgacacatgcattaagtattaaatatagatgaaaacaaaaattaattatacagtttgtctgtaaatcgcgagacggattttttaaacctagttactctatgattggataatttttagcaaataaaaacgaaattactaccatgtcaaaatttaaaaatttttgagatctaagcaagtccagtccacgccgttgttgggctacaggaaagccttgccgcagcaaagagcgcgcatgccggctcgtcctggcacgaggcgaaagcgcccggctacgtgccctcaaaatccatcgggcgcccaagacacacacctgacaccactacctttctcctgcgtggtccgtctccttcctccctcaacctgttcttctggtctcagttcaccaccacagtggctgctcacatccatccatccaccaccacactgccccaaatcgatctcccctctctcgggtccgtagtccctgccggctatcgctgcgtcgttccaggcatgcgcgtctctggtggccgtctacgccggctgctggccgtcaccgtcgtgctctccgtcgcgctgtccttggcgacggcggcggcgggaggcggcgagcacaacttccgccgggacttcgacgtggtgtggggcgcgggaaatgcgcggttccgcgacggcgggcggaccgtggagctgtccctggacgagcggacgggcgcgcggctgcagtccaagcagcgctacctcttcggcaagttcgacctcgagatgaagctcgtccccggcgagtccgccggcaccatcacctccttctatgggaagaaggaaaatgcgctggatggatggatggcctcgttgcagcttggtagatcgg

SEQ ID NO: 8370 - DNA, 663 bp, Sorghum bicolor
  Clone ID: SORBI-28MAY03-CLUS3704_1
gatgggcatcaaccgacagcctctctcttatatttattattacacccaaaatggtgatgcagagaattcttgttacattattgtccttagaatacaactgcgcggaggcagaggaggatggttcagatgttggttggtggggcgtcggattcagggtcccagcctggaggctcgatgttgggccaatcgcctctgcaaccaagcctgatgtagaggctcttcttccctgccagcttcttgtctgctaaggttagctgcttgagggcgacgaggcagccctgcgcaacagctcgcgtgtactctgggtcccacccgccaagcttcaccaccacgtccgccttggcgtaagaaacgcttccactgctcacgcttcttcgggcttcttctcttgcagtagcttcgtcacttgcatcagataccgatagccataccgtgaacccagaatgaaggtactgccatctgtcgaatctgctggctgctccttgcttgccccccagagttgcaactacggtgcggacatggctgctaaggctttccaagacaacagattcggcttcagctaccgagtccgctccttcggaagccacccatgtatcaatcgacttttgagtggcgctctctaacagctcacttgtgcaaaccggaaggtacccaatgccctcg

SEQ ID NO: 8371 - DNA, 559 bp, Sorghum bicolor
  Clone ID: SORBI-28MAY03-CLUS35990_1
gcacgaggccactgtcgcccgcggcctccccacacgccagagccaaaacctccacgcgcgcgcgagcgccgaggagtggtccttcccgatctgcgagatgtggcgcggctgcgtgtcgcggggcctccggaaggtcaaggccgccgcctcggcctccaggctcttctctacgagctcgtcctacacggtggtggatcacacctatgatgctgttgtcgtgggagccggaggtgcggggctcacggcagcgattggcctctcggagcatgggttcaacactgcctgcatcaccaagctcttccccacacgatcacatacagtggctgctcagggaggcataaatgctgctcttggcaacatgagtgaagatgactggagatggcatatgtatgatacagtcaaaggaagtgactggttgggcgaccaagattctattcagtatatgtgcagagaggcaccaaaagctgttatagaacttgagaactatggcttaccattttccagaaccgaagatggaaaaatttatcaacgcgcctttggtggacaaagcttagatttt

SEQ ID NO: 8372 - DNA, 939 bp, Sorghum bicolor
  Clone ID: SORBI-28MAY03-CLUS3611_1
cgtccggttaaatacagagatctcgaggagaagatggaaaggtatgagatggagaggagttcaatgcttgtggatgaggacccagacaccaaggtaaaggagaaagagatagcggctgcagcagagaagctggcagagtgccaggagactatattgattcttggccgtcagctgcaagctatgcgttctccagccgaatcactaggctcttcacctaatcggcaacgcatggaggagtttctgcaggacgctgtaggaacaaccgcaggagaatattcccagaagccttcaggccaacctgatacagaccaggagatacttgggacaggaaatgtgtctccagtcaatggatacaagacacacatgatcccttctgatgcggacgggagccctttcctttctcctaacagctccaagcgcccgaagcatcgatcgagatcctcttcgtcttcctcattcaccaatcacccgttgccagacaaacagagccgaggattcagccggttcttcgcgaagaccaaagagtgaaaacttctccggacagcagtatcaggtttgttaattattggcgccaattgggcgggatggtggagggcatgaatttctgtagagctagtgaggcaagcctgcttgtgcgttctctcaggtcaggtgatgcctttgggttgctggaataatactcagcttgcagtcgagcgggttgtggcgagagtgtgtggggggaatgtaagttgtcagtctcttctgctagagcttttctgggttgctgtgtgtttgaaacctcactaaaacctcactgtacatgtgcttacttgcttgaaggagcatggctgttggtttgtgtttaatcctcctgtgaattaacctgtgtgtattgtccttgtactggtttcatgtacagttaacctgcgctaatttcaagggtattgatgtacgttt

SEQ ID NO: 8373 - DNA, 1333 bp, Sorghum bicolor
  Clone ID: SORBI-28MAY03-CLUS36170_1
gcacgaggaaaacatgaagattttggctaaagatgagtatgagcgcaatttcatttcagcagttgtacctcccaatgagattggtgttaagtttgatgatatcggtgctcttgaggatgtcaagaagacactggatgaacttgttactcttccaatgaggaggccagaacttttttcacatgggaacttgttaaggccctgcaaaggtatattgctttttggtcctcctggaacaggaaaaacacttttggcaaaggcacttgctacagaagctggagcaaattttataagcataactggttctactctcacatcaaagtggtttggagatgctgagaagctcaccaagtcccttttctcttttgctagtcgactggctcctgttataatatttgtggatgaggttgacagcttacttggtgcaaggcgcggggcatttgagcacgaagcaacgagaaggatgagaaatgaatttatggcagcttgggatggcctaaggtctaaagagaaccaaaggatccttgttcttggtgcaaccaaccgtccatttgatctggatgatgcagtaatacgacgtttacctaggaggatattagttgacctgccggatgcacagaatcggatgaaaattctaagaattttacttgccaaagaaaacctagagtctgagtttagatttgatgatcttgctaatgcaactgagggttactccgggagtgatttgaagaatctatgcatagctgcagcatataggccagttcatgaacttctagaccaagaaaataaggaagatatgggtagcacgaaaacttcattaagagcacttaaattggatgactttgtgcaagcaaaagccaaggtaagcccatctgttgcttttgacgcgtcaagcatgaacgaactaagaaagtggaatgagcagtatggggaaggtggcagcaggagcaaatcaccattcgggttcgggagctaaatagtccagtagcaagtttcccgcatagagtcgcacgaatgagcgttttagttgtcggaaacaagcagtagttgcttgatgttcttggcagtaactctgcactgcccgttccttatcttgttcagtctgtccactcctttagccccccctttttacccagagcctactagaacagtgatgatgtcgatagcaaaatggcatatcagatgccatggtttcatatatacctcatgttgtagtgtcacggtctcccaaccagaaggtgaccagaactgtaaatagccccccgaattttttgctcaagagccaacagttttggttatttgcattaaatttcataccattttgatttttaacccc

SEQ ID NO: 8374 - DNA, 892 bp, Sorghum bicolor
  Clone ID: SORBI-28MAY03-CLUS36202_1
gcacgaggcagcgagaactgaccatgggagaagcgtgcagggacgcggcggctgcgggccggcaggacgaagcgggcggcggcggaggtcgtcatcacgcggagaatgaggtcgtcggcgacctggccgcctcagcgaagctgtacgaggacgtgccggcgtttccgatgatggcgctcaaccacatctcccgcctgtgcgagtccgtcgacgcttccgtccggttctacgtcaaggcgctcggcttcgtgctcatccaccgcccgccggcgctcgacttctccggcgcatggctcttcaactacggcgtggggatccacctcgtgcagcgcgacgacgcgcggagggcccccgacgtgaggccggagacggagctggaccccatggacaaccacgtgtcgttccagtgcgaggacatgggggcaatggagcggaggctccaggagttgcacatccggtacatgaaacggaccatcaacgaggaggaagggtcgcccatcgaccagctcttcttcagggaccccgacggcttcatgatcgagatctgcaactgcgagaacctcgagctcgtccccgccggcgcgctcggccgcctcaggctgccccgcgaccgccacaacccgcctgtgcgcaccggcaccggcggcgccgagtaggctaggaggcgtgcgcgcgtgttcgtgacccaccggggccagcagctcaaccaagtttgagtcgccgtaggcccgtagcgggggcttatgctgggttttggctcttgtttcgcgccgagagttcaagttttgaattcgaatttgtactagtttggctttgatttagttatcaggagactagtaactaggagcgatcgaagcagttttggtatgtgcgtttggcttcaaattcttgc

SEQ ID NO: 8375 - DNA, 641 bp, Sorghum bicolor
  Clone ID: SORBI-28MAY03-CLUS36242_1
gacaagcattgatgcactagcagtttgcattggaaatgttcatggaaaatatccacctagtggaccaaacctcagatttgacttgctaaaggatcttcgtgcattgaccttaaagaaaggagttagcttggttctccatggagcatctggtctacctcatgagctcgtaaaggagtgcatagacttgggcgtgagaaaattcaatgtgaacaccgaggttcggaacagctacctggagtcccttagaaagccagaaaaggacctgattcaggtcatggcgtctgctaaagaagcaatgaaagctgtggtagcagagaagctgcgcctctttggatcttctgggaaagcctgagcgaagtacttgcgccggcaacatgcggtaccggggggtggggggcatggttgcatcctcggattcgtgatgatgatgctactctgcagttgcttacaggtacagctcattgcggtatacataatccggagggctcattacaaattgttggctgaacagctgaagtgcttattgtattttgcaatgtggcgcaactaaggctaattcgtaaatcgtaataatgtatgctaccccgatgtaaaatgctccatcgttaataaatgtccccgtgttcgcggtgcctttgttt

SEQ ID NO: 8376 - DNA, 1161 bp, Sorghum bicolor
  Clone ID: SORBI-28MAY03-CLUS36317_1
gcacgagggatctttttatgtatcttcctcgcaaaagaaaacattttcctgtatttacttgcttatacaatgaagttatgtgtatttcatgtcacttttttcattgtgctattctgattttaccaagtgtagcgattttgttattttttctgcaagtttgccagtgcgccgatcgactaattgtagtttgcatagtctggtataacatacttgcattcaactctcagtatataatttgttgcaggggttatttggcaccagagtatgctttgttgggacagttaaccaagaaagcagacatatatagttttggcgtgcttcttcttgaagtaataagtggtgaaagcagcagcaagtcgacttgggggcctgatatgcatgttcttgtggaatggacatggaagctgcgggaagaaggaagactcttggaaattgttgatccagagctggaaaactacccagaggagcaaatgcttcgtttcatcaaggtggcactgttgtgcacacaagccacgtcccagcagaggccatccatgaagcaggttgtcaatatgctatctaaccaatcagaaattgatctgcaaaatgtagttccaccaggtgtgctgaaagaacctcggccgcgtaccggtggctttgggggtttgacagcagacacgtcctcaagtcaaagcaccaaaggcaatccagctgaatcatacagtacacagaccaacatgaacagctgtcaatttagcacaactgacgtatcaccaaggtgacgtgatagactatcacctgcaaagcttgtttgacgtctgcagaggtgttccacacctcccacaaggtttactgtgctgagccctgacatattctcttcatatggaaaggcctgatccattttcatcctgttttagagctacataggatgcgaaggccgctgtgaattgctgatgtacaggaattgtagctcgtcttttttttttgtgcaaaggaggggaattgtagctcgtcctttttttttggtacaaaggaggaattgtagttcaatttgactgttgcttttatgttctttattaaagcctgttgtagggacacattgcaagagtacaagactagtgtattcgaaaattcaaaaattgtgctcggagtatgagcaagaaagctgtgaagaaacagata

SEQ ID NO: 8377 - DNA, 766 bp, Sorghum bicolor
  Clone ID: SORBI-28MAY03-CLUS37238_1
ctacaaaggtgacctgacccctgcgcaagcactggacaaggtcaccacgcaggactacgtgctgatcgacgtgcggagcgacaaggacaaggccaaggcaggcgtgccgcagctgccatcgaacgccaagaaccagctcgtctctgtgccgctggaagaccttccgagcaagctcaagggcatggtgcgcaacgccaagaaagccgaggcggagatcgccgctctgaagatctcctacctcaagaagatcggcaagggctccaacgtcatcatcatggactcctacaacgacgtctccaagactgtggcgaagacgctgaacagcgtagggttcaagaactgctgggtcatggccggcggcttctcgggtcggaaagggtgggcgcagagccgccttgggacggactcgtacaacctgtccgtggtggaagtcgtgacgccgtcgcgggtgatcccggcagtcgcaggccgcactgggacgacctctgcacgcatagcgtcccgagcaactactcgcaagcttcttcccggcagcgtagactgatgagtggggctgaaacaacttcaaagtgtaaatctcaattttcgttttattttgagatgcaacttttgttctgtgcgttcccttgtctttctacagtatttattacgggccttacccttcttagacgaaaatgcagaaatgcaccagcgtgactaaactgcagcttcagtgtcacccctctatcagcgttagtacaacttgtacacaaatcaacgtaatagc

SEQ ID NO: 8378 - DNA, 912 bp, Sorghum bicolor
  Clone ID: SORBI-28MAY03-CLUS37296_1
cttctaccagttccttgtaatttggtacctacagacagaggggaagtggctcgtggctctcttgggcgttctcgcccttctggtccggttctctccgatcttcacctgcttcgttgccggccaggtgttcaatgagatgagctcgagagagatggagaggataaatgtgtttgaaggcattctaaacaacaatgtgttcattgctgtcctcggcagtactgtcatcttccagttcatcataatacagttccttggcgatttcgcaaacactactcctcttacgctcaaccagtggatagcatgtatttgtatcggtttcataggcatgcctatcgccgctattgtgaagatgataccggttggatcttcgtaggaaactagagctaatttcagccgaaaaccgaagttgggcatagctacagtctgatcatggcaatgaagttttgtgtgttgccatttgtgtacaagatagatctctgctgcctgataatgcttctgtctgtgaatctttcccctttttatcctgtagtgtttgatcttagagcatcatccgagtgtcagccaaggttgtgggcttgatccttagaaaaggcctcggactgctgtagctgttctttgctttattttttttacccctggtgcttttccttggaacattggaggctggatctgtatatggcaaccttgttgttcacccgaatgtgcttgttttgacacctacgtatcattttcatcatctgctaagttatgtttcagtcagaagttccagaaatgagtggggtttaaatgtttctgatttgccaagaaaacgtccccccactagcttccaagatctgataaggccatcattatgcaggagtcttgtgaatcttctgcttctttatgctcgtataaatgccagcaggattcctg

SEQ ID NO: 8379 - DNA, 708 bp, Sorghum bicolor
  Clone ID: SORBI-28MAY03-CLUS37388_1
ccttttggagatcattacaggacaaagggctattgacaacacccgggctggaggggagcaaaatcttgttgcatgggcccggccattgttcaaagacaggaggaaatttcccctgatggcagaccctgcactagaggggcagtatcctccaaggggattgtaccaggcccttgctgtcgctgcaatgtgcgtccaagagcaaccgagcatgagaccgctgatcggggatgtggttacagccctcacctaccttgcctcccagacctacgatccggaagcacatgccaattcacacttggtagctccagggacaccaccacggactaggaccaggattcgaagccatggtgctgcagatcagaggggaagtggctaaccaaggcgatggatggtttggggaagcccagaattttggtaagcatctaatctaagatgtgcaagagctggggtgcctgtggagatgaagagagaattttgtctcattttgttggaacggagggcatcgatggtctgttcaaaacctttggtttagcaccagtttgagatgatgtatcttaagatgttgggaatgccattgccaagtgtttaccctggtggattccattgatgaaggtaccaagtgatgtacatatatcgttccagagtgtatgccatttccatctgcggaacaaacaacacaatggaatttatataagtatattttctctt

SEQ ID NO: 8380 - DNA, 848 bp, Sorghum bicolor
  Clone ID: SORBI-28MAY03-CLUS37199_1
taaaataaaattgggcattcatagcaaaatcctggatgacttttgtttggtagggtcaaattttgtgttatgatcagcattttgctatctcctgaaggcatcagcagatgtgatttggcatgctactgttttcaccaaaatctgttcacactatttctaggacttctatgacttgattgatggttcatattatttagccttcactaaatagcttggtgtaaccaatgtctgacatccacttgatcccattctattctccatttatgtgcaaattcgacctggcttcaaagctgtggcgagaagggagttgaatgatccagagaatgcacttattggtgcttttgctggtgccatcactggagctataacaactccccttgatgtcatgaagacaagactgatggttcagggacaagggaaccaatacactggaattgtaaactgtgctcagacaatcctcagggaggaaggccctaaggcattcttgaagggcattgagccgcgagtgctgtggattggcatcggcgggtccatcttctttggtgtgctggagaaaaccaagtcgatgctagccgagaggaggaaccgcgagctacgggccgtcaaggacgaatgagtgaagatcatttttttaacgttgatctcctatcatgtgatactagataaacataatacaccggggccttctcgtcctccggggcgtgctcgtcagcacgcacacgtcgacctgcccctagtgcccccgcctacaaaggattttaagacagattaagaaagaatacaagagaagcaatgtaccaactgaacacatcaaggctgctagttctggtgatagtgatcgagaacct

SEQ ID NO: 8381 - DNA, 532 bp, Sorghum bicolor
  Clone ID: SORBI-28MAY03-CLUS3735_1
attcgagaacacgaagaaatacgacgacaaaggagaagccgagcagcgacactgcatacggactttagacatggagggccagttccaggatggcaaggaggaagtcatccaagcatggtacatggatgacagtgaagaggaccagaggcttcctcatcatcgcgagcccaaagaattcattcctctcgacaaactttcagagctaggaatattaagctggcgcctaaatgctgatgattgggagaatgatgagaagctcaagaaaattcgtgaagccaggggttactcttacatggacatttgtgatgtgtgcccagagaagttgccaaattacgaggctacgataaagaatttctttgaagaacactatcgtactgatgaagagatacgatattggcttgtgggtaggggctactttgatgtgagggacgaaaatgatcaatggatccgggtagcagtgaagaaagggggcatgattggtttggctgcaggaatgtatcaccggtttacattggataccgacaactacatt

SEQ ID NO: 8382 - DNA, 401 bp, Sorghum bicolor
  Clone ID: LIB3476-040-P1-K1-F10
cggccgccctttttttttttttattctaccttgagtggcaaggccaatacctattcaaagtttgaaactagtgcgataggcatctttcttatgcaggacatttgtgatgtgtgcccagagaagttgccaaattacgaggctaagataaagaatttctttgaagaacacttgcgtactgatgaagagatacgatattgtcttgagggtagtggctactttgatgtgagggacgaaaatgatcagtggatccgtgtagcagtgaagaaagggggcatgattgttttgcctgcaggaatgtatcaccgctttacattggataccgacaactacatcaaggcaatgcggctctttgtgggcgagcctgtgtggacgccatacaatcgtccccatgaccatcttcc

SEQ ID NO: 8383 - DNA, 658 bp, Sorghum bicolor
  Clone ID: SORBI-28MAY03-CLUS37395_1
actggtgctgatatttatgcgctgtgtgcggatgcatggtttcacgcagcaaagcgatcagttaagacatttgaaattgatccttcaagaagtaatgatgccagtgctgaggaagtcattgtcgagatcgatgattttattacagtgttaggagacatcgcaccatcactatctctggaggagctacaaaactacgaacagttgaggcagaagattgaaggaccttctagatgatgttggctaataaatatttctacctggtgactttgtgctaccagacccctctcagttgacattcttaaactgctaacatctccaaacattcccaatcttaaagtttcatttttacaagttccatcctgaacttgggcacttctctattcattccggatttatccaaccacatcctggtatggtagcatagcagcatctgctagttgagtagttcagctaatctgtatatgtacatcagacgggaattttctcttaagagagagatcctgtcattctttgtaagctccgcaactattttgaattcaacgacacagaagacttctttgcaaattatgtaaatcaactttgtatagttagtttttgtcgtggtaccatgttgtaataaaggctaaagagaataagagtaaatgcaacatcttttttc

SEQ ID NO: 8384 - DNA, 810 bp, Sorghum bicolor
  Clone ID: SORBI-28MAY03-CLUS43907_1
gcacgaggtgccggtggcggagggggtggagacttcttgtcccggctgttctccgtcggcgcggcgcacgcggatgacaagtcgtcgggggattgggacgcgcacgggctccccgtcaacatgacggtgccgctcacgaagctgagccgcctgcagaggtacaagctgtctgagctcaagttcttcgaccgtgcagctgccggcggtggtgcctacacggggccggaggattccttcttcgaaatggtgacattgcagcctggtggtgtgtacaccaagtcgcagctgctgaaggagctcgagacactcgtctcctgtggcatgtttgagcgggttgatctggaggtgaagcccaagccggataacacaattgggctcacagtctccttcgtggagagtgtgtggagtgccgcaaagcagttcaagtgcatcaatgtggggctcatgtcacagtcaggacaggttgacttcgaccaggacatgacagagagggagaaaatggattacctccgcaagcaggaacgtgattaccagcagcgtgtacggggtgctaagccctgcatcttaccagaaaatgtacgtggagaggtgctgggaatgatgaagaagcaggagaaggtgagcgccaggatgctgcagaagatcagggaccatgtccagaaatggtaccacaacgagggtttcgtatgcgctcaggtggttaactttggaaaccttaacaccaatgaggttgtgtgtgaggtggtcgagggtgacatcaccaaggtggagtaccagttccaggataagcttggaaatattgttgaggga

SEQ ID NO: 8385 - DNA, 1215 bp, Sorghum bicolor
  Clone ID: SORBI-28MAY03-CLUS44080_1
gctcgcgcccgctcgcctggcccctccccgagttcacgccctgcccctgccgcccgcgcccgccgtcacctcctcgctagcgcgcgtccgccggctccctgccgactgcagcccccgcgccccgccagcccgtcgcccaggtgcttgcccgcgcctcccagccagcaagtcgcccacgcgcggccccgcgccttgctcgccgcaacgcccccgcaggcgtccccgcgcccgcttctcttcggtccccgccgccgcagcggtcgcgctggcccgctcctctcctccctcgtcgacgcccgcgccgccacgctctttggcgtcctgttgacacgccatcccgcggcggccagcaacttgacgacgtcagaaccctcgccgcgcgaggtcgtctgtcgagttgctggtcgcaaagccaagctctataagaaaaggttcaagacccgcgagacacgaacgtcccgctcgttgcagggcgcgagacggaaatttccgctcggcccgtccgtggtgggcgggcggcccgggtgggatagttcctcccctcgcagtgctcgtgtcatgcccgcccgccttcggtcttgctatctacgatcatgagaaggccagcaacttgatgacatcagaacccaagcaataaaaaggggtttgccaggaggccgtttgtcaagttgttgatgatgaagccaagcaataaaaagggacgcgtgagacggcgagtgccgctcgtttccaccgcggcggcgacgtctgttcggccttctcttttgtcatgacggcggcggccggctcgactgcgctgtgtgtatgccgatagccgggtgttcctttcgcccacttgcgcgtgccggcctcctactcgtcgatccctcaccgcgccaggttggctttctgggtcttgccggctaggtcctcctcgagatgcatgcacttatttatgatgaaatacaagacacacgagacggaaatttctgctcgtggcgatgatgaaaggcaagacgtacgagatggaaaatccactcgtcgcaggacgcaagacgggaaaccccccgcttgtcgaattgatgttgagaagctgccgattcaatcacgtgagtaactattgttggggcatattatgtcatgatgagagctgctgcaattatacatatgttggagatatattcgcacatgtacatgtcgccgtcctattctttgatcggaaaagatgccatatct

SEQ ID NO: 8386 - DNA, 812 bp, Sorghum bicolor
  Clone ID: SORBI-28MAY03-CLUS44084_1
acctggagcttgactattgaaaactattggttagctatttttgtgtttctattcccgactacaagtcacaggtttttatgcaaaactggatgctatttaaccattaaatttcacgcttctttcattcttctctaactccttgtcctctccgttgcgggtgggttccctatgatttagccaagcctctactggataccagtcaatattccattctatctgattatgctacaatgcaaggtgaagtgccccagcctcagatttgtggtccctctgatgactcttcagcaaaaattgaccaccacgactcaaccagcgatgaggacgatgatgaagatttcaacgactatgaatcagatatgatggttgatgaagagacaattcattcagaaaagccagatacaactgaaggcagttccaacataaatgacataaaaaacatcaccctggacctgaatggctcgcgggttaaatttaagggccttcagcaagtgtttgggccaatcgagaggcgacacctcactgcgctagaagggcaactgagcagatacgtcaaggttgttgggaaggagctatccgatcgaattgtgtattgcctttcttgatatgcagccagccagccgggtcaattctactatgaaagtgcacatgagagcaaaacttgtttcattcagaaagaaaggtcatagctctgttatactgctgcatgtctatgcttgtttttttgttgtagaagatacgagagcccgctgtcgaggctgacatagaacatttgtctggtcgattgtgtatgcgtattggcactgaattatcaa

SEQ ID NO: 8387 - DNA, 937 bp, Sorghum bicolor
  Clone ID: SORBI-28MAY03-CLUS44103_1
caaggttgtcataccccgaagtccacgtgaagctaagggggttgctgttggctagcattcgagatccaaatccagttgtattttttgagccaaagtggttgtatcgtttggctgttgaagaagttcctgaggaggattatatgctgcccttatctgaggcagaagtgattaggaaaggaagtgatataacactcattggatggggagctcaacttgcagtactgaaagaagcttgtgaagatgctgcaaaggatggggtatcttgtgagctcattgatctaaaaacacttataccatgggacaaggaaacagtagaggcctcggtcaagaagactggaaagcttctcgttagccatgaggctccaatcaccgggggctttggtgcagagattgctgcatccatcaccgagcgctgcttccagaggttagaagcacctgtggcgagagtctgcggcctcgacactcctttccctctcgtttacgaaccattttacatgcccaccaagaacaaggtcctggatgctataaaatcaactgtaaattactgaactgctggacctgccgtacatgttccttgatcaatacagagtagttacacgacctatagatagatgtgcactgtttgcactgctggtatgtaacctgagaatgaatatccacgaaccagcttatttattcagcttatttattcaataatacagcgataaataaagttgcaaggtgcaaattgggggataatacatacatatatcgaagtgtctcccagcgaaattcctatgtagctgtcgctttgatcaagggcatcttccatcggaggtgaaaagcttgatgccaccacgcgcacgcgcacttgaggacaggacagcacagcacgaggctcacgaagtcacgagacgtcgcggtccccatcgttgccccggcgtgctctggacgcaat

SEQ ID NO: 8388 - DNA, 991 bp, Sorghum bicolor
  Clone ID: SORBI-28MAY03-CLUS44117_1
cgaaagccgatgctcgggggctacggcaaattattgtcacagacgaaaccggccggccggataagtttccggacgcagatcgagatagctgacagccagcgcgcggcgacgacgtcgtccatgtcggtgggcagcaagtcgctgccggcgcggcggcgcggcaacgagggacatgagaacggcgacggcgccgcggtgagggaggaggagggcgacatggccacgggcggcggcggtagcaggagcaggaagcagaaggcgaagcggtacgaccgctggttctcggggctggagctcagcatcgggccgggctcgttgaaggacgtggacgccgggaagctcaagggccagatcaagaagtgggcgaaggccgtcgtcgcctttgcgcgccagatcagcttcggctcgccgaggtccgcgcgcacgcccggcggcggcggcggcggcgacgacgacgacacgccgcgatcagccccgtcgtcgttgcgggcgtccaggtcctccagccgcctcggtgcccgtggtggtgccaaagaaggagccttcgacgtgagagcttgatgcgtggacaatttcttggcctgcgacctgtacaggactacaagtatgaatctacagtagcattagagtcttctttcttttttctttttcttcacagacaaaaacaatttgtttcgttcttgcctagatgcgcagactacaactgcacgctactatgtacagcatgagggtttgatttattctttcttttcccttttttttcgaaaataaaaaaaatcactcttctctagatgcaagactatatagactcaaggctacctcattgtacaacaagaatttgatctatcttttttctttcaattttcataaaaaataataatttcattcatttcttgcctagatgccacgcttttctgtttcttgatgttgttgttgtttgatatatgtcaaatgtatcggttgtactattcatccatttgtggatacacac

SEQ ID NO: 8389 - DNA, 496 bp, Sorghum bicolor
  Clone ID: SORBI-28MAY03-CLUS3775_1
gcacgaggcgcagctgggcgccatgatcgtcgcgtggtacctgctcaacatctacttcaacatctacaaagcaggtgctcggcgcgctgccgttgccgttgccgtacaccatcaccgccttccagctcgcgttcggctccctgctcatcttcctcatgtgggccaccaggctccacccggtgcccaggctctccgctgcgcagctgggcaagatcgcgccgctggccgtggggcacatgctgggcacggtgttcaccaacatgagcctgggcaaggtcgccgtctccttcacgcacaccatcaaggcctccgagcctttcttcaccgtcgtcctctccgccctcttcctcggcgaggtcccttccctgccggtgctgggctcgctcgtgccgatcgttggcggcgtcgccttggctttattcaccgaagtttctttcaactggaccgggttttggagcgccatggcgtccaatctgaccaaccaatcgaggaacgt

SEQ ID NO: 8390 - DNA, 751 bp, Sorghum bicolor
  Clone ID: SORBI-28MAY03-CLUS37837_1
actaggatacgtttatacttggggcagaggatactgcggagccttgggtcatggtgatgagaatgataaaactagcccagaattgatcagcagcttgaagggccaagttgctgtacaggtatgtgcaaggaagagaaagacatttgttctcacggatgagggctcagttgttgcgtttggatggatgggctttgggagtttagggttccctgaccgaggatcatcggacaaagtaatgaggccccgcgttcttgagagcctgcaggatcactacgtctcccaaataagcaccggactgtatcacactgttgcagtgacaaataagggcattgtattcgggtttggggacaatgagcgagcacagcttgggcaggagtacattcgtgggtgcttaaaacctactgagataatgttccaaaagagtatggaagacataccaattgcggcgcctagtggttaacttcaaggccaagagcccaagaccaccattttggacactattgccggcatatgttgtatttatattgaaattcttcttggcaagtgtattttatactttgtgatttgtgagtaatttgggtgaacgggggaagatggaagagcaaaggttggaggacagtgttgtgtagccaaagaagcctatagtttagtaacgtgtgatgtatcgaataattcaacccaccatttttcttctgtataaaatttattggtgtgttggtatttttttcttgccacttcatttttcttggtt

SEQ ID NO: 8391 - DNA, 903 bp, Sorghum bicolor
  Clone ID: SORBI-28MAY03-CLUS37775_1
attgatggaccaccagtgatcagaacatctgtcattaactccacatacaagaactttttggaaattgtatttcagaacaatgacacaactgtccagacctaccatatcgatggatatgcattctgggttgtagggatggactatggtgagtggactgagaatatccgtgggacttacaacaagtgggatggtgtttctcgttgcacgactcaggtgtttccgggagcatggaccgctgtgatgctgccacttgacagcccagggttttggaatgtacggacagaaaacctggacacatggtatctgggtcaggagacttacatcagggtggtggatccgaatggaggctataatgttactgagatggtggctccagacaacatgctctactgtggcctcctcaaggacaaacagaaggctcagaagcctcatggttcaaggtcatcagcctctgcagcaaaactgaactaccatgtgctcgcgtttttggtctctttggtagccttggcgttgggcctttgacaagaactgccagtttgtggggtcagctgctgtttgcagattaattaggcgtttgacagaaatactgttgagtaagtcagtcgaattcgtaggggttccattcatgatttgtctggcgattgaaatactgccgttgcacatctttgtcgatcagaactgattagcatgctgaagaactgtgcagtagctcgatccgcatatttgaggctgtcggcagctggcacccgcaaagcaaggagtgctgtgctgcctgagatggtccatgtgtgtgagtgtgtttttcttgatcagtcaatctgtggagagttgcaattagtctgttacagtaagtgctatccaattaatctgtgaattgcgggacaattgaaggtattactgtgc

SEQ ID NO: 8392 - DNA, 1012 bp, Sorghum bicolor
  Clone ID: SORBI-28MAY03-CLUS379_1
ctcgcaaccctcgacctctgccgcagttcagctcccctccgccctactccaactactggaatcgcagatccatctggttctgatcgattccttcacctgctggtgaggaggcctggcttgcttggattgatttttctgccccgatttgcagcggcgagcggagatgaactgcgagacctgtcagctgaaggagctggagctggaaccgacggagatcagggatgtgctgcgatgcattttgcacaccatattcttccatagaaccctcagcctggttcgccccaaagatgttgactgtgatttccttgagatcacttatgtacaatgtggtctaccggaactagaaaaggaagttgatgaaaagatagaccagttcactgcttgggtggagaaacacccaaatcgcagaagccagatatgcctctccttcttcgacgagaaacacagacacccaggttggtttgtcaacaaaacagagcgcatttattgggagcaatggttcatcaatttgcatatcatgagccccaaaagatacagcaagtcaaacagctccaaagggctgacaaacattggagcaaatgccctggaggagaccagcacaaggcgtgctgcattggagtcgtcgattaacgaagtgctattccagatcataaacttcgccaatgagaaaaaggaccacattcctgccatccctgacagaattttcaatcacgagatcatgatcccaagctcggattctgtatttggatggaacaccgatgtcattcgcagggtgctgaatagcgggcacccgtactcactttagctgaagacgacagcacgctattctgtgtacataagggtgtaccctgctaatctggcttagggaaaacctagttctttatacataatgacataatgttgtacgctgcttatctgggttgaaatacataatgacataatgatgtaccttgctcatcagtcaaacgctcttaagtttgataaagtttaaaaaaaaaaaaaaaaggcccct

SEQ ID NO: 8393 - DNA, 624 bp, Sorghum bicolor
  Clone ID: SORBI-28MAY03-CLUS37908_1
gtaccagactattccactcaacaagatagaagattttggagtccattgcaaatcgtactatgctttggatataacttatttcaagtcatccctggactctcacctccttgatctgctctggaacaaatactgggtcaacacactatcttcatcaccacttctaggcaacagggattatgttgctgggcagatctttgatttagctgataaactagagcaagctgaaggccagctggcacacagtcgatttggtggtatgattatgccatcacaacgaaagaaagagcaagaggagtctccactggctaaggtaacacgagatagctccaaaatcacagctgagcaggttcatggtctcatgtcacaggtcataaaagacatcctcttcaactctgtccacccctcaatcaaggcaagcacaagtgctccagattcatcaagtgctccggattcatcaagtgctccagattcatccggtcctgagcctatggttgaagcctaagagttccagcgaaaggcaacattgaatatttgtgttatgccatcactaagatagttgcaatcatagctatctgattcagaacgtgcaagacaagttaaattatgtgaaaagaatcattatgt

SEQ ID NO: 8394 - DNA, 796 bp, Sorghum bicolor
  Clone ID: SORBI-28MAY03-CLUS37953_1
cttcgcaagcagaatggtgaccgtgcaatctgggagtatccatttgctgtagctggtgtaaatataaccttcccgctcatgcgggcgctcggtcgcctcgcggtttatccctggccattgttgggtccaggtttcctcttccgtcgttcagaaaacgatcgagcttttgacattctctactgcataaccttcaagctgatggaccagcaatggcttgacatgcatgctacttacatggactttaacacggtcatgaagtctacacggcgtcagctagaaagggagctgttgattgaagatattcagaggattgaggacatgccatcatacaggcttctgggccggtagctagaagaaactgaaatcttaacatggctacatgttgcaaggcttgagatgctaatggattgcaacttgtgtccacagccggtgacagtcttgaaatgtagatgcatatgtatccttgtgtgttaggtacttgtggtctctggtaatctgatctctgaaatttacaaggtagggtttttcctggtgatagaatgccacgtagggtgactgaagtgtctgatcagctgccatggcaaaagtttgtagggtgtgttattacaatctggtcgttgtccatcataccacgaaaagaagtgttcctagggttgtcgttgtaaacaggaggatttgggaaagatgatctgagttgtctcccatatataagaggctagttctttaagtgcgcactgcgcagcaactatatgtcgttcattggtttttctaagatctgtttgccctggttcgtgcc

SEQ ID NO: 8395 - DNA, 454 bp, Sorghum bicolor
  Clone ID: SORBI-28MAY03-CLUS37063_1
gcacgaggagagcgcgaggggcacacccaaatctctacgacgctagatcagagctactaagagctaatccaatcagcggtgatctctagctagctacttagcttttggcaagtgattttaatttagtgaaaacgctaggtagcttgacaatgagccagaggcagccgaggaggccgtccggccaccaggagacgacgagcggagagcagggcgccgtccgctacggcgacgtgttcccggcggtggccgggggcctcgcggagaagcccgtggcgccgcaggacgcggccacgatgcagtcggcggagaacctggtgttcggccagacgctcaggggagggccggcggcggccatgcagtccgcggccaccgccaacgagcgcatgggcgccgtcgggcacgaccaggccacggacgccaccgccgtgcagggcgtcaccgtctccgagacccg

SEQ ID NO: 8396 - DNA, 1068 bp, Sorghum bicolor
  Clone ID: SORBI-28MAY03-CLUS37077_1
agcttcccctctctcgcccgcttcctccctccccctccccttcccttcccttcccttcaccactcccacttcccaaccctggatccaaatcccaagctatcccagaaccgaaaccgaggcgcgcaagcaattattcgctggctagctaggcctgtagctccgagatcatgaagcgcgagtaccaagacgccggcgggagcggcggcgacatgggctcctccaaggacaagatgatggtggcggcggcgggggcaggggagcaggaggaggagctggacgagatgctggcctcgctcggctacaaggtgcgttcgtcggatatggcggacgtcgcacagaagctggagcagctcgagatggccatgcgcgtgggcggcgttggcggcgccggcgctaccgctgatgacggcttcatctcgcacctcgccacggacaccgtgcactacaatccctccgacctgtcgtcctggctcgagagcatgctgtccgagctcaacgcgcccccaccgccgctcccgcccgcgacgacgccgccggccccgaggctcgcgtccacctcgtccaccgtcacaagtggcgccgccgccggtgctggctacttcgatctcccgcccgccgtcgactcgtccagcagcacctacgccctgaagccgatcccctcgccggtggcggtggcgtcggccgacccgtcctccacggactccacgcgggagcccaagcggatgcggactggcggcggcagcacgtcgtcttcgtcttcctcgtcgtcatccatggatggcggccgcactaggagctccgtggtcgaggctgccccgcccgcgacgcaggcgcccgcggcggccaacgggcccgccgtgccggtggtggtgatggacacgcaggaggctgggatccggctcgtgcacgcgctgctggcgtgcgcggaggccgtgcagcaggagaacttctctgcggcggacgcgctggtcaagcagatccccatgctggcctcgtcgcagggcggtgccatgcgcaaggtcgccgcctacttcggcgaggcgcttgcccgccgcgtgtatcgcttcc

SEQ ID NO: 8397 - DNA, 598 bp, Sorghum bicolor
  Clone ID: SORBI-28MAY03-CLUS3700_1
gcgcgttttcagtcggcagcccgtgactacagcaccttcagaccacttggtccataagctcctcagcgccctaataaaggaccagaggtggatccgtgctgtgcttcatatcgccgggcctgcatgcaccatctcgactgtgacgaacgtggcatacaagtatcaattcaaacagtatgcgtggacgcacatgatacttttaacggtttttgcacagtccgctttcactgtggcaaacatatttgaagggatattctggtttcttttgcctgcttcacttattgtgatcaacgatgtctttgcttatttattcgggttctttcttgggagaacaccactaatcaagttgtccccaaagaaaacctgggaaggttttattggtgcatcagtgacaactatcatctctgcttttctgttagcaaatgtgatgggtcgttcccaatggttgacatgcccaagaaaggatctgtcaactgggtggctttattgtgaccctggtccaatgtttaagtcagagcattacttgttggaagaatgggtgccaacatggttcccatggaaagaactagccattaatgcctgtgcagtggcatgcttt

SEQ ID NO: 8398 - DNA, 392 bp, Sorghum bicolor
  Clone ID: LIB3478-046-P1-K1-D3
cttcagatcacttgctttataaggtcgtcagtggcctaataaagtatcagatgtttatttgttattttctttatattgctgggtttgtatggtgtattttgactctgaagaaaaaggcatacaagtatcaattcaaacagtatgcgtggacgcacatgatacttttaacggtttttgcacagtccgctttcactgtggcaaacatatttgaagggatattctggtttcttttgcctgcttcacttattgtgatcaacgatgtctttgcttttattcgggttctttcttgggagaacaccactaatcaagttgtccccaaagaaaacctgggaaggttttattggtgcattagtgacaactatcatctctgctgttctgttaacaaatgcgat

SEQ ID NO: 8399 - DNA, 655 bp, Sorghum bicolor
  Clone ID: SORBI-28MAY03-CLUS37117_1
ctcaaaggaccagaggctccagcagtcatgcaagtaccgcaaatccaaaagggaggagcagaaaaaggaatagttcctactggctacattggagtaccagctaatatccagcaatttgtaggcagtcaagcagcatttcagccaagcattgtctacatggtaccgagtggtgttgacccacatgcttttggaaatgttctgatgccagtgatgtaccagcagatgttccaggtgcctccaaagccaaatgagaccatgcaagatacttcagccaacgaaaaaaggaagcgacctcgtggtcagaagctcacagagacatctcaacaggcaaatggagccccagcatctgcatctggctaggccgctagggggcactgctaacatttagaacaggatttctgtacatacgttgacttcctgccgtgagaaattttacatatggacgccggcactaacaattacctcaatgtgatccaaggtatctggcccaggatggaaatttagtctcacacaattttttttggctgatttcagcaagacaggttgcacctaatttactcggggaatccagtatccacaagttctatttgtaatgtacaaatccccgtgtcttttttgtgatatgtaaatgatttttttttggaacagctgctgt

SEQ ID NO: 8400 - DNA, 628 bp, Sorghum bicolor
  Clone ID: SORBI-28MAY03-CLUS37184_1
gaggaagcaaagaaattgcgaaagagaaagaaagctgaagctcaacgattgcttgacatggagaagagacaaaagcaaagactgcaagaagtccgtgaatcacagagaaagaatgaagaagctatacagcttaaggagcagtatcggggtgtagtcagaaaggaactggaagatttggaaaggagacattgggatatgacttcaatattgcatgcgctaggcatctctgttgaaggtggtgaggttaaagccttcaagcaagctcttctgaaattccatcccgacagggtatcaagaaatgatatttatcaacaagtaaaagcagaggagacatttaagttcatttcgcggctgaaggagaagctacctcggctatcctaatagccatccccaactcagtctctgtttttacacatgccttagtcgcatcctccttttaacctgtagggtcaaggtacagagttgagaggatgtttattggcgttcttagaagtaactagggcttagctctttcgcttgggttcggtttggtaggcattcgtgtacctggatggcgaaacggttgtacatgaccgatggcagaaagaacattcttttttagggccatctttattaatttatcctacaa

SEQ ID NO: 8401 - DNA, 882 bp, Sorghum bicolor
  Clone ID: SORBI-28MAY03-CLUS38125_1
ccaggaggcggtggggccctgccgggctggggcctcccccgcgggccgcggcgcctccccccctcccccggccccctttttccccctcccccttcctccccgccccctccctttcgttccccccgccgcttgccccgcgcaggtctcccccgtggttttcggggcgcggggccgtgcctcccgcgtgccgaccccccccccccgattcgcgtcgattcggtccgagccggggggcgcggctgcccccgccgcccgccgccgctgcgctccccgccgcccgcgcggggagctgcaagaaggtgctcaggttcctgcagtccgtcgagcagtcgtcaggcacggtcgagacctcatcgggcagcatgcaagtagccacaggaagatatcacacacttttggtccatgactcttctgtctattcttgtgggtccagcttgtgtggtgtgctaggtcatggcccagatactacacagtgtgcggcattcagtcgggtttccttcccatcactttctcgtgttataaacatctctgcttcacacaatcatgctgctttcgttacggagtctggggaggttttcacatgtggtgataattcatcattatgctgtggtcatggcgaagtggggagaactatatttcgaccaatgcaagtagaagcacttaaagggattccctgcaaacaggttgctactggtctaagttttactgtgattcttacaagggatggacaagtatatacttgtggaagtaatacacatggccaacttggtcatggtgacaccatagacagggccactccaaagcttattgaattgtttgaaggccccactaaggtggtgcagattgcagccggtgcaagttacacgtttgctgtaacagatg

SEQ ID NO: 8402 - DNA, 800 bp, Sorghum bicolor
  Clone ID: SORBI-28MAY03-CLUS38240_1
gcacgaggcaccagcgtccagtccagcgcggcgcagcgcggcgcccaaccagaacagaacgacgaagcggagccagccagccagccaaccaactaaccaacggacggaagaggcgaggcaaggccgccgcgaagccgtgccaatccggccgcaacccgctttctcctctcctgcctcctcgggatctgcccgccagccttgtgtgatctcgactccccgcgcccgcgattggagctccggctgcacgccgccatgaacccctgcgcgtagaggccgggagggagggagcggggaacgaagttaagctaagtggggggaggccagagcagggtcgctgttacgccggcgagatggacgggagcgccggctccttcgtcgccgtgcgccggctctccggctccgaccgcgccgccgccttccaccactcctcttcggcggaggtcgtgacgggatcaagcgcatggatcgggagggggctctcatgcgtctgcgcgcagaggagggacagcgatgcgcgcctctccttcgatttgacgcctgtgcaggaagaatgcctacagaggttacaaaaccggatagaagttcagtatgacagtgcaaacagagagcatcaggaagcactacaggccctttggtgtgcttcttttcctggcaccgagcttcgggggctaatatcagaacaatggaaggagatgggttggcaagggaaagacccatctacagactttagaggtggaggcttcatctccttggagaatctattgtacttttctaggaactatccaaaatctttccaggaa

SEQ ID NO: 8403 - DNA, 1000 bp, Sorghum bicolor
  Clone ID: SORBI-28MAY03-CLUS38279_1
cttcccccccgctcccccggcgccctgccgcctcccccccagcctccttgtcccctccgcccccgccccctcgccctccccttgcccccggcctccgccgccgccccccgcccgcccccgccgcggccccccgcttcccgcgcccctccgtcgcgccccccctcgtctccccctccccgcgcacctccccacggccggcgccccccgccctcgcgcgtcggcggcgccggcctccgggggccgtctcgggcggggtgcctcctccctcctcgcccgacgtctccctccctgcccgcggacatcgacgctgcgaagggggcctggggagctctggaaggcgagcccggaccgcctccccagcgcggcccgaccgaactgaagcacctgggcagctgtgctgaatgaggggaatagcccggcccgctgcaacggagaaggctgcaggcatattgctggaggggctgctggattgagattgggcagatgcgctaaggtgcttcttgtgggcttcttggggttgctgcgtcattgtaattgcctcaacctattcaagatagaatgttcagaggtgcttcgccagctgcactctggcacttcttgcgtcctccttcgcacggcgtctgatccctgggttgcgtaccccatttgactttgcaggttacatgccactggcactgaacgtcaaccctaagaaatatctacaggcactgttctctgcatgccaaaatctggcagatgaagcatcctcattaccaagtgagcagaaagagttcaagctatacaagcaacatgttgatgatctacaccatttggcaggaaattatgattcggtgatcgtctgccttggggccaaggttcgctcacttcctgaacttgcaaataagttgcctcttaggacctgtagaggagttatcgctgaatttaagttgccatccgatacaatagaagagtatggcagtcaaagcccttcaatcttatctgatgcatggctggcattcca

SEQ ID NO: 8404 - DNA, 883 bp, Sorghum bicolor
  Clone ID: SORBI-28MAY03-CLUS38295_1
attcggaccagaacccgatcgggccatcgggcacgcgacggagaacgcgagtaagcactcccctcctcaacccctcccctccgccgtaaaccccgctgttgttcgccggagcaccccctctccgtccccgtccccagccccagggcaccccatccccgtccccagccccagtctccgtacccccggacctcgatatcttcggaggccgccgctggagccgcctgcatgctcaaatcgtagacactcggccggggcggcgtggacctccgtccgcgctcggatcgatttcggcgttcgcgggtacccaggctctaataatttgtacaaaaccgatggaaagttctaaatctcctcaatcatcgaagaacagccagattacggtaccttctgatagtaatggcccccgatttgacaatgacgggtttgcttcagaaactgcatcaaatcaaatggtcgttttcaactctgaagcaggagataaagagcaagatgaaccgggagaaaaccgtttgcagaagtcagtcataacaagggggatatctccatctattggagcattcactgtccaatgtgctaaatgttttaaatggaggcttatcccaacgaaagagaagtatgaagaaattcgtgaacgtattatacaggaaccttttgtatgtaaaagagcttgtgaatggaaacctggtgtaacatgcaatgatccagaagatatatctcaggatggtagcaggctttgggctattgacaaacccaatattgcacaaccccctcgtggatgggaaaggcagattaggataagaggtgaagggggtaccaaatttgctgatgtatactatacctctccaactgggaggaaacttaggtctctggttgaaattgatag

SEQ ID NO: 8405 - DNA, 704 bp, Sorghum bicolor
  Clone ID: SORBI-28MAY03-CLUS38392_1
ttgccccaggggaaaggcgccttggggggtggtccagcgggagtttgtgcgagactgcatggggtggggcgccgctgtgaagtgctcgtttcataccgggaatgaattcattttgctcctgtctggcctcgtgcttcctgaggggaaaggtgttattaagtgtgatacatcagaagatttagcgagactatatggggaggaggactactataattttgttgtttcaaataggaaatgaatacagtttggtgctgtgagctttcatgtgtatcagcttctgcttggattcctatctcactttttattactgggattaggaggaatctgccctgtcaccaaggaaaacgattcgccatttttgcgctgtctggacgtaggaccactagtccagtaagggttttcaaattgggggaaaaaaaagacactggagctgctgatctttcccttctactggtaatagataggtgcatacggctggaattaatcaaacaccagattttttaaaaaaactgatactaatctagaccatggaaattttgtcatgtattgttggtggagatactatggtgcttttgggggaattccaaatagacttcgtacatgttgactgtactgttatggccctgtggtctaacagagttttacatgatatgtctttgactggtatttagcctggcacttaatatttgcaactcacctcatgc

SEQ ID NO: 8406 - DNA, 662 bp, Sorghum bicolor
  Clone ID: SORBI-28MAY03-CLUS38338_1
aaaaagagctcgcggcacgcacacgcacaagtcaaacgtgcagctgaggcaccgatcatcgctacgttatcctgactgacgtgtgcgttgccaaatcaagctactagctagctcgtgagcgatcgagtgtgtgtctcgtagctagctagccgcccgccggcaatgggtattgcgccggcgtcatcgtcgtccgtcgccgtggtggtcgccacggtggtggtttgcctgtgcggcgccttggcgcgcgcgcaggcgcaggacatggacaaggagtgggcgcggccgccgtaccgcgggttcttcggcgccccggggtcgctgctgccgcagtcggacgtggacctgctggagttcccgctgaacctcgagtacctggagacggagttcttctgctggtccgctctgggctacggcctcgacgccatcgacgccaacctcaccggcggcgggccgccctccatcggcggccagtccgcctccctcaccccgctcatccgcgacgtcgccagccagttctgctaccaagaagtcgggcacctcagggcgatcaagcagacggtgaggggcttcccgcgtccgttgctggacatcagcgcggccaacttcggcaagatcatcgagcaggcgctgaacgcgacgctggacccgcccttcaaccccta

SEQ ID NO: 8407 - DNA, 625 bp, Sorghum bicolor
  unsure (1)..(625): unsure at all n locations
  Clone ID: SORBI-28MAY03-CLUS37416_1
gcacgaggctcttatgagagagtaggcaaaatcgctaccagactcccgtcctctgctcgagggtcgcagcagcagcaccccacggcgccgccgttgtacttttgcgcttttcagcacatataaaccggcaagagcaaagggagcatcggtggctttggattagatctggggatggcggacatggggaaacctcagcagatggaggtgcgcaaccatgatgcgataactggtgaggggtcgtcctgttcggctgctgaaataaagcctgattctcactgcggcgaaatagttggatcgcaggtccagcttccagaggacattcttcatcggatacacgcccttatgccaatgcgagatgctgctcaggctgcctgcgtgtctcttgctttcctgcgttcttggagatgctatcccaatctcatcatttctgttgattcactatgcataaatgaatatggatctcggtatgatgaattaacaacagattttatcactagagttgagcacattatgcagaatcactctggcatgggagtgaaggaatttagactacaaagctacccttgttccactatagatcccagttatcttgatcactggattcaagttgccatgacacctgnga

SEQ ID NO: 8408 - DNA, 698 bp, Sorghum bicolor
  Clone ID: SORBI-28MAY03-CLUS37471_1
cttccgtcgcgtgatccaaccttccccgtctcttcggccgaacgagtcagaccgggcaggttatgtagcctgccttgcttgcggcgagaggcgggagtggaagaggaggtcaaggcaataatgggcggggcggacgggcttgggcagccggacggccacgcgaacggggcggccgtggtggaggagaagctggacgcgctgcggcggcagctggggaaggcggacggcgccccgcgccggatcgtcggcgtcggggcgggcgcctggggcagcgtcttctgcgcgctgctgcaggacgcgtacggccacctccgcgacaaggcgcaggtccgcatctggcgccgcccgggccgcgccgtcgaccgcgccaccgcccagcacctcttcgacgtcatcaacgcgcgcgaggacgtcctgcgccgcctgatccgccgctgcgcctacctcaagtacgtcgaggcgcgcctcggcgaccgcacgctctacgccgacgagatactcagggacggcttctgcctcaacatggtcgacacgccgctctgcccgctcaaggtcgtcaccaacctgcaggaggccgtctgggacgccgacattgtcgtcaacggcctgccctccacggacaccagggaggtgttcggggagattgggaggtactggaaggagaggatcactgcccccataatcatctccctcgccaa

SEQ ID NO: 8409 - DNA, 622 bp, Sorghum bicolor
  Clone ID: SORBI-28MAY03-CLUS37483_1
ggtgcctcgccggcgaattcgggagttccaattccttcaccgtctgtctattccccccccaaacccaaaagcgagaggaggcccaccgccgccgccgccgccgccaagcaaagccaacccggagcatattcacacggaggagaggaggcgtggatccggaggctccccccgcaccgcttctccagaagcagctgacgcggcgtgcccgcgggtcggcggtcggtcggtcggtgtataaatggcggcgggagaggagagcggcagcggcgttgcgggagggagggaaggaggagaagcgccggcggcctctgctcccaacggggaccgctctgggaatagccccctcgccaccgcgccgtcgtcgtcctcagcagatgacagaggcttccatagatcaagcaccatgccgggggtgattaagaatgacgaaattaccaatgaaactgctggaccatcaaatttggaaaggtccagaactgagcgtcgtcggcaaaataatccagctgatgatcctgctaaacagttacttgatgaaaggattccaataaaaaagaagctaaaaatgctaaatcggattgctacagtaaaagatgatggaaccgtggttgttgatgtgccaagt

SEQ ID NO: 8410 - DNA, 888 bp, Sorghum bicolor
  unsure (1)..(888): unsure at all n locations
  Clone ID: SORBI-28MAY03-CLUS37597_1
gcgcctggccccggcccgggcccggcgactccccccctgcccgcagccgccccctgctgcgggcgcgtgacccgcccgctgccgcccgcgtgcggcgaccggccgcccgcctcggtgcggcaatcgctctgctgggtcccgatgctgtcctgtgccccaccccgcgggctattcctcgtgctttcctgcccgatgctctcaggtactacatattatgtagatttatttaataaatttatgcccagtgaaattaaactcttgcctacctgatccaacttgagtatatgtactaagattcgtgccatttatagtgtttgcaaaagtatcagattgtctatactaagattggggccacctgctgtgttcgacgacctgaagtttttttacctggcgctctccgttttcggcaatttgtgactccgctgttccggtgcattttctgctgctgcggttagggtcgacttgcgtcccgggcactgctttcccaggctcgactccacgctcaattctactttggtcaattatctggttgcagccttatccccaaaatatgtatggatcatattggtacttagcttgcagctcatttgtcaagtggttcaaatatagtgttgctgttgctattggaaggtttccccctcgtcctcctcgtgtctggctacatcgtccacgccgtgactgtcgccgggccctctcatgacgctctgctcagaacctccagtctcactagtttggtatgtttaccttttcttgtttatgtttttctggtgtcttcatttagttctgtcaatctctattcaaagngttgtatgtgaatcctgatatttccatagacctgtgatattcaaaggatctagctagagccgtggaaaattaaattttatttgt

SEQ ID NO: 8411 - DNA, 565 bp, Sorghum bicolor
  Clone ID: SORBI-28MAY03-CLUS37713_1
tcgggttcctgtcccgtgaccctctgtaccgctacgtgctcatggtgcagttcgccgtgcctccggcgatgaacatcggaaccatggctcagctgttcgacgttggccaagaggagtgctccgtgatcttcctctggacgtacctcgttgccgcggttgcgctgacgacgtggtcgacgatcttcatgtccattctgtcttgattgaagtcgatcgctggaatcaatggacggtcgcatttgggagcctgctgctgctcaaaactttcagcttagcaagaggaaaggaggagggggatgatgatgatggatcccaagagtctgtcggaggctcggagcaaaagctagaactacctatcttctttagcaagtatatatacataggcagtagagtatgatcaaatgatcatttaggtaattatttattattttatttgtgttgggctgatgggctgacctattagttggcgattggcatagctcaaacccaatcttggaaaaagtagtgaagggttccatttttgttccatgtatattatctcccttataattttaaatcccccctt

SEQ ID NO: 8412 - DNA, 687 bp, Sorghum bicolor
  Clone ID: SORBI-28MAY03-CLUS38696_1
tcaagccagctagttatataattgaagcgatgtgcgcaaagagttatgaagacacaacagagaggctgaaggaaatagaatctaaaattctagcgaagcgaaatgatctgcgtcagtttgaaactgagtacagaaaagctttggcacggtttcaagaagtcaccaccagatatacacaagagagagaagcggttgatgatatgctgagagaaagggacaatatccattgctcgttcacaactgagcgaactttggtaaaccctgttggtgcaggtagtagcagtagtaggtataccgtcgagcagagcattcctgagagccctgagaacggtagtgtagatggcaaagacaaatctggcaaaaagaagtggtttaatctaaaccttaataggtccgacaagaaagcctgatgaatcttttgccagaaacgtcatgtgttttcactttgttgtacattttggaaaccctattgtattcatgccttatgagctttttagttcccagttctctgggagttttgtagcatataggagtttgggtacagcattttattttcatgtattatcccaattgactcttcattgccccatgcctcccaagcaaagttgcatcgacatccaaatttgtgcaatcgcctaccaagttaatatatcattgtcataattggctctatcattttaatggtgg

SEQ ID NO: 8413 - DNA, 1192 bp, Sorghum bicolor
  Clone ID: SORBI-28MAY03-CLUS388_1
gcacgaggctcctcgctagctcccgccgtccagcgccgccgccgcgtcctcttcctcctcgccgccctgagagtgagatggagacatcggaggaggccgggcaggaagtattcaccgctcgtgaggaggagaggatctcggacgctgtggcctgcagcagggatgagggaaaggaggaagaggaggaagtggaggtgagcttcgatgaacttggcctggacgagcagctgaagagggctttgaggaagaagggcatcgccaaggccaccccgatacagcgggaagccatcccgctcatcctggaagggaaggatgtggttgcaaaggccaagactggctctgggaagacctttgcctaccttctcccacttttgcatgaactactgaagttgtcctcagaagggcgtatccgaaaacctgcaccaaacgccttcatcctggttcctactcgagaattatgccagcaggtttacaacgaggcattatctctccttgagttttgtacatgcaaattgagggttgtgcaagttaccgcgagcatgtcgaataaggacattactgttgcgttgtctggcccccctaatattcttgtgtcaactccagcttgtgttgcaacatgcatatcaaagggaattatccgtggaccttcagttaaagagtcactttcaatgatgattcttgatgaggctgaccttcttctatcctaccgctgtgaagatgacttgaaagcactcatcccacatatcccgagaagctgtcagtccattctgatgtctgcaacttcaagctccgatgttgacaaattgacaaagctacttctgcataacccatttattctaactctttcggtggttggtcaagcaaaggatgacgtgatccccaaaaatgttcagcagttttgggtctcatgtgatgctaaggataaaatgcttcatatccttgcacttttaaagtttgagcttattcagaagaaagttcttatatttgtgaactcaattgatatggcattcagattacgactgtttttggaaaagtttgggataagatcagcatttaaaactgcagcctcgtgccaaaattcccgactacatattatagaggcattcaatgcgaagttatttgattatctgatacaaccgatgacactaaaacaaatgacgagaagcaaacccattaggaaaacaaggaaaga

SEQ ID NO: 8414 - DNA, 890 bp, Sorghum bicolor
  Clone ID: SORBI-28MAY03-CLUS3867_1
gccggccgggccggggaccctagtacccccgccgccgccgccgccgccgccgccgccgccggtcctcctcactgctcgccgcgcgttgcgatgggtatcgacctagtcgccggcggccggaacaagaagaccaagcgcaccgcgcccaagtccgacgatgtctacctcaagctcctcgtcaagctgtaccgcttccttgttcggaggaccaagagcaacttcaacgctgtgatcctgaagcggctcttcatgagcaagaccaaccgcccgcctctctcgctccgccgcctcgtcaacttcatggagggcaaggagaatcagattgctgtgatagtgggcaccgtgactgacgacaagagggtctatgaggtaccagcaatgaaggtggctgcgctcaggttcactgagacggccagggcccggattgtgaatgctggtggcgagtgcctcacctttgaccagcttgcgctgcgtgccccgctgggccagaacacggttctgctgaggggacctaagaatgctagggaagctgtgaagcactttggccctgcgcctggtgtgccccacagccacacgaagccatacgtgcgctccaagggcaggaagtttgagaaggcaagaggaaggaggaacagcagaggcttcaaggtctaggttgtcgccatatctatgtattctgacctggttgaccatcttgtttgagtcatagagttggtatatgatattacaccccagttccaggacgtttgagagctctttgttgtttgtacaccagttcaggatctgcaaaaatttgctcgattggtttgcgccctaaaaaaaaaaaaaaaaaaaaaaaaaaaaaaaaaaaaaaacaaagaaaaaaaaaaaaaaggaaaaaaaaaaaaaat

SEQ ID NO: 8415 - DNA, 556 bp, Sorghum bicolor
  Clone ID: LIB3481-029-P1-K1-G7
cgtccgcccacgcgtccgcccacgcgtccgcccacgcgtccggtgcgacgaaggacccggcgaacgcgcagaggcacaagatcgaggccgccgccgccggtcctcctcactgctcgccgcgcgttgcaatgggtatcgacctagtcgccggcggccggaacaagaagaccaagcgcaccgcgcccaagtccgacgatgtctacctcaagctcctcgtcaagctgtaccgcttccttgttcggaggaccaagagcaacttcaacgctgtgatcctgaagcggctcttcatgagcaagaccaaccgcccgcctctctcgctccgccgcctcgtcaacttcatggagggcaaggagaatcagattgctgtgatagtgggcaccgtgactgacgacaagagggtctatgaggtaccagcaatgaaggtggctgcgctcaggttcactgagacggccagggcccggattgggaatgcctgtggcgagtgcctcacctttgaccagcttgcgctgcgtgccccgctgggccagaacacggttctgctgaggggacctaagaa

SEQ ID NO: 8416 - DNA, 687 bp, Sorghum bicolor
  Clone ID: SORBI-28MAY03-CLUS38835_1
aagatcattggatttgaggacccatatacgaaggcaatcatcggctgagctagagaagttcaaagagcggtggaacagggctgtaagggaagatgaaggatggaaggatcctttcgattcttgattactttgagagcagagtgtgacacatctaataacaaagctggccagtggccagtcacagcagtagagaagcggaggccatcccatctggagagctacatttgggccctgcttcatgtcaaaaacagttggtttgttataggatgatgagacagatggctggttataggatgatgagttacacttacacacaccataattttatcctcatgagacaaaagaagtagcggaaacattatcgtcaatacaaggaggagctgatggggaaggtgaaactaaccagggacttcaaacagtgctgcaatttccccttgaaatatctgttcggctagagttgtatagtgacatgatatacacacttgtgcagttatttaatgaggaattttacatacatagcctagagcagttttacctgcttgcctagctgaattccatgagtcagaaacaaatagtatgaggtctgtattttttttttagcaaattaagaggatggcccggcgtatttttgtgttaccgccccgaggttgccgctctctttatttatcaatatataaaggttctgtt

SEQ ID NO: 8417 - DNA, 824 bp, Sorghum bicolor
  Clone ID: SORBI-28MAY03-CLUS38921_1
gcacgaggcccacacccccgcccgttgctcgctgccggccgcccacgccacgcctgcctcttctcttccatcctccctcccgtgccccgccccggccggacctcttaattttagccgccgccgccaccgccgtcgtcgttggatcgtgtcgtgtcgatcgccgccgccggccggagagcagcaggcagcccgcccgccatggaggggaagagcgtggtgatgtcggcgctcgggatcgggatcggggtcggcgtcggcctgggcctcgcgtccgcgccctgggccggcgcctccgcctcctccagggccgcgggggtcaccgtcgaacgggtggagcaggacctccgccgcctcctcgtcgacggcagcaacagcaaggtcaccttcgacgagttcccctactacctcagtgagcaaacacgtgttgtgctgacaagcgctgcgtacgttcacttgaagcaagcagagatttcaaagtacaccaggaatcttgctccagccagtcgcgcaatcctgctgtcaggtcctgcagagctctaccagcagatgcttgccagagcgcttgcccactattttcaagcgaagttgctgttgctagatcctactgattttcttataaagatccatagcaaatatggcactggtggcagtacagagaagacgtttaaaagatcaatctccgagacgacgcttgaacgtgtgtcgggattgcttggatctctttcaattatttcacaaaaggaacagcccaaaggaactatacgtagacaaagcagcatgacggatgtcaaattaaggagctctgaaagtatgaccaacttacc

SEQ ID NO: 8418 - DNA, 1212 bp, Sorghum bicolor
  Clone ID: SORBI-28MAY03-CLUS37957_1
gcacgaggtagcgcgtggcctatctcggcctcgccgactccctcccccatcttccccgaccccgtatctcccaacatccggcggccgccgccattgccgctgctttctcccagccgccatggttaggctcaccgccgacctgatatggaagagcccgcacttcttcaacgccatcaaggagcgcgagctcgacctccgaggcaacaagatcgccgtcatcgagaatctcggagccaccgaggaccaatttgatacaattgacttgtcagacaatgagattgtcaagcttgaaaacttcccatacttgaatcgccttggcactctactagttaacaataacagaatcacacgtatcaatcccaatcttggtgagtttttgccaaagcttcatacgctggtgctcacaaacaatcgtctgacaaatcttgcggagattgatccgctggcatctcttccgaagctacaattccttagcttactggataatactgtaactaagcagccagactacaggctatatgtgatccataaattgaagcatttgcgtttgctggatttcaagaaagtgaaacaacaggagagagttgccgcagcgaaaaagtttcactcaaaggaggcagaggaagaggcaaagaaggtagctgtcaaaacgtttactcctggtctgcctgatgctcaggacatcacaatggagccgcaaggtcctaaagtagttgctccaactcctgaacaaatcacagctatcaaggctgctattgtgaatgctcacactcttgaggaagctgcaaggctagagcaggtattaagcactggccaagttcctgctgaatttgcagtgcccaagcctgatgcaaacatggctgaagcttcagagggagctgagaagatggatacagatggtcagaaccaggagggtgaggctgatgggcagaaacaagatgacgaaagcaccccaattcaagaggattgaaggcatggtgacatggctatatcgccttgggctggaaccattatttgagtttggtttgccagttttcgtgggggggagaaaagagctagagcctgtcgcagtacaccctctctggatcgcatgcctagtatcaagtattttatgtatcctgtggaatgtggatgctaacaacaatttttttagatgatggtactgataagagaatcagatgttgtaaactatacattcgtgcatgtggcgaa

SEQ ID NO: 8419 - DNA, 752 bp, Sorghum bicolor
  Clone ID: SORBI-28MAY03-CLUS38115_1
gactcgtcgtcgtcgtcgtatccgcgggccggttcccgttcctcccgcgaatgcgctaccccgatccctcccctgctcccctgttctagattaatcgcctttaattattcccccgggcctcagctccgcgtgttaatccacggattaaactccccacctgccccccctcctcgtccttcatccttgacacactgcagtgctccacgagtgccgggcgcagagccattctcgccctccgcctccgcggacgaactgattgccggctcggtccaagtttagcgcgtcggacccctcgctcgctccccaatctcagaggaatggaggtggtggaggcggcgaggccggataagctggagcctcctccgtcgccgccggtggagggccccggcgagaatggcgcggccaccaagctgcagaaggtgtaccgcagctaccggacccgccggaagctcgccgactccgccgtcgtcgtcgaggagctctggtggcaggcgttggactacgcgcgcctggagcacagcaccgtctccttcttcgacgagcccaagccggagaccgccgcctcgcgctggaaccgcgtcagcctcaacgcgtcctaggtgggtcagggtttatccagagacggcaaggccctcaagctggctttccagcactggatcgaagcgatcgacccgcggcatagatatgggcacaacctgcacttctactacgatgaatggtgcaaaagccaagcagggcagccattcttctat

SEQ ID NO: 8420 - DNA, 1384 bp, Sorghum bicolor
  Clone ID: SORBI-28MAY03-CLUS38116_1
gggtgctggaggagatgagcagcaacccggacatcgtgtacacggacaggtccggtcgccggaaccctgagtacatctccctcggctgcgactcgctgccggtgctcaagggtcggacccccatccaggtctacaccgactacatgcgcagcttccgcgagaggttccgtgactacctcggcaatgtcatcgcggagatccaagtgggcatgggtccttgtggagagctgaggtatccttcataccctgaggccaacggaacctggcgtttcccgggcattggcgagttccaatgctatgacaagtacatgcgggcatcgctggaagccgcggcagtggcggccggccacgaggagtggggggaggggtggaccgcacgacgccggcgagtacgcgcgggggcctgacgacacaggcttcttccggcgcgacggcacgtggagcaccgagtacgggcatttcttcctggagtggtactcgggcatgctcctggagcacggtgaccgcgtcctggccgcggccgaggccgtgttcggcggcacgggcgcaacgctctccgccaaggtcgccggcatccactggcactaccggacccggtcccacgcggcggagctcacggccgggtactacaacacgcgggaccgcgacgggtacatgccgatcgcgcgcatgctggccaagcgcggcgccgtgctcaacttcacgtgcatggagatgaaggacgagcagcagccgcagcacgccagctgctcccccgagctgctggtgcagcaggtcaaggccgcggccagcaaagccggggtggagctcgccggcgagaacgcgctggagcggtacgacgaggcggcgttctcgcaggtgacgtcgacggcgcgcggcgcgggcctggccgcgttcacgtacctgcgcatgaacaagacgctcttcgacggcgacaactggcggcagttcgtgtccttcgtcagggccatggccgacggcggcgcaaggccagcgctgccgcggtgcgacacggggcactcggacctgtacgtcgggttcgtcgacgcctccaagcagaggaaggcgcccgacgccgagagcgccaccgccgccgcggcagtgtaggtggatgcccatgcgtgtgcgtgcacacagacacatgcgccgtgctgttgtatatgtgtagggtacgtgccccggaggaaggggaactgtatagattcagtcagggccttgcaggttgcagagttttataggctgtaatcgagcaggtaggtaaggaggcaggcatgtcagaacttaggctgtcatcagtttatttgttccatttcgaactgtatcataaggagcagcttggtgactgttcactgtcatgaaggaaaatagaaatgccatttactcc

SEQ ID NO: 8421 - DNA, 600 bp, Sorghum bicolor
  Clone ID: SORBI-28MAY03-CLUS38192_1
acccacacggtcgcacgactgtataattgtgctcgctcgccggccccagggacgtgacacatcgcacgcccgaagcagctcggtgcttttgcctccgcctgccgtgccgcccgtgaggccggcagctttgcatgaggaggaggaggatgggggcactgcacgtcgtcggtgagcccagggtcgtcagcttccagcagcagcctgcagccgtcgtcgccaagaacggccacggccccgtcgtcgaggagatccacggcctgatccgcgtctacaaggacggacacgtcgagcgcctcccggcgatcccgaccgtgccctgcacgtggggcggcaccggagcggacgcgcctggtggcgtcgtcgcgagggacgtggtggtcgaccccgccccgggggtgtgggcgcgtctgtacgcgccgacgacgacgacgtccgcgggaggcggaaccggaggcagcaggccccccgtcgtggtgtacttccacggcggcgggttctgcgtcgggtccgcggcctggagctgctaccacgagttcctcgcgcagctctccgcgcgcgcgggctgcgccgtgatgtccgtggactaccgcctggcgcccg

SEQ ID NO: 8422 - DNA, 668 bp, Sorghum bicolor
  Clone ID: SORBI-28MAY03-CLUS39048_1
agatgttcaagctagaggatgtcgcaatgggaatatggatcaatgagatgaagaaggatggcttggatgtcaagtatgagaatgatgggaggatcttggttgaagggtgcgaggatgggtatgtggttgctcactaccaagaaccaagggatatgatgtgcctctgggataagtttcagaaaacaaaacgaggaacatgttgcaaagaataacagaaatactggaaatgatgctttatttttcggtggttggttgaacagacaccgtcacgctaaaacgttcttgatatatacacagccctacctaagaggattcttgcagaagtggaaggcaaacaaagttttggatatcttctaagtttgtttcgtccgcagtctgaagagtttcaagtcaaactaggggatatgcatcgtagacagaatgtaggtcacatctgttttggcgtaggtaggagggtactgctttgcttactttgtggcttgtaaaatagtatcgccctagaatgtaggatacagcggcagcagattacgttaggatagattgagccagtcttaccattcttttgaaaggaatgcattttgcatctggtgtaaagctatttggtggccatattctctagtattaatacagtcaatgttcactccacgcctgaattttttgtccctggc

SEQ ID NO: 8423 - DNA, 646 bp, Sorghum bicolor
  Clone ID: SORBI-28MAY03-CLUS3911_1
tttttggtaccaacgaacaaggcagagtgttcttgatctcatcgtctccctacgttttttcttttgtctgtacagtttttatcagcagcacatcacaaccacaccccaccctgacaagtgacaacgacgcatataccgaaaaattcgttcgcagacaagacacttgattacacacagacagcttcttccgttccacttgcgcgagttgcacggaggagcaacagcggcatccggagcggagctcgtccggatcccaatccaattgctcccgagcttatcgcattccatccgctggagctgtcaccgggatgcgcgcgcgcgcgcgcccccgtcgcattcgtgcaccgcgcaagtgccgcgcagctccttgtcccgtaggagccttggctggcgcatcatccgtcgcggcacgcctcattgcctcgccgcggtgcccggtggctggctggctggctctgaccgatcggcgcagggctagatgacgagctgctccacgcgcggcgccatcgccgcctgctcgaccggcgcggcagggaaccaaggctgggccggccggttcagctgggaaggcgggggcaccagcgccatggccatgttggcggcggcggcctcgcctcgcttccgcctcttgggcgagccgctggtc

SEQ ID NO: 8424 - DNA, 738 bp, Sorghum bicolor
  Clone ID: SORBI-28MAY03-CLUS3913_1
ggaggctggaaaggttgaggcaattgcgcttgtaacctcagagaggaaagcgagggagcaaattgagacctccatgaggtcagaagagaatttgctgcatcttaaagcagcgaatgacgcacaaagatacaagagtgagatccgtgctcttgagcagcatattgcacaactgaaggtgtccttggactctttgaaggttgctgcccccaagtggggaactgacaataaaacctatgcattgcatctttctgaagggagaaagaacagcaatgcccaaattttgtccaacatagcagtaccccaagatctcgattttgatgatatacagcgcgatcgggagtgcgtcatgtgcttgagtgaggagatgtccgtggtgttcctcccttgcgcccaccaggtcgtctgtgtcaaatgcagtgacctccatgagaagcaagggatgaaggaatgcccttcatgccggacccccatccagcgcagggtgtgcgcccgccccgccggtttctagatttcacatataccatttggattttacttttttttgtttcaccttgattgctcagcttgagttgatggaagattggagagaataataatgaggggtgagtggtgaaactttgacaataatacttcgttaaacatcaaacaagccccagtggacagtgggtactggttgggtttgttatatggatataccggccgcttctgaatgctttggttttgctgcactctggttct

SEQ ID NO: 8425 - DNA, 672 bp, Sorghum bicolor
  Clone ID: SORBI-28MAY03-CLUS39148_1
gactcatgtcgcccaagccgagctcctcccatggctacccctgccacggttcttcctatctgcatctgagtttgtcgagtcaatgctcgcttctctgaaggtccccgtggttgcgcctgtgtctgcagccatggcgctcacagccctccacctgcggctgcgctatggggagaggagtgacgggctggtgacacgacgcgacgccgaggtgcctgggtcggtggtggtgaggcccgagaggaggctggaccacgcgtggatggtttactccacgctgaagatgggcagcgctgaggccgatgcaagcgagatgtgcgaggctctgctggccatgctcgttgagattggcaggaagaaatttcgctgaccttctggtcatctggagttctcgatggttttggttatatatgcacaaatgtgtccaactagatggaacttactacgagtagcatagcacagtagcagtgtagcactatctgttgtcgcacacactacaaatgatagaaatcacggaatattacagtctttacagggaacagtggaaattagatttattagcaattatactgtggcaatatgcaattttgtttttgacgagccacatgctactctggttatgtaatgttattaacacttcacattttaatttagttctgttggaatggtttggtc

SEQ ID NO: 8426 - DNA, 684 bp, Sorghum bicolor
  unsure (1)..(684): unsure at all n locations
  Clone ID: SORBI-28MAY03-CLUS39324_1
ctagacctcccagtgttcctcctntgatgcctcaattcatgagggctcatggcagcatcagcgaacagtaccaacagaattcatcatcgagcctatttgctggggcgcataggtcaggaggcatgcgacctgccccaacacctctaccagagaaccctaccttttccttgttcccgccgggttcatctggccatagctcgatggagactgatgatgtgggaggaagccggttctacgcctgggagcgtgaccgattcgccccatacccgttgatgcctgtggactgcgagacaagctggtggacctcacagcagcagtctcatagcacatcagagcctacatccgcgccaaggaggctgtttgggcaatggctcggcgtcggcaggtcgtcccctgaacatagatcgcccgaggggtcttcgtatcggcaaatgcactcaccgcggatgtagaccctcgctgctgagctgagaatccaagttaatttgaaatccgagttgcttgtaagaaacgatgggaaacccattgtattaaagttaagccgggttgcgccgtaaaactttgggacaatgttcgaggggccagaaacaggaaatgatccggctgagaggatattttgatttggtttatgtgaattccatctcgtacatatttgaaatcaagttgggatgttcggagcttcgg

SEQ ID NO: 8427 - DNA, 613 bp, Sorghum bicolor
  Clone ID: SORBI-28MAY03-CLUS38485_1
gcacgagggagcatactaccagactgtgaaactgtggcttttaatacagcgagggttggtacacaaacgtcgttttttaatgtcgaatctgggtcccccagttattcaagtagacataagcctagaattctatcccttggtggcccctatctctcaagtacttggtgggcttctaaagaacctgttggcatatggagtgaagacatctttgctgctcaggggatattagagcacttaaacgtgacaaaagacatatctgactacctttcatatactaccagggtgaacatttctgatgaggatgttttatattggaattcagaaggtttacttccatcactaaccatagatcaaattcgtgatgtagtgcgcatatttgtaaatgggaagcttgcaggtagtcaagttggtcactgggtctcactgaatcaaccacttcaattggttcaaggacttaatgagttgacattgttatcagagattgttggcttgcagaactatggtgctttcttggagaaggatggtgctggatttaggggtcaagtaaaactcactggcttgtcaaatggggatatcgaccttactaattctctttggacgtatcagattggtt

SEQ ID NO: 8428 - DNA, 815 bp, Sorghum bicolor
  Clone ID: SORBI-28MAY03-CLUS38540_1
agtggagcatggtcttggacatttgccatttacagaaaagcaggttattactccaacaggatctgtttatatgggagttgacttctgtaagaagctctgtggagtgtctattgtgcgaagtggtgagagtatggagaacgccctgcgtgcttgttgtaaaggaataaaaattggtaaaattctaattcatcgtgttggagacaatgggcagcagcttgtttatcacaaactgcccatggatattgctgaacgacatgttctacttctggatccagtgcttggtacaggcaactcagtggcccaagcaattgaccttcttataagaaaaggtgttcctgagggtcggatcattttcctcaatctcatctcggctcctgaagggattcagtgtatttgcaagcgatttccttcactgaagattgtaacgtctgaaatcgattatggtctgaacgaggaattcagggtgataccaggactgggagaatatggtgaccgctacttcggcacagacaattgatgactcataccactctgggtgtatgaaatctcagttgactcctggatagggatgatatcttggaagtaacattcactatggaggccgtagttgtgtttaatagtttgtacaacctttgacataaaagcttgaccaagggcagagggggatgccatagaaggatctgcgtgaactcggaggacgtgtgtatgattttagctttgtacgggtgcagaaacattgttgatcacctgatgttttcaaataagcgtctttgattcaaatacatctcggtgaagtcacgagatcaaaattacaa

SEQ ID NO: 8429 - DNA, 468 bp, Sorghum bicolor
  Clone ID: SORBI-28MAY03-CLUS38594_1
gcacgagggcgatttcgcaaaagggcaaacagaggggaagagaggagaggagcgtgcgacggcacgcaggcgcatctcgtctcccgccgcctctacttgtcttcgccatcgccaccaccccaaggctcggtacgattcggctgcgtgcccgcgagtcggcactgcaccgcggcgcgcaggcggaccgtgctggggttttggtgggggagtaggggaggggcgtcctatgctcttcggcggcttgatcctgtgaaggcggcggcggcggcggcagcaggctttcccgatgcaacggctactgggggtcggcgagaggctattggcagtcggaacaaataggcgggcagccacttattcccatccgagccacagaagtgggtactacacagcagcgagggacaatggcttgtcaacaaggcgtaagattccagccatcttctctagaatgttctcacattacaaagtcaa

SEQ ID NO: 8430 - DNA, 684 bp, Sorghum bicolor
  Clone ID: SORBI-28MAY03-CLUS38616_1
tttcacctcccgacctcacttggcaaaaattacagaggcctgccactccccccttccttctcccagccccccaggcgcctctctctcccttccttcccaggcagcctcccaggcggcgtgatagagacggaggagtggtgccgcctctgccgaggctttggtcctcccagccgagcgcgtcacctccggatcctgcgacgacggcacccgagctagctcccggtcccggcgctccctttcgccgcatcccttgctgcgagccgtcgggaggaggtcgagccgtcggtcgcgtcgcccggggagagttggagagctgccaggcgccttgagaagggttttgttccgggatgtcgtcgtcggggaagatggaggggccgtctgcccccgcagtgcgtcgggacccctacgaggtgctcagcgtgcccagggattcctccgaccaggagatcaagtccgcctaccgcaagctcgcactcaagtaccaccctgacaagaatgctagcaacccagaagcatcagaactcttcaaagaagttgcatattcttatagcatcttgtcagatcctgagaaaaggaggcagtatgatactgctggttttgaggcgttagaaaatgaaggaatggatatggaaattgatttgtccaatcttggaactgtaaacacaatgtttgcagcacttttta

SEQ ID NO: 8431 - DNA, 732 bp, Sorghum bicolor
  Clone ID: SORBI-28MAY03-CLUS38645_1
agtcgcagttggttccgcctctcccttccttcccgtggctctactccagttccattctcagtcgcagttgcgctcgcggatcgaactccctccagcaaccgctagagcctcctcttctcttctcttctcctctcttgtcttctccaaccgctgccgcctggcccccgtgccgcgccgccggccgcctgccatggggaactgcgccagcgccatcgacgctttcgtccagcgcggcaacagggcgtcgccgtcgccgtcgtcggccgctactcctggaatgtctgcatcgaggaggactagtagctctgccaccacagggaagctgtcaacgattagcagcaccagcaccttcatgccgtccacagttagtggtgtcagcgtcgacgacgattacccagagggccagattcttgagtctccgaacctcaagatatacacctttgcggaactcaagagcgccaccaagaacttcaggcctgagactgtgcttggggagggtggattcggcaaggtttacaagggatgggttgatgagaagactctgaacccgtcaaaggctagcactggcatcatggttgccgtcaagaagctcaatcctgagagcgtgcagggaatggaacaatggcagtctgaagtcaatttcctcgggaggatttcacatcccaatcttgtcaaactcttgggctattccatggatgacaacgagctactactcgtatatgagttcatgtc

SEQ ID NO: 8432 - DNA, 693 bp, Sorghum bicolor
  Clone ID: SORBI-28MAY03-CLUS39615_1
gcacgaggcccgcccgacgatctagatccagggcagcacgctgctatcattttgttttcttcaaagtaatccaaggaaagttgcttccagatgtcaactgcaaaagtgttagatcctgcttttcaaggggctggccaaaaagttgggacagaaatatggcggattgaagattttaagcctgttgcgctgccaaaatctgattatggtaaattctactgtggagattcatacatagttctgcagacgacctgtactaaaggtggtgcctatctatacgatatccacttctggattgggaaagattcgagtcaagatgaagctggtactgcagccatcaagacagttgaactcgatgccatccttgggggtcgtgcaatccaacatagggaactccaaggttatgaatctgacaaattcttgtcatacttcaagccttgcattatacctttggagggtggtttcgcctctgggttcaaaaagcctgaagaggagaagtttgaaacacggttgtatatttgcagagggaagagagctattcgggttaaagaggttccctttgcccgttcatcattaaaccatgatgatgtgtttgtcttagatactgaaaataagatataccagttttaatggtgctaactccaatatccaagaaagggccaaggcgttggaagtaatccaacatttaaaggagaa

SEQ ID NO: 8433 - DNA, 632 bp, Sorghum bicolor
  Clone ID: SORBI-28MAY03-CLUS39651_1
aaaaaaaaaaaaaaaaaatcctcatccagatcatcaatcaactcttcaagtctctcaacaactcttcagtcttcacgacatcctttcgatacccttccaaccaaacaaccaacctaccactccaactatcaaaatggccgctccccagattcccgagaagcagtgggctcaggttttcgagaagaccgctggtcccatcgagtacaagcagattcccgttcagaagcccggtcccgatgaggtcctcgtcaacgtcaagttctctggtgtctgccacactgatctccacgcctggcagggtgactggcccctcgacaccaagctgcctcttgtcggtggccacgagggtgccggtgttgtcgttgcccgcggcgaccttgtcaaggacgtcaagatcggcgaaaaggtcggtatcaagtggctcaacggctcttgcctgagctgctcttactgccagaacgccgacgagtctctctgcgctgaggctctcctctctggttacaccgtcgacggatctttccagcagtacgccattgctaaggctatccacgttgctcgcattcctgaggagtgtgacctcgagtccatctcgcccattctttgcgccggtatcaccgtctacaagggtctca

SEQ ID NO: 8434 - DNA, 1116 bp, Sorghum bicolor
  Clone ID: SORBI-28MAY03-CLUS39712_1
taggaaaaccatgctctgtctctgcctccggtgtctgttcgatccggcgttgtgattggggggagtagggagtgcttacaccatttcctctccattcacatcagctctcgacgcctgcgcccccaattcccaaattctgcgccgcctccgccccaaccctgctcgtcgactcctctctgccgaacacgccggaggaatccttctccgagactcgtcttcctcctctctgccgcgcgggcgtggagtggagatccatcaccacgtagattggtctcttcttctgctggttaggcactgaatctgcccttcaatgccttcacaggctctatccctgaagaagttgcagtttaagaagctattgccacgtttttgttgaaggaacaattttttgggtcatccagattggacacggaacatgatgttgcattttgcttcaaagtgaaagctctgtccttttgggacaagagaataaaggcaaaaggaacataaggatagaggagagaaataaacaatgggaaagggagatgtggctactaggtccaaatctcaaaaatcgtcagcaatacagaatgagcagagtacacctacgcacgaggccacagcatatcctgattggtctcagttccaggcatactataatgctcctgggacagctcccgtgaccccaccggctttttttcattcatctgtagctccaagccctcagggacacccatatatgtggggtccacagatgatgcctccttatgggacaccaccaccatatgcagcaatgtatgcacaaggcacaccatatcagcaggcaccgatgccaccgggttcacacccatacagcccttatcctatgcagtcaccaaatgggacagttcaaactccaacatctggtgctggcggtacagagacaaataaatcgaataaaaataagcggaagactcccctgaaaagatcaaaaggaagcttaggtagtctggatgttgttgcagtaaaaaacaacaagtcaccggcaaagcctcaagcttcttcctccaatgaaggttcttcacaaagtgagagtggaagcgggagttcttctgaaggaagcagtacaaattcaaaaagtagttcaagggcgaagga

SEQ ID NO: 8435 - DNA, 678 bp, Sorghum bicolor
  Clone ID: SORBI-28MAY03-CLUS39772_1
cgcgtctctctgtctcgcgctggccgcgccccccccccccccccccccccccccctcccccgcccccggcgccctgggccggccggggcccggcccccccccgcccccgccgcggcccgaccccttccggccgcggccggcgccgccgccccgggccgtgcgcgggcccggccccggccgcggcggggttccgcgcccccgccgccgccgcggccgccgtggccgcggcggcggcgccgctgccgctcgcggccgcggccgcgctcgccctccccgacggcggcggcgcggccagggagatcgaaagcgcgccagaggtgaagaacttgggaccatgggcaaaggggctgctgaaaggtatgccggagatggcggcaggaccggcagctatggcccctgttgtgaagtatccgctggttctggcagaggaccggacgcggcggccggatgttctcagccatctcaaaatgtacgatggagggtggaacgtcaccaacaagcactactgggcgtctgtttcattcacaggagtttctggatttcttcttggtgccttgtggttcatatttttcgggatagctgcagctggacgatgctattttggatcggcagtgtaaattccatgaagaagctacacgggacgtcgattttgttgtgaaccaatctgatttcactatt

SEQ ID NO: 8436 - DNA, 1022 bp, Sorghum bicolor
  Clone ID: SORBI-28MAY03-CLUS39786_1
ggtggccccgtcgccgaagctcatcccacccgagcgcctctcctctccctccccctctccggcagccgctccccggcttaccgccgtagcagccgccgcctcccgcagaagccgaagatggcgtcgtcggcgtcgaccctcgaaatcgaggcccgcgacgtggttaagatagtgctgcagttctgcaaggagaactcgctgcagcagacgttccagacgctgcagaacgagtgccaggtctccctcaacactgtcgacagcatcgacaccttcatcgccgacatcaatgctgggcgctgggacgctgtgcttccccaggtcgcgcagctcaagctgccacgcaagaagctcgaggacctctacgagcagattgtgttggagatggctgagctccgtgaacttgacacggcccgtgccatcctccgccagacgcaggtcatgggtgtcatgaagcaggagcagcctgagcggtacctccgccttgagcacctccttgtccgcacatacttcgacgccaatgaggcctaccaagaatccaccaaggagaagcggcgagcactgattgctcaagctgttgcttctgaagtatcagtagtaccgccatctcgtcttatggcgctgattggtcaggctttgaagtggcaacagcaccaaggattgttgcctcctggcacacagtttgatttatttagaggaactgctgcaatgaagcaagatgaagaagagacataccctacttccttatctcatcaaataaagtttggaaagaaaactcatcctgaatgtgctcgattttcacctgatggtcagtaccttgtttcatgctcagtggatgggataattgaagtctgggattatcttagtggaaagcttaaaaaggaccttcaataccaagctgatgaaagctttatgatgcacgaagaacctgtgctgtgtgttgattttagtagggattctgaaatgctggcatctggagcacaggatggaatgattaaggtttggcgtatacgaactggccagtg

SEQ ID NO: 8437 - DNA, 1007 bp, Sorghum bicolor
  Clone ID: SORBI-28MAY03-CLUS38949_1
gcacgaggctcctcggtgactcgccccaaccgcaaacagtatccgccgccgtcagatcggagctcgactccgagccccgcttctccgccgcgatggcggcgccagcgcgccgctccctccttgtcctcctcgccgggctactagtcttcgcttccctcgccaccctcgccacagccatctacgaggaccaagtcggcctcgcggactggcatcagaagtacattggcaaagtaaagcaagcagtttaccacagccagaagagtggaaggaggcgtgttgtggtcttgacagaggaaaatgtgatctcgtctcttgatctacgttctggcgatatattctggcgacatgtcattgacaagaacgaccccttggatcagcttagtctatcacatggaaaatatgttctaactctttcttcgggaggaactatattaagggcatggaatcttccagatggacagatgatctgggaaactaaccttcgaacttccgcagcatcaaacccacagttgcatgttatgtcaaacaataaagtggccaaggacaacttggttttagtttcagctggacgatggatttatgctgtatcaagcattgatggggcaatttcatgggaaaaggagttttctattgatggcttggaaatcaaggggattctccaatcacctgaaaatgatgttgtatatgctttaggacttgctggttcctcgaagctagctttgtatcacttgagtgctaaaactggagagatactaaaggatatccaagagtcactccctggtggattatgtggtgaaacagtacttggttctgataatgtgttggtagcattagataaggccagatcaagtcttttacttattgaattcaaggctgagagaattagctacaacaaggtgcatgtttcagatcttgttcaagacttgtcaggatcattcaagcttcaatctttgtccaatggcatcatatctttgcaaacatcatcttctatttccctcctaaagctc

SEQ ID NO: 8438 - DNA, 586 bp, Sorghum bicolor
  unsure (1)..(586): unsure at all n locations
  Clone ID: SORBI-28MAY03-CLUS38958_1
gtggaagccgcccngtgccgaggcggacggacacnggtcggagggaatgcggcgacgagtggcgttgccgacgctgtaacgttagctagctagccgctctgctcggagggaggaggccaatgggggtgtggagggagggcgcggggtggtgcttctgctccggcggtggcggcgacgacgggggtaggtcggagcgggtcaaggcggcgatcttgcacgaggggccagtggaagccgccgtgccgaggcggacggacacggtcggaggaaggcggcgacgagtggcgttcccgccgctgtcacgttagctcgctcgcccctctgcggccgctgccgaggacgccgacgcgctgctcggtcacggccacctcgccgcgcggctcgagccgcacagatttttcatcaccagctcgattcttgatcttacaatagttggtcttgattatacagagggtgactcgacccaacagggtcagcaacttcactatttgaaaacaagctgcaaaccaagcctagatcatggaagtgctgtgtacctgctcgggcatacagggaaaaaagaactggtgattggtgaggggaacgt

SEQ ID NO: 8439 - DNA, 1186 bp, Sorghum bicolor
  Clone ID: SORBI-28MAY03-CLUS3888_1
ctggggagctcgagcatcaacaacaacccacaccacgcacatcaacacaacaagccacacccacccaccgctcaccagctagcaaccacctcgatcgcgcagaggccggccggaagctcagccgcgaattctgtaagcaaccaacaaggcgaagtcttggggttcctcgccgcctcggtcaagattcaggaagagatggagaaggcaggacacgagcatgtgatcggcatcccggtgaacaacagggccttcggcattgaggagccggatttccccagcacgggcgccgccaagaacgcagccgccgcgggcggacgggctgcaaagttcggcggccggaccggggacagggtcgcccaaggcctgaaagaacatgtgactctggggccaaagctgtacgagaccgtgaagggcaagctgtcgctgggagcaaggatcctgcaggccggcggcgtggagaaggtgttccggcggtggttctccgccgacaagggcgagaagctcctcagggcctcgcagtgctacctgtcgaccacggccgggccgatcgcggggatgctcttcgtgtccacggagcggatcgcgttccggagcgaccgctcgctggcgctgacctctccccagggcggcggcacggtggtgcgggtgccgtacaaggtggccatcccgctggcgagggtcaagacggccaagccgagcgagaacaaggaccggccggagcagaagtacgtgcaggtcgtgaccgacgacggcttcgagttctggttcatgggattcgtcaggtaccaggtgtccctgcaggagctggagaaggccatcgcgcagtcgcagtcgcagtcgcaatgacctgacgcgaacgaacgtctccgccggctcccgttcggccggccgggcgttgtgcttgtgctctactgcttcatctgtgtgcatatgtagtagggttcagtttccttgatggattgcttggcgtttttggcattgaagcaagtccggtataccaaaaataggagaaaatttataatagattacgtaattggcgatgttgagtaaatctgtgctggtccacggtaaaagtggctcatatgaggtttacatatggaatgaaaaacccgaagtgtttgtgcaacccctagattgtgaactgaattatgatcccatcttttcatttgtggcaatcgtgctggtt

SEQ ID NO: 8440 - DNA, 463 bp, Sorghum bicolor
  Clone ID: LIB3481-031-P1-K1-B4
cgtccgcggacgcgtgggctgcaaagttcggcggccggaccggggacagggtcgcccaaggcctgagagagcatggtacgttcttctccaaccaaatcacggatgaattcctctttctcctgtccgtccatgaattcatctctcgatctgtatctgaggctgaacgtgctgttgctcgatggtgtttgcagtgactctggggccaaagctgtacgagaccgtgaagggcaagctgtcgctgggagcaaggatcctgcaggccggcggcgtggagaaggtgttccggcggtggttctccgccgacaagggcgagaagctcctcagggcctctcagtgctacctgtcgaccacggccgggccgatcgcggggatgctcttcgtgtccacggagcggatcgcgttccggagcgaccgctcgctggcgctgacctctccccagggcggcggcacggtggtgcgggtg

SEQ ID NO: 8441 - DNA, 442 bp, Sorghum bicolor
  Clone ID: SORBI-28MAY03-CLUS39025_1
cgcagccgcggggggctgcgccgcgtgcggcatcatccgcgacggcttcagcaggagcgccagcgacggcggggtgctgacgatggccactagcggccgcgcgcacgacgccgtgcccgtgccagtcccggcggcggagggtgaggaggccgagcggcagcagcggagggcgatgctggtgtcccgggtgatcgcgggaagggtgaagcggccaaaggaagaagcagagcaggcgtcggaggaggaggccggccccggcgaggaagaggagtatgactcggtggcgggatcggccggggtgtactccaacctggaggagctgctggtgttcaaccccagagccatcctcccatgctttgttgtcgtctacaaggcttagctaccttcaattggttacaatttactacagtccatgcatgctcctagtgttaatgggttggtt

SEQ ID NO: 8442 - DNA, 662 bp, Sorghum bicolor
  Clone ID: SORBI-28MAY03-CLUS39075_1
ctggacaccgcaaaaagcactcgcacagctcctccgcgccccctttcccccgtcggccgatttcctcaatccagcctcgaatctgtgatacgacgaggcgacggagagccgaatcgcgccgcactgtagggagaggcttctgcaaggttttggagaggggcgatggaggcgccgagcaacggcgggctgctgtaccacgaggttcaggaggggaagctctgcgccgtgcactgcgtcaacaccgccctgcagggccccttcttctccgagttcgacctcgccgcgctcgccgccgacctcgatcagcgggagcgcctggtgatgctcgagggctcccgaagccccggcgtggccaaccctgccgcaggggacttcttcgcggagggcgagggatcccacaacgtctccctcggcggcgatttcagcatccaggttttgcagaaggcgctggaggtttgggacctccaagttatcccccttgattccccagctgcagggtcgtccctatttgaccctgagcaggaggttgctttcatttgccacctgcaggaccactggttttgcatcaggaaggtgaatggggagtggtataactttaatagtctctatccagctcccgagcacctgtcaaagttttacctctcagctttcattgacaccct

SEQ ID NO: 8443 - DNA, 1014 bp, Sorghum bicolor
  Clone ID: SORBI-28MAY03-CLUS40043_1
tggtgcaaagtgtagcattgacgctttgttggagcgaacaattaagcatatgctgtttctacaaagtgtaaacaaatatgcagagaaaattaagcaagctgatgaaccaaagataatcgacaaagagagtggtgttgtcttgaaagacaacccagatgctggcagaaatggtggtgccacgtgggcctacgaggttgctgggcaaaccatggtttgcccaataatcattgaggatctttcaccacctggtcagatgcttgttgagatgctttgcgaggaacgtgggctctttctggagatagctgacaacatacgtggatttggtctcacgatattgaaaggacagatggagctccgtgatggcaagatatggtcgcggtttcttgttgaggcaaacagagaagtcacaaggatggatatatttttgtcgcttgttaagttactggaacagaacagccttgttcgatctaccgaccaaatggctaaggtcatgaataatggggttccatcatttgcaaaccatcagcgatctccaatgccagttccagtgggcattgctgagagactacagtgactgcaaaatgtttcaactagatagtgttaggtaccacgactgtaacatatctggtagccagaactccatgcattcgacagagcctagtgaagtgatagtctcactgctgctagaaatgccagtatcaagaacatgactgatgcaaacatgagcttctagtgcataaattacgaacttccctgattactggggtgtgatcagtgaagtggcattctttcccgcttagttagaaatcttaggttgacaccttgccccagagtagctaggctcttgatactggtgtttcttatgcagtgatggcagtgtagtaatgctagcttgcagtgccagagcctcagaggctatactggactatcaccctctcccccctcattttgtgattatgatctgaatgattagcgagttacttatgcaagatatcagagcttaaaatgtactcg

SEQ ID NO: 8444 - DNA, 631 bp, Sorghum bicolor
  Clone ID: SORBI-28MAY03-CLUS40046_1
ggaggtgctggtgatcagctcgcagaagaaaggccccgcggggggcgtgctgatccccaagggcgggtgggagctggacgagtccatggacgaggcggcgcggcgcgaggccgccgaggaggccggcgtcgtcggcgagaccggcccggcgctgggccgctggtgctaccgcagccgcagctacgacgccacctacgagggcttcgtgctcccgctccgcgtcaccagggagctcgaccggtggcccgagatggccgccaggcgcagggagtgggtctccgccgccgaggccatcgcgcggtgcccgcacctctggatgcgcgaggcgctccagcggttcgccgacaccgtcgcggcggaggccacgacgcacctcgcctccgcgctgtaggacgtccgtcgggttggctgcgcgtgtcggcggcctcgcgcgtttttcgcccgcgcacgcacggacgcgcgcgcggggccgccgacgtcgtcggcgaactggcacgaggacgcggcttgtacattgttcttgggtggtggtgggggtagtagttgggatttcacaacttgtaattctcacgaagtttaacaacattcactgtgatactagtatacacgaagagaaacgaacgatagaaaa

SEQ ID NO: 8445 - DNA, 645 bp, Sorghum bicolor
  Clone ID: SORBI-28MAY03-CLUS40087_1
gaaaatgaaccagaagaagaagagatagtagcaggtccacccttgtccccacaatgtaatgctgagctacatacagattatgatggtgctgcagttagatggggtttaacacaccataaagaatctgctgctgattgttgtcaagcttgtcttgatcaagctaagaatgccaagccaggggaattgaagtgcaatatatgggtttattgcccatcggaatttggatgcttctcaccagacaaatatgagcataagcatcaggagtgctggttgaaacaggctgaccaccctaaactcaacttcaaagacaagtattcagagccttacagagatgctcatcccaatgcacctgttgtcgtgccgtggatgtctggtgtcaccagtgcatgagctaccagtcccccagcagctcaattgagactcctgctgatccaacttaaacagacaaccatacagcttttctttttccttttgcgactatactcttttcttgttcttctttctgccccagtatatacaatgtaaaagtaaaacttagcttagtcgacctggcagcgaaagtttttgagcgatgcttgttggggtacacaattggatttggtggtggttaattgaattcagtggttcacctattggtgatcttcc

SEQ ID NO: 8446 - DNA, 775 bp, Sorghum bicolor
  Clone ID: SORBI-28MAY03-CLUS40088_1
tttttcgccctctagtaggagaggccctatcgaaattaaacaatgttataagacatcctgaggcacgacttccagacaatatcatggcatatgataatgctgtttcggcacttggaaaaatatgccaatttcatcgtgatggtattgatgcagctcaggttattccagcctggcttagctgcttgcctataaaagacgacaagattgaagctaaagttgtacatgaacaactttgctcaatggtggagaggtcgggttctgaaattctcggtcctcaaagccagtatcttcctaaaattgtttcaatttttgcagaggttttgtgcaatggaacagaactcgccacagatgaaactagaaacaggatggtgaatatcttgaggcgtttccagcagactttgcctcctgattttcttgcatcaacgttttccaacttgcaaccgcagcaacagctactgctacagtccatcttgtcgacatagtcgttttttctgtcgctgcaaggtctgggcttgtttatttttcttgatgttttgtcagccaattctttatgtggaatcttttttctgggtggggtaatttgtgaatgcattgcttgcttcaacgaactggaagctgccaccacacatggttttgatatagagtgtatattgtcttgtattcgaaatatggcttgaggtgctgcaacagaggtgcaagggaaatggtgggatttattgttggatgggttggacatatgcagttttggtaatgagatcattatacatttgagtgg

SEQ ID NO: 8447 - DNA, 763 bp, Sorghum bicolor
  Clone ID: SORBI-28MAY03-CLUS4010_1
cgtccgaagggaagaaaggagtttatgatcattcgccagagaattgtcaagttacaggctcatgtacgaggacatcaagtgaggaagaactatcggaaggtagtctggtcagttggtatcgtcgagaaagtcatactgagatggaggagaaagaggcctgggttacgcaattttcagcctcagaaacaactagaaggtccatcacaaatccagcctgcgaaggctgaggatgaatacgatttcttgcacgacggcaggaggcaggccgaagccaggcttcagagagcacttgcccgggtgcactctatgtcacagtatccagaagcaagggagcagtaccacaggctcacaacctgcgttgctgaaatgaaacagtccaggatgatgcaggatgagatgctaagtgaggcggctggtggtggtgtggacgatttcatggctggactggaggacctgatctgcattgatgatgccgcgatgtctgccatttggtgaagctgtgagagccttttagatcagttattaggcagggaggcggtttccttattccttgtcagactagccctgtaaatattgttcagctagttgttcacctgactgtttaattgcattctgctagtactactataacgtagtttcattgcactgattatcgctacatacaataatcgcctcttattatttgatagagtttataacttgacatttagctgtaaatcctgcgtccatatcaaaccataatgggtgtgaatttgcgacatct

SEQ ID NO: 8448 - DNA, 624 bp, Sorghum bicolor
  Clone ID: SORBI-28MAY03-CLUS39355_1
tatagcggaggaagtaaacttgagggcgatcaattcaagcttctttgtagcatatctaactcgacaaattttaaattgtcgcgtgtcgggacaagggtgcttggtaaggaacccagattccaagaattcaagaacctgaggagcttatttctggacagatgtgatctcagtgatgacttcaagacattggtattctttctttggggttctcctattcttgagaagctcactttgcagtgctgcgagttcccaaaatgttctagcaaaaagaaacgaatgcccatgtgcaacagtatctcatcttctgagcttcgtggactggatttgctgtgtgagaacctcaaggttgaaatcatatataatgatggccatggaccccaccttatcaggcttctgcagcgtgttttagtgaatctgtcgaagaacaacattaaactcaccaaagttaattagtgttttttgttgtcccaggccttctatgtggcttctcacctaatggttcatttgaaattatgtgcacattataggcttgattcagatgcactaaatctcaagcctatacttttgattaatttctaagtgaaacaggccttgcctctattgaaaatatatgctattaattta

SEQ ID NO: 8449 - DNA, 661 bp, Sorghum bicolor
  Clone ID: SORBI-28MAY03-CLUS39476_1
gattggaggatttgcttctcattgatcgctcacttattatgaggcgagctaatttgattgatagacatcgggagatgcggcttgatgtggataatatgtcctatgaggaattgctggcactaggtgaacgcattgggtacgtaaacactggacttactgaagaaaatattatgagtaacatgaaacaatggaaatatgccttaatatcattggaagatcctccaacaggtgttgaaccatgctgtatttgccaggaagactatgtggaaggtgaggacttgggcagactggattgtggtcatgactttcacaccggatgcatcaaacaatggctggttataaaaaatctgtgcccaatctgcaagaaaacagcactggacacctaagacatggctgcctttttcctcctttgttaaaaagcaggtagcagcaccagggcaagtggttgtcatttaaccacaccctcccaagactagcaactggttacaagcatgttacacaccttcccatcatcaacatacatgtgggaatttatactataggtggtacatggcatttacctgaagccaatggctgtagaccctggagtttcatccttgttttgttcaaacctagatttgggatttaaaatttattcaatgacattcgatttgctggccca

SEQ ID NO: 8450 - DNA, 782 bp, Sorghum bicolor
  Clone ID: SORBI-28MAY03-CLUS3959_1
gccggcccgggtacaaataccgaaggaaaaaaaaggccaacaatggacaccgccgcctcatggcgcctcctctccccggcgtcctccgccccgcctccctgcccgcagcagctactacccaagcggcgagcgacgttcgcggcctcgccacaggcgcagcagtcggccaggtccagcgccaagttcaggctcctctgcctcctccatgacaagtcatcggcgccgacgacgtcggtgcagcagagctcgcagctgcagaggctggcgacggtgttgcagtgcggcgccgtctgggcagctgttgaggcgccggcggcgctggcgacggtgaccggggaggaggacctggatatcctagggatcctgccgccgatcgcggcgttcgccgtcttctacttattcgtcgcccctccgataatcatgaactggatgaggctgaggtggtacaagcgcgaattcgtggagacgtacctgcagttcatgttcacctacctcttcttcccagggttgatgttgtgggcgccattcgtcaacttcaggaagttcccgagggatccgaccatgaagtacccttggtccaagccaaaggagggcacgccgctgttcaaagacagatacccgcctatagacacctataagcagccttgatatttgtactcgggccggctcgtcgtcacgggcacgcagcaaaagatttctttacctcaatctgtgtcaaaacaatatcacagtctaataatacccgtgctagtacatggaaaagctactctcgagactcaaaa

SEQ ID NO: 8451 - DNA, 623 bp, Sorghum bicolor
  Clone ID: SORBI-28MAY03-CLUS3950_1
cgtccgcggcacgcgcctagaaaccacgcgacgccaccgaccaccatggcagccgcgctcctcctctcgccgcggctcgtgtcgctccctcctcacccgagcctcgcccccggcttcaccttcatcaagagaccaacgtcttaccccctcggccgccgcggcgcgaggctccgggccgtcggggacggccccggcgcggggctgacctccgaccagaccacggtctacaacggcgcctacgggccctggaccgtggatgactccgacgtccgcgaggtgctgctgtaccggtcggggctggtgacggcggcggcgtccttcgtggccgcggcctccgcggcgctcctgccggagggcaaccccgcctccggcgccggcgccgccgacctcctgtacgccgtcggcgcctcggggctgggcctgtcgctgctcctcatccacatctacgtcaccccgatcaagcgcttcctccaggcgctgtgggccgtcggggtgctcggctccctcgggacctacctcgtcgccgcccgcccgctggacgagggcctcgtgcagtacgtgttggaccaccccgccgcgctctggttcgtcggccccacgttcgccgcgctcactggcctcgt

SEQ ID NO: 8452 - DNA, 1154 bp, Sorghum bicolor
  Clone ID: SORBI-28MAY03-CLUS39590_1
gcacgaggccgaagagacacggtgagaagaaatgcacggccgccagcagctgcagcgcgagcgagcaaggcagtacgtccgttggtcggctcgcccgccacacccgtcgcgcatgcacgcgcggcgcccggccacgtgccgccgcgggcacgtccctctccgcgcctttaactcctccccgccatctccccactgccaacccgacagacacccgatcgacaccgccgaccggactccctcaaagccggctaccggggcgcgagcgacagcgagcgggagagcatgggagatcggcagcagcagcacgcgcacgggcacggcggcggagagcacccggcggcagcggacccgccgtcgtcggcgacgctgctgcggcgggtgcagacccacgcgcccaactcgacgcaggtggtgggcttcctgacgctgctcgtctccggcgccgtgctgctgctcctcacggggctcacgctgacgggcgccgtcgtggcgctcgtcttcctgggccccatcgcgctgctcaccagccccatctgggtgcccatcgccgtcgcgctcttcgtcctcaccgccgccgcgctctccgcctgcggcttcgtcgtcgccgcgctcgccgtgggcacctggatgtaccgctacttcacgggccgacaccccgtcggcgccgaccgggtggactacgcgcgcagccggatcgccgacacggccagccacgtcaaggactacgcgcgcgagtacggcggctacctgcacaaccgctccaaggacgccgcgcccggcgcctaggcgcgccggcccgccggccggcatgcaccgccgcccgtgtcgttgccgttgccgctagctaggtcgctctcttcttcttggtagttcctcttgcgtgtgtattgtgcgatcgatccctctcgttgttaaagcaatttcctcttctttttctctactagaacacgtacgtacggtgttaatttcgatctcgtggcgccatttgatgtttctcttcgtgtaattaggtaagtaattagctagttgaatcataagagggctcgtggtcctggcatcctgcttgactccccctcctattgatccttattgttttttctcagttctcacaaccttttaatatataaagtagtaaataaaacaacaaattaaag

SEQ ID NO: 8453 - DNA, 758 bp, Sorghum bicolor
  Clone ID: SORBI-28MAY03-CLUS396_1
gcgggagcggccgggccggggagagagagagagagagaacgggaagcagggctagacgcggagcggcgagcatgaggggcggcggcggcgggatgatggacgatgaagagcgggtgggccacgcggagatcccgaccagcttcggcccggagctgcgcgcctgcctccgatgccgcctcgtcaagacctacgaccagttcaggcagaacggctgcgagaactgcccgttcctggagatggagagggagcacgacaacgtcgtcaactgcaccacccctaacttcaccggaattatctctctgatggatcccagcaggagttgggcagctcgttggttgagaattggcaggttcattccggggtgctatacacttgctgtctcggaggagcttccagaagagtatcaggggatttgtcaagagaacaatgttcagtatgtgccgcccaagcgtgtctaaggcgagatggccatgatgtattggtcctgaagcagtatagacaattaggtagaagtgcctgtgcttgttgtcaagggtactgctcaccttatgcattgtatctgagtgttaatcaggactaaagttaacccttccggaagtctatttaggtggtgaactggtgatggttgaatctacgaaataatcatgatgcccgtgcttgaaatctgtgaccaagcagctcatgtgcttctgtcatgttctttcgcatctatgggttatagaaagaaatggttttaatatcatacctattttgtgcca

SEQ ID NO: 8454 - DNA, 545 bp, Sorghum bicolor
  unsure (1)..(545): unsure at all n locations
  Clone ID: SORBI-28MAY03-CLUS4034_2
gattcttgtctcttgcaatcacagtacctgatggttaccatttctctaaggaagctcgcagtaaatttgatgtggaaacagagccgcctaatgaagttgagatcgagccagcgagcggatttctaaactctgaaggacaggcatcactgaagttcagaaggatatcgtcatccttctcaatgggaaggataaactgcaaggtttactactgtaaagaagatgaagtttgtctttaccaatcggttgcttttgatgtcaaattccgtgaagaggccgaacccagtccagcacaaattatgctatcctattctgtttcgccaagagataattcaggtagtacacagctaatagctgctagaaagaatgccaaggtgtagtcagactcacggtgattgttctacttgcatcattgtattgattgtcaatttggccctaggcccacaggggtaagtgttttttttattcttgaagtgcaagattaacttccnctgtatgatgtatagctgacatgctgcttgtaacccagctccattgtctcccctaac

SEQ ID NO: 8455 - DNA, 679 bp, Sorghum bicolor
  Clone ID: SORBI-28MAY03-CLUS4034_1
tggttaccatttctctaaggtcaataataaccagaagacattgtttcttcttatcttactttgcaagtttgcatcattcattactagtgactgaggtacaacattcaatagtgcttgtattaacattttttggctgaggtgtaggaagcgtccggtaaatttgatgtggaaacagagccgcctaatgaagttgagatcgagccagcgagcggatttctaaactctgaaggacaggcatcactgaagttcagaaggatatcgtcatccttctcaatgggaaggataaactgcaaggtttactactgtaaagaagatgaagtttgtctttaccaatcggttgcttttgatgtcaaattccgtgaagaggccgaacccagtccagcacaaattatgctatcctattctgtttcgccaagagataattcaggtagtacacagctaatagctgctagaaagaatgccaaggtgtagtcagactcacggtgattgttctacttgcatcattgtattgattgtcaatttggccctaggcccacaggggtaagtgttttttttattcttgaagtgcaagattaacttcccctgtatgatgtatagctgacatgctgcttgtaacccagctccattgtctccctaactgcacaacagtatcaatggagtagtttattatcagtccatt

SEQ ID NO: 8456 - DNA, 687 bp, Sorghum bicolor
  Clone ID: SORBI-28MAY03-CLUS40445_1
gcctactgatttttcttcctgctgatgccgagtgccgactcctccattcgtctacttcacgatctggtccaaagccccaactgaaatttacatccaggcccttcgccggagatggcgtcggagctgacgtaccgtggcggcagcgcggcgccaggctccgcctccaacggcggagagtactccccgaagccctccaagccgctctcctggctctcccgcgccgcgcgctacgccgccgccgagcaccgcccggtcttcgccctcgccggcatgctcttcgctgccgccctcttcactttctcctccccctccacctcgtcgccgtcccagcccgccgcgtcggtcggattcaaccaccttgccgtcaccgggcacccgtccttccgcgagtccgtcggcggcaaggtgcccctggggctgcgtcggcgcgcgctgcgggtgctcgtgacgggcggcgctgggttcgtggggagccacctggtggaccgcctggtggagcgcggcgacagcgtgatcgtggtggacaacttcttcacggggcgcaagggcaacgtggcgcaccatctccagaaccccaggttcgaggtgatccgccacgacgtcgtcgagcccatactgctcgaggtcgaccagatctaccaccttgcctgcccagccagccccgtgcactacaagtacaaccccatc

SEQ ID NO: 8457 - DNA, 1183 bp, Sorghum bicolor
  unsure (1)..(1183): unsure at all n locations
  Clone ID: SORBI-28MAY03-CLUS40519_1
gcngcnggaattcggcacgagggcggcctcctccgcgctctcggggaagcggagacggggaagcgccagacggtgtggatgagccntggcgacgaggtggtcacgctgccgcaaggctttgaggtggttgcgcgcagtgtgcagggcgccgtcgccgccatcgagtaccgggagaagcgcttttatgggctccaataccacccagagggtacacattcagcccaaggaatggaaacactgcgccgctttctttttgatgtttgtgggatcaaagctgattggaagatgcaagatgtgctcgatgaagaaatcaagaccatccaaagcaccgttggccctgatgagcatgttatctgtgcattgtcaggtggagttgattcgacggtcgcggccactctcgttcacaaggcaataggagataggcttcactgtgtttttgttgacaatggtctattgaggtacaaggagagagaacgagtaatgacaacctttgaaagtgatttgcacctgccagttacatgtgttgatgcctcagagcaatttctcagcaagttaaagggtgtcgaggacccagagcagaaaaggaagattattggcagggaattcatagctgtctttgatgactttgctcacaagctggaacagaagatagggaaaaggcctgaatatttagttcaagggactttgtaccctgatgtaattgaatcatgcccacctcctgggagtggaaggacacattcccacaccatcaaaagccatcacaatgtcggcggccttccaaaagatatgaagttaaaactcattgaaccactcaagctcctattcaaggatgaggtgcggaaattggggagtattttgaatgtcccagattcatttttgaagcgacacccatttcctgggcctggtcttgctgtacgtgtcctaggtgatgttacacaaggcaatgctttggaggttcttcgtcaggtggatgagatatttgttcaagctattaaagatgcaggcctctatgataaaatatggcaagcctttgctgttttcctgccagtacaaacagttggggttcagggtgaccagcgaacccattccaatgctgttgttttaagggcaatcaccagtgaggatggcatgactgcagattggtactattttgaccatgcattcctggtagatgtggtaaaca

SEQ ID NO: 8458 - DNA, 582 bp, Sorghum bicolor
  Clone ID: SORBI-28MAY03-CLUS40538_1
gcacgagggactagcgaggctcgtcgtcttcattcgtagttcttccatcccctgtgcgcaactgagagcaagcaggcgaagatccagggcgtcgtcgtcatggatctggtgaacggcgtgctcaactgggtggggacgccggccatggtggcctgcctgctgctcttctacccgccctactacctcttcaagacctgctactccttcctctcctggctcttccccgaggacctcgccggcaaggtcgtgctcatcaccggcgcttcctccggcatcggcgagcaactggcttaccagtacgctctgaaacgggcctccctcgccctcgtcgcaagaagggagtcgagcctccgacatgtcgccgaccgagcactcgagctcggcgcgcgcgacgtcatcgtcctcccgggcgacgtctctgcccccgatgactgcaacagatttgttcagaccgcgatcagtcactacgaccgattggaccatctcgtgtgcaatgccggcatcgcgagcgtcggcgcgtttcaggagattccagatgtcacaaaatacagctctcagcttgatgtcaatttctggggttct

SEQ ID NO: 8459 - DNA, 718 bp, Sorghum bicolor
  unsure (1)..(718): unsure at all n locations
  Clone ID: SORBI-28MAY03-CLUS40654_1
gcacgaggcttcttcgcacatatacttgctcgacgacacagcaaatagtcttgccaaagctagctaggtatagaccatggctactgctctcactctcaagatggctgccgtctgcatgctggtcctgaccatgggccagctgatggcagctgttggtgcatcggcgccgctggtgcaggcggacgccgccgcgccgacggctcgccggctgctctcggcggaggaccatgagcgtcgtccagcctctgacgacgaccccgagtccgataaggccatggaggccatgatgctgctccggctcttgcagaagacgaagggcgcagctgcacctgcacccacgaagacgggcggcagctgcccctgcatcagccccctcgtgaatccgtggtgttgctttggtagtgctggcagcgctgccacaaactgaaatcttcatgagatagaagagaccatgtatagatggttgcggcctctaattaaatgtgtgcggtatggtgctttcgtatcatttctgccgtccaagtccaacaataaatatacgtaagatcgaaggtagttaattagccttcgatcggggtactacttgcgtatagagggatatgatgcatgcatcatgctgctacatgcatgcatgcacgtacgtagctaggtttgtttgctgttgcagccttgcaggcttgcacccacagtgtttgtgtccaagatgtgtcncaagtac

SEQ ID NO: 8460 - DNA, 698 bp, Sorghum bicolor
  Clone ID: SORBI-28MAY03-CLUS40635_1
ctttggaagcaaagcactctcagttggcgttgatgtttcatttgatacggcaactagtaatttcaccaagtacaatgctgctctgcgcctcaccagtccagatcttattgcttcccttcatttgaataaccatggtgataccctggttgggtcctactaccacttggtaaagcatcattcaggcactgctgttggagctgagctgtctcacagcatctcaagaaatgagagcacactaatctttgggtctcagcactcactggatccccacacgactgtcaaggcacgtttcaacaactatggcatggccagtgcccttgtccagcatgaatggcgtcccaagtcattcatcaccatctctggtgaggtcgacaccaaggccattgaaaagagtacgaaagttggcctgtccttggtgctcaaacactgaaatgctgaatgttttgggctctaggattttattttcggttcaggtggattggaataaacatggcctggagtcatctttgcggcaccattttgatcttgaattactttttttttctcacatgatcaatttgataggcaaatattaggattgaccttatgttttaattctcagcgccctgttaataatttctggtgattgagacctattgttaagcttgtcaaatatgatggtgattattttgtgttcacttcaatattcattcattcgt

SEQ ID NO: 8461 - DNA, 1295 bp, Sorghum bicolor
  Clone ID: SORBI-28MAY03-CLUS39792_1
ccaccgctcgccaagcccccgtcgccgccgactcccctgatccggccaccgttcgtttcttgatccggcctcccggcacctctcgttgcaggtaggggacatggccgaggaggaggcgccgccgccgccgcccaagctgctctacattgccgtcgccgacggcgggggccgccgggcgttccggtacacgcgccccgtgctgcagagcaccctgcatctcatgggatgcaagcctcgccatgccttcaagattagcaagagagtattcaatgtgatgaagagtgaattcttggccgcatcgaagtcagatggggcaatcgaacaagaaaattatcccgcccttagccttggggttggtacagatactccaaaaatgttggagagaagcaatagcagcataccgtttgaattataccagaaccagactaccattgttgtttcaagagaggagtttgtaagtgttgtatgtgatgccctctctttgtacaagtatgtcggacccaaccagaaagctgacctacttctcgcttgcagaattaaagagagaaaggaatcggtgacaatactcttgtgtgggacaagcggatgtggcaagtccactttatcatctttgctgggtagtaggttgggcatcacgacagtagtttctactgattccatacgacatatgatgagaggctttgcagatgaaaaacaaaatcctcttctctatgcctcaacctaccatgcaggcgaatatttagatcctattgcagtttctcaggcaaaggcaaagcgcaaggcaaataaacccacaattgtttctcatccaaataccagtggaggcaaagatgtgacttcagatgacaaagctcagcaaggatcctcagaattgcctcctagagctgaattgattggtaacaagcaaatggcagtagaaggctacaaggcgcaaagcgagatggtgatcgacagcctggatagattaattacatcctgggaagagcagaaagaatctgtgattgtcgaaggagtgcatctaagccttaactttgtgatgggattaatgaagaaacatccttccataataccatttatggtatacattacaaatgaggagaaacacatggaacgatttgctgtacgtgcaaagtacatgactctagacccagcaaagaacagatacatcaagtacattcgaaacattagagctatccaggaatacctatgcaaccgagctgacaagcatcttgtgccgaagatcaacaacaccaatgttgaccagagtgtggctgctatacatgccacagtcttca

SEQ ID NO: 8462 - DNA, 867 bp, Sorghum bicolor
  Clone ID: SORBI-28MAY03-CLUS39820_1
tcaccgaggcgccgccgcgtaccaggcgaagcggcaccggaaggagaaggagagaagcgagagtcttcctcgcccgtgcccaccgtagcaagccgaatccgaagagagcggagaggagagagagagagagctgagcgaggatgccgacggttacctgcaacgcgtgcaacacggggttcgacgacgaggagcagcagcggctccactaccgctccgaatggcaccgctacaacctcaagcgcaaggtggctggagttcctggtgtcacagaggctttgtttctggctaggcaagctgctttggcggaggggagcaagcctgcaagcaccccaatgctttacagctgtgccctttgtggaagcacgaggaggagctccaaagctcatgagcagcatcttaactcacgatcacatcttttgaaagcctctcaggagcccaatgcctctattgctggtatcacaatagtcaagccacttcctgaacgagtcccacgcaaagctccatctgcagttgaggaagatgaagacgacgacgaggaggaagagtgggttgaagttgacccaaatgagatggaggtggctgatgagtctacttcaaacatgcaagaagatgaggagtcctccaaatctgatgatgagatggctgatcttgaagagttggatatctcgtcatgtttcatgtgtgatctgaagcatgataccatagaagactgcatggtccatatgcataagaagcatgggtttttcatacctgacagtgaatacttgaaggatcccagtggtcttcttacttatgtcggattgaaggtgaagcgtgattttatctgcctctactgcaatgacagatgccagcccttcttcagtctag

SEQ ID NO: 8463 - DNA, 657 bp, Sorghum bicolor
  Clone ID: SORBI-28MAY03-CLUS39872_1
ctgatctcctgtacaagcttgtgaagcagtgtgaagccatgctggagcagctccttccggttagtgaggcatctgtatccagtgaagatgtaaaaggagacagtaatgatgaagagaagctggcaaagccgagttcttccttggtaaatggtggtggcattccagagttagatgagattgagtacatggagagtatgtacatgaagagcaccgttgcagcccttaggtcactgaaggagatccggagcaagagttcaactgtcagtatgttctcgttgccacctcttcagggcaacaatgcacaggacagttaccagatccgggcagagcaaaccaaactagatgaagagccagagaggtggagcaaagtaacagtgatagagcaggcggccaaatgacaggtcgaatgtgcaacatctgatgcctcagttcgtcacgattttagacttacatttgctggagatgaggctgggatctcaatctccctgtcgtatattcagtaatttgtatgaattcaggattcctaacagctgtaaaatggtggaaatgttaaatcatagaatcccagcacaaccgtgagacagaacagaactgattttattcactattgtgaatcgatcatgtatttttcccgatctacaatcgtttactgagttt

SEQ ID NO: 8464 - DNA, 652 bp, Sorghum bicolor
  Clone ID: SORBI-28MAY03-CLUS39985_1
cactcccagaattacaagctgcggcttgaaggtgcagcatcaaacagaatgagccaattcgctgttgttctagaggttttttgaagttgccccttctctgttcatggttgatgttcgaaaggttgctggtgatactctggaataccacaggttttacaagaacctatgcagcaaacttgacagcataatctggaggccaaccgaagtttctgcgaaatctacgctgctgaggacgaccacatgctagcccaagcactgagctactgatggagtgacaccagctgctgaggaagaccacttgctgggtcactgtagtggcaccaacaagagacgtgattcctagccgtcagaagagggggagcttctgttaaatctagcattgctcgtggacctgggattcgtgatggtttttgcagctgctttcgcaggcgatgtatgtaccatagttgagtctttattagatcagacgaggcggcttacaacactagttgtttgtatatttgtagtaatggtattggagatagtctgtatagctccagttgtgcagctgtatgtagcaggaacctgaatgtcaggtcgaatcgttgtttgcatccagtaaacaagatggctcatgtgatcaactgatcatgccaccaaatgccagatattg

SEQ ID NO: 8465 - DNA, 867 bp, Sorghum bicolor
  Clone ID: SORBI-28MAY03-CLUS40031_1
gcatctgggtctcgtgttctggggctctccggccccgctacccaggctgggtgaggtttgtgcagccccgaccgcagcccctccatcagggaatcagctcggcgctcaagattgcgcaagcaggctgaatgggaggaagtagccaatcgtgcagatttgctaaagcaggaaaatagttcgcttaaagaagaattgaaacaacttcaggagaagtgtgatagcttgacctcagaaaatacatctctacacgagaagcttaaagtgcttgaggatgagaaatcaaatggaaattggtgcaaggattaaaggctgaaacttctctctttctgactgctgatataatttggtggtaacctgataggacgacaactaaggaggtattcatgtacggtattagatttttgttcgaggggtaaaattgtatcataggaattgacatggttgatggctacgattcttcttccagttgcctcggctgctgtgctctgtgttgtttttcttcctctttgtgctagatcctacagaagtacaactatgtagaaaccccccaggtgttgtttgaagcgtggggattagcgaatggtatagctgttgtagagctgctcattgagcttcttgagagaaactgaagcgtgttaaagccatatttgatttatgattcagacggactattttacggatagtactgtagtaatgaatacacggatttcactcaatcacattgactgtttgcatccttgtatgggggagtgggcgtggaaaattgtggaagctgagcagtgtgtgctgttgctcatatgttagtgggtagttaactcagcaaatctttgtgaaatatgacctgaaaacttttgttcgtcttaaatc

SEQ ID NO: 8466 - DNA, 523 bp, Sorghum bicolor
  Clone ID: SORBI-28MAY03-CLUS40886_1
gcacgaggggcggacaagccggtggagagcggcgacgcgctgggggtggctggcgcggagaaccgcaacagggacgacgggacggcgaggccaggaggcgtggcagcgtccatggctgcggccgcacggctcaaccgtgacgaggcggtctgggatcagtgaagcagcgagcgagtgcgcgtgcgagcagctagcgcgctgccatggagaggagacgtgtcccggacccggagtccttgtttttttttttttgaaaaataagtccttgtttttttaaaaaaattcgctagctttggttttttttagttcggtagctccacgtatctgcaaaactgcaaagtagcgtgtcaatgtgccggctgatcaaaacgtgtgtatctcgacttcaggtgatctgagttgtatatagtagtgtactagtacgtgttgtagcttcgtgcaataataatgtagcgcgtcgagcgtgagatatcttaccctaaaccctaagtgtaagatatatgtacccagtgcacttgtagtt

SEQ ID NO: 8467 - DNA, 717 bp, Sorghum bicolor
  Clone ID: SORBI-28MAY03-CLUS40897_1
ctctactgcatctgcctcctctccccatggcgccgccgcccgcgtcgcctgctgactcggcacctgatccaaggcccatcgccagcgcgcccgtgcccatcaccgtgccgagcctgcgggaccacacgcaccaccacctggtcgatcgtcgggacacgccgcgggtccgcgcgtgggactgggagccggagcggaaccggcgcggaggggcgatggatggggctgcagcggccaagctggtgtccggcgaggccgggtacgtcttggaagacgtcccgcacgtctcggactacctccccgatctcccgacctacccaaatccattacaagataacccggcatactctgttgtgaagcagtactttgtaaacccagatgacactgtctgccagaagattgttgttcacaaggatggccccagagggaaccacttccgtcgtgccggacctcgccaaagggtatattttgaaccggatgaggtccatgcatgcattgtcacttgtggaggattgtgccctggacttaatactgtgatcagggaaattgtatgtggcttatctgacatgtatggtgtcaccaagatactcgggattcagggtgggtacagaggcttctatgctcgcaacaccatcaccttgactccaaagagtgtaaatgacattcacaaaaggggtggaactattctcggatcatctcgaggaggccatgacactgtga

SEQ ID NO: 8468 - DNA, 710 bp, Sorghum bicolor
  Clone ID: SORBI-28MAY03-CLUS40987_1
gacgcatagccgccaaacaaactcccgcaaagctgacgagcaccatagccaaatcaacgcatgcccgtggccaggagctttcacaaagctgtctccgtccacgagtgctctagctgacacctatcgccggcgtcaatggcgagctccggcgatgaagggcgcgtggtggtggacctccgctccgcggcggagtcggcggctgccgacgaggaggcgcacgccacgcctctccacgagatcgagtccctatgcatgcgctgcggcgagaacggcatcacgaggcttctgctgacgctgatcccgcacttccgggaggtggttctgatggccttcgaatgcccacattgtggtgagaggaacaatgagattcagtttgctggacagctccaacctaagggatgttgctatagcttgaaggttccgttggggcagagtgacatactgaatcgtcaggttgtgaagtctgattcggcgactatcaagattccagagctggactttgagattcctcccgaagctcaacgtggaacactttctactgtggaagggattattatgcgagctgtggatgagctgcaggcacttcaagacgaacgaaagaaagtggatcctcagaaggctgaagctatcgatcaatttttactgaagttgagatctcttgggtcaggagaggctgcattcacctttattcttgatgaccctgcaggaaa

SEQ ID NO: 8469 - DNA, 1144 bp, Sorghum bicolor
  Clone ID: SORBI-28MAY03-CLUS40993_1
gcacgacgcgagcgagcggcacgagaagggctagggttccggcgaggcgacggcgagcgccatggcggggattcggtggccgccggaggacccggagatcttcccttctcgcatggtcagcggcggggcctggatccccgtcgcgcccccgggagagatggcgtcggacgacgaccggtcggtggccgcggactcgtggtcgatcaagagcgactacggcagcaccctcgacgacgatcagcgctacgcagacaccgccgaggtcctcctcgcctcctcctccgcctcctccgcggccgcgccctccgcgtcggttgccgtccacccctcctccgacttcagcttcgacaaggatgtccctgactccagtgacgttgagcctcggttgctggggttgcagaattttcaggatggtgcttatgctgaggatcttgcaaatttccatgaacgcagccacgctgatgactggtttggcactgagatcatggatatccgtgtaggttggaccaaaaatttgtgctcaagcagggatttacccagctgcagcgtacttgacattgggactgggagtggcagactcttgcagcagcttgcgaagcaggggttttctgatctgactgggattgactacagtgaaggcgcgattgagcttgctcggaacctagcaattcgtgatgggtttgagcacattaatttcttggttgatgatgtattagagtcgaagctggagagaagatttgaacttgtaatggatgaagggactcttgatgcaattgggctccatcctgatggacctgtgaagagaatgatgtattggcagtcagttgctagcttggttttccctggtggtatattggtcatcacatcatgcagcagaaccaaggatgagctggtgcaggaggtagagaacttcaaccaaaggaagcttggtgctatgggctcagaaggattgccagctagtgaagctgcggtgttcagctacctcgaccacgtccaaagttatcctagtgtggatagttcttgcatcacgaccgttgctttcctgcataagtgaatgaaacacaaatgtatgtttggtttgttgggcctagaaagttaccatacctgctacgatattaactatgtatccaaatcactggtgtat

SEQ ID NO: 8470 - DNA, 895 bp, Sorghum bicolor
  Clone ID: SORBI-28MAY03-CLUS41014_1
gcacgaggggcgaccacggtggcgagagaggcgcgcgatttttactcgccgcggtaaccggatcttgtgaacacaagagctccatgtggccaccggccacggttcggcaatggtagtttcgtcacactgcctgtcttccaccactcgccgatggtgctagcatggtgggaggtctagttctgtcccaggcgcagacgcaccaggtcgccacgccaagaaccgccgcgccggcgccggcgcaggcgttggagaagaggccgtgggaccaggcgcagccatgtggcacggcggcggcggcggcggcggccgtctcggtgcggagcttggacgaggtcaggaaagcgcacgcgcggcatatcaagctgggcgtcgatcgctgcccgcggcacgcgcggccgctgctcgcggcgtgcgcgctctcgggctggccgggcggcatggagctcgcggcgtccatcttcgagtcgctcgtcgagccggaggccttcgattacaacaccctgatgcgcggccacgtcggtggcggccgcggcgaccgtgaaccggcggccgcgctgcgcctgtacgttgacatgctggaggcgggcgtcgggcctgacagctacacgttcccgttcgtactcaaggcgtgcgcgcagctcgcgtccttgcaacaagggagttgcaggcgcacatcgagaagctcgggctccagcacgacgagcacgtgcagaacagcctgatcagcttctatggcaagtgcggcgagccggcgatggctcgtctggcgtttgaccgggtggaggacgaggagcggacgacggcttcctggagcgcactcctcgcggcgtacacgaaggccgggctgtggggcgaatgcctcgagtcgttcggcgcgatggtgctcgatgggtgg

SEQ ID NO: 8471 - DNA, 454 bp, Sorghum bicolor
  Clone ID: SORBI-28MAY03-CLUS4792_1
gcgcggttggtcacggtccagcggcaccatacaagaaggccagcccaaggaatcgtttgccaaaaagctctcaactgaggagctcatcgagtctgttgttgcagagcttgaggcactggacattgacaagaaggatccaccagatgcgaatcctgacccaaagaaccagatggcgcgagacctcattaagcagacaagagagatggaggcgcaactcaaggagcgaagggaatgggcgcagggaaaggcaatacaggctgctcgcaagcttggtgctgatcttactgagctgcgtgtgctgcggatggaacatgatgagaaccagcggcgtaagaaggaaaagcaggtgatggaggatgacacaatgaagcgccttgctcatctagagaatgagctgaagaaaaagagtgggcagcttgaccggagtaacgcaactgtgcagaggctggaaatg

SEQ ID NO: 8472 - DNA, 841 bp, Sorghum bicolor
  Clone ID: SORBI-28MAY03-CLUS48004_1
gagatgctgatgaagacgatcaaagtgcagattctgattatgaggagaacgacgaagagcaacatcctgtgcatacaactatgatggaagcctcaacgcacaaaaggaagcgtcacagtgatgtgcctttgatcacatcaagctctcatgaaggaagtgagaggtctgatccccatggtgtcacagtggacatcaacaagactttcacagatgcaaccaacatgattttgttgcaacaagacttggcttcacaagccatagagattcagaaacgtcgcttgcagattgaagcgaaggaactggaactcgcaaagcaacgtctcaagtgggagcggtttagtaagaagaaggacagggagatcgaaaaaatggcattggagaatgaacatatgatgattgagaacaaacgcttggaacttgagctgagacataaggagttacagctagatcttaagctgaaaggctaggggaaccatctgtaacttttgcttaatcaacactcaatatgtaagatggtaaacaagtagcggttgagcttctggaatctggaagagaggtggtagattagagtagactctgacaaccattgctgtgcgtatgactttgttctgtgttcttctgtctgtgagatgtacttgttgggcctcctgctctccgcgacagtagtattgttgggcttgatgtgatctgtaagactgtgacttccaacttgcctagccaattttttttttcttccgcatgtatatcaaggtgatgttatttggctttggccccctctgaagctttcatgaaggtagtgagactattgggcctatttagtttgggttaaaccattgctgct

SEQ ID NO: 8473 - DNA, 628 bp, Sorghum bicolor
  Clone ID: SORBI-28MAY03-CLUS48048_1
gatccgctggtgaatggccctttgttcaggtgcagcagcttgcgcgtattgctatgagatgcgcagcagagaaaaggaggcggcgcgctgaccttgtcactgatgtgtggccagtggttgagacaatgatgaagaatgcctccttatcagcatgcccctcaacttcttcatctattcaggatgaaagcagcgtgccacattactttttgtgcccgattctgcagaaggtcatgaagaatccacacatagcagcggatggattcacctatgaagccgaggccatagaggaatggcttgaagcacatgacacatcacccatgaccaatctgccacttcgaaactgtgttacaattccaaactcagcgcttcgcttagttatccaagaacatcttcagcgtggaccatgactgatgcagatccttcgctgtgggagtttatgcctacaggctacatctgtatgattctcaattcattcctgcttggatcctgaaggggataaaagaaaactagagttttattttatttttcctttaaaaatcttagtgtatacaaaattggtcttatgattctttgtgtagcatgtgcataactggttgtgactatgaaagaaagtaaataggtaattgtc

SEQ ID NO: 8474 - DNA, 693 bp, Sorghum bicolor
  Clone ID: SORBI-28MAY03-CLUS48096_1
caggaacaatcgaagaattgctggatccattcctgatgagccgccaagctcccccagatcagatgtcgaagctcgtcaacatcgggctgctgtgtgttcaggacagccctgcagataggccgacgatgtcatctgtaagcgtcatgcttagcagcaacacagtctcgctccaggtcccgtcgaggcctacattttgcgttcaggagttggaaggcgactcgcacctttacacggatgcgtataaaagggcactaaagttgcagtccaccgacaaaacaaaggcaacgataatgtcgccgaatgaggtgtcgctcacagagcttgaaccaagatgagaatgagccttcagccttcccaaggtgtatcacgcagcctctcatatatatactctacttttgacaaataaatctcctacttgcccgagataccctaaccatgtgtttgtgcatttaggattctcttggcttgtaagaatgaactagctagggcctaggagtaataaaaaaaattaggaatatatattatgtaccaaaagatccagtcatataacatcatgttcagggtcatgtagggtatctacttatgccatttcaattcagtgtattggtgtaagttataaatctaaaagagactatatatgttttttttctgtgtatatttcgagagctcaatggattattacaggtatttctg

SEQ ID NO: 8475 - DNA, 813 bp, Sorghum bicolor
  Clone ID: SORBI-28MAY03-CLUS41222_1
tactggatttagcctcatctaaggaattgatgaggatcaatggcactaccaaatctgctctggctaatcacttgggcgagtcgattgcaggggctacaacaataagggccttccaggaagaagatcgtttctttgagaaaaatttggaacttgttgacaagaatgctggttcatatttctataattttgcagcaactgaatggctgattcaacgtctggagacaatgagtgctgcagttctttctttttctgcctttattatggctcttcttcctccaggaacttttagctctgggtttataggaatggcattgtcttatggtctatccctaaataattcatttgttttctctatccaaaatcagtgccagctatcaaatcaaataatctctgtggaaagggtgaaccagtacatggacataccaagtgaagcagcagagattattgaagaaaatcgaccatcaccaaactggccgcaagttggtagggtggatcttagagatttgaagatcagatacaggcaagatgctcctcttgtactacatggaatcacatgcactttcgaaggtggagataagatcggtatagttggccggacaggaagtggaaagacaactttaattggtgcattgtttcgtcttgttgagccaactggagggaaaataattatagactctgtagatatcactacaattggcttacatgacctgcgttcacgtttgggtatcattccgcaagatccgacactctttcagggaaccataagatataatctagatcctcttgggcaattttcggatcaaaaaatatggg

SEQ ID NO: 8476 - DNA, 1178 bp, Sorghum bicolor
  Clone ID: SORBI-28MAY03-CLUS41188_1
gcacgaggctcctcctcctgctcctcctccgccggcgattcgctcccgtccctcctctcgcggccacgccctccccggcgcctccgcaacctctcaccgccggcccccgcccgccctccgtcccccctccacgcctcgaacagcccgcctccatccgcgaggaggaaccccgatgagctcggagacgtgttgatttggatagctattcgtagagtgtgcaatggtggacttcgttcgacggctcgccgctgtcctgctcaagtgctgcgatctcgacatacccagtcggccaaagggccttgaggaccctgaacgcttggctagagagactgtttttaatgtgaatgaaatcgaggctctgtatgagctgttcaagaagattagcagcgctgtggttgatgatggcttgattaacaaggaagaattccaattagctctgtttaagaccaacagaaaggatagcatgtttgctgatcgggtatttgacttgtttgacacgaagcacaatggaattcttgaatttgaggaatttgctcgagccctttctgtgttccatccaagtgcaccaattgatgacaaaattgattttgctttcaaactgtatgatctcaaacaacaaggtttcattgaaaagcaggaggtcaagcaaatggtggtcgcaacacttgctgaatcaggaatgaatctttcagatgatattatcgaaggcattattgataagacatttgaggaagcggatacaaagcacgacgggaaaatcgacaaggaggaatggcgtagccttgtcttgaggcatccgtctttgttaaaaaatatgaccctcccatatctccgggatatcaccacaacatttccaagctttgtgttcaactcgcaagtagaggatgcgtgaggtcccagcgtctaaggcaccactcaagcccctggggcacagcagttcatgttctgtaggggcactagtgtgtttttgtttccttgaaaatgtaaattttatgtgctggcacgtcctccttttgtatagtgagtattgctattgtgcacagaattgccgcatgaagcgtttcttgtcatgtgtttataaaatgttcttcaaacatattgttcatcaaaagctaaagtaagatttgaaccgagtctaaaactactcaaagtcaattgaattgagtacaaatgatccc

SEQ ID NO: 8477 - DNA, 576 bp, Sorghum bicolor
  Clone ID: SORBI-28MAY03-CLUS41320_1
cgcgttccggacagaggcggtggactggggcctcgcgcagtcccccgggttcagcgccgtggaggtacgcggcgagctgcaccggttcgtgtcgcaggacatgtcgcacccgcggacgcgcgacatctacgagatgctccaccagatggagtggcagctgcggttcgatggctacagacctgacacgtcggaggtggcgctggacgtgggcgaagaggagaagcggcacgtggtcgccgcgcacagccagaagctggccatggcgttcggtctgctcagcacgccggagggggcgccggtgagggtcgtgaccaacctccggatgagcaaggaatgccacgcgtacagcgcgctgatctcggagatcttcgggcgggagatcgtcatcagggaccggaaccggctccaccggttcaggcgcggcgcctgtacttgcagagactactggtaacggtttcgttggtgtgaactgtgatcgatggtgtaaatatcaacagcgatttctttctttgtccctgcaattcagtgtatgtatgattcctttgctgtgaatggaatacacggtgcacgtcttcg

SEQ ID NO: 8478 - DNA, 691 bp, Sorghum bicolor
  Clone ID: SORBI-28MAY03-CLUS41331_1
accctcttgtaggactgctattggaagaacagccctgctgtacccacgaacatgttagttgtactattccttatcaagttctcagagccaatgagggaagctttctgcggatgattttcaagttgctgcaggagcacacagtgtaaatcaagtaagaagctgccgaatattcttttcacttgatctggcatggccagcatacagagttggggcagttgaggagcacatccagagggagacatctgatggcctcacggcgctagtcttttacagtatagcaatgatgggtagtgactgattgcacaggaactgactgcacactgactccagtcagcaggcttcggatggttcttggcactcaggtctccagctacttgtatcttgccatcttccgtttcatttttctgctcagaccaaggaatggaagtgctgctgcctatgtccgaagcttcaatgctccaccggccattacttatgttttagaatgatccaaaactcagatcctgctatttttttctctcccttctttttcattgtttttagcactcatgagttatttttgtagacgaccggtagaccattatcccttttctcattatcccttttcttcgtctccaccctctgctatttttaatcaagaagctattggaggaaatttgaaatttgttcggcattgcttggttttgccccc

SEQ ID NO: 8479 - DNA, 655 bp, Sorghum bicolor
  Clone ID: SORBI-28MAY03-CLUS41343_1
ccggtgcgggcggcgccgccgggcgctgcgccgacccggcgacacgggcgtgggctgtggtggagaccacgggcgacaggccgagcccacggagcgtgttctgcggcgccgggatcgggcggcacgtcgtggtgtttggcggcgaggtggatcccagcgaccgcggccgccgcggcgcccccggcctcgcggccggggcgcgcgcgcgccgcgcggggacccgcgccggcacgcgccgcgggggcgtcgccgccacgccccggccggcggccggcccgccgccgccgccccccccgcgcccgcgcgggtggcgcccgcccccggcgggcgcgcgcgtcggccggcctggccggcgggtgttgggcggcagcgcgccctccagcgcccggctcgacgtctgcttcttcgtcgcgcccgttcgtgaggctgcggcccctcgcctgcgcgcgcgcccggctggcgtgctggcggccgtgggtcgggttgcggggcgttcggcgcggcttggatgtatgtatgtaggttgtggtgattcttgtgagtttgtgacgcatcatctttgtggtcgtctagttttcttgctgttttttttttctttggtcggtttgtgggttttatgttgtgtgattggataacaaatcatggtataaccacc

SEQ ID NO: 8480 - DNA, 749 bp, Sorghum bicolor
  Clone ID: SORBI-28MAY03-CLUS41474_1
aaatattgaggatgcgacacagttgtctttgaagggatacattgatgttgagtcggttttggctggttatttgccacttcacctcctacttttgcctcaaaaagttatcttgaaatgtctaaacagtggagggccaccttttctactttttattggcatccagtcatctgctaacccaggagatcatctaacgttgttgctcgcttctcttgttgctttgaatagaataaaggaggtcaatgaagagctgaaggaggcagatttttttggggacattgttatagttctattcatggatgtcaagatgccgtagctttatctacagaacaaccggctatgaagcttgctcttggtcctcggctgctggtcacctggtgtaatcagcggagggcatgacagacacatggctgcctccatcatcctaagattgagaaaccgggcataccatgtctattgcaaattatagcctcaagaaagccatgtaggcctcacacctcaaggcttcagcaatatgggttgtgggcacagatcagggagagactttctgaagaaatcaaatttgtggactgcgtggataccaaggtcataatattgcaatcagagccttatcattttttcaccaaagcatcatcatgttagagaaacactacagcctttggctttcactaaaccaatgaatattttgagctcctaggttggttctttgattcacagttttctaatcaatatttgtcagacaatatttatcc

SEQ ID NO: 8481 - DNA, 648 bp, Sorghum bicolor
  Clone ID: SORBI-28MAY03-CLUS41549_1
tggctacaagcagctgcttggaaacggtgggtgggaacaatgcatggccaccctgcaaccagatgttgtgcagaaattagctagatacggagtatgatggcagtcgagaagcaagctcgtgtggcttattcacctcataggccatctttatggcggagacacagagaggagcagaaagggatatgagaatgtctgtctgtctgtgaggggtcgtcgagagtgtgggctgctgatgcatcttacaaatgtggcacttgagaatcgatttggttcgttgggtggtttgttggtaccccattgtatactggtcagctagttggtgcacagcacagccccaacgggagtgagtgaggtggacaagacatatagtggtaaaaaggcaacgggatggtgagaatgtttgtcaatctgtattggttggttgggtcagtggacttggttttgtttttgtcattccactggcaaacaaacccaccctattgagaaaacagaaaggttttgtagcgtgttattcttttttattttattttattttggttcattactaggtgtaggatcgttttcgagtcttgtttgacaggaagggtttgtatgaaatcaattcattgcccaataataaaaagattgatggggtttgtttctcctgcg

SEQ ID NO: 8482 - DNA, 774 bp, Sorghum bicolor
  Clone ID: SORBI-28MAY03-CLUS40710_1
atgcgcaggaggatggcactgtggtgttccaggatggcagctcaatcaaagctgatgtcatcatgcactgcactggctacctgtatgactttccattccttggagatgacagcactatcactgtggatgacaaccgtgtcgatccactatacaagcatattttcccacccgaagtggcacctcatctgtccttcatcggattgccttggaaggttattccctttccactttttgaactccaaagtaagtgggttgctagagttctatcaggacgggtcaaacttccatctaaagacaagatgatggaagatgtgaaagctttctatttgaaactagaagcacttggatggcctaagagatacacacataacttttcaaaccatcagtttgagtatgatgattggctcgctgagcaatgtggctatccaccaatcgaagaatggaggaaacagatgtatgctgttaatgcaatgaacaaggcagctcgtcctgagagctaccgtgatgaatgggatgacgagcatctggtggccgaagcaaatgaatacttcaagaaattcttgtaaaatcttactattctcatcccatgtttttttgacatgcctggggccgatctcaactgcaatatgcataatcatttaataagttaagtgatgtggaattgtggattggccacacttctgggttagcatttcattgatcattcgatcgatgtgtatatcagagagcaaacaatcttgtagtaaactgtggattgtcatcaacaaacaacat

SEQ ID NO: 8483 - DNA, 568 bp, Sorghum bicolor
  Clone ID: SORBI-28MAY03-CLUS40681_1
aattacgggatgtgttccgatggtcccgttgtaagaaggccatgcctgagagtgccatgcgctccatcggtatcccgctaccagcagaccagcttgaggtgttgcaggataacctagaatgggaggacgtgcagtggtcgcagaccagcgtctgggtggctgggaaggagcatcccctcgctcgagggcacgtcctcccggggtcccagaagcgtctgtgggtttctgggaaccagcatccccgcgcccgagcgctcttccccttcggccaactagctagaggcgccgaggtactttgccctctcgtctacgccggtgccgtgtatgtttgaggctcttgtactgtacaaggtgcgatgcaccatgtcatgtgtgtacaaaaagaaaagatcaactgttgtaggttacattattatttacatgatagtgtcttactgtgtggactataacctattcgttagggctgcttgctcctgcccatgcatgccttaaagatgtattgctggtgtgaggtccctgataataattgttgggtttttgtaatttgaattgttatttgatataatat

SEQ ID NO: 8484 - DNA, 1124 bp, Sorghum bicolor
  Clone ID: SORBI-28MAY03-CLUS40755_1
ccacgaggactcaacgctgttgtaccgctggccggggccaagctgcagcggttggtccgctcctggggggactgtggcggcggtgcggtgctgggctgcttgcagctgcggcaagaccgtggtgccctgcctgagcccaagcggtcaccttcggtccgtctaggtcgtgatggggatgttctcgtcgtgccctgggcctgccaggtcactggggcagggcacccacctaacgtcactgcgcctctcgccactgctttgtatgctggtgttgctcccttcgcggtccctcagggccctgcgcccacggtcgccgtgccgtgtgcgttggagccatccgtccggttgctccactccgtggggcggtgccgggggcaccctcttgcgcttgcgcctcaggccaaatatgagaaaacgaagatatacctctggcctggaccaatgaggagcggaatgtctgctgctggtaggactgttgagactgtgctgtacttggctggtttcagcaacgtcaagacaaagattattggatcaaggaacccacttaacgtgattaaagctctcttcatagctttgaatgctattgaaactccaaaggatgtccaacagaagtttgggcgtactgtcgtcgagtcatatttgttgtaaccatctgattgtttggaggactcagagagtcagaggcgaggggagcctctataggttttgccatgagaagacaaaggaggcaaatggcaggtccaaccaacgagagccctctttgttttggtggtgatgtccaccattgttgagagggtgcatgttgaagtggcaaaaatgtcagtgtcaacagtaatcagataaaatagacggtatttccctgactctgtagaacttgaatgaacctggggacacgcatttgagggttcttgtataaatactccaagatcaaagtcaaaattgccttgtctttttatgacgaggtgccttgtttttgttaccatagcttctccctgcagactgttgtttggatgataaaatcaattgaatattttttttcatgagttactgtttattgtgtatgcaggttctccctgcagactgttgtttggatgataaaatcaattgaatattttttttcatgagtt

SEQ ID NO: 8485 - DNA, 651 bp, Sorghum bicolor
  unsure (1)..(651): unsure at all n locations
  Clone ID: SORBI-28MAY03-CLUS40770_1
gctgagcgtcccataatcaatccaccagacaaagtttcaaggcgaagatggtcacccaaggatgtttttgttgttatatctgagaaagaatgaacttcatcaaatcacagttaacatgagagcaagctcccgaccagtgaccatgcctaaggaaaaacaggcagcaactagcgcagagagctgtttgattcagatgcacatttagcagaaggcaagcgctgagcgcgaaggagcaaaacatgatcagattttggatcagtctagatggatacttcaggttgccctttacaaaaaggatgtgaacagaatatgcagcacatgctttggaagtttggatcggtccagttcatttgtatattctcgtctgtgtaagttccacataaacaacgagcaaagcatccccctggcttaagccgagggtttaaagctatttagtgagcgggaattcaattttccagtgaggctgtggtaccctagctatagagtagaccacagcggtagttcagcatgacagttccatttcttaggctgttcagcattttgtacaaattgaggaaaccatatttgtccttatgttaggaacaatttctgccgtattttgtcaacacaatgagatgccggccagtccatgtaaatatgtaanggaagatc

SEQ ID NO: 8486 - DNA, 597 bp, Sorghum bicolor
  Clone ID: SORBI-28MAY03-CLUS40794_1
tcaacatctgtggcaccaccagcttcatccgtgatgcctacagcaccacctcttcatccaactccaacagctgctcaacgtcctccatatggcactcccttactccaaccttttcccccaccgtctccacctccttccctgacccctgcacacaacaatggacctgttatttcaagggatgaagttaaggacgccctccagagacttgttctgaatgacgagttcatcgatttgatatatcgtgagttgcaaaatgcgcacatgtagactgctcactagtctgtatggagtttatctaaaaccaatgatagtcttatggagctgcttgccgcgacaaagattgtcccccttgtttttgttcttgtcagttttgtatgatttatttcttaaaacttgtgtatagcttgtcaaatgtagagtgcttatagcagtgcttgtaagcatttatcctgctggttcccaaataactgtattgtcatatagtattcatgtaaccgagcaccaagaatgttagatttcgagatgcccgttctggggcatctggattttgtaaaacaggacttgtgcagggattttaaatgccatatttttcgtgtg

SEQ ID NO: 8487 - DNA, 589 bp, Sorghum bicolor
  Clone ID: SORBI-28MAY03-CLUS4810_1
gcacgaggattttacattatagtattccttggaacccacgcgtccggcatattgaggtttctggatatgtcacctgcgtatcatttttttctcagcaggaaaatgctactgaacctaacaaggagacttcacacagattatctaacaagggtttacaaactgatcgttctatacagccagcaagttcaattggtagttggtactcagagtacacaacctgaaccacagcctgtatcatcgactcccgaactaaatcggtcgccaaccggaacaacacacacccacaggaaactgtttggagaagacactctcactgaaaaggaaaccatagtggatcaaaatttgaacgcaaaaggaatcataacgacgaccgcaacagtccaatggatccactactgcagccaaaagaaaaaaggctatagcgaggctctatcaaagctaacataaagtttgatcttttctatgttggccggccttagtttttaaagtaaatgagttttaggagttctgagaaatattgagggactcaaaaccttttaatagtaggcgctgaattgaaactgtacctgtcaaatgcataatgacatat

SEQ ID NO: 8488 - DNA, 714 bp, Sorghum bicolor
  Clone ID: SORBI-28MAY03-CLUS41722_1
tgaggacccagatgacccaaagaacttcagaaagacaattgggaggatcatgtcaatccaatacaaaataccggagtatgtgcacgtgtcccaagactgcaaggaactgctctctagaatatttgttgcaaactctgcaaagagaataacaatcagggagatcaggaaccacccctggttcctgaagaacctgcctagagagctcactgaacctgcacaggcaatgtactacaagaaagacaacagcgccccgacttactccgtccagtccgtggaggagatcatgaagattgtggagaaggcgcggacgccgcctccttcctccacccccgtggctggctttggttgggccgcggaggaggacgagcaggaggacagcaagaatccagacggaaaacatgaggaggaagaggatggtgaggacgagtatgacaaacaggtgaagcaagtccatgccagcggggagtttcatatcagctgaggcctgagggtttcgccggcgacagaggagaccccaaacaggagatgttgtggtagcagctgatgatggacctgatagtttgtggtcttgtttccaagttttctttcattttttttcctgtgatgcctcaagcctgcaacagtgtaaagtattgaagtggttccagcattgcccttgtattgactgattaaagccagcatggggaacataattatggaataaaacatctcgtg

SEQ ID NO: 8489 - DNA, 730 bp, Sorghum bicolor
  Clone ID: SORBI-28MAY03-CLUS41818_1
gcacgaggcttttctatttggttttccctgctgtttcgtttctgcctgcctcggcctcctgccagggtttttccttggccagccggcggcgggggtggcggcggcggctggaggacctcaacccaccttcaacgccagctcgttcatcctggctgctgcgcccgggtcggggggccaccgttgctgggcacctgccgtcctcgcaggtcgcaagcggaggtgggatttgttaaatatctgagatggcagaatgtcagatacaagactggaagcaccagcacccttcagctccagactcagttagtagacatgaagcatcgataccaagaacaaggcaaagaaacatttttggtctattagctcagcgggagctctcacctcgaacaaaaaaccaagcgaaaaatctttggaccaaacctccaagacgtgatgcttgtcctgttgaattaaaattttggggcactgatgctcggcatgatctcctttcttgggctgaatcagagttcttgcgttggtggattcccaaatattgccctcttctgccttcttcgaaggcaactatcgcagctgcatttagtccagatgggagagtacttgcatccacacacggtgaccatactgtcaaaataattgattgccaaactgggagatgcttgaatgtactgcttggacatcagcgcactccatgggtggttagattccatcctcagcgttcagatattcttgctag

SEQ ID NO: 8490 - DNA, 1230 bp, Sorghum bicolor
  Clone ID: SORBI-28MAY03-CLUS41841_1
cacccaagcagcgtttgcaccgacgtggccgaatccacggtgccatgggccatgggcggcgataaggcgcgagcggacgatagaaagccgcggccgccaactcgcccacgcagcaaggcacgggccactcccgccttcgccacccgcctggcgcctgcctgtggtcgcctgccgcgtcgcgtgtcaccggctcaccgcactcacaaaaactgcaagacgcctgggccgcgcacgctgccaccaccgccacccgacccgaggagcatgagcatggcggcgccgtcgtcctccctcgcctcttcctgccacatctcccgccgcgccaccgccaccgccacgcacgaggcccagtcgcactcgcctccgctgccgcagcagctccgcctcgggtgcttccagcgcggcgcgcgcgcgcagagcgcctgcagggcggcatcgaggaggcgcacgccaggtgtttgcttcgtggtctcaccaagccagccaggtcttgctgcgatcgacgtaccggcggcgcctaatgcgacgaccgtccgcgaccgtacttcggtgtcctcgcttttggaggttgtttcggacgacttgctgaaactaaacaacaatctaaaatcgcttgttggtgcagaaaatcctgttctggtttctgcggctgaacaaatttttggtgccggtggaaagagattaagaccagcattagtttttctggtgtctagagcaactgctgagttagctggtttgtcggagctaagtacagaacaccaacgattggcagagattatagagatgattcacaccgcaagtttaatacatgatgatgtcatagatgatagtgggatgcgaagaggaaaggaaactattcatcagctatatggtacacgggtggctgtacttgctggtgattttatgtttgcacaatcttcttggtttcttgcaaacctagaaaacattgaagttataaagctgatcagtcaggtcatcaaggacttcgcaagtggtgagataaaacaagcatccactctttttgactgtgacatcactcttgatgattaccttctcaagagctactacaaaactgcatctctgatcgcagcaagcacaaggtcagccgccatattcagtggcgtcagcaccagtatttgtgaacaaatgtatgaatatggcaggaatcttgggctgtccttccaggtagttgatgacatcctggactttacccaatcagggggggcccgg

SEQ ID NO: 8491 - DNA, 665 bp, Sorghum bicolor
  Clone ID: SORBI-28MAY03-CLUS4189_1
tgtttcttctgcttaccatcatatgtatgaccggaaattagagaaggttgtcaagagcgaaacatctggaaactttgaatttgcacttttgactgggctcagatgcgcggaaaacccagcgaagtattttgctaagctcttacgaaaggccatgaaaggtttaggcaccgatgagaagacacttacaagggtcgtggtgacgaggactgagattgacatgcaatatatcaaggcagagtacttcaagaagtataagaagccattagctgaggctatcaactccgaaacttcaggaaactatcgggcgttccttctttcacttgttggtcatggccactaggctaggtttcgaccatgggagatgatattccatcgatccaccctaaatgcagcgatctaccaggaaaacttatgatgttgccatttatctgtcgtgactcgtggattcgtctaactgccgcatatgtggttcccagtatgcttgtctaatgtattcgtgtatatatttggattgaaactgggtttcttgttggaaaattctggatggggcatagagctgttgctggtcacggtgggcttgacttgacttgtctctatgacaccaataatattatgtaatgtttgtgtgtggtcattccatttctttcgtcagcgaatcagttatt

SEQ ID NO: 8492 - DNA, 761 bp, Sorghum bicolor
  Clone ID: SORBI-28MAY03-CLUS41894_1
gcacgaggcttcttcagcttcagtccagtcacaactgaatccgccgcgcaaggcatccaaggatttgttcgtccttcggagggtggggaatcgaagcgacgaaaacgaagcaatgaacgaggcggtgcaggaggcgaagctgctgcggcaggtgaacgcgctcatcgtggcgcacctccgtagccagaacctcgggcaggccgcagccgccgtcgccgccgccaccatgacccccatctccgccgccgaatccgtccccgcaaatcaactcctacgtctcgtggccaagggcctcgcggcggagggcggaggaggagccgcttccgcattcgactccgccgggttcggtggggcggtgcagccgctcggctccagtgccgtggatttcagtatgcaggatgtcaagggctcatccaagagcttccccaagcacgaggcgaagcatgtctctgaccataagaacgctgcccggtgtgcgaaatttagtcctgatgggaagtattttgcaactgggagtgctgatacatccattaagttttttgaggttgctaaaattaagcagactatggtaggggactccaaagatggtcctgccaggcctgtgattcgcacattttatgatcacacacaggccatcaatgatctggattttcatcctgagagtccaatactgatatcagctgcaaaagacaatacaataaaattttttgacttctcaaagaccaatgcgaggaaagcgttcagagttattcaggatactc

SEQ ID NO: 8493 - DNA, 1485 bp, Sorghum bicolor
  Clone ID: SORBI-28MAY03-CLUS41926_1
gcacgaggcaatgattatgtcggtaagggcttatctggtggaaaaattgttgtgtacccaccaaggaacagttcttttgttccagaggataatattgtcattggtaatgtggctctatatggtgctaccaagggagaggcatatttcaatggtatggcagcagaaaggttttgtgttcgcaactcaggtgctcaagcagtggttgaaggaattggagatcatggatgtgagtacatgactggaggtgctgtggttatcctcggaaaaacagggcggaactttgctgctggcatgagtggaggcattgcctatgtttatgatgttgatgggaaattcagtgctcgctgcaacaatgagttagttgacctatatcatgtggaggaagagggcgccagcatcacattgaaaatgatgattgagcaacatcgtcgcaacactgagagtgttttggctagagacatactctccgattttgataatcttcttccaaaatttgtaaaagtatatccaagggattataagagggttttagaaaacatgaaggcggaaaaggctgttgctaagcatgcaaaggagcctaaggtggcaaatggaatttctgtgacaactaagaaagtacaacctgatcagtcagcaagccgaccaacacgtgttgccaatgccaaaaagtatcgaggttttattacatatgagcgagagagtatttcttacagagatccaaaagagcgtgttaaagattggaaggaagttgcaattgaatcaacacctggcccactattaaatacacaatctgctcgttgcatggactgtggcactcctttctgtcatcaggaaagctcaggtgctggttgccctcttggaaataagctcccggaattcaatgaattagttcaccagaacagatggcgcgaagcattggatcgattacttgagacaaacaacttccctgaatttactggacgagtttgccctgctccttgtgaggggtcatgtgttcttgggatcattgagaatccggtgtctatcaaaagtatagaatgtgcaatcatagacaaaggtttcgaagagggatggatggttccacgacctccacttcaaagaacaggaaggaaggtggccattgttggcagtggaccagctggtttggctgctgcagatcaactaaataaaatgggccatttcgtaactgtgtttgaacgtgcagaccgaattggaggtttaatgatgtatggtgtgcctaacatgaagacagacaagattggcattgtccagcgccgtgttaatttaatggctgaagagggtgtcacatttgtggtgaatgccagtgttggtagtgatcctttgtactcaattgaacgtctacgttctgagaatgatgcagttattttggcttgtggagcaacaaaaccaagagacctcactatccctggacgtgagctatctggagttcatttttgcatggaatttctccatgcaaataccaaa

SEQ ID NO: 8494 - DNA, 790 bp, Sorghum bicolor
  Clone ID: SORBI-28MAY03-CLUS4103_1
gcacgaggctgctgctctactgtgctttgtggtgggctggtggcagcggcggcggaccggcgacagtggtgatggagttcacctctaagcagaaggctgtgcttctcctctgcttcttcatgctctcctgccttcttcttcttccccgggcttcctctgctgcgcctctttccagaagcctgtcgctgacgaaccgccagctgcccacgaagaaccctgctctggaggtgcctgcccagcaggatcagggtgcggtggaagatggaaacctcggcgaggtggcggcgaggatggacatcgaggtgaacgactaccctggatccggtgccaacaaccgccatgaacctaggagccctgggagaccatgaactttgcttgacgccccgtcatatatatcatccctgcgtacgtctcacagaagaacgaagagcatggcatggagtcttgagagttttataattaagctactaagtacgtagcatgcagcaggagtacattgttagctataaattctactagagcttattaacgagtcttgtcgtgtatacttaattacgtagcttagtacttgtatacgtcgatcgtatcgtggggtgtggtacggccggtggtgctgaggccgtctaagctagctgcatagtattttgttagggccttcaacaacgcactgtcagaagatcaagtgaacgagctggccgtgctagctgttccgtgtatagccagcggcagtcttgttcgtttgagcttatcagccgaatctgctagttatttagtagtatttttctctccc

SEQ ID NO: 8495 - DNA, 722 bp, Sorghum bicolor
  Clone ID: SORBI-28MAY03-CLUS41074_1
ctggcagcggcggtgctggtcttcggctgcgcacctccagggcgtgaatttgtcactggttcatatgatagaacagtaacgatctgcaagtgtcccggggtcctctgcaggggcgtttctcgcacctcccggatgcgaagcgggttgtgtggcatagacacctgccgtggcccctttccaggcccgcccaccgacggcgcacgtcgtcggctgcggaagtccgcagcgtcggaacaacgcggaggccctccgccccgggggccctgcctgcgcggccccccgggtgctgtggaggcgccgtacaagctgcgcccgcatgcggtgcgcagcgtggggctcgggcgcctgccgttgcctgtctccggggctgccatccgacggcgtgcgatgtgggtgccggaagtccggagagcggtaggttgccccccccacagcgctccggggtccatgccccggctgccgttctggttgcggagaatcctcaaccaagttgtggtggccggcccgggccgtggagtttgtgttgttgaggcggtgctgtgatgagaacgcatgtttcccattgagagctgagctccagttttgccccttgctaccatatatatatatatatatatatatttgaaataccaaaccaatattcgtatcgagccactgcgttataagagtctgtaaccatgagcaatccgaattgaagagtgtaaccaaaatatttgaaatac

SEQ ID NO: 8496 - DNA, 737 bp, Sorghum bicolor
  Clone ID: SORBI-28MAY03-CLUS41079_1
acagttttgattcaacgagtggcattgttgagtgtgccattgttgagacagcggatggcagactcgggtgcttaactattgttgatggcacagccgacctgtattgcaagaattggcaaagcaattgtgttggcagacaagagtggctgcatgacaagcaaatttcattgcccaaggattctgggatcacttatcattgggaggttgagggcacagcaggacattacttagctctagtaggtgagtcgtcgcgaaattctgaacattttgtgctggacatcaagacatttcttgttgagaatctctgcatctcgtcaaatggtgcgatctttggttttccttatgcaagatttccaccaccattggaactgccaagcatatgaaatgatgatgaagaagaggcacaagattgagcgggacatgagcatcggcaaggaaggcagatggccaaagaatcagcaggtgtatgaacaagtagtttgtggtgattgagggttgtcatcactagccaacatcatgtcgtttggcagcttggccatgcactcctagctagcaagctctagctgtgaaagggaaccagagacagccaagacgacacctttttccgccttgtgaattttatcatgatgtgatattggtgtacgacatgttatgagattgctagactgaattgtacaattgcgttgttggcttcagagaagaataaatagtagttaaaaaagaaatcctataaaaaa

SEQ ID NO: 8497 - DNA, 779 bp, Sorghum bicolor
  Clone ID: SORBI-28MAY03-CLUS4110_1
gccggccgggcctcctggtggcataggtgaagaggggggtctcctactcgctcctgcttccacctattaaaaaaaaaaaaaaaaaaaactccccgttccacccgcctctcccgccgcgagatccggctccgcttccagaatcttctggaacgggcgttccatgagcgtctgatcggccgccgccatgggctgcgctggatccactcccaaagtcgatgagaacagcaagaagttgaaaaagcctaaggcttggaagcatactcaaccaattacaccagcacaacttaaacagatgcgtgatgaattctgggacactgctccacactatggtggccaaaaagagatttgggatgctctaagagttgccgcagaatctgatttagcccttgcgcaaaccatagtggacagtgctggaatcatcatttccaatcctgacatgacgctttgctacgacgagagaggtgccaagtatgaactgccgaagtatgttttgagcgagccaacaaacttgatccgcgacgggtgaatctggacccccacgagcagggccacgtaaattatgtgaatgttgatttggtcgctgattctgggctgcaactttcagtctttcagagataatgaagcttctttccgcgctgtatagtaatcttatcggacatgctgtagacctgccactgaactcggttatacaggagagtgccgactatggtgcatatacatatgtaatcatcagtccatcctttgcacgtggagaaaaactacacatgtgcctgtctgcg

SEQ ID NO: 8498 - DNA, 704 bp, Sorghum bicolor
  Clone ID: SORBI-28MAY03-CLUS41101_1
tgcaaattaaaggacatgctgaatcaggggtctctaaatgggcatccaaattggatgagctagaaacactcttcagtcagaattttgtgctcttcattgaccgctcatctgcatgtagtgacgagcttaaagccctgaggaagaaggtacatgatcatcttaaggaacagaaggaacttgccaatgtgaacaatgagctggctattaggttgaaagagaaagaaatggtagtgtcagaaatggcgaagagtgctgctgaggcagaggcaaagatgctccagctcgagaagacagtggacgagaaagaagacgagctagcagctagagtgcaggagaagagagaagccatcaagcagctgagcgacaccattgtttaccacaagaattacagcgatgacctggtgcgctacatccgcagtcagagtcgccctcgcctcccgttctgcctttaaatttggaagtcagaaagatgtaaaggctccattctagctgtgaatttttgcagtaaggagaccattgccatttttcttatgtatcatgtatagggctcaaatactttctggaggtagtcatatactcatattcagtggcttgtgcattctattcgctactaaggggactgctgtagtaattaatttattcgttttgccttatttttttatcggattggtcaatatactacctgagactgcgaaggtaagctc

SEQ ID NO: 8499 - DNA, 612 bp, Sorghum bicolor
  Clone ID: SORBI-28MAY03-CLUS42332_1
gcacgagggccttcccccgtggctcgagctcttccacccgccgattcactcagctctagcgatcgcgcctccaacctcccctaatcccctcgcgcccagggaggaggccgggtcgcggcgagcgacgattccctccgattcctcgcctcccagaagttccgaaccgctcatgatggctatgcagcagcagcagcagcagcacgcggggtcggcgtccgggtcggcgtccgggtcggcgtcgagctccagctcggggctgcaccttctcgcctcgccctcgtccttcggggacaccacccacaccaaggttttcgtgggcgggctcgcctgggagaccaacagcgacaggctccggcgcttctacgagcgcttcggggacattctcgaggccgtcgtcatcaccgaccgccactctggccgctccaagggatacggattcgtgacattccgtgaagccgattccgcgaggaaggcctgcgaggaccccacgccggggatcgacggcaggcgggccaattgtaacctggcttcgttgggtcgagcccagcatcccgtgcctcctggtaatggtaaaatatccttatactttctaccgatttgcagtgtacttgt

SEQ ID NO: 8500 - DNA, 597 bp, Sorghum bicolor
  Clone ID: SORBI-28MAY03-CLUS42459_1
gcacgaggcttttttccctgtcgccggcggcgatagggttccgttttccttgctccggcgggccgtagatgcttccggccctctccggcgcctcagatccggcggtgaccgtgctcttgttcgttcttctggtcttgattcgagtgggaggggaaggggtccctttggtcttgggagattcggagacatgcctgcgctctacgcttacggagatggcgggtgcctcgtctcggcgccggctgagctgtccgggctcttctgccgcggcgccgtgcagcagcggaagcgcacgctggtggccgcgtccgcggtcgccgtggcggcggcggcggagtgcgtgagggcggccaagaaacagaggcagcagctgccgctgccgctgccgtcgctcgacgcgctcccggacgagtgcctcttcgagatcctgcgccgcgtgcccgggggccgcggccgcggcgcctccgcctgcgtctcccgccgctggctcgcgctcctcggcagcatccgggcctccgagctcggccaggccgccgccgcggcggacaccccgtcgctgcccgacctgaacgaggagttcgtcatggaggaggaggataa

SEQ ID NO: 8501 - DNA, 1098 bp, Sorghum bicolor
  Clone ID: SORBI-28MAY03-CLUS42526_1
gcacgaggccccggcggcctgccgctccgccggcgcggccaccgcccgcgccggccgctcctccgcggccggccccggctcggccccatgcagtggcgcctgcctcctcccgcccccggcgcccccgcccgggcccccgccgcggcctcgccgtctccggctcggtccccctcgcctcgcgcccactctcgccccccgccgggccgcggccggtgctgcgcggaggcgcccgcccgttccggctgggtcgcagggtcgagcccgggctgtggctcgtgcagtcgcgccacatatctgatggggagggctaccttgaaaggacgtttctgagtccagcttctatcagagccactgctgtcatcatcagctggatgaaagatgctggacttacgacgtgggttgatcaaatggggaatattcacggtcgatttgagccgacaaattctaccaaagaggccttgttgattggatctcatatggacactgtcgttgatgctgggatgtatgatggatctttgggtattatttgtgcaatctctgcactgaaggttttgaaagttactgggaaactccagaggctaacgagaccagtggaggtcattgcattcagcgatgaggagggtgtcagattccagacaacttttctgggaagcgctgctgtagctgtggtactacagtacaagatgttctgaaaatgaattcttttgaggctacctctacgcccgtgggtcaagccaagtacaacccagagtctgtggggagttatgttgaggtacacctggagcaaggccctgtcctggaagcccttcgttatccacttggtgttgtaaaaggaattgcaggacagacacgattaaaggtaatagtagatggttcgcaagggcatgctggcactgttccaatgaaattgcgccgagatccaatggttgcagctgcagagcttgttgtgactctggagcgcctctgcaaagagcccaacaagttgctgacctacgacgaggagtgcagctgcttcaccgaggagtccctagccggcctggtgtgcaccgtcggcgagctgaatacgtggccaagcgcgagcaacgtgattccgggcca

SEQ ID NO: 8502 - DNA, 688 bp, Sorghum bicolor
  Clone ID: SORBI-28MAY03-CLUS4240_1
gcacgagggagagctacagctgctggtcccgcggagttgtgtgaaccaagctgctggtgggctaccgcctggccgggaacttcttgtaaaactgtcgggctttacatgaacaatcccagcaatggcagcaaagtgtgctctttccgcaccatccttatcggctcaccgacccctctgccgcaacaggcttgctccatgcctgccatcgccaagaccagcaagagccgttgctctgagagtgagtgctgcaaagcttcctccaggggttgaagtgcccagggtgcagccaaagctgagcgagcccttcttggggttcacccagactgctgagatctggaactccagggcctgcatgattggcctcatcggcaccttcattgtggagctggtgctaaacaaggggattcttcagatgattggggtggaggtgggcaagggtctggaccttcctctttaattaatagccatggtattttcatgtgctggtacggtggtgtattgttggccaaagatgaggatttcacttgctgtcaactacttccgcaaagatatttgggagagtttcagcagctatatatgcttgttaataaccattttcatatggatatccggatgtacgttacaagatcagtatattaatgagctgctttctttatactctgagaaattaaagcaaagatcagataat

SEQ ID NO: 8503 - DNA, 484 bp, Sorghum bicolor
  unsure (1)..(484): unsure at all n locations
  Clone ID: LIB3478-001-P1-K1-B8
cccacgcgtccgctaccgccgccgccgccgcccttctacgccaccttcgccggcgaagagcgcccgccagcaatggcagcaaagtgtgctctttccgcaccatccttatcggctcaccgacccctctgccgcaacaggcttgctccatgcctgccatcgccaagaccagcaagagccgttgctctgagagtgagtgctgcaaagcttcctccaggggttgaagtgcccagggtgcagccaaagctgagcgagcccttcttggggttcacccagactgctgagatctggaactccagggcctgcatgattggcctcatcggcaccttcattgtggagctggtgctaaacaaggggattcttcagatgattggggtggaggtgggcaagggtctggaccttcctctntaattaatagccatggtattttcatgtgctggtgggtgtatgttggccaaagatgaggatttcacttgctgtcaactac

SEQ ID NO: 8504 - DNA, 919 bp, Sorghum bicolor
  Clone ID: SORBI-28MAY03-CLUS42550_1
gcacgaggccactccatcaggcagggtgcaggcacgcaccagccagccagcgccccgcccaccaccgagaaaacaccgcaccacccgcccgcccgcccggccgacatcacacgaccgcccgatccggccggagcctccctcccttttacccctcccgcgcctccgcctgcgcctccgcgctgacgcccgccgcggcgtccgcccccccgagtccaaccccaattctgccggggcagcggctctccaaatccccaattttttttttccctgccccaaaggccgcggggatgaaccggatcccgtccgtctcgctgcgaggcggggcggacgaggacgccgcggcggcgtcgccgcccgccgatcccgcggcgctgtcgcggtgggtgcgggccttctccatcatccggttcgacctggagcgcgggcagctggtggaggcctgctacccgcccgacgcgctgacggcgcctggcggcggcctcgaccgcctcgtcgccttctcctccttcccggactccatgtcccaccacctcccgcgccaccgctcctcgcacgaggactcgctcttctcctttcgcgtccccgacccgtcctccccccgccgcgctttcctctacggcttcgtcttcaaccgccagcgccaggacgagcgcctcccccgcggcggcgagcagaagtccgtactcatcctctcccacgccccctactcctcgctcttccgcctgctgctgcagatcctcggcccgctctgcttcgacgtcggcccctccgcgctggctatggtggcgtcgcacgtcgccgcgtggcccgcgccggcgccagggcgcccaatggagcttccaattggcagtgccgcgctgcgcgtgcaccttccacctgcggctgacgaccctggtccgccgcctgcgctgctgcccgg

SEQ ID NO: 8505 - DNA, 797 bp, Sorghum bicolor
  Clone ID: SORBI-28MAY03-CLUS42645_1
gcacgaggatcagtcactgcaaataaagatcaccagtatatctatgagatactgttggcatctggtcttttgcacaaagaacatagtatcgcagtattacctggtcaactccaaccatcaaattatccaatcaatccggagctcttcctcattcttgagcaaacaaaaccagacttagtttctgccttccaaactgtcagcggagctaagaaaagttgtaagccttgcacagggaggcttcatcgaagacttgtgtttgacctggtaaatgaaacaatagctcagaagatgagcgtctgtagatctggaaggcagacagtaaagtttcttcaatcaaggaagttaagtgggtggcaactattcaaggatttgtgcactgaggttgacaggctaataaaatgctccgacgaggaggagaatgaaaacatgatatttgatgaggatacagttaatggaacgaaagactggatgagcttcgacactgtgctacatggcatggtttgggaaattgaacgatccatcttcaagggccttatcgacgaggtcatcggtggtgagactacagagaagatgcaatttgtacaaaggaaactgcagaggcagctttctttcagtagtataaactgaatatgcgctgtagtagtcatttccattaagaagcttatagcaagtagcaactagttcatgtaaccttttctattttgctaaagactaaactgtagaatgagtataaatgatcctcaaaactagtcttgctcccagaagaagcaagaaatatatataatatattcttagtg

SEQ ID NO: 8506 - DNA, 695 bp, Sorghum bicolor
  Clone ID: SORBI-28MAY03-CLUS41558_1
tctgttattgcacatgaacttgggcactggaaactcaatcatactgtctattcctttgtagctgtccagctgcttatgtctcttcaatttggaggatatactctagtgaggaactccaaagatctatttgaaagttttggcttcgaggaccagccaataataattggattgatcattttccagcacaccataatacccacccggcaccttctgagcttctgcctgaaccttgtcagcagagcatttgaattccaggctgatgcctttgccaagaaccttggatatgcccctcagctccgagcggcccttgttaaactacaggaggagaacttgtctgcgatgaacaccgatccttggtattcggcatatcactactcccacccacctctcgtcgaaaggctgcaagctcttgaagattcagacagcaaaaaagaagactaatcctaaccggcagccagagctgctgttcctgaagggccaaagcctttgatcttgtatgagactatgaggtttccatatatatgtccctgccgtgcgcaaggggcactgattcagtggttgaatgttgagggtttcgatacatgagagtgttgtcaaagctatgaagcgtccagcttgtgtagcagtctatcggttagtgagaaatataagcaaatcagctagtttccaaaaaaaaaaaaaaaaaaaaaaaaaaa

SEQ ID NO: 8507 - DNA, 679 bp, Sorghum bicolor
  Clone ID: SORBI-28MAY03-CLUS41610_1
tctgacttctttgacccgtgctgtgaggagaggtggagaaaatacaagcattgaggccaatggaaactcttatgatctctcaacaaaactgctccatcttgcgtggcacccaaccgagaactccatcgcgtgtgctgccgcaaatagcttgtacatgtattatgcataggggaaagtgctagagaaaattggtagttttttgtttgcttgctcgatgtgaaaggccatgttcaaggattcaggtgcaggaaaattgttctcaattcgatggctggggccgaaaagcaagcagtcggtgatggtccgcaagattagtcctggtacaagttactgccatacgcccatacttgactggacttcctccctgggattccttggtaaatgtgaagtacgtgttctgataatacgacgaagcttctgcaccccccaagatatgatgatgactatagctgccttgtagcgaaattggcaagcagtaagaagattgacaacgacgacagcagctgatgctaatttcaccaaaggtcacaggaattttatctgctcacatatcacaaaaaggctgtaagatcccccttttttcttttgcgacatgtaatgcaaactagtctcagggctaaccatcatcagttgtcatgaactctgatcaatgagcatatatatatatatatatattact

SEQ ID NO: 8508 - DNA, 714 bp, Sorghum bicolor
  Clone ID: SORBI-28MAY03-CLUS41652_1
gcacgagggtagatcatcacggcgttcaccttcacctagacattctgtttctccccgaaggcattctccaagaaccacaacttcaatttctagaaggagatcaccttactcaaggagagggtcaccttccttgtcaagatacccatccccatcttcacgccggaggtctcctcgtcgcagaaaatcaccatcatctgggccagaaagattctcaccaggtagacgtccatccccatccccagcaaggcgcaggccaaggtccccatctccaggaaggcgcaggccaaggtccccatctccaggaaggcgccggccaaggtccccatctccaagaaggcgcaggctacggtccccatccccaggatggcgcaggccacgatccccgtccccaggaaggcgcaggccacggtccccgtccccaggaaggcgcaggccacggtccccgtccccaggaaggcgtaggcctcggtccccatctccaggaaggcgcagaccatggtcgcgatctccaataagacgtcgatccccatctccaaaacgtcggaggagatcaccgagttcaccaaagactcgttctgcaaatcggcgttcgtctccacagggaaggaggagtatcactccgaaaactagcaggagtcctgatcgttctcgccggagtttaagtagagacatcgagaaagaaacaaatggcatcccctccattaaagacagaga

SEQ ID NO: 8509 - DNA, 834 bp, Sorghum bicolor
  Clone ID: SORBI-28MAY03-CLUS4166_1
cgtccgctggataagatcacgaagtcctcggccatccttgcgtccaacactagctccatctgtataggccgcctggcttgagctgccagacgcccctctcaggtgatgggcaacctctggcgtcaaagaaactgaattcgctcttcaaggttgtgaagtgagtttcgtgctgcaggtcataggcatgcacttctttaaccctcctccgataatgaaactgatcgagattatccgaggagctgatacatcagatgaggtgtttgctgcagtcaaatctttttccgaaagacttgggaagtccgttatatgctcgcaagattacccaggattcattgtgaaccgcatcctcatgccgatgatcaatgaggctttttgggcactgtacaccggagtggcaaccaaagaggacattgacacagggatgaagttgggcacgaatcacccgatgggccctctgcagcttgccgatttcattgggttggatgtgtgcctttcagtacttcgggtacttcatagtggcctgggagataataagtacagcccttgccctcttcttgttcagtatgttgatgctggccggcttggaaagaagcgtggagtaggtgtatattcatatggacagaagtcttcatcagtcaggccaaagtcatctatgtaaacatgaaagtaactgttgagcaaataaaacaagatgtagcaatagtatgtatgttacattgcacatcagagaacaaggagcacaacttaattcagaggttgctgctcaatatagaaaaaatggttcagtgttttaatctaataaatggaattcatgaaaattacagccccaaaaaa

SEQ ID NO: 8510 - DNA, 917 bp, Sorghum bicolor
  Clone ID: SORBI-28MAY03-CLUS42850_1
gcacgaggatcccgatgaggagaacattgaagcactatgcaaattgatgagtacaattggtgagatgattgatcatgtaaaggcaaaggagcacatggatgcctattttgctaggatggagaatatgtcaactagtcagaagttgtcttctcgtgtaaggtttatgctgagagattcaattgacctcaggagaaataaatggcagcagaggcgtaaagttgaaggtcccaagaagattgaggaggttcacagagatgcagctcaagaaagacatgctcagtcgagtaggttagggcgtggtccagctgttagttctgttccaagaagaggagcacctcctatggattatggcccccgtggatcatctgcattagcatccccaagttctcatcaagggagcattcgaggaatgcctccacagtcacgtggttcacaagacatccgatatgaggaaaggcaccagtttgacaatagaactgttcttccccagcgggcagtcaaggatgaagctatcactcttgggccacaaggtggccttgctaggggtatgtctataagagggcagccaccagtatcaaatactgaacttccttctgttattgaccaccggaggatagtatctggttctaatggttataactctgcggctgattggacatcatcatctggaagagaagattctagctcaagaattccagatcgaacctctggccgaactcctgcttctagtcaatctgctggaccttcacagagacctgccagccaggaaggccgttcaggaagtaaatcatattctgaggatgaattgagagaaaaatctgtttcggccattcgggaatattacagtgcaaaagatgaaaaggaggttgctttgtgtattgtggagttgaatgctccaagtttttatccttctgttg

SEQ ID NO: 8511 - DNA, 1605 bp, Sorghum bicolor
  Clone ID: SORBI-28MAY03-CLUS42869_1
gcacgaggcacacatcaaaatgctatgcagaattcccactctgatacaactcaagggaagagggatggtcaaggtactacacagaagcatgcgaagccatatttgaagaactctcagaacgagcagcactttccaggttctgacccagcacatgggtcagccaatgttagaattgccggtggaactgttggacctgctcgacgtcatgttggagttattaattctactaggcaatttactggccgttcgggttctcagatgcatgcgccaagtggttcttctcatgcaaatattcagagggggagttttacctcagtaggggcatctgggcgttactcaccttttatgtctagaaacattcaacaaaaccagagacctgatacaatatttcgtggaaggcccactggtagatcttttgttgcacaaaacgtcaacaggtatcaccagggtcctactagcaaccaaaaagtacaccctattaaggagtggaagccaaaatcgacaaagaaggcacccaccaccgatgcagataacaatatagctgatgctgcatctccatcagctagcaacggtgaaaatgctaatgcaccggatgtaaacaggttgtctgaaaaactttcacaagctaacttgcatgaggtggagcatgttattattccggaacatcttcgtgtgccagaatatgagcagacaaagttaaggtttggcagtttcacatccggcttggaatcagaacaagcacctgcctcgaccccacaagacactgagcaaccagaacatttacaagaatcagttcaacaggtcagtgaagatgatagtttggatgctggacatgatgacatggatgagcaagctagatcttcacagcacctgtccacgtcaacggctgagatttccttgcccccatctgaggatagtgatcgaatgagtgggcaagtagagaatgatgatggcctgggcttagttcagagtgacactccagttggagcagcagatggtgacagcacccaaattacctcgactttgactcctttttcggcttatggtcatgaagatcctaatatgcagcccgcggatgaggcccagttatatggactggtggagcctaatgtacatccgcaagtattagcttcctcttctcaggggtatccttcagaaaatccggaagcagataatgctgtgcaagtcttcaggatgccagaacctaatgttcactcacaagttctcccttccacatctgaggccctaaatccacagattgtgagcaacagccctgttccgatctcttcacagcagcagcagcagcatatctctcagcaacaagctgcagcacagatgtaccctcagatgcatgtgcaacattttccaaatttcatgccatatcgacaactctattctccagtttatcccatgcctatgccaaactactcgccaaatgtcccttatccatcaaatggaaataattatcttcagatgcccagtggaggttcacatttaactgcaggaggtgtgaagtatggagtttcacagtataaaccagtcccatctggtaacccttctggctatggaaattacactcatccagctggtttcacaatgggttct

SEQ ID NO: 8512 - DNA, 688 bp, Sorghum bicolor
  Clone ID: SORBI-28MAY03-CLUS42874_1
attcctcttcctcatcaatccctctccctcaccagtcaccacaccacacagcaaaaccctaaccaaaccctagcccaccgcccccctgtctccctccagcccccggtcgacatgggagtaataataatggtgtgagggcggttcctctccttccggttccaatctcccaactttcttccgtcggtgcctcgccggcatgtccgccttggcgtccggctccggctccggctccacctccgctcgcgacgcggatgacgtcgcgatcctattaaggatcttgaaggtgacgggcgcggactgcgaccatctctccgcctcgcagaaggacatcctcgcccgcgcccactgcatcggcaccggcggcggcgtggaggaggaagaagaggaggccgaggtgatcagcacgccgcctctcacactgcagcacccgctgaggcagggccaaagccagcaaggtcaggcgggggagggggggaggatggcgtcgccatgtgctccatgcccttcgcccagactcacccttcctctccttcttccgcttcctcggatagccggcagcggaagccacggaagccgcgcaagcctacgaggaaggtgagagccggcaccaagatctggcctcccacccccactgcgactgcgactcccactctggctccggctccggctgcgactgcgactgcgactg

SEQ ID NO: 8513 - DNA, 457 bp, Sorghum bicolor
  Clone ID: SORBI-28MAY03-CLUS42940_1
gcacgagggaagatcctggtttagagtatgagctggcagctctgagagaagccatggcatctgggtttacatatctcctagcacacggcgatgtgagggcaaggaaggagtcgctcttcatgaagaagtttgtcattaattatttctatgcattcctcaggaggaactgcagggctggcactgcaaccctgaaggtcccccattcgaacatcatgcgtgttggtatgacgtacatggtttgattgggactctgctacagttacgtcacaagactgaaccacgaatcttgtatggggtgctgcaccagctagtagtttagggattgtactgcggtactgattaaattcattgctgcctctggccatctgctcggaattttagtcacagaaatggctgtatgtgttcgatttgtcattcatttcgccctttgatgggcatgcttcagttgtttgtatga

SEQ ID NO: 8514 - DNA, 655 bp, Sorghum bicolor
  Clone ID: SORBI-28MAY03-CLUS42903_1
agattttcagaagtttgactatgagaacttcacacaatcaccaatgtctgataaggcagcaccaagtgtgaacttactcccagcacgaggccgaatcacttgcagagattacaaaaaactggttgacaatagtgaacctcatctattattggacgtacgacctgcacatcacttccaaatagcttcgatttctccatctctgaacatcccgctctccatgttggaagagaagctacctacacttgaaacctcactaaaggaaacaggagaggcatcaaccttgattgttctgtgtagaagaggcaatgactctcagagagccgtcaagcttctccatgagaagggatttgcttctgcgacggatatcatcggtgggctgcaggcgtggggacgagatgttgatcctgatttccctgtgtactagcgaaatggatgtaacaattttatgcctcctatgaggattcacgattatggtcaaacatttacataggacagggcttgtgggagtgagtttaagattgtttcccacgcggttagctattgttctcagattaagaatgatctacttgtttgagttcctaccttgtaacagtttgaatgccgccagaggtgctgctgttgcaaaaacgataactctgatactattattgaaaaa

SEQ ID NO: 8515 - DNA, 572 bp, Sorghum bicolor
  Clone ID: SORBI-28MAY03-CLUS43333_1
gcacgagggcctgctgcccccgtcgttctgtttctctgtgcgtctcggagaagggagaacctccctcccactcgcctcgcagatccgcggcggcctgcttcgctgctgccttgcctgcaagcgtcagcggcaggggcggcccttctcccgtgacccacttcggtgccagcggctgctcccgtgggtgccgccgcctcgtctccctcctccttccagatccatccccgtgccccgcggcagggaccagatccaccaccgcgccacgagctccggcaggcggcatccgctcgccgcggacgtcccaggagtcccgtttgccagcgacgcctgcacgcgcgcgggcgcgctacgagctctccgccacctgccggacggcgtgaatcagcgacttgacagcaaaaggaccctttcaatcaaagagaagttcgtcactgaggctgaagaaaatctggatgtgtttaacttttagggcttactatttttgagaggtggtctgacatagactatccaaaattcagcgccagggctcagggggcgacctaccccaagttggggagttcgttccttttcca

SEQ ID NO: 8516 - DNA, 660 bp, Sorghum bicolor
  Clone ID: SORBI-28MAY03-CLUS41962_1
gaagagaaagaacaccggagcgggagcctggcccgggcgccatctctccttcctcctccctgattcagatctctcaccggcccccgctccattcccaccctaactccgtctcccaccgaccagaccttctcgatcgccgccggccaatggaggccatccggaagcaggcctcgaagctccgggagcaggtcgctcggcagcagcaggcggtgatgaagcagttcgggggcgggtacggcgcagacggcgtgttcgcggacgaggccgaggcgcaacagcactccaagctcgagaagctctacatctccacgcgcgccgccaagcacttccaaagggatatagttcggggcgtcgagggctacatcgtcacggggtcgaagcaagtcgagattgggaacaagttatgtgaggatggcaagaagtatggcactgagaacacttgtaccagtggaagcacactgtcgaaggcggcattaagttttgctaaggcacggtccatgatggaaaaggaaaggggtaacctgctgaaagcccttggcacacaggttgcagaaccattgagggctatggttatgggagcccctttggaggatgctcgccacctcgcccaaagatatgacaggatgcgtcaagaagctgaagcacaggctattgaagttt

SEQ ID NO: 8517 - DNA, 858 bp, Sorghum bicolor
  Clone ID: SORBI-28MAY03-CLUS42200_1
gcacgaggatcgccgacttcgggctcgcccggatcctcgtcaagtccggcgagccccagtccgtgtccgccatcggcgggacattcgggtacatggctccagagtatgggtacaggccaaaggtgaacgagaaggtggacgtctacagcttcggcgtcgtcctgctagagcttacaacgggcaaggtcgccaacgacagcagcgcggacctctgcctggcggaatgggcatggcggcggtaccagaaaggcgcgccgttcgacgacatcgtcgacgaggccatccgggagccggcctacatgcaggacatcctgtcggtgttcaccctcggcgtcatctgcacgggggagaacccgctgacgcggccgtcgatgaaagaggtcatgcaccagctcatccggtgcgaacagatcgccgctgaggcagaggcgtgccaggtgagctacgagggcggcggcggtggcggcggcggcacaccgctcctcgagtcgaggaagaaaggcagccggcgacggagcatgtctgactccggccggtggaacgacgacgacgacgacgaggacagcggcaacttcgttgtgcacgtggtgtagtgaagtcggacacggacagtatatagctactggcctgctgcaagctcatccacaaggaatttcgcagaggagccggcctctgcggagcaggcagctgaagcctgaagaaggccgatcctgcatgggcgcaagtgcaaaataacgaagtgcagtatagaggatgtaataacgccaataatgcgtgtaataacgccatgtattcactgtttgattggcagtaaagccagttttaacatgaactagtagccctgttgtagagggtgag

SEQ ID NO: 8518 - DNA, 635 bp, Sorghum bicolor
  Clone ID: SORBI-28MAY03-CLUS4223_1
gatgcctcagaaacactcatacagatgctggacatgggcttgtttcctgattacctggatagagctgctgtactgactgcactgcggaggaacatacaggaatctggcagcctagaatcgtacttgaagctctgcaagcgactatctgagacagatctgattggaccttgtattgtgtatctctatgtccgcaaatttaaattgtggatggcgcacatgctttagagttctgatgaaccctttgtcatatatccatccactcatggcaggtacaaaatgtgggtggttcaaatgcttgtccctgatgaaagcctcatttccggtgaaccggttggtacatagtatggttccttgtatatttttgaccgaaatagagctctcgactggctgtttgttgtaagcaggactattgtagtcctgctgaagagtccatatggtacatgtaagttttctgtgttactgttaccatatgcagttgctgttgaaagctgtgggttactgcggcctgtaggggatcggcaagatggaaacttgtaatgtacagttctattatataaatatgtccatacgctaagttcttctggaactgcacttgtaaagttgtaccgagattatatggtacttctctcttttcc

SEQ ID NO: 8519 - DNA, 811 bp, Sorghum bicolor
  Clone ID: SORBI-28MAY03-CLUS42242_1
cgactccgggcatctcgcaggcgggaggtcgtcgtgctcgtgcttcaggtgtactactcctatcaatcagatggctggcacgtcccgtgtgaggatgaagagtggcacggtctcggcgttcagctgcccgtcacctcgcggcagctccgagtgactgtgttcatggagaacaagaggccatgggcgtgccgttgcagcgtccatttcagttccgtgtacataatccaacaagtacgtacagagcccaagaacttgcacggtacgtcggtaccgaataataaagcattccataaaaagccttttccagcgtcaccggcagtggcggctttggattagggatccacaggatcgatcacatacgggggcagaagatttgtgtagtgtatttttggtgtgcaacatctccaaccagatgggggtatgtaacacttgtagtgtgatgcttgtagggtctcgcaaggtttttgtccgccatttgtttgctttgccagttactcctcgaagtttagatatgttgttcgacacttctacagtaaaaagaaagtttagatgtgctcggctgatcggccctgagggcctctgcctgaggacttctcaagctttcgtgtgttgcttgccgtcgctggagaagcaacagaaactggagattggtcggtctcactctcgtctcgccgtgaagtctgcctgggcggctatagttaactcctcccttgtcaacctcgtgtcgtctcctcctccgtgtggaagtaccgtacttgccatgcatgtgacctactgctcctcccggtttaatcttcaaataaaatatcgg

SEQ ID NO: 8520 - DNA, 687 bp, Sorghum bicolor
  Clone ID: SORBI-28MAY03-CLUS43151_1
cgccgtccctcccgcccgaggaccctaatccctgaatccctccccgcctcctccgcctcgcgctcgattcgaatccgagctccctatcttgcggctgctgctcccgcctcccgctgcaagcctgcaatggaggacacagcggtcgaagagcccgaggtgagcggcgccgcggagttcgcgccggcgctcgtcgctgcccacccacaaggcaactccgtcgccgtcgctattgggcccgagctccgcgcgttcgatctcagtgctggtctgccagtttcattgtcagatgattgtggtggccgttctcattcagatgctataagagctatttgcttcagtgtgagtggagctttgtttgcatctgctggtgacgacaaacttgtgaaggtttggaagactgattcatggcgttgcatccagactataacttcggagaagagggtcagtgcagttgctattagcaacgatgacctgtatgtaacttttgctgataaatttggtgttgtttggttagtcactttgcgggaagatagtgcagagcaggtttcagttgataacaaacctgtgtcaattcttggtcactattgcagtatcatcactagcatgcagtgctcgccccttgggcggtccgtcgctgcggctggcagcgccttcacttgcgtgtctcattccccccaaagaatcctc

SEQ ID NO: 8521 - DNA, 1032 bp, Sorghum bicolor
  unsure (1)..(1032): unsure at all n locations
  Clone ID: SORBI-28MAY03-CLUS43228_1
gcttcctggctgcttcgtccgtcccccgtccgtctcgcccaatcgccctctcgtctcgtctccgctccgctccccagcaggacccgcgacgcctctcctcgcccagtggccgccactttcccagccttgactcngttcgctngggaccgagcaccngcctcgtgctcttcgccngtgcttctgcgggctcctcctcnctctcctccgcgcccggcgcggcngccgtcctggtggttccgcggggcgccggtcgggcgcgatcggacgtgcggccaacccgcccggctccggagagatatattgtaaaatggaagtactgcgtgatatgcacctgccaccaggatttggattccatccttcggatcctgaacttatttctcactatctgaagaggaaaatacttggccagaaaattgaatatgatcttataccagaggtggatatatacaagcatgaaccatgggatttacctgcaaagtgcaatcttccaatcaaggacaacaagtggcatttctttgcctctcgtgacaggaagtaccctactggctctaggtcaaacagggcaacactcgctggttactggaaatcaactgggaaggaccgagccataaagctgaacaagcgaactctaggaacaaagaagactctagtttttcatgaaggccggcctccctctggcagacgcactgagtggattatgcatgagtactacatagacgagaatgaatgtaaagtcagccctgatatgaaggatgcctttgtcctctgccgtgttactaaaagaagtgactgggcattagataatgataatgaggtgggcaacaggaactctcatctggaacaactagatgatgctgctacatcagttgtcagcactgtaaagccagaagatgctgctgcctcagtcatctgcccagaagaatcgaatcatgctgctacaccagttggcagtgctgaactatgtaatgatgttgctcaggcagctatcactcctgattcaagatctccaaatgggggcattgaactggaaac

SEQ ID NO: 8522 - DNA, 752 bp, Sorghum bicolor
  Clone ID: SORBI-28MAY03-CLUS43238_1
gcacgaggcacagagtctctccgtcggtgccagactgccagtggactgcgagtgcgagggagcgcctccgcctcagatccgaacccccccaccgatgcgagctccggcgatgctccgctgggccgcggcggcgctcgtgctcgcggcgctcctcgccgcctcgccggccgccgccttctacctccccggcgtggcgcccaacgacttccacaagaaagatccacttttggtgaaggtgaataagctgacatccacaaagacgcaacttccctactcgtattactctcttccattctgcaagccaaacacgatagttgatagtgcagagaatcttggagaggttctgcgtggtgatcgcattgagaactctccttatgtgtttgagatgggggagcccaagatgtgccagattatctgcagagcaaaaattgacgataaacaagcaaaggagctcaaggaaaagatagaggatgagtatcgggtgaacatgattcttgacaacctcccactagttgttgctattgcaaggcaggataggggtgctcctgtttaccaggctggatatcatgttggtgtcaagggccaatatgctggtaacaaggatgagaagtcctttatccacaaccacttgacatttttagtaaaatatcacaaggatgaaactgcagatctctctagaattgttggatttgaggtcaaaccattcagtatcaatcaccagtttgaagggccgtggaatgataaaaacactc

SEQ ID NO: 8523 - DNA, 853 bp, Sorghum bicolor
  Clone ID: SORBI-28MAY03-CLUS43317_1
aaaaccccagttctcttcgctccgacgtccgaccgccggggcccggggccgatacggcgatacccactgcaatgctccgcgatccacggccatggccttcctcaagaccctaaaccctctcatacgcaagcgcgccaccccgatctcgaaccccaggccgctcctctccctccacacctacctcgcctcatcctcccccaccactaccgccgcggccaaccccttcgccagcgatgtgcacacccatgtccccatccggtccggcggcccgctgttcctctcgtcggccccatggatgctgtcgcagtcggcgacaccgctcacggccgcggctgccgcccttggcgccaagctccgcagggcccaggccctcgccggcggccgcgcgctggccgtcgcggacgccgtgaggtgggagcacaggcggatctccgggggtgaagcggaggttgcggcgtcttcaggaattgtgggatgtggaggtgagaggtttctgaatgcgcccaatttggtgtcgattggacggatggtgtcagggcctgtcattggatggatgatcgtgaatgaatggtatcttcctgcatttgccacattggctgtatcgggtgcaagtgattggttggatggctttttagcgagaaagatgggcatcaattctgtctttggatcatatttggaccctctggctgacaaggttttgattggctgtgttgctgtagccatggttgaaaaagatcttttacatcctgctcttgttggcctcgttgttgtaagagacttgcttcttgtgggtggtgctttctacaagcgggcttctagtctgggatggaagtggaacagttggtcagaattt

SEQ ID NO: 8524 - DNA, 652 bp, Sorghum bicolor
  Clone ID: SORBI-28MAY03-CLUS42647_1
aggaggcacgtcaatgactttggatcagataataagtgtattgaatgatctagagtgtacttctaccactaataacccagaagaatttacattcgatttgaataaattggttgagacatgtcgaaatgatgagatagagtcccttgtgaaaaagaaacatgggcaagaagcttacacaatctttaggttattgctgaaacaaggctgtccggttgagactgatgaaattactgacaggacaattctagacaagcaggttgttcatgaaactctatacaaactttggaaggacgaatacatagattcagagagagtcccttctacatcaggaacaggaaccggaagcactcagttctttgtttggagagtaaaaaatatttatagggaacacttcatggaccatctttaccatgctgctttaaacttgcgccagatgatcaattacatggctgaactattacttgagggttcaaaggacgaaatcaagcttcggaacagaaaaaacattttggtcctagctctcactagacatgatgaatcccttatgctgttccatgatttttgagaacactggatctggatctggtctgtcatatttacatatatggatgtaaagttagatgactaaaataaagtagcttaacttttgtgc

SEQ ID NO: 8525 - DNA, 628 bp, Sorghum bicolor
  Clone ID: SORBI-28MAY03-CLUS42655_1
atggatatgtgtctggagcaaattgggatccagaaggtcgtgttgcattgttatccttttctaactcgacgacacttggctcaattcacttctcatctaagccaccatccttagatgcccacctcctaccagttgaacttccagaaattttctccctgattgttagccgaggcatagagaaattagcatgggatgcttcaggggaacgtctggcattgtcgttcaaagatggaaatgaaatgtaccgtgggctgattgctgtatatgatgtgcggagatctccacttatctcactatcactagttggattcattcggggacctggagaaggagcaaagccactcgcttttgcttttcatagcaaatttaagcaagggccattgctttctgtgtgttggagtagtggttggtgttgtacatatccactgatacttcgttctcattgacgccaattgtagcacctcactggttcaggactgaatgttttaattattattggcgacttggaagactgaacgttgcaatgtgcctaggagaaatgcaaagcatgaattgtatcccatgtatgtaacattatgacttgagaaatggtgcctattgaatgcaaaaaaaaaaaaaaaaactcgag

SEQ ID NO: 8526 - DNA, 720 bp, Sorghum bicolor
  Clone ID: SORBI-28MAY03-CLUS4268_1
gttagcgttcatgcaatgcaacacacaagcgtccgatcaacctttaaaataaactcccatcttcagtcagcacgatataatgctgtgtgccactgatcaggtgtgagcagtgaatcaagcgatccaaaatcttctgctagtggtatatagtaggtcaccatacatagcagctagtatatatatagctagctaggtacacatatgtttagctatagcttgttacatatatagctgtatacgtacatgatgcatgcatacatacaaaataatgtaggcgaaagatatatctgtacatgccaccagtatattgacaaaggttttcagtatgtgtagacatgatctgaaaggagatagaaacatataggtagggttttggattttattaggttggctagtagtagtacgtatatatagtagtcgagattgatatgtgaaaaggaaccagctagcatcatgtatttatctcggtttgtagtatttggctgcttgcctgcaccacccaatgcgtttattagcgttgtggtgcgaagataaaagtttttgttaatctcctccctgcttataggagcttattaatctgtacatgtacatagagtgtttgtatgcacacacgtgtatgatgatgtatgtatatgtttgtgtaccatcagaaatcaaagaaagataagcggaagaaataccttgtggagtgtgtgtgtgtaattaacttgccatctgcaa

SEQ ID NO: 8527 - DNA, 617 bp, Sorghum bicolor
  Clone ID: SORBI-28MAY03-CLUS42791_1
gcacgagggcccctccccctcatctcgacaaaaaaaaaaaaagacaacccgcggcctcctctcgacccctcgctcacgccgtctccccatgccggcctctcccaacgcggcggccacgacggcgcgcctcccccggcgatctgtgctcccgccgccccttccttcctctccctctcccccgatgtggcggcatggagtccgggccccagcggcaccacctgaccgcggggcgtctttgcggcgcgacgatgtcctcaggctacgacggagcaccgcctgtgtgacctgtcgacgctcatccccggccacggcagggcatcaacagggctttccgagcagggcccttcggtggctggcggcgcgggtgttctccgaggcaggctcctcgaaaccctaggtttacgtgctcgcggacaccgctgtccagtgccgggctcgggcgcggtagtctcatcgatgaccacgagagctccagcatgagcaggcctccgccaccgccgtactagcgatggccgtggttgtcaccttcgattttggaacagcggcgtgggccatgtaccctacgctcaggtttcctctcatctttttatctaggactctctatttgccttgttcct

SEQ ID NO: 8528 - DNA, 620 bp, Sorghum bicolor
  unsure (1)..(620): unsure at all n locations
  Clone ID: SORBI-28MAY03-CLUS42849_1
gcacgaggctagtcacctcccttctccctcccccgcctcctcctcctccccagacctcccctaccggcggcttaccttccccgcgtgcgcgtgaaggagagcggcccgcggcgatggggaaggcgtccaagggctcgcggaaggggaagaaggcgtggcgcgccaacatccgcaccgacgacatcgacgacttcttcgagaagcagacgcgcgatgcccacgcgggcgccgccgccatcccctcccttccttccgactcgctcttctttgtcgacaagccggccgcttccgcgtctacttccgccgccggcgcctcggacacaaccaccaaagatattcctgtcaaaaggaagatcgagaagaagagggagaaggttctttaccatgagagtttgttgaagcggaatccatttgtgcagccaatcccatcttctgtggtgagcaagaaggataagaagaaggcaaagaagaaggaactgcaggagacacagggagagaaaagtgtccctatggaagatgattctgtagtaaagaactttgacatctgggctgtggatggtagaggtgattccaaggcaaaaaagagatctactacatcagttattcctgctgntgaagtt

SEQ ID NO: 8529 - DNA, 592 bp, Sorghum bicolor
  Clone ID: SORBI-28MAY03-CLUS43768_1
gcacgaggcggattggcttcaaggcgaaccagttttcttgcagcgcgtgctggcgtgctgctctcgtgagcagtctctctccctcctgccccacgcctcccgatgccgcccaaatcgaaggcggccgccgccgccgcggagccggtagccgtcgaggacctcttcacctcgattcaccgccacatcgaggccggtgctttcgaacaggccgccaaggtcgccgaccaagttctcaaggcggctccaggggatgaggacgcggtgcgatgcaaggtggtggcatacatcaaggccgacgagatcgacaaggcgttcgccgcgatccgcgccgccgagcgcctcccgatcgacctcagctactacaaggcctactgctgctacaggcaaaacaaactgcaagaagctctggagcttttaagaggtcaagaagaaacttcagctgttctccagctggaatcccagatcttttaccggctaggaagaatgaatgattgcatgagtagctatgagaagcttcagaaatttaaaattgactcaatggatctgaagataaatatcattgctgctctggttgctgctggaagggcttctg

SEQ ID NO: 8530 - DNA, 862 bp, Sorghum bicolor
  Clone ID: SORBI-28MAY03-CLUS43772_1
gcacgaggcacaaaacccttccttccttcctcccgccgccggctaaacccttccttccgccgccgcgacgaccacccgccgcggggccaaccatggcgcccgttgcggctccgatacgcgacctgctcacctccttcagccccagcgcggacttcctcgcgctctcttctggggacggccgcatcaaggtatgggacgccgtgcggggccggctgcaaaccgagtttgccgacatcccggcagtggaggcgggcgcggtcccggtcgctgagtcgaagcgcggccacctcgccctcgattacacctgcatgaagtgggtacagctttccagcaagaagaagaggaaggctgggagctcactgattgtgcttggtacgcgcgggggggatgtgctggcacttgatgtcgctgcgggcaattggaagtggcacgtcggcgattgccaccctgggggcgtgacggctgtagcgtactcaaaacatgggcggagtgtgtacacggcaggcgctgatggcatggtctgtaggattgatgcctctgatggggctgttgttgggaaatttaaatcttcttcaaaggcaatatctgcattagctgtgtcatcagatggaaatgtgttagcaacagcagctggccagttgaggacttttgacacttccagcaacaaaaagattaaaaaattctctggacatccagttgctgtgaggagcatggtttttagcaatgatagccagtatgttttgtcatctggagttggggaacgctatattgccatttggaagctgggcagtgggaaaacccagagctcaaactgtatcctgtcgatggagcacccagcaatatttgtggactgtaaatgttc

SEQ ID NO: 8531 - DNA, 696 bp, Sorghum bicolor
  Clone ID: SORBI-28MAY03-CLUS43820_1
gcgcggcgctccctccggctgaaggttcttgaggcttcccgcggcctccctctcttgtacgctgcgcgcggcgcacgccccccggcggtcgcctcgcgtgccggcccccccccgccctcgcccccgcccgccgccccgcgctcgcgccccgccgctccctgcgctgccgcccgccgccgcgccgtcggcccccccggccccctcgtgcgcacgggcccctccgccgcgcgcggcctccccgcgccgcggcgtccagtcgcgcggctccgacgtcccgcgtggagcttgcctacaaagaagaggtcgcatttatcaggtaataaaagcacaacattcgcatcaaggaagaggaggagccacaatacaggtcgaactgagggatgttgacactggaaacaaactaacagaaagatttcgtactgatgaggcccttgaggggctgggtgttgcggcggggtcattcccgtagccgtttccggacggcgattctgtgcctctcatggggcctgatgcgcttgtgctgcttgacacggcgcaggaacgggctggccttccggcgccattcctctacggcgagatgtagctgtctctacaatgccttgctgcccggcccatggccggtacaggcccgcgccgggtggctcgctctgtgtaatgctaacctgccctctgtcctccaaatgctttgttcatttc

SEQ ID NO: 8532 - DNA, 671 bp, Sorghum bicolor
  Clone ID: SORBI-28MAY03-CLUS43821_1
ctaacccctctcagcctcctctcgccgccgatccggcccaaattccgaacccctccggtcctctcccatctcccggcgtccccaccgcgctctccgccatgccggacgtgcagccgctcgtcagcgacttcgtcctcaagctcaagcgccggaaggtggaggggtcgcatgcggttgcccggcagacggcggagctgctacggtcggttgtgtcgcagcatcggatggttagcagcgccaaccaggctgccgcgcttgccgatgccgtacgcgctgtgggggagcagctcatcgccgccaatcccgttgagcttgctgttggaaacatcgtgagacgtgttttgcatataataaaggaggaggatatatcttccacagcagttggtatcgaaggtctttctgttactgttgacagtgatgatgaatatgacagtgaacatgatgatcgccctgcattatctgctgctgttcttgctgcacatgctagaaatgccctccgtgcaccttcattgcagactctgctagaagacattcctgtgagtcctgcagtttcccgcactgcatcatcaactggtgactcagacggaaaaagtaaatcagctggagataagagctcgactaggaaactgaagcatgatgtcatcgcagccattggtgatcttattgatgag

SEQ ID NO: 8533 - DNA, 537 bp, Sorghum bicolor
  Clone ID: SORBI-28MAY03-CLUS43863_1
gcacgaggggcatcttatgggggcaagattattttaaacccgcacgagggttatgttttgcaagagggtgatgaggtgatagtaattgcagaggatgatgatacatatgccccagcaccattgcccaaggttaaagaggctgtttacatagacattgttcatcctgaaagaaagcctcagaagattcttctttgtggatggcgacgggatatagatgatatgattgcggtacttgatgctttccttgcgccaggatcagagttgtggatgtttaatgatgtccctgaggttgacagagaaagaaagctgattgatggaggtctggacttcagtcgcctcgataatattactttggtgcatcgtgaaggaaatgctgttattcgccgtcacctggagagccttcctttagaatcattcgattctatcctgattttggcagatgaatctgtagaagattcagcaatccaagctgactcgaggtcacttgcaacgttactgctgatcagagatattcaggcaaaacgtcttccatacaag

SEQ ID NO: 8534 - DNA, 700 bp, Sorghum bicolor
  Clone ID: SORBI-28MAY03-CLUS4295_1
gaatcgatcttgatcagtttgaggactacttcataacgctgcgagcttggaggcttgatggccagtgcacagagatgtgtgtaaaagcacatgcattgaagggtcaatcatgtgtccaccacaggctagtggtgggtgatggctttgtgactatgacaaagggcgaaagtattagaagtttctttgagcatgctgaagaggccggggaagaggatgaagatgatgccatggaaagggatggaaatgattttgatggtgatggtgcccatccacagaaacatgccaagagccctgaactggcaagagaatttcttttggatgctgctgctgtaatattcaaagaacaggttgagaaggccttcagggaaggtacagcacagcaaaatgcacatagtgtttttgtgtcccttgctttaaaacttttggaacagcgggttcatgtagcatgcaaagaaatcattaccttggaaaaacagaacaaacttcttgaggaagaggagaaagaaaagcgtgaagaacaagagcgcaggatgaagaggagaacaagagaaagagaaaagaagaacaggagaaaagaaaggctgaaagaaaaggacaataataaagggaaaagactagttgaatcaaagtcaccagacgatgtttcatcttcagctccaagcaactcctcaacatctatcaatgattattcgacaaatac

SEQ ID NO: 8535 - DNA, 762 bp, Sorghum bicolor
  Clone ID: SORBI-28MAY03-CLUS42961_1
tcagcaatccagcagccgttatcgtgaatttgaacctggtaccattttccttccagacaggagctactatccacatttggcaagtatggctacttgatcgaggctcagactgatatttcagaaactacccgtagtgcttgtgttgtgtttgggaaaagcattgaagctgaggaggcgtacaagaacggttgtcagtaccttcttggtcagtttgggcctccgtttgctaaactaaggcttgatttctctccaatcaagttgactgtgccttcaccgtctcttgcttcaaagcctccgctccgagatattaggaagaaccttgaggatatgatttcagcccgccgttcggctttgaacaaggcaacctcatcaaatgggcagctgaatcctgttccagataagcttctgggggagatgcagggccttttggcgaaagttgacaggatgcttactaggcctcctgctaatgctccttagctccgccaatctgaaggattatggccgtaacctattggtagttagacaaaccttggtggcagttctgttagctgtagcttctgcatctaagtttatgatgaactatatcgtttgcccgttgcagcagctgtgatttggaactcctgtgaatggtggcgcttattgtgtcactgcttcgtgtactatatacgccaataaggtcgcagctccttttagtgccctgattttgtgtaatgttaatagtatgtccttgccatttatcagagctgttggagtttgcatcgg

SEQ ID NO: 8536 - DNA, 808 bp, Sorghum bicolor
  Clone ID: SORBI-28MAY03-CLUS43025_1
gcacgaggcatggccgaggtggtgctcataacatggattctgacgaatccccagagtcgtaccaaatggaagtggcagttgtttgaatcagtccgcatcggagatctctggcacaacccgcactaccatgagttgccgctgctgccacattttccggtcatcagcactgtggaacctcatgtcatctacttcacggtctttgactacaagtacgatcccgagtacgaggtgatggaagtcacagaacgatatgtgctcggcgttgacatgcatcttcggagtgtagtgtcagcgttcatggcctcttcctctaggatgcttacttctcacttcacccgctacataaaccagagaacagtttgcccaatggagaaagaggttactgatgagggggaccctgctgcatgggcttccgtctggatttccaccaagcctcttggagtttctccagtagaaccagcacacaaagccggcagacttgggggacgtgtttccagtgatggggtcgcacagtttatcagcaaaactggaccaaccatgtcatcaatcactccagtgatcggtttgcagtgtgtgctaggtcactaagttattgtcgtgaggaaactcccttttttgtgaggaaatctacctccctcttcattaacaattaggtaattgatcgggtgtatccttgacttgtttcctaactagcaactagcaagcttggatggttgttctacctgtgacaactacgtaagcagccaggaagagacctttgatgtaatgttcttgatgcttctcgcgccagggctggctggctgtgatc

SEQ ID NO: 8537 - DNA, 906 bp, Sorghum bicolor
  Clone ID: SORBI-28MAY03-CLUS43129_1
gaggatattgagactgcctttaagctagttagtgatggtgtggtttctgaggccaccatgggtactgaaactttgcatatctcaggtgctgatgctgcagagcccaaagaggctgctggagagctgcatgtcattgatgcaaaatctgtggatgacatgcatgctgctttccagaagcacttcgatgctattgtgaatagttcctttgaagaaaatgatgacaagtatggacatgtagagacagcagaatccacgaaacctgatgaacttactgaagcaatacataccgaaagtcagcacaacctaggagatgctagggagggtttaccagtggagggtacaggcaatatgagtactagtgaagcagagagtcacgatgacattgatgcggcatccaataaggtcttccatagcagtgccaagagtactgcacaggcagtggagttagaggtttctcacgaaagagaagaggaaagtgaacatcaatgaataccaccggattgactgctgaaaggaaacgatagaatgtcatcagagatgaatgagacaaaaaatactccttggttgaaggagctagcaaagcattgatggaacgctattgttaagtttcacgggcttgccactgtgcatatacttcacatattcaaaacacaaaagttttgatgtagaccttttgtgaatgcgctttctttaactttcttttattcttttgaggttttggtgggtttgttttagattgattcccccctcctttggctgtaatttgaagaggtgtaagttttgctcagacagtttggttggttccagggacatagaactatctgttctaccatgtgaattgagattttggtgtatggtgtgaactagtgaagttggcaatagaagaattagacaggtacaattttc

SEQ ID NO: 8538 - DNA, 865 bp, Sorghum bicolor
  Clone ID: SORBI-28MAY03-CLUS43150_1
gcacgaggctcggcgctccctctcgcgccgccgccatgtcgccgccgcagccgccacacacggtgccccgagagacggtggccagcgccgtcgcctccctcaccaagtggatgaagaagcgcgccgcggaggcgcgcccgaacctcctcgccgacgagcgcgacgacctcgtcgtcctccagctctcgctccgccgcgtccccgcctcgcgcagcaccaggccacgcctcctcccgctgccgcatcccgtcgtcgggcacgacggtgcctccgtctgcgtcatctcggacgaccgccccaagtcgcggtccccttccgcctccgacctcctccacgcgtccaagtcgctccacggtctccccgtctccgaggtcatcccgctctccacgctccgcacggactaccgaccctacgagtcgcgccgccgcctcgcggcctcccacgaccttttcatcgccgaccgcgccatcctcccgctgctgcctcgcgtcctcgggaaggcgttctactccaccaagaaggctccgattggagtcgatttcacccgcgtcggttggccggagcaggttcgcaaggtccttggctctgcttttctctacctgcgctcggggacctgctcggggatcaaggtgggtaggctggacatggaggaagcggagatcgtggacaatgtgatggccacggtggaggaggctgtcgagaaggtgccaaagaagtgggccaacgttagggcgctgcatctgaaagctgtggattcagttgccctaccaatttaccaagctgtgccggagttgggtatgaaaatcgaggtgcctgaaattgttgggtctgcggaggtcattgatgctgcagaagcggagactcg

SEQ ID NO: 8539 - DNA, 1155 bp, Sorghum bicolor
  Clone ID: SORBI-28MAY03-CLUS43_1
aaagactccaagctcctgtgtggcttctgtttctgctgccgcctcctggtccacatctctctccgccgccgccgctgccgtcgtcgtccgccgacaccgtagcgctgggaagggatcacacgggagcggcgacgcgaggcgggggacccgcggttttgtcgcccggatggcggcggagcgatgacactggcggcggcgggagcggcgcggcgttgggatgcggacgatctgcgatgtgtgcgagagcgcaccggcggtgctcttctgtgcggccgacgaggcagcgctctgtcggtcctgcgacgagaaggtacacatgtgtaacaagcttgctagtcggcatgtgagagttggacttgcagaccctaataaacttgcccgttgtgatatatgtgaaaattcacctgctttcttctactgtgagatagatggcacctcactttgcctgagctgtgatatgactgttcatgttggtggcaaacgaacccatggaagatacctgctcctaaggcaaagggttgaatttccaggagataaaccaggccatatggatgacgtgcctatggaaaccgtgcctatggaaaccaaagatcctgaaaaccagagagaccagaagaaggcgcccaaggagcaaatggcaaaccaccataatggcgatcacccagcctgtgatggcaattgcgatgaccagggcaacattgattcgaaaatgatcgatcttaatatgcggccagttcgtactcatgggcaaggatcaaattcccagactcagggggtagatcttagtgtgaacaaccatgactctccaggggtggtgccaactagcaattctgaaagagacgccagcaagtaaactttggaagatcagatgtacatttcaactacatatactgctctataggagctcatggggggcagaaatggggttattcagtggtctctctgttactattactagtaagtatatttctggcagagttggagctaacgaccgcatctcaattcggcttgtcgtgcccattgcattctagctgcgaacttgcgattgtcagaactcatgtagaagcgcagctgctgtcgcctgtgcttcggagtcggagtattgtgtgccattagaaactgtacaaaagattaatagaccggtctctttttttt

SEQ ID NO: 8540 - DNA, 673 bp, Sorghum bicolor
  Clone ID: SORBI-28MAY03-CLUS44145_1
gagggaagtgcccgcgggccatctggcccgccggccagccgatctcatcgatccgccatggcgaccgcgtactacgagagctccaggccccggggcggccccgcggaggaggcggacgacttcgacgagttcgaccccacgccgtacggcggtgggtacgacctcgccgtcaccttcggccgcccgctgccgccgtcggaggagacctgctacccgtgctcggcgccctccacctcctacgacgcgccgcactactccgcctccgagccgtccccgtacggccaccacgccaagcctaagcccaactacgggttccgcccccagcaggagcagcagccgccttacggcggcggtggcggctacggatccacgcccgagccccctgctgaggagggcggtggctatggatctggctacggatccgggtatggtaggaagcagcaggcggaggagagctacggctctgggtacgggaggaagccgccgcaggcggaggagagctacgggtccggcgggtacggatctggctacggcggtcagacccggccggaggagagctatgggtcagcagggtatggatctgccaatccgccagctgagagctacggctctggctacgggagggagccgcaggtagatgagagctacggatcggagtatgggtctgggtacg

SEQ ID NO: 8541 - DNA, 220 bp, Sorghum bicolor
  Clone ID: SORBI-28MAY03-CLUS44161_1
gcacgagctgccctcctacttcaagcaccgcaacttcgccagcttcgtccggcagctcaacacctacgggttcaggaaggtggacacggaccggtgggagttcgcgcacgagtcgttcctccggggccaggcgcacctgctgccgctggtcgtgcgcaagaagaagaagaagaaggcggccggcggctgccgggagcagctgtgcgaggagggggaggag

SEQ ID NO: 8542 - DNA, 309 bp, Sorghum bicolor
  Clone ID: SORBI-28MAY03-CLUS44188_1
gcacgagggtggaccacgccaccgccgccgccgttggtagcggtacagagacccttcaatacgggaacgggcaaagggcgatcgagacgttctcggcgacggacctgcgagactgcccggtggcgcggctgcagccgtggctggggatcagcgtgacggagttcaagaggaaggtggcggagtaccgggcgagcaccaagcccgtggtgcccggcgccgacgccacggacaccggcaccccggccgacgacacccccgcggccgtcgtcgccgcggacgacgagccgagcggcgagcagcaggaggagg

SEQ ID NO: 8543 - DNA, 814 bp, Sorghum bicolor
  Clone ID: SORBI-28MAY03-CLUS44232_1
gcacgaggctattgagcgccttcgcagactgaaaggcattggagactcaaagcctctcagcatcctgtgccgctcattacgtgatatcgatacctacacaacaggatttcctcgaggcaccaaccaagggcaagctaacattttccgtgctgtcaagcgtgcaatacctgggccttacacatttattttacctgcaaccaagcaatttcctaaacagtgcataaagcatggttcttccacaaggtatgcaaaaaggaggcaggtcggcgtccgaattccagatgatcccatctgccaggcaatattgcaaaatcttgatgaacctttgatctgcacaagtgtcaaatatctatcggaggatgaatggatacttgatccagtaatcattgctgatctttatgagccactggggcttgattttattgttgatggtggacctagaattgctgatccttctaccgtggtggatatgatgggaacaaaccctactataattcgtcagggaaagggcccaatgctggattggatggtagcaaaagatgaagaggaggaggagacacaatcgatgtttgcttttaaagcagcttgaaatttgcctcgccctgacctgcactttgcgatggttcccccaaccgaaccgaagcgtcttcttttggctgcataggatgttagcacttagcagtagcatatatcgaacacggactgcgtgctgtaaatatgcaaggtgatgtaggagtatctgcgagcttgcagaatttgtccagtagtgacatttttgctggagatcatggaaagtttgctgctggctctgttt

SEQ ID NO: 8544 - DNA, 686 bp, Sorghum bicolor
  Clone ID: SORBI-28MAY03-CLUS44237_1
gcacgaggatcagcaccacctattatatctttgcataagcgtgctgagaaagcccagtacttccttgctgaggcaatgcataatttcaatggaaccacagagaaggaactgagcttaattgttggcgactatgttgtcgttcgtcagattgctcccaatggctgggcggaaggagaatgccgagggaaggctggttggtttccagccgcctatgttgagaggcgagaaaatatccccccaaataaagttttcccacaagcataagatcacaagggtcaaggggtcatctgtttcccactgtgcagagtttgtgggttgcaaataacattccctgccattggtgcgacctgaccctggcattggggttggggagttgtaagcctgtatgtaacttccaaccggtttgatgctttggttcttgtggtggtctagacttagagcaagatatgtcggcacgtgctgtgcctgcacgcacattgaagatgtagattcgcatgtgtaactatccttgatgtatctatcatggcagaaactactgttcgctgatttgttgtgagagaaaaacaatgttgaatggctggcagattcggctgataagcttcgaataggctgcatgtgaggtcttccctttctctgctactgatgagcataaactgtaaagtgatttttgcttctttttggtgtgt

SEQ ID NO: 8545 - DNA, 658 bp, Sorghum bicolor
  Clone ID: SORBI-28MAY03-CLUS43438_1
gcagatctgcaacgttgtggcatgtgagggcgcggagcgcacggagcgccacgagacgctgagtcagtggcgcggccgcctcgtcggctccgggttcgagcccgtgcacctgggctccaatgcctacaagcaggcgagcacgctgctggcactcttcaacggcggcgacgggtacagggtggaggagaaggacgggtgcctgaccctggggtggcatacgcgcccgctcatcgccacctcggcatggcgcctccccgctccgtgatcatggggtggggttttggacgctgatcaaggcacacgtcccccggccccgggcatggcgcagcctccccgagctcgccggcgcagttgaagctgtagacgtcaatgaacgctgaatgaattgcagttattaggcgaccgggccacggttctcgccggcgtgatgagatggactggacactttgactccgaccggatcgggcctgtgttcgttcttgtttccgatccccctctcttcccgttgcttcaatccgtcaactatggtagcccgtagcccctattgttatgtttaaatgtctattattattattatgtgtaattcctccccagcgctgatatccaataaggacgaaccggatttcgttaaaaaaaaaaaaaaaactcgaggggggcc

SEQ ID NO: 8546 - DNA, 598 bp, Sorghum bicolor
  Clone ID: SORBI-28MAY03-CLUS4345_1
gcacgaggcaccggcctgcggagggtggtgcacagcaccgacggcggccgcaccaaccacccctggttcagcccggactccaagacgctggtgttcacgtcggactacgccgccgtgtccgcggagcccatctcaaacccgcaccactaccagccctacggcgagatcttcaccgtcaacatcgacgggtcgggcatccgccggctcacgcacaactccttcgaggacgggacgccgtcgtggacgccacactacctgaagccggaggacgtcggcgagacgctgcaggcctccgggacgtgcgcgtttgaggattgccactggctcaacattgctgcccagccagatggcctcatgtgtggcaagcacggctgatgtagaatctgtgatgggactcatgtatgtatatatagcactatagcagcgatcatccagtgcagtgatgccatcttgtttgcttgcatactactgatatgaataaggtcatgtacagtgatgccaagtttaaggcaaaaattaaagaaactccacatacttatgacgatgcttacatgtactaatctcgggtctagttcgctcttggctctattgcccggtc

SEQ ID NO: 8547 - DNA, 757 bp, Sorghum bicolor
  Clone ID: SORBI-28MAY03-CLUS43562_1
tcaggaggctgatcagagcaactttactgacgcggcgacatccggagatctggaggtcattgacaacacacagctgctggagtggtttgctgagaactaccaccagtttggctgctcgcttgagtttgtcaccaacaagtcccaggaaggttctcagttctgccggggatttggcgggatcggtgggatcctccgctacccagccgatgtcagtgcctaccaggatggtgacttgtctgatggggagtatgatgaagacttcgaatagcaatcagccgaaactcaaatgaatccggtccgggaggagcctgtgctggcccgggccgcgccgggacagaaccctgaaacttccaaacgatcggtgcaaggaaaccatggtgggggatctgcagggaaggaggtttgagcaacatggaatatatatatgatgaagcttgtgtgaagtgtggtgacgttggttctttggagacggtgtcttgctctgttggtccgagcttgcagtctggtgatgctacaaggaatcaaccatggagggtgccttctgttggtcaggagagcttaagtaatataatcaactagcatcctattaatattgagtcggtgccagagtagtgtggtgaataaagtgcctgtgagacaggcggtcgtgttggcctagtcgttaaggttggtttgagcggctgcgttgccgatgcagctgtctttttttatttgttgatgaattccttgaactgaggtcgtggtgtgcttgcactct

SEQ ID NO: 8548 - DNA, 720 bp, Sorghum bicolor
  Clone ID: SORBI-28MAY03-CLUS4357_1
catcgggtggcgtcactaatgagatttaggcgtccgcggaaggagcggaactttgataagaagatccggtacactgttcggaaggaagttgcgcttaggatgcagcggaatagaggtcagtttacatcttcaaaaccaaagcctgatgaaatagcagcatcagaaatggcagctgtagatggctccccaaattgggcgttagttgaaggccgacctccatctgctgccgaatgtcatcattgtggtactaatgcaacagctacgccaatgatgcgtcgtggacctgatggaccaagaacactatgcaatgcctgcggcctcatgtgggcaaataagggtctcctgagggacctatcaaaatctcctgtaccacttcaagttatgcaatcagctccacttctagatggtggtaatggaaatgtcatgtctgcgcctggctctgagctagagaatgctgcagctgccatgaccaatggccacgagtcatcaagtagtggtgtttaatccagcgatggggcaaaggcacgagcatcatcccggagtgatctctgcggtaggcggtcagttgttgtactataactttgagttggagtctgcttagatatggaatccttttatttatcttgcgttctgtaggttttaagagctgcgacagtgttttatcccgtgtaatcatgtttgctgccgttgcggctatagcgaatttgttttcttgttctt

SEQ ID NO: 8549 - DNA, 909 bp, Sorghum bicolor
  Clone ID: SORBI-28MAY03-CLUS43724_1
ctccatcggtagccctaggccgccgccgggcgcccgcgcggtgctcacgcgccccaccccgctccgctcaggtgaaggctggtcctttaagcacttaaagatgggcgaggtacacgaagctgacaagaatattgagatctggagggtcaagaagttaatcaaggcgcttgatgctgcaaggggcaatggcactagcatgatttctctcatcatgccacctcgtgatcagatttcacgcgtcactaagatgctgggtgatgagtatggaactgcctcaaacatcaagagcagagtcaacagacagtctgtgttggctgccataacctcggctcaacagaggttgaagctttacagtcgagttccccccaatggcttggtgctctatactggtaccattgtcaccgatgatggcaaagagaagaaggttacctttgactttgagccatttagacccattaatgcttccctgtatctctgtgacaacaagtttcacactgaggcactgaatgagcttctggcatctgatgacaaatttggtttcataatcatggatggcaatggaacactgtatggcacgctgagcggaaacagcagggaggttctgtacaagttcagtgttgatctcccaaagaagcatgggcgaggagggcaatctgcagtccgctttgcccgcttgcgcatggagaggcgacacaattacctgcgcaaggttgctgagcttgcgacacaatacttcatcaatcctgccaccaaccagccaaacatcgttgggcttattcttgccggttctgctgacttcaagaatgaacttggtaaatctgagatgtttgatccgcgtcttcaggccaaagtagtcaagatgattgacgtgtcttatggtggggacagcggcttcaaccaagccatcga

SEQ ID NO: 8550 - DNA, 717 bp, Sorghum bicolor
  Clone ID: SORBI-28MAY03-CLUS4440_1
cgtccgcccacgcgtccgcagaaattcaaaggttggcagcacacaaggaggtaatatatcaaacactgagaggtggatactaccagctgcgatcaggtgtgcttgatttcttgaacacccttgtgggtttggacattccaatagcaattgcaactcctcactcaaggaagagtctcgaagaagggattaaaactgttggtctgcaaggctactttgatgctataattgcattggaggacttctgcctagggaaacctgatggtgagatgtttgaggtcgcggcagagcaacttggtctggagccagatgtttgtgttgtgtttggtaactcaaacttgacgacggaatctgcacataacgctgggatgaggtgtgtggcagttgcaggccgacaccctgcctatgagctccaagcagcaaaccatgttgtgagatggcttgaccaactctctattgttgacttgcagaggcttgctaatggtgaagttattggtcgcaggggtagagaatctgacatggatatggaaattgtgattgaggaatgatgcttctgcaaacatgacgtaccaaatatatcgttgtacttataatctgatgtagcgtaagtactgcattacattttgtaaacaggccaagcagggcaagatcaggactaatgatagtcctaagtttgcattaccttcttggtttgcttgtgacgcattggaattcatttag

SEQ ID NO: 8551 - DNA, 868 bp, Sorghum bicolor
  Clone ID: SORBI-28MAY03-CLUS44409_1
gcacggcgccagcatgcagtgaaacacattataatcatatactccatagctacaaacctacaaggaggactcgatcgatcatcgttcgacagagtgagctagctagctagcatactgctatagctagctaggatgaggatgcggtgcacactggcggtatggctgtatcttgtcgtcatggctgcggcggcggccgccggcgacgacaagccagagccgaggccagtgatcactccaaagccaaagccaaagccaaagccacagccacagccacagcctgaccagccgaaaccaacgcctgatcagccctacaaacccaaaccacagccagagccagggcacccgaagcccacacctcagcccaacccaactccagaacccactaaaccaaagcccatgccgcagcccgagccgaaaccgaagccacaaccgcagcccaagccggagcctcagccgggcccgggcaaacccaagccgaagcccccagcatactcgccgggcacgcccggtccttgatggtgggtgttgtatatataaaaaagcaagctgaaagagcttatagtataaataagcggctggtggcatgctggtttatttctagcctgtccgcttgtctgaaaaggtcggctttgctcggctaactgctgcggtttgtgttatgtgtttgttgttaactatgcacacgtgcgcgtgctcgtgcgttgcgtgcgtcatgacactactgcatgcgcacgtagtgtatcagtgcatgtcatgttccatcacactactgtgtagtacgtgtgaagagtgtatgtgtgagttgtttgcttcttgtgcctctacttatatactatctaaagagccactgcttgttgtacgtgttgtg

SEQ ID NO: 8552 - DNA, 677 bp, Sorghum bicolor
  Clone ID: SORBI-28MAY03-CLUS4454_1
ttacttggatgcagagcaaagcaggagagatgatctagaatctctcggttatgtcttatgtactttcttaggggcaggtttgtttgggcccccgcttttcacccatatgttgtaaacatgtaatggttccatgcatgcttgtgtgaatggatgtaacatttcattggtctttttgtctttgaacagcctaccatggcaggagctgaaagcaggaccaagaagcagaaatatgacaaaatcagagagaaatagatgcttactcctgtctaggtggctcataaattagctctcgacattcatcaattctttattatgggtttggtactctgcaaatcgtatccatcagagtttatctcctactttcactactgtcgttcatcgtggtttgaagacaggcctgattattcttacctgaagagactatctatgatctctttataggggaaggataccagtttgactgtgtgtttgctggaccattttgaagtatcctcaggctgcaacccccggacaatctgataaaaattagcagttgctagaattctagcatcgatttgtgtttttgtacgaacacctgtgtgtcatgtgtgtcagattagttgttttagttcccttttttctctataaattgtaataggtagcaactcttctcgttatagtgttgtacacaaccattt

SEQ ID NO: 8553 - DNA, 744 bp, Sorghum bicolor
  Clone ID: SORBI-28MAY03-CLUS44561_1
caggatcgcaaaaaaaaaagactaaagagtaaacacccacttctttgaattggctggcatgtatgtatatcatctctacaaatttaagtctgcctattgagagtgtgctcttgcttaaccttgacttcaaaaagatcaagagagagagagagagagagagagagagagagagagagagagagagagattgtcttggtaataacattcatcacacagctgcttgcttgcagtttgttctttgaatcaaagtactggggtaagttagttggtctttgctactacgcattgctgcaacaagcaactctagaggtagtataatttttctgccacgaaagataatatatatatgacacggccggatgcctttaaatacagctgcatcctcggtcccgtttcctcgcaacaagtcacaggatcggagcaaaacaagcacacacacaaccaaaaactcccgggcgccagctcgatcataccgaaaccatttcctccagcttgccgcgaccatggcctgcagtctccagggtggtgtgctcgtcctgtccgcgggggccgcccgccgctgggcgccctccggcgcgcgccgcccccggcgccggggtgggcggactccatgcagcagcccactactgccacttgtattacacactgcagtatacagagtacagttggaatatgaagtgcatgcatactgtacgtctctctctctcatcacttcctttgttgcatgcgtgtcgatcgatcgac

SEQ ID NO: 8554 - DNA, 915 bp, Sorghum bicolor
  unsure (1)..(915): unsure at all n locations
  Clone ID: SORBI-28MAY03-CLUS4463_1
cgggcgacgccgcaaggatttctttggccatagtgtagaggaggactgtgtgatggcaaacaattctggttcgtgcagatagcaagaggtgagaagctcacactggtgagccatcatggatgcacgagttcactggtgtggccaagcatgcaagtgggcctgtcactgctgccaagacgatatacgaggatgaggaagggtacttaatcgtggtgagcatgcttttctctgatccacatagcgtcaaggtgtcctggaggaacacgctgacgcatggcatcgtgaagataacatgcgtgagcactgcccggatgccctacatcaagagacatgacaggatgttcaagctgacggaccctttccccgagcactgccctcctggtgagtttgtgagagagatacctctggccacacggattccagaagatgcaaagattgaggcgtattatgatgagacaggaactgggctggaaatcatggtcccaaagccccgggttggaccagaggagcatgaagttcaggtgtgcatgaggcccccacatcttggtgacaacgatcttgtgctatcctagaacaggaaaacagttagcttttagatctcccagtgtcatgctcatgccattagatgctggaatgtaacaggtggtgccatggatcagtaagagccatcatatttgctgctaaacatgtagcttataagttgagaattcctttttccccataaaagttggtgatttaggcaaaagttccctccccctacctctgtcaattcccctctgtacctctgttacacaagtaaatcactattggtgatcttccttgactatctgaaagctggctagttgagattnctgtgtatattcagaatgaccaggttcnngtaataatgttgatggctacctatgattttgaggt

SEQ ID NO: 8555 - DNA, 920 bp, Sorghum bicolor
  Clone ID: SORBI-28MAY03-CLUS5220_1
ctgtactacaccatcaacaccacgcgccgccattaggagaagaagaagaggcagagcttagggagcgaaaaagacgcttcttcttcttgctgctgtgcttgcggatccgcggtggctgcgctcgccggcggggaagaggggtcgcgggcggcgcgcctcaagtctttcttcgcctccgtgctctttgggctctttggccaggccgaggacaacgagaacgaagagatggccacgcgcaaccacaacaacgccgtcgccgccgccgccgctccgcagctccgccaccacacaaccgaggcggtgttcccgctctcggaaagagcaaggccggcccggccgaactgacgccatgaaccggcgacccgtcctcggcgatattggcaacctcgtcaccgtccgcccagccgaagggaagcctcagcctcaggaacagcaggtcaatcgccccatcacgagaagcttcggtgctcaactcgtgaagaacgcgcaggcgaatgccgccatcaagaatgccgcaatcctgcctgcgaggcatgcgccgaggcaggacaggaaggctcctgctaagctgccgccgcctgaggatatcatagcacttagctccgactctgaacagagcaggacgcagtccgagagcagcgctagctccgtccgctcgaggaggaaggccatcaacaccctttcttctgtgctctcggctcgctcaaaggctgcctgtggaatcgctgataagcctagacaagtgatcgaagacattgacaagttggacgtcaacgatgagctcgcagtcgtggaatacattgaggacatctacacgttctacaagattgctcagcacgagagacggccatgtgactacattgaagcccaggtcgagatcaacgctaagatgagggctatcctggttgattggatacttg

SEQ ID NO: 8556 - DNA, 693 bp, Sorghum bicolor
  Clone ID: SORBI-28MAY03-CLUS52162_1
ataacatcccagcccccaataacacactccccagtatcatcaccaagttcaagcgccagggcctcaatgttgttgatgttgttgccctctcaggtggtcacaccataggtatgtctcggtgcactagcttccggcagaggctgtacaaccagacaggcaatggcatggctgacagcacgctgcatgtatcttacgccgcgcagctgaggcaggggtgcccccgctctggtggtgacaacaacctcttccccttggacttcgtcaccccagccaagtttgacaatttttactacaagaacctcctggccggcaagggccttctaagctctgatgaggttctgttaaccaagagcgctgagacagcggccctcgtgaaggcatatgctgctgatgtcaatctcttcttccagcactttgcacagtctatggtgaatatgggcaacatctcgccactgacagggtcacaaggtgagatcaggaagaactgcaggaggctcaacaacagccactgagggcactgaggtcactttatgtgctgaattgtatgtgatgttggtggcgtgttttgtttaaataagtaagcatggctgtgattcaatcatatgttcaatcttttgtgttttatctaaacacattgtaaaatgtgtatgtattaataactcaatatataagatgagttcattcttcggtgcc

SEQ ID NO: 8557 - DNA, 747 bp, Sorghum bicolor
  unsure (1)..(747): unsure at all n locations
  Clone ID: SORBI-28MAY03-CLUS52211_1
aaattatctgggtgaagaccaatcaacttcaacgtatcattcgaactggccgcactggccattggttgaatcacagcaaagaacattgtcttgttggaataaaaggaaaccctttagtgaacaggaatatagataccgatgttattgttgctgaagtccgtgaaacaagcagaaaacctgatgagatgtacgcaatgctagaacgaattagcccaaggacaaggaagttggaactgtttgcaagaatgcataatacacaagctggatggctttcactgggtaaccaattacaaggggtaaggcttgttgatgaagggttgagagcaaggtacaaggctgcttaccccgatgttgaggtccagccactgtctcctcccaggacaagcgcaccaatggatgttgaccaaagtagttcacagaaggctgctgcgccagatggtggcgagaggcccgcctgatgcttgcaaacttatttgcaagtcaccgtgtcaggacccactactgatcatatagttttcatcactgttagcgttacccctgttgtaaaattaggcagctcagttgtatttggttactgatgaggatcgtttcataagtatatcatgtgaaagaaaattgcactgtaacagccccagcaaaatattgccaccaatgtaatcagggcctatcttgtcttgttttccaaattccaagtgcatgtgtatgtccaanaaattgaaaggaaatctgcttctcttttgtgggggc

SEQ ID NO: 8558 - DNA, 767 bp, Sorghum bicolor
  Clone ID: SORBI-28MAY03-CLUS5227_1
gcacaggacaagtcccttttatccatatttccagtttgggcaatcaggaaacactactaccaactatacaagtggacaaggctacaacttgcaatatccacaaatgttccagttctcgactgtatcttctacagctgcagctgtcaccggctttgctcagcagtatgcacgaccattgtcactagcagcaagccctcaagcccaagcagtccctatcccccttaagcaggcatgactatggcactcgcagctccaaccctgccaactccaacacaggctgctcatccttaccggttgattccctcgcacttcgcagtgtccgctgctccagagcaacccttggcctaaccatggtctaaaactgtctcgtttccaatgcgtcgagtccatgcatccatctctaacaccaaaaggcactattgtagatcatgtttatcagccaaagtgctcacctccatatcccacatggtcatgtggtgactggatattagctttagccccaggatgggcacaaagcttcatcccccaaggatggggtgttctaacagacaagtacaaaccccaaccattctaacaatagtccaaggaaggacttttatcagggagagttaatttcagacgtaccaagacaaggctgtagctaaaagaaactaacagtcaagcatgacccagggagggttcatgctgatacttgtcaaattggacaacaatgacagctaaataactgatttaactagcatgccactcccacatttcatcagtagaat

SEQ ID NO: 8559 - DNA, 865 bp, Sorghum bicolor
  Clone ID: SORBI-28MAY03-CLUS52317_1
gcacgaggcgcgatgctgccgggccgtgccgccacggcccgagcgccaggtatagattcattacattcagaaatacaaggggattgcccacgccgatcccgtctggatctcacgtcgccggtgacccgccgcggctacgggtgtgacatcctcggtttatcctagcccgcctctgtgaccgcccgtcgaatttgtcctcccgtagcggattggagcagagatccatcgcctggcctgccgtggagtcagtctcgcccacctgagatggcttcgggactatctcacgggactagcatcgagtccatggcgcggccggtcgccgtcgaccaccgcatcagcatccactattacttccgcatcgctgacaacctcctccgccaggctaatgtgtatcgagaagagaagaatgttctggacctctacatcatcctcctgagatactcgagcttgttgcttgagaccatacccaaacatcgcgattaccatgcatttaaggccagagaaaaggaattcctgaagaaaggcccacacaactctgagaaaattcttggcgtcgtcaatgagctagagtccctgaagccagttgtgcagcaacaaattgccacctgtaatagcaggggtgcagatgaacctaatggtgtatatggaacctatgctgcaagtagtgggttggagcaccagaccccagacccatatatgtcaaagtcattggctggaagccctactagactactgcagaaaccgttacctggttcaaagcatcaagcagctacatcacagagtattcaaccttatagacatgctatgaaaccacctaccaacatgctgtattcaaaagaggaaacgttatcaagacactcaatac

SEQ ID NO: 8560 - DNA, 670 bp, Sorghum bicolor
  Clone ID: SORBI-28MAY03-CLUS44780_1
ctgcggcggtggacagaactgcaactcaaatgacgaatcagaaaaaggagatctgaaaacaagatttagatcattggatagtgattctgatgaatcaaataaggctatttctcctggaaataagaaagaccgttctgattctgatggttgctgctgtcaaatgaataaggttggcataggagagaagaaatcatgctgcttaccttctaagatcaatgatagttcaggtggagctgtgcttcgctatgctttgcacctgcggtttctgtgcccctccaagaaatcctcgaaatcaatgcttcggtgcaaatctgatccatcatcggcaccatacagcaataatacagtacccgaggaagagcggaggttctatctctacaatgatcttagagttgtatttcctcaaaggcactcagatgcagatgaaggcgagctgcgagtggagcatgacttccccgccgatcccaagtactttgacataagcaactgatggtccctctgctcccatcccatctcatgtactatagcttgcgctgctgctgctgctgctgcgcacaaaaagaatctgtaaatattttaccatgactaacttggtcatcagccatttcatcttttcgccagcaaaaatgtacaggttaatgttccaataaaatgcataatttggttcctc

SEQ ID NO: 8561 - DNA, 694 bp, Sorghum bicolor
  Clone ID: SORBI-28MAY03-CLUS44792_1
ctcagttcatcaaggatacaacacaaaaagcttcaagagtagagaagacaatgaatggtggatactacctactatcctttttctcatcaaatcactgcaagctggattagttaactggcacgttgcgaatttggagatccaggactactcgttatttagccctgacccagatagattctgggcaatgtagtcgcctgcagcaagctaagacttgcagaaagtatggtttggttgatccgaatgacaaatatcaattttgatcctgaatatcaacccgatgcaatctctgaatctgaaggggtctaacatgctggacctggaacttccttctatttctgggagctctccagcttagtgcagatatgtcaaattttttttctcacagttgtgtcttggtcgtgtgcctagaatagctctgtcgcccgggtgggaattagatttgtgcattttctttggttcaaattaaatcgttgattcgagtgtacagcaagaaactaatgagattggcgttctagtatgtacatcattgtaagtaatagaaccgttccaactgtaaacagttctcatggaaaactggaaaagcatgtttctttctttctgttgtgttttcccttttgtcactgttacattttgttccaagtgactgatcagaacagcatctttggcaagaaaataagtgcaaattcttttcctc

SEQ ID NO: 8562 - DNA, 678 bp, Sorghum bicolor
  Clone ID: SORBI-28MAY03-CLUS44822_1
agatcaagtgtgcccaatggcaaccaaaatggctattgtcaataatcccaaattatccactgctcaatttcatgctcactactgcgatatatgttgcggtttcccataggctcttcgaattgactaatacctggaagacggtatttgtaccaaatcgtgacaacaagcgcctctcatacaattttgtggcaggagctgccatttcggctgcactgtactttgtatcatttgttctaattggcattgcaggatactaggaagtctagttattgccctttcttttgttcaattagttacaacgacaaagcctgatcgacagagcaaatttaaggcgacacagcacgcactgctaggggggctgctatttcagtcactggactcgggttttatctgagttacatggtgaaggaaaaaattgctgtgcaaggcagaagatctcgaagagtgtaacatatgagtgaaccccaatcccaagaggggatatgataaaaaaaatatatatatatatccctgtataggcgttggaacgcaaaccgacttagcgagtgatcacgtcagctgtgaaaatcagattttgttccttgttttgtttaaaagcttgaaatagacagaatggttcctccttttttgggggggtttaaagcctgaaagtcagaggcctcatattttcctccggtt

SEQ ID NO: 8563 - DNA, 697 bp, Sorghum bicolor
  Clone ID: SORBI-28MAY03-CLUS44824_1
ctgatgcagttcatcaattattcttccttctccctagtggccgctcaggttgcgcaggttctgtccgtgctggcggggagctgctgcctatcggaattgcaacagcagcttttgacggcatccattcttccaaatgggaagagcctgatggagccaaaggatgttggctgatttatacaatgcaagctggcaaaagttgtgagttggagtcatatgatttgatgtcagctaatgatgctccagagagggatccaatggactgggttcttgaagggagcacagatgcaggttccacctggaatctacttgatgctcggaattctgaaatgtttgagagccgtttccttagaaaaacatttacagtggataagagatataaagcaaatgctttccggtttaggtttctacgcgtaagagaatctcattctaatccaaggtttcagataggatcaattgatctatatgggaaaactgtatgaacttcccggaactgtgtttcacttttagtgaggtcagcaagtggaagcttttctaacctgctcgatttcgcgaacctgtgtagtatcataaatccaattgtaatatggacattttttttaaggaatccggaggagccagtggctcctatgtaatatgaacatttactgtggaaatagcagacagtagtatcatgaatgaattgaataattaagaacaa

SEQ ID NO: 8564 - DNA, 741 bp, Sorghum bicolor
  Clone ID: SORBI-28MAY03-CLUS44837_1
gcacgagggctccacaacaaatggcaaagatggttcttcaggtccattttcatcaccatctcttgcctctaaagctgtctgtgctttgcaatgggaaacggcatccagcaaagcttcatcctgacattgcttattttgttcggcccctacccatggacttaaatactttcctatgcaaggaaaaccaattgaggggaatgtttgagtatgctaggaggtgcaccttcaaagatcatcttcagaagctagagcacgaggacagtgcagagcacagcgataagaaccttcaggtggcccagagtgttgcttcaaagatactgagcaatgctaatgttcaccttgtctcaatggatatgccagtaaccttcagtgttgatgatgcctctggcttgtgttggagattcagcagtgaaatcctgagcacttcaaaaccttgcctgattaccatcctcgcggaagggcatgcctcaggtccactggatcttactgtcaaggtgaactctgaagatacggtgtttgccctgaacctcctgaacagagttgtagtgatcatagattgaggtgtcaagtttttagtttttgcattcagtttaagatatcacgtggatactgtaaattgtacattatcagcaaatgaaaagggtatttgaagcacgtgactgtttgtaagaaagattgttgaatattgcaactccaatagttccaaaaaaaaagaattgataaatgaatgagctttattgc

SEQ ID NO: 8565 - DNA, 573 bp, Sorghum bicolor
  unsure (1)..(573): unsure at all n locations
  Clone ID: SORBI-28MAY03-CLUS44873_1
gcaccacgccgcctccccagtccatccatccatccatccattaccccgcgggcaagcattgccttccctctcccccggagcggagagccgcccgcccgcccggcctcccatggccacctcctcccgctccgtcccgcactgacgtgacgccgccgagggattgaggacccaagacctccagctggaggaagaggagtcggaaggagcggccgcgcgcccttcgccaagacttgcgtcgtcgggtggcccggcccttcgccggcgacgacaagcacccaccacgtacgcccgccacctcctcctccccttcatgccgcaccccaaaccctaatgttgctgaggagcagcgatgtcgacgactggcgaaatcctgcggacggagctatcttccaggacaccgccgttcggcctgaggctatggattgtgattggtatctgcatctgggtggcgatcctgttcatcctaggcttcatgtgcttctggtccatataccggaggaagcccagcaagtcgtccttcgacagtaccaataccatcccggtgtcccagattccggacgtctccnaggagat

SEQ ID NO: 8566 - DNA, 610 bp, Sorghum bicolor
  Clone ID: SORBI-28MAY03-CLUS44259_1
gtcgtcgccgcggccgccaatggcttcggccccggcgacctggacgcgcgcctcagggaggccgcagaggcggccgcgcgggcggcgcacgcgccgtacagccagtgtccgtcgggcttcgcggtggcagacggtgacgggaggatctacgccgggggctgcctggagtccgccgcctacaacccgacgctgggccccgtccaggcggccatcatcgcgatggtggcagccggaggcggacccgccggggacgtggtcgcggcggcgctcgtggagaaggagcaggcggcggtggcgcaggaggcgacggccaggatcttccttgatgccgtggccccacacgccagcttccacgtctacaagtacaggccgtccgatgcttgatgagcttctgtggcggtgggatgggcacgaacttgatcgtgataatgttcataaaaaaataatttaagaataagatgagaaaatcctgtgcagttgccagcaggactgtgatgtggggcctacttgtcagcgtgattattgttcttctattgccacttgtgttcactctactgtacttattcagagtgttatctgatttaatggttggcctgattggccacatttg

SEQ ID NO: 8567 - DNA, 954 bp, Sorghum bicolor
  Clone ID: SORBI-28MAY03-CLUS44295_1
tggacgttgcggcccaggcccctccgcccgcgtctatccttccgcacactccgggaaggcttgggcctccgccctctaaccacctggttccctgtggtgggttcgtggatgcttgcgggtccatcctgcaatgccctggctgcctgttgcggtcgcgtggttgcgggctcgtctgtcttgcttggccgttgctggtttttgctggccggtttctttcgggcctcctctagtgctcccctctgtgtggtacgaccggcctttgtttcgcggcggggctcgctgtgtgcaacaccctcgataactaacatccgagttcgaagtctgtggttggctgattcattcatacatcaactagaagaaccctctttgttgaaactctctcatattctacgtggatgggcttgcaccttgcaatgtgtttgataccaaatctcaccatacaaagactgaagaggtccgcgaagtttatgattgattagcatccatgtatatgacttcaactttcaacaaacacatgttgtggcccttgggctcgagataaaaaaaaggttaaaacttcaatccacaacgaccgcgcggggcagaggtaaatatcgtgccatgttccttccatagacatggtgacattgtcgcttgtgtttcatttgaatgagaggattgaatatacttcttataacattgtgaggaagttctaacgcatcttggtttttcctgctggtgtttttttggttggcattctctctccaactgtcatgaaaataatgaactgtacataaattcttaaagggctgtttaatttttgaggtgaaatgagatgatttacttgatcaaagtgtccatatttaggtgtatcatttttctgagtgtccaagtcgtgcctagaactgtgcgacgtgtaacagagcagaatgaagtccacctttagtcggtgattataatattcctggtttaact

SEQ ID NO: 8568 - DNA, 739 bp, Sorghum bicolor
  Clone ID: SORBI-28MAY03-CLUS443_1
gaaaacctagacgagaagtctgcggaaaggggaaagaactagagcatcgcgtggagagaggaaggcggcggcagcagcggccggtgggagatgtcgatcctgtgggagaagagcgcggggtggcgatggctagttcggcggacgcgtgactcgaagcccttcttcttcaccttcgcggcactgtgcggcgtcgtccccggcgttatcggctacggcgtgatgcagctcaccagctcccgcaacgaacagctcgaggcccaccttcgctccacggcccgacctgagaccacgatgatggggcaagtaaacagggagagactggcggagtttcttggcgagctgcaacggaaagaggacacgaatgacagatacattgctgcactgaagggtgaaactctgactaggaagcgctatgaacgcattcaggctgtgcctgccaacgaccaagcgggccaggagacgactgccaaggccagtgcggaggagaaacccaaggcaaagtgattccactagcaagatgtgccctagtcgaatcactcactgaatatacacatgcttgagcatcatcatataaacggtcaacgccattgaacgtcgttacgcttgagtatttgactcttcttctgttttaaacgcagctgttgtagcagctgtaaatttttcgtcatcagcgtatctctctttggtcgaatctttgggcggttcaatggatgctagtagcagcgctctcggttctgcc

SEQ ID NO: 8569 - DNA, 855 bp, Sorghum bicolor
  Clone ID: SORBI-28MAY03-CLUS44342_1
tggacgtcctggacacgacggggacaatgtactcgatggcggagtacgccgggttcgtggacgaggacggcggcggcgggttcgagggcgagtaccgcgcgttcctggtggacgccgggtcgacggtgctcagcgcggggctggggagctcgacggtgaccacctacatcgagtcgacggcggggatccgggaaggcgggcggacggggatcaccgccgtcaccgtggccgcctgcttcctggcgtcgctcttcttcggcccgctgctcatgagcgtgccgccgtgggcagtgggaccgtcgctggtgctcgtgggcgccatgatgatgcgcgtcgccagggacatcgagtggggcgacatgaaggagggcgtcccggcgttcgtcaccatggcgctcatgccgctgtccttctccatcgcctacggcatcatcgccgggctgggagtctacgtcgcgctgcactggtacgactgggcgagacacgggtacggcaagctcagcaacgcgctggacgagcgccggaaccaggtggccgccgccgccggcgaaatcggcacggcgccggcagcgcacgacgtcgtctgacgatcgaactcccgatgtgtgcgtgcaagaccgtagcagcagctggtcgtgttgtttagtaggctggctacccgcaacaaaaaaaatatatatgatgttgttgtttagtagggtgattattagcttttttagcttgatcatgcatcatcactttgggagggctttcagatggcaggggttggtgctgggggccctgtgtatgtatggtaaaaggggctggctgctggggagattcttgatgtgtttgtactttgaccatcattgcagc

SEQ ID NO: 8570 - DNA, 812 bp, Sorghum bicolor
  Clone ID: SORBI-28MAY03-CLUS44346_1
gcacgaggccgtagcgggtgcctgttgctccagcttgggagggctaaagagttggttggagggcgagtttgctcgagcccatgtcaatgccggcccaccgaaaggcatgtggtgcgcagtccccgcccggacgtcagagaaaaaggtgccagcgcggcgcagagaaaagaagaaacagagcccacagctgctgttgttgtgaggtgctgcgggtcctgggcccggcgccaaggtgcgctgtccgtcgttgttgggtgcagccctgtgtaggccacaaggagttgtgagccgggctgacctgtgttgaagaggcccgttaggaagaacgggtgctcttgttgggccgttgtcactgcgaggaggcagtccggccggtcgacgagaaaagcacttgggccgttgttgaaggaggcagaccaagaccacatcagaggtgttggtggtgcgcgcgcgcgcacgtagttgggccatcgccggagggggatattgccctccggcgggtcgtcgctgtggtaaaaagttgttcgatgctctggggggattcgtcgtgggctgctgaatagggggtgtggcattggcccgggaggccggcaaatgccggcgggttaattgggtccgggggttcgcccctcggcccgaagccccttgatctcgccgagctgggcttccacggagttagagcggcaaaggggttgagccaaccctcagtccgagggttgtcgccgggctgtgcgcgccacacgcgcagcccgcttcgtggagcgtgggctcgcaaactatatcccctcctaccactctttcaaaaagaaggc

SEQ ID NO: 8571 - DNA, 687 bp, Sorghum bicolor
  Clone ID: SORBI-28MAY03-CLUS44396_1
gcgcgacgacggctagcagcagcagctgcaacgtcggcggtgctgaggccgaggccgaggccgaggacgacaagaggaacgtcgtgctcgggtgcgtcaacaacatggagccgcccgagcccgagagctgtgtgctcgtcgggccgtgcgcgacgccggcggacgtctcggtggagtccgagtgcgacgaccaccaccaccaccaccttgattacgacgacgggttcccggagtcttactgcgccatgccggagctgtgggagccctggccgcttgtggagtggaatgcggtggcctgaaatggagaagttagctagtacataggctcaaggcttgtgtgtgtaacgtacgtgcatggtgctcctgctctcaacggaattaaagaggacgggccgctctgtgccaatggcggatgcgcgcggggcgccgccgggcagttggtcggaggattcggagcgccatcgaagtgacctttggagtttggaagcatatcacccaatgccattactgctttcgatgctgcaaaaatcaatggtatttgttcagaggcgctggcggtggtagtgaattgcacgggcttgcagtgttgtggttgtctttgtgtattcgaggttaatctaatggaagaacgttcgcttcacaaatttggtattggcgtgtacgtatatgcctgcttgcaaaagacga

SEQ ID NO: 8572 - DNA, 958 bp, Sorghum bicolor
  Clone ID: SORBI-28MAY03-CLUS4523_1
atcggtattcagtctcttctagcggccgtgtgcgaaggtggactcggaaggacgacggctcggttcgtatctccctttcggttcctgaggcgcgtgtgtcggccatgtcggaggccggccgccgcggagcgcgggagaagctccgggaggcggcctgcaacgccgtcgccggcggctcggctggggtgatctccgcgacggtgttgtgcccactggacgtgatcaagacgcggctgcaggtctatggcctcccttccaacttctctggcgcacctccgcctggtagggtgcttatttctggttttcagcagatattaaaaaatgaaggcttgcctgggctgtatcgtggcctttctccaacaattgtagcactgtttccgacttgggctgtaatcctacttttgcttgcgtctccagatggtgaactatctgtccaagcaaatgttctcgctgcttcatgtgctggaattgctcaacctactgcaacagcatgtgtatgggattcctgagctggcagatgaggagtcaagggtggaagctcaggaggaggtgcctgaagatgaggagatgcaagatccacctccaccacagtctgctaatgcaaggatgggatggactactgagctgtgagctgtggattcctgaagcagatcctaaggctttcttccatgagaatttggtgttgaccttggaacaccattacccggatttgcaagccacactggagtataactgcactgagcacaaacaccctctgaggagatcactttgggttgcagagctggtagtcaagacactggatgccactaaggggattcgaaaggtggaatcaaaacacatctctcgaatcagtcgggacacgatgaaggaaagcatggcagatgcagcttaccaggccttgatcttttaccgtggtagatgcttttgagatgtccaatacaatgcaacatatcactat

SEQ ID NO: 8573 - DNA, 595 bp, Sorghum bicolor
  unsure (1)..(595): unsure at all n locations
  Clone ID: LIB3481-045-Q6-K1-B12
cgttcggtcggctcggttcgtatcttccttggggttgctngggcgcgtgtgtcggccatgtcggaggccggccgccgcggagcgcgggagaagctccgggaggcggcctgcaacgccgtcgccggcggctcggctggggtgatctccgcgacggtgttgtgcccactggacgtgatcaagacgggggggggggtctatggcctcccttccaacttctctggcgcacctccgcctggtagggtgcttatttctggttttcagcagatattaaaaaatgaaggcttgcctgggctgtatcgtggcctttctccaacaattgtagcactgtttccgacttgggctacggtgagccgtacgttggtgaccaagcccaagcttttgaggaccagcaagctcaggagagctttgagcaagatgccgccccgcacccgtagtgctgcacgcatggctgctgaggagtaccgtgctatgttcaacctaggaggacagcatgtggatggagttcctgagctggaagatgaggaatcaagggtggaagctcaggaggaagtgcctgaagatgaagagatgcaagatccacctccaccacagtctg

SEQ ID NO: 8574 - DNA, 892 bp, Sorghum bicolor
  Clone ID: SORBI-28MAY03-CLUS45465_1
tttacactctgtcctcccttcaacctcattgccctcaagcttgcatcctagtcacctggcacaacgtgtgctaccaactccaaacccaactttacaagcggcggcaccgtcaggctcgaatacaacaatgccttccatccctacaggcatgcagccgccagattctgggtcactatcgctggatgcatggcttgcagctaatcttgggttgaatgatgatgcgtctacagctcctgctaagaatacagccagtcttgggttgagaagtgatgcgcctagggcagctcctgctacaaatacggccagtcttgggttgagcagtgatgtgcctatggggacggctcctgctacaaatacagccagtcttgggttgagcagtgatgtacctagggggatggcttctgctacaaatacagccagtcttaggctgagcagtgattcacctagggtgacggttcctgctacaagtacagccagtcttaggttgagcagcgagtcgcctggggcgacggctcctgctataaatggtcctgagatagatctggtatgcttgtctgatgatgaatgagacttagcaggtgtacaaggctgacagttagagatgactgcttgaaaagagtagggtgactgaaggcattattttacaggtcccttgagccgtcgttctggcaaggtaggaatgttgtttgtgctgtgaatggctggtaacagcaatgccagttttatttagattcactgtaaattggtatcatgacaaatgtcatccaacggttgttgtaaatcgctaacctacggggaacatttgtggagattaacctctgagatagagttgggtttcaagcgctatgagattgctgtacatgtttgtcattgattagggatgcatatccat

SEQ ID NO: 8575 - DNA, 623 bp, Sorghum bicolor
  Clone ID: SORBI-28MAY03-CLUS45486_1
agaagatcgaggacagcatcgcctttgtgaaggccatgccgaagccgctcgccatctacgcgttcacccaggacgccgcgctgcggcgacggatcgtggacgagacgtcgtccgggtgcgtcacctttaacgacgcggtggtgcagtacgcgatcgacgggctcccgttcggcggcgtcgggcagagcgggttcggacagtaccatgggaagtactcgttcgagatgttcagccacaagaaggcggtcatgaagcggggctacctcttggagctgacactcaggtacccgccgtgggacgagagcaaggtcaccatgatgcgctacctctaccgcttcaactacttcgccttcgtcctctccttcctcgggctcaggagatgaactctactccagcatcaacgcaaggattgcacagggattcgattgtacccaataaactgacagtggatgcaggaataagccaatatagacaatatgcagtagctgtgttgcttgtgattgtgaggagcaagtatcatcctgcacttcaaaacccgtaaaatgtgctaacctgcatcctatctatgatttgcctgtagtgaaagtgtgaaacaaacagtaaaattcctttcaatctttagc

SEQ ID NO: 8576 - DNA, 1064 bp, Sorghum bicolor
  Clone ID: SORBI-28MAY03-CLUS45333_1
gttttggtgtttgtctatttctgcagggggttatcaggaaatatggaagaaaggcccacatgtcaggattacgtaaagatattaacgtgctgcgcaattatcttacatctagaagactccagaagccacgagaccgaagcggaggcgaatcggggccagacacagggcgcccgccctgtccgactgggcgcccgccctgcccctaagtccaatcaggactctgctttgcgggaactctccaccgacctaaaggatgaatctaaaccatacaatctatgtcggtttgatccaacggcccatattcacttgcagggactataaaaccagaccccccggcccctggaggagtggagctctcaaccctaattcattattcatcaagggagaagaagcctctgatcaagcctagagccaccacatcaattagatatctagattagcacagctacataggattagaactagaaggagtcaatcttcgattggtttccggatctgtcaagaggattcttggtaattctctaattgtgcttctaacttgctttcctaattatctttgttcttcaatattatgaatatgactttgttctacttcaatatattgcttatgactttgctctacttgcttatattcaagattatattgttcttagtttatcatagttatgtacttggcttagttagattggatttatatacatgcttaggatcgtatagcgtttatccatcggatccatgggtaaatgatagatattgtgtaggcgtggtgcttataccgtatttatctgcgattgtacgcaatatgccagatcgcggggtggttcgtgatagtgacagcttcattgattcttatatagtccccctctcgtgtattgggctggcagagcaatattattacaggggagtgattgctatgtttctcatattccttgctaatatcactatgcatgggcgtagtcttgtctcgcaatgattgctaagtatgcttgcactaactatgatatgctagactatatagttaagaataacttagggaatattcttgtagttcgttctaataccat

SEQ ID NO: 8577 - DNA, 628 bp, Sorghum bicolor
  Clone ID: SORBI-28MAY03-CLUS45506_1
atatggatcctgattacatgtccacaaataagttaacaaagaagagtgatgtgtatagtttcggcataatactttttgaactgataactgccataaatccgcagcaaggtctaatggagtacattaatctggcagcaattggaggggagggaagggttgattgggacgagatactggataaggacctcctagtagggaacatccctgaagaggtccggactcttgctgatgttgcctaccgatgcgttaacaagagtccgaggaagcgccccttgatatcagaggtcacgcaggccatctcaagactcaggcagcgccagctgagaaagcatgatgcgctaacactgccgaggagtgagaccaggaccgtacttaggaggatagaataccagcatgtggagcttgctgccctcaccagcatgagagaacttacgccgataagggcatcatgaacttatgatgagcttgttctagtatgtaggttgcttgatagagttagattttaacttgataaagaaacccgtatgaaaatgtaaagagggttgatcttggttcgaccttgctgtagctgtttgatgaaagcatcaggtagttactagatcgttaaagatctcttgtcttggttgcc

SEQ ID NO: 8578 - DNA, 574 bp, Sorghum bicolor
  Clone ID: SORBI-28MAY03-CLUS45520_1
gacggcggccgctacagggccgactaccgctaccagcccttcctggcgggcttccggacgttcaggaccgccggatgcgaggccgccgcgcccgccgccgggtgcccacccgtgccggcgtcccccgccggcgctgggctcagcgtgcagcagcgtgacgccatgcgctgggcgcagcagaggtccatggtctactactactgccaggattacacaaaggatcgctccttatacccagaatgctcgctcgctacctagctagctagcctgatgatgagtagtgattcattaattaagattattaagcaccctgccgtgcgtaactagtagtaattgaagcatgcatgatcgaagcagcagctcatagcagatcatatagcagagagcggcaagggaggaggcgtgcgattgaagcgccgccctacgtatacgtagtagtacactagtacgtacgtacggatcatcctaaaattgttcactggtggttgaggcgtgtgacttatttatcttcaattcagagatgcacactagtctggatccatatatatgtaatgtataaataagtccattatct

SEQ ID NO: 8579 - DNA, 667 bp, Sorghum bicolor
  Clone ID: SORBI-28MAY03-CLUS44644_1
aagcagaatccaatccaatcccctcccctcccccgctcgcgccgccccctccctccactaatcccacccggccagccccctcccccgcgaatcaatccatccatccttcttcctccgcaagccagagacagaggcggcgattgtccaccgtgcgtgttccctccggcatccgcgggacggacgggggagcaaaacctcaccagcggcgagggtgggcgatgaggtcgtcggagccgtcgtcgcggttcgtgcaggagctcgtgctgtacgccgccagcgccgcgctaagctgcctcgtcctcttcgcgggcctccgccacctcgaccccaaccgcgccgcctcccagaaggcgcagcagcagaagaaggagatcgccaagcgactcggccggcccctcgtctccaccacgccctacgaggacgtgattgcgtgcgacgtcatcaaccccgacagcatcgacgtcgagttcgactccattggcggcctcgaccaggtcaagcaggcgctctacgagctcgtcatcctgcccctgcgccgcccggagctcttcgccttcggcaagctcctcagccccccagaagggcgtcctcctctatggcccgcccggcacgggcaagaccatgctcgccaaggccatcgccagggagtccggcgccgtcttcatca

SEQ ID NO: 8580 - DNA, 1000 bp, Sorghum bicolor
  Clone ID: SORBI-28MAY03-CLUS4465_1
gtgatgttaagtcacctgaaacgattcttgatcatgatcggattatatggctaggggatttgaattatcggattgccctatcatattgttcagcaaaggctcttgtggaaatgcataactggaagcaattattggagaaagatcagctgcggatgcaacaaagatatggacgagttttccaaggttggagagaagggaggatctattttcctcccacatacaaatattcattcaactcagatcggtatgctggagagggtaggcaccctaaagagaagaggagaacaccagcatggtgtgatcgcattctctggtatggtaacggcctcaatcagctgtcttatgttcgtggcgagtctcgtttctccgaccacaggccggtgtacagtatcttcctggcagaggttgacattgtacaccaaaggaggagaaacatgggatatttcagctctagaatcgaggtggaagagctcttgccgcattctcagagctatagagaaataaagttttattgagtttgacttatagcatgatataaggttaggaggttggtcaaatgttctacgtccggggttccagattcagttctctagatgatcagatataccgaagacagaatgtgcaaatactaactgaatgaaaaggacattgggcaattttgctgctgatcaacagaaaacgatggctatgtcgtcggagatgtaccagcccatgtcgctaactatacatttcatccaactttagcccccttagttcctcctagtcctagcgacatatttgcttcatttttttttgttcgcttttttggtagttgaaccctggagtgtcaacaaacacaacaacatgttttctttttcttttcttttgctttgcttcttttccttcaagactagaaactttgtaaaaccagctaatgtttgtgtaccccagcaagtcgtggacccgttttaaggcagtgaatgatacattgaatgaattagcttcaagatgatttatatat

SEQ ID NO: 8581 - DNA, 604 bp, Sorghum bicolor
  Clone ID: SORBI-28MAY03-CLUS44676_1
gcggcggcaggagccaccttcgaggaggtgttcgagctctactgccaaggccactgcgggctgggcccgcagtgggagcacgtccgcgagtactgggaggcgagcaagaggacgccagggagcgtgctgttcctcaggtacgaggagatgctgcaggacccggtgggcaacctgaagaagatggcggagttcatggggtgcccgttctcggcggcggaggaggacgccggcgtcgtgcgcgccatccttgagctgtgcagcctggacaagcagcggagcctggcggtgaacaagaccggagcttacgcctacgtcaacgctcgggagggcttggtgacacaagtcgtggacaacaagcatttcttcaggaaggggatcatgggggactggaggaaccacatgtcgccggagatggcagcgaggctggatggcatcgtcgaggaggcactcaagggatcgggatttacctttgggtacaccaatacaaataattagggcacgtttggcacggctccgcagtctccgctctactgttgacaatggagataggagtgttttaagatctttatatcaactcgatgtaataaacttgaactataataaa

SEQ ID NO: 8582 - DNA, 667 bp, Sorghum bicolor
  Clone ID: SORBI-28MAY03-CLUS44679_1
agctcgaagatattgatagcatgcaagatgagatgatggatcttatggatgtgagcaacgaaatacaagaaactcttggcagaagctacaatgttcctgatgacatcgatgaggaagaacttatgggagagctcgatgctttggaagctgacatggactttgaatcagagtcagtcccatcttacctccaaccagaccaagaatctgaactcaacttgcctgctgcaccaactggccatgcagcagtcccagcaaatcagcagcaggaggatgagctagggttgccgacagtaccacaagcttccattcgtacctagttaaacagaatcacgtttcttggagtgaatgatgtaaagagagtcgtatgatatctacaattggatgtaaaatgttcttatgtaccgcaccactgatttttttgccacttcacttgtggacggtgtaaatgtgattgaattgaattggttgggacataataagatcctccttgtatttggtggtggagggctgtgctctgccctacatggttgtacatacatatgaggatctgttggcatccattttgcttttcatgctgtgcattgtctgcactgattgggtttagcgaagtacaatatgatttgttgtacatgtacagcatatgacaatgcctgttcaaaagtttagc

SEQ ID NO: 8583 - DNA, 1145 bp, Sorghum bicolor
  Clone ID: SORBI-28MAY03-CLUS4478_1
cgtccgtcttggtgtatgagtacatggagaacggcactctgaggtgccatctttatggcacgaggtgggcacctcttagctggaggcaaagactggaaatatgcataggagctgcaagaggcctccactatcttcacaccggtgctaaaaacacaatcatccatcgtgatgtcaagtcaacaaacattcttcttggtgaccatctgttggccaaagtttctgacttcggcctctcaaaggttggcgctgatactgatcaaacgcacgtaagcacgacagtcaaagggacctttggttatctggatccagagtacttcaggactcagcagctgacagacaagtcagatgtatactcatttggtgtagttctgcttgaggtgatctgtgcaaggccagccatagtacaaactcttccaagagaaaaggttaaccttgtagagtggggtatggcgtgtcataagagaggagaacttcatcagatcattgatccacatcttgtcgggaaaatcatgcccatagcattgagcaagtgtggggagacggtttgtaaatgcctctctgattatggagtggaccgtcctacaatggcagatgtactatggaacctggaattcgtgctgcagctgcaggagtcaggggaagaaaactccaacattcacatggataacgcaacctcacagcagaacctgcaggaattcacgttgcagctgcaggagacaggccaagacgacaactccaacatgaccatgactaacgacaactccaacacgaccatgactaacacctcaatacagacaatggaagatgaactgccttgaattgttctgcagagacagaaaaagtacctttgccctagaaaatggattatcatccttgatgtcgtcgtaactttgtccttatgtgtctcaagacagatccatgcattctggattgtgcattcaagctctgctcacctcttatagttatatgcatccttgattcgtgaaataccagtttatttaccaaccgactttgattagctgtggtaatcacaataccagtttattttctttttctttttattgtaaacttgctttgtaaactcttctgcttgtttatcttttaatatattccagtagaggctccctgagcctctcctgtttctc

SEQ ID NO: 8584 - DNA, 585 bp, Sorghum bicolor
  Clone ID: SORBI-28MAY03-CLUS45807_1
gcacgaggctttgcagcccgagggctctctctgtgtgtgttactgcgtgcaaattaaagcagcagctcttgctcgatcgcgggatgatgtctgagaggaatctccttgcacgccgccagccgctgccgcccgccattgccgtggcggtggtggtggtggcggtgctcgtccatccacgagcggtggcggtggcgcaggctcagccttcgccgggctacttcccgagcgccacggtgaggtccatggccttctccgaggactacgacaacctgtgggggccgcagcaccagacgctgtcgcaggacaagatggcgctcacgctcttgatggaccgaacctcaggcagcggattcaagtcgaagcgctcgtaccggaacggctacttcggcgtctccatcaaggtgcagccgggctacaccgccggcgtcaacaccgccttctacctgtcgaacaacgagctgtaccctgggaagcacgacgagatcgacatagagctgctgggcacggtgccgggggagccctacactctgcagaccaaacgtgtacgtgcggggcaccggcgacggcgcgcacctggtggggcgg

SEQ ID NO: 8585 - DNA, 656 bp, Sorghum bicolor
  Clone ID: SORBI-28MAY03-CLUS46033_1
ttgtgcttcatacagttagcccagttgaccatgatcccaagttagtagaggctgaggttgcccctggtcttggagaaaccctcgcttctggaacccgtggcactccatggagactctcatgtcacaagtttgatggcaaagtcacaactctagcttttgcgaatttcagtgaggagatggtggtgctcaactctggccctactgatggtgaagtgactcgtaggaccgtagactacagcaagaagccgttatctgttgatgcaacctttagggggcagtttggtcagcgccttgccgccattggacagtatctggaacagaagttcggaagtgcccaagatgtggaaggttgcctggttggccaagatatatttatagttcagagcaggccacaaccataataaacaaaaagttctgctaagatgaatgtggttacctggttagctgaataaaaatggatactggctgaagaaatttaaggactctgtagcatgaatagcagtgattgagtctttttatatgttatcttaggaaaaataataatttggcacaggttcagccattcacttgtatcgattttgtgaactaaaaaacttactggatatacataatgaaaatctacaggacttataagagtatcttcagtaatactactc

SEQ ID NO: 8586 - DNA, 810 bp, Sorghum bicolor
  Clone ID: SORBI-28MAY03-CLUS46044_1
gatggaaagagcctgagctcagaaactagacttgtgattgagcaggaggtgaagaatttcttggagaatgcatataataatgcgaagaccattcttacaaaacacaataaagagctacatgctctagccaacgcacttcttgagcatgagaccctcacaggagcccagataacgaacatattggcccaggtacataacaaacagcaacaggagcatactatcgaagcaccgcagaagaccccagccgcaccagcttcccccgcatcaccagctgcatcagctgccgcagcagcagctgcagccgccgccgcagcacagcaggcggcagccaaagctaagggggtggctggtatgggatcttagcacatggaccactccaccagattgcattgtgtatatttcatcaaacaagcaaagctgttccagcaattgacagtcgacgagggtcattggtagtatgctaaagtgctgcagcaatagaacatactgattgcgtggaagttactgttcatgtgccttcagtgcaaagcagaaacaaaaactttacacattgtagtaggcacatttagctggtgcttgaatcagttttgtacccacatcgaaaacaatttatgttgtttacaccccaaaaattgttagattttgatctgcctgcctcttgtaccttaacagagcataaattgtaacacattctgaataagtgtcctgtgtgcttaatacaatgtggtagctgacgagtcgattcatcagcccctctgaggctcatttgttgtatgttacttcccccatcttaaattataagtcattctg

SEQ ID NO: 8587 - DNA, 656 bp, Sorghum bicolor
  Clone ID: SORBI-28MAY03-CLUS4605_1
ttggatctccacatggtcttccaccagagctccctgtggatgagagctggcgccccacaggacagatgagagggagtctaacaggcaatgcttacagttctgcgattcggcactatcggggccggtctgagcagcagcagggccagcctcggcctcccagcacttctggcgcgcgaaggcctcagtagctgccaggcattgcagtgttgctaattatcaagcaggactgtgggttacctgattcttttggctcgtgtttcggcactatgatgatctattttagtgtaggtacggaagtctagtgaatagtgagtagttagtgctcggcttgtctaccacgcacctgtttgtaaccggttctagcacacacctgcttgtaatcagctacaaagtcggcagcgtagcatacgaccagtgctgtaaagtgcactctgatgatgttaaattagtacttccttcgtcctaaattataagtcatatcaagaatcttgtagagtcaaagtttttcaagtttgaccaaatttatatagactaagtatcattagattttttgttagttatatttttatagtgtacctattttatgacataaatctttatatctctctctattttttgttaaacttgaaaatgctttgatttttcaagattcttgg

SEQ ID NO: 8588 - DNA, 1254 bp, Sorghum bicolor
  Clone ID: SORBI-28MAY03-CLUS4613_1
aatctcccgggcacccggcaagaaatggagctgagcctccccctcctcctcgccgcctcccaagctcctcctgctccgcgcgcgtagccgcgccgcacctcccagtcctaaaaacacgcccgcgagctccggtccccgcgcgaggtgctgtttgagccctgaagatggcggccatgactgcttacaagtatcaagctcaggcgatgatgagagactacttgctagctgatccgctcgttccctacacctctgtgctcattggcgttgtcctctgcaagatggcttatgatttcactcgaatactgagctccttttatttcaagggctatacttcattgacaaagatacagcgcatcgaatggaacaataggggtatgtccagcgcacatgcaatttttatcacggctgtatcattatatcttgtcatgtcgactgatcttttctccgaccgcatcaagggacctattacattccgtaattcaataatatccacttctgcattaggggtttctgttggctacttcatcactgatcttgcaatgatcttctggctgtatccttcccttggtggaatggaatatgtcctccaccatactctttccttggttgcgatagcttacacaatgttgtctggggaaggacagttttacacatacatggttctcatttcagagacaaccacccctgagatcaacatgagatggtttcttgatactgctggactgaagaaatcaaatgcttatttggttaatggaattctgatgtttgttgcatggctggtggcaaggatatttttgttcatgtatgtattttaccacatctatttgcactacagtcagataatgcagatgcatgcctttgggtactacctgacatttgttgtgccatcagtgctctttgtaatgaacacaatgtggttcatgaagatcttaaaaggtgtgatgaaaacactggcaaaatggccttgatggatgaagccaagaggatcccagaactatcaacaggatttggtctttctggcatcagtgcgtgaccttaatctgtaaagttatggatatcagggtaactagagaaagttaatatgtaaagtattagcaaacaagctagattaggtgaaattgccccgtttttagcaaagctggaagtttataaccagtttggtttgtaccggagatccagcatgctgttctgcttaccccatctgtgccatgtgtatattagaagagcattttaatggatggtttgtaaacagtc

SEQ ID NO: 8589 - DNA, 916 bp, Sorghum bicolor
  Clone ID: SORBI-28MAY03-CLUS45037_1
gcacgaggctgagctgtctgcgaaagcctttgcagtgatggttttgatgcttcctccagacagtgcacgaaaatggcgaccccatgaactggagcttgttgaagttgttgctgatcaggtggcagttgcactatcccatgctgccattttggaagagtccatgcgtgcccgtgatctgctaatggagcagaatattgctctggacgcagcacggcgagaggcagaaatggctatctgtgctcggaatgattttcttgctgtcatgaatcatgaaatgcggactcctatgcgagcaatcatttctttatcatccctcctgttagaaacaaaacttactgcagaacagcgcgtgatgattgaaactatactaaaaagcagtgatcttctagaaactctttcaaatgatgttttagatatctccaagcttggggatggcagtcttgagctggaagttgcaccttttaatctacatgcaacctttacagatgtggttgatttaattaaaccagtagctgcattgaaaagattatccgtaatggttcatttggctccagagttgcccacctgtgcaattggtgatcgaaagaggttgatgcagataatactaaatgttgctgggaactccgttaagtttacaaaggagggtcatatttcaatttcagcatctattgctaggacagattctctgagggacccatatgctcctgatttccatccagttctctccaatggatctttttacttggctgtgcaggtaaaagacaccggctgtggaattagcccgcaagatatgcctcacaccttcacaagatttgcacacccgcaaaatgctataaacaaactgcataatggcaacggattgggtctggccctttccagaagatttgttacccttatgcaagggaacatctggctc

SEQ ID NO: 8590 - DNA, 660 bp, Sorghum bicolor
  Clone ID: SORBI-28MAY03-CLUS45105_1
tcggtgcggctcctatttcgtctatgatgactgtcaagcgatggtcgcgtggcccttcagccactcaaattggaaaacccgctgttcacatggctagcgttgacttgaaaggaaaagcatacgatgtgttgagacagaattcttccagctttttgttggaagatgtctacagaaacccaggcccgctccagtttgaaggaccaggtgctgattcaaagcctatttcattgtgtgttgaggatcaagactatatgggcaggataaagaaattgcaggaatacttggagaaggtgaagagcattgtgaagcctgggtgctcgcaggatgttcttaaagcggcgctgagtgccatgtcttctgtgacggagacactgaacatcatgacttcatcttcagctggccagactctactgtgagtcattaggtaccattttatggtgtggatcataatccccacttttttccatggtggcgattaacaagtttaggaacagtaacccgggtatcacacgggtacttttgtagctttttggagagctctatcagttttgatttcggtagtttatgaaggcttgtttttaatgagtttgagctcgaataatttttgaaacagccggattgtgaaatcttaataaaccaaattttgtgactgcatccaaa

SEQ ID NO: 8591 - DNA, 616 bp, Sorghum bicolor
  Clone ID: SORBI-28MAY03-CLUS45163_1
atcaaggcattcagatcattttatcaatcgcttgttgagaagataagaccacaagggaatgggagtcttgttttcagatagcatcattctttcattttcaatatgtttttcaccaaaagactcctcaactgtgttattcaattataggctagttgtgccatcaatgtacatagagctaccatttctgaggttggaagaggtattactgcggcattatctttaccaagactggcaaccatggtggcatccttattcattgtattctatctgagatgcaggggaattcatcctgcaatagtttctactgagaaggaaatacagggttctattttcttattttagcctttctccccaaatcatagactgttctgctgtctgggcctgaaattttgcaaggtacttccagtgaactagttggtataggggcaaaaagagtgttgtgtaggctgtgtttttcctgacgaaaaatgtcacaccgcctgttgtgttgtaagtcgtgttgtaccaaattttgcgaaacggcagctggttttgcaccccctattaccatttggggtgatgtacatattttttttgttattttccccatttgctttcaataattattttatcgcct

SEQ ID NO: 8592 - DNA, 680 bp, Sorghum bicolor
  Clone ID: SORBI-28MAY03-CLUS45297_1
gaggaaggatccaggcgcccctcttttgccaaggaagagccccttctgagcagtcctgcccacagcactgatgataagtctaatgaaactaatacgactttaggagtcactgctgctttcactgcccagacaagtgaagtagtaacgagtgtggaggactccactagtggctcacaacctgcaactgctggcccagttgctattgctgatgcttcgggcgcgacggctacaaattctcttcaaggcaagggaagccgaagcctgaatcggaggaggactagaaagggcaagggccagagccagtctggtacacgcacaacacctgcagctgaaaaatcaagaggtgcgagcatcgtgagccggataaactccaaggttgagcggatcgaagcatggagatgaaatcaaaagccatttccattgttgttgtgtactagatgactgacccagtgtttcctgaaaatagcaccccgaactgcttgcacattttgcattttctatgcgcttatcattccttactgtatcatggtcattgtgttgtgagatttgagcttcttgtctttactaacttgtgtatctttcttatggttacatctgtgagtcaatgaaagatgctggtgctttcctttgtacattaatcttttttatgcctaatttatcaagtgcctaaaagttcaggt

SEQ ID NO: 8593 - DNA, 639 bp, Sorghum bicolor
  Clone ID: SORBI-28MAY03-CLUS46394_1
gcacgaggcttggctgtcaatcgctcgacgacctctgctaaatgaggtctcgccggccggccgtatgaggcaatcatggaggtagtcacggtgccatgagcccatgatcaccatcctcgccatggccaagctggggagttttaacctgcccaagagtgtgagggttcagtcgtctttcctcactctcaatccgtaggtctatgtctatcctcgccgtctcgtcattacgacccctttcgctttgctggacgagtcccgtgcgcgtgcaggaaggttcaatttgaaacaaccgagctggcgagcgagcatggaaatcgcgacgggagccataagcacactcctgcccaagctgggcgacctcctcaaagaggagtacaagctccagaagagcgtcaggggtgagatcatgtttctcgaagccgagctagaggccatgcagactgttcttcttaagatctcgtcggcgcccatggacgagcagcctgacgcgcaagtcaacctttgggtgagggaggtccgggagctttcctacgacctcgaagacaacatcgacagattccttgtgcgcatcgaccatgcgccagagcagctccatggcctcaggggcttcatcgacagaagccttaagcttctgaccaa

SEQ ID NO: 8594 - DNA, 658 bp, Sorghum bicolor
  Clone ID: SORBI-28MAY03-CLUS46290_1
gtcgccgccgacgagaggcggcacgaggcggcgtacaccagggccagcgccgagctgttcgacgtggacccggacggcatggtgcgcgcgctggcctacgtcatgctcgggaaggtcaccatgccggggctgctcatgtcggacggcctcggcggcggcggcgacagcctgttcgcgcggttctccgcggtggcgcagcgcgccggcgtgtacacggcgagcgactacggcgacatggtggagcacttcgtgcggcggtggcgggtggcggacctcggggcgggcttgtccggcgagggccgccgcgcgcaggagtacgtgtgcgggctggcgcccaagatccggcggatggaggagctagcgcaccggagggcggcccgtggggagccaggcctggcccggttcagctggatcttcaacagggccgtcgtggtgggctgaccctttttccacagggaataacctcagacgcttcgtgggccgtgtgttgtatccatgcttgcttcttttaccgatccagtattgcttgaatcctgctaaaaaagagagtattgcttcaatgaaggtcatatattagaccgtttgtatctactctgctgtgttgccgtgtacttcctcagtttgaaaatgtatttctttactcataaagaccgtttgt

SEQ ID NO: 8595 - DNA, 969 bp, Sorghum bicolor
  Clone ID: SORBI-28MAY03-CLUS46420_1
gcacgaggctgcctgcttatatcaccacaccagctagctccccatcacccccgccgccgactactgctgctgccaccgcccgctggctggctaaaagcgcgtaggctgtgaccgactgcgagggcaccgcaccggagaaggagcacgcccgcgcccgcgcgaaccgcagcgcagaggcaggggacttgtccgcaggtcggtcgatcggtcggcatgaagctcccgctgctgcggccgctgtggccgggcctgggccccgcggcggggccggccgacgcggcgccggagccggccaagccgtcgctgccggcaacgtggctgctgctgcacgcgctcttctgcgccacctccatggccgtcggcttccgcttctcccgcctcatcgtctacctcctcttcctgcccaccccgcccatcaaccccgccgcgcacctcgtctcgctcgtgtccccacccgccgtcgtgctcgcgggcgccaacgccacggccatggcaacgatcaccacgacaacgaccacgacgaccaccgtcaccaccaccaccaccgtggccgccgagatcggtgaccacccgcagccgcagcaccaccaccaccaccacggccccgtcttcgtcggccgacatccgatccgcgtccgcgcctggccccacccggacccaagcgagctcctcaaggcgcaccgcatccttgccgccgtccagaacgcgcagcgcagcaccaagcgccgtggcgcgggacccgcgaggcctgtcattgccgtcaccccgaccaccacctccgcgctccaggtgccgtcgctgacgtctctggcgcacaccctccgcctcgttgacgcccagctcgtgtggatcgtcgtcgagccgggccaccgcaccgacgccgtcgccgcggtgctgtcccgctccaacctcgacttcctccacatcaccggcgctggcgactccacggcgagcctgcgattgcacgcc

SEQ ID NO: 8596 - DNA, 597 bp, Sorghum bicolor
  Clone ID: SORBI-28MAY03-CLUS4648_1
gccgctcgaggggccggccaggcggccgggatacgaaaaaaacgccacgccacgccagggccggccagacagattcttctccgcctccgcctccgcctccgcgtgacttagacttggggtgtcgtcgccgagttttctccggcggagggcggcgcgaccggcaaccagcgtgagcgcgaccactcggcgacatgactcgcggcaaccagcgtgaccgcgaccgtgagcgcgcggcggcgcggaagcccaacgccaagggctctcaggacgggctcaccccggagcagcgccgcgagagggacaagaaggcgctggaggagaaggcggccaagaaggcgcagcaggcagcggccggcggcaccgggacctccaccgacaacaacaacaacaacaagaataaggcaggtggcaagaagtaggcgcccccgtccacgcgcgcgccgccacctctgtacgattatcgatcgatgcctttagcttgtaaacctgttcgcatccacctagatgcgatgcttgttgggtcataaactcgtcttctgttactctgatgatatccacatttggtgatgagaaaaaaaaaaaatgtaatgcgcccta

SEQ ID NO: 8597 - DNA, 592 bp, Sorghum bicolor
  Clone ID: SORBI-28MAY03-CLUS46607_1
gcacgaggatcacactttgccaaaaaagaaaaacagcaagagctagctagaaataatggcgacgcaagggctggcaacagtgatgacggtgaagctcggctccttgggctggagcaagagcaactactcgagcggaggaggagcagcactcaggcttctccttctctcccctgcacaagcacaacccagggtccccgctcttcgtgcatgctcgtcgcccccctgctgcggtgggcttggctagctactggttaggttaacacgcacaacgaactgaacgtacgtactgatcgatttcttggccgggtgtgcatgcatggcggcggcgcctgctagtgtgcacgcacttcgtgcatgctcgtcatccacctgcagcagaggcgccgtggcagggagatggagcgctgccgccccgccggcccccgcggcccccgccggccgcccccgcggcggcctcccccgcgccgcggcggcggcggcggccggcggcggggaggccaacgacaacgacagggcgttcgcggaggagctggccgagctgcgggccgccgcggcgtgcgttcccgacgacgtgctcgtgtgcctggtgggc

SEQ ID NO: 8598 - DNA, 703 bp, Sorghum bicolor
  Clone ID: SORBI-28MAY03-CLUS45524_1
gccgtatgatcatagagcggatgttttcagttttgggatagttctttgggagctgctgactggaaagcttccatacgaggacatgacacctcttcaggcagcagttgccgttgttcaaaaggatctgaggcctattattgctgctgatactcatcctatgctcgcgaatctccttcagagatgctggcagaaagatcctgctctaagaccaacctttgccgagattgtggatatactcaactctataaaggaggtggttcagagttctgtgcatcacaagaggcatccaggtcgatcgcactctgggaggagacgaggctgttgatgcgccagttttgtgtagtgtgcacgcccgtttcattttcattttgtagtcgagtgatgacttcagaatgcggccagaatagtttactatgttcattccgagagtttttttacaacttttttctttaattttgtgaaaggttatcagctttttaaattttgactaaactttccacctttaaaagcttatagaagggggcatatccacgtttacatttggcctgtatctgtatttcgtactgtctctcctttcttttttcaagttgcggtaggcaaccaagattcaaatgaaaatctttaatcaatatagaataagtatgtgtagattaaaccatgtaaatttagagaaccattttggtatattgttaattttatgttt

SEQ ID NO: 8599 - DNA, 686 bp, Sorghum bicolor
  Clone ID: SORBI-28MAY03-CLUS45532_1
aatatgcaggtcccaatgcccgcccttcaggtggtttcagagaaagtcttcttcatgctttgaaattcaacgatttctaccatgacaccgttcaccagtttgctcctacatacaatgaatatgtgctctacaatcacaacgagggagacaatgcacaaacgaagtatccctcagggagcaccgccccaagtggtcagggtgtagagttggctggcatcaccgtggtggcttcaaacagtccagtgacatcaagtgtatcatccaaccaggcagagcaggaagagacaatgacaacccctatcaaggacaaagtcgatcctcctggagggctttacgatctgacagaattgcttgatgtggatttgtctagctacccagccaaggttcctgcaatcaccgatgtaagaaaacaatgatcaagcttgatgagatgggctattagtaggtgttgcaattgggggagatcgtgatttttgttgaagagttaccatagttaccattgtaaaaatgtgtgtattacttgttctgatttttccccattgaaagggggtttattcattgtcagcagctgctgccacacggcctcattcaccctgctctctactaactgtgtaaaatgttgtgagctcaaggtggaccttaagtgtcaaggggaatctatactaatataatattctgcgtttctg

SEQ ID NO: 8600 - DNA, 1087 bp, Sorghum bicolor
  unsure (1)..(1087): unsure at all n locations
  Clone ID: SORBI-28MAY03-CLUS4560_1
cgttccttctggnaattgacacaccacagcctgggtggggggcagcagagcgcatagaggagacaggaaggtatctaaaagatatgctcagaccttcaatgtgcccttcgagttccgagccattccatctaggtttgaggcggttcagatagaggatctccacattgagaaggatgagctgctgaggggggacagcatgttcaaattcaagacactgatggacgagagcgtggttgctgagagtccaaggaacatggtcttgaacacaatcaggaagatgaacccacatttgttcattcatgggatcgtcaatggctcttacaatgcaccattcttcgtgtctcgcttccgggaggcattataccactactctgctatctatgatatgctggagacaaacattccgggggacaatgagcagaggctgcttattgagtcagctctgttcggtcgagaggcaatcaatgtaatctcctgcgagggtctggaaaggatggagaggcctgagacatacaagcaatggcaggtgaggaatcagagagctgggttcaagcagctcccaatcaaccaggacatcatgaagcgtgctcgggagaaggttaggtgctaccataaggacttcatcatcgacgaagacaacaggtggttactgcaagggtggaaagggcgcatcatactggcgctctcaacgtggaagccggatcacaaatcttcttcctagctccttgtgcttacatgaccgcagagcactgtcaatggagacctgttcgtggatgcttgggctgattgttcctggactgcaacatatagctatgctatgctatttgaactacttactatatagtgatgatgcgatcaagggtccctgcaagttaggttatggccgttatggtttagctttggacaggaacagttagtgcattctttgatggagcagcaggcttaggtatattagttacgcggtagacctaggattgtttcatgcatggatcagttttatggaatcttgtattatatttgttccccattaaccagtgctgtcaaagttttgggtttgtttggttcaaaaaaaaaaaaaaaaaanaaa

SEQ ID NO: 8601 - DNA, 845 bp, Sorghum bicolor
  Clone ID: SORBI-28MAY03-CLUS4563_1
gcacgaggggctgcaactcggactagcactcgtccccgtctcgagcccagacgcagacgcgcacaaaaacgcgtccggcggagcaccaggtcgtcgatctccgagcctcggcccgccggcgatggagaagggaaagggcctcgctcgccactgggcggtggagctccccgacgcctcctcctcctcccctgccgtccccgacccgcccggcttcaccagatccgcacccgatgcggacgacgccgcgggtgcgcgccagcgcaaggactccgagactgcatggaaggcgcagaaagcttgggaagtcgcacaggccccgttcaagaacctgatgatgatgggattcatgatgtggatggcagggagcaccgtccacctcttcagcatcggaattaccttctctgctctgtggcaacccctcaacgccctccgttctgttgggaaagtttttgaaccatttaaggacccaagggtggatactattgctcctaagttgctcttcattgccctcaatttggctgccatgggtctgggtgtatggaagcttaatacattgggccttcttccaacaaatccatcagattgggtatcttcactggctcctgctcgggaggttgaatatgctggagggaggggtccccttaatttaatgaccatttccactttggaactcattttactagttgtaatattacatcagtactgagtgaaattttacccctgcactcctgaatacacgagaagtgcagttttattttgtgtggacatagatgattctgtacccaatttgcgaccgtgcagcaaagtcgcaggataaccacggacagtaacagacaggcaggttt

SEQ ID NO: 8602 - DNA, 886 bp, Sorghum bicolor
  Clone ID: SORBI-28MAY03-CLUS45743_1
tgggactgccgccgccgcccctggctctcctcctccgcctccccgctcgctcttcttccttctcgcgggccgctgatcccttcactcttcacagcgagcgctagaagagggaatggagctccgcctcgcctcccgcggcgccctttcggccgctccgccgctttccggctgcttgtcgcggcactcgctctcgccgtggctcaagatccagaaccacatttatccgatgccaagtctctgttacaaggttcgtaccacggcaaaatgccatgcttctatggcaacaagttacgtggaaacatcagaggtcactgatttggactgggaaaaccttggctttggcctcatcgagactgactttatgtatgttgcaaaatgtggacctgatggaatcttttccaaaggtgaagtcctaccttttggtcctatagcactgagtccttctgctggagtcttaaattatggacagggattgtttgaaggcctaaaagcatataggaaagctgatgggtccatccttctatttcgtccggaggagaatgctataaggatgataagtggtgcagagagaatgtgtatgcctgctccaactgttgagcaattcgttgatgctgttaaacaaactgttttggcaaataaaagatgggtgcctcctactggtaaaggttccctgtatatcaggccactcctaataggaagcggtgctgttcttggtcttgcacctgctcctgagtatagctttatcatttttgtatcccctgttgggaattatttcaaggaaggtttatctcctatcaatttgattgttgaggagaaatttcaccgtgccagccctggtggaactggaggcgtgaaaaccattggaaactatgcctcggtactgaga

SEQ ID NO: 8603 - DNA, 795 bp, Sorghum bicolor
  Clone ID: SORBI-28MAY03-CLUS4699_1
tccgagcattagtgatgtcctgtgcacagcaacagcagaggctcttgcaatggggaaattcgtcatctgcgcagaacatccatcaaacgagtttttcatgacatttccgaactgcttgacatacaagacttcagaggagttcgttgcgagagcgaaccgggcgatggatagagaaccccagccgctaacccctgagcaaagaacaacctttcgtgggaggcagcgaccgagagattcatggagtactcagaccttgacaaggttctgaacaatgaggctgctcagcctggacaaggtaggaatagaaagaatacaagaacctcacagcctaatttgtctgacatcatggatggtggtctggcgtttgcccatcgatgcttaactggcaatgaggtcctcaggctggcaaccggagccattcctggtacccgggactacgataagcagcactgtatagatatgggtctcttgcctcctcaagtacagcaccctgtatatggctggtgatgaccggtgagcacccaaagttaatcataggtatatattatgtagataatacaccatgtagctcttatgtcgactaatgtttggagagttgtaattgtagcacccatgatgacctttagccattgttttgtactctgtaataaggttgtttctccttaaatttggagttgtattatggaaatgtagtacatggacatcaaaagttcatgactccagaagactgtcagcataatctttgtatgctttggccattgttttgtactctgtaataaggttgtttctccttaa

SEQ ID NO: 8604 - DNA, 839 bp, Sorghum bicolor
  Clone ID: SORBI-28MAY03-CLUS46914_1
gcacgcgcgcgggacaccagccagctagctagctcgctagcgggaggatggccggcagggcggtcggcgttctcctggccgtggccgtggccgcgctcctcgccgcggcggcgagggcggcggacgacgacgacaaaaagcagccatggaagtgcttcagatcatgcgccaggggttgctaccaccaccacgacaactatgctgccaccgtgtcgacggacttcccctcctccggggacgccgccgaggtctccgccgtcaccggcgagtgcaagaacggttgccacgacgacgagtgcttcaaggacctgccggccatcagccacacgcagtgcgccatggccacctgcctcagccatccgcacaatagcagaaagaaaacggcgtgcttgaaggactgctgcgagaagtgcttcggcaatagcccacctaagcccggcccacctaagcctggcccacctacgcctgccccgccagagcctcctggcccacctgcgcctggtcccggcccgaagccgacatctccgccaaattaagccgaagcaatgggcaaaccgaaggaatacttgcttataattcctacaaaataatacgtataggagtacttacttggaaaaagagatcttatggctgttgccggaagtgatattttctcttgtgttggcctataacagcagccaaccaactccaaagctatttggcattccattccagtttcaatattgataacaatacacttaggccaatctcaatgagaattgtattagagtttcatgcatattaaatatgctgacgtgacattggttttatgtgcagagagataataagagttttatgtg

SEQ ID NO: 8605 - DNA, 670 bp, Sorghum bicolor
  Clone ID: SORBI-28MAY03-CLUS47148_1
actaacttttctgattcccccgttccccgtcgctctctctctgcttactctcccccgtcctctgaaacgaagcatcaaatcaaatgggatgggataaatggattcaagtacctagggcttgagcgtgatcaggaagcagcagagagggtggaagagaagagaccaagcgacgattgggcgagcggcgccgccagggcttcgttggccccttcgacggtgacgagcatccaccagatacaagattgagcaacattgtctaagcgcctcgtccagtccagacatctaaggcaaaaacaatgctgcacctgcaccaccacagtccacttgtctctcggcatggtgcggtttgtccacccactaggcttgcttgttcttgcatatgtaacaaggccaacagcagaatcaccgccgcgcaatcaacaaacaacaatgcaaacttgctccttctgcgggggtggtcttctacaaggcggcgaatcaccactgttgccagtggccagtcagtaccaggatacacacctgatgatggcgatcaatgccttgaaacaggcaacaagatctcttttacgactgtaaaggacgctgtcatatgaataaacagcagcctgaattctgtgggtgtcagaagtgagctaattcttctagctctaccagcaggtttgggtcaagc

SEQ ID NO: 8606 - DNA, 787 bp, Sorghum bicolor
  Clone ID: SORBI-28MAY03-CLUS47155_1
gcacgaggattgacgcaatgaatgatgagacatttgggtcttctgaattatcaaatgaggatagagcagaagaagaaaggaagcggagggcatcttttgagttgatgagaaaagagcaacacaaagcaatgcaaggaaagaagaatggtcctgatatcctgaaggagaaccctagtgatgatgtcatttcacagttacagacatctactgcaaaggcaaatgccaaaactaaaaatgagaagttagatggttccattgtatcctcgtatcaggaagataccactaaaccctcttcagttctactagctcctgcagccaggccgcttgtcccgccgggttttgcaactgcatttgcggacaagaagcttcagccacagtcgtctaacatcacacatgagccgaagcttggtggtcagctagagggtgaccaatcagcaacagagttcacatctgggagtaaagagaaggcaatttccaataacgttgctattatgggtccaaagcacacgcttccagctggtggtgttacctcttcagctgagttgcctcctagcattctgaaagggagcgaggattgggaagctgatgtaatggataagtattctattggaaaggaaggcaaatctaaaaatattgatccagttaggaaggatgattcagtatcagtcttagaacagttctttggcaatgttttatcgaaaagcggcagtaacctacctacttatgttgagaaccagccactgaaaactgatgatgacatgattgcttcttctgtgccagaatcatc

SEQ ID NO: 8607 - DNA, 547 bp, Sorghum bicolor
  Clone ID: SORBI-28MAY03-CLUS47217_1
gcacgaggcgagctctttctcaactcggcccaagagttctgcctcctccaagctcccttctctggctctggtcagtgccaccctgagggtgagagatggaggcaaatccgaagaacgtcttcacgattaaagtggaggacggtaagcctggaaaagacggccagccggcggtaggaccggtgttccggagcgtgctggccaaggatggattcccagttcttgagcctgacatgcaaacatcatgggatgtgttcagggtagcagtaggcaagtatcccaacaaccggatgcttggatggcgtccgtttaaagatggagtgccagggccctacttgtggaaatcatacaaggagatctatgatgaggtgctgcaagctggctctgctttgcagcacctgggagtgcaaccaggttccgcggaaacttaagctatgtaaaatagacccctttttccattatttgtgaactagccttttcgtattttttagagatcctagaacattcaaatggatcagacgaactgatgcttgtttgtttggcctatact

SEQ ID NO: 8608 - DNA, 582 bp, Sorghum bicolor
  Clone ID: SORBI-28MAY03-CLUS47298_1
gcacgaggtgggcgcgggggtggatttggaggacggtgagggcgaggaggacgcagaggccgcggcggcggaggggtcgagcagggagacgcggatgctgccaaggatgccggtgcgtgtgctgctcgccgagggcgacgactccacgcgccacgtcatctccgcgctgctccgcaagtgcggctaccgagttgctgcagcctctgatggtgtgaaggcgtgggacatattaaaggaaaaatctttcaacattgaccttgttttaactgaagttgatctgcctttgatgtctgggttcctcttgttatccacaatcatggagcatgatgcgtccaagaacatccctgttataatgatgtcttcccacgactcagttagcatggttttcaaatgcatgctaaagggcgcagcagattttcttgttaagccaataagaaagaatgaattaaggaacttgtggcagcacgtttggagaaaacaactggcaaacggtgggtctgatgtgcaccacatacaacaagaagagaatcttgcagaaagaatcgaacagaagactggcgtgacaaagctgataatttgaac

SEQ ID NO: 8609 - DNA, 689 bp, Sorghum bicolor
  Clone ID: SORBI-28MAY03-CLUS46169_1
gcacggccctcacgatcaccctgcgctttgccaccaccagttctccaggcggccgagctctcggtggccgccatgccacctacctcaccacgctgactaatggcgaccgccatgcggggcggccgcctccggcggtttggtttccgccacgtctcttccatccttttccagccccctccatgccctgccccgagcctgggcctgtacctggccgttggccggaccggcctgggacgcctcctgtgctcggcggccggggccggcgaccacgcgggcaagcaggtgccggcgtggctggctctgacgcagcaggtgctgcgggacgccgtggagcgcgccccgtcggcgggctccgaccctgcccccaagatcaccctggggcatgtcactggtaggtttgcaagaagtggtggtcctggtgggctgaatgctaatgatgttaacacaaaggttgacatcaggctccggctttagtgaagtcaccgtctttcatacggattcagctgtcgaatcgtccacgcgggaccgacctcgggcgcgaaacaccgcgttggtgctagcccttgtgcgatacctcggtctccgtagggcatctttgttcctgcctgccgctatagtcaggcattcatgggtgctgcggcttctgctccaaaaccgtaaacaaattattaagttggggtcagcgacgc

SEQ ID NO: 8610 - DNA, 783 bp, Sorghum bicolor
  Clone ID: SORBI-28MAY03-CLUS4621_1
ccggtcgacccaccgtccggtctagttcttttagccgcaaacatttccctattcctcggctttgcagggctattttgggcctttgcagaagccagggatatcagattcattttattggtgatgtctgcaatattctgtggttatgtttaccagtgtcctccattccgattaagttatcaaggactaggcgagccattgtgttttgctgcatttggaccactggcaaccacagctttttacttctcaaacagcagcacaaatatctcaagcggaatggcacttctccctctcaccaaaacagttatagcttcatctgttcttgttgggctgacaactactttgatactcttctgcagccatttccatcagattgatggagaccttgctgttggaaagatgtctccactggtaagaattggcactaaagcaggatcgcggatagtgtcaattgggattctcacgctttacattctcttggctgcatttggcttatgcagatctctcccaccagcttgcattgtcctctgtgcccttactctgcccatgggcaaattggttgtggactatgtgctgaaaaatcacgaggacaacacaaagatattcatggcgaagtactactgcgtgcgcttgcacgcgctgtttgggatggcactagcttcgggtttgttcttggcccgtaatggtatattatcctgacagtgacagatagataggcagcattgaaatccaggagagaatccagagcagtagagcaacatgcagtttcagaatcagtgaacgcac

SEQ ID NO: 8611 - DNA, 601 bp, Sorghum bicolor
  Clone ID: SORBI-28MAY03-CLUS46233_1
gggccattggtcaccctggggcacgctatcagaggtgcaagtcctggctcgccccggatgatgaccaggaagattcagatgatttttttaccaaggagggcaaagaaactgcaggttactctatcgtgtccaaaactgtctcagaaattttgttgcaatctgagactaatgaagtaaaaaacggagctgcatgcttgctggctcttgatttgtcgtctctctcaggcggtgcgcctggacgcacaaggggccttaagatacgctcagttaactccttttgacaatggcttatattggtgttttagatgacccaaagcattcttcaaaatgatactgcagaagtactgacttgaattttggatcaatcaattcccatgagatgactgcttcaaaaacatcttagttaggaaaaagaaggaaacaagcatggaatttatttccgtttgttatttgtttaggtgccacaaggaggcgagatcatagcaagggattgttgtaccttatttttgaagggattatgtactttttctgctgttgagaagtatttgttggtcggtgtgtggggtggccgcctatctgaatgttcctttcacagcggtat

SEQ ID NO: 8612 - DNA, 720 bp, Sorghum bicolor
  Clone ID: SORBI-28MAY03-CLUS46253_1
gcggtttttcccgttcgccatggccggttgccagtctaatagtccgtacgcggattttagaatgtcaaaccaggtttgaaaacaagagctctagagttctatgcctcacatttgatattcctttttaattgctaatacggtccattgactaatactctgttatataaatagcacacttattgtggttcacaaacaactaaaatggaatcaaatatatattcttcatggagttataagtattttttgggatagacagatgtttggtttgcttttattctagaaagttgaaaacataagagagagtggtgttaagtagttgattaacaacaaacatcgcttgacaatgcaaggtataatataatcaacaactaattcttcttccattttgttgtcatgcaaggttctaggtgcaaatgatcattcaccgctcataatagcataaatacatataaaactgacatggaaggatgatagcttgaagatccaatctcttggagaattgcagagagtttgatggaggcaatgcatgatttgagacaaagaagggtgtggttacttttgttagtgagtgttggacatttcaggcttctatgtagccatgcaaagatttgatcttagatatgaaatttatgtgtatcttttatggagagacttattcgttacaaatttcatttttatgtgacgctaacattgatatatattgactttcttatattattt

SEQ ID NO: 8613 - DNA, 644 bp, Sorghum bicolor
  Clone ID: SORBI-28MAY03-CLUS46263_1
atcgtcgcctgccccccgtttcatgtctttccttgggggtcacggactgggcccaccgttggatcccccccgtgcgccgccttcttcggcctccctcccctcgttgggcagccgcgccgcgaccttgccttgccctgccgagcgtcggggccgtgccgggtggcttacttccctgcgtcgtggtttgaggcccgttcttccatgggtacttcgacccttcgctagaattaatagtggcttgccaccagtatccaaaatattctaggagaatcagaagagatgtcgtaaggatgttggaattgatatggatcatgctattttccctttacaaatgacttggtatgtcaggaaacaaaaaaggcctaccgttgtaatcctcccgtgagcagcattctatggcatccctcccgacgaagagcagccgcgtcgcaacctatggtagacgagcggagcgtcgtggccatgccttatgaattatttgcctacgacatgtttatagacccattaatctattggtactacaagcctttgctcatatatttttctgtgacctttgtgtttacatccctctgccatgttctaaacaaagcatttgtgtacaaatttgttcctggtgagtctaagctaatgcatattgccactgc

SEQ ID NO: 8614 - DNA, 737 bp, Sorghum bicolor
  Clone ID: SORBI-28MAY03-CLUS47607_1
gagaagatttatggctatgataccaagactgtgaaccttgcgaacggatcagcagaaggggcgtacgcactctcaagagggctgctgaccatgatgaccgtgcctttcggtgtttgtgtcctgttctacagcccactgtaccttgtgttcaagcacgacagagagaacgcgaaactcaccagcttcaaggagcaggagctagtgtgatgatatgaatgcgctgccttgatcagcattcggaacctctcggcatcccgagcaggagcttgtgtgatgatctgaagatactgccttgatcagcattcagaacatctggtcataccgtcctgggtcattctgagtttctgattgagattctggcaattgtgccacggagagaagtgtggagcaacaattgttctggccgatttgaagattataaggcgaccttctctttttgtgcccatccaacaagccatttttctatggcttctcttggtgatgagtgatttgtgttgtggaggttttttttttacagagaaccccagagaaggcatatgacatgacctgaagccctgaactatgctgaattgctgatgttacatgtagttgccttggtagttaaacagatcactaataatgtttcactgatcgctgggatcagctcgttttcagttatctttctggggtttttttaagaaactctggaaattttgtatcagttgattatgaaagaagttctagcagtttggttcatc

SEQ ID NO: 8615 - DNA, 921 bp, Sorghum bicolor
  Clone ID: SORBI-28MAY03-CLUS4772_1
gcacgaggaccatttaccgtggtattgatggatgagatagagaaagctcaccctgatattttcaacatccttctccaaatctttgaggatggacatttgacagactcacagggccgtaaggtttccttcaaaaatacgttgattgtcatgacttcgaatgttggttcgacaacaattttaaagggacgacagagcataggtttcttgaaggaagataccgagtcaagctcgtattttgcaatgaaatccttagtaatggaagagctcaaggcatttttccgtccagagttgctcaataggattgacgagatggttgtgttccgtcctctggagaagactcagatgctggccattcttgatatcatcctaaaggaagtcaagggccgacttttggcccttgggataggtttggaggtgtctgaggcaatgaagcacctgatttgccaagaaggctacgacaagagctatggtgctcggcctctgaggagagctgttgcccacattatcgaggatgtcattagtgaagctattctttttggcgagttcaagcctggtgacacgatactgatggacattgatgcagaggggaagccatgcatgaaccatctggaccgacagatcgtccaggtctctgacccaacacggacgttctgaagttctgtgccggactttctgaagttgtacttccagtgtagtagactagggatctaatcttttattctttcaagcatcgtgattattaattctttcatacatagatatatagagtagtattccatcttgtacatatatcaaccagatggtccagataggggaatctggtcagttattgacgttgtttgaaattttcatccaactgtatgtatatttgttgaattgtttccgattcaattggccacatgtatcattcttataccgtct

SEQ ID NO: 8616 - DNA, 1002 bp, Sorghum bicolor
  Clone ID: SORBI-28MAY03-CLUS47738_1
gcacgaggaaacctcagagaatccacacctctccccccctctctctctctctctagatctacgcaagccgcctcggtgtgctccgggaaagcaaacctcagagaatccacacctctcccccccccctctctctctctctctagatctacgcaagccgcctcggtatccgcgatcgccgccgccgcggctgctgatcgtccgtgctgctccgcggaggtggtgctgcgctgctagctggtcgtccgagagtccgtccgggtcaccgacgccggcgacgtttctgctataaatggactttatgttgcacttggatcaccaaagctgcctggatggtctgctagtggtggagatccctgtggtgagagctggcagggtgtcacatgtactggctcaagtataacctcaatagttttcaatgctgcaaatttgggaggacagctaggcagcctcgggaacttcgcttcaataactgaaataaatcttagcaacaacaatatcggtggaaccataccggaagatctacctgtcacactgcagaatctgtttctctcagataaccaactaactggaagcattccaatgtcattatcaaaactccatagtctaacagccatgtcactgaatgataaccatctagatggaaaactaccagatgcatttgattccctcacgggacttgtaaatctggatatttcttccaacaacttcagtggttcattaccaccttcattgggaagcttgacatcactgactacattgcacatgcaagataataaactatctgggacccttaatgtcttgcaggatctccccctcaaagatttaattgtagagaataatatgttttctggaccagttcctccgaagctgctgaacataccaaacttcaaaaatgatgggaatccttttaataccagcatagctccctctacctcaccctcttcaactcctacaggctctacaccaacacaaacaccatcgtcctcttcatccccttcagga

SEQ ID NO: 8617 - DNA, 1361 bp, Sorghum bicolor
  Clone ID: SORBI-28MAY03-CLUS47748_1
gcacgagggcgaatatgcttatcaatttgctctggtcgctagctcgccggatacaatactgtactgcgatgtgcggctgaccaaggatgagattggcatttgcctgccggacatcaggatggataactgcacaaacattccagatttctatgcgcagggtcagaagagctacctcgtcaatggtgtgcctacctcgggatggttctcggtggactacaatggcactgagcttggacaagtaactctcaagcagtcaatcaattctcggacgcccagatttgattcaagtttctttgcgctacttgctgttgaagatgtgcagtccaagttcaaacctccaggaatttggctcaatgttcagcatgacagtttctacagccagttcaatctaagcatgaggaattatatcatttctgtatctaagcgtgttgttgccaattatatctcatcacctgaagtgagcttcctcaccagcacgcggggaagaattagcaacaaaacaaagcttgtgttccgctttcttgatgagagcactctcgagccatctatgaaccagacatatggctccatgatgaaaaatcttacatttgttaagacatttgcatctgggatacttgtcccaaagagttatatttggcctaattcaccagacaattatctgcaaccatacacttcagttgttgatgatgctcataaagcaggcttggaaatctatgctgctgattttgcaaatgattttctgctcagttacaaccacagctatgatcccttagcagaatatctctcattcattgataatgatgtcttctcagttgatggtgtattgactgatttccctgtcacagcatcagaggcaattggatgttttaccaatttaaacaaaagcaacactgatcatggaaagcctttaattatatcacacaatggtgctagtggggattacccagggtgcactgatctagcttatcaaaaagcagttgatgatggtgcagatgtcattgattgccctgttcaagtgaccaaagatggaataccaatatgcttgtcttccattgacctaatgaccgatactactattgcaagatcgcaattcatctctcagactgccacgataaaggatattcagattgcaccaggggtttttagtttcaacctcacctgggatgacattgtaaagaacctgaaacccaaaatatccaccccatggaccaacttcaaattggaccgaaatccgagatataggaatgcaggaaagttcgtgaggctatcagactttttggagttcacaaaagataaagatttgtctggaatcatgatcagtgtagagcatgctgccttcctggcaggggaacttgggtttg

SEQ ID NO: 8618 - DNA, 594 bp, Sorghum bicolor
  Clone ID: SORBI-28MAY03-CLUS47892_1
gcacggcgctagctcgcttcagctcgcagctcacaaagcagcagaccaagaaaagagcagcgaccgagaaagagaagcgcgcctccgctgctctgtcggagctcatcccgccgccggaccgagcccgccgatggccatgaggcacagggcgcggtcctcccccacctccccgctcaccccgtcctccagcaccagaacaaagaagatacttggtttctctgtatctctcatcctcatcaatctggcttcaattatggagcgtgctgatgagaatctccttccagcagtttacaaggaagtcagtgcagccttcaatgctggtcctactgatctgggatacctcacctttgcaatgaactttctgaagtcaatagcatctcccttggcaggtatccttgctctgcactatgatcggccaacagtgcttgcaatagggactgttttctgggccttatcaacggcggctgtcggtgttagccaacattttgggcaggttgcattctggagagctgtaaatggccttgggcttgccattgtaataccagcgcttcagtcgttcattgctgatagctataaagatggtacacgtggtgc

SEQ ID NO: 8619 - DNA, 690 bp, Sorghum bicolor
  Clone ID: SORBI-28MAY03-CLUS9750_1
gtcccgtgtacggtgttcgcgaacatcctcctctgctcagctcactcccccccagatcctctctccctgttagagagctagacccacctcagatccccccccgcaacaaccgagcgtccgagccccagtccagcgatgccgccgccgccgccgccgcaggggaacggggggaaggtgaccccgaacctggcgatggacgccgaggccacgcgcatgctcaacctcacagtcctccagcgcctggacccggccgtcgaggacatcctcatcaccgccgcgcacgtcacgctctacgacttcaacatcgacctcaaccagtggagtcgcaaggacgtggaggggtcgctgttcgtcgtcaagaggaactcccagccgaggttccagttcattgtcatgaacaggcgcaacactgataatctggtggaggatctattaagtgattttgaatacgaacttcagccaccatatttgttgtatcgaaatgctgcccaagaagtaaatggtatttggttttataatcaacatgattgtgaagctgtcgcaagcctttttggaagaatactgaatgcttatgcaaaggtgcctccaaaaccaaaagtgcctaccacaaaaagtgagtttgaagaactggaggctgttccgacatctgctgctatagatgggccccttgaacctcagctgtcatcccct

SEQ ID NO: 8620 - DNA, 1028 bp, Sorghum bicolor
  Clone ID: SORBI-28MAY03-CLUS46776_1
gcacgagggcaccaatcccctcccgccaactgctgcggctgcgcctcctgcggctgccgcgacgccaagtccgccaacggcgacatggctgtgggcggggagaacaagaagaaggcgtcggagccggctccgcctgagacgccctccatgatggagcagctcgtgccggagatcaccacccacgctctcagctacctcgactacaccagcctctgccgtctctccatgaccaactcagccatgcgccgcgcggccaacgacgacggcgcctggaaggcactgtaccacaaggattttacggtggagcagggtactataaatcctcctaatggatggaaggcatactatgcagctacaaaagccatcattaaccttaatgcagagttctacaatatcatcagggaaggggccttgccagcaatgagccgtttttggcttaatgcagactatgtcaagtgtattcatgcgactggggagttctgcactggatacaacgcagtgatggagagctggggcctgctattcaactggggccaagatggagggcagggcattgccttccagataagggatgtccgtgtccgtgtgctcggtgaggtggcatgggttaacatgaaggcgaatgtcgacgttgacccagtgctgttccatgttaccaacgtgtatgagctctggaacggcaggtggtatatggtccatcaccatagctcgctgatggctgaccctgctccgcataatatgtttgggtgaagctggaggagaagaacagcaagaaacctttgggatgaaaattcggtggtgaatgtttggtgtggtatgcttcttgaccggaaatagattgtcggatgtattcgaagagagattcccttcccccccttctccgttgtggatctgctgtttgtttatattactcctctggatctgcgttccgcagttttgtacaaatgtgttttaggtgttattaaaacttaaatcggtgaatggaaggttatggtgccctgtgggtcgcgggctcgcggctgactttg

SEQ ID NO: 8621 - DNA, 824 bp, Sorghum bicolor
  Clone ID: SORBI-28MAY03-CLUS46663_1
gcacgagggccccggtggtttctcaccagtgcccccgggaatactctacctccggatattccggtgcatcaaggactgctccatactggccgaggacatactctctcttctgatgctttcagtgaaggatatcgcggaaacaactgtgcccagacatcggtcagacaaactaaagaagaccaagtatgggatgaggcatggccaggtatctctttcggctgcaatgacgcaggtgaaggtggcggcatcgctgggagcgacactcgtctggctatctggtggcacggctctcgtccagtccctgatccaggagatgctgccgtcttggttcctggccgtgcagaacctggaccagggcggtgccagtggaggcatggtgtacaagctgggcgggcacgcgctggcctaccttgcagtgtactcggggatgttcgcctggggcattgacccaacgcccgtgtcccggcgccgcgagagggtcatgcggtcgcacctggggttcctggcgagcgcactggacggcaagatctccctgggctgcgacctctccctgtggcgtgcctacgtctctgggttcctggggctggtggtggagtgcaccccgtgctgggtgcaggaggtggacctaagggtgctcaagcgcctgagcagcggcctccggcactggggcgaggatgagctcgcggtggcgctcctccgccgtgccgggccggaggctatgggcacggccgccgagatgatcctgggcagggagtggtgacacctgtctgccgcgctgggcccgtccataactatatgcagttatgcacggccgccgtcgccga

SEQ ID NO: 8622 - DNA, 693 bp, Sorghum bicolor
  Clone ID: SORBI-28MAY03-CLUS46851_1
gcacgaggcaaagatcttttggaagtacccagtgtcctacattgtctatgggtcatggggtttgaagggcgggtacaagaacgacatgcttgggctggagttcgagccaatggtgccagggcagccgaaaattacaggagaatacatcatcaccgagatgatggggctgagcttgaaccactccaagtggttggacctcgccatgatcttcgttctcctcttcgcctaccgcctcaccttcttcatcgtgctaaagctcaaggaggctgctgcaccatacatccgtgttgcctacacacgcttcactgtcaagcgtcttgagcggcgtgcctccttcaggaagacactggccatgacgtctatgtccaagcggcacaatccgccgcaccccatggccatccaggagggcctcaactcgcccatgccatactgagccgaggagactaagagcaaagagtgctgctggtagctagtggttgatatcacaattacatgtgtatgtgcttacagatttgtctgtttgattgtttagttgtcagagcgatacaatcttcacagcattcgtttcactgtaataactctggacactatacgcatacaagatagtgttgtgtacttgtgcgtacttaatttttgtttacatttgttttcgtaaacattaaaatcaggaaatgatccttaacaaaaccacgc

SEQ ID NO: 8623 - DNA, 857 bp, Sorghum bicolor
  Clone ID: SORBI-28MAY03-CLUS46864_1
tgaagagtacagtccacatctgtctgactgtgggcttgctgctctgtcaccgaagcctgagagagaggtttcagctgaagtggttggctcttttggatatagcgcccctgagttcgccatgtcaggaacatacaccgcaaagagcgacgtgtacagttttggagtagtgatgctagagctgttgacaggccgtaagccactagacagctccagagggaggtcagaacagtcgcttgtcagatgggcaaccccgcagctccacgacatcgatctactcgccaagatggttgatccggcactggatgggctgtaccctgccaagtccctctcccgtttcgccgacataatcgcgatctgcgtccagtcggagccggagttccggccgccgatgtcggaggtggtgcagcagctggtgcggctgatgcagagggcgagcatcatacggcggcaatcggacgatctgggctactcgtacagggtccccgaccgcgaagccgacgtcctctgaagttgcttcagcagctatactgtgtgtatagctacaaagcactgcacagtttatatatatgtttaaaccaaaaaaaaaagagagcaaacaaaagaaaacagattgggggttgaggcagcacctgactgagtcaggttactttggagttgagtgctgctggaagctggatcactgaaacgtgttattctgtcctctgttagtggccagtcacctgtatgtaatgtaaatgacatttgagcgacatggatagcgtttggagtgtaccgggactttttcgtgagctgtgagtgtcatgtatagagtgcgctcttgcaagtggtcgatatatatatatatatatagaaggggg

SEQ ID NO: 8624 - DNA, 831 bp, Sorghum bicolor
  Clone ID: SORBI-28MAY03-CLUS46894_1
gcacgagggcctcctctgcagcccgcgccgcgccgctctcctcggcggccgccgccttccgccgcaccagcccgctcctctcagaggacaagccggcgaaggtggaggacgtcatgcccatcgccacggggctcgagcgggaggagctggaggccgagctccaggggaagaagcggtttgacatggatccaccggtcggtcccttcggtaccaaggaggcaccagctgtcatcgagtcctactataacaagcggatagtcggttgccctggtggtgagggagaggatgaacatgatgttgtatggttctggttgaaaaaagatgagcctcatgagtgtccagtctgctcgcaatactttgtgcttaaggtcatcggtgatggtggagatcctgatggtcatgacgatgaagatgatggacatcactaaggatgccttatggttctgaaaataagaatttgatgaggcagatgaatccattatacttcttttctagaaccagactgctccacggcatccttgtttatgaatagacatttggccatcaagcaggtggtagttttcacctagggattttgtccaaacaaaagctatttgagatttgacccatgcatttctttaagagcatcatcgaataaaagatgactgcatcagattgctttcttttgttaccctatggccatcgggtgtgatggacatgtaatattcagtcataaacagtcccgtttctttgtttagtgtgctgagaaatttgcaaaaggcctcctatatctttgacaatgacaattgaagccgagagtttgatgatccctcatcttatgactattgccct

SEQ ID NO: 8625 - DNA, 1349 bp, Sorghum bicolor
  unsure (1)..(1349): unsure at all n locations
  Clone ID: SORBI-28MAY03-CLUS4821_1
ctgctttggattcttcttcctgatgtgccaagagaggcccagaagaggaagcacgcaggaaccaaccaaccagtcatcgaatcggcgtgcggcggtctggtgattttaagggtcgagatcgtgttcttgggaggctgagggacaagagctcccttcctgtcctctttcctgcggcttgtcttggtccaagagggcaaaactcgccgggaggaaatggcggaggtgaagccggaggagataagccatccgcccatggagcagctccaggggttcgagtactgcatagactcgaaccctccctggggcgaggcgatcatactgggcttccaacactacatactggcgctgggcacagcggtgatgatcccggcggtgttggttcccatgatgggtggcgacgatggagacagggtcagggtggtgcagacgctgctgttcgtgacggngataaacacgctgctgcagtccctcttcgggacccggctgccgacggtcatcggcggctcctacgcgttcgtgatcccgataatggccatcatccaggaaccgtcgctttcggggatagccgatggtcaccagaggttcctcgagaccatgaaggcgatacagggggcactgatagtgtcctccagtattcagatcatcctgggctacagccagctgtggggtattttctccagatttttcagtccagtggggatgactccagtggttgcgctgctgggatttggccttttcgaaagaggtttccctgtggttgggagatgcgtggagattggcttgccaatgctgattctctttgttgtgctctctcagtatctgaagaatatacaaataaaagaaattcccatactggaaaggttctcccttttcatctgtatcgcattggtatgggcatatgctcaaatcctcacttcaggtggagcctataagaatagctctgaggtcactcagaacaactgccgcactgacagagccaatctgatctcttctgccccatggattaagattccttacccgttgcaatggggtgcaccaaccttcaatgctggccagtcatttggtatggtgtctgctgttttggtctcgctagtagagtccactgccttttacaaagctgctgctcggcttgcaagtgcgactccacctccggctcatatcctgagtagaggcattgggtggcagggaatcggcatccttcttgatgggctctttggaacggggactggatccactgtctcagtggagaacgttgggttgcttgggtcgacaaggatggggagccggcgcgttatacagatctcagcttgcttcatgatatttttctccatactgggggaaattggagc

SEQ ID NO: 8626 - DNA, 487 bp, Sorghum bicolor
  Clone ID: SORBI-28MAY03-CLUS4822_1
atgggagataaggtcaatggtgctgtcagattttgtggtttgaaacttggccaactgaagaaccttctgggtaggacaatgtacgatcaacagtcatgtgcatggatgtctggggttaatgtgattgatttggacaaatggagagatcataatgttacagagaattacctgcaactcctgagaaagtttgggaacaatgatgacgaggcctctttgcgagcttccgctttgcctataagtttgttgtcgtttcagcatcttctatatccacttgatgagagattgactttatctggacttggatatgactatggaattaaagaagaagttgctcagagttctgcttcattgcattacaatggaaatatgaaaccttggcttgaattgggtataccagattataggaagtactggaagaggtttcttacacgagatgagagattcatggatgagtgcaatgtaagtccatagtgcactagagcttggg

SEQ ID NO: 8627 - DNA, 773 bp, Sorghum bicolor
  Clone ID: SORBI-28MAY03-CLUS48270_1
aagatgtggagatgcattcaccagcgcaacctgcatggctccatgagtttgctggggtgatgaaaaatgcttgtgggccagtgactgctgccaagtctatctatgaggatgaccagggctacttaataatggtcagcttgccgtttgttgatcagcagagggtgaaggtttcgtggaggaacactctgactcatggcattgtgaagatcgtttgtgttagtactgctaggatgcaacatataaggagacatggtaggatgttcatgcttgccgatccttcccccgagcactgccctcctggggatttcattcgtgaaatacctctagctactcgtatccctgaagatgctaagctggaggcatgttttgatgaggctgcctccgtgcttgagatcatggtcccaaaacgaggaaatgaacctgaagagcatgaagttagggtctctctgcgaccccctcactttggagctaatgatctacttttgacctaagctgagtaaggtctctgcaccatgttccgtcttgtttgtaaccccagattaatgccaaatgtagctgagaatcaaggtttcagtatgcttgttctctgccaaatgttttcagtacctgtgccatactaagtctcttcagcaacaaagactttggctgaagactagtttgttctagcttttgtgttatgggtgtctttttaaccctcacgtttagattttgtactaagttcaattaaagaaaataatattctgagttgtcacttgtttgattgttggattgtg

SEQ ID NO: 8628 - DNA, 621 bp, Sorghum bicolor
  Clone ID: SORBI-28MAY03-CLUS48306_1
gcacgaggctagtcaaagctcatttaaaattatcgatgctgtcctgaatagaatcaacactattatgtccaaggattttatggacactagatctttctcccagcacatggcatttaatatcattggtgcaacccttttgggtgatgccttcttcgaatggtctgacgcttctgcttatgaggaacttcttatgctggtcgcaaaggatggttgcttctgggcttcttatgcaattccaccgttctggagacctagttataggaggtatcggaccctatgtgctaagctgaagatattaacagagagcgttgtcagaaaatcaagacaaaatagttcacttaatcattttgatcagagatcttatctgaaaagtaaagggacagatccaaatagacgtgttttagacaacatgatggcaagtcattgtctccatggggctattggaggaccacttaattcagaagaggaaatatgtggaaacatcatgggtttgatgttgcatggtatttccgcttctgctaacttgattggtaacattttgacaaagcttgtcttgtccccagaattgcaagatcagctacatgtggagattgtttcagtctgtaatgaatcatctaaact

SEQ ID NO: 8629 - DNA, 663 bp, Sorghum bicolor
  Clone ID: SORBI-28MAY03-CLUS48328_1
cgccgacccgtccgctctccgccgccccccctcctcttcgccgccccccccccctctccccgcccccgcctccccgccccgcccccatgcctctccccaccttgccctcacctccacgccttgcctccatgctggcacaagcagacctcctttgcgtgatgaatcgacgaggcgtcagggggtaatttgggaggaggcgttcatggatactgtgtgcagaggactagaggagggttcccactccccaagacccccgcgcactatcgccatcgaacaaatccgtacttgacgtcgatctgttcgaccttcagaagtctatggtatgagcgcggcgagctccagtaatcaagaaaggaagatgtttttgcagcgtacattgacaagcaaacaagtggcgcggcggcaggtggagcgattgcccgatggaccctgcaccttgcgcctttcttcgttttttccatcgttggttctgcctcttctcttggctccatgtacccaaagcctcgtgctccgtgtcggagtacatagcacggggtccttctgagttatagatctgtgattatagtggattaggagtttatgactgggcttcctatgcccctcaaactcgtcgccgccctgcgctccccgttgctgtgcctcttgtcttccttctgtgtttta

SEQ ID NO: 8630 - DNA, 667 bp, Sorghum bicolor
  Clone ID: SORBI-28MAY03-CLUS47373_1
gcacgaggcatgagtctgtccctgcaagcacgagggctgcctccacagcatcatcatggtctgccgccggcggcctaagtgccacctcctgtgtgtctccgccaccgcagcgccgccatggcagcagcttgaagccgccgcagcgctctggacagccggcggcgacgaccctatccgcatcagggaaccaaccgaacctatcgtacttagactgtaggacaaggactaggaggagaggcgaccgaatcagagctgccgatgccgtgaccatggatggctgggcagcacggcttgaagccccggtagcggttgtcactggagcgtctagagggattggcagagccatagctgtggcacttggcaaagcagggtgcaaggtgattgtgaactatgccaagtcaggcatggaagctgaagaagtgtgcagagagatcgaggagtccggtgggacggcgatcagcttcgctgccgacgtctcttgcgaggccgacgtcgaatccatgatgagggccgcgagtgatccttggcgcgccctcgttgtccgggtgagcaatccaaggattgcacgtcacgcgccgctgatgcggtgctggtggacgagtttatagttacgtcacgattgtgtttcatctcttctctgccgcaggcaattgatgcttggggagct

SEQ ID NO: 8631 - DNA, 690 bp, Sorghum bicolor
  Clone ID: SORBI-28MAY03-CLUS47453_1
tggcaaaagatttagagataatgaagtacggctggattctatccaagatatggacattgatcctccagagaggagcacaaaaagaactaaaagcaacactaccccattgaagcctgtccaaactgaggatggtggttctgttcatatgagagaagacagtgttacagttagcacggatgtaaaagatggcaatccagatggttacaaaaagttcaccatagctaaactgaaagaagagctaactaagcatggatttgcagcgcagttgctagagctcaagaatccaaacaagaaagatatacttgcactttatatgaagcatgttttgtgcgagtaaatggccatggaagttccagtattcaatgtacatctatccaaactaggatgggaatcaatagagtagtctgtcagtatatttaacaaacggatgcctcattgttttccaggtattcggttctgctgattggtttgtattttggtgttaacctcgaatggtttccggtttgtgtctaggcttgtatttcttatcttgctggttgtgttgagttacgactaattaggcatgtatattgtgctagtttgacaagctgggtcttgactcctgagtgctaaatgacctcaacggactagtcttcggcaagtttgtggttcatttttatatgttattgctgtgtaaagagtgctttatcc

SEQ ID NO: 8632 - DNA, 937 bp, Sorghum bicolor
  Clone ID: SORBI-28MAY03-CLUS47495_1
gcacgaggattccaagcaacattgacctcttcaaggaacttatgcttccttttgcaatagtggctgaaaattttaagaaactgcaacgctgggagaacccacgttcaaccttttgttttctattattagttcatactgttattttcaggaacatgctttcttatgtatttcctttcaccttgatgacggtggccctttccatgcttgctgtgaaagggctgaaagaacaaggccggttgggtagatcttttggcaaagtgacaattagggatcaaccaccctcaaacacaattcagaagatcctagcacttaaagaggcaatggcctcagtggaaaattatctccagaacctgaatgtctccctgctgaaaatccgcacaatcttactagctggccaacctgaggtgacaacacaggttgcgattgttcttctagcatcctcagccgtccttcttgtgtttcctttcaaatatgttcttgcattcgttacatttgatctcttcacaagggagctagaattccgtagggaaatggtgagagccttcatgaacttcttgaaggaacggtgggaatcaatacatgctgcccctgtggtcgtgttgccatatgagggcgctgaaagtagccccaagacactcccggcaaaagcctcggggcaatcagaaccccagaatgtgcaagggggaagcggttatgtcacctcaaagaacggcatcagcagttcatgatccgcacagctctgagagcatcttgttgtaaacttatgtacagttttgtacagttgaaacctgtatagattacttgagaggtgagattaggtatagctcgtaccagtcggtgaattttgcagaagctcttggagtaatattccatttagtcgtagcgatgataactagcgtagacgaggaggtaggacgtaggagtaagaatttggccc

SEQ ID NO: 8633 - DNA, 762 bp, Sorghum bicolor
  Clone ID: SORBI-28MAY03-CLUS4738_1
gcacgaggctcgccaccccccccggccggccggcgtcccccgcccgcccgcgccggccgccccgccggtggcccgggccgccggcggccccctctccccgcctgatggcgccagcggcagccgtcggaccgtccctggcccggccatcgagcagccacccgcggcgcgccggcagcgtcctcctccggcccgtctccgtgcagcatgtcttgcttcaggggcggaggcgtcgccaccggcgcctgacgggcgtcgtccccgtccgtgccgcgccggacgcgccgccggtggtcagggcggccgtcagcgccgtcaccgagctcctcagagccctttccccaaacaagaacctcagggatgctgccgcccagcagcagggggaggagccggattcgagtccgccgcgttgcggcagcgtcgaggacgtgctcgccgtgctccaagacgattaccggcgcgcctacttcctcaccggggatttcactccgggcatatacactgcagactgcttgtttgaggatccgacgataaagttccgcggactttctaggtactctcagaatctgtacctgctagtgccgttcttcgacagcccttcgcttgaactggagagcattgagaagggtttgagggttgaaacaaagttcgtcaaagcaacatggaaactaaggacatatttgaggcttccatggaggcccctgattgcgatcagagggaacacaacctatgatctgaatgaagattcaaggtgattcggcactc

SEQ ID NO: 8634 - DNA, 475 bp, Sorghum bicolor
  unsure (1)..(475): unsure at all n locations
  Clone ID: LIB3481-048-Q6-K1-C1
cgtccgcagcgccgtcaccgagctcctcanaccctttccccaaacaggaacctcagggatgctgccgcccagcagcagggggaggagccggattcgagtccgccgcgttgcggcagcgtcgaggacgtgctcgccgtgctccaagacgattaccggcgcgcctacttcctcaccggggatttcactccgggcatatacactgcagactgcttgtttgaggatccgacgataaagttccgcggactttctaggtactctcagaatctgtacctgctagtgccgttcttcgacagcccttcgcttgaactggagagcattgagaagggtttgagggttgaaacaaagacatatttgaggcttccatggaggcccctgattgcgatcagagggaacacaacctatgatctgaatgaagattttaaggtgattcggcactctgagagctgggacgttttttnggttgaggccatcgctc

SEQ ID NO: 8635 - DNA, 957 bp, Sorghum bicolor
  Clone ID: SORBI-28MAY03-CLUS47552_1
gcgcggggggcagatggggcgccctccctgccgcagcctgagggggtctttgcaggtgggcggcgagccctgcagcagcgcgtggctgccgtgtctaggttgccgcgagctccagatcactccgtggccacgcggattgggatctcactgcttgccgcctactcccttcgcaggcgcagcgtggtcgttctgcgtctcaccgtccgcctgcgtggtctctccgaggaggtcctgcatcgcatgggccgtgcgcttggtttcgctggggagggcgtgctccggggtggcttggctctcccgggtccccgtgtgggtggtgtccgtggtggtggggctccccccggaccccctcttgcggctctggttggccgggcttctgctggcctatcggcgcacgccccgctcgagggcccggcagttgcggacctacgggtggcctccctgcccgcggggccggcacagggggagagtcgggaagcctcagaagctgcaaggcaatcacaggaagagagtcataccgccacgggtccaagtacatcgtcgagcatccagcaaccatcgcagcaccctgcaaacctggcaccaggcccatccacaaggccacatctcttgggtagtacagactctgaattctcaacagttccgctagcatcatcatcatcgtcatcatcatactcgtctgcgccgaatccgttctcaagaccacctctaagatgattgcaatcaaagtgtacactgtacagtaccggactattggtccccttttttgttctgggagtgatcccgcatccgaaggctaagctatttgttccattcgttgataatgcgatgatgatagtagttgattcagaaattaccttccttttcctccttgggcatgtaaagatctcagtatgtaaaaatggattcctaccctcagaggccttgacaacaaatggagataaaatgagattgttg

SEQ ID NO: 8636 - DNA, 1040 bp, Sorghum bicolor
  Clone ID: SORBI-28MAY03-CLUS48558_1
gcacgagggtgacatccggctcggcgtggagacgaccacgacgacgcacacggcacacatcttgctggagagatgctcccaaggttttttcaccgtaaaactggcagtgaagctagcaagcgtgctttcttaccgaaatctacggatttcggcgtattggagggcatgctacaagatccctgtgcggcaccgatgtgtctgccgatggattttctgaaagccatcacgcaagatttctcccaggaacgagaagtcggaagaggtggatacggagtggtttacaagggaattcttcaaaatgggaaggcaattgctgtgaagaagctttcagagatgcagctagaagatggtccatttcagaatgaagttatttatctaattgggttgaagcacaaaaatattgtaaaacttgtaggctattgcgctgaatcacggtgggaggcaactcaagtaagcgggaaatatgtcatggctgaaatacgaaaaaggctgctttgctttgagtacctaaataagaagagccttgataagcacctctcggatgaatcttgtggactcaagtggaatatgagatatcagataattagaggaatttgctctggtttgcattaccttcacacggaatgccatattgttcatttggacctcaaacccgagaatatattgcttgatgatggtatggtgccaaaaattgcagattttggtatgtcaagactctttggccaacaacagtctcgaataatcactgaaagtcgcgggggggcacgtggatacatggcaccagagcacttaacaaatggattcatatccaccaagtctgatatattcagtctgggcattataattatagagctaatgatgggatctagggactatcccccaagtagtgaagcatcatttgagcggttcatcaagaacgtggttgaaaattggaggaacaacttggaaaaggcaccaaagtatatacccctggaaatagaaagtcgacaagtaaatacatgcattgtaataggactaaactgtgtccactctgacccgaa

SEQ ID NO: 8637 - DNA, 681 bp, Sorghum bicolor
  Clone ID: SORBI-28MAY03-CLUS48544_1
gcttcattccctctcgtcgtctcgccactcgctacacccccaaaaacctcacgcgctctcgacgccgccccgcgctcgcctcgtcgccacgccgggcgagagggaggggcgcgcccaccccgggagccctatataacgacgccggccggagctgagggtataagctggtatcatggcgtccaacacaggagcgtcaggatggttcaggggtaaggtgaaggctgtgacatctggggattgtctactaatcatggggagctcaaaggctgagatcccacctgagaagtccatcaccctgtcctaccttatggccccaaggctggctcgccgaggtggagttgatgagccttttgcatgggaaagcaaagagtttctgaggaagctttgtatagggaaggaggtcacgttcagagtggattatacagctcctaatattggacgagaatttggaactgtttatctaggcgacaagaatgttgcatactcagtagtttctgctggatgggcaagggtaaaggagcaaggccccaaggggggcgaacaaaacccttacctcgctgagctgttgaggttggaggaagtcgccaagcaacagggtgttggtcgttggagcaaggaacctggtgctgctgaagagtcaataagagatcttccaccatctgcaattggtgaagcaagtgg

SEQ ID NO: 8638 - DNA, 709 bp, Sorghum bicolor
  Clone ID: SORBI-28MAY03-CLUS4858_1
cccacgcgtccggaggaagcagcggcggcagcagcagcagccaggccatggcgtcgtcgtcgaccccggcggccgtccgcgagatgcagaaggatctcgaggtgcaggccaacgccctcagcaagatccagaaagacatcgccaagaaccaccaggtccgcaagcagtacaccatccaggtcggcgagaacgagctcgtcctcaaggagctggagctgctcagcgatggggctaacgtgtacaagctcatcggaccggtgctggtcaagcaggacctcgcggaggccaaggctaacgttaagaagcgcattgagtacatcacggcagagctgaagcggatggatcgggctctcaaagacttggaggaaaagcaaaacagcaagaaggaatcgatattcaagttgcaacagaggatgcaggctgtacaagctaaggcttagacatctgcttgtttgttgcaaccagtccaagtccatgctgcatttcatcctaataccctccaggttttgtcgttgggaggaatcaggtctgatattctcgtgtccacagaaaaaggaaaaaacggttcctagtgaattactacgctattctgtacgctctaatgtaaaagtgtgcctctagtagaactgtagaagatgtagctatcagtgtatcgttgcattttggcccatgtttacttctcaatatgacttgatttgaattgattttc

SEQ ID NO: 8639 - DNA, 649 bp, Sorghum bicolor
  Clone ID: SORBI-28MAY03-CLUS48899_1
gagatggcgagcaacctgccattgctgctataggttcactaaaaagtgtggatccagatcggatcattctgaagaaaattgttttgactgggtatccacagagagtctcaaaactgaaagcaatcgtgcgttacatgttccacaatcctgacgatgtaaaatggttcaagcctgttgagttgtggacaaaacatggacgtcggggccgcatcaaggagactgttggtactcatggtgccatgaaatgcatattcaatagcagcattcagcagcatgatacagtgtgcatgagcttgtacaaacgcgcttacccgaaatggcctgaacagctctaccacgtataagattgccttggacattttgcttgtatctggtttgtacctgtaccagcaggcagcaggctatccaggaggagtatggacgtaccaacacgggaatgaaaccttcctggagctggcgtgctgtgtagcccatgtacttttaggattattaggaaattgttttggcattggccctcttagctaggagggcgaattttgatagtgtgattattaccgctggattatcatgttttgtttgttctgtggactaaaacgatgacattttatacgtctattcaatagtaaaaaatagttttatttggctctcg

SEQ ID NO: 8640 - DNA, 926 bp, Sorghum bicolor
  Clone ID: SORBI-28MAY03-CLUS48894_1
ccacggccgtccccctccgcgacgccaccctccccccaccccccccggccatcctcgaccccggcaaccgcgccttctgccgctccccgctcgaccgccacaagctcgtccccctggcctgcggccccgcgctgctgcgcgaccccgccctgctccgggccttcctgcccgcaggcatggctctctctgcctgcgataaaaaagaggagtatgatgaagaaatgactgcagcctgggaggctatttgtgaagcatattgtaatgacacaaaccccacacgagaccctggtatgcttgatgctgtgaaggacgcaatattacggatgacatattactggtaatgatcacaactctactgtccctctctcgtcactccaacaaaatgatccggatcaatgtggggggggattttgcaggtacaattttatgcctctttcgagaggctcagctgttgttgggtacgtagtgttgctcggtttattcctggcagcaaacatggatatcactgccagcattccacccgatgtccaagttgattgggaggcgatcctgtctccagaccctgacacatttgttgacgctatcaagccctggctgtacccatccacaaaaataagcaggtgcttgaaagattacacggacgtcagcatcgcgttcaacacaacaggttcagttgtagcggccctaacttctgttgacccataggttacagaattatatgtccaaatgttataggtttgcttcagttgctagcgtatttgtttcaacaaacacggaatcagctttgcctagtttgtcggaattttctcgcagcttgctaaagtttgtttcggagttgtatacaagcttgctggaatgttgttacttcagaaaaataagaaaattcatttttcatttcattggaacaagggttttttttttcttgt

SEQ ID NO: 8641 - DNA, 902 bp, Sorghum bicolor
  Clone ID: SORBI-28MAY03-CLUS48921_1
gcacgaggcccgggcttcccgcaaagctcatcccctcctcccacatggcgggacgcaaccggagcttcgtactgtggctgcacggcctcggcgattctggcccagccaacgagcccatccgcaacctcttctctgccccggagttccggctcgccaagtggtcgctccccgccgccccccgcgcccccgtctcctgcaacaatggttttgtcatgccgtcgtggttcgatatccacgagcttcccatgagcgctgggtccccgcaagatgaggctggggttctcaaggctgtggaaaaggtgcacgccatgatagacagggaagtagccgatggcatccaccctgagaacatatttgtttgtggatttagccaaggaggtgctctgacattagctagcgtattactttatccgaaaaagttaggtggaggagcagtgttcagcggttgggtgcctttcggttcatcagtcaccgagaagatttcacctgaagcgaggaagaccccatttctttggtcacatggaatggctgacaaagtagtattgtttgaagctggtcaagctggtccaccatttttgcaaagtgcgggtgttaactgtgaattcaaggcatatccagatctgggccattccctttccaaagaagagctactttatctcgagtcatggatcaagagtcgtctaaatgcctctcaagaaaaggacggttaactgataccatcatgctttataagttgcatttagtattttttatatgagacacagatcaatttggctactgatagatggaccgatgggacttgggagtactcagttactggtcttggaatttgttgtgtttgcatttgcatttgagcgttgtgttataaaatagtaaataaataatccatgttcctctaattt

SEQ ID NO: 8642 - DNA, 863 bp, Sorghum bicolor
  Clone ID: SORBI-28MAY03-CLUS5740_1
cccacgcgtccgggcttcagaggcgggagcagcggcggcgggggcgcgggcgcggcgcacgcggggacgctcgtgccggcgatgttcgtgttcggggactcgctgacggacaacggcaacaacaacgacctcaactcgcttgccaaggcgaactacccgccctacggcatcgacttcgccggcgggcccaccggccgcttctccaacggctacaccatggtcgacgagattgctcaactcctgggcctgccgctgctgccgtcgcacccggacgcctcgagcggcgacgcggcgctgcacggggtgaactacgcgtcggcggcggcggggatcctggacaacacggggcagaacttcgtgggtcgcatcccgttcaaccagcagatcaagaacttcgagcagacgctggacaccctgagcaagcacctgggcggcgcctccaagctggcgccgtcgctggcgcggagcatcttctacgtcgggatgggcagcaacgactacctcaacaactacctgatgcccaactacaacacccgcaacgagtacaacggcgaccagtactccacgctgctggtgcagcagtacgccaagcagctcggcacgctctacaacctcggcgcgcgcaggttcgtcatcgccggcgtcgggtccatggcgtgcatccccaacatgcgcgcgcggagccccgtcaacatgtgctcccccgacgtcgacgacctcatcatcccgttcaacagcaaggtgaaggccatggtgaacaccctcaacgccaaccgccccggcgccaagttcatctacgtcgacaactacgccatgatctcgcaggtccttcgcaacccatggtccttcgggttcagcgtgac

SEQ ID NO: 8643 - DNA, 649 bp, Sorghum bicolor
  Clone ID: SORBI-28MAY03-CLUS57406_1
gtaattaatcggcgatccgatcgttcatccaattagaccatctcgatccaagagccggccgccggtaaaatacccctgccggccgccaccaccaaaccagttccggccggcgtcgttgcccacttgcccgtgtctattctccctcgccatctcacctgcaggctgcagccggcagttctgcgtttggccgccgttcggccgttcacgagcggcggagcgggacggacactgctgacctgactcccaatacctcgggtctccccctcccccagcctccatccaggtcacgtcctccgtcggccggcctcgtactcgtctgcgccttcgtcgcccgtctgctccggctccgctccgcttcttcgaccccgcctcccccgtggggcgggagccgggagtgcgcgctcgcgccccccccctccagatctccgcggccgctggctcggtcgggcttggtcgtcgcgcccgggctaagcctggttattgtgtccccggggggcggcgatgcggcggaccgctgcgcttctcctggtgaccgtcttcgccgtggtcgccgtagcgaagggtagtgctgatacgccaccagctgaaacaaatggtgatagctctagtgcacagtcaggcgttgggaaactggaacaacatgatcaga

SEQ ID NO: 8644 - DNA, 823 bp, Sorghum bicolor
  Clone ID: SORBI-28MAY03-CLUS57497_1
gcacgaggaagcatttgcatgcaatggcgcaatcatctgatgagcagcttgtggtggtgtcacaggtgcttgtggcagatataaacattggttatgaagatatagtcaaccttcaggttcttgccttcaatggcacaccggttaaaaacttgaagcacctagcgaccatggtggaagagtgcaatgaggcattcctgaagtttgatatggactacgatcagttggttgtcctggagacgaaaactgcaaaggctgcaactcaagatattctgacaacacattgtataccttcggctgtctcagaagacctgaagagctgaggaaagctaggtgctggctgtcggctggtacagccaaaagatcctacaatccttctgggaccaggacacttgattttattgatgaatacatctcccgttccacgagaaatgctgaaagagttccattgcaggtgagattctgcatgtcgaagagtggaagctggaatgtaactggttgcaccaaaaaagcctagcaagcatcacatacactcaaaaggcatatcgatcagactgaatggcacactgagccatcccgagtcatagtaggatagattaaaaaaaaaagttttgcctgtattccatttatcaagttgatagcatggaaatcatcatgagtaactttgcatatacccatttgccatggttggtcagatgatactttcactttagacgtgtgtggtccggttgtcaagaccatgcctttgtgtatcatcgtttctttgttgtgtggagtactcaaagttcaccgaggaaaaaaaatcgtatctggatagctttttccc

SEQ ID NO: 8645 - DNA, 1186 bp, Sorghum bicolor
  Clone ID: SORBI-28MAY03-CLUS57554_1
ctgctgcctcttcgcacgaggcacaagagactgggagtagagggcagcccaacggattggacgattggtatcgaatcttttcctcaacccgtcgattggagttgctccgcactatggaaatcctctgatctggtgaactgagtatatttctggtagaaaggaacttggtcaataaaataccttctgaggcaatatgacatcggtaggtctactatcgtcaggttatgaagcgagtaccagtggaaccactgatcgattgccagatgagatgaatggcatgagcataagggatgaaaaggaggtggaagctgttgttgtcaatggcaatgggatggaggtcggtcatacaatcgtgacaactgttggtggaagaaattcacagtcgaggcagactattagttacatggcagaacgtatcgtggggcaaggttcatttggagttgtcttccaggccaggtgtctggaaactggtgagagagtagctataaagaaagttcttcaagacgtgagatacaagaaccgtgagctgcaaacaatgcaagttcttgatcacccaaatgttgtatgcttgaagcattacttctgctcaacgactgataaggaagagctttacctcaatttggtgcttgaatatgtgccagaaactgttcaccgtgttattaaacattacaataagatgaaccaacggatgccgttgatttatgttaaactctatatgtatcagatttgtagagctttggcttacctgcacaactgcgtaggggtatgccacagggatataaagccacagaatattctgctgaagttgtgtgacttcggcggtgccaaagtcttggtacggggtgaaccaaatatttcatatatttgttctagatactacagagctccggagctcatatttggtgctacagagtacacaacagccattgatgtgtggtctgctggttgtgttcttgctgagcttcttctagggcagcctgttttccctggggacagtggtgtcgatcagcttgttgaaattattaaggttctaggtactccaacacgggatgaaattaagcgaatgaatccaaactacaccgaatttaagtttccgcaaatcaaagctcatccatggcacaagatcttccacaaaagaatgccatctgaagctgtagatcttgtttcacggcttctgcagtactca

SEQ ID NO: 8646 - DNA, 600 bp, Sorghum bicolor
  Clone ID: SORBI-28MAY03-CLUS4903_1
gaggttgagcggacggaccccagcctccagcggaacccaatctagcaatctttcgcctcctcgctcggtgcctgggtccctggcctccccgtccgccctccgcctccgtctccgtctccgcttccccaatccgccgacgccaccgttggtctccagttgtacagtgttaggcctttggctctaagctattctgggattcaagaagtacggaaacatgagctacttccaagctacaatacacaagcctcatattatgctcactgcatacaaaccagtagatggtcttggaaggacctgtgagctactttatcaagattctctatgcccacatgctaccagatcttttaagctggtggagcaagtgtatccaaggcttgttcttgtttctgcttgccataaaaggcttggtcctgtatatgcttcgagtgggaaagaaaaccctaagattagcaatgatccattttcaatggaatcattgaacaaagcaatggcagaagcaaaaaggccaaggtcaattcaagacgtgctgatggagcaaatggctaagattggaggactaggctctggtggaaatggaggaaacaaaaaccgttatggacg

SEQ ID NO: 8647 - DNA, 553 bp, Sorghum bicolor
  Clone ID: SORBI-28MAY03-CLUS49046_1
gccccaatccaggtgtctcctccttgcggccgtcgtccatggtcacgagccaagtagtgatgagcaaccctgacgacgatggctactcctggacaaagtatggccagaagaacatcctcggagcgaaacacccaataagttactaccgttgtgcgcattggatcgcgcagggctgcaccgcaactaaacgattgcatcgcaaggaggatgccgacacgttgggcttcgatgccatctactacgggcaacacacttgtgatcagatcgcacactccactgacaatatcagtagccccttgggctgtaccaccactggatctacttccaagctgggcaccgataaaattcatcctgaacaaggtggactttgactttggtcaacaattaagagtgaaatgcaccattagtctatcaacttgtccatctgtgtcacttcagtctatcaactttgaaagtgcatttttttggtttaaaaccttgttaagtggtacataaatagttcatacctctttgtttcgtgaatagatatgacatgatttcgttcgcttgtctt

SEQ ID NO: 8648 - DNA, 1145 bp, Sorghum bicolor
  Clone ID: SORBI-28MAY03-CLUS491_1
ccacgcgtccgcaacttttgaaggcagagcaaggagccaaggaccacgaaatggccttgcgcggcaacctgctcgtgttggtcctgctgttcgccgcggcggccaccgcgagcggtaagtcggcgaggctcgatcttgtccccgccgcgccgggagcgtctttagcctcgcgggcgagggacgaccggcgccggcacgcgtacatgtgcgcccgtctgttcgccccggcgacccagaccaagctgttcctggaccccgagatgcccttctacggcgtgaaggtcgacgccatccacgtggcctactccggcacagggcagtactttgtaaagctccgcgtgggaacgcccgtgcaggagttcacgctggtggcggacaccggcagcgacctcacctgggtcaagtgcgccggcgcctcaccgccgggtcgcgtgttccggccaaagacctccaggtcgtgggcgcccatcccgtgttcgtccgacacgtgcaagttggacgtgcccttcacactcgccaactgctcctcgccggccagcccttgcacctacgattaccggtacaaggaaggatcggcgggggcgcgcggcatcgtgggcaccgagtcggcgaccatcgcgctgcccggcggcaaggtggcgcagctgaaagacgtggtcttgggttgctcctcctcgcacgacggccagagcttccggtcagcagacggcgtgctgagcctggggaacgccaagatctcctcccgcgtccgggccgccgcgcgcttcggtggcagcttctcctactgcctcgtcgaccacctcgccccgcgcaacgccaccgggtacctcgccttcggcccggggcaagttccccggaccccggcgacccagacgaagctgttcctggaccccgagatgcccttctacggcgtgaaggtcgacgccatccacgtggccggcaaggccctcgacatccccgccgaggtgtgggacgccaagagcggcggcgtgatcctcgactccggcaacaccctcacggtcctcgccggcccggcgtacaagggcctggtcgccgcgctgagcaaggcacctggacgggtccccaaagtgagcttccccccgttcgagcactgctacaactggacggcacggcgaccgggagcg

SEQ ID NO: 8649 - DNA, 1090 bp, Sorghum bicolor
  Clone ID: SORBI-28MAY03-CLUS4911_1
gtgcggccagctgttcttataaccgatgcttacaatgctttgaacaatcaaggctatagaaaaaagcaagatcaagatttcattgattcattaattaaagttctagcaactggtggaagtgtgctacttcctgttgatacggctggtagagtgttggaacttcttttgttattggatacgtactgggatgaacggcgattgcagtatcctatctactttctgacaaatgtgtcgacaagtactgttgactatgtcaagagttttcttgaatggatgcgtgatcagatagcaaaatcttttgaaagcaatagagccaatgccttcttgttgaaaaaggtaatgctgataattaacaaagaagagcttgagaaattgggagatgctccaaaggtggttctagcatccatggcaagtttggaggttggcttttctcatgacatatttgttgagatggcaaatgaagcaagaaatctagtgctctttactgagaagggacagtttgggacactggctcgaatgctccaagtggacccaccccctaaagctgtaaaggtcactatgagcaagcgcattcctttggtgggtgatgaactaaaggcttatgaagaagaacaggaacggataaaaaaagaaaaagcgctaaaggctagccttgtcaaagaagaggagctgaaggcttctcttggatcaaatgccaaggcttctgacccaatggtcattgatgcaagctcatctcgaaaatctgcgaatgctggttcacattttggtgggaacactgatattctcattgatggatttgtacctccttcaaccagtgttgctccaatgattcccttttttgaaaacactgctgaatgggatgactttggtgaggtcatcaaccctgatgattatatgatgaaacaagaagaaatggataatactctgatgcttggtcctggagatggtttagatggtaagattgatgatggctcagcacgcctgcttctcgattctacaccctcaaaagtcatttccaatgagatgactgttcaagtgaaatgctcattggtttatatggactttgaaggtcgctctgatgggcgttctg

SEQ ID NO: 8650 - DNA, 944 bp, Sorghum bicolor
  Clone ID: SORBI-28MAY03-CLUS49124_1
tgcaaggatacagtgcaagatatggacaaattggtggtgacagttacccacaagctcgtatggtcccattagcaacagattcagaaacacatcaaagaatgcatggtggaacaagtgctgatgattacccgtcgacaagatactcccttggatcttcaggtgctcgctttagccaaccagctacaactgttccctcttttgggctcccaggtgtgagttcacaacgaggctcaggctcagtaatggacaagtattcttatgggcccgggcctccgactcctccgcggcgctccggtgctccccggtgtacggcgcccccccaggcaccctgctcctgcccgggcccttcgcgggccgggtggcctcatatctgatcgctggaacttgttatctaagtttttttaaggcagaaactgtggggagttccccacagtatttcagttttcgtttttgaaggggatagacatgctataaatgttatgcagcttttgaccagatctaggcgtaacatggtaactatgttagtattccacaagcatgcatccatgcagggtcgtgttaagcaaaattgtttcttataaggtggttccatgctacatgtagtcatgacaaatgccagcacctacgatatatgccctttccttggagatccgacgatatatgccttttggcagccccagggcatgatatcactgattgtacagaaaagtgaacgactccttccgtagttagagtcctagtattacatcttttctcggcaaaattgaatggctgtatcatatgctgcctgttagttgtttttcttatagattatcgatatataaaaggaatggaatccggtttcatccttagaaccaagggaatcagacctggctgtttgttacatgtgtttttttaggtaaaaggaacggtgtccggcttcatcccttagaaccaaggatgtc

SEQ ID NO: 8651 - DNA, 669 bp, Sorghum bicolor
  Clone ID: SORBI-28MAY03-CLUS48341_1
gcacgaggcttcagtctcaccgcgcacgaggcgccgccaaggtgctagctcaagctcttacagtgtatcatcattcatgtccgatgaattggactactcagattcgttgtccttgcacgaggacagcagtaccgagcacagtggctctaggtcggagcttctgtcgtccctctcagttgatctgaagatgcccccaacagaacatgttcagagtccggcacctcatagagatctggaagatatggattttgatgccgacttgcaagatagacttcagaaggcctttgatgagattgtcaagttgaagaaagaaaaccttgaagagtcttgccagcgccaacaggttgagaaggagctcctagtcgtccgcaagaaagctaagaaactacaggatcacctcttaaaagagctacagcactcgaaaggatttgaggaagctcgtgctgcagatcagcgcttgatacaaaagcttaaaaaggatattgaactgctaaagatccagcgtgatgaatatcttgaaaagtttcatcaggcaagtgaccagatcttgcttcaacctttaggagcagctaaggaagctcatgaacaggataaacatgagatagaaacactgagagaaggaattagtcagcttaagatccaccgagacgaataccttgcaaagttcca

SEQ ID NO: 8652 - DNA, 553 bp, Sorghum bicolor
  unsure (1)..(553): unsure at all n locations
  Clone ID: SORBI-28MAY03-CLUS48389_1
accaatgcaacccagccagctcccggcttgcacttgcacatagctacctgccaacagctagctagctcacaagagggcgatcgaaccagtagcacagtttgtcagcaaagtacatactttttgacgtcgaccaaccatgactaacaagctcgccacttccctcctcgccgccgccgtcctcctggcgctcgccgcccctgcggtgctcgccggcgaccccgacatgctccaggacatctgcgtcgccgactacaaatccctcaagggcccactgcgggtgaacgggttcccgtgcaagaggccggagaacgtgacggcgaacgacttcttctcgaacgcgctggcgaccccggggaacacgggcaacgcgttgggttccgcggtgacgtcggcgaacgtggagacgctgccggggctcaacaccggggcggttgtcggtgtcncgcatcgacttcgcggcgtggggcgtgaacccgccgcacgtccacccgcgcgccaccgaggtcatcttcgtcctccagggctccctcgacgtcggcttcgtcaccaccgc

SEQ ID NO: 8653 - DNA, 697 bp, Sorghum bicolor
  Clone ID: SORBI-28MAY03-CLUS48390_1
gcacgaggctgggacttcctggccaacaccaccgacaacaggggcacgcggatcgcccggggcttcgacaacgtcagctcgtcggcggcaccggcgttcgacgctgcctccggccggctcgtcaacgcaaccgctgactacgcggcgaacaactcggccaggcgctttggcacaggtgaactgccgtttgaccagacttaccccaagatctactcgctggcgcagtgcacaccggacatgacggcggcggactgccggacatgccttgggaccatcatcaggacgttcacgcccacgtatttcaccgggaagcatggcgggagagtcttaggagtgcgctgcaacttcagatttgagacatatcagttcttctctggccgcccgctattacaactcctggcgccgcccgggccaccgccatcgccatcgccacagccatcggtgaccggccaagggagaagaagagatagaacagcactgatcttggccactgcattgcctttagctgctgcaatattaatagctctcgcagtgacgtgtttttgttttcggagtagaagaacagaagcacgacaggactctgcaaaaccatattctactaatccagacaacatccaaagcatcgattcactccttcttgacctatccaccctacgttcagcaacggagaactttgctgaaagcagtaagcttggcg

SEQ ID NO: 8654 - DNA, 966 bp, Sorghum bicolor
  Clone ID: SORBI-28MAY03-CLUS48475_1
gcacgaggttgacatgccgcgaatcctcttgaaagagaggggtgccctcgggaacgcggacacaggtggtgcatggctgtcgtcagctcgtgccgtaaggtgttgggttaagtctcgcaacgagcgcaaccctcgtgtttagttgccactatgagtttggaaccctgaacagaccgccggtgttaagccgggcgcagggctggtcgtcgccacggccccgtcccccctacgccctggccccctcgccggccaccacgcttccccatcccacccgcgacggccgacggcctcctgactccttccgccgtccgcccgtcccgcgccgcctaggcgttgtcccgccacttgaaggaggtcgtctcctccgactcagggcttccctctccatccgagcttggatcgctgcttcttttcctggtcttgtcattcgtgagttcatactccagttatctgcatcacaagggaaatggcaagcaaagcaggtggtgatggcaaagaagccataaacgagcaagtaattgccaacacttatgccaacatgcgtaccgaaatgaaccagctctacaccaagatcacagagctggagatggaggtcagtgagcactcccttgtgatcggtgcgatcgaaccgctggacccctcgaggcgctgctacaggatgatcggcggcgtcctggtcgagaggaccatcagggaggtcctgcctgctgtgaagcgcaacaaggagggcctcgaagaggtgattgcccgcatgcatgaggcactggagaggaagaagaaagagatcaccgaatttgagctcaagtacaagatcaggatccggaaggctaacaatgatgccaaggatgaaggtggcaagaaggaaggcactgcacagggagtccttgttggtctgccggacagtaataaaatttaattagagagacatggatgatacgagttattatcctttagacagcagggagg

SEQ ID NO: 8655 - DNA, 521 bp, Sorghum bicolor
  Clone ID: SORBI-28MAY03-CLUS48460_1
cctactgcacgccgcgcgagctgaacccgacccagcaaccaggccaccgctcctttcctctccgatccggggctccgcgcccgctccggcgagccatcgccgcgtcgcctccacgcggccgactacttcccacatctatctatctgtacccggcttcaccgccgccgcgcgcaccaaggttgcgttcaccatattacctacctgtttgcttatctgctcccgagcccagcaaaccctagtcgccgccgcccatggacatagagaccgacgggcgattcggcaacaagcgagtgcaccatcgcctcggcccgggctccggcggtgctccgtcatctaccaacggcaaggtctgcaactactggcgcgccgggcggtgcaaccgtttcccgtgccccttcctccacagcgagctccccgaggctgcgccgcccaagcgccccagtggacccggggggaacgtctggcgcaacccccacaccggaggaagaggcggcggcggcggcggtcacagtagagggggg

SEQ ID NO: 8656 - DNA, 607 bp, Sorghum bicolor
  Clone ID: SORBI-28MAY03-CLUS49441_1
gcacgagggtgcacgacgatcattcagtgacactgttatggcttctctcaagccatctctagtgttctgctctattcttactcttctgagcttgaactgtggtccatctcatgtatttgccaaggtttatatggtggtgatggaggatgacccagtcatttcctacaaagtgaaccgcaagcatgtaatgagaggcgacgaagctcagaagtacaaacgggtggccacaacaaagcatgacagcttcctggactcatttctcccagtgggatcttacaagaaactatacagttacacgcacttgattaatggatttgctctccatgctgaatctgagaagacagttagaattcttagtggtgcaaaaggagttagatttatccaagaagacatcaaaatggccaagatgaccacacatacaccaagttacattggagctagtgcagtatggccgctcctgggtggtgctgagaattccggtgatggggtggtgattggcatgattgataccgggattgaccctaagaacccaagctttgctatcagcaacacgtcaagccaagcaaaaccaccaccggctagtttcaagggaatatgtcgtactgga

SEQ ID NO: 8657 - DNA, 737 bp, Sorghum bicolor
  Clone ID: SORBI-28MAY03-CLUS49476_1
agagatcgaaacgaaagtgagagagcatcgcagagggaagaaggcggcccccttggctggctcgatcgccgctgtgttcacgcggaggaatcagatcagcaccgcgaaatccaccagcgcagacgaggcagcgagcagtccaggcctctaggggaccaggatggcggcggccgtggcgtcgctgtacaggcgggtcctcccgtcgccgccggcggtggacttcgcttcgccggagggcaagcgcctcttcgccgaggccctggcggcgggcaccatggagggcttcttccccctggtctccgtcttccagacgcagtcggagccggccttctgcggcctcgcctccctcgccgtcgtcctcaacgcgctcgccatcgacccgggccgccgctggaaggggccctggcgctggttcgacgagtccatgctcgactgctgcgagcccctcgacaaggtcaaggaccagggcatcaccttcggcaaggtcgcctgcctcgcgcactgctccggcgccgacgtccaatccttccgcgccaaccgggtcaccatcgacgacctacggcggcatctcatccgatgcgtctcctcccaggactgccatcttattgcttcctaccacaggaaggctttcaaacagactggaactgggcatttctccccaatcggtggctaccatgccggacaggatatggcgctcatcttggatgtcgcccgtttcaaatatcctccacattggg

SEQ ID NO: 8658 - DNA, 1074 bp, Sorghum bicolor
  Clone ID: SORBI-28MAY03-CLUS49671_1
tgaagcgtcaagcttagtcgcaactagcaaatttgagcataagaaacgaatggagatgattcagcctatacctgatatagaggagccatcagggcaggaaggtgctgagctatcaaaaatacctgttgatttgaaaagtggagactggttccttaagattgttccatggattggaggccgtattatctcgatggcccatcttccttctgattcccagtggcttcacagcaggattgagataaatggttatgaagaatacagtgggactgagtataggtctgctggttgcacagaggagtacaaagtcatcaggaggtatcttgaacaatctggagaggaggaatctatttgtatggaaggagacattggtggtggcccggggctccagcgccagatatctattttgaaggagaacccaaaaattgttcagattgactccagcattcaggcaagaagtgtaggagctggttctggtgggttttcaaggtgggtctgggttcgcgcgaggcctacattcaccctgctgcacccaactgaggtagtggttgctttcacggccatcaatggttcaaagcaagagatctccccggaggcaggagaaataacgtttgagggagacctcagacccaacggggaatggatgctagtggacaagtgtgttgggctcagcttggtgaatcggtttaatcccaaggaggttagcaaatgctttgtgcactggggaactggtgatgtgaacatggagctctggtcagaggaaagaccagtgtctaacgagacgccattgaggatttgccaccagtatgaggtgcggcaaacaagctaaacactacccggacaacagaaataaaaatacaaatttggaggatgtttcagttcagcctcgcacttgttttacggtctttgtattgacggttgtctttcatggtattttggagtcgggtcattagtgtcgttacctattggaggacgttgggtctgctaaaaacaggttgctctgcaatctctgcagctgttcatgactggcattaataaagctgtggctgttgcaatctcaaaaaaaaaaaaaaaaaa

SEQ ID NO: 8659 - DNA, 523 bp, Sorghum bicolor
  Clone ID: SORBI-28MAY03-CLUS49590_1
aagcacagtcaaaatggatgatagcagatgaccagctaagggtggacattagggcagccgtggaggagacagtgatgccagtttatgcctcgttaattgccaagttgaagtcttctcctgaaaccgggcgtgatttgtacatcaaatacactccagaggatgttgtagcccatatccagcacttgtttgaaggagcagcaaagtgacaaatgatatgcagccttgtagcctgttatactgcaggttctgcccttctgaacttgtgaagatgctatcatggattctccattcgtggttaatgtcttgtactcacatatggtgatgctgttgtctcgaattacaactgtgcatcactgtttttgtcctccatgagaaagttattcagtttggcaaatgttgtatatgtgtgtaggtgtgtctgtatcaatgagtagcatgattattttgtaacaatattagggttctatttctgtttcgagcactactttaatttaacccccattaagtattatgtgtggatttc

SEQ ID NO: 8660 - DNA, 808 bp, Sorghum bicolor
  Clone ID: SORBI-28MAY03-CLUS49666_1
gcacgaggggaacgtctaggcgccaattttaatcgtgaccagaatggcatgcatgctcaactacttgcattatccaagcttgtggagcttcttgatcctccgttgcataactattttaggcagaatgactgcttgaactacttcttctgtttccgctgggttcttatacagttcaaaagggagttcagtttcgaccagatcatgcttttgtgggaagttctgtggacccattatttgtcagaacatttccacttgtacttgtgcgtagcaatcttgaaaaaatatcgtcagcggataattggggagcagatggactttgatacccttcttaagttcatcaatgagctcagtggtcagatcaatcttgaccgggctatccaggatgcggaggcattgtgtactattgcaggagaaaacggggcttcctgcattccacctggaaccccaccttcgatgcccattgagactgatggtggcctgtatgtgcaagaagacgaggtcttgtgagatatcagcggtgaccctagaaaataattgcacagaagcatcaggagttgttatcctgtagtgctttcatcaacgtcataaatgtgatccgttgtaaggttatacctatggaagaatcatgaaatctagggttgtgtgtgtatatactccctcgataaacctgtaattgatactttcacttaagagatatggattctgtatggaacgccaggttttatctcagctaacatctgttctgccacccaacacttgtttggccagttcctgtgttacaacttaattgctaaagggggttcatttt

SEQ ID NO: 8661 - DNA, 617 bp, Sorghum bicolor
  Clone ID: SORBI-28MAY03-CLUS4970_1
ccacgaggtccgcccacgcgtccctcacgtgtgccgcaagccgcgactcgcgacgcgactctgcccgccgccgccgccgccgccgccctctcccgctgctccctctctctgcgcacgccgtcggccgcgctgctcctccccgccgtctgcgcacgtccgaagctccaccggatgttccggtgagcaaccggcgccggcgccgccgcctaggttccgcctacccccataggcgaggcggggagctccgattcgcgactagtcgcgcctaggcgagcgcctagcggaactatgatttcagtgataagttgttttaaccttatgctatgaattgcagttcactttcatagtgtgcagccgttcgggttgatctgcgcccccatctggacaaccgccactgctccgtcctttggaaggcccccttggtccgctgccttccggtgcccgctgggagcccttccgtcagacctgtgatggtactccttttgtcatacctgagatggaaccaacacttcgcaagcagatacaagagtgtaactggcaggttgtgaatgtgacaactcctgcaaattattttcatttgttgcgtcgatacatagggagttccggaagccactgat

SEQ ID NO: 8662 - DNA, 609 bp, Sorghum bicolor
  Clone ID: SORBI-28MAY03-CLUS48929_1
tctcgtggtgcacttcccatcgaagatctgggaccagcaattaacaccattcaaaaatttcaaacttctaacctatttgcagtaagggttcacctccaaggagttacaccgctgattcacgacgcgcgcagatgcgcgcgcaatgcactagtgaggaagtaaagcaccgaaaattcaagtaaaaaagctgaggttatatgcgaagcatcagtttttgtccacatgttcaactgttcaagagctacaaaatgcagtgatatgaagcttggaagtaaagcacaaacagtttgctgctactgctagcctgctacagcatagttcataccgtgaagcaggaataagaagacttggaatgcgagaccatgaagcaagacagggcatcaaataaaacatatacttaatagtaatcgtctgccttcaaacatacataaagtttgtattgtttctgtatgcgatccgatgctgcaaacaaaaactcatagctaatatatgctgcaaacaaaagatgacaacagaaaacaaccttcctagcaaaaactcagactcgtagctaatgtatgcgatacgatgctgcaaagaagagtcccttttttttgggacttaactgcc

SEQ ID NO: 8663 - DNA, 781 bp, Sorghum bicolor
  Clone ID: SORBI-28MAY03-CLUS48952_1
gcacgaggcatgaattattgtcaatatcatcaaccaatgcttaccctaaaatatccatttgcattcagttttgttggtgtaatgcttactctaaaacatccatttgcatttactgcaccttaatctcagcaaactcagggcagttagtgtcatcccaaattcagaccacatagtgttatcccaaattcagttacagtcgttggtattatccagaatttaggctgtttacagattcagctataaaatacccttatttcccttgtgatctaaacttagttacaatctatagtatttttatgttttatttctctcaggtgaaccagaagatgatgctaactctgacagcaagcatcatgtactggtatttgaaaaggccaacatcacattcattggactctgaaaatgggagttcatgtgagacaacctccatcacaacttcagatgattctgcatctgaatcatcgattgatgacaatacaaccagataaaagtgcaggatcatgaagataaatgatatgacctgtgtttttgaaaacttgggatactcataccagtgcagcatcggttgtgttcttgattgtttgctgtaattttaagggcaaatgcattcaagacagagggaagggaggttaagagctatggtgttcatttgtgaggtttattagtgtgaaagcttgattggtgaaagatgtgtgacatcctgtaaatattgatacaggtagctatatctgtaacatcatatagtgacagtggattgtccaaaatccccatagcttgattt

SEQ ID NO: 8664 - DNA, 766 bp, Sorghum bicolor
  Clone ID: SORBI-28MAY03-CLUS48999_1
cggtggacggcaaggacaaaccgttaatgctgaaggaactaaaaaaggtttggaataaggatgacccaaatctcccatgggaggagggagagttttcaccttcaaatacattactggtagatgattcgccgtacaaggctctgtgcaacccgccaaacactgcaatcttccccgaaccctacagttacctgaaccagagggatgattattccttgggacctggtggagaccttcgggtttatctgcagagaatcgctgctacagacaatgttcaaaattttgttcgggataacccatttggtcagaagtcaatcacagagagtgatccaaactggaatttctatgtgaaaatagttggtaagatggagaagcgaatagttgatgaagtggaaaagaaatggaaaagaaaatagttgataaagtggagagttccttaggttaataggaacaaaggttcaatcaagagagttttgtatttgtttgtgttgcttagcaggagttttgcattgcgagcagtgctatcatgtgtaatctagtttagtaattgttgtttcatagacaaaacttgatttgaagaattttgataggttttgttcttctggctgagggatgaatcatggtttcccctgtatcgagtattacatgctctggttttctgtaacttagttactgttggaagttttgatgactatgctgcaaggatgtttcagttcgatggagctgtaatacattcgaattgttgtaaaatcatctcagtttcatggtt

SEQ ID NO: 8665 - DNA, 824 bp, Sorghum bicolor
  Clone ID: SORBI-28MAY03-CLUS49003_1
tttgtggaatcccattagttcaggtgatggaagaacaaagacaccactgagccctactgttgctgggtcagatcctcatccatttggtatgagccatggattaggaggcagcagtgttcagcttatggagtcctcgaggcaatccttgggtgcctatcacagctattctgttgggagcttaggtcagatgcagttttccagtggtgtgcgaggtcagactactcttcaaagccggaggtcgcaatcaagagaagatctcatttcttcacttgctgatattcatgttccaaaagtgtagcattgcatcacagaatgacgactagaatgagatcctatatgccataacaaactctgtaaataatagctccagagttcaaactgcttgatttcttctctaatcagaagtcaattttgtcggtccactgacacttcaatgaagtttaggatccatataaatgaacttatgacttgtgcctatcctggacatgatacatccattcataccattgtatgtgctcaagaacataccataacagtgaagttctagtagtgtcccggaagatatatttatgccgttcaccagtctggttgaccgtggctacaacctgcaagtttgtagaccgattgtgctgcagtcaggcatgtttttttttctactgagacataataaaggtgcatgtggtctcatgtattgttgtaccctctagctgtagtggctctgtgagcctcctcttctttcctgaaatgccttttggtaggccaccttgtgatatgaattgaaatcatgaaacagaaacactgacatcagttctactggattatcc

SEQ ID NO: 8666 - DNA, 668 bp, Sorghum bicolor
  Clone ID: SORBI-28MAY03-CLUS49028_1
cgtctgatgaatttgagccactgcctatcaagataagtgcaaaaaacatgggaaatgtctctcgtttcatgaaccacagttgctcacccaatgtcttctggcaaccagttcaatatgatcatggagatgatggacacccacatataatgttctttgcgctgaaacatattccaccaatgacagaactgacttatgactatggtgttgctggagctgaatctagtggtccaggttctcgtagaacgaagaactgcatgtgtggatcacaaaactgccggggattattttgatgggtttgaagacttgctctctgtggttaatcatgcaaataactttctgctagatcctttctatgagagcaaatttagtctccggatgatataatagatgatgccaattgccatgtgtactgtgaagacagtaagtcgccgaactgtagaatttctgtcccctgcactgcatggtggtggttttcccaccatttgctcagatgtttatgggggcgtggatagatgtattgcttctgttaatcttgtccaccaattgcactgccatttgtagacttgttatcagccctgtttgcgctggacacctggttgttagttgtgactccttggatctggtcatgtaaattaacctggtttaggatccatgttgctttggactcg

SEQ ID NO: 8667 - DNA, 750 bp, Sorghum bicolor
  Clone ID: SORBI-28MAY03-CLUS50084_1
acaacatcaacaagagctggcagaactaagacaactgttcccgttgccccttcatttgtgtgtgctaaccgtgctgacaagaggaaggagttctacacaaaattagaggagaaacataaagctttggaagcagagaaggacgaggctgaggccaggaaaaaggaagagcaagacgttgctttaaaacaactaaggaagtcattggtgattaaagcaaaacccatgccaagcttctatcaagaagggcccccaccaaaggctgaacttaagaaggtgcctactactcgtgccaaatcaccaaaatttacaagttcaaggagaaagagctgcagtgatacaacacaaacacctgaggggaaaaataccaattcaacatctacccggtcacatcgtcacagcattgggacttctaaagacgctaacagagtacaatgctcgccgaagagtggtgtggcgaccaaaactagatccgtcaagcctgagctgaaggccctctgaagagcatggagcagccaagcgctgcgattgtctttgtacaaaccgaattgcctaactcttagccgtttccatttccatgcatttttttcttttattctatacccaacatctccaccaaaagaaggctgtagggccaatcacgttgttcgcgctgctgaaccttatccattttcttacattcgtcttgtactcgtaagaactctgttgctggaccatgtgatgtaaattactcgaagatccttgtagggagtt

SEQ ID NO: 8668 - DNA, 701 bp, Sorghum bicolor
  Clone ID: SORBI-28MAY03-CLUS49997_1
cctcctggccactgccctccccccgcgccccccctaaactcgcaagcaacccgcggctgagctccgtgcaccagttgtctcgcgttgctgccggtgctgcaggcggcattgtcggcgagcttaggatgggtggcatggtggcgtcggtggcggcggcgctggtcgtcgtccttggcgtggcgtcggtggcgacggcgcagttggagacctgcaacggcgacctcccgcccgtgctcgccgccaactactccggacttgcctgccagccggtctggaacaacttcgtgctccggtatcaccaggacaagaacaacgtgctccggatcgtgctgtcgacgatgtacagcacggggtgggtgggcatggggttctccagggacggcctgatgatcggctccagcgccatggttgggtggatcggcaagaaggggctcccccacatccggcagttcgcgctgcgcggcaagagcagctcctggccggccgcggcccccgcccccctcggctccagcgcccccggccccaccgccgggctgccgccgccctcgatctacctcgccttccagctcaggttctcctaccgcctctcccaccagcacatcatcatggccttcggcaacagcatccccgtcaagaacaagctcaccaggcaccaggacaagacttccttcaccttcgatttcaccactggctgaacgtgt

SEQ ID NO: 8669 - DNA, 752 bp, Sorghum bicolor
  unsure (1)..(752): unsure at all n locations
  Clone ID: SORBI-28MAY03-CLUS50137_1
actgcagtatactgcagctagtatttctgttcatgatgcagcagacgaagaagaggctcttttgagtgagcatgaaacctctcgggagaatgccgaagaagaaataacagagggtgaattgtggtacgagttcgagaaggacttggatcgacagactgaagtggaggcacgaactcgagaggaagaggcagctgcagccaaggaaataatggaagaggaaagtgctgtgctaaaaggtgtagaggacaggcagtccttcacatcagatagcttggagaggcagcaattctacccacctggtagaatcatgcacatggttgcaatgcctcccacagatgctgacccagatgatccagtggctgctgacgagtgctctgttggaatatatgagacccctagagatctttacagcaagattcgactctcaaataccatgatcaatgatcactacatgccaatgtataagaagatgatggaaatattgattgagaagttcgcaaaggatgaggacagctattgtacaggttctactgtagaataacgtgaaggcatgaatgacctatatacatcatataactgtacaatactccccttgttagctgttattagcctctctgacattgcaatatacaagaggtgatgtcctcctgacccgtgaaaaaggattttagttagggtcatgtgagtgtgtgtgatgtgtaaatgtaaaaggaaaccagaatcagcannatttaataccttttccagtcaaa

SEQ ID NO: 8670 - DNA, 948 bp, Sorghum bicolor
  Clone ID: SORBI-28MAY03-CLUS50155_1
gcacgaggttcaaagggactttccagacaccacaagtggtagaacatcagccaatcaactggttgggagtgtcagtgagttaacaagggttaaaaagcagggttctagtgcgagtttggctggggatgatcctgattttgctgaagaagctgttagtaaatggtctgattctggcatgtcaaaaggaagctctcactccttgctaaagcgctctacaaaccaacatactacatctcagtcagttcccgcagatctgtcttcagcaatcaggctgaagaaagcaggccttgtgtcctctgatgagaataagatggaatcaggagtggcatcagtagcccagggtatggaaagcagtgttcctagcaacaaagagccaggggtgtatagcatgccatcagccaccaacaatccagatgcctctggtcagtccttcagcgaagcgctgaagagctcgaggaagcctccgttgcagtatgatgcctcagaatctgcagacggtggcccaggtggtaagggcgcaaagaagaaggccaagaaaggaaagcagattgacccttctcttcttggcttcaaggtccacagtaaccggatcatgatgggcgagattgttcgagatgattagcatgcaatgagtgtacatacccggtaggaggtggccttagaatcatgattggcttcaaggtccacagtaaatcctaaactctgtgtacatgctccctcacctctttgtaactccgcagaaattttgtaccatggcttcatttttgcccagatcttctcttagccatagtcttacccgatttctcagatttagaaattagggagcctttttttcttcttatcggtgcccccaggtttacagaagtgtcatttgtacagaacagctaagagcatcatgtattttgtgccatagttttgatgatctgtcgtaaacggggaagatatcct

SEQ ID NO: 8671 - DNA, 1196 bp, Sorghum bicolor
  Clone ID: SORBI-28MAY03-CLUS50217_1
gcacgaggacttgcagtaaagcggggcaaccagaagtctcaccaagggctgagggagttccggacggagatcgaactgctgtcaggactgcgacaccgtcatctcgtgtcgctcattggttactgtgatgaacacaatgagatgatcttggtgtatgaatacatggagaaaggaactctgaagagccatctgtatggcgctcgtgggccgcctctcagctggaagaaaagactggaaatctgcattggagcagcaagagggctccactaccttcacactggttttgccaagtcaatcatacaccgtgatgtcaagtcagcaaacatcctcctcgatgaaaatctcttggccaaggtttctgattttggcctgtcaaaggttgggcctgaattcgaccagacgcatgtcagcacagcagtgaaagggagcttcggataccttgatcctgagtacttccggagacagaagctgactgacaaatcagacgtgtactcttttggtgtggtgctgcttgaggtgatctgtgcgaggccggttattgacccgactcttccaagggacatgattaaccttgcggagtgggctatcaagtggcaaaagaggggagagcttgatcagattgttgaccagcgcatcgctgggacagtcaggcctgaagcactgaggaagtttggagagacagtggagaaatgccttgcagagtatggtgtcgagcgtcctacaatgggtgatgtgctgtggaacctggagtttgtgctgcagctacaggaggcaggtccagacatgtccaacatcgacagtatgaatcagatctctgaactcccttcaaatgcaaacagagtaagctccttggatatcagcactacagatcaaagccgtatgccgattgagtactccgacatgtcgacaagtaacgccttctcgcagctaatcaatgcagaaggaaggtgaaccggatagaagtgttccagagtcactgaaaaatacagaaggaaggtgaactggatagaagtgttccagtcactaaaaaatgttgagttacaaaaactagagagagatgcctcttgcttgactattttctatcccttctcacatatacaacaccaagttattgcttgcctcttgtaagtacttgtgttgttgaagggtgagtagctttgtgccagtctcagtgtgctggtctaattcttttgctc

SEQ ID NO: 8672 - DNA, 638 bp, Sorghum bicolor
  unsure (1)..(638): unsure at all n locations
  Clone ID: SORBI-28MAY03-CLUS49235_1
gcacgagggcagcaccgacgacccacgaccccctcctttctcctccaccccacgcggcctagccctgtgacatggctcctcgcagagcgtgacgcgggtggtgtgggtcctgcgcggcggcgcgacatgggcggacaccgttgttgcccacggttgcctccctccacgtgagctcctgcacacaggcagcgcggctctcctctccctcgatccatccactcgctggtttactcttcctctctttcccttcctccctcctttccttccccctctctcctgatgtgggatatcaccgtagatgtggtgttttcattctattctcgcaccaatctacacatggttattgttaattgttgttgttatcccctacaaacccgtgcagctcctccaaagaacccctggccacgtctcctcanatgttttcagcactttgatttgctatcctctggttgataaacgctgcagctgattcagctgatttcgttaccaaatacctcctcctgtgatttctaatgcttctttgggtttacttcctagctatgcttaatttttacagcttccactgtaagtcctgaactctgagcacatgaccatggcactaatattggtttcacactatctgcactgcagtactgatg

SEQ ID NO: 8673 - DNA, 1073 bp, Sorghum bicolor
  Clone ID: SORBI-28MAY03-CLUS49311_1
gcacgaggggtaaattaacccgactatatcagcgaatggagacagaacctggattgagcaagcttgttcacaatgaatccggattgaagaaggcaatagagccccttcttcaaatggctgagaaactgatccctagacatgcacacaaacacactccactttttctatatgctacagctggtgtccgcaagctacctagtgcagagcccgaggggctccttgataaggcctgggatattctgaacaattcatcatttttatgtagtagagacaaagtcaagatcattaatggcatggatgaagcttattatggatggatagctcttaaccaccacatgaatatgtttggcacctcatcatctaaaatgacatatggttcacttgatttaggtggatcatcattacaggttacatttgagaatgataaatcagtgcaggatgagacaagcattcgtctgagtattggttcagttgatcatcaccttagtgcttattctcttactggttatgggttaaatgatgcatttgataaatctgtagcacatctagtgaaaaggttgggaggagcagctagtaatggcaaggttcaagtcaaacatccctgtctacagactggatacaaagaaaattacacttgttcttactgccacccattaaaacaagatggaagtcccagtgttggcgagaagaacactggcaaagagaagcagggaatagctgttgaactggttggagcacctcagtggaatgaatgcagtgctcttgcaaaagtaacagtcaatctttctgaatggtccagtgcaagtccaggtcttgattgtaacattcatccttgtgctcttgcttctaactttccccaaccacatggggcagttttttgctatgtctggcttctttgtggtttttaaattttttaatttgactgctgatgcgtctctagttgatgttctaaaaagaggtcaggaattttgtgaaaaaccatggaaagttgcaaagagtagtgttcctccacagccttttgtagaacaatattgcttcagagctccttatattgcatcactactgagagaggg

SEQ ID NO: 8674 - DNA, 747 bp, Sorghum bicolor
  Clone ID: SORBI-28MAY03-CLUS49371_1
gcacgaggcctgggcgctgctggccgccgccacctcccgcgcctccgactccgccaagtgcccctccgctgtctcgcagcgcgcgcggggccgggtcgtcttcctcccctgcggcctcgcggcgggctcctccgtcaccgtcgtcggcaccccgcgcgccgcgcacagggagtacgtgccgcagctcgcgaggatgaggcagggggacggcaccgtcatggtgtcccagttcgtggtcgagctccagggcctgcgcgccgtcgatggcgaggacccgcccaggatactccacctcaaccccaggctcaggggggattggagccagcaccctatcctcgagcacaacacctgctacaggatgcagtggggcgccgcgcagcgctgtgatggcacaccacccggcgacaacgacgacaaagttgatggattccccaaatgtgagaaatggatacgcaatgacattgttgacaccaaggagtcgaagacaacttcatggttgaagagattcatagggcgtgcaaagaaacctgcaataacatggccattcccctttgtagaggagaggctatttgttttgactatacaagctggagttgaaggtttccacatttacgttggtggtcgacatgtgacatcttttccttatcgaccagggttcactcttgaagatgcaacgggattatttgttaagggtgatgtagatgtacattcagtttacgccactgctcttcctatgtcccatcctag

SEQ ID NO: 8675 - DNA, 1027 bp, Sorghum bicolor
  Clone ID: SORBI-28MAY03-CLUS49388_1
gcacgaggggctatcatcactggccttagagatatcttcaattggatgtgaagaaggacatgaccaaagtggcagcaaagataacctacatggacacgtaagcaatcatcaggtcttatcagaggctaaagttgaaggtggcgaaaaggagcttggggactatccaagacctcaagctgttgtggctgctagcgtattgaggcatattgggatcgacgagatgctgaaggagataagggctgccctgagaaaatgctttgatcacaagttaccagaaccttgagcaaagcaagttagcgtaacataggcttagtaccatagtccagttcctgtagcagaaaagggaatgatctggatgcctcctggcacatactgaagaatctccaacggcagtaaaatccatggagagttttctgaagcaacccatactaatctattcacacatggtgtattgtcgtctattaactacaaacagatgcggtagctgctatgggctgccctgagggactgctccgatctcgcggcaccggtaccctgcgcggacccggttgccgtcacctgggcttagcaccggcgtccggtgccggtggcggaaaggggcttgggctcgatccctccccgcacgctctggtggctccccgccggctgtggcatcctgggagcgtcgtctggcgcaaccggatgtcggctgcccggcgtggagcccgtcagctcttgtgccccgttccttgcgcggggcctccttgcgtatctctggcttagtgccctgggcccgtccccggcgccggtttggggacgacctggctgcctccgggcacagactggtgtggctccaacggcagtaaaatccatggagagttttctgaagcaaccggaagtctgatatctgacttggagcgcgtcagtttttaagctccgtttgtaacatgggtcctccattgaaatttctgggaaattgaactgtgtccgtccacagcagctgtttatagacgacaatacaacatgtgtgaatagattagtttgggtt

SEQ ID NO: 8676 - DNA, 585 bp, Sorghum bicolor
  Clone ID: SORBI-28MAY03-CLUS49414_1
gcacgaggccatcgcttgcccctcgctcctcttcctctccgcgccgcctcccttcgaatcgaaatccctctccgccatgccgaagggcgccaagaagcgcgccaagctcaagaagcagcagcagcagcagggccaccccgacgatggcggcaacaccaacaacgccagcaacggcaacggtaacggcagcgatgacaacaacaacgcctcgagcggccgcgacggcgagcaccacctgcggatcccacccaaagtttctcgcgtggatgcgagcgaggactccatggagagctccgaggagatggtgaccccccgggccgccgcgtcggagccggacgaggaggagaggaaggccaccgcggccgaggtgtccgtggagcgcgccgtcgaggcggacgtcgccgggtctggggaggtcatggtggacgcgtttccgccggaaaccgctgggcaggaacgtgagggcaaggtggatgaggcagaggtggaggtgcacgctgcggtggcacaggaaccagaggtgaaggatgtgttggtggccgaggaatccgtggtgcaggagccagtggctgatgcaccggaggt

SEQ ID NO: 8677 - DNA, 867 bp, Sorghum bicolor
  Clone ID: SORBI-28MAY03-CLUS50589_1
actgccagtcatatgatggaggctttggtatggttcctggctctgaatctcatggtggaggaactttttgtgctgttgcggctctccatctaatggacttcattcaagttgatttggcatctaacttaagagactcctcgtcaatcaacatatgcatgctcctcgaatggtgtcttcagagacaagtcactaatggagggtttcaagggagaagaaacaagcccaatgatacctgctatgctttttgggttggaggtgtcttgaagatcttgggtgcttatcacttgatcgatcgctgtgctctgcggggatttttgctcacctgccagtcaccttatggaggcttcacaaaattcccagatgatcggataccagacatctaccattcttactatggcctggcagccctttccttgttggaagaggatgggctcgaacccctccgcgtcgatcttgggatcctgtccgctgcattatagaaactcgcatttctaccaaatccagttagtctacaatgtttgggggtaatccagtacctcatacaggctatacagctgaaactgaaagccaaggaagttaatttatggatagagtaagttggtctgtgttgtcagtgtgcttgtttggctgggcggatcatgtaacattactttgtgagttttaaagatgtgtgataatttgttgcaaaagaagtgcgatgagcatgctaaccgaactgtcttcttcccagttagttgagctaattgttgacagttgagttagctgaacggctttgttgtcacttggaaagctactcgaatgtttgatgtttctcttgcgtctgtttggcataactaaatgacttgcggctgctgacttggaacagtt

SEQ ID NO: 8678 - DNA, 712 bp, Sorghum bicolor
  Clone ID: SORBI-28MAY03-CLUS50599_1
gcacgagggcggtgtcgtgcctggccaatcgaaagagctcctcccaggctattcgatgagtccttcagcagcacagcaacttctttctccaagtactctgtcgtggacagctccatggacctgagcagctgccgattctccgagctcagtggaggggctctgcaagaaggcagcgacgactcagagaaggagaggcctctggttctgcgcaacaaggcgccaaggtggcacgagcagctgcagtgctggtgcctcaacttccgcgggcgtgtcactgtggcctcggtcaagaacttccagctgatatcttccgtgccacagccagctcccgtgggggtttcttctgctccaccgctggcggtaacacctcctacacagacacagccacaagcctccggtccgtcttcagcgtcgtccagccatgtccatgacccagtgatcctgcagttcggcaaggtcgggagggacatgttcaccatggactaccggtacccgctgtcggccttccaggcctttgccatatgtctgacgagcttcgacaccaagctggcctgtgaatgaatagatgggacgagtagtgtatcgtagcagggcagcagcgctgagagtcttgagcgatcgttttatgtgtttaagtgataagcagaggcattctgagcctttgcatgtaaataatttacacgtagctgttgattccaagtattgtttcgtg

SEQ ID NO: 8679 - DNA, 839 bp, Sorghum bicolor
  Clone ID: SORBI-28MAY03-CLUS50686_1
gcacgagggcggacagcagaaaaccatcacatcaaaccggaaaccacccttccctccagaactcgagaccattctcccctttccccttctccacgcttcgcccctcgccgactatttgagtatatagataggaggttgaaggagaacaaccacatggttattgttgtggcggagggagctggacaggatcttattgctcaaagtatacctgctgcagatcagcaagatgcatctggaaataagctgcttcttgatgttggtctctggttgactcacaagattaaggattattgcaagagcaagaagatggagatgactattaaatacatagatccaacctacatgatccgtgctattccaagcaatgcatcagacaatgtctattgcacactgctcgcacatagtgccattcatggtgcaatggcaggatacagctttacagtcggaatggttaatggcaggcatgcatatataccatttcatagggtgacatctacaaggaacaaggtgaggataactgacaggatgtgggcgaggctgctgtcttcaaccaaccagccgagtttcctgagccagaaggacatcgacgcggcaagagaagccgataaggcggccaatgcgaagaaccaatctgcaccagcgttggcaaatggtgagaaataagtatgcttttgacggctctttgttgtgtacagtagctgttgcaaactgactgaggtcagtaggccaaaactgcgaattcgatgagttttgcttccatttgcatcggaacagaatccacgtaataaaagtttcatagtgtgtgtatttgcgttagtaaacgtgtaccagtgctctgc

SEQ ID NO: 8680 - DNA, 708 bp, Sorghum bicolor
  Clone ID: SORBI-28MAY03-CLUS50789_1
gcacgagggtgaggggcaccttgccatggatggctccagagttgctgaatgggagcagcaacaaggtgtcggaaaaggtggatgtgttttcgtttggtattgtgatgtgggaaatcctgaccggagaggaaccatatgcgaatatgcactatggagcaataatagggggcattgtgaacaacacattgaggcctcctgtgccgggaagctgcgatcctgagtggaggcggctgatggagcagtgctgggctccagaccctgtgcagcggccggccttcacagagattgcaggacgtctgcgcgccatgtcggctgcagctaaccaggtgaaagcagcaatggcagctgcggcggcggggaaataaacagaaagtaaagtagtggtgggtggctcccagtgtaggtgggcgggacaaggtgcttccccatactttgacagttgacttgtaaagagaacgagagagagtaaacataatcgagtggcaatttttcactcactactagtcactactcgtacttcatgatagtagtaggagcactgcaattggcatctgcattgtagcagtattatatgtatatggccgcaatgaagaagcaactgcaatgctccatgcgtgtgtgtgtgtgtgtgtgtggatgatggactgatgtgactgaatggtatatataaaactctgaatacaatacaatgagaaacagtcgaggtgt

SEQ ID NO: 8681 - DNA, 760 bp, Sorghum bicolor
  Clone ID: SORBI-28MAY03-CLUS50818_1
ttctgaataaacttgctgctgctagaacactgggttcaagtattggtagtaaagttttgactgatttggttgagggtcttgaggaagctgctgtgtcagttgagataagactgaagattgatcagaatcattcagatttgaaaggagggtccttccgtgactatggagaatcagtcttgaggcatttagagaatgcaatcagcaaagatccaaatctccatatagcccccaagaactatgaaggcgtaagggtttcaggatatggtgggtggttcctgctgaggctctctctccatgaccctgttcttcccctaaacattgaggcaccacgtggagatgatgcgattaaactggggcttgcggttcttgctgctgtgaatgaattttcagcactggatgtgacggcactgaacaaattcgtgcagcagtgaacatagggacatttatcattctgtgagcttcgcatggtgtcttgcttgccccggtcaagcgtggcacgagtatcgtacagaaatatacctgtttacacagactttgtagtctggaaggacaatggaggttccagtggcttttctcctaagatgattttttgcgtgtttataccagctatctgattaagaatatgcgtgcgtgctggtgaggctggtctttacttgagaataatatttgagttacccgaataagatcaggaggcttgctgtgatgtgaggccatgaatttgccaaagagaacctatcgatttttcattaaaaaaaaaaaa

SEQ ID NO: 8682 - DNA, 1283 bp, Sorghum bicolor
  Clone ID: SORBI-28MAY03-CLUS49700_1
gcacgaggctcgtcatctccgcctggaactaccccttcttgctggccatcgacccggtggtcggtgccatcgccgccggcaacgcggtggtgctgaagccgtcggaggtggcgccggcgacgtcgtcgctgctggccgagctcctcccgcggtacgtggacgcctcctgcgtcagggtcgtccagggcggcatcccggagaccaccgcgctcctcgaactcacctgggacaagatcttctacacaggtaacagcaaagtgggacgcattgtcatgtcctacgctgccaagcatctgactcccgtcgtcttggaactcggcggcaaatgccccgtcgttgtcgattccaacgtcaatatccacgttgccgccaagaggatcgccgccggcaagtggggctgcaacagcggccaagcctgcatctctccggattacatcgtcaccaccaaatcccttgcaccaaagctgctggagtccctgaagaaagtgctgcgcaagttctacggcgaggacccgctgcggtcgccggacctgtcgcgcatcgtcaactccaaccatttcaacaggctcaggacgctcatggacgacggcacggtcgccggcaagatcgccttcggtggccagagcgacgagcagcagctgaggatcgcccctacactgctgctggatgtcccgcttgattctgcgatcatgaaggaggagatcttcgggcctttgcttcccataatcacggttgacaagatcagcgagagcttcgccgtgatcaactccgtgagcaagccactggcagcttacctcttcaccaacgacagccggctcaaacagcagttcgagaggaacatctcgtcaggagggatgatattcaacgacaccgccatccacctgacaaatccacacctgccattcggaggagttggggagagcggcatgggcgcgtaccacggcgccttcagcttcgacgccttcacccacaggaaggccgtcctggaccgcagcagcttcctcggcgaggctagggcgaggtacccgccatacacgccggcgaagctcggcatcctcaggggagtgctcaagggcaatccactcgccatggttctggcggctgttgggtatacaggaggaagaagaagggcatgagttgattgatgatccctgcttcatactgataataataagcagattcgacgcatacgtagtagtgtgtctcttttttttttggttttagaaacgtataaattaaagtaatagtacatttctgtgcaagtacgaaggatttgcacatgc

SEQ ID NO: 8683 - DNA, 662 bp, Sorghum bicolor
  Clone ID: SORBI-28MAY03-CLUS49765_1
gacttgtgattgatcccagttcaggaaagacgattcacgaactccgtggccatttggattactcctttgcgtcagcatggaatccagatggccgaacatttgccactggaaaccaagacaagacatgcagggtctgggacatccgcaatctctccaaatcagttgctgtattgggtggcaacatcggagccatcaggtcgattcgctacacatctgatgggaagttcatggcaatgactgaaccagcagatttcatccacatctttgatgtagagagtgggtatagcaggaagcaggaactggacttctttggtgagatcgcgggaatatcgttcagtcctgacactgaagctctttttgttggtgtgcatgatcgcgtattcagctgcctcctccagtttaatcggcgaaggttctactcgtaccttgattcgcctgtgtgagctagtgctggtagacctgtgagatctacccaggctgtagaaacaagaaagttgtgtatatgtttataggttttgctatgaagaaactggagatggtgtgtttacttttgctgaacaagctgtaggtattcagcgagccgtcttttcgaagctttgtactgtcgctgctttgttcgtttggctgataagccatagcagaaagtattgttggctgatttg

SEQ ID NO: 8684 - DNA, 653 bp, Sorghum bicolor
  Clone ID: SORBI-28MAY03-CLUS49861_1
gcacgaggcgacgacgacgacgacgacttcggaggcggggacggctacggcgacgagcctatcccgatcgccgcgccggggacggactatgacgtcgtgatcgatgctctctccccggggtccatcgccaacgtgcaccagatcgccaggaggatggtggacgccggctttggccgcgagtgcgctgaggcctacgccgcggcgcgccgcagctttgtcgacgagagcgttgcgcgccttggcgtccgctcccgcaccgccgaggaggttcatgcctcaccctgggaggagcttgagttcgacatcgcccgctggatcccggccttcaacatggtgttccgcatcctgattcccagtgagcgccgcctatgcgaccgtgttttcgacggcctcgcccccttcggcgatcttgccttcattgccgccgtgcgtacccaggctctgcagctcatatcgttcggtgacgctatctcttcctcaagccgcgcgccggagcgcctcttccgcgtcgttgacatgtacgaggctgtgcgtgacattctccccgaccttgatcctgtgttctctgacccatactctgctgcactccgtgcggaggtctccgcgatgtgcaacacactggggtcctctatcaaaggtatatttaggagtgg

SEQ ID NO: 8685 - DNA, 807 bp, Sorghum bicolor
  Clone ID: SORBI-28MAY03-CLUS49809_1
gcacgaggattccacaggcctgtaagctctgtgaatttggagctctcaggttctgcattgcattgagatggggaggcattcttgctgctacaagcaaaagttgagaaaggggctctggtcccctgaggaggatgagaaactcatgaatcacataacaaagcatggccatggctgctggagttctgttcccaaactcgctgggctccaaagatgcggaaagagttgtaggctgaggtggataaactatctgagcacgaggctcaagagaggggcattctcccaagacgaagaagagctcatcattgagctgcacgctgtcctcggaaacaggtggtctcaaattgcagcacagctgccagggaggactgataatgagatcaagaatctatggaactcgtgcatcaagaagaagctgaggcagaaaggcattgatcccaacacccacaagccccttactgaggctgatcgcagcggagcagctcccaccgtcagcaccgagagaacctcagggtccagcgatgtcaacccatcaagtgctggtgctctggggaacttgagccacctcctcagcgagacggctcaatcatcaatgctgatgcccatgtatgaccagaatcgcactgaaactccgaacttggcacgccctaaggtgccaccaaaagagttgttcctggagcagcttactgctggacacgagagtccatcaacctgccgctcatcaggccagactctctatttccctttccaacagcctttaggctacaacagtgagagtggcagtggcgatggggcgaatatgaattcact

SEQ ID NO: 8686 - DNA, 956 bp, Sorghum bicolor
  Clone ID: SORBI-28MAY03-CLUS49987_1
actggacccccatcctcttcctgcctcaccacctactccctcatccgcggtccggctgcctgtgagctgccctcttgcaccgatccaaggcacaggacaggatgcagtccaagcaccggatcttcgcggaggatctgctcctcgcggcggagggggaggaccacttcgaccgggtgccggactccctggtgctcctcatcttcaacaagctcgccgacgcgcgctccctcgggcgctgctccgcggtgtcgcgccgcttcaacgcgcccgtcccgctcgtggacgacgcctgcctccgcatcgaccgcgtcatccccgccgacgccgccgacggcggcgacgcgctgggcggcctcgcgggcgggccgcgcccgcgcgccgtgctctcgcacctactcaaggccatgctgcaggccgtgctcaagcccttcgcgcactgcgacgccaagtccgcggcgcacaagcacgcgctgctgcagcgcgcgcggcagcagcaccactcgccggcgcaggtgctcaagaacttcagcagcatccgcaacctccgcatggagctccccgtgtccgacgtcggcaccgacgacggcgtcgtcctcaagtggaaggccgtgttcggcagcacgctgcagagctgcgtcatcctcggcggcaccaaggtggaacgggctgccagtggcagtgccaacgcctccgccgctcctcccccagctccccacgccgacgctggcgacgccgcggccgcgggcggccctgacgacagcggcagcatcccggagtccttctacaccaacggcgggctgaagctgcgcgtggtgtggaccatcagctccctcatcgccgcggccaccaggcactacctcctccgcgagatcgtcaaggagcaccccaccctggagcaggtggcgctcacggacgccaacgggcagggcacgctcagcatggggcgcgaccagctc

SEQ ID NO: 8687 - DNA, 888 bp, Sorghum bicolor
  Clone ID: SORBI-28MAY03-CLUS5107_1
cgaaaaactcaagcacgcggcgatgctgcgccttcgcgcttgcggcggcacggcgccggcgtcggtgcccgcgctcgtcagggcccgcctcgccaggcgagcctcctccgcagcctccgccgctgccaccgtcgcctccgcttcctcctcttcgtccgccctggaagagctcgccgccgagcgcagaggtttggcaaaggtcattttaaagaaggggaagacccaaatattccgagatggaagcccaatggtgtacagcggtgctgttgataggataattggtcgacctcctccgaaatctggcgatgttgttctggtagctgatgggacagagaaacctattggatggggcctctacaactctgcgcctgggttttgtgttcggttgatgcagctagaagaagatgcaataagagatcccacatgtgcacttaatatggaaagactgcttgaagcaaggatttcatctgctgttgatttgcggcgcagtttgggtctcccttcagctgacacaaatgcttatcgcctcatcaacagtgaaggggaccgattgtctggtctaatagtggacatctttgctgatgttgctgtcattgcttcatctgctgcttgggttgagaaatataggcaagaaatacaatttcttgttagcaaagttaacggcatcagccatataaagtggaggccatcggcagatattttgaaagaagaaggattggatatatcagagcataaggagcctgcttcaccatgctcaactgttaaggtcatggagaatggcattgtctacttagtctcattagagggtcagaagacagggttttatgcagatcaacgggaaaaccgctctttcatatctttactttcaaaggaccaaagggtccttga

SEQ ID NO: 8688 - DNA, 280 bp, Sorghum bicolor
  Clone ID: SORBI-28MAY03-CLUS5110_1
cgagattgttgggtttgcgagctcagcaacgagaaggtcctctactgcatcctggcctaaggcgtccgcgagtgctcgcgagctcactgacagggaggtcctccactgcatctccaccatcaaggtcaccgtgcccttactgctattactactaagctgtctaattatagcgtgggggggggcccttccccctcccgagcgctgaccccaacactccccctgctcctctcctccctcaactctcacctgagtgatcctacccagtgcactcgctcaccag

SEQ ID NO: 8689 - DNA, 527 bp, Sorghum bicolor
  Clone ID: SORBI-28MAY03-CLUS51135_1
gcacgaggtagtctttcaattagaagtctagattctagaaactaatactgatttgcagtgttatttgttatattttaagtttatggattacacttttttttatgacatggaagtgggaatatccaagtttcaaatcctagctccgccactgcaccccacctgcctttccccttcgtccctttcaactacaatgagatcgggttgttatcttggctatgcgttggggtagctggatctggtgttgctacagtcgggttcattcagtgctcacgcacaccacacgcacaatgagcgtacgggtgcttgcgccaacttgaccactaactgttggttcgccttcagcgaagcacgcatgggagcacacgtggagctcgctagcgccacggatggtaatggcaagcccgtgactgtagatggccgcagcggctcatctagccccatcctgagcctgtttaccccagccactagccatccttgtctcctagaggattgttttagcctccgtgctggcacctatgcctgcgatg

SEQ ID NO: 8690 - DNA, 659 bp, Sorghum bicolor
  Clone ID: SORBI-28MAY03-CLUS51180_1
ctcgtccaatcgtcctccgccgctgtcgcgagccctccgtctctcccctacaccgctcctccctctcgtctccccccttccccccccccccccgcgctccccccgcaccccccgcggcgccccgcggcggggccccccgcggcgcgcctcccccccccccccctccccccccgccgcgcggcggcgccgccgccgccccccgcggcggcgcggcctccgccgtcgtcgccgccctccccgctctcctcccctccgccggcctccctccgctgcgctgctgccgccacctccccactgacggctgccgccgcggcgtcgccgcgcggcctccggtggtagctcctgggctgcgtcccaccgcggcctccctctcctgccctcccggagcccaagcggtcccggtctgcgcgcctagggcccgacgccctgcctcctcaccttcctggccgctcgtccgattgttgatttgaggtctgtcgagtgggacaacgagctgggagttgtgaatttgtgccttaaccaagttgcgtattcaggattgttggtagcagctggtagcctggcaacttctgctaatcttgaacatgaagtgacaagtcgcaaaaaacgagcccaaggacggaggcctgaagccatttccaacaggtatgtctgatcac

SEQ ID NO: 8691 - DNA, 856 bp, Sorghum bicolor
  Clone ID: SORBI-28MAY03-CLUS5130_1
cccacgcgtccgataagatggatgtgaacaagagtggcaagttaacattcgaggaattcaaggccggccttcgtaaactgggaaaccaaatgcctgattcagatcttcagatattgatggatgctgctgatattgataaaaacgggaccctagattatggggaattcgtcactgtggcggtgcatgtgagaaaaataggcaacgatgaacacatcgagaaggccttcacatacttcgaccggaataagagtgggtatatagaaatcgaagagcttagagaggcgctatctgatgaactggatggaaatgatgaagacattatcaatggcatcatccgagatgcggacacagataaggacgggaagataagctacgatgagttcgcggcaatgatgaaggccggcactgactggaggaaggcgtctcggcagtactcgaggcaacggttcagcaacctgagcctgaagctccagaaggatgggtccctcagtgccgagccacgataggcaggtcaccacgccaccagacggagaagtcgagaaggccatatgccgatgtcctgagctgaagcatggtggctactgagtgttcatccgtttgtctgtttgttttgctgtgcgggatttggtcagtcagtcaggttattcgattccacgctccattttacacgtacggtgaatctgtaattcttgggtttgtgattgtaaagatggtggttgtgcccgtacgtattgtagatcgatgcagcagcgtgtacttacgaagaacgctggagtagcagaagtagagtcttgcttgtaacttgtaattgtaagtagaatttgtttgtgtgatgccatgcatgatggttgccggc

SEQ ID NO: 8692 - DNA, 679 bp, Sorghum bicolor
  Clone ID: SORBI-28MAY03-CLUS51494_1
cgaggcgacacccctctcccctgtcctctccctcccctccggcctccccctccctctctccctctcctcccacgcaagagcagtgacagcgcgcgcgcgcgcgccacgagcgggtggaacctcgccgcctcccgcggcagatctcgcgccgagccctggtttcgacgcgagatccgcgcccgccttccgccgcccccccggggtgggtaggcagcgccgccgctcgccgcctccgtcacgaagcattaccaggattacacttccaccttgaagatgatgatgggattactagcgtttgagagccaccaggggctctggaacagcggatactattcacagttgtttggaattggaggagttctgatcactcttaccattcttatgttatccacgggctactttgggggaattggtgctccattttctccatttttctggccatatctaggacaagtgccaaagaagagggaacgcaaaaggcctgtcagagtgtacatggatggatgctttgatctcatgcactacggccatgcaaatgcattgcggcaggctaagttgctgggagatcagcttgtagttggagttgtcagtgatgaggagattgtggcaaataaaggtccacctgtcctttccatggaagagaggttgactcttgttagtggtctgaagtgggttgatg

SEQ ID NO: 8693 - DNA, 1099 bp, Sorghum bicolor
  unsure (1)..(1099): unsure at all n locations
  Clone ID: SORBI-28MAY03-CLUS50373_1
gcacgaggccttactctctggttcaggattcgttgagagctctaagcagcacgtcaggcagctttggacttcagtaaagcagcctaacattttgttgccgacattgtttatatttctttggcaagcaacaccgcactcagattctgctatgtttttcttcatcacaaacaagcttggattcactccagagttcctagggcgtgtgaagcttgtaacctcttttgcatccctgcttggtgttgggctctacaactattttctgaaggaagtttctttaaggaaaatctttctcgcgacaaccattataggttcagctcttgggatgacacaggtgcttcttgtaactgggctaaatcggcagtttgggataagcgatgagtggttttctattggtgattcattaatcatcacagtccttggtcaggcttcatttatgccagtcttggtgttagctgcaaaattgtgccctccaggaatggaagccactttatttgcaactttgatgtccatttctaatgctggaagtgttactggtggtctggttggtgctggtctaactcggatatttggggtcactagggacacctttgggaatctacctctattgattgtcgtctgcaatcttagttcactgctgcccttacctcttttaggtctcctgccagaggaatcaggtgacacagataatggagaaacaaagaataactgacttcctgagggttttatctctgtttgttctgattctcaagtatagcataccacagtgcccagtttcaattcatatatggcccatccagttgaagttcaaaagatcagtagggaaatatgaaaatcatactgggttaccattgtcatcagccagtatctcctgtgactattaacctgtggtcgaagtgattcattggtgatctgaaagtgatctatgatgctatggcgcacatggtactcaccattttttagtttctataagctaccttgttagctaatgcgaccccatgaaaattagagtaggggtcaaagactagtagttgaggattcccttacaaagtcgatatgtattgtaacaaaaataaggggganagtatttatacgttaaggg

SEQ ID NO: 8694 - DNA, 733 bp, Sorghum bicolor
  Clone ID: SORBI-28MAY03-CLUS504_1
agggaccgagccgtcacgcatctccccgccgctccctccctaaccgcacccggaatcccgcgccacgcctttaattcccccccctcgaccgcctcggcaagggaataatttcccacgatcagcgtcgtcgcttatctccgaatctctctctccctctctgcagtccgcaccatgggttccgacttcaaatcgatccccttgatcgatatcagcccgcttgtcgaaaagattgatgatccaagcatggccaacgacagggatttactgcaggttgtccggttgctggacgatgcttgcaaggaggctggattcttctatgtgaatggccatggtatggtcgcgtcgctgatcagggaactcagcgcttgtacccacgattactgatcggagcctgatcaggaacagttggatactgagacttcacccgcggctggataaagagcgcaagcaggctgagttcttctccgtgacagggcgaagcctactcttgatgctgcaaccgctggctatccttctactgccccaggtcagtccgcttccctcgctggaccaatggaaggttctgacgtctccccagagtgcccatcgagggttgcagtgctgaggggagaatattaccaagggcaagcctgatatgcatgaagcaatcgattgctatactcctattagacctggcaaatatggagacctcgctaaaccaatggaaggatctaacttatggccagaataccca

SEQ ID NO: 8695 - DNA, 802 bp, Sorghum bicolor
  Clone ID: SORBI-28MAY03-CLUS50411_1
tggaggacagcattaatctgcagagaactagaagatgagtttgatgcactggtcaaaagctatgatcagaaagaaaagcttgttacacttatacaacaaaaagaaaatgtgggggatctttttaaccagcttcgcctggctctgcagaggcgctctaattcacgtcctgcacagacgcttgctgcaacttgtatggatgaacaggaacttacggaaagtatgcaaaagttgctcattgttatgcaaagattagatgaaaagattgggccaatgctagaagcagatggagaacatttcaataaaagatggggctggttgtcacgtgctggcctatgggataagagtcatctgaccaggcaaattgaaaaatatgctgatatatacacatcaagggtttcaaattttctacactatactccattcatgtatttccaatctcaagaacagacacttgcacatgatgcccattcctattctgggggaaaggccatcaatgttcattgagcgtccgttcaagtcacaatgtggaggttaggcagggaagagagaacgtgatcattgtgattatggctgcgatggctagacagtaacaattgtcacattttgaacaaattaatcaatacatcttgtacgagtgtatggatgtataagcaaatatttaattatagcatgctgaatgattggtccgattggcatctttgtatacataaacaaattcttccaaatggttgtaatatccatgtgagtgcgataagaaattattatcatcttgatatttgccattcaataaatgggccacctt

SEQ ID NO: 8696 - DNA, 929 bp, Sorghum bicolor
  Clone ID: SORBI-28MAY03-CLUS50443_1
tggggaggatggctccaacagaggtgcccaaaaacttgcacgcatccgcgagaacagtaatttcttcaggtcagaactcaagaagatgggttttgaggttcttggtgacaatgactctcctgtcatgcccataatgctctacaatcctgctaagattcctgcattctctagggagtgccttagacgaaaggttgctgttgttaccgtggcatttcctgcgacacctcttcttcttgctagggcacgcatctgcatttccgcttcacacactagggaggacctgatgaaagcccttgatgttatcagcagagttggtgaccttgtgggcatcaagtacttccctgcagaaccaccaaagattgctgaagctgatcatgataagctggagtaggaatgaaccctgaatcgccccatgagtgattgaagctgttagaatcccaaatcattacggaaacaagcacacattgagcagtttcgttgggattttgtcaatacgcaagagtccaggatccgtcgtattagctgactattgtttgttgattgtacaactattcttccaaatgtgtatagccggttgaaattcagttgttctgttgttaatccattcccaatatgtaatataattggaggcaatataaatttttagttgaactttcgtgagtttcccctggcagacgactgacgactatgaaggcctcttgctttcatgtatttttttaccttttgtattcagtctatgttatatgggaccagtagatgtctcttcacactttagatgaagttatgaattattaagctaagttatgaattgatttttgtattcagtgaatgttatctgcggccactggaaatgctcttttttcttgttatgcttctagtggaagttgtacttgtagatgtaggcagttgtgtaagactcatcctcgtgc

SEQ ID NO: 8697 - DNA, 582 bp, Sorghum bicolor
  Clone ID: SORBI-28MAY03-CLUS50556_1
tgacaacgcaatgccagcacttgagattattgagatgaggtatcaaaccttcgaaggtctgtttggagttaacacacttggcaatctcaaaggtgtgcatctcagagaggagaaactgggagaaaaagatgagaaaacaataaacggattcttgttagatgatttgaaatatagcacagaggaactgcaggtagccgttgatcacaccttcatcacttattgaatagtcgaaatgcatttctgccagcgatcgcccccttcgcatggagtggagattggaatcttatatatattattccctgctttctagtttgcaaaataaacagttgtctgtcatcccatggcactgttatttgtcattgatgtttctatgtactgctgtgaagttcggttatgctattacagttacagtgatggtctgtttattgttcagttatggttgctctaataataaagtggaggaccctccatggcacaccatttgtaacccatttgtaattttgttcgatcagttgtaatattactctgtactcttatataaaactcgcaaactaatttattgtggggaatcgttgtttttgt

SEQ ID NO: 8698 - DNA, 671 bp, Sorghum bicolor
  Clone ID: SORBI-28MAY03-CLUS52016_1
ctactgatgaagaggctgcaggaagcaaggcaatcaccaaggatcagatggatgtggacagcgggaatgtagacggtggatttgtagggcctatcccaccagcaccagacactgaaggggataatgatgaggtatcagttcaagataacacttctaacaccgagagtagtgagtgtgcctccacgaatgatggcgctgacaagatcgatcaagccaagttagaaggtcaggataaagcagatgacagtatggctgctgatgctggccctcaggagggcaaggatgaacttgcacctgttggcgccagcataagtgaagaaaacaccactatatctttggatcaagctgtctcaaaggaggatgaaggcagtgctcctgagcgaagtattgtttgatggctaattgaggggtaacagtgtgaaattcatatagtatgcctctcaaaaaggggacaccaattttttttttttctttagccttttgatgcacccccttgttctccaacgtgttttcagtcctagctcaagctgtgtttccttcggagattcgaattttatcttgatgttgatttccagttcaggctgttacaaacctgctatgttcaattttctgtggacaatttcatcttgatgggagaagaaaaaccatgcaaatatctaaagtaacattgt

SEQ ID NO: 8699 - DNA, 709 bp, Sorghum bicolor
  Clone ID: SORBI-28MAY03-CLUS5181_1
caaaaatcatggagtgtacctttcttaggttcatcttacacaacagaatgcgatgagtccttaaagccagcagttggcatgacatttgaggatattgaatcagccatagagttctacgaagcctatgctgcacatattgggtttccggtacgtgttggtcagcacaagcaaagaatggattgctgataaataagtgttttattgctcgagggaagggttccgtaagtctaaagatgagatgcaatccgaacctgtgcacagcgggagaaggaagtgtaaaaaaaatcactcgatgtggctgcctgcaattgttgctatcaaattgacaaaggaaagtgcattgtggtccatttggaagtctcgcaagaagattgtgacatcgccagtagcgctgatctacaagatgctgatgctgagcaagtcttggcgtcctctgttgaagccgaagctgattccaatggcggatgagatgatgaatttgatttcggcgaaagctgcttctgcgatatagtttctgtcttagtagagttctttgtctcgtttagctgcttttgctgaaccttttatagcttttagttgcttttgtcgagcttttagttgtggttgttttgggccctctgttttgtaaactggaatccccagtgccggatcaaggtgttcgttacgctttcttataaagttgggtgaaagcctttgatcaaaagaaaaa

SEQ ID NO: 8700 - DNA, 909 bp, Sorghum bicolor
  Clone ID: SORBI-28MAY03-CLUS52071_1
agcatggaccaattcctccatcaagagttgctgatccaagaccaggacttgctacctctgaaaccggacgctatcagaatttgcatgttccagtggcattaatggagtgtttcctgagcgtcgctgagttaaatactgcaaataatttggaaacctgtggaattctcgctggtactctgaaaaagagaaccttttacgtgacgacattgataattcctaagcagaaatcaacatctgattcatgtcaagctacaaatgaagaagaaatatttgaagttcaggacaaaggctcccttttgtctcttggttggattcatacacatccaacacagacctgcttcctatcttccattgatcttcataatcattacgcatatcagattatgctaccagaagcgattgcaatagttatggctcctacggatacaacaagaaaacatggcatatttcatctcacggagccatgtggcatgggcgtgatccatgattgtgatgcgactggattccaccctcatgaggagcccctagatgggacaccaatctatgagcattgctcccatgtatacatgaacccgaatgtgaagtttgagatgattgacctacgtgaagcatgagaagatataaacgacttttgcagattccaaaaaccacaatgtcttgcacatagctcttctgttccacttctgtctacacaagttgtcttgaaacggcggttttgtttctatgtcggggcaagtgacaattaatcaatttatcatgatatgcaacatggcgtgaaggggtgcttattttttctcggccccttttatctttattttatcttttgtttctgttttgtttttttattatactaggatcatgtctttacaacgggaacaaaataatattacaataatttaagtttgtggt

SEQ ID NO: 8701 - DNA, 829 bp, Sorghum bicolor
  Clone ID: SORBI-28MAY03-CLUS5216_1
gcacgaggccagtagtcatatgcttgtctcaaagattaagccatgcatgtgcaagtatgaactaattcgaactgtgaaactgcgaatggctcattaaatcagttatagtttgtttgatggtacgtgctactcggataaccgtagtaattctagagctaatacgtgcaacaaaccccgacttccgggaggggcgcatttattagataaaaggctgacgcgggctctgctcgctgatccgatgattcatgataacttgacggatcgcacggccctcgtgccggcgacacatcattcaaatttctgccctatcaactttcgatggtaggataggggcctaccatggtggtgacgggtgacggagaattagggttcgattccggagagggagcctgagaaacggctaccacatccaaggactttcccttccccgcatcttcctccatccttccctcagaatcccagatctctctcggccccgtgcccagcgctcccaaacccttgcgccgccgcgggtgccaggccgcgagcgtcgccatgggcatcgtctttacgcggctcttctcgtcggtcttcggcaaccgcgaggctcgcatcctcgtcctcggcctggacaatgccggcaagaccaccatactctataggctgcagatgggagaggtcgtctccacgatcccaacaatcgggttcaacgtggagacggtgcagtacaacaacatcaagttccaagtatgggatctcggcggtcaaacaagcatcaggccatattggcggtgctactttccaaacacccaggctatcatatatgttgttgattcaagtgatacagata

SEQ ID NO: 8702 - DNA, 657 bp, Sorghum bicolor
  Clone ID: SORBI-28MAY03-CLUS52160_1
tgaggcagctgttaagaaaaacaagcagaagttgcttggaaagaaagttagtattgcacgatcagatccaagcaagggtaagaagagccgcgaagcaggtcaagcaagccaggataatttacctcagagtggcggtgatgatgcaaaagcaacaggatccagtggaccagacaatgaagtacctaagggtgatgcaaaaaccacggggaagaatacccgttttgcaccacgagctgtggttaaaactcttgggtggaccaacaaggatgagaagaaaccagatgtcacaggggagttgaagtcaaatgaggagttccgaaatctgttactgaagaagtgatatcaataagcaggtgcgtgaatctccatgcccgatccagctttaatttgccaagacttctggtggcttcatctctgttagaaatttagaaagatggacctgtagtagcatctaaaatcgttctgtcttaacccgatgtagcaatggatatttctttctgccggagagattatataagccatgtcgaattgcagggtggtgaaatatgacgtcgtccgagaaaaaacctgcccatgtaaaaaagaaaacatcgaccttatactatatactgagtttttcaatcgtacgcagtgctggtgaaacatcacagcatctcg

SEQ ID NO: 8703 - DNA, 546 bp, Sorghum bicolor
  Clone ID: SORBI-28MAY03-CLUS50876_1
gcacgaggaaaagattctctcttccttttttctctccatccacccgcttctctctcccttcttgccggggttggtttttggttctctctacttctggcggctgatcgccgctcgcctgcaaccgccgacggagaggaagcatcggaccgccggggcctctcttccgaatcccaatccaagggacggacagctgaagtagctgtggaatatggaagtcgaacaggctgctgaagtaagcgctccagagacggccgatcttaaggcgcctgataagacgctggcacacgatgatgaaaaagaaaatataccgaatggtaatacaaatttgcaagtgaaggaagcacacaatgatgaagacgatggaacaggatctgatgggtttgagctgatagatgtgaaggaaaacttcgattcagcaaaagtggaggaagaaatggccgttccaagaagtactacagtcgatacatctcctgttacagaagaaggtgaagcacaagaagaaaaaacaacagcacatgaagaacaatcagttgcagcaaacacaag

SEQ ID NO: 8704 - DNA, 687 bp, Sorghum bicolor
  Clone ID: SORBI-28MAY03-CLUS50909_1
gcacgaggagaaggctctcgccccccgtccccaatcctcgccgcccccccccccgcaccctcccccgatccccgccgcccgcaggccaaaaccctacgcctctccctcggcgccgggtataggcagtgtaatcactttgtcagaaatgccttctgcatccaagtccaagtcaaaagacagatcagctgcaaaagttgcaaaagagcaacccaaggttgctgcaaaaccaatgggaaatggtacgcttgcaagttcttataacaacctctctggaaagttccatgttctggaaccatcagcctctttgttgggtagccaaggcatcgataaattcaggaatacagatgaaattgatgagcattctcgcagctcccatggtacaggggattttgattgtgcctccaacaatggtagctgctctggtgagtcagaagatccaaaggaaaaaccaaccagtactgcgtctcgggtagactctgttcctggatgtgatattgataaacgcgagaagatcagacagaaaaatgagaagaagcatcaaagacagaaggagaggcgtgcccaagaattgcacgagcgttgcaagggataccttatgtccagaacattggagtcacttgcacagaagcttgttgcgatgggtttctcagcagatcaagcaacaatggcccttatacagaatgaggg

SEQ ID NO: 8705 - DNA, 382 bp, Sorghum bicolor
  Clone ID: SORBI-28MAY03-CLUS5062_2
gttgatgcaagatgtgaccagactggatttgccttctggatagcgagcagtagtgcttgggccggtggttccatggagatgttcgtctgctgctatgtgactaagcatagcctgcaggctatattaaggaaccacagcagggcactagagcacgacactatgacattgcaactaggccacaaaattagtatctattggctaagttaatatttctattaaattggctcgtagttggactatctaggatcatgtgatgcagagcccacagacctacagcatggaaacaggcatggagttggtgctatctaacgtggatgcacatggcggcgtagggcagcagggaagcaccttgcctttcatgtcgattggcattgggtcaatg

SEQ ID NO: 8706 - DNA, 776 bp, Sorghum bicolor
  Clone ID: SORBI-28MAY03-CLUS5062_1
gcggagtagagcgacagcacacccctccggtgcggcatgtgaacctaagcagcggcgcagaccagagctgcagcgccctcccgtccccttccctcgaccccaagccacggcacggtttcgaggcaacggcgcgctccctgggcggcgacgcggcctggcacggccccaagacgctggtgcatgcacccatcaagctcttcgaggggccagtcccctggcggctgtgcatccaggcccggagctgcaactcgtgtccaatctagtgaaggggaggaggaggagtagatctaatgatgatttggtgactccgtctgcctatttccttgatgaagacttcctaagagcagagttaggaaaccgaccattgcagattcaagactggatctgccttctagatagcgagcagcagtgcttgggccggtggttccatggatctgttcgtctgctgctatgtggtatctattggctaagttaatatttctattaaattgcctcgtagttggactatctaggatcatgtgatgcagagcccacagacctacggtatggaaacaggcatggagttagtgttatctaacgtggatgcacatggtgacgtagggcagcagggaagcaccttgcctttcttgtcgattggcattgggtcaatggtgataagtgtagctttactaacatgtacagcacctcctttagtatttgttgatgttccactacacttgtcatcatgtgaatattttaaactaggcaatcatagtgtgtatgctacttataatgtt

SEQ ID NO: 8707 - DNA, 568 bp, Sorghum bicolor
  Clone ID: SORBI-28MAY03-CLUS50911_1
gcacgaggcaagaaactacagattctgataaagaacaagaacaatgcccagaaaacttcctaaccaggtcttttgatcaagcttccaagcagctgagccgaagtgcaaagaaaccattttccacttttcactctacacccaagaaaaaaatgcagggcaatgtgtttaccttcaatgagaaacacacacctaaaacagtggatcgggacaaaatggacaaaaccactgagttgcctggtagtgagtctcctgcagaagaaagagaaaacagtaaacaaccatctcattcacccctttctccaactgaagatgaagagagtaaaagttccgaacaaagttttgcaaaaggttggagtaccacattgtcattctttttttgaaaacaaaggcaggagttctgccgctcaatttaagaaggaaacgaagttttatgtacaacggcggcaccttcagtgcccaatagcaccggtcatagggctaaaacacaaacgccacagatcacacactgtgtttagtacacttaatacaggaaagcatttggctagatcatgttacattccctttgtgt

SEQ ID NO: 8708 - DNA, 744 bp, Sorghum bicolor
  Clone ID: SORBI-28MAY03-CLUS51025_1
gcacgaggggcattctccggccgccgttaaacccgggacgccagcaaagcaaaggtgagctccgaccgaccgaccggcccgaaccgaccgagaaccccagccgccgcagccggcgagagagggagacacaaacgaaaccctagtgaggaagtccctccacgccacagccaagaagggagggggaggcgatggagtacccggcggcggccgccggatcggggggccacaagtactactacccgccgcagcactcgcagccgcaggcgcttcgccgcccgccgcgccccgccgctcggtgggtcaagcaatggatcccgcaggatctcgcgtcctccggcggcaaatgctcgctcttcaagtgggtcagagaggataggtacaggaactccaaggagaaccccagagtgctggatgtagaagcccccaagcctgaacccaccacagagatcctcttcctctgcagctacgacaactgtggcaagacctttgttgatgtcagcgcgctccgcaagcatgctcatgtgcacaacgagaagcagtatatctgcaacgagcccaactgtgggaagaaatttgttgatagctccaagttgaagagacattatcttacccacacaggacaaaaggattttgtctgtccacatccaggctgtggtaaggccttctcattggattttaacttacggtcacacctgaaaacacatgcattggagaattatcacatatgccctttcccagcatgtg

SEQ ID NO: 8709 - DNA, 726 bp, Sorghum bicolor
  Clone ID: SORBI-28MAY03-CLUS5232_1
gcacgagggttcaattctggactctggctgctgaagaagctcaagggtgcacaatgcatccatcaactaactttcagtgatgatcaagacccccagaatacgtatttttataagctttgcaagttgaaaacattggagaacttcaaaaatatcatattgttatcatcaccacaggatggctatgtaccatatcattcagcaagaatcgagctctgcccagctgcatcagcagacacctcaaagaagggtgaagtcttcacagaaatgctcaacaactgcttggatcagatccgtgcgccctcatccgacacccggacattcatgcgctgcgatgtgaatttcgaccagtccaaccaagggcgaagcctgaacaccatgatcggcagagcagcccacatcgagttcctggagactgacctctacgccaagttcatcatgtggtccttccctgacctgttccgatgacagacgacacggcttgtctttgtaatactgccacataccaaaccaatagcgcacactactgagtactgaccaggcaaggaaaactaagcttgcataaagtttcccaccagaatccaacaccgcgacaggcaggtagcactgtaaagatcctagaagcaatgatttttccaggttgctagatcctattctgtataaatagttgattcttttttcacttcattcatagtgctgtagatgtgcacctttgctgtgaatttataa

SEQ ID NO: 8710 - DNA, 1135 bp, Sorghum bicolor
  Clone ID: SORBI-28MAY03-CLUS52342_1
gcacgaggcaccgcagcccggtgtcgctgttccacagccctgccgcctcctctccggcgtccaggagcccgtcggtttcctggctcgccggccgcgagcgcgaccggctcttctccagcttcgtgcgcaacgcgcttggctcctgcattgacttcgcgccggtcaccagcttgccgctgggtgtgcgccccgcggccactggtgtcgacgccgccgagctggccttcgagcttgacgaaagcctctctgaggcggagccgtgctgcgaacctgatgctcgtgaactcctcgcccgcgtccaggctcgccactgcatcttccgcgacgagcttgtcgtcaaggccttcttcgaggcccaccgggcacaccgtggccagaagcgggctagtggtgatccgtacttgcagcattgcgtggagactgcggttcatctggctaatattggtgcaaatgcaaccgttgtgtctgccggccttctccatgacacaattgatgattcgttcatggactatgatcatatcttcaggatgcacgaggctggtgttgccgatcttgttgaaggggtttcgaagttaagccatttgagcaaacttgctcgggacaacaatactgcaagtaggactgttgaagctgatcgcctgcatacaatgtttcttgcaatggctgatgcacgagctgttcttataaagttagcagatcgtctgcacaacatgaagacgatagaagctttgcctttggttaaacaacttaggtttgctaaagagactatggaaatatttgtgccattggccaaccgattaggaattgctagctggaaagaccagttggagaatatttgcttcaaacacttaaacccagaggagcacaaggagctttcttctaaacttgtgatgtcttttgatgaagcacttcttacatctacgcttgataacttggataaaggcctcagagatgaaggcatttcatatcacagtctttctggaaggcacaagagtctgtacagtatatactccaagatgataaagaagaacttaacaatggatgatgtccatgacatccatggtctacggctagtggttgacacagaggaagattgttatcgagcacttgacatagtgcacaagctgtggccccg

SEQ ID NO: 8711 - DNA, 523 bp, Sorghum bicolor
  Clone ID: SORBI-28MAY03-CLUS5240_1
gaagatttcaggctattttgcccctaagaggtaaaattctcaacattgaaagaagggatgaagcagccatgtacaaaaatgaagagatccaaaaccttattcttgcgcttggattaggagtgaagggtgaggattttaagaaggaggctctccggtatcataagatagttatacttactgatgctgatgttgatggcgcacatatccggactctcctccttactttcttcttcagatatcaaagagcattatttgatgaaggttgcatctacgttggtgtacctcctctttataaggttgagcgtggaaaacaagcacattactgctatgatgatgctgatcttaaagagatagttaacaccttccctccaaatgcgtcatatcatatccagaggtttaaaggtttgggtgagatgatgcctgtacaactgtgggaaacaacaatggatcctgagaggcggctgttgaagcagcttaaggttgaagatgctgctgagggccatgttgtgttctcgtcacttat

SEQ ID NO: 8712 - DNA, 719 bp, Sorghum bicolor
  Clone ID: SORBI-28MAY03-CLUS52648_1
acgccggaaccggaaggcagcgagggttttaacccgcgggcgaaagccgccgacgaggagaacggaggctcggcgagctataccgacagccacggagaagccgcgcgcatcgcagcgaagcaaaggagatgcttctcgaggagctgctccggtgccagatccaggagtggtacccggccttccgccgccactccatccccaccgccatcatcccgctccccgccgccttcctccgctacctcgtcggccagccggcctaccccgaccctgacgccgatgccgacgctgacgaggagccgctcccgttcctcctccccgcgataacctccggccgccaggccttcgcgcccatccacgcgcaccaccccgaccccgactccctcctcaactccgacgtcttcttcggctccagcgacgaagacgtcttcgaccccgacgccgaccacccgctccggccagagttcccggagctggaggcggccgtcgacgccgccatcgccgagctaggcggcgccgcgctccccaagctcaactggagcgcgcccaaggatgccaccttcatgtcagccgatggcacgactcggtgctcgtgcttcgccgaggttgccatgctgctccgctcctccgactgtgtggcccacgacctttcctccgctcgacaatcatgccaggatttcgtgcgcccggagggtgctcgacggaatgcccaaaatgttagt

SEQ ID NO: 8713 - DNA, 904 bp, Sorghum bicolor
  Clone ID: SORBI-28MAY03-CLUS52675_1
ctactggaatcgcgtgcaccgcactccgccccgaggcgaagcagcggcgatggcggcggagaagccggctccggtgcgcgtgctctactgcggcgtctgcggcctccccgccgagtactgcgagttcggccccgacttcgagcgctgcaagccctggctgcgcgcgcacgcgcccggcgtctacccggacgacctcgtcgccgcttcctcatccggcggcggcggcgacaaggacgtcgacaaggtcggggagcgcctccagggcgtcgggatctccgacggctccactagcgccgcaggggatgcttctgcttctaagcccgatgaggtgaaacgcctgcctggtggtaagctcaagaaaaaggagaagcaagaggttgtcattgagaagattgtccgcaacaagcgcaaatgtgtgactgtggtgaagggacttgaattgtttggtgtaaagctgagtgatgcttcgaagaagcttgggaagaagtttgcaaccggagcttctgttgttaagggcccaactgagaaggagcaaattgacgtgcaaggggacatatcatatgatattgtggagttcattacagatacatggcctgatgtacctgagtcggccattttcttcattgaagatggaaggaaggttcctgctgcttgatgtcatatggtttataaggcgcaagaccaatggatttacaaatataatacagacataaagtaagggcatggttgttaaggcatgtagcggtcataccagttcgtctcttgttcgaagtcatggactgttgttccagtttttaggcatagttcacaaatggcattttgtttaccaccgtccttctgcttccatgtatgaaatcaaatctatgcaatttcccatttactccaagtgtgatgtctgttgtgc

SEQ ID NO: 8714 - DNA, 742 bp, Sorghum bicolor
  Clone ID: SORBI-28MAY03-CLUS51535_1
ggatgcggctgcatactggtggagcgcaggagctccctgataacagtagtcagcatcgccgattccaccctttatctcctcccgtccgctccgtttttcctctcccgtccaccccgcgtggcgcgtcctcactcccgtgcggcaactgggacactgggtctgggtgcgccggcgccctactccattcgcctgcggcccaggcgttcgtcgcgtccttcgccggcgacgagcacccagccacccaccaggttgtctatatttccttccccttttgaaaatggatcatagttctgacgaagattcagaaataagtgattctgagattgatgattatgaaggaaaagtttatgcaagtctgatgtctggaggtttaaaggtaaagaataacggagaaaattacagttgtctcttctgtagtagcaagaagaagaataattacagtaaaagtagtctagttcagcatgcctcaggagtaagtgcagcgcctaatcggaaggcaaaagaaaaagcagcccatcgtgccctcttcaagtatttgaagaatgatcttgctaaatcatctgaaccacagccacttgtaattcctgtggagccacaacctcttcagaacagagatgagaagtttgtgtggccctggatgggcatcctagttaatgtgcctactgaatggaaggatgggcgccaaattggagaaagtggaaatcgtttgaaggagcaactatcacacttttgcccactgaag

SEQ ID NO: 8715 - DNA, 849 bp, Sorghum bicolor
  Clone ID: SORBI-28MAY03-CLUS51573_1
gcacgaggcattagcgttgccgcctgactcccctcatagagcagtggatccacaatacaaaggcatcaagcgtttcctgcttacactgttactgttctacagtaagcaaagcaagtccatcagaggagcaaatgttgtttatgatcgaatcacttctcaagttgatgcacctgcaatttatgatgaagggaaggatggtgttaagttcggacagtacatctatgaaatgtacaaccacgatgtagagctcagagtttcaaaagctggggttaacttgctcttgataaaatggatgaaggagctagagaaaatattctatggaaacattgtgaagtatgatgctgcgataagcccagaggctcgtcaagatgatcttgtaactgtcatctgccctctcgtgtaccctcgccaagtcagctgccgccgccgcgacggctacgtcgccccgccctggcgcctccccgcccgctgggctgaggcccgagatcagactgaattctatgttcttatccaagccctgtccattagcgttgccgcctgactcccctcatagagcagtggatccacaatacaaaggcatcaagcgtttcctgcttacactgttactgttctacagtaagcaaagcaagtccatcagaggagcaaatgttgtttatgatcgaatcacttctcaagttgatgcacctgcaatttatgatgtttttcagttggagaaaacatttaagacaacattttcattgcttgttcttcatatgtggcttgttctacgccgcttgaaggaagaagggaaggatggtgttaagttcggacagtacatctatgagatgtacaaccacgatgtagagctca

SEQ ID NO: 8716 - DNA, 857 bp, Sorghum bicolor
  Clone ID: SORBI-28MAY03-CLUS51712_1
gcacgaggaggtagagcaacaaaagccaaaggttcctgtcttggaggaacatctagttggccagctgagcaaggaggaacaagatacactgggtgcaaagtttaaggaagcttcagaggctgataagaaagtccaagagttggagaaggagatccttgattctagagagaagaccgagttttatcgcacgaagatgcaggaactcattctctacaaaagtaggtgtgagaacaggtttaatgaagtctcagaaagtatgtctgctgataaacgtgaggtccaatccctttctgcaaaatatgatgatagatgcaagaaggttggagagctcgcggcaaagctaacaatggatgaggctactttccgtgagatccaggagaagaagttggaaatttataacgctatagttaagctgcaaaaaggggatgaaagtgatgagaagcttcaggagcgggctaataagatacagtcagatcttgaggagcttgtgaaatctttgaatgagcaatgcaagagatatgggttgagagctaagccaactactttagtggagcttccttttggttggcaacctggaattcaagagacagcttatgcatgggatgaagaatgggataaatttggagatgaaggattctctataattaaagaactaacagttgaagtcgagcctcccattgcaccaaagagtcagcctactgaagatgctaaagcatctacaaatggggcattagcagaaaaagaagacaacaagggtgataaatctgctgctgctgcagagcaggcagtcgaacctgaaacaacaccatcgaatatcaaaccagagtcagcaaaaagtcctccagttagtcctgtca

SEQ ID NO: 8717 - DNA, 485 bp, Sorghum bicolor
  Clone ID: SORBI-28MAY03-CLUS51733_1
acctcattcctccccctgacggactcctcctcctcctctctctcctttcctcacgcacacccccgctgacggtcgtcagttctcgcaacggccgcagcagaccacgccccgctgctccttcttcttcttcctcctcctcctcctcctcatccaagcagagagggaaagccagaggcagagggacgagcgagggtcccggcggcgatggagcagtacgaggtggtggagcagatcggccggggcgcctacggctccgcctacctcgtcctccacaaggccgagcgcaagaggtacgtgatgaagaagatccgcctctccaagcagaacgacaagttccagcggaccgcctaccaggagatgtccctgatggcaagcctcagcaacccgtacatcgtcgagtacaaggacggatgggtggacgaggggacctccgtctgcattgtcactagctactgcgaaggaggggacatggcccagaggatcaa

SEQ ID NO: 8718 - DNA, 751 bp, Sorghum bicolor
  Clone ID: SORBI-28MAY03-CLUS52030_1
ttgcagctgataggatccttttgttggattcttattttactgttgtcatattccatgggataacgattgcacagtggcgaaaggctggttaccaatatcaagaaggccatgagtcatttgcccagttgttgcaagctccacaggaggaagctgatgcaataatcaaggagcgctttcctgtgcctcgattggtcgtgtgcgatcaatatggttctcaggctcgatttttgctggcaaagcttaatccatcggtctcgtatgacaatcctccagcaccaggaggggatgtcatattcacagatgatgtgagcttccaggtcttcatggatcatctccagcgcttggccgttaattagattattatatgatgattacattatgcactgcaattttgcacagcgtgggagtaattttatcgtgtagccaattgttgctctgcatctgtacatcgtcttggtcactgacagatttctgatccaagagcaactattatataccatgtaaatagggtgtcgtttctcgttgctaaaatacgaaaatttcaaagcaaggccggcttgttcagtccatagtgagtgcgattgacctacaatgacaaaaatgcaggcttggcttgtccgttctaaactattgtaacttgtaacggctggttactcttgttctagagtaaccgagtcaattgtagcgagcgtcggagtttcacatctccgttatttttatagtgcaaatctgagcctagcgaatccagatc

SEQ ID NO: 8719 - DNA, 595 bp, Sorghum bicolor
  Clone ID: SORBI-28MAY03-CLUS53056_1
agcacaggttgtgaaggaaacaattgacccaatggcaaccattgaattcaaacccaatacagctgatgatccccatatgagaaagccagatatcaccaaggctaagcaactgctacattgggagccaaaggtctctctcaaagaaggccttccgctaatggtaaatgacttccgtcaaaggatctcggatgagtaatcaaagcaatcctacaatactggtgactattttgagtctgaacgatgctgcaaatacagtcagaagctcttcaccgattggagccatgcagtacaatgtactgtgtacacaatagactgtagaatcacacaggccccatttggaatgtggggattccatagtatttctacgggatagtacaatttctgtgaaatagctgataagttcatgggaagttcgtattaattttttttgtatcttggtgagtcagaacagaagcagtcaaattattttttgtgcatgtgtgggattccagatttgtgggtggtgagagataggatacaatgctgtatttcaggagcttttgtaacacggaacattcatcatgtgaaaaatgtaattgaatagtttgccagcccc

SEQ ID NO: 8720 - DNA, 614 bp, Sorghum bicolor
  Clone ID: SORBI-28MAY03-CLUS53348_1
gcacgagggtgcggttcacgctctgcgccgacgcggccgccgagggcgtgggcttggcgagcttcgaccggtgcggggccgcgcgcgtggagggcgcgcgggaggtgtccgtgtcccggtgccgcgccgccgaggtggagcgcgcggggagggtcaccctggaccggtgccgcgacgcgcgcctgcggggcgggggcgcgctccgcgccgcgcggtgccgccgcgccgacgtcgagagcttcggcggggtgcgcctcgcgcggtgcagggccgcgcgcgccgactggtgcggcaccgtcgaggtcgagctgtgcagggccgtcgacgtcacccgctgcggcgccgtcaccggggagcgctgccgcgtcgtcaacgccgccgggtgcggcagcgtcgacgtggcgcgcgccgtgatcaacttggtggaggaggagcagccgttgtcagcctctcctgtactgtaatcgcggagctgctcaagtaggagtggagtactactgtatcttcttcttctgttgtaaactgaacaacaatgcttttataaaattgtttttcaaaataggctctgtggtccgcgatttaatgattgattgagttcattctcgagtctcgcc

SEQ ID NO: 8721 - DNA, 645 bp, Sorghum bicolor
  Clone ID: SORBI-28MAY03-CLUS53104_1
aaccacaggactattcactctggaacaagcttggtgcaacccaagcaaacagcatccagagtgctgatgcaatattggcgtatcagcaggctctagacttgaaacccaactatgtgcgtgcatgggcgaatatgggaatcagctatgccaaccagggtttgtatgaggattccattcggtactatgtaagggcagttgcaatgaacccaaaagctgacaatgcctggcagtacttgaggatttctcttagcaatgcttcgcgagctgacatgattgctgcatgcgacgcccgcaaccttgacgctcttcagaaagagtttcctctgtgagtcctccctcaaagacattagctatccagcagagatcttcatccatggaaggaagcagcacactagcaagccacgtgataatggtaccattggctgcactcaggatcatggacatggacgtggaaaccagtagcatcttgtatttgcctgttgattcttctatttattttacaaagtgtggggatgtatagggagtagggaaacaacatccagttgatgtgaagtatcatggcgtgaggctatagtggcaaagggggattatacatctgtaagtacacacttacggaaggcacaacaggaataaaagaatggggtg

SEQ ID NO: 8722 - DNA, 1253 bp, Sorghum bicolor
  Clone ID: SORBI-28MAY03-CLUS53391_1
gcacgagggggatattgcattgccaagaatgagaggctcttggtgtataagtacatgccaaagggctcgctttatgataatttacaccaacaaaacagtgataaaaaggcattagaatggccattgaggctaaaaattgccattgggagtgctagaggattggcatggcttcatcacagttgcaaccctcgcattcttcataggaacattagttccaagtgcatattgcttgacgatgactatgaacctaagatttctgattttggtctggcaaggcttatgaatcccattgacacccacctgagcacatttgtaaatggtgagtttggtgacttgggttatgtagctccagagtatacccgcactcttgtggccactccaaaaggggatgtctatagctttggggttgtcttacttgaacttgttactcgcgaagagcccacacatgtgtcaaatgcgccagagaacttcaaagggagtttggtggattggataacttacctgtcaaacaactctatacttcaggatgcgattgacaagtctttgattgggaagggcaacgatgctgagctgcttcaatgcatgaaggttgcctgctcttgtgtgctttcttctccaaaggaaaggcctacaatgtttgaagtttaccagctgctgagagctgttggagagaaatatcatttcagtgcagctgatgatgaactgacaatgcaacctcaaaatgccaatcctgaagatgagcttattgtagcaaactagttgaacctatgtgatgagtaggtgcttgtcagataccaaatattgccgcagctgttttaacttggaataatcaggtcaactagaatcattctctatcttttatcaggcaagcagtaggatttgtccttctgttgtaaggtctatcaatatgtggtgtttacatttgtacatccttgccgtgctcctcaggattgtcttctccttgttgtaagatggatcagctgtattgtcaaccaaattttagctgtagtgatagcaatgtgaaacaatgttggcccatcagtcatgcatcttcagcattgtggtgctttcgtttagcatttctgtatactcctttccaaatcgaaatgttagaccagtctggactagttttcagtagtgagagttttatgtcgtagttcgaaaaagtctgggacatgctggtaggcacctggcagggccggtgtttttgtatatgcacgatgtggtacttacatattatgttacatgattta

SEQ ID NO: 8723 - DNA, 1148 bp, Sorghum bicolor
  Clone ID: SORBI-28MAY03-CLUS53744_1
gcacgaggcacggcccacctcaccacaattcccccgccggctccgcgaaacttttgcatccccaccaccaccaccgcacctctccttcaccccgacgaacacggcacgacgagctagccccgcacccccacccagatttagcctatctctcccaccgctgtggcattcctcttcccccaccccatccgtaggcgctccggtcgtcccgccgcctcctggccctgcgttttgatttcttcgtttgtgcttgcttgcataaactattttttaaataaatgaaggcaaatatgggcacaaaacctcgtccaccatctgctgatgtagaaaaaggagagattggcgaaatagatacaagggctccttttgaatctgtcaaagctgcagtgagtttatttggtgaagtccggttttcatctgacaaatcagctgcaagaaagcccaaggctccacaagcagagagggttttagcgaaggagacagagctgcacttggcccagaaagagttgaataaatacaaggaacaactgagtaatgccgagacaacgagagtacaggctctctctgagctagagaaagctaaaaaaactgttgaggagctaactaccaagctagatgtgattaacaagtcgaaacagttggccattcaggcaacagaggatgcaaagactcgaaccaagcagcttgaaggtggcagcacaaatgaaggtctaggaacagatggtcctctgaagcaggaactggaaagtgcaagggagcagtatgctgtcgctttggcagaccttgatgcagcaaaacaggagcttagaaagctcaagaaggattttgaaacatctttggatatgaggttgtctgctgcccagcaggaagaggaatcactgcatacaactgaagccaacaaagaaaaagctaaccaacttcgtagtgagatcgctgaaattcaagaatcgcttatgcatgttaaggcagctacggtgcaagcacacgaagaagaggcacaaatccttgctgagaaggatgtcgctaggaccacatataaacaagctttggaagaaacacagaagaaattgtcgtctttgaggagtgattttgatcctgctgcttatgatagtctgaaagaaaaactagaacaaaccaattctgagattgca

SEQ ID NO: 8724 - DNA, 920 bp, Sorghum bicolor
  Clone ID: SORBI-28MAY03-CLUS53805_1
ccccgcggccgggtcctcttcccaggtcctgggtcgtccgccccggtcccccgcgcgcgtgccgtctgcggcctctccgaccccgcgctcgagctgccctccggcgccccgctcttctccgtcgcggggcgcttcccctcggcgcgcggttcccctgtccgggccgcgctgcgccggtctcgtctcgccctgccctcgctctctggtgcctccccgcgctgccccgggagctgcgctcccgcccccggcggttcggcctcctgtgcgcgttgggtggggtgctgggagcacatgaatgagcagcacagtgcagtagtagtcaatcccttccttctttctttggtgcgtgttcatcgatttacttgttgtgttgttttggtcctgtgcaactaagagcagctagcgccccttcctgtgccacgaccaatgttgtctttgagctctaattttgattggtcttgcacttgtccagatgcttccattcagtgcgctgggagcagcactcacatcaccgagggtatgaacagcagttcgcgttagttggatttttgggagcatcaggtttttgctaattacattttcaatcggcaacctagctggtctttctgttgccgcagggtgcaggtttgcaatgtgttcgatttagagcagcaagtggacatggattcagttcttgtgcaatataagcaacctgatgtaaactcagcagtttgggcagttttagttcttctctaaatgaacgaattttcagggaatttttcagtctatttttcacagctttgattttctattttgcgcgtagcctgtttttgtctttttgatagattggaatggacgtcatagccacatgccatctattgatttgagactctgggtgtagataagttgaatcatttctttttttcatgatatatttcagt

SEQ ID NO: 8725 - DNA, 633 bp, Sorghum bicolor
  Clone ID: SORBI-28MAY03-CLUS61812_1
ggtgacaaagagggagaaattgccgaggttggtgcagaaacaaacatatttgaaggaaatgtaacaacaagagaaaatgaagaaatatcacatccgcgggataacccacatagcagcccgctgcaaacacaactcgcaggtgctacagggataactactggtcgtactagcagcacgctggaaacacaacttgcatctacaacacctgcaactactgctaatactcgcacaactaggagtgctgtgaataagtcaaaaacagcccaaaacaaaggagggaatctagcagtttcttatactactacaaaagcattgaaggatgatgcagctaagaaacgagcatttggaaaaaggaaagaacaagcaggcaatgtgtaggagcaagatggagtttgaatggagcgcacgattgatgggatgatcaacatcaaggcaaccataccattgctgcagtgctccatagctcattacattttgatgtgatcaaactagatagtgatttgtgttggatacattatgtgttttatgtgtgcatgtgttatctactaagtttgacattggatggtttggtttcattaattatttgtatgaacagaccaggtttaatggatatctaaatatttcctacatctt

SEQ ID NO: 8726 - DNA, 653 bp, Sorghum bicolor
  Clone ID: SORBI-28MAY03-CLUS61837_1
tcggttctgcaatgcgatatggtaacagttcatcatgtggtacctaccaatatgaacagaggacagctaaaaacccagcaattggtgctactggtgtttcacctaggggctcatactctagaacaattcctacctgcaagagcgaaacaagcgaggctgacaggattgatgcaagtcaaactagacagcccaagccatacatcccaaacaaactacctactacagtagatggccggaatggtcattggtaggtttacctgcaatctaccagcaaacttaacaaaaatatctgcagatctctgagacatcctgacgcagttaaagatgacattctgtacagagtgaacatttttcagggacacagtcagagctgaactgtaatagaagcaggcttgatgggctgcttggttccacgtagatttggccttcgctagctgattgatgattcagattaatcatgtacggtgtatagtaaaaatattgtggtaggcagcaagaggctgctagcctgctactgacgtagaaactatacacgctgtctgatcgtttttgtaactatacacgtagaaactatatactgtttcttgtagctgtccattcaaatgtagcaacaatcagctatttagttttacaatggaatcttagaagacgtc

SEQ ID NO: 8727 - DNA, 1331 bp, Sorghum bicolor
  Clone ID: SORBI-28MAY03-CLUS61894_1
cctactggatcttctctttgcatatgcacccagagggcgaaattggttaccaaaaaccaaacactttccagcatattatacatgcaaagggcgaattggttaccagttaccaacactttccagcatatgcacgcaaaggacgaaattgattaccaaatcaaacagtttccagtcccagcggtaggaacagaccgtcaccagccaaaggataatccattccctcacacaggcacaaacgctgaacctgctctccgcagtctaggagatggcgttgatcacgaatctctctgactatgaggagcttgcgaggcagaagctgcctaagatggtttatgacttctatgccgggggtgcagaagaccagtggacgctcaaggagaataaggaggcattctccaagattttgtttcgaccacgggtgctgattgatgtgtctcgtattgacatgtctacgagtatactgggttacaaaatttccatgcctattatggtggctcccactgctttgcacaaactggcccaccgagaaggagaggttgcttctgcccaggcaacagctgctgcaggaactataatgacattgtcttcatggtcatcttgcagcattgaggaagttaactcaagtgcaccagggctccgtttcttccaactttcagtattcaaggacagggatattgtgcaacaacttgtcagaagggctgaaaatgctggctataaggcaattgctgtcacagtcgtgccgccacggctttgtctaaccacgggggccgccagctagactatcttcctgcaaccatcagctgcctggaagaggttgtaagagaagcaaagggtcgtgtgcctgtgttccttgacagcggcatccgccgtggcactgacgtgttcaaggccttggcactgggagcctcaggagtatttattggaaggcctgtactgttcgcccttgctgtagacggcaaggcaggggtgaggaatgcactgcaaatgctgagggatgagctcgagatcaccatggcgctgagcggttgcacgtcgctgaaagatatcacccgcgatcatgttatcactgagagcgacatgatccgtcgctctcggatgtagaggctttgattcgtttgctgttgtgcagcactgaaagtctgttgccctggcatgactgtcttggcccatcggattggtttttacctcttggcccatgcgctactaggttcatttgggctttttctcacttctctgcatctaccattcagactattgacccatcaagccttgagggcttacaatttcaaaggctgacccaaatgaagacatgccggtcactctatgacttc

SEQ ID NO: 8728 - DNA, 862 bp, Sorghum bicolor
  Clone ID: SORBI-28MAY03-CLUS6191_1
gcacgaggagccgccggcctcccgctcactcccgcacaggcgccgccgctccctcctgcacccgctcactctcgcaccccgcacccgcacaggcaccgccgtacctgcggccctccgccctctctgtctgcgatgactgggtggactaccgccgccgccctaccccaggtggtgaggcctttgcctacctcttcgccggcgatgagcgcccaccaggttcaaactgtaaatggtggagatgaaatatataatgaagaccaacgggcaatatacaagttattatctgaaagaatcaaatctgaaaatgtccctgaaaataaggatggatcagatgacgatgatgatgacgatgatgaagatgaggatgaagagggtggtgatgacgacgatgatgctgaagaggatttctccggagaagaagatgggggtgacgacgatgatgaagatgatgatcctgaggctaatggtgaaggagggagtgatgacgacgatgatgatgaggatggtgatgatgatggcgatgatgacgatgaggatgacgatgaggatgacgatgaggaggatgacgaagatgaggaagaccagcccccttccaagaagaagaagtgatttgctcttccatggattcacctcagcttctccatgctgttagttgggttgtttagatcatggaacagctttgggaccaatgtagcttgttgcttgtcgtggtatcgtagtttaggaaaatttgacctctgatgaatcattatcttgttttcttcactgtgcatgtagtcttaaattgtgtgttctcgatttttactttggaactgtgattgcattcaattttattcagaaaaacaaagggccctagggccgc

SEQ ID NO: 8729 - DNA, 1133 bp, Sorghum bicolor
  Clone ID: SORBI-28MAY03-CLUS54204_1
gcacgaggtgcatattgtagaagaggaaacctttattcagcgtatggttggtttcgaaagatgctggaggaaggagttgaacctaatgaaataacatataatgtcctcatacatgcattatgcaggacgggcagaactcaactggcttatcgtcattttcatgagatgctagaaaggggattggtgccaaacaaatacacatatactttgttgatagatgggaactgtaaagagggaaactgggaagatgcgatgagattctattttgaaatgcatcagaatggtattcatccagattatttaacacataaggccttgttcaagggatttgacgaaggtcacatgaaccatgcaattgagtacttggagaatgctgttttgggtgaatagattgattgatctcaagcttgtccttttgtcctcgcttcgctgatatcttcctgccagaggtgatagatggattcacgggccattcatttcaaaatggaaagaaaaaagagagtttgaaacaacattctctgagttaagcacttaagctgctgggtgctttctaaacgaatagttaagcacaaacatgccttcctcttgctgctcagagatgatagatggagtttgggggcaattccatccaaaagaagaaaagcaagactttgggaccatgttctcttagttaatcagctgggtgcttcacaaatgaatagttgatcacaaatccgtcttttccttgctgcttaaaccttggcagaattctttccttggtatcatagttatggagacacgttttctagtgaaaactgggtggtaggcatctgctctgtttctgaagacctctcttgatacaattctgtcccctttgttatttccttttgataaggtatactggaaacctgttggccttcaattccttacccaactagctgaaatagtaaatggccgtgggccttttcgactgagctttcttcaattatatataggatttctcttggtaagaatataccaagaatttttttgtaacgaataattcttgtatcaccatcaattttgccataggcacaagtcatagtatattgacctgtcagatatgtaactgtattctcattcattgaatcattaaatgagaagattattcattt

SEQ ID NO: 8730 - DNA, 1100 bp, Sorghum bicolor
  unsure (1)..(1100): unsure at all n locations
  Clone ID: SORBI-28MAY03-CLUS54256_1
gcacgaggctacgggaaaggccagctgagcgggttcctcgccgatccagatggtgttcttgatgtggtaccggcggacatggtggtgaacgcgacgctggcgtcgatggcgaagcacggcggcgcggcggggcccgggatgcacgtgtaccacgtgtcgtcgtcgacggtgaacccgctggtgttcggcgacctgagccggttcctgttccaccacttcacgcggtgcccctacagcgacgcggcggggcagcccatcctggtgccgcccatgcgcctgttcgacaccatggagcagttcgccagctacgtggagacggacgcgctgctgcggagcgtccgggcgtcgtcgtcctcgtcgccggcggtggcgcagcgtgcccgcgacctgtgcgccaggtccgtggagcagaccgtccacctgggcagcatctaccagccctacaccttctacggcggccgcttcgacaacggcaacacggaggcgctgttcgcggccatgtcgccggcggagagggcgcggttccacttcgacgtccggagcgtcgactggagggactacatcaccaacgtccacatcccgggcctccgcaagcacgtcatgaagggcaggggcgtcgccgccaaccagctgctcgccagcacctccgtgtgaccgtcggccggccggccggccggcaaagggatgcgcgacggcgggctatctgccaggcccagactgttgctgttgctatatgacatgccactgccacaacacggccgatgaccgacgacgcccaatcttgcctctccatttccacagtacgtagcagcaatctaaggttgacttgggtacgccatgcttgcatcgcattactgatagatatacgagattgttcatgtctcctccgtcttgagctgttgattcttgtactctcgtgtagtcaaaacaaaaaatgaaggctgtgattatcagtgaccgaaattcatcaaggttgcactcatgcacatatcactcacacaaaacactagcaatctgaacatggtgctgtctgctagtgccattcttaacactgtaagccattctttaccanaaatttaatttactgatgagaaggtgtt

SEQ ID NO: 8731 - DNA, 640 bp, Sorghum bicolor
  Clone ID: SORBI-28MAY03-CLUS54258_1
ctgccatagtctgatctccttgacctgttgggtttgggaacttcatgatcagcaaagatgtcgtgaccactgagctccttggatttcgcactggacacctgccgcttcatcttactgtccccctcgctctcaacggtatggctaagctcacgctgcctcgccaccccagcaactgaagttggcttcctgggaggaatggtcccgtcctgagaaaaggtgatctggctagcctgacgatcgcgggaggcagttgcgacggcggcggcggcactctcggccttgaatatgccgatccctgctgtctccttcgacttgggcgcggagcccgtcgccctcatcttggtcttgttgtggccgccggcgccctcctcggtgacctgccccccaaacaccaccttcctgaactcctccgtcggctggttaggccggcgtgctggcagcgagccggcgccatcggggtgaggccacgcgagcaggccggccgtcgaggtgtgggaactcctcacgggggccgccctctccatctccctgcctgcccctctcgatctctccggggcccaggaagggagggagggattggagatcaaggcgaatgaatgcgtcgtccacggaggctcgactcatgagaaggtgaggaagt

SEQ ID NO: 8732 - DNA, 675 bp, Sorghum bicolor
  Clone ID: SORBI-28MAY03-CLUS54316_1
cccgggctgcaggaattcggcccctagctggttcccacgcacacacccccctccatctccccaacgccgccactctccttcctgtctccccactcgagcagggcagatcacaattccattccactcgagctcgagcagtgccgccagctcctctcgtctcctagccaagcttgccatctcggcggtcggatctcgagcttgtgcactcaagaagccctatcatctccagccaagtagccatggtccgtcaccagccagcaaccaccatcgtcattcgttcgagatctagccgccatcgacagttttggcgtggccaccgccgcagctccgagatccgaccgtcgggagttcgggcatggccaccaccatggctctgagatctggccacatctgcttcatgggcgttcgtgtaggcgctgctcgatgcgtcggtaagttgcagcggaggtcgcggcgtgatggtgcattgcaggtggacattgacgccgaggtggaggtcgcggtcgcgggacagcccaagaagaggacgttccgcaaggacagctaccgcagtgtggacctcaacgtgctcctcgacatgtccaccaatgacctctccagctcttatccgtccgtgcctgccgaaggtaggcgtttgctgcagcagaaaatggtgttgttggtgacagaattccg

SEQ ID NO: 8733 - DNA, 643 bp, Sorghum bicolor
  Clone ID: SORBI-28MAY03-CLUS54456_1
acccataccaatttttcgtatttaataagcaaaacacacatatagctcggggtacatatatccattgtacacacaagaaaacggcagcacacgccatccattgtacacaacaaaacggcaccaaacgccatagggatagggttgttccatcaggggttgttccatcgggcatgccacaaccaacacagaccaaaccacgccagaagtgaaccagatcatctcaaagactggagatgggactcatcgcctgatcacgaaaacaaggacgcagactgacggaccaaccacccgtgcggcggcataggacaataagatccatatgcacgctagcccagcaagatgctgctgtcgccgccaggaggctgccgggttcgacggcctgcatgatctccggttgttgaggccttcccgtctgcaaaaatgctgctaccgctcattcctttcggcttcgcgcggttcagagcctgtttctctgcaggcactgaatctctcccggagatggtcttgccattcagatcagtagacttgttgctggaccctttcttctttgctgttttcactgcgctgtctgtgtcggcctctccaaacgagaaggagctcacatttgcatttttcacaggtgacagcgtggcggagctgccat

SEQ ID NO: 8734 - DNA, 1315 bp, Sorghum bicolor
  Clone ID: SORBI-28MAY03-CLUS5428_1
aactctatctctttcccattttttccttaggaattatgttcaacaacaacgattcttgaattcgcgatctgtggcattgctctaaagtttcttgcttctatcttactgcagacagtgaagagccacaagaaactgccaaacaacataatagattgggaccagcaagcctcgcattgcattacgctaatatcatcaatcatattgacaatattgtttctcgatcatgtgcaatgcctccaaacgcaagggatacgttatatcatagtttaccacctaccatcaaatctgctctccgttctaagctacaatcttttgaaatcaaggaagagcttacagcttctcggatcaaagcagaaatggagaagattttgcgatggcttgtcccttttgctagtaacacgaataagtaatttaatctcacctaatcacctatgatctgatgatttacagccacaatgattattcatattgtacttcaaatgtaattacttgttcataccagggcacaccacgggttcggttgggttggagagtgggcaaatacaggatctgaattaaactgcaagctatcagggcatatggacatgtcccgaatcgagacactgtatcatgctgacaaggagaagactgaagcacttatcctggagctggtcgtgtggcttcatcatcttatcagtaaatcaagaaacgctagtggaggtgtaaggtctcccatcaaatctccagtcagctcaccaacacaaaagggtgctgcaatcaaactgttgccaggcaaaatgaacaattcaccaccggttctcacccaagaggatcaggatatgctcagggatgttaagtacaggaaatttgtccctggaataagcaaaagtcaagagtttgacacaaagtcaagtcacagcaaacagagtaggttgagcaagagcaacagccactctccagccagtggcaacaggaaagaattgctcccagttaggaggccttccatgcttccagttattgacttcgagattgacaggaccaaagctttagatctaattgacaggcttgacatcctaaaaatacaatgagcattgaacctaactggaaaagaaacctgaaatttatgtggtcatccgcagtcttgaaaccccagccgcgatgtaaacaattatcgtgtatcagcagcaaggccgcccgttagactctgtggtgagaagctaacagtatgagaagctggtatcgcatatccttgtaccgaatagagtaggaaaaaaatgttgtaaaaattacctgttgtttctacctgtacaagaaatggaaagtgcaagttttgata

SEQ ID NO: 8735 - DNA, 319 bp, Sorghum bicolor
  Clone ID: LIB3476-006-Q6-K1-A4
gcttacagcttctcggatcaaagcagaaatggagaagattttgcgatggcttgtcccttttgctagtaacacaaataaggcacaccacggcttcggttgggttggagagtgggcaaatacaggatctgaattaaactgcaagctatcagggcatatggacatgtcccgaatcgagacactgtatcatgctgacaaggagaagactgaagcacttatcctggagctggtcgtatggcttcatcatcttatcagtaaatcaagaaacgctagtggaggtgtaaggtcccccatcaaatctccagtcagctcaccaacacaa

SEQ ID NO: 8736 - DNA, 739 bp, Sorghum bicolor
  Clone ID: SORBI-28MAY03-CLUS52775_1
gagagaacagcaatttcttccgctcggagcttcagaaaatgggttatgaggttcttggagataatgactcacccgtcatgcctatcatgctttacaatcctgctaaaattcctgcattctcaagggagtgcctgaggcaaaatgttgctgttgttactgttgcatttcctgccacaccacttctacttgcgagagctaggatatgtatctcagcttcccactccagagaagatctcataaaaggattggaggttatcagcaaagttggtgaccttgtgggtatcaaatacttcccggttgagcaagagaagaccacggctgttgaaaaactgaagaagattcaatgaacaatggcaagaactctgatgctgttgtgctaggttggcagggtcatcttggtgtacattgtatgcctcagtttggcctttctgtgcacctctgggccctttttttcttgtcctttgtttctggagaaaattattttttgtacagtatgtatcatccaccatagttcaaaatataacaggcagataggcattgtcatcgaattcagaaaagcaattttcccagttacctctttaaaccatatagactatatgactgaaaccatgtagatatttgcagtattattatctatcattctggttgttttgaattggtacgtagatgagtccagtctttgaagaccatgtaacaaatctggagtacagaaatataaaaggcagcagagttgagtctg

SEQ ID NO: 8737 - DNA, 688 bp, Sorghum bicolor
  Clone ID: SORBI-28MAY03-CLUS52804_1
ctgggagcgggtgctgctgctcctggcttccaaggctacacaggcttcaaccacccgtcctatgctgctgccggctatggaggtcttcagcaacagcatctccagcagcagcagagcaacaacctcatggcgagcatgcaggggtaccatcatcatcctgcagcgacggccgcgatgatgaacaatttgaggggtctgaatagcaacatgatgatgatgcatcagccccagcagcagccgcagatgatgtaccactcctctccccagatcagcccttacactggctactacaacccttacaattactactaccatccccatcctggcagtgctggttacccagccagcaatggggatgtggagaccatgttcagtgatgagaacaccaagggctgtgttgtcatgtagggatgcagctacaatcctataatctagaggttggtgatggaccatggtaatggtgatgcagtcctgctacccttttttttgtttcttttttgtttcctttaattattttactgctcttatggtttcgcctgtatcaagagtgaatcatggtgttgacttagatgtgttgttgaaagtaggggcaacttgagagggttatcaaacagtgtaatgtaataccttttaggcttttactgcctagtgctttgccctgactggcttgttataatttgtatattgt

SEQ ID NO: 8738 - DNA, 692 bp, Sorghum bicolor
  Clone ID: SORBI-28MAY03-CLUS52835_1
tgatgggtttggaaggactgcctctgctctcattggcaatcgtattaaagtttataaccgaggggctggtgtcggatcagttctggctactgcaatctgtggagcaccagctgctgcagtagctccagtctcggcatctgctcgtgctttacattatgcacttcttgggctaaggaacagccttgatcctgagcacaagaaagaatccatgtacaaataccagggaccccctcaatcatagacgtcgttgaggagatgagtttggtggtcagttcattctttggtgtgccttacaccatctctctgagacaactggtttaggaggtcctgtgccagtctcgtccaatggtgaggtgcaagcttgtacagtgtgtacagatcgtaggacagattatttgtggcatcgaagccatacactatgtaaattaacacataagggtttaattaccactcatcttttccaccacgcaggcacgtggaagttttgtaatatatcccactttgcttaagtttaggaagataccctagagcatccatgcctgtccccgatgtacataatgtggttaccctgtgagttgtgcggatgtcaatatctctcttttgctttggttgtgtgtgtgcgcgcgcgcctcgggtccgctgacaataagttcccaagatttgcaagtgtaaatattaccatcaatgttttg

SEQ ID NO: 8739 - DNA, 683 bp, Sorghum bicolor
  Clone ID: SORBI-28MAY03-CLUS52900_1
acagaagaagaacgtaacgagactacttgggtagatgatgggttccagtactaccttgccctccgcaagtggtacccaggcctacgccctgagtcggagttccgatgcttcgttcgggagcggaagctggttgctgtgtcccagagagacccatcagcttactacccatcactgcctgcatggagttctgaggtgcaaccgaaaattgaggctttctttgatgaagtgattgagccacagtttgcctcagtcaattatacgtttgatgtgtatgtgaggacggatgggcgggtcaagctgatagatttcaatccatggggtggttataccttgccgctgctgtttacttgggaggagcttgaggaggaggggagaggtcctgagctggagtttcgggtggtcatgcagcagggtgcagtgaggccaggattgatgacagctgtgccgtatgatatgctggattggggcgaggggagtggctgggatgtttttctgaagaaggctgatgaggagcttgacagacagatgaactcagtagatggcgattcatgattgcgttttagaaaaagaaaatatttgaagtatgctgtaggcacacaatctaaagtgattactgctgttatttttacctgccacaactagcagtcacctgctttcttaaaattgttatgcagtctcttacc

SEQ ID NO: 8740 - DNA, 718 bp, Sorghum bicolor
  Clone ID: SORBI-28MAY03-CLUS52912_1
gcacgaggcaaagaggtacagagggatgtcatacccctgctctgttcaatattcttagcgagtcaaggtactggggaaactgctgaagctatatcaccggatgatgaagaatctttgttgcaaggagaacgcgaagctgaaatgatgattgttgaggcctatgcagcacttgtgctggcctttctttcaacggaaagtatgaaggttcgaggagccatttccagttgccttccggacaacaacttaaaagttcttgtaccagtactagagaaatttgtgtcatttcatctgcagctcaacatgatgacaagggaaacacattcagctgtcactgaagtcattgaaagatgccggcaatcatagaagtgggaagaggcgccctgtacagattaactgacctcttttgcagccgaagcacacacaggtgttgctcatcacctggccagggcgcgacaaatggatgccagaggctggcgtgcagttggcttgggagctaacagggattttattctttcttttgtccctcctggtgttctgattctgtagtgtcttctcctcctcccctgaaatcatgttgttcccgtcccctgggaatagtgcatattatgaatgatgtccaataacagcataggccatagggcaggtagttgtgctgtttcagttcgtcggctctcccttacaggttgtattttggtgttacaattgaatcagtgcccac

SEQ ID NO: 8741 - DNA, 993 bp, Sorghum bicolor
  Clone ID: SORBI-28MAY03-CLUS55193_1
gcacgaggcctaccctcgcgcccacgcacctccaagatttacctggcttcacacgtagtgttttcaaaagggatcatgctttaataacaccagagagtcatgttttcagtcccttgcctgattggatcaataccttaggagcatatttgatcagtccagctattggtgcacacttcactatgtatctggcaaacatgcaagatggttcaaaatcatccctaccaccgaaagatgttgaaaggcttgtttttgtactacaagggagcatttcattgactgtggggactggaactacccattctcttctggtggattcctatgcatatcttcctgcaaacacaaaacattctatgatctcagatgaaccaaccactcttgtaatatttgagaggaggtacagtgccgttgaggattcccatcctgatctaattgtcggttcaacagataagcaaccccttcttgaaaccccgggagaggtatttcaactgaggaagctgctaccgacttctctgtcctatgactttaatatccatataatggactttcaaccaggcgaatatctcaatgtaaaggaggttcattataatcaacatggacttcttcttttagaggggcaaggaatataccgcttgggggagagttggtatcctgtgcaagcaggggataccatttggatggcaccatttgttcctcagtggtacgccgctcttggtaagaccaggacgagatacttgctgtacaaagatgtcaataggaatccattgatatgatcaagaaaccagaacaatgagcgaataaatcaaatggtgagctgtgccaggtttgaagaatttcaatgggaggtgatcacaggaataagaaaatgagatcttgttgtacgctgaaacatcttgaaaccaaataacgtcagaagttgaatgtgcgcttgtgatgttcatcactgccaatctttggtgactggtgcaatttgaattgtgatgtaacatattctgg

SEQ ID NO: 8742 - DNA, 754 bp, Sorghum bicolor
  Clone ID: SORBI-28MAY03-CLUS5498_1
cccacgcgtccggcccagcagacctttatccacagagatttgaagccatcaaacatacttcttggcgatgacatgaaggccaaggtggcagactttggattggtcagacttgcaccagctgatgggaagtgtgtctccatagagacaaggcttgctggcacttttgggtacctcgcaccagagtatgcagttactggacgagtgaccacaaaagctgatgtcttcagctttggggtcatcttgatggaactgattacaggacgcaaggcacttgatgagactcagcctgaagacagcatgcatttagttacatggttccggagaatgcagctcaacaaggaaacattccgcaaagcaatcgaccctgttattgaccttgatgaggagacatatgctagtgtttgtactgtttcagagcttgctggtcactgctgtgctagggaagcacaccaaaggcccgacatgggccatgctgttaatgtgctgtctaccctttcggaagtttggaaaccaaccgacccagactccgatgacagctatggtatcgacctgaacatgaccctgccacaggctctgaagagatggcaggcattcgaggatagcagccactttgacggtgcaacctcttcatttgttgcaagtttggataatactcagaccagcatccctacgaggcctcctggattcgcggagtcattcacctctgctgaaggaagatagacagttagttgctagggtgtgcaaaaccttatgc

SEQ ID NO: 8743 - DNA, 796 bp, Sorghum bicolor
  Clone ID: SORBI-28MAY03-CLUS55237_1
tgcagaggtagcaaatgttcagcgaattgcggaacagcttactatggggatgaatcagcagagagttcctggtaatgaacatcctgttgaacagcagaacccttcagatgctgtttggagaggtgctggtctggatgctagctggattccaccgtggtcaagccctgtgatggacaatcccagttcctccagtgcagtgaggtcagtaggtctcactggagttcagatgatgatgaggcagttggcttctgtgaccgacaattatgggcatgctgatggtacctggaacctatggcccgagccgatggcagggtcctctcttgttccatccacttcctcgatgcctggtagtgcatctgcttctggattgcggctccgtggtagtgcaggcacaggcaataatggaagtctttcagaggtactcactatggtagatagagtgcgggaagttctacctcatatccctgatgagctaattatagaggatttgatgaggacaaacaacataaacgccactgtgaataatcttctgctgatgcaatagtagatacgtcaatacaacatataagtatgacgtttactggctataaaagcttataagaaaagtatgtatagttaaaggcgagcctgggtgtaacaacactctttggttctgtaataaaagcctttttttttcctttattatttttgttcgcagaggtttgtatagcaaccatagttgtataatatgatgctcgatatgctataggttagtgtatctagacagaatgttatcggaactaaaatttgtttttgg

SEQ ID NO: 8744 - DNA, 1138 bp, Sorghum bicolor
  Clone ID: SORBI-28MAY03-CLUS55240_1
tgcacgaggctctaaggtcgcttaaagtcaaacaccgacttgttgttctatcagctcacttgacttcagtcgaacccgtttttgcatcatctatacaagcttgctttcacctgccagtcattcatccagcttcttttatcttggacgaaaaactatacatcacgaaaggacaaatcacgaaaggacaatgtcactcacagtcaagggcaaaactgctgttgtcacaggagcaggctcaggaatatgctatcatttctccaaggccctccttgagcggggatgcaatgttgtaatggccgaccttgctctacggcctgaggcgagcgagttgctgagggcattcccttctcaagctttataccagccgaccgatgtcacaaaatgggatcaacttgatcacgcatttgaggtcgctaagaaggaatttggagggtatgacatcgtgtgccctggtgctggcgtatacgacccgcccttttccaacttctggcacccagccggcacagcgttatcaaaagacgtgcacagcgcaagtcgtttcacaagcctcgacatcaacttgacgcacccgatctacgcaacccaacaggccattgcgcatttcacagagaacaagaaaccaggatctatagtgcacatctcgtctatcgcagcacaaggtccagtcttgtcggtacccatgtactgtgcagccaaggctgggatatcccatttcgtccggtcactcggaggtcttgagacacctcccgaaagcaccgacctggctagcatccgagtgacagcagttgcaccgggagtaatcaaaacaccactgtggacagagcatccagagaagctggcgtggatcgatggcgcaaaggatgagtgggtagagcctgaggatgttgcgttggcaatgcttagtctggttgagaaggatgaatatgttggaggaacggttttggaagttggaaagggtcaaacaagagaggtccatgttctcaatgatgttgggccgtctggctcgggacataccgtcagcggtttgaagaagggcgttgatgaagtttgggagatcctttcacacaagaggcatagctgagctgggttatcaatgtctgtagaaaatgctgctgcaggtaatttgaatcaacttggc

SEQ ID NO: 8745 - DNA, 545 bp, Sorghum bicolor
  Clone ID: SORBI-28MAY03-CLUS55261_1
cgtgcgagctcgacctctgcctgacgccggcgttgtcgccgccgccgctggcaggtgggctgctgctgggcggcggcgcgtcggacgagtactccgccacgacgacgtgcgaggaccaccagcccgtcaccggcggtgatcatgcggaggcccggaccacccccgcgctgctaaacctcttcaactaattaactgaccgaccatcgtcgtcatcgatcgtgttctccgtacgtaattaactgtttccgttgttccttccttgtaagatatgtaactgtgcagagagagagagagagagagagagagagagagagtcgttcatctcgtgatgggggcagggccagggtgtacgtgtgctacgtgattagttgcagggatgatcaatgggtgttggttaatcgacgtttttttttttttggcatgtgaaaatgcttgtgaaaagtagtaaagaagaaactcgccgattagcactgttaattgggtgaattaacgagtttttttttcttaattttaattgatgattcggttgcctcggcaccttgcta

SEQ ID NO: 8746 - DNA, 590 bp, Sorghum bicolor
  Clone ID: SORBI-28MAY03-CLUS55273_1
gctgaaaagaagatcaggcgaatgcttttcccccgttcccagcgtaaaaacgtgaaaacctctactgaagatgtatcctaatatatcagctgattttccttatagaggatgtaaacaccttgttcaaagacaagggtgccaatggaatgatttggtcttatgcgagtttgctaggagatggcgcacaacctgtcgactatgaggataaccaaaagcagcagagtacctgattgaggttttgacctcgctgatgaaggaaggttggccttccaagaatatagtttggtttctgacagataataaaaaaacaaataaggtgccaattcgtgtaaaagatgcactgccattttatgctggcggaaactgatgagttgaccaaaggtttgtcagctacaaattcccagtaataacgagctgcgagaggaaagggcagagtaataagatctcgttcagttctttactccaacttgtaactaacttagttgtctctttcatgtctgaataaatgtaatgtaacgcaactgtgattatgtcgttgttgaactatacaaaaaatgagaatttaataaagtttcgagtgcttgtactgt

SEQ ID NO: 8747 - DNA, 822 bp, Sorghum bicolor
  unsure (1)..(822): unsure at all n locations
  Clone ID: SORBI-28MAY03-CLUS53885_1
acctcttctccgcacgccccccagcgcagcgcccgcagctaggcagctacccaaacacagcccccgcccgcatcgaaacctcgtcgcgtcgcgcggaagagaggagaggggcgggggccgagaagggaataccgctgcggataccctcgtcctccaccgccgctaaaccctcccgtgctcctccgcgggcgcgggacgccgagcgcgaaaggcgcccgctctcggcccgccgcaccccgcactcgcactcgcgccgcgaggggaaaccctagccgcggcagatctagagcgggcgttctcgatctggccgcgtagaccccgtttcggccggggaaatggcggaggatcctgccgcggaacaggagatgcgtcagctagaggaccggctcagggaggtcggggaacggctgcaggcgccacccgacgacgcggaggacctgctcaacctcctcatcgaaattgaggagtgtttacataaagtagagcagtcacctcctgaaagcacatcgaatgctcttcgcccagcaactgaagctctggtcaagaaagacctgctgggccatgctaattcaaatgttagacttggcgtggcatcatgcatatctgagatcacacgtatcacagcgcctgatgctccatatgatgacgatgcaatgaaggatgtattctctttaattgtgggggccttcgaggatctggatgacgtagagagccccttctttganagaagaacttcaattcttgatactgtggcaaaagttcggtcctgcgtggtgatgctagatcttgaatgtgatgatttgataaatgatatgttccatc

SEQ ID NO: 8748 - DNA, 1065 bp, Sorghum bicolor
  Clone ID: SORBI-28MAY03-CLUS5387_1
gcacgagggtttccccgcgatgggcgccggccgtgtctgccgcggcggcccctcctccgcccaccccgccgccggcgcaggcgcggggcggccgttcccgccgctcgccgcgtcctcctccgccttcccttcctcggccccctccgagacggcgtccacgtcggtcaccaagacggtgaacggctcccaccacttcaagatcgcgggttactccctctccaaggggatcggggtggggaagttcatcgcctccgagtccttcaacgtggggggattcgactgggcgatctacttctaccccgacgggaagagcggcgaggatggcgctgcctacgtctcgctcttcatagccctcgccagcgagggcaccgatgtgcgcgcgctgttcgagctcacgctcgtcgaccagagcggcaagggccaggacaaggtgcatacccactttgggaggtccctcgagagcggcccatacaccctcaagtaccgcggcagcatgtggggctacaagcgtttcttcaaacgaactgccctggaaacatcagactatcttaaagatgattgccttttagtgaactgcactgttggcgttgttcagtcacataccgaaggaccaaagatatacacgattccagtaccgcggtcgaacatggctctacatattggtcagctattgacaagtggcaagaggacagatattgctttcgaagttgatggagagatgtttcctgcccacaaagtgattctttcagcccggtctcctgtttttagggcccaactttttggtccaatgaaggataaaaacatgaagtgtataaagattgaagacatggaggctccagtattcaaggccttgctccatttcatgtactgggatgagttgccggatattgaagaacttactggtgtaaatacaacttgggtatccaccttgatggctcaacatttacttgctgctgctgaccgttatgcattggagagattaaagttgctctgtgaacttaagctgtgtgaagatgttcaataaacacagtagcacatactgtggcactggctgaacagcaccac

SEQ ID NO: 8749 - DNA, 753 bp, Sorghum bicolor
  unsure (1)..(753): unsure at all n locations
  Clone ID: SORBI-28MAY03-CLUS53927_1
ctccctctcccccccctcgcatccggccgccaccagccaggccagggcgcgggcgcccccagcgcgagcggcggcccagcgcgggtggtgctccggcacggccggcgcgacccggcgtcgccgctctctcgctcccccggcgccgcccggcgatccgccggccgcggccccagctgccgcccgctcccgctctcccgacccccatctggccgcccgtctgcgtgccccccacgtccatctcgatccgagatcaccggcggtggctgtccaccttcacaaggtcttttcagatgccctatggagatgggtaacttttgcttttgtttctctgctttctccccactatgagttcgattcctgctctagggagtcggactcctgttctagggttttggttccattgcttgcctgctgctccagggtatgtcttctctgtgtcaatctctaagaaatttgcttcatgcgagttgtggctgtgcaaccacccgtaaggctcgagaccaatgccccctggtggatctttgtttgtcaagacggaatatgaggtcatggtctcatggatcagaaatattaaaacatattcggctatataggcagcagattgccaggcggacctacagctatgattgaagcagtccacccctcttgaacccaggtctcctctgtaatgcacactaggtcatgtgctgacnaagccgtccgaatacagattgctgggcacacagagctcggctttcattgggccattgtcct

SEQ ID NO: 8750 - DNA, 508 bp, Sorghum bicolor
  Clone ID: SORBI-28MAY03-CLUS54115_1
tccccgctacccgtcagcacaccatccagaaggagaggtggtaggaggactgcgcagtatgcttaggggactgcatgtcccgaagagcagcaagataactcggtcagatgagacaggtagaagggctgttgaaattgaagccgtcaagttcagttccattagtcagagcctttttgattgaagcggtctctgagtgacctgcttgacagagagttctagtgaggctgatggtagtaggagttcaggctgactatgcatgactattgctcttttcatatgcttcttcattgttttcggttttaaattttttagccagtgtacataggaaggatcagtgcccctgtgtggggaagaagaatgcaccagccatggtagaggtgggggacagtgtgtgcctccttttgggatgttcatcatcaagttaccagtcgtgtacagagttgtcatggtctggtgcatgttggcctgtagatgcaataagaaattcaccagggttttaactgaagaa

SEQ ID NO: 8751 - DNA, 720 bp, Sorghum bicolor
  Clone ID: SORBI-28MAY03-CLUS6829_1
gagacgtttccctcttccccttttctctccccctcccctcttctcctcccccgtaccaaaacaacctcaccgagtcgcaacgagagcgagaacgagaaccccccaaacgagagcgagtctccggcgattacgaggagcgcgggcacgccaaagcggcgaagcgcgaaggaaggaaggaggcagcaggatcagccatggggcttgactactacaagatcctgggcgtcgacaagggcgccaccgacgacgacctcaagaaggcctaccgcaagctagccatgaaatggcaccccgacaagaaccccaacaacaagaaggaggccgagaacaagttcaagcagatctcggaggcttacgaggtgctgagcgacccgcagaagcgcgcggtgtacgaccagtacggcgaggaggggctcaaggggcaggtgccgccgccgggcgccggcggggcgggccctggcggcgcgaccttcttctccacgggcggcgacgggccgaatgtgttccgcttcaacccgcgcaacgcggaggacatcttcgctgagttcttcggcggctccagccccttcggcggtatgggcggcggtggcatgggcggcagcggcatgggggggtgggatgcccggcatgcggaccggcgggacgaggttctcctcgtccattttcggggacgatatattcggctctgcgttcggcggcggcccggacgggtacggcacg

SEQ ID NO: 8752 - DNA, 696 bp, Sorghum bicolor
  unsure (1)..(696): unsure at all n locations
  Clone ID: SORBI-28MAY03-CLUS55404_1
cgccatggcgctggcggaccgcgtcgggcggcgcccgctgctgctggtcagcacgggcggcatgacggcggcgctgctcgtcctgggctccctgttcgcggcgttcgcgggggccaaggacgacgccgcggtggccgcggtgagcgtggcggccgtcgtggcgttcgtggtggcgttctccgtcgggctcggcccgctggcgtgggtgtacagctccgagatcctgccgctccggctgcgtgggcagggcgccgggctcggcaccgccatgaaccggatcatgagcggcgtcgtcaccatgaccttcatctcgctctaccagggcatcaccatggccggcgcgttctacctctacgccgccatcgccgccgcgtcgttcgtgttcgtctacgcctgcctgccggagaccagggggcggagcctcgaggacatggaggagctcttccacaccaagtgatttcattttcacatgcgctgatctgatccaaccacgccattggttcagttctggattcggtgccattgcaggtttatttgccattgttggagctggttttgatcttggtagttaacatgatgacacatgcatattgaaatcgattgtttgagcggggtctcgatgttggacatgggaacacattgtaaattttgtattctttctccacaagggtaaggaaatcaaaggatnttttcttc

SEQ ID NO: 8753 - DNA, 687 bp, Sorghum bicolor
  Clone ID: SORBI-28MAY03-CLUS55563_1
ctgcaagatccccagaagctgtgtgtgtatgcggagaagaaggacgcttcctcaccgggccctggcggcgtcggcccgttcgggctcgtcgtgatggcgtccggcgacatgcgggagcagaccaccgtgttcttcagggtgttcaggcacggtggcacgtacaaggtcctcatgtgcgccgacctgacaaggtcatcgacaaaagagggggtgcacaagccagtctacgcaggatttgttgacgtggacgtggagaaggacaggagcatatcgctaagaacactgattgaccactctgtcatcgagagcttcggaggcgggggccggacgtgcatcacggcccgagtgtaccctgagcacgtggtagcaggaggcagtagccacctgtacctgttcaacaacggagctcacccagtgactgtgtccaagctggaggcctgggagctagggacggcaagcgtcaacgttgaagaagactaccgtgtgggcacactgtaatcgcccgtggttgttccagtcctctcggatgacgctggatagatatataggggcaaccgtaaggttgagcgaagtgcatgcatgtcaaaataaagcttggatgtatatcgtccgtcccattgtcgttgttcatcgtacgccgtatggatggattatgacctactatataacaagccccatttgtgatct

SEQ ID NO: 8754 - DNA, 1327 bp, Sorghum bicolor
  Clone ID: SORBI-28MAY03-CLUS55576_1
ccgttgacgggcagacccttgttttctctgggccctcccctcccgtaccctcctttctccttcccttcccttccccctcccctcttctcccccgtcgccggcgagagctcgggcggaggcgctgtggcgcccgcaggagagcttttctccccgggaaacaagggaacctgcggagggctcttcttgacttcccccaagggcgggctgccgttggattgtgttgaaagatctcagttttatccccaaggagggatttcttgtcgccaatccggatctatctgttggtggtggaaagttccctcttttatgaggcgaggaggctgtgtgaggaacccgtgtgcctcccatggatgcgctgctgaaccctgattggcgcaccaggcgagaaggggcagcaagcatcgggtggtgacagagcaggaagacgagggagaggagaggcagttagtatacaagagaagcaggcaaaaataggaaggacgaaggagaaggagaggagggagctctccatgggggagcccctcctcacctccctctccatggagaacagcaacagccacccctgcacgctgctctccatggaccctgctggctcgcacccggcctccgccgagtcctcaggtggtggcggtgttgccaccaatggggttggggttggggttggtagcggtggtgacagggaactcttcatcattccgcggcgtgagtcggcgcacccaggcccgccggacatcaacctcccgctctctgcacgtcccttaccgccgcctccgtcatggagcctcgatacatttgacatacttgatgttactcttggaacacacaactatgagtctgaggttgcacttgcacttccaaagtcgacgggtaacagcaacggcaatggcagtgccactattggtgtcggcgcgaggaagtgtgctaagagaggagacagcatctggggtgcatggttcttctttaatcactacttcaagcctgcgcttgtggagaagcctaaggggaagatgacacgggatgcttccgggagcatctcgggcttcgacaagtctgatctccgccttgatgtcttcctggtgcagcatgacatggagaacatgtacatgtgggttttcaaggagcggcccgacaatgcccttgggaagatgcagctccggagcttcatgaatgggcattccaagcatggggagccatctttcccgttcagtgccgataagggctttgccaggtcacaccgtatgcagcggaagcactaccgtgggctatcgaacccgcagtgccttcatgggattgagatcgtgggctcaccaaatttgtcagcagttcc

SEQ ID NO: 8755 - DNA, 1043 bp, Sorghum bicolor
  Clone ID: SORBI-28MAY03-CLUS5561_1
gcacgaggggagttgctgcccagcttctggattctgtgaacaagctggaaactaacatgaaaaccaacttggaaagggctatgaaggagaatgatcgtgtttacctgatgcgggttccagctgctggttccttgggagccctccctgcagcatcccttgtaaagcctacctctttggcagaagttttagatgccagcaaggaaaggcttttttcatcacttgtgcctgatggcagcatgaaagcactctctaagtacacagagatgctagataatattatccggacccaagcagagaaattgcagcaagccagtgagatcactagagtcaggctgaaggaaatggacttaccagattctattctttcattggaaggaaatataaccttgcccttggatctcaaggaagacgtagaggctgtgcagataagtggtggccctgctggcttagaatctgagttgcagcagcttagggatttgagcagggtcaatcaggaactacttgttcagactgaagagcttctacagaaggaggcgaatgaagacgctcaatttcgtacacaatttgggagtcgctggactagacctcaatcaagcaccctaaccaagaatattcaggatagattgaatctgtttgcttctaatctgaagagagctgctgatagtgattctctgatcgaacgaggcgtgaaggagaactatccattgatgtctatccttgacaaaagaccgatagagtctgcacttccaagtatttccaggcctatcatgtccttggatgggaatgaagatgccattgttggagccctgaaacaaagcttgagacaactggaggctcttggagcacaaagggcaggtcttgaagacatgctcaaagaaatgaaaagaaaggacgatatattgcctaagttgatgactggtgtggatcacatgatgatcttttcaagaaggagcttgctaagtatgatcctatctgtgctgataatgctgataacattgtggcacaggaacaattattgctacaaatacaggcacaaaatgagc

SEQ ID NO: 8756 - DNA, 869 bp, Sorghum bicolor
  Clone ID: SORBI-28MAY03-CLUS55673_1
ctttcgtctccgcacccggcttggctgcctcccctctcctcaccgcccggcgcgccaccaccatggacccggaagcggtgcggaaaagcctggagcccaccgcaaccgcagagaaaatcacgggctccacccctgcgcggctccacttctacgaccccttcgtcctcagcggcgtcagcatcgaagccgccgagcacggccgcctcctctgctccttcgtcgtgacacctcgccttgcgagtcccgtggggtacctccgcagcggggtcacagcgacgctcgccgaccagctgggatcgcccgtgttcttctgcagcgggctccccagcagcggggtctccatcgagatcagcgtctcctttgtcgacgcggctgcagtcggggaggaaatagaggttgaggggaagttgttgcgtgctggaaagtcagttggtgttgtctctgtcgatttcaggaagaaaaagacaggaaaattgatggcacaggcccgtcatacaaagtatcttgtggcatcaagcaaattgtgaggtgctccccttctgttaacaagatatcaacataattgcacccaaaccctccattactggtgccatcattaataggcagcaatcatacaatgcttgtgatatatctttttttgtcaaaaaaattgctgtatatatactatatatgtatgaaattcaagtatcatcattggtgcctctgatgcatattggtctagtcatgttactttcacttgacagacatgatcggataacatgtttcgacagaggcacttggttgtaacttcgcaggaaataacagttgttgcattggctcggtctgccatcatcttgggagattcaatccgtttaaaaaagaattgatca

SEQ ID NO: 8757 - DNA, 1038 bp, Sorghum bicolor
  unsure (1)..(1038): unsure at all n locations
  Clone ID: SORBI-28MAY03-CLUS55718_1
agagcgttccccgaccgcccactcgcgaccgcacctgcgccgggtcgccgcacaaacacgaaaccctacatcgatctcgacatctcgcagtctggtggcagcgacaagctactctcgcggccgttcggtgccatcgcggttgacggcggctcgggcctgcggggtggtcgggaaattgcgcatctgacgacgactagctactgattcatcgagcggaaattgcgcgatgaccgcaaagaccacgaggaacaagggggggattgattgcacaagaggtctgagtagggagcagagagccataaacagaaggaacaaacttgatacatcactggtttcaagccggggttacaagagatccagggaccgcaacgtaaattggatcctaaaacgtattgcagccactgaagcgttttgtaagtttgaggataatctatctgctattgcagtgcaacgatttggtgaacctttacctgatagagaagaatcaaacattgcttttgaggagaggtcatttggtgaaatagtcaaacctggagataagagctcgtgggcatgctcgggcatacctatacctcacggaagaactacacaaagcctaacaagatttgtgacatcagcacatttggttacacaattcaaccagaatagaaataaagatgataagttgagggttgcagtgcgccttcctaataatagagctactgatgggttcttaggactatatgataaagacattgctattgtcacatgcttcggcttcctaggagtccatcgtatagatctgaatgataaggcaaaacctttccctgttgataatttgaaagctgctgggcgtgccttcaactctggcagttggatggccatgcgtggatctctatatcagaaacgccccctcgaacacctcgaagacctcaacacctgggtttcagatagtcaacatatctcanaggctgtacttggagggccacttctggggtcagataataaaattgtagggatgagcttagatatatatgaccctggtgatgcaaatntgag

SEQ ID NO: 8758 - DNA, 1201 bp, Sorghum bicolor
  Clone ID: SORBI-28MAY03-CLUS54533_1
gcacgagggccaggctcaggcagacacaagcagccagccaaccagttcgtcgctgctgtgccgtgcctgcgtaccgccgccgctgctgcaatcttccccgtccatcctttccctcccttccactctctctctctctctctctctctctggctcgcggtggaatcggaatcggaatcggaacggagcggctgtcgtgtgtcgtctgccccttcgtcccctcttcgacaccccaccccaccccaccccagtgctagctagctagtagctcccctcccctcgcctgtgggctgcaagggagggcgtggtttgctggattcgcggatcgatagcagagatcaatcaatccatggcgcggaccaactgggaggccgataagatgctcgacgtctacatctatgactacctggtgaagcgcaacctgcaggccaccgccaaggccttcatcgccgagggcaaggtcgccaccgaccccgtcgccatcgacgcccccggcggcttcctcttcgagtggtggtccatcttctgggacatcttccacgcggccaccgccaaagcctcctccacatccaacgcttctgctgctgctgccgccgccgccaccgccgccttcatcgatcacaccgccaagcaacaacagcccgctggggccggggcccctcctcctcacccccttcacgatatcaacaacaacaagtccagagagcaccacatgaggctccagttgctgcaccagcacaacccccatctccaaactacaagagatgctcctccttgcgcctctatcaatgccctcagctctgatgtctccgctgtcctcgcttccaaaatgatgcaagaccgaatcaggaaccccaaccctatcgactccgacgcctcacagcatccacgaggcgcaaacaggattgcccttctaaagtcaccaccacctagccacactgggcctatgcctatgcaacagcagcagcagcttcatcatccaagaaaccagcaacttgacatcaagcccgatgttgctatgccacaaagaacgatgcctgcggacccttcttccttgtatgcagcagggatgatgcacccaaaacctgcattacttgctgctggactaaatcaaggtgttgttgggagtgtgccacttaaaggctggcctctaacggtcccaggtatcgaccaactccggtccaatttaggcgggcagaaacaa

SEQ ID NO: 8759 - DNA, 775 bp, Sorghum bicolor
  unsure (1)..(775): unsure at all n locations
  Clone ID: SORBI-28MAY03-CLUS5450_1
gtcgcgaggtgggggacgagacgaggcctgagcgccccaaacccaaaccccagaaccccgacctagggttacgccatcgccatgggatctgttgcctccgccgccgtgccacctcctcctcaatcagcgccgccccaggtgggcgcgccgccttatgggcccgggctcgccgggatcctcccgccgaggccggagggggaggagaagaaggaggagaaggtggactacctcaacctcccctgccccgtgccattcgaggagatccagcgcgaggccctcatgtctttgaagcctgaactttttgaaggattgaggtttgacttcacaaaagggttgaatcaaaagttctctcttagccacagcgtttttatgggctccttagaagttcctgcccaggcagctgaaactattaaagttcctactgcgcattatgaatttggtgccaattttttagatccaaagttaatgctcattggaagggtgatgacagatggaaggcttaatgctcgtgtgaaatgtgatttgacagacaatctgacgctgaaagtaaatgcacagcttacccaagaggcacattactcacaaggaatgtttaactttgactacaagggaagtgactatcgagcacaattccaaattgggaacaatgcattctatggtgcaaattatattcagagtgttactccgaacctatcaatgggaactngaatgttctggcttggtcaccaaaggaagtctggaattggttttgcctctcgctataacacggacaaaa

SEQ ID NO: 8760 - DNA, 695 bp, Sorghum bicolor
  Clone ID: SORBI-28MAY03-CLUS5456_1
gcacgaggcaattccccaactgcccgtgcgctcatctccctcgttggcgtgctcctcccccgcccctcgtcccctcccacccaccgccaccgagtccgagagcgagagcgagatagagatccagatccacgtgcagatccatcgccgggggccgccatgaacccgacgcggcccgcgcaggcgtcgttccgtgaccgcaccaacgagttccgcgccgccgtcgagagcgcgcgccgccagtcgtcggcccccgcggcggcgagcagcagctctaccgggcccctcgatgggttgatggcggccacgtcggctcgctcggagttcaacaaccgcgcgtccaagatcgggctcgggatccaccagacctcccagaagctaagccgccttgccaaattggcaaagagaacatctgtttttgatgaccccacagtggagattcaagagttgactgcagttatcaagaaggatatcacggctttgaatactgctgttgtagacctacaagctatctgcaattcacaaaatgagagtggcagtctctccaaggacacaacaaatcattccactacaattgtggacaaccttaaaaatcgtttgatgagtgcaacaaaagaatttaaagaagttcttaccatgcgaacagagaatttgaaggttcatgaaaatagaaggccaatgttctcatcatcagctgc

SEQ ID NO: 8761 - DNA, 883 bp, Sorghum bicolor
  Clone ID: SORBI-28MAY03-CLUS5474_1
aaccccgccactgacaaaaactagcaaaaatccccaattccgccgcagtccgatcctccaaaccctaaagctcccaatccccaacctttcctacgtctccggatgccctctacccgcgcggcctagggcggcagcagtcgtctggcaggcggggacgcgccaatggagccgcgcgtggccaacaagttccgcctcgggcgcaagctcgggagcggatccttcggggagatcttccttggtactcacgtgcagaccaacgagcaggtcgcgattaagctggaaaatatgaagacaaaacatcctcagttgctgtatgaggcaaagctgtataggatacttcagggtggaactggaattccaaacatcaagtggtttggtgtcgagggtgactacaatgttcttgttatggacctcttgggtccaagccttgaagagcttttcagcttttgcaacagaaaactgtccctgaagacagttttgatgcttgctgatcagttgatcaaccggatcgagtatgttcatatgaagtccttcttacatcgagatattaagccagacaatttcctcatgggccttggcaagagaatgaatcaggcatacgtgattgattttggattggcgaagaaatacagggacagtacaaaccagcacattccatacagagagaacaaaaatttgactgggacagcacgatatgcaagtgtaaacactcatctcggaattgaacaaagcaggagggatgacatggaatcacttggatatgtactcatgtacttcttaagaggaagtcttccttggcaaggtctaaaagctgggaccaagaaacagaagtatgagaaaatcagtgaaaggaagatcgctacttcaggtgaggttctctgtc

SEQ ID NO: 8762 - DNA, 938 bp, Sorghum bicolor
  Clone ID: SORBI-28MAY03-CLUS54960_1
ggggaatatcagaccattctgctgtcacaattatgggtaagaggatagttgtagggcagaaagacatgggcagcaataccagcataactttctgggaccaagtgctgaatcaagagttcctccaagacctactcagtcttttgcacatactcctgaatatagtgttttcagttatccatctcaacctgctatgccttttcccccagcgttctttgcccctgggggcagtccgtacttggttgatgcaaagggtgcaccagtcataccgcctctgtcaggtctaagcctcggcatttctcatccatctttcagcaccagagcaacaccaccctcatctaatgaattgagttactttcatcctagcatggatttcagttatggagtgccatctgaaggcgcacgtagggaggcagggagctactggcccgtgtcctaccagggccagacaatgtttgtggatgaacgcatgaggaatgtgtcacagggtggtagttctgggttggtgctgaaacgaaaagagccagagtcaggttgggatatgtactcgcgtcgttgagtctgatgaaggtttgttgcagccataatcgattttgtcccgctttcttaaaaatggtatgttcaatgttccgtttatgacggaccttggacattgtattctagggtatttctttggcacctgaaaatgggtccagttctattaggtctgaagacatacacggagaactgaataagagatcagctacaggtagatttgagagatgttgacatggcaaggacattgttagctgctggaaaccaccttgtgtagatctggttctttgtgaatgtattagctttgttttagttgacataatatagtcaaattgctctctacggagagctgaaattatgtaaatcatcatcgtataactcatagatgaaatgcatcctttttatcc

SEQ ID NO: 8763 - DNA, 757 bp, Sorghum bicolor
  Clone ID: SORBI-28MAY03-CLUS5603_1
gttaaaacgcttcctccaggaatccaattgctccctggccgtcagtcttaatgcaacgacagatgaggttagaaactggataatgcccataaacagaaagtacaaccttaacttgcttcttggcactttaagggaggaacttaacctcagaaaaaaacagatagtgctatttgaatatgtcatgctttctggagtgaacgacagtatggatgatgccaagaggcttatagagctagtccaagggatcccatgcaagataaacctcatctctttcaatccacacggcggttcccaattcaagcccacaccagacgataagataattgagttccgcaacgttttaattcaaggtggcctcactgtttttgttcggctcagcagaggggatgatcagatggctgcctgcgggcagctaggagagcctggagactaccagctgcctctgctccgtgtacccgagaaatttcaggttgccttgtgatgataaacagcgcatacagtaaactggtcctgagcagcttgacgatcacacggagtaattggcttggaacgacggttcgatcgtgcaaatcttagtaagttctaccgccctcctgaagattgcctggaactctgcaatatcgtgcaaatctgaacctgggtacttatgtgacagcacattttgacatggtgttgcttctgctaatgcgtggtgtaaccaaactaaattcgataagaatatataaaatgggtatttccgcgcaaatcgtctctgtag

SEQ ID NO: 8764 - DNA, 615 bp, Sorghum bicolor
  Clone ID: SORBI-28MAY03-CLUS56143_1
gcaggccaccacccacaagggctgattcaaggtcccagcaaccacagaaccgttatggtgctttagacagaagttcaaaccggagacctccatctggatacaacagatagtagattgtgacctagtttatgtcatagctcatagtctgttgttagtagagctaggagaaactcagctaaagcataggcagaatagtctgcaaagtctggtgaccttcaagcagctaaggtggtggcatcaaagatgggaggcaaaatttgtatgctactgcagactatcaggtactggtggttggtcgccattgaagcagctaggttgtgatatcagaagttttttttgaagcaagacttgtatactggtggctggtcgccattgtttcatttgtggttgccatttatttagaagatgttgtataagcgccctggggcttaaataggttccaatgaagaatatttctgaaggacgtttactctgagacttgacaagttttgggggggcattttgatatcagataagtgtatgtaggagtgcctattttcagttttgttgatgagtgtattccaagtcatgtatgaactcattagatgtcattaatgaaagtgggacttctctttt

SEQ ID NO: 8765 - DNA, 663 bp, Sorghum bicolor
  Clone ID: SORBI-28MAY03-CLUS56175_1
ggaaggcgatcaaagtaccatttgcacatggtgatagccatactgtcgtacatcctcttcgggctgctgccaccagtcatctacggactgtcattcaggacaagcgacaacagggagaacaaaatgttggtggtcgctgctgtatctctcctgtgcattgcgctgctcgcaattggaaaggcgcatgttaagaggcccaggacttacttcacaaccctcctctactacctgtccattggattcagcggttccgggttgtcgtatgccacaggcgtcctcatcatgaagctcctagcacactttggtatcattgatcagggtggtgcatcagctcctgctcctccaggtctctcattccccgaagcagtcgcctgggcttcctactgagctttgagccctcatttagttgttttgatggtccaatagattatctgggcacacacacatctgcatggagtcacggttgttttgatggtcgaatagattatctgggcacacacgcatctgcatggagatgctatcttcggttcagaaagtttttatcccttttttttcaacagccacttggccatagtataatcttcatcacagaattcttctgtaccacaaccttgtcatcgtatttttgacaggaacatattatcagttacaatatcctttttc

SEQ ID NO: 8766 - DNA, 642 bp, Sorghum bicolor
  Clone ID: SORBI-28MAY03-CLUS56176_1
gcaaggagcccaacgacggcggcgagcacggcagcctggcgggatgggcacgacacctctaccagtctcgagggagcatcaccgaggccacagacatgagcatcagatacgccgggtactccgacgagatcgaggttgttttcaggttaggcgtgctctgcaccgcagagatggcgtcgtcgcggccaaccatggacgacgtgctgcagatcttactcaagtgcagcgagcagacgcacgagaagagcaaaacgcagcgtgtccctgagaacgaggaggatccactccggctgccacagcgcggtagtcgccggaaacagctctcgaacggcacggggattgacatcgaatccaagagccacttcgacagcattgtctgaaggaatgaaggaaggaaggaaggggaaccgaccactgcacataccagtgagtaagttaggacagcgttaataaacatctatacttctatactgatgcttcatactatagtacatttcagtagagttacagcagagaaatcatgcttccaaacttgtcaccagacgttgaatctaaatttgtgcattgacactgtaaatttgttgcaagtggcgcacacattagaccactgaaacagaacaaatagcaaaggtttacgattac

SEQ ID NO: 8767 - DNA, 1215 bp, Sorghum bicolor
  Clone ID: SORBI-28MAY03-CLUS56207_1
gcacgaggcaccttgcagctcccccatcccccgcgccacccccctcctcccccctccccccccccccccccccccccgcctccccccccccccgccccccgcccccgccccccgccccccgccccccgccccccccccccgcccccccccccctccccgccgcccgccccccgccccccgccgccgccgccctcgtccccgccccccgccccgcggtcgcccggcccccgcccccccccgccgcgttccggccggggaccgcggaggccgcgcacgtcgcggggggggcggaggccggggccgcggcccgcaccctcggccccccggcccgctctccgcgctccgggtgcccgcccgccgcccgccccgcgcgccccgctccctgctgccgccttccgtccccgccgtgctggtcctgtcgtccgtctggggcctgctggtcctgacgtccttatggattctgaagggtcttctcgaggtggtctgcacatttggaagcatggtgtttgcaagcatccttcttgttcgtggtatatggtctggggtggcatacatcagagaaaaccgttacagctatattcaccggatcgacaacgatgagaaccgatggagcagagtgcagactgctggttgatattttgctttccttctctgtgaagtgtgaacagacaccacaccctgcatttgcaggctctatagagtacaaaaggaaaatatatggtcagcaatgaataaaatgctcccctgtccggtgccaaatgattgttactattgctagaccccgcggctgaacgaggatgaaacgaatccacatgtacctgcacagaaaagtggtttccgttcgagttgggcgccttgaggatcgatggttgagttgatcatagctcatgcgttcagtacagtgcatggaagaatgcaaattgtgctgaaggatcggggatgcttttggaaggtgccggctgggctggcgtcggccgtgtgtatgactacaaccagtcgacaccaatgctcatggttgtattgtagatgcaaactctcgctggtttagagtcagaaactcttgggatttttatttgggcacgcacagaaagtcagaatactcgtcgtatgatgtatctgatgtttcatacacatgaccgttctgacacgcaatggacttgatcacggaagtttcatcacttctataggttgtattacaggatcgtgcctaggaga

SEQ ID NO: 8768 - DNA, 793 bp, Sorghum bicolor
  Clone ID: SORBI-28MAY03-CLUS562_1
aggggccttttttttttttttttttgggaaatgaattgctgcattcatgtaaagttagctgtaaattttgatgccacatgggctttcatttcattcacacatataactttccatttactggtagtacactgtattctactaatggccaagtttaaccatgtctagaggactggggcttcatattataaaacaggagtggtagaacaaaaccagggcccaatgtttgatattaccaatgttgatccaatatttgacttgagaacaatataagcccaaacaaaatttgagcaagcacgtaaacaaaaggaaaagtatcaagtgaacaaaaggtagacaatggacctcattcaatctcaatttgctgaggtgcatcattttgatctgcctcacttgattcttcagagctgttttcctcagctattccagaagcctccactgtccgacttatccattccttgagaggatcctcattcaggtcaagcctcaacagaccagcaaacacgccacccaagaatgctactggctccttgatggcttctcggaggatgcgctcgtcgccgagagggttgaagcaagctcgcatgaccactgcagctcccctcctcctactcgtcgtcgtccgcccatcaaccccatggagacacctcctcttggctggaactgccggcctgctggggcggagcagagcagtggcagtacccgtagaagtcgccatggatagcgagcaaacgcctccacaccagcgttcggccattcgagaagtttcctcaactccttttttttccggccggtt

SEQ ID NO: 8769 - DNA, 622 bp, Sorghum bicolor
  Clone ID: SORBI-28MAY03-CLUS55277_1
tccccgtccgagacaggttcgacccttagcactgcttcaccagcatccacgaagtccaattgcttcacaccaggaaagcgccctagagactgcaacgaggaaggagataccaaaggaaatggcaaggtgtgggtgccaaagacgatccgaatcgatgacgtggatgaggtggctaggagttctatcttgtcgctaatcgggatcaatggcgacaaggcaggcaaagatggcaaagggtgcaagcttgcaagggtttttgagcagaaagaagaggcaaggacggcaactcactcagtcatcaatggcttgccattcttgcaggggaacccagctgcgctctcacggtcattgaccttccaggagggatcttgagcatcatatgaacctcaattctgtgaagacaagccgtttagcgcggcacagctgaaattttgtacattagaggattgtaatctaggtgtgggcaatggaggggtgtataacatagctcatagctgcaagcggaccttgaaactatacaatagatatttgtagatagcaatatatatgggtcggggtcggggaaggataaggagagcaagtttccttatttgtggataataaataatattataaagattgg

SEQ ID NO: 8770 - DNA, 1077 bp, Sorghum bicolor
  Clone ID: SORBI-28MAY03-CLUS55305_1
gcacgagggttgggtacagttgacaccaatcaattaaaaaataatatggctgacatatccccaaatggtcgcttcatagctgctgccgcttttactgccgatgtcaaggtgtgggagatagtttactcgaaggatggttcagcgaaggaggttaataaagttatgcaactcaagggtcataagagtgctgttacttgcttgtgcttcgctccaaattctgaggaagtgattactgcatccaaagatggttccattcgagtatggaacattaatgtaaggtaccacctcgatgaggacccaaagaccttgagagttatgccaattccacttcatgactcaaaaggttctgtttgccaatatgaccatatgaacgtctctcctgatggtaaaattctggctgtaacaagtggatcaacgttgcaatggttatgtgtggaaactggtacagttttggatacagctgagaaagcacatgaaggtgatataactggcattgcttgggctccacgaaaaattcccaatggtggcgtgcctgtgtttattttggggactgctggtgtggacaaaaaggtgaaactttggtcagcgccagaggttggttcaacatgagcggataaggactgaatcctggggccatcccctaactgcataagacagctttgccaagggcacataatggaagaaagaggaaacaaaagaaggatgcaagctaactagcccagaacagggaaggccttgcttggtgctcctctgttgatatcgcactgaactgaggcatatttttgttccattgagtttgagggatagtaccgagggaggcttattactgatgagtgtgaaacatggcgagcacgccccaatgcaacaggaaggcaccatccttggggttgtagttgtgctatataggcatatagcctgccaactctttataaaataaactgaatgttgtctgcatttttctttcgttccttctactgggaatgatctggctgtgtgatccaatataatttgtgctgctgctgcttcagaatacacgcccgtgttgttgtttaaaaaaaaaaaaactcgaggggggcc

SEQ ID NO: 8771 - DNA, 683 bp, Sorghum bicolor
  Clone ID: SORBI-28MAY03-CLUS5531_1
gacgaagcaccactattgtattgtgctacttgattaaatacaggaacatgacccctgaagcagctttggatcatgtccgatccattaggcctagagtgcttttggcaccatcgcagtggcatgctgttaggtcatttggaagtctcaccactggacaacttccagttcggagtacgaacctgggctgcttcttagaagccattgaagctcgttgtatgaacacggaaaatgatgattaccacgtgatggagtttgactgcgaagatagtggcttaccactttctcaaattatgctatctaagccagccagccccactgggtgcaccgatgcagtcctcataacagaagcagatcttgagggctatgatacttatattggtactaggaaagatgccgtgtcattggtagtagccactcgcaggcccatcatgaggagattgtcctgcctctttggctccctgaaacttaacagcagcagttgtgaaccagcttcaagccggttcactgaggttcgtgcctgctaggtagtgtctttctccagttttccatgttgaatcaagagtgtatctctagataggcaatcatccaaataggatttgtagaagcctgagtttatagccatggcagtgccatcgggaagaaagttgtgtgcatagccagaggggttgtttagtttttaagaa

SEQ ID NO: 8772 - DNA, 691 bp, Sorghum bicolor
  Clone ID: SORBI-28MAY03-CLUS55312_1
ctaagcttactatagttaggaagcacccttcaagtgctgtgaatacttcaaattcaactggggcgacagagtcagctgatgatgatttacctagtgtgatgacatgcgccaattatctgaagcttcccccgtactccacaaaagaaatcatgcgcaagaagttgctttatgcgatcctggaaggccgaggatcgtttgatctttcataagaaatatataatatccgaactaacatacaggggtcaattttatgctggagttagtttcttggttggtccatataacaaaggttgaggttaccagccgcacagcaaacagcttcaagggcgagagcccagtcctcactcggatgcaggctaggccatatagcccttgagtgaggatatgcgccaacaagaaccaaaacggagccctttctttcagtacaggtaaataaaagggaatttttgttccagaatccagaactggtgatgtgatcatgttgatccagaattgttatctgtaacgagaacatgtacatgtgtgatgactgactgttaataaatgtggcccagtgtaccattcggtccccaaaacaagggaaaacgcacgtggaatttccaactattcagttattttgccaaattccatgtagtttggtaaaatatataagtccttaaaatagtataagagatgctgcttttttcttctc

SEQ ID NO: 8773 - DNA, 790 bp, Sorghum bicolor
  Clone ID: SORBI-28MAY03-CLUS56360_1
aaaggcgttcatgttgctgtcgaaatattaccttgaggaggcaaaatggtgcaatgagaagtacatgccgaacttcaaagatcaggttgagctttcctctatgtcgtcggctggtccagtactgacccttgcagccctaatggctgcgggcaatgaggcaaccaaggaggcattcgagtgggcaagcagtgtgcctgacatggtgcatgcttgtgcagagataggccgctttgtcaatgacatatctggtttcaagaaagggaggaagaacaagaacgatgttgctagctccctggagtgctacatgaaggagcatggcaccacaggagaggaggctgcggcagcgctcactgcaatggtggagcaagcatggaggaggatcaacaaggcgttcatggagatagatcgaggactgctgccagctgtgactttggccgtgatcaaccaagcaagattaagtgtggtcgtatactatggaggaaaggatgcctacaccttcaccagtgaccttgaggatctcataacgtccgtcttcctaaagcctatcccagtttaatgatgaacaatattttgtgtgcatctcttatcatgttataagcatgctttagttggtgtgagcttggtcatgtcatgtttctcggccaagcatgtgtcattgcacacataagcctattcgagtttctagtagtggggtccctctccttatgtgtgtgtcctgttcacatgggtgggacttgttctggttgatcagcttaagctttcccctttaatatggtctgtagtttgttgc

SEQ ID NO: 8774 - DNA, 819 bp, Sorghum bicolor
  Clone ID: SORBI-28MAY03-CLUS5647_1
gcacgagtgcgacttaaaactatcttctccgccgcgatttggggcgacttgggctggcaaaagcgttgcttcgcttctcggactactaggttaagttgcgttttcggttcttagaaaaggactggctctgcactcagataatattaaaatggatggtgcacagccaccgagtgggcaattgaacaactcgttcaatactcttatggtttctggagatgagcagagtcaacagccgcaggatgctgggaatgaaaccagcttcacgaattggaaagaccttcccatggagctgcttctgcgtatcatttcactagttggagatgacaggatagtcattgtggcctctggtgtatgcacaggatggcgtgacacattagggtggggagttgcaaatctttcgctgtcatggtgccaggaccacatgaatgacttggtgatgtcactggctcacaaattcacgaagctccaagttctatctctacgccaaatcagagctcagctagaagacagtggggtggaggccgtggcgaacaactgccatgatttacgcgagctggatcttagcagaagctttaggctcagcgacctgtccttgtacgctctggcgcacgggtgccctcaccttacaaggctcaacatcagtgggtgctccaatttcagtgattcggctcttgtgttcctctctagccagtgcaagaacctcaaatgcttgaacctgtgcgggtgtgtgagggcagcttctgacagagcgctacaggccatcgcatgtaactgtggccagctgcaatcgttgaacctgggctgtgtgatagcatcact

SEQ ID NO: 8775 - DNA, 983 bp, Sorghum bicolor
  Clone ID: SORBI-28MAY03-CLUS56615_1
gcacgaggctgaccaagaaattgagctttatgaggaaattaagtttgagccaaacgtgatgtgcgaaattattgacaagaagctcacttttcgttctagtcagcttgaagatggggcccgtggctgtttccaaaaatcaccaggagcagaatatgatgcacaagtgcgatatccagatgttccttcatttttggagtatgtccataataggcaggttgtgcatttccggtctttggagaaaccaaaggatgatgatttttctttggaattgtcaaagcttcatacctatgatgatgttgttgagagagttgctcgccaacttgaattggatgatccagcgaaaattcggcttacatcccacaattgctactctcagcaacctaaaccacaacctgtcaaatatcgagtggagcatctgttggacatgctcatccattataatcagacgtctgacatcttgtattatgaagtgttggatataccactgccagaattgcagttcctaaaaaccctggcacgcgcatttcaccatcctacgaaggatgaggttgttattcatagcatcaggcttccaaaaaatagcaccattgctgatgtaataaatgacttgaaaactaaggttgaactgtccagtcctaatgctgaactacgtgtgctagaagtcttttaccacaagatctataagatctttccactacaagagaagatagagaatataaatgatcaatattggacactacgtgccgaggagattccagaagaggagaaaaatataggtccaaatgatcggctaattcatgtttatcacttcatgaaagatattaatcagactcagcaaattcagaacttcggagaccctttctttctgcttattcatgaaggtgagactttagcagaagtcaagaagcgcatacagagtaaactgcaagtctctgctgatgaattttccaagtggaaatttgcgtttatatcgatgaatcggc

SEQ ID NO: 8776 - DNA, 591 bp, Sorghum bicolor
  Clone ID: SORBI-28MAY03-CLUS56625_1
agaagtcgccgtctccccaccgtctcttgctccctccgcggctttgacgtcgcctcgctcgcaatgaactccctcctgaggccgccgctgccggggctgacgccgatcctgagcgcgaggcgcagggtctcgccgccgcaagcagcgccggtgcgggtcggctcggcggagctggccggcggcggcgggcgcagatgccggcgagggctggcagtggtggcgtcggcggctccgtcgtggatggaggaggctggggtggacgtgctggaggagggcgggcgttggaacccgtcggtgtcggactcgtaccgcccgacggggctgccgcggcccaacgccacggtgctggaggcgcaggcgcgggtgtgcacgggccccgcacagacgcgcccgctcggggaggagcaagccatgcgcgtcctcgacactatcctccgctccgcgatgggagaactcaaagaggagccagtctctagtgcacagttaggtgcattttttgcaggcatgacaatcagagctaactcacctcctggggccactccggggtgcgcgggggtgcgtcgtgccctgcgcgcggcttggccacgcctt

SEQ ID NO: 8777 - DNA, 806 bp, Sorghum bicolor
  Clone ID: SORBI-28MAY03-CLUS56808_1
tgatgagaagaagaactgttcatgctggactagtgtaaaagggtgaagaaggtgcgctttcaatgacaaccaaggaaagatcagctcatgcatcaaaaggacttcctgttaaccactgttcagggtttcggacaccaaacaacatagattcctctgagactgatggtatttctagagaaagcttcagggtcattgtgaatgcccaggaacttggttttgaatccaccgaaactccaagaactgatagatcaattctaaagaacttggagctcggtctggcagcactaggcggcgagaaaggagcagcctatgaccgaatagttcttaatgcagctatggctgaccacttgctaggctgcagcggagccgaggatatcaacactgcacttgaccgggcgagagaagccattgatagcggtgaagctctgagaaggctcatgagttacataaaaatctcgcacacagtgtcctagtgttgatccgtgaccaagtactgattgtacaattttggcttgagtcacggccggataccttcttccccgaatctgattgccttcagcccttccccactcaatgttactacaagctagcatgaaatattccttcaccatcaagggcctgtcagaaaaagaaagaaaaagaacaggtgaaatgaaacagtgccttgttgaaaatggtagtgacacggaatgctttgttaagatttttgttttaccatgagaaaagttgatgttgtgtaacacgtgcagattgtcctcctgagatgtatacgaatcagataatagtggcattgtgaatactctaca

SEQ ID NO: 8778 - DNA, 643 bp, Sorghum bicolor
  Clone ID: SORBI-28MAY03-CLUS55844_1
ggccggctgcctcctccggcggcggcgccccccggcgcctccgggcggggccagccccggggcgggccggcgagcgcctgccgcggccggtcggcgcggcgcctgcggccgccgctcccgccccctccgccccccccgtcgccccccgccgcgacggcggcggcggcggcgggccggggcgtggtgagggtggtcaggccgacgctcagtcgcgtgcgcttttccttctcgcatacgcttccgcagtgtcctctcctgtccgcacctcccgtctcctctgctcccgtcccagctcctttcgcctcgccctggccttggtgctgaggccgctcataggggttgggggggactgcgttcaggcttgtggtggagttccgcctgccccccgttcttggagctgcgcctgtcccgccacccatcagcactgcatctcgaggcgctccacagctctgttccgcaagctgcttcgtgggtctttcccgggcgcgccgggtgctgtcgtcccccggcgggccggttccgctggtccttcttcggctttgcgctgcatattataatacaactatgcgggatgagatcctgaagtctatgatctgcccaggaataacatatggagatctacccataaatgttgtgggacatt

SEQ ID NO: 8779 - DNA, 725 bp, Sorghum bicolor
  Clone ID: SORBI-28MAY03-CLUS55846_1
gcacgaggggcaccgaggccctgacctgcggtatcaagggcagcgacgtccacctcatctccgaggccgcgacggaccctgaatggaacggcgactgtaccgtgtaccgacatgccgacagcgacctcgccgtcctcccgtacggtgcggcgttgcctgtctctctcaaggtcctggaacatgacatcctcaccgtgtcaccgatcaaggacttggcacctggtttcaggttcgccccgattgggctggtggacatgttcaatagcggcggggcggtggaaggcctgacctaccacctcctcggcggcgcaaagctgctcgacggcggcaacggttctgcttcgggctccgaggctgtcggattggcgtgcatggaggtgaagggctgtggaaggttcggtgcctactcttcagtcaggccaaggaaatgcatgctgggttcagctcagctggagttctcctatgattcttcctcagggctggtggttcttcagctggagaagatgcccaaggagagggttcacaagattgttgtcgagttgtagggtggtattgccaccagtggtacaaaaatgtaggttcattggtaatcagagtccactctgatgagtatgaagttgtactagcttattgatggtagggactggagtggcgtatggtttggtaggcaaatgtgattcatgattcaattgaaaggaatatgcgcatactgtctgactgttctc

SEQ ID NO: 8780 - DNA, 651 bp, Sorghum bicolor
  unsure (1)..(651): unsure at all n locations
  Clone ID: SORBI-28MAY03-CLUS55888_1
ggcccgcgggctagctagacgaaggagtcccaagttctcagcagtcagtcagcatgatggtctccattaccagccaccgccagcagctcctgctgtacctgcacttgctcgttcacttgttccttgggatccaacagctctcgcactccctcgccacctacaccaaccaaactaccgtgccaccaccagcagcagcagctgttccatgccggccggaccagtccgcgacgctgctccggctgcggcgttccttctccaccaccaccgactccgcatgcacccttgcgtcgtggcgggctggcacggactgctgcctctgggagggcgtctcctgcaccgctgccgatggccgcgtcaccaccctcgacctcgccgaatgctggctgcagagtgccggcctccatccggcgcttttcgacctcacctccctgaggtacttggatctctccttcaacagcttcaatgagtcagagctcccggccgtcgggttcgagcggttcaccgagctcacctacctcaacctctcctacaccgactttataggcaagataccgcacgggatacgacagctcagcaaactggtaaccctggacttcaccaattggatttatcttatcgaaagtgacaacgactatntcctgccactcggcg

SEQ ID NO: 8781 - DNA, 610 bp, Sorghum bicolor
  Clone ID: SORBI-28MAY03-CLUS55918_1
gcacgaggtgcaaaacaggaaggcgccgaagcgcccgtcgccgcacccgagtccgccgccgccgcgccgctccaactcggcaccacggagcgggctggctggaaactcgtttgctgtgatggaagagggcagtgactactatgttgtcaggaaaggcgatgtggtggcagtttacaagactctaagtgactgccaggctcagatttgctcttcggtatctggtcctgctgcgagtgcctacaagggtcactcttggagcagaggaaaggaggaatacctgtcttcatgggggctaagtcatgctacttatgtgatcaatgcagccgaacttagggaagatgtacttggtccccttgtgccctgcagttttcaggacatacttggttctagttcaaatcaacaggctccaaatcatataggcttccataatgttgtagcatctcagactggagcacaatatgttgatctgaaccatgaagccagatctagttccttcaggcatatctcaccagcaaatttcaatcgtactggagctgttgatgcacaacctatctcaaaacaatatatggtgggtattcttcattttgatggtgcttcaaaagggaaccca

SEQ ID NO: 8782 - DNA, 1121 bp, Sorghum bicolor
  Clone ID: SORBI-28MAY03-CLUS56023_1
atgatggttcaatagcttttgaaaatgacttcttcaagcgtcaagcttttttgacagtgtctggacagcttcaggttgagacatatgcatgtgctcttagtagcgtttatacctttggaccaacattccgggcagagaactcacatacatcacggcatttggcagagttttggatggttgaaccggaaattgcattcgcaaacttgcaggatgatatgaactgtgcagaaaaatatgtacaatacctttgcaagtggctgcttgatcattgccaggaagatatggagtttatggtgaaaaattatgataagagtgcaattgaacgcctggagcttgtttcctcgactccttttgtgcggatttcatatacaaaggctgtggagctcttgaaaaatgttacagacaagaagtttgataacaaagttgaatggggaattgatttagcctctgagcatgaaaggtatttaacagaggatatatttaagaagccagtgattgtctataactatccgaaaggaataaaggctttttatatgaggctcaatgatgatgacaagacggtggctgcaatggatgttcttgtgcctaaggtcggcgaattgattggtggaagccaaagggaggaacggttagatgttctgaaacagaggatacttgatgctggcttgcctttggaaccctatgaatggtacttggacctccgccgctttgggtctgtaaagcacagtggctttgggttgggttttgaaaggatgattctttttgcaaccggaatggagaacatcagagatgttatacccttcccaaggtacccagggagggctgatctgtgatctttggagaccttggttaaacagatgctagttgaattcaacatgctattagtgattttgagatgttttgaccgttcagttcctactttgcatattttaagtatattggagtacactggtaaggttgtcaaatgtcatgtaattctgtgtgtattttatttgcatctgcaggctgcgactgatcaaccttttgtctctgctatagttgtgttcaacaggcaatgttttctaaaaaagaaaaaacaagtcaaaagttagacagtttaattaattgacagttgtcactgt

SEQ ID NO: 8783 - DNA, 1312 bp, Sorghum bicolor
  Clone ID: SORBI-28MAY03-CLUS57036_1
ctactgggtcactcctatcagacgcgcgaagcagctcagcgacgccgcgccgcgcgaccaaaatccgccgtgcccagaccccgacgggaaactcgggctttagctgccgtctgcctcgacatgctcccatgggcggccaccgcgtcaccacccagcactccagccgccgtctcatttgctcctcccctccgcgccgccgctccccgccctccaccgcccctctgccgcccgcttccgcggatgctgtgcgcgggcctcaaccccccaccgcgcgccgcctcttccgacggcgacgtcttctgggaggagccagacgacggctccgggagcgactacgaggacgacggcccggagcagaggagagccttgcggctcccggcttcctcgccgtcatcaaggctcgaggcggcgcggcagcaagaacaggacctccggagcgcaatcgagcttctcctaacgcctgaagaaaaggctatcttggatcagcacgagactcctgacgtcactaaaatatcatcaccgaaatggcatccacttcatagctacgcgctggcactgcagatacccctcatggacaagcttctggacagtggtgttgacatcaacttacttgatagagatggcttcacctgtcttcacaaggcggtcataggaaaaaaggaggctgtcattagccatctcctaagaaaaggggcaaatccccatgttagagatagggatggagctacaccattacattatgctgttcaagctggtgccctgcaaactgtgaagttactgattaagtacaaggttgatgtcaatgttgctgataatgatggatggacaccactccatttagccatacagagtagaaatagagatatagtgaaggttttgcttgtcaatggtgtggataagacaagaagaaccaaggatgggaggactgcactggatctaagcttatgctttggaagggatttcaagtcatatgatcttgcaaagcttgtcaagcttattccagcaaatagaggagtgtgatttcgctctgccacaaatttcagggaaacaaaagccaaaagttagccagtgcagcctcgtatgagccatgcatagattatgaagaagggtccagatgcagcttataaagaaacaagaaaggaattatcgctgctggtcattttaacagtttttcttgaccgccaactccaagcgatctgacatatcgctctataattgcgccattggaattctgtccatggtctgtagtctgttcgacatgactcaaaatatggagaaccttatggatatacaagcagcagtcttcttcgta

SEQ ID NO: 8784 - DNA, 820 bp, Sorghum bicolor
  Clone ID: SORBI-28MAY03-CLUS5710_1
gcacgaggccggcgtccgacgggcgacggattgcgcgcgctccgctcgtcgtggcgcgtgcggcaccgtccccgtaagccgccgcggccgcgcgctagcgtttcaatccgtcttcagcgcctgcctaagaagcacgtgacgtgacacctctaccgttggcgctgtctgcagccggtggggccgggaccacgcggcgcggccgatccagatccggcgcactcctccgcgctgctgccctttcccagcggcggcagcggcttcgcctcgcggggcacggttgcgccagacgaggaagaggggggagacgccgcgagctcggctgaatcggaggaagtggcagaggcaacaaatgattcgttctcctactcattaagagagtgccagaagcagcggcggcttaagtcagagaggtctgcactggtgcggccaccggcctcgcatgagctcaatagtgccggaggtattgagctgctagtgctctcgccgaggtgcttgattgggggtaacccgggaggaatgagcaagagctcaacgacatcatcccggagcagatcaggcacaggcacgttcccaagccctgggactccgaactacaaccggcattgtgcaggcagcatgcagtactccaagggttggagttcagagcgcgtgccactgggcactggtagcaatagaaggtatgggggcagtggggttgtgcttccgtttacaatgggaggaagctgccatcgaaatgggaggatgcggagaagtggatcctaagtccggtttcatgtgatggtatgggaaggatgtctgcaccggctccgcatcatagacg

SEQ ID NO: 8785 - DNA, 1002 bp, Sorghum bicolor
  Clone ID: SORBI-28MAY03-CLUS57176_1
gcacgaggcaagccaccatcgccattgccggagccacggccaccactggtgcgaccgatgccatcaacgagcaagagagggagcaaatggaagtttgtattgaccggggtccttggaggtgctgcaattgtggtactacttggccttagcgcgctggtggtttgcttgttgagaagaagaggaaggagaccgagaggaagaggagtggagcagaccgcggggggcattcggtctgggcggagaagtagtagtgtgaatcccgtcacaatgtcacccatggcatcccccggagccagtggttcactaaagggcctccctattatcgtagatgaattcacctatgagcagttgcaccatgctgcagggggctttggggatgataaccttgtcaagcatgggcactctggtgacatgtaccatggtgtcctggagagcggctttcaagttgtcataaaaaagattgacctgaaaagcagtaagaagtgccagggcgagttgagctttcttacaaagcatagccatgggagaatcgttccattgctgggccatttggctaaggatgaggaggaattgctggtctacaagtacatggcaaaaggtgacctcacaactgcactgcacaagaagtcagtcgacgttgaacaggggttgcgctcattggattggataacaaggctcaagattgcaattggtgtggctgaggccttgtgcttccttcatgacgaatgcagtcctccgttggttcacagagatatccaagctagcagtgtgcttcttgatgacaaatttgaagtgcgtcttgggagtctgggtcaaatatgcgctcaacaaagtgcaggaagccagagtttcttctctaggattctaagatcatcaaggtcccttgacaagaacatatcaggtccaccagctagctgctcatatgatgtttactgttttgggaaggtgctactagagctaatcaccggaaactttggtgcgagtggctcaactgatgcagat

SEQ ID NO: 8786 - DNA, 1091 bp, Sorghum bicolor
  unsure (1)..(1091): unsure at all n locations
  Clone ID: SORBI-28MAY03-CLUS57210_1
gcacgaggcactcatcatccacccagaccctnntcctcccccacccatctcgccggaaccctaacgtcgaccgccggcgctgcccatcggcggcgatcgcattgctgcgcgtccgatgaagacccgcgcctccaagagttacctctgcgcgggcagttcttcgttcgatgaccccgacgtggtcgaggtgtctccggccgcggctgcgggatggacccctagccaccacaagaggaagcggagccaggttgtacctcaagaagtaattgaaattgatgatgatgatcctgatggagtcataattattgctgataaagcaccagtggacaagaataagcaaactgctgtatgcccttgccctatgaattggccaaagtatggcaagagtggttggtttccggacatacctggcccaagcacatatgcttcaaaacatactgattcctgggttgatcacaaagtgtttcaagatgaggcagtttacaactattctgatgagtacccctatgagggatttgaagaagactatgcttatgatgaagatgagtttgaggatgatggttatgatgctccacttattgaaagtgaatttaaatttggtttgtctgccaagtttgataaccttgatgttccacctggtctggaggcttctttatcatggacgcagaagactgctattgagattgcaaataagaccaaacccactaaggctgtagatgataaaatcgaagaaaaatacaaggccttcaaacgatttgatactgttgatgatcacagtgatcattattattcaaagccagaaaagagaagggttcaggtggtaaaaaagccatcaaaagactgggtgaaacgtattcagcatgagtggaaagttctagagaaagatttgccagatactatatttgtgagggcatatgaggatagaatggacctgcttagagctgtcattatgggaccagctggtactccttaccatgacggtctcttcttctttgacatttacttccctcctcagtatccaaatgtaccgccgatggtgaattaccgtgctggtggtttgcggcttaatccaacttgtatgcttgtgggaa

SEQ ID NO: 8787 - DNA, 790 bp, Sorghum bicolor
  Clone ID: SORBI-28MAY03-CLUS5737_1
ctaaatattctgctggactctgattatactgctaaactgtctgattttggcctggcaaaagctggccctgaaggtgatgagactgatgtgtcaacgagggtgatgggaacctatggatatgctgcccctgaatatgtgatgactggtcacttgactgctagaagtgatgtctacagcttcggcgtcgtccttctggagctcttgacagggcgcaagtcaattgacaagtcacggcccagcagggagcagagcctagttgactgggcccttcccaagctcaatgacaagaggaggcttctccaaataatcgacccgaaactggagggacagtattcggtcagagcggctcacaaagcctgcagcctcgcattctactgcttgagccataaccccaaggcaaggccactaatgagtgacgtcgtcgagaccctggagccgttgcagggcggtggcagtagcgatggagctggtcaatcttctggccttcctgattatagagctcgacgcaggctaacagggaacaacgtccacttaagggccatcccaaaccccaagtgctcccctgctgtccccgcttgcagagtgcggtgatagccgacaggcgacggtgctgttccagttgctgctggaataggttgggttgtatattacaaagtctaaaccatgggcgatgtgtgcgcctgttctgtgctgctgtgtgtgtttgagtttttgtttttggggttttttgccagcgttttgaaatgtaaatttgatctgcatgctggtgcttgtaaggcccgctaatttc

SEQ ID NO: 8788 - DNA, 741 bp, Sorghum bicolor
  unsure (1)..(741): unsure at all n locations
  Clone ID: SORBI-28MAY03-CLUS56261_1
tggttcagccagttacaaaactagacaatgtatacatcgctcntgaggtctacaaaaatgaaccatttgacagaagtgcagatgtatttgcatttggtctcattctttacgagatgattgaaggaacccctgcttttcacccaaagccacaagaggaagcagctaagatgatttgtttagaggggctgagaccaccattcaagaataaaccaaaatactaccccagtgatgtgaaagagctgatacaagaatgctgggatacgacgccttccgtcaggccaacattcgcggagataattgtgcgcctgaacaagatacacgcgagctgtgctaagcagggtcgctggagagacaccttcaagcttccatggaaacaaactggagacagatagttgtaaagttccgtgaggctgccgtcaagatttcgccccctcccttcagcaaatgtgagtaaacacgactacacgagtgaagaaacgtacagagttacaaacagaagccgttccttttcagctcaggttctatacgcgtccaatacgagagcacagtttgtagcctgtatgaccgtatctaggcttatgccaccggcccatttcctcctgtgatattttcatcttcatccaaacgggaacagtgaacagaatattacttttctgaacattgagtacgtgccacttccttttgaactcgtacgagctacgacatgtgagcgttgtaaattctacacgatctcattttttt

SEQ ID NO: 8789 - DNA, 631 bp, Sorghum bicolor
  Clone ID: SORBI-28MAY03-CLUS56292_1
cggagatggaaatgttcttcatgacatcacagaaaaaccaaatcacctgcaaagagtgacaattttcagtgggactatcataaattcaattgagtatttgtacagtgacgacaatgggcagcagcacactgctggtccatggggcggctgtggaggaaatggccgaaagattcatcttgaccctgaagagttcatagtgaaggtttctggaacatttcatccatgtgcatgggacaaatccataccgaatgttgtatcgtctcttacacttgtcaccaacacaggcaaaacacatgggcctttcggaaagcagatcggagctgatttccacgttccaatggggagcaacagcaggatcgttggcttctttgcccacggaggcaattacatcgaggcaattggtgcctacgttcgcactctgtaaccacagcctgtacactgtattctatatgagtatattgtttctccatgatcatcggtatcttatcttcttagttacgaaagagagagccaaaatgtaagcaattagctgctgtatagtaaatacatcagggcgcttcatcttgtgtatccatttgactgaatattgagcactgtcagcaaagtttgacagaattttgagcacttatgt

SEQ ID NO: 8790 - DNA, 848 bp, Sorghum bicolor
  Clone ID: SORBI-28MAY03-CLUS56310_1
gcacgagcccctcccccattcgctccgccatggcatccttcatcgcgttcaccgttttcttcggcttcaacgccggcctctgctgcctccaactccccaccatgaccacgaccacggcccaggcttcgcagcagtcgcagagtggcctcgcgctcgtgctgcgcctggccgcggccgctctcgtcccggcggtcctggccacgctcacgctcactccgctgctcacgttcgcgcacgttatggagctcgcccgtgccaaggcggcgggcaacggcggtgccgcggcacgtctcgtcgtggcggggcttgccagggcgaccctcctcgcggcgacggcggctctcctcgcgggcgccgtggtgcagctcggcgccgacggccacctcgatcgcgggcgcggcgacgtcgcgcgcctcaacatcaagtgaagtaagaaccgatccccccttctcccgactagaaaaaagcaacctggaccaagtggggttgcaggcttggcttgcggcggcacggcacggcacgccgtggtgctgctgccggactcgcagccagcccggccaggcatgtggatctcgcagccggcaggtccgatgctgctctgtttgttgcagctcagcgcgcgcgcctgagtgtctgaagaaggggacgggttcttggatgtatctatcataaaaatgtttgatgctcccgtgcaagtaaaaagaggatactctctacgtactagtacttcatttgatcctcgatgattgttgccgtactactgcttttcgtttgtggggaacactagtaatttgtatttatatttgtatttgtatttgtatttgtatttgtatgatccaaggatatac

SEQ ID NO: 8791 - DNA, 915 bp, Sorghum bicolor
  Clone ID: SORBI-28MAY03-CLUS5636_1
tcgatcgccgtggaggcggccaagggcctctgctacctgcaccacgactgctcgccgccgatcctgcaccgcgacgtcaagtccaacagcgtcctcctcgacgccgacttcgaggcccacgtcgcggacttcggcctcgccaagttcctccgcggcaacgccggtggttcggagtgcatgtccgctatcgccggctcgtacggctacattgctcctgagtatgcctacacgctcaaggtggatgagaagagcgacgtctatagcttcggcgtcgtgctgctagagctcattgccggtcgcaagccagtcggagagtttggggacggcgtggacatcgtgcagtgggtgcggatggtgaccgggtcgagcaaggaaggcgtgatgaagattgccgacccccgactctcgacggtgcctctgtatgaactaacccatgtcttctatgtcgccatgctatgcgtcgcggagcagagcgtcgagcgccccacgatgcgagaggtcgtgcagatactagccgacgtgcccggctcgacatccacgtccattgacgtgccccttgtcatcgagccgaaggagaatgggagcccgggggagaagaagcaggagcagcaggaagggtcacacgactcgccgccacagcaggatcttcttagtatctagaagtgcagttgcaagaattgatcgtactgatagtagtactttgtagcatccttgttcgtttcagtgaagcgttggaacgtggcggtatctgtgtgtgtgtgtgtggaagaggtgatttgtgcatgttcccgttagctagattgccactattacgttaagtatggtgagttggttgggccttgtaatctctgtcccatgtacaaatcaaatcaagctgtttgagcttccatttgagttcttaaatctctcaagttc

SEQ ID NO: 8792 - DNA, 963 bp, Sorghum bicolor
  Clone ID: SORBI-28MAY03-CLUS5632_1
ctgcagatgacattggcgactgtattaatcctgggacagttgcagggtacagtgaagtgaagggtgctgtaggtgcttctgccgccacttctgcagtgcgacctgctggctcccgatcatccagtttccacggtgtgaccaggcatagatggagtgggaaatatgaagctcatttgtgggacagttcttgcagagtagagggacgtagaaggaaagggaaacaagtttatctaggaagttatgatactgaggaaaaagctgccagggcctatgatgttgctgctattaaatactggggcggaaataccagactaaactttccgattgaacaatatggaaaggaattggaggacataagggatttgtctcgagaggaatgtgtaacatacttgagaaggaggagcagctgcttttcaagaggagcttctatttacagaggagtgacaagaaggcagaaagatgggagatggcaagcacgcataggactggttgctggaactagagacatttacctgggaacattcaaaacggaggaagaagctgcagaggcttatgatattgctgcaattgagatacgtggcaaaaatgctgtgactaattttgaccgaagcaactatgtcgacaagggtatgcactgtatagaaggagaaggcttgaggctgctcgcatccaagccagaagaatgacttcaagttcaatgcagtgattgttgatggagcagatttggccagacatataatggagcttagttggtacatacagatagaagaactggtttcagtttgtcaatattcctgctttacaaggcttaagattacagtaaatcgacccactagcaacaattgtgccaggaagattttgagcttgtgtatcataaggctttgtagcatagatctttctgaaaatgttagcaagtccatgtttactgtttgatagcatcgagttatcaaattgcactttcca

SEQ ID NO: 8793 - DNA, 654 bp, Sorghum bicolor
  Clone ID: SORBI-28MAY03-CLUS57582_1
aacccagttctgttccttcgcgatcgactagcgccatggcggggagggcctcccggcggcgagcggcgccgcccgagggcgtcccgccgccgttgcggccgcggctgccggtggccgcgcgcctcctccgcgggagcggaggctgagtaattaactccttccttgatttttccaagcaccctgccccatccctatcgcgccaccggcccccgaactactcccccgccgcccccgctgcatgcctctttccctgggccggcggcgacgtcgtccccgctcgctcccccgccctctccctgctccacgatcgcgactactcctcccccctcgatttgccccccccggcgccgcttgccctccgctaacgcctccagcacaacacgcacgcctccaccatacccaactactaccactacacctcccgcctcatagagctcgcgcgtgtgctccttgccctccacgatctccgcatactcctcaagcacagctcgaacaaagtcagctacgttccgctcccgacaagcttcgtgggagcagcggttggagacggcgcgagtaacgataacctctctcccattcagtgccgccggcccgctctctccgtccctgttgatattgaggcaatcaaagcaaagcttggctatcaatacaatt

SEQ ID NO: 8794 - DNA, 922 bp, Sorghum bicolor
  Clone ID: SORBI-28MAY03-CLUS57689_1
gcacgaggcatcattcatgagcgtgaagctgaagccatggcgacggcgccagagcgagacgaggaggaccttctgggtgttctcctgaggctgcagagggatggtggcctgcagttcgctctcaccaacgagattgtcagcacggttatttgggatattttctctgctgggagtgaaacatcatcaactgttctagtatgggcaatgtcagagcttgttaggaatccacaagtcatgcataaggcccaatcagaggtgagggaggccttcaaaggacaagacaagataactgaaggtgatttgatcaaattgagatacctacagctggtgatcaaggagactttacggttgcatgctccagtaccactgttgctccctcgagaaggtcgtgaatcatgtcaggttatgggttacgatgttccaaagggaaccaaggtgttcgtgaatgcttgggcaatagcaagggacaaaaaattgtggcatgatgcagaggaatttaggccagaaagatttgaaaatagtagtgtcgattttagaggtaatgacttcgagttcactccctttgggtcaggtaggagaatatgccctggcataacgcttggtttggccaatctagagctggctcttgttagccttctttaccattttgattggactctacctgatggcgtcaagttggaagaatttgatatggcagagatctttgggataacgttaagaaagaagtccatgctttggatcatggccaacccttacaataatcttataccaaattaatcagatgatttgtgatgtgaactgtgtccctgttgctgcttaatttgtaccggagagagtgattataattatagtgtatcagtctgtgctaaggacaataaatgtactcatattttatcctgtgcttatgttatattgtttcctc

SEQ ID NO: 8795 - DNA, 1299 bp, Sorghum bicolor
  Clone ID: SORBI-28MAY03-CLUS57724_1
ggagcttctgtatggccacctcggcggtcgtggcccgcctcgctggcgaggcctcgcggcccaaggtcctagcctccgcaaatggactctcatcctcgcggtcgcgggtagccgttaagcgccgctggcggggccgaggcgtccggtgctgcgcggctggtagctccggtgggggcgccggcgccggcgccgtggtccccggggaggagtttgtggggttcttccgagaggcgtggccgtacatccggggccgccgtgggagcaccttcgtggtcgtcatgtccagcgaggtagtgtccgggccgcacttcgaccgcgttctgcaggacatatcacttctccatggtctggggattaaatttattcttgtgcacgaggcacatgtccaaattgataagctgttatcagaaagagggaagaaggccaagtatgttggtcagtacagaattactgataaagattcgagagatgctgcaatggatgcagctggtaggatacggttgacaatagaagctaaactttctcctggtcctccaatgttaaatctccgtaggcatggtgttattggacgttggcatggtcttgtggataacattgcaagtggaaacttccttggtgctaagagaagaggagtggttaatggaattgactacggattcactggtgaagttacgaaaatagacgtttcacggctcggggaaaggcttgatagtgatagcatagttgttgtcagcaacatgggatactcaagttcaggagaagtgttaaattgcaacacctacgaggttgctactgcatgcgctttagccatggaggcagataaacttatctgcattgtagatggtcagatatttgatgagcatggacgagtcattcattatatgtctattgaggaggcagatttgttgattagaaagcgtgctaagcaaagtgatatcgctgcaagttatgtcaaggttgtggatgaggaaggcatcaattctctgcataaaggggacaacggatcatcattgagtgccaaggctcatataaatgggtatgctgcttcttttcaaagcggattgggttttaacaatggaaacagtgtttattctggtgagcaagggtttgctattggtggtgaagagcggttaagcggatcaaatgctgcttcttttcaaaatggattgggttttaacaacggagatggtttttattctggtgagcaagggtttgctattggtggtgaagagcggttaagcagatcaaatggctatatttctgagttagctgcggcagcatatgtgtgccatggtggcg

SEQ ID NO: 8796 - DNA, 735 bp, Sorghum bicolor
  Clone ID: SORBI-28MAY03-CLUS5777_1
gagactcgagagccgcctgctgctcctcccctctccagctctcctccactgtacccaaacctctgttcctcgctcgcgccggcctcggcctcggcctcggcctcaagccggcgagcgatggagcggcggtccgtccgcttcgtgccagccgagattgcaaggatggagaaattggctgcagatagaaacgagcaagtctttgataacaagttctgccagaagcttgcagaagaatttaatcgttctgctggccgtgctggaagtaaagcgttacaggctacacaggttcaaggatggttccttaataagtttccagcatcagccactaaacctacttgtgtgcccactgcttgccaagaaaagactccagcctcagaagtaaatgtatcagtttctgaaaaaagatctgcagcttctgaagaaaaacttgtgtgcccactgcttcccaagaaaagtacttcagcctcagaagtaaatgtatcagtttctaaaaaaagatctgcagcttctgaagaaaaacttttccctcctgatacaagtgtttcaaacaatgaggatgaggtttctcctgttttttcattagaaactagagatatgattcctgaacttgatgacctggagtttgaagccaagtctgcaaaggattctgcctggtatgacattgccatgttcttggcacataggacgaacaaggcgggggaagtaaaagtccgggtgagaatccagggtttgggg

SEQ ID NO: 8797 - DNA, 592 bp, Sorghum bicolor
  Clone ID: SORBI-28MAY03-CLUS57788_1
gcacgaggtccaccacctccgccgcctcgccgttgacatccctagccgccaggaggggagcccagggttggaggccgccgcgcagtacatcaaaggggagctccagggtctcgccgcccgtgcgggcccagagtacagaatagaggttgaggaaacactggttagtggctctttcagcatgatgtttctgcgtcatagagtcacactaggctacaggaatcataaaaatattatcatgagaagatgatgatccatccttgttggtaaatggtcattttgacagtccacttggatctcctggtgcagcagactgtggttcttgtgttgcatctatgcttgagctatcacgactcatcattgactctgggtgggtccctcctcgaccggtgattttccttttcaatggtgcagaggaactttttcttttggctcacatggttttatcaagacacatagatggaacaggacaatcagtgctttcatcaatattgaagcttctggaagtgggggtacagatttagtttgtcaatctggacctggatcatggccttctcgcatttatgctcagactgcaaagtaccctatggcaaat

SEQ ID NO: 8798 - DNA, 658 bp, Sorghum bicolor
  Clone ID: SORBI-28MAY03-CLUS578_1
gcgtccgccccgcgtccgacgcgtccggccgaataatccccccgagccctcaggccacgcctctgccacgcgaccaaaccaaagtagcgaggcgagagagcgagagccgccatggggaagatcaggatgcccgtgccgtccctgttccgccgccgctccaagtcgccgccgccacagcagcagccggcggccgagggcaagggcaacgggtcccctccgcgagcggcgaccgcggaggaggagatggcgcgcgtgttccgcaagtttgacgcgaacggcgacggtcggatctcgcggtcggagctcgcggcgctgttcgagagcctgggccacgcggcctccgacgacgaggtggcgcggatgatggccgaggcggacgcggatggcgacggcttcatcagcctggacgagttcgcggcgctgaacgcgacggtggccggcgacgcggcggcagtcgaggaggacctccgccacgcgttccgcgtcttcgacgccgacggcaacggcaccatctccgccgccgagctcgcgcgcgtcctcaggggcctcggcgagtccgcctccgtcgcgcagtgccgccgcatgatcgagggcgtcgaccagaacggcgacggcctcatctcgttcgaggagttcaaggtcatgatggcgggcggcg

SEQ ID NO: 8799 - DNA, 625 bp, Sorghum bicolor
  Clone ID: SORBI-28MAY03-CLUS6928_1
agcacaatcagcaataccaaaagatccataattaatctaacgtacacgtacgtagtccagctgatttgtccacgcggcatggcgacgcccagcgccgccgcctccagcagcttcctcgtcccggcgaccaccgctgtcgcctcgacaccctctgcatgcccatccacgctccccaagaagaatgccgctggcgctgggcgccggcggcaccgcacaatgcagtgcagggccagcagcggcggaggccgccgtggcgacggcgacgacgtcgacagccgcctcctttggctgccccgtcgtcaagtgctcaccggcctgagcggcgtcgccgccggcttcgtcgggtaccctgacgaccttgcgtccatcgccctcgccctggaggcgaaccccgtggagagctgccgccgcggggagaaggtgacggacaagatcgtggagtgctcggacccgagccgcggcttcccgtgcccgccggcgacgcggatccccgtcgtcgacttcacgccggagcccaaggtgacgcgcatccggcagccggcgcacctcctggacgccgagtaccaggccaagtacaaggaggccgtccggaagatgcgggcgctggacaagtccaacccgctga

SEQ ID NO: 8800 - DNA, 442 bp, Sorghum bicolor
  unsure (1)..(442): unsure at all n locations
  Clone ID: SORBI-28MAY03-CLUS5686_1
ctctctctctttcctccctcttggaggagagagaagagggggagaccccagccacagccacagccacagccacagccagcacaagaccacccagcccctctcgctgacgtcgccgccgcaatggagtccggtggcgccagtggaggcggcggcggcggcggcggggacgaccagctgcacggcctcaagttcggcaagaagatctacttcgaggacgccgccgcggccggctccagcagcggtggcggtggcggtggcagtggcaatgctagcgcgaccaccgcggctccagcgacgcagcagccgtccccgccgcaggccgcttcgcccagggcagccagcggcggcggcggcatggaggggcagggccgccggcggcccctccccggcgcccggcccgcgcgctgncaggtcgacggctggcacgtgaacctaaccgacg

SEQ ID NO: 8801 - DNA, 954 bp, Sorghum bicolor
  unsure (1)..(954): unsure at all n locations
  Clone ID: SORBI-28MAY03-CLUS56915_1
gcacgagggaaaggtactatttgtgagcgttcccagctgttacgcatcaagtattatggtaactttgacaagcctcttggcaggtttctgcgggactacttgtttgatcagggctaccagtgtcgttcctgtgataagccacctgaagcccatgtccattgctatactcatcgccagggaagtctaaccatatcagttagaaaacttaccgaatttgttttgtcgggtgaaagggatgggaaaatttggatgtggcacagatgtctgaaatgcccttggagtaatgggtttcctccagcaactcaaaggattgtcatgtctgatgctgcctggggtttgtcacttggtaaatttttggagcttagcttttcaaaccatgcagctgcaagtagggtggccagttgtggccattctctccacagggactgcctccggttctatgggtttggcaaaatggttgcttgcttccgatatgctcctattagtgttcattctggttacttaccacctcataaacttgattttggtcaccagcccttggattggatacaaaaggaagcaaatgaggttattgagcgagcaaaacatctctttgatgaagtattgcattctttacacttgatatctgacaaaaaggttcaaggcagttctcctaacatggaatttagcaattacattgctgatcttgaaatcatgcttcgaaaggaaaagtcagaattcgagggatgcctgaataaagtcttgagaagggatatgcagaaaggccaaccagacatccttgagatcaataggctgcaaaggcagttactcttccattcatacttgtgggataaaagactggtatttgctgcaagatcagatagatatcgtcacgagaagatcaattctatagatagtgttgctgagcaaaatgtactactaaagcctcaaagtgagtgcaatgggaatangtct

SEQ ID NO: 8802 - DNA, 1253 bp, Sorghum bicolor
  Clone ID: SORBI-28MAY03-CLUS56936_1
gcacgagggtttcgttcagtggattatgagaagattgctaatgaggaacaaaacttaagtagggcaggcaaaatgaaagagaaatctgatgataaatacgacagagatcctagggaaaaattagatcgaggtgaaaggcgtcgtggggaagatgccattgagagatcaacagttagattgtcagagaggagagaacgttctattgaaaggatgcaagagagagttacagataaagccattgaaaaaggtagggcgcgcggaaataaggatgagaggaataaagttagatatgctgaaccttcggtggaccggacacattcttctgatgaacgattccgagggcaaagtttgccaccgcccccacctcttcccgcaagttttgtaccccaatcagttggtgccaaccgacgtgaagaagatgctgaccgaaggggtgggagctccaggcatgttcaaaggtcatctcccaggcgcgatgagaaagaaaggaagcagtcagaggagaatacttcttcatttcaggatgatgggaagcacagaagagaggaagatattcgtgatagaaagcgtgaggatcgggatatattatcaaacaaggtagatgacagggatagggaaaaggggacttctttgaaagaagacagtgaccctagtaatgcttctaaacggagaaagatcaagcgagaccagacttctttagaagccggggaatatgcaccttttgctccacagcctccctcccatggatccggcagctcacaattgtctgacgtacgagaaagagaaaggaaagggttaatttcacaacatcgtacctcacacgctgatgaccttcctaggacgcatggcaaggacacagcaagcaagtcaagtcgtcgagagtctgaccaaatgcacgagagggaatgggaagaggaaaagcgaccaagaactgaaacaaaaaggaagcatcggaaatagccgatcaatattgacatggattcagttgagcctcattaattttctccgagcacagtagtgaatgcatttgaatttcatgttttcctgtagtgagaaaacatgtttcagcatagctaagcagattgtttcatagtgtactgcgccagttaggggatgtggagcttaagatgatgctaaagcctttcctgtcgagctcaccaatgcgaatttcacatatggagatgagccatgtttagcttcatacattttgtgctgtaaacaatgtggaatgtggcatagtgatttgtactgtg

SEQ ID NO: 8803 - DNA, 806 bp, Sorghum bicolor
  Clone ID: SORBI-28MAY03-CLUS5700_1
agcacgcgtgcgtccacgcgtgcggctcaatgctatccgaaaggcctgcgcctccctggaagcggagtaccaaccaaaggtgactcttgttgtggttcataagcgccatcatactagattatttgctcacaaccacaatgatcagaattcaattgacaggagtggaaacatactcccaggtactgttgtagattcgaagatctgtcatcctactgaatttgacttctacttgtgtagccatgctggcattaagggcactagccgtccagctcattatcatgtcttgtgggatgaaaacaacttctctgctgacgagttgcagactcttacaaacaacctctgttacacttatgcaaggtgcacccgctctgtatcgatcgttccaccagcgtattatgctcacctggctgccttcagggctcgtttttacatggaaccagagacttctgacagtggatcggtggcaagtggtcctgcaggccgtggacctcagtcagcatcccatagcactcgggcccctggtggtgcagctgttaggccacttccagctctgaaggataacgtaaagagggtcatgttctactgctgaggctaggctggggcgcttatggtaccctcacttgtaaatatgtttggagatcgtaataatctggcagctgctactttgggtgctgtactgttaccatttactgtactggtctacgtttcttcctcgagcaccatgtatgcactcatgctattgtgtccacggatcatgtatgcacgctgtaacatagtaataccctcggttgtgtgtgtatgtacgt

SEQ ID NO: 8804 - DNA, 1172 bp, Sorghum bicolor
  unsure (1)..(1172): unsure at all n locations
  Clone ID: SORBI-28MAY03-CLUS570_1
gcgttcgtgtacttctccttcccanaggcgcgggggggccgggccacgcgctcgcgtccggccgccacgcctgggccaccgtggacccccaccacccgcgcggaccgggcgccggtgccgcgcccgcgtggtacgtccgggcgtcgctcgcccagtccgcggggctccgcaccgtcgtcttcctcccgtgcaagggcggcgtcctcgagctcggctccgtcgtgcccgtccgcgagactcccgagacggtgcgcgcaatccagaccgccctcgctgttgcgccgcccccggcacgcgaggaatgcatgagaatcttcggcaaggacctctcccccagcggccgaaccccgcgcagcggcgacaattgggctccacagcagctcggcgtccaagccacggcgtccaaggaagccgccgccgcgagacccaaggctccggagccgccgcccaggagcatagacttcaccaagccgccaggaaagcccgagcagcaggccggtgtcggcgaggagcgggtgccgcggaagcgcgggcggaaacccgcgaacgggcgggaggagccactgaaccacgtggaggcggagcggcagcggcgggagaagctgaaccagcggttctacgcgctgcgcgccgtggtccccaagatttccaagatggacaaggcgtcgttgctcagcgacgccatcgcgtacatccaggagctggaggaccggctccgcggcggcggcgggtgctcggcggcgcgcccggagagccccgccgtggaggtgaaggcaatgcaggacgaggtggtgctgcgcgtgacgacgcccctgtacgcgcacccggtctccagggtgttccacgccatcagggacgcccagctgagcgtggcggcgtcggacgtgagcgtggcgacgacgccgtgacacacacgctcgtgctgcggtcggccgggcccgagcagctcaccgcggagacggtgctcgcggcgatgtcacgggggatgaccagcgccaccccctccccgtgactttctgtgtgtactgtagcggtagccgtaagtcgtaaccgcactcgcctcgtgcgtgcaactgccagtcgttagtgcaagttgttttttccttgtgactgcatgccggccacgtagtaaagccatagaaaatggaatggccaggattaaatttactgct

SEQ ID NO: 8805 - DNA, 667 bp, Sorghum bicolor
  Clone ID: SORBI-28MAY03-CLUS56975_1
gcacgaggcccagttggaatctctctctctgtatgcgccattgcggcgcccgtggggcccaccacggcgccgccggcagcgccaccaaccccctcctccacctccaccttcccaccggcactccccacgcctgctccacgacgcgtcgccgctcccccccccccccccccgcccccccccccccccgcccccgcccctcccccccccccccccccacctccccccccgccgcgccctccccccccccccccccgccgccccggcccggccgcgtgccgcccccccccccgccgcgcggggcggggcggggccggcgcgcctcgccccgctcgccgcgcgggcgcgccccccgcgccgcccccgccgccccgtccggccgcaccgcgcgccgcgccacggcttcctcctgcacctgcaccggcccatcccgccgatcgtggggcttcccgtcgcgggggcccaccgcaccgcttccgctggctctttcgccgcgtcttccccgcgatcgggtggcttccttactgggttgttcacctcaccacatttgatggatgttagggagcgatttcgcctggatggggttaatatttctgaagagaaatttttgaagtacttttggtggtgctggaacaagttgaaggagaagactgatgatgatattcccatg

SEQ ID NO: 8806 - DNA, 879 bp, Sorghum bicolor
  Clone ID: SORBI-28MAY03-CLUS58018_1
gcacgaggcaaaagcacgtgctctctgattatgcgaataatgaggggcacgagttgactatatgcatcctgaaccggttatatcgtgaggcagagcaggatcaagattttctttcatctacaactgctacatcagtttatgaatcctttcttctaaacatagctgaaaatcttcgagacatgtttccagcttcagataagtcacttggcaaattgctttgtgagataccatacttaccagaaggtgtgctgaaactgctcgaaggtttatgttctcctggaagtaatgagaagcaggataaggatattcagagtggtgacagggtaactcaaggtctcagtgctgtctggaaccttatcatgctaagaccttcaaatcgggacagatgtctggagattgctttgcagagttcaactcatcatctagaggaggtccgcatgaaggcaatacgtttggtggcaaataagttatttcccatggcaagcatttccaaaaagattgaagattttgcaaatgaaaaactaaattcagtgctggaagtgattccatctggtgattctgcaactactgaaatggctacacctcaagcacacaaagatgttggtttggaaaacttaacagctccagtggcagacgcgcaaactctgatgtctctatactttgcattgtgcaccaagaaacattcccttctcagacatgtatttgcaatatatggtaatctaccgcaagctgccaagcaggcagttcatcgacaagtaccaattctgatacgcacaataggctcctcctctgatcttcttgggatcatctcagatccaccagctgactgctgggacctcctcatgcaggttttacaaaccctcactgatgctgcggttc

SEQ ID NO: 8807 - DNA, 1117 bp, Sorghum bicolor
  unsure (1)..(1117): unsure at all n locations
  Clone ID: SORBI-28MAY03-CLUS58090_1
gcacgaggctggttctctcctgtaaacaagatcagttcaagctgcaccagttctgtctacattggcaggtttgagtttgacacagatttcatagccatcaaagtgttccatctggaagagcatggttgtctaaagagctttcttatggaatgcgaagtgttcagaaacacccgccatcgcaatcttatgaaagcagtgaccttatgctcaacagtggacatggaaaacaaggagttcaaagctatagttttcgattttatggccaatggaagcttggatatgtggctgcacccaaaattgcacaaaaatagccccaagagagttttgagcttgggccagagaataagaatagctatggatgtggtttctgctttggactacatgcacaaccaactgacaccacctctagttcactgtgatctgaagccagccaatgttcttttggattatgatatcacagctcgagttggtgattttggatctgcaaagtttctctcttcaagtcttggtagcccagaaggttttgctggcgtggaaggaactattggatatattgcgccagagtatggaatggggtataaaatctcgactgcgtgtgatgtgtacagtttcggtgtgttgctacttgaaatgctcaccggaaagcgacccactgacataatgtttactgatggtatgagccttcacaagttggtgagctcggcatatccaaatggacttcacgaagttttagatccctacatgttccaagaggaagaccttgtatttgcaacactaacgctgcagtgctatctggtaccgttggttgaagttgccctattatgtgccatggagcttcccaaagatcgacccgggatacgagatatttgtgcgaaaatattagagatcagcgaggcattcctcaagccccggtgtctttattgaataaggtccaacaatgtggacagtttatcatttgctataaactagaacatcttaaaggaaaaaagctacatttatgctcttcaatatactcccctctgcaaaaatgtattttcatggtccccaggagaaggatggttgctatgtttctgtaaagttattctcanaactaagttcaggtagttacttttacttc

SEQ ID NO: 8808 - DNA, 1304 bp, Sorghum bicolor
  Clone ID: SORBI-28MAY03-CLUS58100_1
gcacgagggtaagaagattggtgtaagcttgaagtgccgtgagccatgggggaatagggcattctggacaaacgccgctgggccgggttggaagttgagctttgcagttgagccatggactaaggactttagcacgtcgtgtgcagcgccatattctgctggagccacagagcatcaattgtcgctggatgagaagatggataactcctccgttgcatctgatgggaagtcaccagtttctgaaaaattgaagttgctatctggttcatgttacttgcctcaccctgctaaggaggcaactggtggtgaggatgcacatttcattagcattgatgagcatgtgattggcgtagcagatggtgttggtggttgggcagatctcggtgtcgatgctggattatatgctaaggagctaatgagaaattcattgagtgctataaaagatgagccagaagggacgattgatccgcccggggttttggaaaaggcttatatgagcaccaaagcaaggggatcatctaccgcgtgtatcatcactcttaaagatcagggtatccatgctgtaaatcttggggatagtggcttcgtagtagtccgagatggccgcactgttctcaggtcaccctcacagcagcatgatttcaattttacttatcagcttgagagtggaggtggcagtgatcttcctagttccgcacaagtatttcactttccggttgccccgggtgatgttattgttgctggcacggatggactttttgacaatttatacaacaatgagataagtggtgttattgttgaagcactcagggttggacttgagcctcagattgcagcacaaaaaattgctgccctggctcgacaacgagctacagacaaaaataggcagtcaccattcgcatcagctgctcaagaagctgggtaccggtactatggtgggaagcttgatgacataacagttgtggtgtcatatgtgaagagtgcctgagccccatgatccgagtctttcttttattagaatgtacataaatctttgtcctgaactggcgcatgtatgcaccggggcatagaagtgtattctcaaggtgtgaaatcccctgatcctagaagcacttgtgctatgtttagtatggttgccctttagccctggaatatgttagcaaaccattaccccatttacttgtttgccactgtgagaaatcttttttttataactccctgaaaccagggggtcgtttccctggaaccaaattttgttgtaaacagtatcgattgtccaatgatagttatagaagaattggcct

SEQ ID NO: 8809 - DNA, 865 bp, Sorghum bicolor
  Clone ID: SORBI-28MAY03-CLUS58119_1
gcacgaggatcgagaaaccagcaaacaaccgagaagacctgcggcggctgcgtcggaagagagaacttcagcggtgaaaggagagggaaaccaccatgctggaccatctcgtcgggctggtgaaggtgcgcgtggtgagaggggtgaacctcgccatccgcgacctccgatccagcgatccctacgtcgtcgttcgcatcggcaagcagaaattgaagacacgggtggtgaagaagagtaccaatccggaatggaacgaagaactcacgctctccattgaagaccctgcagttcctgtcagactggaagtttttgacaaggacactttcgttgatgatacaatgggtaatgcagaggtggacatccgcccattagtcgagattgtgaagatgaagctccaggatgttgctgacaaaactgtggtaaagaaattggtgccgaacagacagaactgcctagccgaggagagctcgatatatatatcggaggggaaggtgaagcaagacctggttctacggctaaggaacgttgagtgtggggaaatagagctccagcttcattgggtcgacctccctggctctaagctgacaacatagacgaagggtgtatgagggaggctatgagctctgccttgccagccctgctgttttcagggatccccaactctttgctgcttgaaaagaactagtggtttgcatgcgcttgcgtggagccattagttgtttgtaaggagttttggttggcgtttagtaaatagcgtcagggaaatgtatgtgcatgaacgtttgaaaatcaagactatataaaatgtatacaatgcatgtactaagtttatttcgtacacatgatgatccccatcccagtt

SEQ ID NO: 8810 - DNA, 1154 bp, Sorghum bicolor
  Clone ID: SORBI-28MAY03-CLUS58175_1
gcacgaggccctcatggggttcaagatggggaagaggagctcgataggaagcaaggaggccgttccagctgaggtggaggccacgtcgccggcgccggcgccggcgacaccggagtcagcgacggagaaggagcgcaagaacagctgggagaagcacgggggggagagggacataaggcaagggatcgatctagccaccacgctagagcgcatcgagaagaacttcgtcatcacggatcccaggctccccgacaaccccatcatcttcgcgtcggatagcttcttggagctgacggagtacacgcgggaagagatcctcgggaggaattgcagatttcttcaaggggcagagaccgacatgtccacagttgataagatccgggaggctatccgggaacagaaagaaatcactgtccagctaatcaactacaccaagagtgggaagaagttctggaacttgttccacctgcagccaatgcgagaccagaagggagagcttcagtacttcattggtgttcaattggatggaagcgaccatgttgaaccccttaggaatcgtctctctgagaacacgcctcctcagagtgctaaactggtcaaagctacggcagagaatgtggatgaagcagtcagggagcttcctgatcccaacctgagaccagaggacctatgggacatttactcaaaatatgtttccccaaagcctcatagacgttacaactcttcttggattgcgatagaaaagattacaaaatctggggagaagattggcttgaagcacttcaagcctataaaacctttgggttgtggtgacactggcagtgtacatttggtggagttgcaaggcagtggtgaattatttgcaatgaaggcaatggacaaatcggtgatgttgaaccgcaacaaggttcatcgagtttgtatcgaaagagaaatatactcactattggatcatccttttctcccgacattatatacttcgttccagacaccaacacatgtttgtctcataacagacttttgtcctgggggtgaattatttgcactacttgatatgcaaccgatgaaacttttcagagaagaatctgcaaggttttatgctgcggaggttgtaattggtcttgagtatctccatttccttggaataatatacc

SEQ ID NO: 8811 - DNA, 813 bp, Sorghum bicolor
  Clone ID: SORBI-28MAY03-CLUS68171_1
gcacgaggttcttcttcactctcccaagtcccaagcgcgcaaccgtctctttcgttccctgcccaactttccacttcaccgccatgtgttcggccgaaatcccagccgcaccacctctctgtcgtctcccattccctgccgccggcctgcgcgagccgcgctgccgagggcgtgaggctggagctgcgcatcaccgaccgccgcgggctgctcgcctacgtcacgcgcgtgttccgggagaacagcctctcggtcacgcacgccgagatcaccaccaggggcgacaaggccatgaacgtgttccacgtcaccgacgtggccggccggcccgcggaccccaagaccatcgacgaggtgatccagaggatcggcacggagagcctccgggtggacgaggagcggtggccgcgcctgtgctcgacggagggcgacgcggcccgcggcggcggcggtgcggggatcttctcgctcgggagcctcgtgaagaagaacctggccagcctcggcctcataagatcctgctcgtgaggacgccatcaaggggggggcacgtgctcgctcgatgggatggatccttgtgtaaatatgggatggtgcgtgggttaggatgtaaatggagtaggatttttaatttgccgtttctaggttttagttgccacgtgtacatagtagcaagtggagatggaaggttttaaaagttgctggtcggcaacagcttggagcttaatggacctctctggtgggtcatgccacattgccatgccatttatctatcattctaacttttttacataaaaatagatggatggaaga

SEQ ID NO: 8812 - DNA, 1099 bp, Sorghum bicolor
  Clone ID: SORBI-28MAY03-CLUS68196_1
gcacctggctcacctgcctctccggggctcggttgctcggccactaccgccctctggttgggccccttcccgtcagtgtcgtgcccgcgggctcgtccctgtcgggtcctcgggcctctgccgcgtcgcccgagcggggctctcgcaaccgcccctcttcgccgcgcccgcgccggtggcttggggtgccctactcctttgcccctttcggccccggggggctgccctccctccgcgcgctcgccagctgttggcgctgccccccccagtggtctgatgcgcgccatcgcttgccccctctccgctgtcgggctgccccggcgcgcccaccaggtgcccgctgtcccactccctgtgctggtcctgggcctcgctggtgttgccgccatccgctcccctcccgtgtcccagggcccccgtactacttgcccagccaccaaggcctttctatctatctatctatctatctatctctgtccctgcagagtttccggggttggttatttctgccattatcgttgattggtttggccggaaagctacaatgtggatcttgctgtttggatgctgtggtttcctcggacctctggctgttcatcagaaagaggcactgacaaccgctcttctattcggtgctcgcgcctgtggcatggggagctctacagttttgtgcctttatgcaccagaggtgtacccaacatcagcgcgctcaacaggtgttggcattgccaccgccattggtaagattggcggcatcgtttgcccccttctcgctgtcgggctgctccggagctgccaccaaatggaagcagtcctagtctttgagctggtcctaggcctcgcaggagtagcctgcatcctcttccctgtggagaccaagggccgcgagatgaaatgatcggcagcacgccgcgagatgaaatgatcggcagcactttgtttgagctccaaatgcacccaaaatttaagctaccactaccagcgtccatcatcagtgtgtactatatatatatatatatatatatatactgtagctggctacaaaataacttattttgttgccactttaaattacgataattactatattaatttacaa

SEQ ID NO: 8813 - DNA, 666 bp, Sorghum bicolor
  Clone ID: SORBI-28MAY03-CLUS68207_1
acacccagcagcaacgaccaacgagctagtagtcatcactctctcacacacacacacacgctcaccatataaacaaacaagtcatggcttccgctgcacagaagaagatggccgttgtttgcttgatgctgctggccgtcggcctaatggtcgatgctaccgacaagcccaccagctgcaccgattcggtgaagaatgatagtcctccggacagcgactgcatctgctccaagaactgcgcatgtgccggtaagtgcatccttatggagcctgccagtgttcagtcctgctttatcgactgcgtcctcaaaaacgactgcatctgcgaggacaagaagaacggcgctgaccagccgcagtgaacactaagaaatctcaagtgagcatgcatgcgtgtgccctgctgcctgcctatatatgcatgaattaatatacatctaatgcaggcatgctccaacttgaagcaataaacttattaagtatgtgttcgtctgtaataatgcatgcatcatgtgcatgccgtgtctttgtctgctatacttatgattgtactcgaagtttgtaataaagcgccgcacatgacggctggtatatatgtctgtatgatgatcgagcgagtcttcctgtgtcccgcttgttttattttcatatataaaatgtgtgtgc

SEQ ID NO: 8814 - DNA, 1071 bp, Sorghum bicolor
  unsure (1)..(1071): unsure at all n locations
  Clone ID: SORBI-28MAY03-CLUS5836_1
gcacgaggcatggttgccgtctgcctcctcgagctcgtcccctttgccgagatcgatgccgctgcgctcgcgcgccgcctgcagtccgaaacgtcgtccgccagcgaggccgagcgtgctgctctggccgacctcgctgcggagcttgggggctccgcgcccgctgcggttgctcttgcgctccgtcgcatcgcggaagacagcggcggattgcagatcgaggaggccttcattgggggcaagcagatgactatggtctgggccatcgaccggagcaagcttctcaaagagctaccagaatccgcctctgtgatccaaatgcaacctccgccaactccacaggtggctcccaccgatactgatactaacagcgccatcataccaaggcctccgccactgcagcagccggatatgtggggtcacccaatgccaccgatgttcccacgccccaggggcatgccaatgccgagaatgccgccagggttgatgccgctgcagcgaccattcatggcaccaggggcagttatcccaatgggtggtggtcctgggccgagttccgcacagctgaagctgaggacagaggaggatgatcttaaggaccttgaactgctgctaaacaagaagacatatagagagaagcagaatacaaagactggagaggagctgctggatcttattcaccggcctacagctaaggagactgctgtcgctgcaaagtttaaaacaaagggtggctcccagctgaaggaatactgtaccaacttaactaaagaagattgccgacgccaaacaggttcttttgtggcctgtgataaggtccattttcgtcgtattatagctccacatactgatacaaacctaggagattgctctttcctagacacatgccgtcacacaaagacttgcaagtatgtccactacgagcttgatcaaacaccagatgtacctcanatgatggctggtgctgtcgcaccacctaggcaaataaagccacagagagctgaatattgttcagaaatagagcttggagaatcgcaatggataaactgtgacattcggaacttcaggatg

SEQ ID NO: 8815 - DNA, 1352 bp, Sorghum bicolor
  Clone ID: SORBI-28MAY03-CLUS58371_1
ccggacgccgtcccagtgtccccacccaccgcggtctccacgcagccacgggcatgtgggccctcaacctgaaggccggtgggccttgcctcacgccgaggcatcgccagcgggcggcgcggttcccgcttgccgccgggatcggctcgctggctgtggggccgacgaggcgcgggcggcagccggtgcggtggccgagtttggcggtgagcgcgtcggggtggaagggcaacaacggtcgagaggacggcgacgagcccaggaacaaggcctcctcttctggaaaaggtgatgcacctactcccagtggagatgcttccaatggaacaacccaaaatcagggcgaaccaaaatcaagtgacacgatgtatatacctagcaacttgtcatattggcgagatgtgagagcaagctttgtgattccaaagttggagcaaacagtagatgcaaatagtccacaacagacagctcaggatggatcagtatatcatcttccccgaaagtgggctcattctattcctatgccagagtctggatgtgtgttggtcgccactgaagagcttgatggcaatggaacctttgagaggactgtcatccttctcctaagactaggttcaagagatgcctatgatggcccgttcggtgtcatcctgaaccgtccactgtacactaagatgaagcatgtgaacccatccttcggcgagcaagcgacaccttttggtgattgttccctcttgtttggaggccctgtcgatatgagcatattcctgatgaggatgaccgagggaagaccgatcaaggggtttgaagaggtggtacctggcatctgctttggcttcaggactgacctggagaaggccagtgctctgatgaagaatggcacggttaatcctgaagacctgaagttctatgttgggtactctgcttgggaacatgaccagctgctgagtgagattgatgcaggatattgggtggtgacttcctgcagctcaggcttgataaccgacgcgctgacaatggacccctcctgcttgtggaccgagattttgcagctgatgggaggccaatactcagagctgagccaaaagccgaagcaagatggcatgtgaactttgcttgcttgcatcctagccatttgccacggtccctgtggccaatctgtacataatttgagtaatcgtcggctgatcttagccagtgtgattgctctgctcgatgtaattgcatatgtggactgctttgtcttgtttttaaccttgtgaaagaacgatgcggtacttgagcacggcaacgcctgcctgcctacttgctgtgcccaaagctgaaactttttatctggtgcgtatgctggc

SEQ ID NO: 8816 - DNA, 973 bp, Sorghum bicolor
  Clone ID: SORBI-28MAY03-CLUS58383_1
ctcccatctccgcctccgcttgcttgctgctgccctgcccctgctccggctgggacgagcctcctctcctccctcctcgtcgcgtcccgcataactgtgcctgctgctcctcgccgcgccccaccgctcagcagcccacactgccccgatcccgccgaagtgcccgcggcgcccgcacacgcgcccttgcctgcgccgaccggccgccggcgaggggtgtgggcgcttggtcgacgtgacctccgcaggcgcgcttggtgtcttcgtcgtccggctggtttctcgccagcctcgctgcccgcgagtggcgtcgtgtcggcggtccatgccggcggcggtgcgggaacaaggcgagggcggcgcgccttgtcgccgtgcggactgacatgacttgagccttgaggtgcgtgcggttgctggctaacctgctggaaataacatgggtgataaaagggaatgggaatggggtcaaattcaggagatgatactcatactaccagaattttatcaaccaaatcaagaagctgaggtccctgttctaattttgtgaaaaacgggcatgtgtcaaatctggttcggtaactgttcactcatcgccctcttcgtcgccggtgtacgcggtgccgaatcggcgtccggtatccatcccaccgaagcacgccaaccaccccgagcgctctaccctcgttgtgtttgctgatgctgcctcccctcccttaattggtatgtcatggcgtggaatgggagattcatccagacttggataggtttctttctttgttaaggatcccatacttgcttggaggaattttcctggagtggggttttgttctaggagatcttctgtgcgatattaggatgtgtacagaggggctgtattcttgtgtataggttctctttctattgatcaactcttgctgattctgacggaatgttggagggtcaatcttggctgatatcaaggtcgctgccg

SEQ ID NO: 8817 - DNA, 909 bp, Sorghum bicolor
  Clone ID: SORBI-28MAY03-CLUS5845_1
caccaaccccacaccacactactccaccgccgttcgaatattccaagcttgaggggaggagagccgagcgcagaaccctaattgcctctaccgattgctaatcagtggcgctcaggctcggtcccagggatcggatcttccgagtgtgacggaggggcagtcccaggcacggcggcggcgtcggcggctccccctcccgcctctcgccagtcgcctcgagccctcacctccgtcctccgcgcaccggccggcgaccctgcctcagacctcaataggcaacggaggtacaatgccaagagcaaatgagatgttgagggcagattcaagaatgatggtggtctttggtgccttgacgtcgaaaccagagcagctgacatttgaagactccctcagatttgtcaagaaagtgaaggcccgtgattacatgctgtacttgtcattatttgacattcttggaagaatggaattgtcccagcttgatgcctaccgagagttacagctgctgtttcaaaatcacccagatctgtgtgaagagcttgagaagttcagaccacctgtgcctataaagcaggcgacaaacaacatttggccctgggtcattgtttgtgctgtcccattggttgcagttagcctgatcccggcgcttggaaacccagtactgtggtttgttcaacaaactattggtgaaaaaatagccgtctgattgaagaaccactgcagtgcacatatgtgccatcacaattgaattaatatcatctttatatatttatatatatgtgtatatatatattcgagtagtatcctggaaggaaaacttgtgttcttggtcatcaagtaccactcagcaagaaatttagtcggtacttgctgggagcgcaactgtgcaagcccaccaaacattacccgttg

SEQ ID NO: 8818 - DNA, 724 bp, Sorghum bicolor
  Clone ID: SORBI-28MAY03-CLUS58454_1
gcacgaggcaagagcaagataatcagaaggggaaacaattccagtggccaatggctcgggggccagcaggatatgatgcgccgaagcaaaaagctaaagagatgaatgacacggaagggaccccaaaatccccaaagatttctgaagagtctcctcaatcacccaagatcaagatcattcccctgtcttggtttgagaatggtcatcatcatgatcagaaactggctgccaaaaatgactctggagaccacaacaaaagatcagcagtaaagaaccaacctgtgcttactaataatgaagatgaagatagcatgacactggaaggaaaccctaaaactacttcagctgtgcccaagagcataaatgatgagaagaaacctctaagggaaagctgcaagaccattccagttgtgccagagaaagagattaatgaaaagaaggccagtacttgcagaaccattccagtcatgaaaggaagtgatgagaagaagattggcatgaaggaaaagaaagaggcaaaggagacgaacagtgttgaaaaggtagaagagaacaggaaaacaaaacacagtgactcatcaatagctaagcattcaaaattgcccccagtatgcttacgtgtggatcccttgccaagaaagaaacctggaaatggttcttctaggtctcctagcccaccaacaaggaaggatgctgacagcgcaaaggacatgaagaacccgca

SEQ ID NO: 8819 - DNA, 699 bp, Sorghum bicolor
  Clone ID: SORBI-28MAY03-CLUS58468_1
gcgggagcgagcttcctctcgaccgcgccgctcgttgcccgcggcgtcgctgcctgctcttccatttcgactccgacgcggaggcacccgcacattcgagtttgctgccgggctgacgctgagggctcggaggctgctgctcatgaagagcgtctgcgattccgccggagagatttcattggcacctgcgtcgggagcgccattggtttggaattgatcgacggttctacaagattctctggagtggctactgcagctgatctcattgagcgtagacaacggtcggagttccagtcaaaaatcaaagatacgctctacgtagccataaaggctaagccagagctcgttccatcattgttgaccttggcactgaatgatgccatgacatatgacaaggccacaaaaactggaggagcaaatgggtctatcaggctagaaacaagcagacctgaaaacagtgggctctctgctgcattggatttgctgactgaagccaaaaaggagatagattccttttccaagggaggtcccatttcatttgcagatctgatccagtttgcagcacaatcagcactgaagagatcatttcttgacgcggccattgccaaatgtggtggaaatgaagagaagggaagaaccctatactctgcatatggttcaaatgggcagtggggtctgttcgatagaacattcgggaga

SEQ ID NO: 8820 - DNA, 953 bp, Sorghum bicolor
  Clone ID: SORBI-28MAY03-CLUS57812_1
gcacgaggctgatgtttgtcgcagcagagccttttgaggacgacttgatcatatcagtagaagaccgtgtagcacaaaacaaagatgaggtgattggtgaaactatcataccactcgcaaggcttcccacgcgggctgatcacaagccggtacggccagcatggtttgatttaagaagaccaggaataattgatgtgaaccagctaaaggaagacaagttctatgcaaaggtaaaccttcgtgtttgccttgaaggtggttatcatgtgcttgatgagtccacacaatattgcagtgatctccgtccaacaatgaagcagttgtggaagccaccaattggcatgcttgaagttggcattttaagtgcaaatggtctcaatccaacaaaaaccagaaacgaccgtgggtcgtgtgatgcatattgtgttgccaagtatggttcaaaatgggtccggacacgcacaatagttgacaacttgagccctcgattcaatgagcagtacacatgggaagtctttgatcatggaactgtactcacaattggtctatttgacaactgccacataagtggagataacaaccacggttcctcaggccacatggataaacccatcggcaaagtgagaattcggctttcaacacttgagacgtcgcgtgtgtacacacactcatatccattgctcgtcctcagcccatcaggagttaaaaagatgggtgaactacatcttgccatccggttcacaacatcatcccttatcaatgtgctctttacatactctaggcccctcttgcccaagatgcattatgcacagcctctgtcaatagttcagcaggaaatactccgccaccaggctgtgcagcttgttgcgcagcgcctgtggcgcatggagccaccagttcgcaggcaagttgttgagtttatgtcagatgctcgctctcatctgtggagcatg

SEQ ID NO: 8821 - DNA, 1341 bp, Sorghum bicolor
  Clone ID: SORBI-28MAY03-CLUS57823_1
agcccaaaatcccagggagcaggtcctcagcccagccccctcgctcgccggcgtgccccacccgacctcgcgacctccgccctccccctccagcctacggcacctgcgccaggtcgccagcgccaggggcccttcgcggcttcgccaacccctgtcggccagcactgctgtcggtgcctggtgcctgcccccagctccagcggcccttgcacatcacggctcacgaattgcaagaactgcatttgtcttcagggcagctcagaagctaaccctcgggctcacggttcacgatggaaagaacaattaattccttaatgtacaaaggatctattcccgatgcaattaatcaatcaagaagggagaagaagctctttgtagtgtacatatcaggtgaagatgaggcttcgggtagtttggaacagtcaacactgattgatgaaaatgtggttgaagtgattggtagatgttgcatcttattgcatctcaagcaaggcaatgttgatgcatcacagttttcagctatctatccccagaagtctgtaccaagtatatcagtgattggactgaatggagttttgctgtggaatcatgagggatatatcaactctgaaaatctgaaagaaagtattgagaaagcttgggctgcccttcatctacaggagacagcggcgaccttgttgacagcatcgcttgcttcaagaaatgttgaatctgtgaatactgctactactgttttgctagctcaagggagctcttctactttagaaaatccttctgatttatccagtcaatcaccagatgtttttggtgccagtggagttgcccattcaactgatctggtgtcacaagttcctagtagcaccaccctttatgaacctcttgagattaatgaaagagaagggtcaaaatcagactcgggtgatagaactgttgaggagctaggttcaacaagtactgaatttagttgtgatttggttgatagttcaaggaagtcaaatatggtcagttctgcagatccaaaaggagaatacattacagcatcagtgaaaagaaagaacaaaaatgatggaagtcacacttctgtctccttggaggatactcctagtacactcactaatagaggagtttcttcccagtcacttgtggaacaagacaaggcaacaacatctgccccacctcttatttttgtgaagtcagatgatattcagcttagtattcgtatgcccagtggaaatagactggagatcaaagtaacaaaacaagatgttttaaggaaagtgaagaattttgtggatgaaaacaaaggcaatgagcttagctcatatgatctttctctggttt

SEQ ID NO: 8822 - DNA, 806 bp, Sorghum bicolor
  Clone ID: SORBI-28MAY03-CLUS57961_1
gcacgaggctattcctctctgaacggcggctgttctgtttgcatctcaaagcatctcgagagagagagagaggaaggagaagagaagagaaccacgcacgctgttgctccaagtcccggacccgagtgacgctctgttttccctcgacgcgacgcagatgcccggcggccaagcacgccgcatccgagcccagtcaatcaccggagacgaaagagaaaaagcaggtggagagggaggggaggggatccattccatggttggttgggagcaccgcccggggcttcagtcgtcatctgccagatatcagtcagtctgtgtgctgctgcagaagaaaatgaaactgagaattctgccttagtagtgggggcggttccacatcggacggatcaatgtcacccatcagtcgagctatatcatccaatgatattggttatctctgattatcccatatatcttctcgacatatgctgtcaactgttgcttgaaccgaagtgctggatattttgcctctaccattgatgcagtgtcaggccttctcaccattccactgtatccactaggtatgcctaatcctgatgatgcccgagcactctgaaatgaaagttatggggtgtaagctcatgtttatgatgtgaacatcagtcctcggtactaaatgaaagttgactagtgaaatcttgacgagaagaggaatacaaaatacaaaacacattctatctttgaatttcaatgggaggcttgaactatggcctcaaccactacgacattgtgctctaccagtctaccagtggccttggcctatatgg

SEQ ID NO: 8823 - DNA, 1068 bp, Sorghum bicolor
  Clone ID: SORBI-28MAY03-CLUS57982_1
gcacgaggctcctctcgagctcgacgggacggaaggaatcccgggcggcgggggccagggggagggagaagagcagccggccgtggagggtaacggctgcccaagaacctgaccgaccggaggcaggcaggcagggaggaggtgagcgagcggcggagagatggggcaggccctgcgcaggctcttcgattccttcttctccaccagggagatgagggttgtgatgcttggtctggatgcagctggtaaaacaactatactgtacaggctgcacatgggagaggttctttcaacagtccctacagtcggttttaatgttgagaaggttcagtataagaatgtggtattcactgtgtgggatgtgggtgggcaagaaaaactcagatcactgtggaagatgtacctgagtaattctgatgcactgatctatgtcgttgattctttggacagagaaaggatcagagatgcaaggcaagaattccagaccattatcaaggaccctttgatggcaaacagcataatcttggtattcgcaaacaaacaggatctgagaggtgcgatgagcacggatgaggttagcgaaggactggggctgcatgatctcaggaacagaatatggcacatacaggggacctgcgcactccgtggtgagggcctatacgacgggcttgactggcttgcgtccaccctgaagcagttgcaagaatcgggtcatgcaacttcggttgctggcccttccatctaatccagtggaagtgagctcagtgcctcaaccaactgacagggctcctgccatgattcgccacaagcccacaagaatatgctccagcacaagaattccttggtgtggctgcccgctgatggagttcctttgtgttggtatcatatcagccagttcatccggcaggaactcacatacctttctcctgagattgtttgtaaattgttgaacgaatgtaatgccgacattgttgatcttgtgtgtatacttgagggctggtgcacgtggttgtgtttgtttgttgtttgactgcttcacaataaaagagatcctctgtgattctggtg

SEQ ID NO: 8824 - DNA, 749 bp, Sorghum bicolor
  Clone ID: SORBI-28MAY03-CLUS58008_1
gcatctcgattatctcccgagccgaccagcgaccagcggcgccagaacccagaaggttcgctcatggcgctcacgtccatgctcccgttcgcgccctcgaacacctcgctatcctactcctcccgcgcctcaaccgccgccgcgttcgctcctcgtggggcccacttcgccgcgtacggaaggagcggcggcggtggcgcccaatcactggcgtgcgccgcgcctcgccgctgcggacgggctccgcggcggcgccgcggagggggcctggtggtctgggcgtcggccgactactacgcgacgctgggcgtgccacgcgccgcgagtaacaaggacatcaaggccgcgtaccggaagctcgcgcgccagtaccatcctgatgtcaataaggagcctggagcaaccgaaaagtttaaagagataagtgcagcgtatgaggtgctgtcagatgaaaagaagagggcgttgtatgaccaatatggtgaagctggggttaagagtgcagttggaggccccggtggagcttacacaactaatccatttgatctgtttgagacattctttggagcaagcatgggtggcttttctggcatggaccagagctcgtttaggacaagcaggcgaaacactgctgttcagggtgaagacatcagatatgatgtgattctggggttcacagaggcgatatttggaacagagaaagatattatattatctcatttggaaacatgcgatacatgtggtggttc

SEQ ID NO: 8825 - DNA, 595 bp, Sorghum bicolor
  Clone ID: SORBI-28MAY03-CLUS58881_1
gcaccacgaggcaagctagctacagtcgtagttgagagcagtacgtacgtagttgaagactccaattattagcgaaggagaaggaatggcgttcgtccatggcgagcaagagggtgaggacatggtcggagctttcgcccttgtctaccagcacgtcttcagctacatcaagacgatggcgctgaaatgcgccgtggagctcgccatccccgacgccatccacggccgtggcggcgccgccaccctcgccgagatcgccgccgacacgggggtgcacgagtccaggctcgccgacctgcggtgcctgatgaagctgctgaccacgtcggggctattcagagccaccgccgcggacggcggcgaggaggtggcgtcgtcgtacgcgctcacggcggcgtccagcctcgtggtcggcccgcgcggcctgtccaacatggtgcgcttcgactgcgggcccgtctcgctcaccccgttcttcgacatgcccacgtggctccggacggcgccggggccggaggcccccaagtcgctcttcgagctcacgcacggccgcacccggtgggacccagccaacgccgacaacgacaccatgatc

SEQ ID NO: 8826 - DNA, 662 bp, Sorghum bicolor
  Clone ID: SORBI-28MAY03-CLUS59000_1
gcacgcgcggggagaagctaataatatgtacctgaatagcgtgcgcgcaagtgcccatagctgacttgcatctgatcggtgtcccgatggaggccgctgctacagcaggtgctggagatagttcctttgagccatccctgtgggatgacttctttgtgtcctacacccctccttgctcacagatgtcggaggagtggatgagagagagggcagatgaactcaaggtggaagtacatcgtatgtttgaagctgtggatgaaatgcgtgttgctgactcgatgattcttgtggatgcactccaacgcctcggcatagacaaccactttcaggaagagattaacacaacaatgaggcatgtatacactggggaactagagatgccaagctccaaagaactgcacatggttgccctccgctttcgtctgcttaggcaacatggattttttctacctacagatgtctttgatgagttcagagatggtactggaaatttcaacacatgtctaaccacggatccaaaggggcttgtgagcctgtacaacgcagctcacatggcggtgccaggcgaggatgtcctcgatgatgccatcgccttcaccaggacgcatctcgtggcaatgaaaggcagtcttgtttttccaattgcggaccaaatatctcgt

SEQ ID NO: 8827 - DNA, 1099 bp, Sorghum bicolor
  unsure (1)..(1099): unsure at all n locations
  Clone ID: SORBI-28MAY03-CLUS59062_1
aagtgagagcacagatttcttcctcctcttgctcctgctgctgccgctgctgctgctgccgtttctcgttcctgttcctctttgcttgtgggtttgtcgcagataaacctcgcataaagcttcgttcgttcctcggttcttgatctcaatcggccgggctcctctgtttccccgctccaagatcttccccggccctgttcttctgtctgcagccagcccgcggaaatccttggaggagttgcagaaatttgtagcgggagaggcttccgtttcctgcggcggcggcctcggtgcggttcttgatccgggggagcgagctcacctgggtcgcgccaatgcagccggacccgagcggcgacgccggcnatgcgaaggcgaagctgccgctgccgcagccggtgacggctccggcgccgtcgtcggggcggccggcgtccgtgctgccgtaccagacggccaacgtgcgggaccactaccgcatcggcaagaagctcgggcaggggcagttcggcaccacgtaccagtgcgtgggcaaggccgacggcgccgcgcgcgcgtgcaagtccatccccaagcgcaagctgctgtgccgggaggactacgaggacgtgtaccgcgagatccagatcatgcaccacctctccgagcacccaaacgtcgtccgcatccgcggcgcctacgaggacgcgctcttcgtgcacatcgtcatggagctctgcgcaggcggcgagctcttcgaccgcatcgtcgccaagggccactacagcgagcgcgcggccgcgaagctcatcaagaccattgttggggtcgtggagggatgccactcgctcggcgtcatgcaccgggacctcaagccggagaactttctctttgccagcaccgccgaggaagccccactcaaggccactgactttgggctctccatgttctacaagcctggtgataaattctctgatgtcgttggaagcccttactatgtcgcaccagaggtacttcagaaatgctatggtccagaagctgatgtgtggagcgcaggggtaattctgtacattttgctttgtggtgtccccccattttgggcagaaactgaggctggaat

SEQ ID NO: 8828 - DNA, 822 bp, Sorghum bicolor
  Clone ID: SORBI-28MAY03-CLUS59177_1
gcacgaggcgaacctctcctgtccatggcagcagccccgccggcgccggctccccaccaccaccaccaccaccagcagccgtcgtcgtcgtgctagtcgcctgctagtgctagatgcatgggggccgcctcccgccgcgcggcgccggcgtggcggtcgtcgtgcctggcgctgtgcctgctgcccgtcgcgctgccgctgctgctcctctgcctcccgctgctcttcgtcgccgtggccgtcgcccgcttccgccgacgccgccggcggctgatgctcatgacgacggcggcgggcaagagcaggagctgctgttgtcccggtgagcggtcgccgcacggggaccaggcccaccgcgccgcgctgctgcacaagtacctcgaggaccagatggagctcgtgggcgccgacgcaggggccggggaagcccccgcccccgacccgacgccgagctcgcagcgaagccacccgcagcagcagtagcgtggggagctgctctgctgattggggcggcgcaggaagcagagctcggtggtggtgactacggctacgggcggctgatctgattgatttagaggattcttggtgttcttgcgtcactctgttcgtctcttgggaaggatgatttgtttcttcatctttttgcatttctgtatgtagatttcgggaggatttgcgttttgtgtatgagaaagtgagaatcagagtcagagagatgcactgacaggagacgcacgagatcatgttcctgaattcttgtcaggtgtgactgtgagccaggcagctaaaactcggtgaatggattcagctgttaactgactg

SEQ ID NO: 8829 - DNA, 649 bp, Sorghum bicolor
  Clone ID: SORBI-28MAY03-CLUS59213_1
tctgggttctaccctcccccgtcttctccctccctcgaagcactgcacggccgccgccccgcgcaggtgtttccttctgctgcagcgcctttattgcactcacctgccctgccaacgtcttcaagctccagcagtggaaggcggcggcggagctagcatagcacaccaagcggcgacacgacgtgcccccagctgccacagaaatctacatataattggagccccaaccaccttgttcctcttcctctgcttcccccttccccagctagcgcctagtagcccccctacaccgtcgcgactgtgtaatcaatcaatccgctttcctagctcctactcgccggagaagagaaggacacgccaaggagccgcggacctgctagtgctacctgcctgctcccttcagttctcagagtaaaagttccctgcagattcctctgacctgctgcatgttgggtttgagttccacaaggctaccgtaacaagtgtggatatgaattggtgttgtcttcctagtagaagagccaagaaagaagagaatccttactccaacagcataggcggtatttattctgagaagaacataaggctcttctcctatgctgagttaagatctgccacggacaacttcaaccgcacgaacaaagtaggc

SEQ ID NO: 8830 - DNA, 686 bp, Sorghum bicolor
  Clone ID: SORBI-28MAY03-CLUS58181_1
agcaacgctgcagaggcaaacgcgaaaccaaggcacaacgaggcagcgcgagccagatctcgcgtgcccggctgcggctgtgaagccaagcatcatcagatcggacaacgggacaaggcgccggagctccagcaatccaccggagtagaagcggcaggccggcagcagatctccgagcagagcagagcagagggataggagtagccaagggcaaagggcgtcggcgaagatgctgccgacgaccgcgtccaaggggcgcggggccgcccgctccgccccgccgctcctcggcccctacctccgccgcatcgtcaagtggcaacaaatggatattgaatacacattttggcaaatggttcatctctgtacttcaccaaaagtagtctatcagcacaccaagtatcacaagcaaacaaagaaccagtgggctcgggatgatcctgcatttgttgttattctgattcttttcctcgtgtttgcaacatcagcttactgtgcagcgtatggagagagtgcctcacatgctgctctaacaatcacttcagttgtgtttctgcatttcttgtttgctgggatagttctggccacactttgctggtttcttacaaattcttacttgagagaggaacctaacagccatgttgttgagcaacgtgtagagtggctctatgcattcgatgttcact

SEQ ID NO: 8831 - DNA, 437 bp, Sorghum bicolor
  Clone ID: SORBI-28MAY03-CLUS5821_1
cccacgctctctccgacccaagccggcctcctcatcgcatctcccgtcctctctatgcagcagcacatcgcatcgtctcccctccagcccagatctgagatgcaccctaagatgggatctggcgtcacgaggttgcccaagatcaaccctcgcgtcttcttcgacatgaccgtggccggtaagccggtgggtcggatcgaaatggagctgtacgcccccgacgcccccgccgccgtggagaacttcgtcgacctctgcaacggcgggtgtgtgggagacagcgggaacaaactccactacaagggctccgtgtttcacagcgtcatccccggttacatgtgccaggggggcgacatcacccacggcaacggcaccggcggcgaaactgtcttcaagaagccgttccgcgacgaaatcaatcgggagctgcaacgggt

SEQ ID NO: 8832 - DNA, 991 bp, Sorghum bicolor
  Clone ID: SORBI-28MAY03-CLUS58227_1
gcacgaggccggcatgacccgtgacgaccttttcaacacaaacgcctccatcgtccgcgacctcgccaaggcctgcgccgagtcgtgccccgacgccaacatcctcgtcatctccaaccccgtcaactccaccgtccccatcgtctccgaggtcttcaaggcccgcggcgtctacaatcccaagcgcctcttcggcgtcaccaccctcgacgtcgtccgcgcctcccgcttcgtctccgagatcaagggcaccgaccccaaggacgagaacatcaccgtcgtcggcggccactcgggcgtcaccattgtccccctcttctcccagagcaaccaccccgacctgagctccaacgccgagctcgtcaaccgcgtccagttcggcggtgacgaggtcgtcaaggccaaggacggcgccggctccgccaccctctccatggccttcgccggcgcccgcatggccgagtccctcctccgcgcctcccagggcgagaagggcatcgtcgagcccaccttcgtcgactctcccctctacaaggaccagggcatcgacttcttctcctccaaggtcgagctcggccccaacggtgtcgagaagatcctgcccatcggcaaggtcgatgccgtcgaggagaagctcctcgaggcctgcttcgccgacctcaagaagaacatcgccaagggtgtcgccttcgttgcccagaacccccccaaataagtgcatcaccacttcgctcccttgagcaggttccaccaatctggggacaccttgttgtagtagatggacatggttgagtagggttgaaaaaaaaaaaaagcaactaaaccgaaacacaaatctctcctggccccatccccggtaccaatcgcgtctgggtgtacggccgggaggggaacgacaggtagacgcggaggcgcaaaaagtcgtgctttcctactcgcggcatcgactttgggtctgcctctgtaccatagatttcaacccccctgactt

SEQ ID NO: 8833 - DNA, 1066 bp, Sorghum bicolor
  unsure (1)..(1066): unsure at all n locations
  Clone ID: SORBI-28MAY03-CLUS58246_1
gcacgaggggagccataaaaggcttgcaacccgcccatcgcccacggagccatcgatggtcccggtgatccctagaaggacacggtttactgatcttcgtgtagttgtaggtctagttgtgcatgtggtgtgagtgggcgtgggtgtgtgtttgtgcatggacagatgctacagttgtatctagatgagaggcttcaaaaaaaattgcatggaattggagatgtctgtactatgaactgactgcagagttcatgaggaaaatagtttactcttgtccatcatcacaataccgtcgggaccacgtggggctgctatcttcttttgggggctgctacctcggccattcaggctggctccgcgatgtggtgtgtctgcacttctctgtctgtttggtccccccagattgttgacaggttcaattttagctcatgagatgatgcatgcatggttgcgacttaaaggataccggacactgagtccagacgtagaagagggcatttgccaagttcttgctcacctgtggatcgagtcagagatcatggccggatcaggcagtggtgctgcttcgtcatcctcaggatcttcatcatccatgtcatccaaaaaggcggggcggtctcagtttgagcacaagcttggggattttttcaagcatcagatcgagacagatacttccatggcctacggagagggtttcagagccgggaaccgggccgttcttcagtacggcctgaagcgcaccctcgagcatatccggctgacagggacctttccattttgaagtggcatggattcacattttgcggaaaatcttatattatatacgtgatttgtcatccagtgttcctttacagccaaagaaaccaattgtacaaacattctttccagaaatccagagaatatatcttggaaggcanaaatgggtattaaatggttgagatcgagtggccagccctgaccaatcacttttgtattgtgaccanaactctggaacgaaaaccaagtggtaatttttttttttacacatggcgtgaatttcaataaataccagtacgattttacagta

SEQ ID NO: 8834 - DNA, 751 bp, Sorghum bicolor
  Clone ID: SORBI-28MAY03-CLUS58274_1
gcacgagggtgaacaaaaaggtccatgcttgcttctcccctctcgcttcctttggcaccccgccccctccgcgggggccctgcccatctcttcctcctctggccggcgctctggcctaccagcaagaacacgctgcggctggctggcggctgcggccacactactcaagtgtgaacaaaaaggagcttgcggtttgagccttgagcgcgcgggtgtggcggtggcagtggcgaccgtgaccggcgccggagatcttgggtgcgtgcgagatcctgggctgggctctgtctctgaaggcgccgcccgccacccctgtttttttatcctaagataagtttcttcaatccgataccacttctagtttccttcaaagatttgtgaactatgaagccacctttggagaggaaccctactaagaagcgccactcttggtggtgggacagtcacattagccctaagaactcgaaatggcttgcagaaaatctcgaagaaatggacaagcaagtgaaggaaatgctccagctgatcgaggaggacggtgactccttcgcgaagaaagcacaaatgtattaccagaggcgtccaatgctcatcacccatgtcgagaatttctatcgtatgtatcgtgctctagctgagcgctatgacaatgtaactggtgaattgcgcaagaacatccctacaaggctgcagtcgacaaccagttcagagtatggttctgagctgcagaggtctccctcaccatctcctg

SEQ ID NO: 8835 - DNA, 670 bp, Sorghum bicolor
  Clone ID: SORBI-28MAY03-CLUS59565_1
gcacgaggccggggcgaccttgacttccctctccaacctcctcagaacccagccaatccgctcatccgctgatctcaactgccgggcactccgatccggcgacgatggaggggaacgccgacgcctcttcgacggcgccgctggcttggcacgacttcctcgagcggatgcgccagccttccgccgccgagttcgtcaagtccattaaaagctttattgtgacattctcaaacagagctcctgatccagagaaagatagtgctgctgtccaggagttcctggaaaacatggaaggggcattcagagcccacactccttgggcgggcagttcagaggaagaacttgagagcgctggtgagggacttgagaagtatgttatgacaaagctgtttaatcgggtatttgcttcagtcccagaagatgtgaagagtgatgaagaactttttgagaaaatgtctttgctacagcaatttataaggcctgaaaacttggatataaaaccagagtaccagaatgaaacatcctggctgctcgcacagaaggagctgcagaaaataaacatgtataaagctccaagggataagcttgcctgcattctgaactgctgtaaagttattaataacttactcttaaatgcttcgattgtgtccaatgaaaacccccctggcgc

SEQ ID NO: 8836 - DNA, 1418 bp, Sorghum bicolor
  Clone ID: SORBI-28MAY03-CLUS59569_1
tactggattcttacgccggcctggagccctcagctcagccctcgggctcggccgcccggctcggctgctcgcctactccctagtccctactccccacggtcattctcgtgcagccgggccggcggcaccggaacagggcgcagccggagcagcggcgccttgtgcttgtgccactgcccacatccagcggtctggcgcctccactgttctattccttttcgtctgctccaatccagctgcggcctctaatttgtgctccaccatgaagatatcctggggtaagaattccaaggttaagaaacagtcggtggtagtatcaactataccaggcctaccatttggagtggggagtgacaacgatgaggttgaaagggaggaaaaatcagatgcaaacacaaactgtcctggaacaaagccagttgaaactgctgagttgctccagagtcagggagacaagctagccgaggaagggaagtaccatgaagcacttgctaaatgggaggctgcgcttatcttgacacctgataatgcaatacttcatgagcagaaagctcaggttttacttgaagtgggggatgcatggcgtgcactgacagcagcaaccagagcaacagaactggatccattttggcctgaggcttgggttacccttggtagagcacagctaaattttggggagccagattcagctatactgacttttgacaaggcgttagctatcaagcctgattataacgatgcaaaagctgaccgagaaactgctgctcgtctagtcaagaaacgagggcagctgcatacatcagggttaagtgctaacaagagacgcttcacagttggggagtacccagagaagggtgcagagggcgaagaaaaagggaaagaaacagctgtatagtccagttagtctgctcccttttaatccaggtgtggctgtcctagaatggagggagctcatgtaagatgtaaccgtttcaggattctgctctaattttgcatgtcagggttctggatctctgagcttctcggttgtgacaaagctgtatcatcgctctgtgaaactataaggtatatagaggtctagaaggtgagtatcgtgaagccatgtggtgtttgtgcatattcctgtgagccatgtgctaatgtgcctcgttggcccggcttattatcagtgtcaatgtagaccgatgggccagctaatttgttagaatctgtaacaagcctttttaactggcagcttctatgcagtgtcacaaggattgttgactatttaggaaagagaggaatgtgaccgtgtgagagaaaaatgttgtttgttctgcgaagctataaaattttggactatgagactatgtacaagcatcattttacaagttgctagttgctgcttgtacaaattcaaggacttgtggaattctacg

SEQ ID NO: 8837 - DNA, 901 bp, Sorghum bicolor
  Clone ID: SORBI-28MAY03-CLUS59571_1
gcacgaggtcaagaaggtaaacggtggagagatcgaaggagccgtcaagaggggttacctgaagacggacgaggagttcctgaagagggacgagagcgggggcgcgtgctgtgtcacagccgttctccaaaagggtggactggtcgtctccaatgctggagactgccgtgcggtgctcagccgagcagggaaggcggaggcactcacctctgaccaccgggcctctcgggaggacgagaaggagaggattgagaatttgggtggatttgtggtgaattaccgtggaacatggcgagtccagggctccctggcagtgtctaggggcattggggatggacacctaaagcagtgggttgtggctgacccagacaccaggacggtcctggttgaccagcagtgcgagttcttgatacttgcttctgatggcctctgggataagatcgataatcaggaggcagtagacctcgcacgacctctctgcattaacaatgacaagacctcgcgcatggctgcctgcaggatgctcactgagacatcgatttccaggggctcaactgatgacatcagtgtcgtgatcgtgcagctgcagaatttttcaagttcctaacctaattggagaaactggaccaaaactctagccagtagcgcactaacagactggtggaaagcaggataggtagacatcatgttacttcgctggcgaaagttttcattagtcggcattattttgtggggattttaacatccattctttatcgtagaaccattcggttcattatttgattcattctttatcgtagaaccattcggttcataatgcggggagatctctcgcttcatggtatcttactgtaaaaggcgatttgcctgtgtacaatgatatattcatagattaaaactt

SEQ ID NO: 8838 - DNA, 660 bp, Sorghum bicolor
  Clone ID: SORBI-28MAY03-CLUS5959_1
tctatctccagtggcgattgtcgaactcaatcggacatgtgggccacatctccttcgccacacccactccatctccggcgaccgccgccgcctcccttcctcgtccgccgccacaacaagcggctggaccgcatcgcagcctcacaggaccccctcaccgcgctgacccgcgtgctgtgggggcgcgcgctgccgccggcgcagctcgtcctcgccgtgcgccacggctggaccgcggcgtggcagctcctgatgcggcagctagcgccgtccgacccgtcgacgggcgccttcacccgtacccctgcccgcttccccgccgtcgcgggggagcccagctcccggctccacctctacgtgggcctcccctgcccctgggcgcaccgcaccctcgtcgtccgcgcgcttctcggtctcgaggcccgcctcccggtctccgtagccgtccccggggacgacggcgcgtggtccttcacgcccggcagccccgaccggctctacggcaagcggaagctccgagaggtgtacaccctgcggagcggcgggttcgagggcagggcctccgtgcccatgctctgggacgccgagcgccgcgaggtggtctgcaacgagagcatcgagatcgtcaagttcctctgcggcctcgtgggcgaccgcgcc

SEQ ID NO: 8839 - DNA, 1081 bp, Sorghum bicolor
  unsure (1)..(1081): unsure at all n locations
  Clone ID: SORBI-28MAY03-CLUS5967_1
ccaaattcccatctgctactgctccactccactncactccactcaactccaggctcttgctctgctcccgtgggcgagcgcaaacccgcctcgcttccccaaaccctagttcctcgctcgcccgcgtggcctgcgaggctgccacccccggatcaagtccgtacagcgccccccgagcgcgcgtccaccccctcccggactccagcggcggcgggatggggtctgactccaagggcttgctcgagatcgagcccctcgagctccgattcccattcgagacaaagaagcagatctcgtgctctatgcagttgacgaacagaacagatgactacatcggctttaaggttaagacaacgagcccgaagaagtactgtgtccggccgaacagcggcattgtgccacctcggtccaccagcgatgtcatcgtggcaatgcaagcacaaaaggaggcaccaccagacatgcagtgcaaggacaagtttcttgtgcaaagtgtaattgtggcggaagggacgttagtcaaggacatcactggacatatgtttctcaaagaatcaggtaatgtggtggatgaggttaagctgaaggttgtctacgtcccgccacccaaaccaccatccccagtgcgtgagggatctgaagaaggctcatcaccccgagcttcattatctgatggtagtaacttgaattatctagagatgcagacaacgagggaatctgatgagccactgttttccgctgttaaaactcacaaagatcaagaagactacacctctgagacatctgctttgatttcaaagttgacagaagagagaaactctgccgttcagcagaacaataagcttcgagaggaactggaccttttgaggagggaagtcagcaagcagaatggtggattctcctttgtggtcgtggtggccattgctctcctgggaatgctactaggatatatcatgaagagatagagttcgtgtgactcgcgtcatgttagaccggttttcctcacaatattgaatattgtctaatgcacttttcacatgtacactgctactccatagcatattcatatggtgtcttgcgt

SEQ ID NO: 8840 - DNA, 675 bp, Sorghum bicolor
  Clone ID: SORBI-28MAY03-CLUS5974_1
gtccatgcttttgtagctcaaattagggatgaagatggaactgtgttgcctaatatccgtatagctgactgtggccataagattggactgaatggcgttgataatgggcggatttggtttcagaatatacgtgttcctcgtgagaacttgcttaatttggttgctgacgttttgccagatgggcaatatgttagcatgatagatgatccagatcagaggtttgcagctttcctctctccgcttacacttggtcgagtaaacattgcagttgactcagtctacatttcaaaggtcagcctagcgattgctgtgagatacagtttgtcaaggagagccttttcaattacaccagatggccctgaaacgttgttgcttgattatcccagtcaccagcgacgccttctaccacttctagcaaaagtatgtctgatgagtagtgctgctaattttatgaaaaatatgtatgtaaagagaactcctgaaatgagcaaagccatacatatttactctagtgctctgaaggcaacactaacttggcagaatatgatgactcttcaggagtgtcgtgaggcctgtggcggtcaaggtctaaagactgagaaccgcgtaggagttttcaaagctgaatttgatgtccagtccacatttgagggtgataataatgttctaatgcag

SEQ ID NO: 8841 - DNA, 725 bp, Sorghum bicolor
  Clone ID: SORBI-28MAY03-CLUS5861_1
cgttccgtgagcttgaagatggacatctccggcgcctacatcgccggctacgaagcagggaacttctcgtgcctcgtcaagagatcaggctcaggccacacgttgtcgtcggtgacctgttaccggagctcgtatccatggggaggtcctccgaccgtcgacgtcgccgtccccgaggtgtccgcatggcgggtggaggatctcgacgaggctatctcgtcgctgttcctgttcccgacggggaacgcgacgaaggaggacctgagccggggcctcgccgcctgcgacgtgatggtcgcgaccgcggccacgttcccgtacgtggagcggcggatgagcgccggcatgtgggacggcaacggcgtgtccaacgacgggagcctgcgcgggcttcaggagagctggccggacctctccgccgccgtccaggagtcctaccagggcgccttcgccgctccggtggctcttcagcggagcaacggcgagtggatgctggtggacaacgtgcgtcgtgccgtgcccctcgtctccttccttgagaacgcaggctgcaagaagaagatgacgacgacgacggaggcggcggcggcggaccagcggcttcccttgctcatgaggtccgtcgtgcaacagccgccgccggatgaggaggacatgcagatgcagctgggcagttcgccggcggcggcggcggggacgacgtcgtgcggccaggccgagccgac

SEQ ID NO: 8842 - DNA, 1031 bp, Sorghum bicolor
  Clone ID: SORBI-28MAY03-CLUS58615_1
agcagactccggtgcgcggccgccatcgccatcgccacagctgtccccgccgccgcggcgctaccgctcccgctcgcgcttcgccgccaccgggccttccgccgcgtccccgcggcggccgtttgcctccggttctcgtcgtgccggatcccggcgccgccgaggagagcagccgcggccatgtcgtcgttagcggcggcggcgcagaggacggagcacgaggccggcgcgtggtttgcggtgccgggcctcagcctccgcgaccaccggttcgccgtcccgctcgaccactccagtcccgaccgcggggacaccatcaccgtcttcgcgcgcgaggtcgtcgccgctgggaaagaagacgtatctctgccttatttgttgtacctccaaggagggcctggatttgagagcccccgtcccacggaagcaggtgggtggttaaagaaagcttgtgaagaccaccgtgttgtgctgctagatcagcggggaacaggattgtccacaccgttgactccatcatctctttcgcaaattacatctcctgcaaagcaggtggagtacctgaagcatttcagggcggataatatagttaaggatgcagaaattattcgtctacgtcttgtaccagatgctaaaccttggacagtcctaggacagagttatggtgggttttgtgccgttacatatttgagttttgctccagaaggcctgaaatctgttcttttgactggagggcttccaccactgggcgagccttgcactgcagatacggtgtacagagcctgctttaaacaggttcaacaacaaaacgagaagtactataagaggtatccccaagatatagaagtcgttcatgaggttgtaagatacttaagtgaatctgaagggggaggggttcttcttccatctggtggccgattaacccctaagatgctgcagtgtcttggattgtcaggtctgggttctggtagtggatttgaaaggctgcattatctgcttgagagggtgtgggatcctgcacttgttgctgg

SEQ ID NO: 8843 - DNA, 1099 bp, Sorghum bicolor
  Clone ID: SORBI-28MAY03-CLUS58755_1
gcacgaggcagcaatctcttccgcctcatgaagaaggttggcgctgataataatctgctggtgaaggaacacacccatacttttgtaaataaagggggcgtgattggtgaacttgattttcggttcccggtgggagctccattacatggcattcaagcattcctaagaactaatcagctcaaggtttatgataaagcaagcacgagggttgctcttgcccttagcccagttgttcgggctctggttgatccggatggtgcattgcagcaagtgcgggacttggatgatgtaagtttcagtgattggttcatgtccaaaggtggtactcgggagagcatcacaagaatgtgggatcctgttgcttacgctttgggtttcattgactgtgataatatcagtgcacgttgcatgcttactattttcaccttgtttgccacaaagacagaggcatccctgttacgcatgctaaagggttcacctgatgtttacttaagtggcccaataaagaagtatataacagacaggggtggtaggtttcacctaaggtggggatgcagagaggttctctatgagaaatcacctgatggactgacctatgttaaaggccttctcctcaccaaggctacaagtagagagataatcaaagccgatgcatatgttgcagcctgtgatgttccgggtatcaaaagactacttccatcagaatggagggaatgggaaatgtttgacaatatctacaagttagatggtgtccctgttgtcactgttcagcttcgctacaatggatgggtcactgaacttcaagatttggagaaatcaagacaactgcaaagggcggttgggttggacaaccttttgtacacggcggatgcagacttttcctgtttttcagaccttgctctctcatctcctgctgattactacattgaaggacaaggttccctgatccaagctgtgctgactcctggcgatccatacatgccattgccaaatgaggagatcattagtaaagttcaaaagcaggttgtagaattgttcccatcttcccggggcttggaagttacatggtccagtgtggtaaagattggacaatcgttgt

SEQ ID NO: 8844 - DNA, 483 bp, Sorghum bicolor
  Clone ID: SORBI-28MAY03-CLUS58858_1
gcacgaggctagtctcgagttttttttttttgactctcgcgcggccctcctccccccctctcttccatgggagactccaaagaaagagaacctcttccacggctgcttgatcttatcccggatgggaaacaatgtaaggggagggaagcacaaggcgcaggaagatcatcaaggaacacaggctttgggagcgaggaggacaagcacctagagctcaaactcggtcctccgggtctcgtcgaacaaggggcgacagcagcagcgtcaagagggatacagcgagagattccggctctctcgcttggttgcttcccacataaaccctcctccaagcctgcaataaacactactgcgactgggacaaagagggggttcttagacaccattgaggccaaaacagaaggtcgtgatgagcagaagcagcaggctggagctggatgtgggaaggaactagcactggaccagaagataacagccgcgagc

SEQ ID NO: 8845 - DNA, 931 bp, Sorghum bicolor
  unsure (1)..(931): unsure at all n locations
  Clone ID: SORBI-28MAY03-CLUS58799_1
gcacgagggctccccacccggcgccgcctccgcctcgacccgcccgccaagctttacttcccatatgaacccggcaagcaagtccggagtgctgtcaggatcaagaacatcagcaagtcccagtgtagccttcaagttccaaacgactgcacccaagagttgcttcatgaggcctcctggcagcgtacttgctccaggggaaagcatcatagcaacagttttcaagtttgtggagcatccggagaacaatgagaagccattggacaagtgcaaggttaagttcaagattgtcagcctcaaagtcaaagggccggtggagtatgtccctgaattgtttgatgagcagaaagaccaggttgcagtcgagcaaattttgcgggtagtattcttggatgctgagcgcccaagcccacaaatggacaaactcaagcgccagcttgctgaagcagaagcagcgctagaggcacgcaagaaacctccagaggacaatagtccccgtattgttggtgaaggccttgtgattgacgaatggaaggaacgaagagagagataccttgctcgccagcagatcgaaggtgttgattcagtgtagacacgaggcagccctgtaaactatgcaagattgaacataccatttcatgggcagttgtcaaatggttttggagcttaatgtgaaagttcggagcaatcaagcaacaatgaggctttgtgtaattaggatttgagcttcacgaacttctgtcttgggtctggatgtgtgtagataatcagccgcttcttttgataataatacctcctgttctaagccatgtactcagtgttgtggaatgtgggactcaacatgtgaatgtgatacattccctagctgttgtcctgtcaatattagaattgtaatatcaanaagacacactcccaaggtgattatttagtg

SEQ ID NO: 8846 - DNA, 968 bp, Sorghum bicolor
  Clone ID: SORBI-28MAY03-CLUS59914_1
ggtaccgggcccccctcgtcgcctccgctcctggcccaccacactttcgtccccctcttctcgcacctcctccctctcttctcctgctgcaggcgacagcgacggcctccttgcggcacgcgcccccaaggtggccgtcctcggccgttacggagcggcgtggatgagccccaccggtcgccgccgttgcgccttaccctcgacgctgccttctctttgcagatccgcatggcttggacgaaaccctaggtgctcgctggtcctcctcacgccgccacaccagctgcaggtacccctcgacggtgtcgtgattgggaaggagcagcctcaacacctcccgtttcctcttatttttggattttggttctatctctttgatttcttcctatgttggcttggattcctagacttttcccttctttggcctgtgatgaaaattccagacccaattgatcaacgatatcaactgatgttcattttcttgtgaggtactaggcatgaccagctacttatattatgatccctataagccaggtccacgtatccttaaatattttcatacgtctgatccccgtaattagctgtgcagattagttggcctaggatttcttcaaatcagaatcagcctttgtttaccgaggagatccttttccagttcggatagggtgccgactgctttgtgatggcgtacggggcccaaccaatatatactcggatcctgctttttggaatccatatcttttgcagtttatgagagtaacccgattgtggccatgcctcgaagctccaagttaatgaacagatgatgattggtatgtttctgaggcctctaaaaatcctgccttcattagaaaattcttagctttttcattgtgagttgtcacacatgatggttggtaggctctccactcctatatctatattacgacctatacacctgcttacacagtagtagatacttacatagt

SEQ ID NO: 8847 - DNA, 580 bp, Sorghum bicolor
  Clone ID: SORBI-28MAY03-CLUS60000_1
acccaccgtacacggctccctcgcctctccgagaggccttggcgcgcgcacgagaagaagctcaggcgaagcgcgaggcagagaagaggatgccgtgacggcggaaacgaagaagccgagagagggagggagaagcgaagcgaagcgaagcctttacatatacccggccccgtcccaatgcccacggcttccgccgcatcagatcccaaaccctaaccctagtcggccgtccgtccgtccgtccgcgggtccgacgccgccgccggtgacgcgcgcgatcgggcgccgacgcctgctgacgcgctgtgtgccgcgtccgtgattctctcgccgcgcaaggaatcgttgcaaaggggcagctctgtgcccaatccaatcccctggccgcagcgacgcgcggccgctcgcccgcggatcggggaggggagggaggcaggagtcgagatgccgggggacgtcgcgacctcgccggcgccggcgccgccgtccgtgtcctcgtcgtcgcagaaccaccaccatcacggccccaccaccgacggcggcctcctctgccacgccgtcgccggcgcctccgctggct

SEQ ID NO: 8848 - DNA, 1024 bp, Sorghum bicolor
  Clone ID: SORBI-28MAY03-CLUS60005_1
ggccaaccaatctgctctgctctctgctctctctcttctccgcgtctttaactccgagactccttttttttgtccgcgtcctcctccgccctcaaccgtagccgcctcgctgtcccggccgccgaacaccccagctgctcgccgttgctgcagccgcgcaggcgatagatggatcgtgattgcgaagaagtgaccgagttcctggggcaggtgcccctcctgcagtgcctcccgggttcctccatccgcagaatcgccgaggccgtccaggtcaggagctacgagcctggtgactatgtcgctcgcgacggtgaacctgttgatggcctttacatcatattggatggtcaggctgaagtttctgcacctgcaaatgctgaagaagcgaaccgcccagactatgtgttaaataaatacgactactttggttacggaactaatagttctgttcatcaagtaaatgttgttgcactatcaaagctgacctgcttcatattgcccaatcaacatggacatttgttacaacccaaaacaatttggaatccggaggaaacacctgaacattctttgctggaacaaattttgcacttagaaccactggaggtcgatatcttccgtgggtttactttgcccgaagctccaacttttaggcacgtttttggaggacaattcattggacaggcactggcagcagcatcccgctctcttgcttgtcctgacatcgtgctctgtttgcccgcgtcctttctcgtcgctggtctccctcaccttcctactttctagcgcgttcttcgggctcgcggtggctccagctttgccgcaacttttgtggacgcgctgccgctgcgtcccgttggcgcctccgtgagtgcttcgtgcctctcatgaaaccaaatattcaggaacaaatatacaaattatatttaaaatgatttagtccctgtcagcgtccttccagatattccattatgccttactgtcttatttatgatatgactatctccttcatgatttattcagttga

SEQ ID NO: 8849 - DNA, 955 bp, Sorghum bicolor
  Clone ID: SORBI-28MAY03-CLUS60017_1
cctactggttctcttctcgactaaacctcgacacctctctgccctccgttcctcgctcacacctgtgttcttccatggccgggctcggcgcgggactgggagcgcgcccctccgccgccttcgaggccgggaggttccagcctctcgctgcccctctccgccccgtccgctccggcaaattcatagtgccaaagagatgcttcactgtgtcaagtaggctcacatgggtggaagatgagcttatggagataaggaagtcacaagagcaaagttcaataaaatcaaagaaaaggccacctttgaggcgtggaaaggtctccccacaacttcctgtaccagggcacattccaagaccatcttatgttggttcaaaaggattgccagaactatgcaagggccaattacacgatgctcaagggattactggaatgagagctgcttgcaaacttgctgcccgtgttctggactttgctgggactttagttaagccatccattactacaaatgaaattgacgcagcagttcataatatgatcatcgaggctggtgcttatccttctccacttggctatcggggtcttcctcatcctagccgtccatcactacatgtgtgtgtctcgcagcggttccctgtttcatctccgcggctggtgcgggtccttctccacttggctgtcgtggtgttcctgaatggataccttcggcggtcctccagtgcgtctgcctggggacacctggatgattctatcaagcattttctcaatgcagctgaagaatgcttggagaagggcatttctgtctgcagggatggtgtgaactacagaaagattggcaagaaaataagcaagcttgcctatttttatggctattatgtggtggaacgttttgttgggcatgggattggaactacgtatcattctgagccacttatcctacatcatgccaacgaaaactc

SEQ ID NO: 8850 - DNA, 1447 bp, Sorghum bicolor
  Clone ID: SORBI-28MAY03-CLUS60024_1
gcacgaggtccgcctccaaaaacacctccccgttcgtctgcaagaacatctccttcccatccatcgctccgcctccttcatacagctctccctccagcgctctcccctctccaccgccgccgcgacctgctcctctcggggccacttcgccgccgatgactacctcgtctccacctgcggcctcacccgggagcaagccgcgaacgccgccaagtgcatctctcactggaaatcgtcctccaacgccgacgccgtgctgtccttcctcaccggcccggcgctcggcctctccaaggccgagatcgcgctgctcgtggccgcacgcccgcgcatcctcagctgcagcgtcgacaacaccctgcgggtccgcatggaccgcttccgcagctacggcttctccgtcgcgcagatcagcaacttcatccgcgtggccccctgcttcttccgcaccttcaacatcgacgagaagctcggcttctggatgcccctcctcggctcgccagacaggttcctccgcatcgtcaggcgtaacttctacatggccacttccgacctcgacaaggtggtgaagaccaacatccggctgctccaggagcacggcctatctatccaggagattggcaacctgtgcgttgccaacccgaggctgctcactggcaacccggacagaaccagggccatcctcgtgcgtgccgatgagatgggcgtgccccgcaacacgcttttgttcaggcaggctctgaccgccgtggcgggcctcggcccggagaccatggcctctaagctcaagatgatggccaagattctcgggtgctcagacgctgaggttgccagaatggtgcaaaagaaccccgtttggtgctgaggcgctccatggagaggattcagcgcacctgtgagttcctgaccaatgtggtcggcgtcgataccaagtacattcagggcaggccaacaatcctgatgtacagtctggaaggccggctggtgccccggcattacgtgatgaaggtgctccgggacaaagggttgatccggaaagatcagagcttctacacgatggtcacggttagtgataacgtgttctgctccaggtatgtacatcctcataaggatgttcttcctagccttgccgatgcatatgcatctgcttgcaatgggaaaatagccatctgaggcgcgattccagcaaacaggctatatgggcagcaactgcagttgcatcttgcatgtcattcttaacacattcagatactctgatgtgtactctgcaagactgcagcgctgtacttggctcatagctttagaattgcagaaactcagtatgctaagtttaggaacttatgaatgaccaaagcatgatgttgttgatttcactataccttggattctgatgatgaattttatcatgcttcaactcattctactggtacgcagaatggtttggttc

SEQ ID NO: 8851 - DNA, 786 bp, Sorghum bicolor
  Clone ID: SORBI-28MAY03-CLUS60149_1
gcacgaggacggccgccgccgcctccaagtcccactagctgcagctaactcccgccgccgcccccgatccgaccgagagcgagcatggcgcactccctcgccgcttccttctcgccggccgccgccgccgcccggcgccaggtgacaaatgtgatttcaagccggagctcggtttccttccagagccacaggatgacttctgtatccatccgttcaagaccaagttctcttcggtttaagatttgctgttcggctaagaaagagacagtcgacaaggtttgtagtatagtgaagcagcagctggctcttcccgatggtactgctctcaccggcgaatcaaaattcgctgaacttggtgctgattcactggatacggttgagattgtgatgggcctcgaggaggcattcaacataactgtcgacgaaactagtgcacaggacatcgcaacggtgcaggatgcggcggaccttattgagaagcttatgcaggaggcacctccaaaggtcgtctagatccatcaaccttgcgatctatgactttgcattcaatctctgttgtatgttaaattgttcatgttaccatttgttctttcttgatgattcaagatgagatttttgtattgatgttgctgaggtaaattagatgctccatccaaaggctacatgaagcagatgaagacaaatgtattccactttccattcgtatgttgtactactatagagaaacccatgaactattatgaagagtcactacaactatcgttattgatttttgagaagtctcgc

SEQ ID NO: 8852 - DNA, 640 bp, Sorghum bicolor
  Clone ID: SORBI-28MAY03-CLUS5905_1
gcgcccccgtcgacgcccttccctggccgggcagcccgccccccctctccgtggggttcgccccgcgccccgtgcggctgctgacgcccttggcctcggtcgccggccagctcgcggcgccgttccatgccctctggcggtggcttcacatttgcgtctcagccctggtgccgctgcatcgcgcctctttaggcctggggcgtggagtttcggtttaccctgagctcgctctgcttgccggctttcgcgttcctggtgccgtgcctgggcgggacctgtctttctgtcaatcccgctctgtccgctctggtgctcccgggcgccacgcgcgtggcggccggtgtccctacctgaggggcgggcgcgcgcccccccctgcacgctgtgggcaccggcggtccgcctgacgccgctgcaccgctgccccctcgcgccttgccccgccctctccgccggtctcggctgcggccgcggccctgctgcacctccgtggtcctcctcctcgtcctcgtccacttcctcgcagggcccccgccttcctcccgcccagcctgctgcagctccgcatgccccgcggcctcctccgcgcgcctcgtccccctgtcgtctacatcctcagcgcccccgtcaacttccttca

SEQ ID NO: 8853 - DNA, 434 bp, Sorghum bicolor
  Clone ID: LIB3478-053-Q6-K1-D5
atttattagcatcagctttgctttgtatatatggacattgaccagcaaaacttatcttgttaaattaaactgaattttttttgtactctattcaaagtaatgcttcctaatattatattcacttcttgtatttttttctatcagatcaactaggtggattttgagttggtgaaagctctgcaagacaagaaaagtctatcatacaaaactgctcaatcccctaaaaagctccagggtactacaagcgagaggacctaataaacaaagttatggtcgatggctggttccacatatgtataacgatccatgttccagtattcctaccgcatctgatcgaacatatggcaatgcggacaactatttgtcaaaaaaatgtctaatggaactggtgctttcatagccctgctttgtctacaattttatggcatgcatta

SEQ ID NO: 8854 - DNA, 402 bp, Sorghum bicolor
  Clone ID: LIB3476-012-P1-K1-C11
gctacggcatcgcgcctagccccaccctctacgccgatcacgtcaaaatcctcggcctagcttcatcaccaagagggccaatgcctttctccagtccatccagtttcaggaccacatgctccgcggcctcctccacgcggatagtccccttgtcgtctacatcctcagcgcccccatcaacttccttcacaggcatgatagctcacagcccatcaccaaagagtacggcccgcttgaggaacggatgaagaagctcatggctaagatcgctgagcagctcgagaaggagttccatgccctcaagtggaggcttcatgattacaacagaagagcagttgtcgctgcatgttgcatcaaaaagccatagaccaaaagatagagttaagacttagggagatcaac

SEQ ID NO: 8855 - DNA, 983 bp, Sorghum bicolor
  Clone ID: SORBI-28MAY03-CLUS5926_1
ctctcctctcccggcacgaggctctctccccccactcgccgcctcgacctgcccttcccacacacaccacctgtccccgctccgctcccgaggcttagggctccggccgcgtccccttccgctcccggcattcccgatctcgccgccgcccgcctggcctcgacctcgatcggcctcccccctcgccggccggctcgggtttgtctcgccgctattgggcctcggcccgccgcgatggtgtcgggcgggtgcgtgggggcggagggggaggtggaccctgaggcggtggcgccggcggcggccacggaggaggcggtggtgccggtgcaggcgcccgcgagggaggttgtggtggggtacgcgctcacgactaagaaggccaagagcttcctccaacccaagctccgggggctcgccaggaaaaaaggaatcttatttgtcgctattgatcagaaacgtccattgtctgatcaaggtccatttgacattgttcttcataagttgactggaaaggggtggcagcaattattggaggaatatagggaggcacatccagaagttactgttcttgatccacctggcgcaatagcaaacttgcttgatcgccagtctatgcttcaagaagtatctgaattggacctcacagattgtcatgttcttttctgcaggtaaagtacgtgtgcctaagcagctattcgttaatactgatccctcatcaataccagctgcggttaggagggcggggctctctctcccattggtggcaaaacccttggtggcgaagtcccatgagctatcccttgcttatgatccaacttcactgaccaaacttgagccccccttggttcttcaggaatttgttaaccatggtggtgtcatgtttaaggtgtacattgttggggatgcaataagggttgtaccgtggttttcacttccaaatgttgatgaaagggatctcttgaataatgcctgggttattcggt

SEQ ID NO: 8856 - DNA, 1262 bp, Sorghum bicolor
  Clone ID: SORBI-28MAY03-CLUS59306_1
gcgcggggtccggccgcatggagcagtttcctgcgtcgggggtgctgctattttatttcatcctcgtctctgtcttgttttgctgccttcttctgactgtgggtgtgctgtcgttgatcctcataaaccgtcgggaggccgcgtgcgccggacgggggggcccctgctgcggccggtggtccatgccgtgtctgccgattatcttcggtggtggcccgaggttgccccatgggtgcctccggcagcgctcttggcgggccccgctcctgccccactcttttggctctacgccgcctctgcgtggatgttgggggtggcccgggggggtgtggccgcctgctatggagtcgtgccaccctgttggagccacaccttgacgacaacctctctggcccgctcatcttggaccgggagacgccttgtgccgttccgtgtcagcttctttcgctctcctaccgtgggtggctggagcttccgtcccgtcttgggctccatgcggcgcgtgcctatctccgtgtcctcgcttctatgtgccctgcttccctcttcttattatcaatgtatggcagatttgtcgcctataactttctgatggtgtgctgttgttgatcctagcaaagtgacaggatgccgcttgagccgtacggggatgccaatgcagtggccggtgttccatggcgagactggtgaaaatgatgagtggaggcacaatgattccagatgggtggcaactgcatagctcatggtgggagctgctcgtgctccactctatagtctatacatggcctctgcaatgatgatgggtgagtgcctgagtggtgaagacgacttctatggagacaatgcagccagttatattgacaccttgaagaaaaacataatggtccacacataatggacagagagacgctaagtgctgatcattgagagcttcattcgctctgcaacggagaatggttagagcaagtgtctagagatgggcagcatgcggcaagaaccaaactgcatgtccacacatgtatgtgccttggttccgttttctgtggatgtaagtttgaccaaattgacattgaagttttttttatcttggcagaacaagagtgccttcaggttttgaagggtgctcaagtcattattaatatagagaccataagtcagacttggaagtattactcttggatgagccattgaagcaattacacaagtactactctgagatgagccattttttcttatttgaaataaattgggtgaataattta

SEQ ID NO: 8857 - DNA, 1069 bp, Sorghum bicolor
  Clone ID: SORBI-28MAY03-CLUS59495_1
gcacgaggcgcatcttcccggactaagccgattagaggcacgagcgaagatgccgcagcggcactcgaagaacaacaacgacctcgccttcttcacgtacgaggagaagcggaagctcgggtacggcacgcagcgggagcgcctggggaaggactccatcaagcccttcgacgcctgctgcctctgcctcaagccgcttatcgacccgctctgctgccccaagggccacaccttctgtaaggagtgcatcctcgagtgcctcctcgcccagaagaaggacatcaagcgcaagctagcagctcacgaggcccagaaaaagcaagagaaggaggaggaggaggagaagctaattctgcagaaggctaaggagttggatgcctttgatcagcagaatcatggggctgttccccagtaccatgatcgcagtggttcccaagacaagaatgggtttcatggagcaaacagtgtgaaggtcacttcttttgaagaggaagccctccgcaacatgaaggcattctggctcccttcagctactcctgaagctacagtcaaggtagatgcaccctccactgacactgtctgccctgaggggcaggagaaactcaagttgaaatcgctcttccctatctcattcacggaggaaactgttgatcagaagagcaagaagacagtggaaaagagctacatgtgccctagttgcaagtccactctcacaaacaccatgtcccttgtggcggtcagcacctgtggccacgtcttctgcaagaagtgctctgacaagtttctagtaaaggataaagcttgcttagagtgcagcaaaccattcaaggagaggaatctggttccattggagaaaggaggaactgggtttgctgcacatgatgaacgcttggaggcaagggatttcaagcatttgggtagtggttctgggttaggactagtgaagcctgcaccaaaagctttctagccttgaataattgtagccccgctgttgtatattgtttatcatggtgtcatgaaattatgtaacctggaaattttgttttatggcatcaaaatcactctattc

SEQ ID NO: 8858 - DNA, 1179 bp, Sorghum bicolor
  unsure (1)..(1179): unsure at all n locations
  Clone ID: SORBI-28MAY03-CLUS59483_1
gcacgagggtttttttttgtctgggattttgttcgctgcattccactgacatgcatgggtgcggaatgcagtgtcggattgaattggagcaggctaggcttttagttcttgaagcggccgatcaactcgatcggcatgggaacaagaaagctcgtggtatcctcgcgatggccaaggtggcagctccaaatatggcccctgaaggtgcttgacatggcgatgcaagttcatggtgcagctggtgtctcatcggacacggtcctgtcgcacctgtgggcaacggctaggacactgcggatcgcagacggtcccgacgaagtacatctcgggacaatcgctaagctggagctgcagagggctcggttgtaacttgagggggaagtacagttgtttaggagaataaatggacatggacctgtttgcaaggttaagggatggcaggcagcacgagcacatcgctggcacatagataatgagtaaataatggcgttgtatattcatcaatgtacgatgttgtacacttgtattctctgtggtacttaaccatgtcaacggccggcattagatactatgagcccacanaaaccanaatcagactccaantgtttgatccgaatgatggatgtacagtgattaactggccgtaaaacctgtaatgagtgttaagaatgtatgtgcttttcttgtacatcagagaaagaatcagagcttaacaagcagtgagatgtcatttacttccatacatagatgactagccttcggctgttgtcgattattaaccaaagaatcatcatacagtagtacagtagtaggcatgagatgaaacacatgcagtggttgcaggtccagctttcaggattactgctagctaggctcgatatatatatatagatataaactttgaactgatgaaaacaaacctgagtgagctagctgaaccgtttttacagtattaattccagaggaacccaaaaattctactagctagctacgctgtataaacatagctaggtgaagcccaatgtgtaggggaaggatgtggagttgagccagaggtctccctggatgaagtcgagcacggtgaagttggcggcgtcggtggcgttggtgagcacgtggtaccccgaccacgccacccttgcggaagtgtcggctccaggcccgcggttcatgtactcg

SEQ ID NO: 8859 - DNA, 947 bp, Sorghum bicolor
  unsure (1)..(947): unsure at all n locations
  Clone ID: SORBI-28MAY03-CLUS60576_1
aagtcagaacggccactgcccggaaatcgcccgcctccgctccgtccgctgcgctgcgctcaccaccacaccaacacattgcccacctcctccgacgaccgtctgatcggcatcgccttcgcctccgctaaaagacccgcggtccacgctcccctccaaatcccatcccatcgccataaatctcgccacgccgtcgcccgcgcgcgtctctcccttgtctcttccccccaaccactccgccaccggcgccgaagcagagcagccatggccggctccgagcagcgcgtcgtcgccgtcatcatggtcggcggccccaccaaagggacgcggttccggccgctgtcgctgaacgtgcccaagccgctcttccctatcgccggccagcccatggtgcaccaccccatctccgcctgccgccggatccccaacctggcacagatatacctcatcgggttctacgaggagcgggaattcgcgctctatgtctcgtctatctccaacgagctcaggatccctgtcaggtacctacgagaggacaaacctcacgggtcagctggagggctctacagctttagagattatatcatggaagacagtccgtcacacatagttctgctgaactgcgacgtctgttctagcttcccccttccagacatgctggaggcccataaaaagtatggaggaatgggtaccttactagtcaacaaggtatctgcagagtcagcgaaccagttcggcgagttggtagctgatcctgaaacaaacgaactgctgcactatacggaaaagccagagacttttgtgagtgatctcataaattgtggagtatatatatttactcccaatatctttagcgccattgaggatgtcttaaaacagagaaaggacagagcanatttgcggcgtgtatctagctttgaagctcttcattcagcaaccaaggcgct

SEQ ID NO: 8860 - DNA, 1029 bp, Sorghum bicolor
  Clone ID: SORBI-28MAY03-CLUS60662_1
gcacgagggtaaagctggccaactgggtgtaagagatggtctgattttgaggagccctttaaaatttctgggatgtggcaatgctccatctgcacgcatgaaaattctacagataatttatcttgtgagctatgtggtgtacttcgtgatctctcactgtatttcaataatatcagtgaagccaaagatggagctaaatgcagacacaagtattctggggtatccatactcgcagcacctcgctggcccccagctacttctcaggccttcgcgagtgtttgctccggtgggttccatggcgcgggattcccctccgggcagctgcgcgcgacccggggtcctcgtcgccagtcgtccgcgtcgcgccgaccccgccccttttgcgtcgggccgtgctcgttgccttccccatctccccgtgacatggtcgttacaggcttaaaatcatccagaaactttagaaaagttgacacaaaggttctagttaaagattctgttgacgtgaccggaaagaagatgatagataataatattcttttaactgaaaagagtacaagtatggacccaagtgcatcagtacaattggatgttattgcatctcaccgcgaggcaggccgccgtggttgaagtgaagctggacaaagaagtgtgcgtggaagaattctcgacgctgaaggcccttgggcgggtgttcctgcggtctcagggtaaccccgttgcagggggcattgtgactcgaattctggatcaggatttgaccctcgattaaccagacgtttcatgtacacgatgtgtctgttatgttgctgagctagtcagtagatgtgtatatatgtttatgtagcttgggctaagggttgttttgtcgtgcagcagctacacgcggctgcaatgcctgcattaacagacggcactaacttgaattttattttactttttaaaaacaatcgtgacgtcagactaatacctgtgacgggtcattttaacaaatctggctgagcccatgggtggtccccttttctatgttgt

SEQ ID NO: 8861 - DNA, 1215 bp, Sorghum bicolor
  Clone ID: SORBI-28MAY03-CLUS60635_1
gcacgaggcttatatcctgcttacccttcagcttcacacagcctgtcagccattgcattactagctttttttcacttttggttggcatctcttgtttctagtacaaaaggatgctgtttgcttcataagcacaaggtgagctcgagcgtggaagctgcccacgaagtgaactctcctgcagttaggctctgaaatgagtaatgggtgctgaggatagagttgagcaagtcacctcccattctgtgtccctgctaacatatggtgattgccactggctatgatctgtaaccaaagaagaggaaaaatgcgagataagcagctggaccatgagaaccagggatacaggtatggctattgatttgcttcatattcacagaatcctctccaccctgttggagataaagggaataatcatcgcgagatatataaaaggtaaagataatatccagaaaataaccaaattattgctgaaagctggtgagcaaaagcttttatgcaccttggaagagccaatggacgagcactgcatacaagacagcaaggactcaattcggagaacaatcatggagcatgataaggtcttcagacagcaggtgcatgagctgcatcgtttgtatcatgtacaaagatcattgatggctgaaagcgataaccatagttatcaaccgagaacagaagaaactcatgaaatggtgcagggatcaaggtcgaatctcaagagtagtccttctacctcagggacaaatcaatctgctcgccttggtaatgcacaacactcaactccccagcaagtaactgaagatttgagtcttcatgaatgcaagccagtaaactgcctcagcctctttagtgaagaaaactcaacagtcaaagaaagatttcacagggagaaccataaatcagcagaagatgaaagttggaatgcctctgtagggagtgatcttgacctcaaactaagcattggccccagttcacattcaccaaaaagaccgcactggctattctcaggaagcagggaaagaaacccttctggtcagcatcgatgagagcaagctagtaaacatctgatcatttagtttgatggcgcgagaagcaaaacacagcacaccatagtttcatatgctgagaaagctgaagcctccattaaaaatggcatgtggatttgtggaaacacaggcctgaagaaaaatgcacttctagctcggcgcctcagcc

SEQ ID NO: 8862 - DNA, 1140 bp, Sorghum bicolor
  Clone ID: SORBI-28MAY03-CLUS607_1
attttttggcatgtcgtcgtcttcgccttccctcctctcatcgcggctcccctcccccgccgccaccctcttcacaaagaagccggcttccctgcgctccgtttcctctgcgacggcgaggcacggggttcggttagtggtagccgcggcgtcggcggccgcagcggcaccggtgtccgccgcgcaggtaagaccgtcggcagcggaggtagcgcggacggtcgtggagcttgccgcgtctgggacgctctccgtggtgggccccgacggctggcctctcggcgtcggcgcgcgcttcgtcacggatgctgccggtgcccccgcgctctgtctggctgccgcgggggtcgccgcgcccgatgcgccgtccagcgtccgcgtcgaggtgggacagagtggggctaggacaccacaatgtactatgcttggtgccttaactaagcctagtgacatgtctgtattgaagaagctttctactaggtggcaaaagaaattggggaagagattgatcaagatcttttgtatttaatatctgttgatcggatcttgcacatggaagattttaatgaggatggcatgtgggtagttccatcagagtacacaagtgcagaacctgatcctctacgcaattttgctgaaaacattgtggaggaatttaacagcaaaaatgctgaagacgtccataggatatacaacatatatgtcgaatcagatttacaggtggcagatgtgaagatcatatgggttgacaggttaggtttcgactttcatgttcattctggggaaggtgtctttgctgttcggatccctttttcacgggaggtcactgatgagaagggggtaaaatcatcattcaacatgatgtctcatcatgcctgggaggtggaaaagagctatgccagtccagagtttgagaaagtacagttcttgaagaaggtcagatagcagtgcgaattctatttctgtggtccattattttttgttattcagaggagtatagtgcggagttttggttcctcttaacatgtattgtttgtcttatatattggtcatcattttttgtaccaaatacatttgatgcaattgacatcatgaattatgtgatagaaatttatttgagaagagcaatgaatttgacgt

SEQ ID NO: 8863 - DNA, 727 bp, Sorghum bicolor
  unsure (1)..(727): unsure at all n locations
  Clone ID: SORBI-28MAY03-CLUS60859_1
tgttcccgcacgaggcccgtgcctgcggcttctgtctctgaatcagcggcggctcccgaggcgcgggctggcgagcggctaggcgccggatctacggcggtgatggaggtgtgatttggacgggagggagcgaggtgaggtctcggttttctcggtataggagatggcggcggcagaggcgcggggaggggagttccccgtggggatgaaggtgctggtcgtggacgacgacccgacgtgcctcctcgtgctcaagaggatgctccttgactgcagatacgacgtgacaacatgtcctcaggctacaagagcactaactatgctgcgagagaataggcgtggttttgatgttataataagtgatgtccacatgcctgatatggatggattcaggctacttgaacttgtaggccttgagatggaccttccagttatcatgatgtctgctgattcaagaacggatattgtaatgaagggaattaaacatggagcgtgtgactatttaataaaacctgtcagaatggaggagttgaaaaacatctggcaacatgttgttaggaaaaaatttaatgaaaacaaggatcatgagcattctggtagcctagatgataccgatcgtaacagaccaaccaataatgataatgaatatgcttcctctgcgaatgatggaggtgatggcagctggaaatctcngaanaagaaaagagagaaagaagatgattgaact

SEQ ID NO: 8864 - DNA, 1118 bp, Sorghum bicolor
  Clone ID: SORBI-28MAY03-CLUS60914_1
gcacgagggtgcattgaactacctatgctaaaattgtcgagcaaagatataggttgctagtgacaattaatcccatcaaaattttggcccttggagatggcaactgcatctaataaataggggcacagaatgtcatttcagctcagctaatttctcttacttttccttgagtatcactctttgtgggatggaggtagtgtacttatttgagggactgttacctctggcacttgcattttgatgccactttagatgatatctaaccattttagtattgtgtattttctgttgaaggcacgagggatgagacctggagtggtgccttaccaaagcatcttatctgctttgcaacggattgcaaaagaagaaggaatccgtggattgtacagtggtctcctgccttctctagttggcgttgctcatgtagctatccagctcccagtctatgaaaaggtgaagctatactttgctagaagagacaatactacagtttataatctcagccctacacatgttgctatttgttcatcgggatccaaagtagcagcctcgataataacttacccacatgaggttgtacgatccaagctgcaagaacaaggccgtgatcatcatggtgctacacggtatagtggtgtcgctgactgtataaagcaagtgtaccagaaggagggttttcctggcttttaccgaggctgtgcaaccaacttgctgagaactaccccaaatgctgtcattacttttaccagctatgaaatgatcaatcggctcatgcaccagcttctggctccctaaatccctactcagacgcttgaaggtagcagatttgccattgaagtcttgccattgaagttctggcagagatgaactccaacctagctgcaggtgtaatagttggttatcgtggttgcattgccgctttccaattactgtcgaattggaggcttttgaagaacgatttttgtgaaataaagagactaacagaaaatctagtgtcgtgatatagaaactttttctctgatctgtttgttaaactattgctacgagccgatcgtaggctacaaaatatgctgaccgcgattgcgagtttgtacctgttctgtttggttcatgtagcc

SEQ ID NO: 8865 - DNA, 1015 bp, Sorghum bicolor
  Clone ID: SORBI-28MAY03-CLUS59766_1
gcacgaggccgttgttccccctccagccgatcaacctgcagttccatcggcatctttggccggtcagtccgcagctccgtcagcacctcccagtccaaggcaagagatcgccttgaagcaagaacaagattctcctgatagcctgttttccttcgccatcgatctctctgaagaagaaggcgaagaagcaagttcttcccagacagttggcattacatcggcagagaccagggccaggctggaagaattgtcagttctccttcaccaggatacagcgcatttggtcgatgactccgaccctaccaagaccctgttcagaactctcagaggccaaatcccagccgacgttgaagaaatcctgttccaagccgctcatctggagagtcgccagctgcagtaccagagagcttctcggcgtcttgccgatagagccgctcaaactcaactctccgatgaaatgaggaaagagaaactcctgaccgatgagaagcacaagaacatcggtatcctgaaatcttcaggagatgcgctgaagcagaagatatccgatctatcggcaagaagagaatccctgttggcggaactcaaggaagtggagaacgccttatcccaagcccaacaggaagagaaccaattgccagagaccatcaggcttcttgagcacgagcgaaatgttcatggtcgcaaggcactccaactgaagaagaagctaaagccgatagaaggttctgccgatgatgacatcaaggagatagaagcagccaaccaaattcggctacgtgctatatcggctatccagtcgctgcttaacacataaagtttccatcggcattgtatctacgctttcctgcttcctcaacttttagtctagccgataggactgttatcggcgcctaaacttttgaaacaccaagttctgtccccaagcatttggctccagccgataggagtgttatcggcacctaaacttttatgcatcgacccatatactggggtagtacttctttaaatattt

SEQ ID NO: 8866 - DNA, 1538 bp, Sorghum bicolor
  Clone ID: SORBI-28MAY03-CLUS59786_1
tactggctggccaacgagttgagtacgccgcgccgctgtacgcgcaggcacccgcactcctgctcctgcgcgccaatggaggacaacggcggcggcgaggtggcttggcgtttcggggcggccaacccatcgctggaggcggccagcgcgctgagcatccgcgcgctggttcatcggctttatggctgcgtggaccggaacgacccgaggccgctcgcgccgctcggccacggtgacccctcgccgttcgcgtgcttccgcgcagccgccgcggctgaagaggccgtcgccgctgcccccgccgctgggaagtacaatagttaccccaccgccgccggcctcaccgaggcgtgcagcgctgtggctgcatacctatctcgatacctcccctacgagctgtcgacaggcgacattgtccttaccgcgggctgcaaccatgccatcgagatcatgatggctgtccttgccatgccgggcgcaaatgtattgctgccacggccaggatacccaatgtacgaagcacgcgcagcgttgggtgggctagagttcaggcactacaatcttcttccggacaaaggatgggaggttgacattgaaggtgtggaggcccttgctgatgagaacaccgttgccattgttatggtcaacccgaataacccttgtgggtccgtctactcctatgagcacctgaccaagattgcagagacagcaagaaagctcgggataatggtaatctgtgatgaaatttacgagcattgcacatttggaagcaagcccttcgtgcccatgggtgtgtttggtgagatagctcctgtggtgacgctgggcggcatatccaagaggtggatggtgcctggttggcggcttggttggattgcaatgactgatccaaagggaatcctcaggaagaagaagggagctataccccaaatcattgcaaacacggatgatgttttcttcacaaatgctatgaacacgatgagagaggccgcagagatatgctaccagaggctaaagtgcatggagtgcatcacttgtcctcataagccagagggatccatgtttgtcatggtagagctggatatctcatatttcaatggcatcgacgacgatattgacttctgcaccaagttggccaaagaggagtgtgttgtgatctgcccaggcagtgggcttgggatgaagaactggctccgtgtaaccttcgcggtagatcctcctctgttggaggatgggatggagaggctcaagtctttctgcctgaggcatgcaaaacccactagaaatcatgccacctcatgatctgttaatataaataatattctgtcaattgcatggatgatcccttgtgattaaataaagatgtatatttggtgttgtaacacatatggactccaaccaggaacgaaagggggatgaatcccaattctagtccattctttacgtggactctatcactctaccaaacttttgggctttgttcggactatatatacacaacactgtaattataaatatttttttgactgaacgtaatt

SEQ ID NO: 8867 - DNA, 783 bp, Sorghum bicolor
  Clone ID: SORBI-28MAY03-CLUS5982_1
acccaccatctcgttctcggctcttcctctccggctcttccccgtcgggcttccgccttcctgcacaccttcttgctccgtttcttcctcgaacacagattctgtaccccaccccgactctacctataaatctcaccagctcaccccacgaatcccggcaaaacccaccgcccgaagcaaagctcgagccgccgccgcgatgatcctccgcatccgcagccgtgacggcacggaccgcatcacggtcccagactcggcctccgccaccgtcgccgacctgcagcgcctcatcgagtcgcatctcaccgtgcccgtcccgctccagcgcctctccctcgacccggccctcctgctccccaacccctccgccgctgtcccactcctcgccgacccggcgacgccgcttgcctcgctccgccttgccaacggcgccttcgtctacctcgcatatccgcccgatgcgcgctccgcccgcccgccgccgcccaaggcgctttccgtcgctggctccttcggcaagaagatgaccatggatgacctcatcgcgcgccagatccgtgtcacacgccaggagaacgcgctctgcgccgccgcctcctttgaccgcgatgccgccaacgcgttccagctctacgtcgccgagtccctcgcgttcgccgtcaagcgggcgggcttcctctacggccgcgtcgacgcagagaccaaggaggtcttcgtcgacttcatctatgagccgccgcagcagggctccgaggacgtggtccacctcatgagggatcccga

SEQ ID NO: 8868 - DNA, 879 bp, Sorghum bicolor
  Clone ID: SORBI-28MAY03-CLUS59848_1
gcacgaggcccctcagtgtcatcttacagagaaaaagagaggcagcacagggcaataaccatgagaaatctgctgaggttgcagtcatgcagacaggttctctggttgaaactgagaagaaaggctgtggcaacattaccagctctgcagattgcaaaagtggttcaggtgacgaagagtataaagaggaagatcatatccctgtggatgcacacaggcagtcttcttctcatggtgataagtttgaggttgagtatgctgctgaagtggatgcagaaggaaatcaagaggcggataactatggccagagagagggtgagtctgacgactacgagacaattgaaggtcacgactacaaatctgaagatgaaaatgcatacgaagatgacgaagatttcgacgatgatgatgactttgctcggaaagtgggggttgtattctcttaagcgctatggtgtcattgcttctgttgcttgaggcaaagagctctaggttttctcattggtcctgttgctttgaggcaaagagctctaggttttgtcattggttctgctgcttgacgcaaagctgaaatgcctgctttgcttagtgcatctcttgggtgatttcatctggcgctttatgtttccttttattttgatagtgccaaagcctattattttgtgaggctgattactgataattataggtcagataagaagcgaggtagcgttcataatcgatttgaggtttacatgtaaacagctgtgatgttcagcatatctgacctaccctcagactttgtattgtattagtttccttactaacagcaggatattccttggatcaatttgtgcccgaaatgaaatataatcaacccccagaaggggcattttgctt

SEQ ID NO: 8869 - DNA, 904 bp, Sorghum bicolor
  Clone ID: SORBI-28MAY03-CLUS6128_1
gggactggaaatgggtcttctgtatcagttgaaaatgctggtttgctagctttgacacgtgttggtagccgaagggtagtgcagatatcagctggtttcatgatattcttctctattctggggaaatttggagctgtgttcgcctcaattcctgcacccatctttgcagctctatattgtatttctttgcttatgctggttctgctgggtttggcttcctccagttctgtaacctcaacagctttaggaccaagttcatccttgggttctcagttttcatgggcctttcaattcctcaatactttaatgagtacacatctgttgctggttatggccctgttcacacacattcaagatggttcaatgacatagtaaatgtgatattctcgtccaaggcgtttgttgctggcttcgttgcatatctgctggacaacactattcacagacatgaaagttctgtcaggaaagaccgaggctatcattggtgggacaagttccggtcatacaggactgatacaagaagtgaggagttctattccctgccattcaacctgaacaagttcttcccttccgtctgagcttgctgtggttaatgtgagatactcttgttactctggactgtctatctcctgttctctggcggtggcactgttgatctttggtatggtatatgaaaaaaaaaaattatgcttcaaaaggatgaaagatcctacggctgctgtatactttatattctattttggtgccaaaagtaggaaattttggttacccgtttgtcgtatgggaatagcatgttcatacatgtcattgtagtcaaatttcatcattcacaacgggattagtagaatgacaatgtcattgtagtacactatgctaatattgtatattgtagtaatccggcccc

SEQ ID NO: 8870 - DNA, 711 bp, Sorghum bicolor
  Clone ID: SORBI-28MAY03-CLUS61304_1
ggttgggaaaaaggcggacttggttgtggtgaatccatttacatggtccatggtccccttacatgacagaattgccaacattgtctattccatgcggacagagaatattgagtctgttatgtgcaatggtcagtggatcatgaaggaccacaaaatcatgaatctcaatgaggaagaggaaatttcgtcagctgtgaaaagagcgaacgaccttcttgagcgagctggcatcaatctccccagtcggatgaactacgtatagttattctctttccatttcgtcatgtatggtcagttggcaccatgcccgctaattgcagtggtgcaagcttgcatgatggcccggcaggatttgtactcgtactgtttggttcatcctcgggtaatgtgagctcaaatgtaatcagctcatgtcggtttagtcggtgggaacgttgattgccgactttgattggtttggcgttgtaacggtaatagtagaggcggatggcagcgcaatcaaataacccccggagacgagcggtaggaataggacggtatctgattacgaggtattgcataacggacagaactgaaacaaacgtctgcatcgttatccagtcccctaagtaaacagattacatttcataaagctaaacgccatctttgtattatgactagtcttaccactttggagtaaagacatgcttggatgatcgtagccatgacttc

SEQ ID NO: 8871 - DNA, 685 bp, Sorghum bicolor
  Clone ID: SORBI-28MAY03-CLUS61471_1
ctattgacagaagaggaaaagataatgttccgccggattggccgcaaaatggatgggcttgttctcctaggaaggcgtggtatctttgatggtgtaattgaagagattcatcagcattggaaacataaagaggttgtgaaagtaattacaaagcagaatcaagcccgacagatcatgtacacagcgaatttgcttgaggttgagacaggtggaatattaatagcagtagaaaagctcacaaccagccatgccataatactttaccgtgggaaaaactatcgccgcccagcaaaatcatcatttagtaatctcctaacgaaaagagaagctctccgaagatcacttgaggtccagcggcgagggtcaatgaaatactttgtccgggagagacagaagtccatttcggaattgaaaaggagactgagatatgtgacaaggcaaatcaggtatcgaaccccatgatcatgaagaagttggatgcttggatagcatggtcagtgaagatatttgcaaattgcagtaatgactgtcaagattttttttcttattatgggatagccgtgtaaaactgtaaagccgaaaatgaacaattctgaagtgtacagcttatataattgtctgttgtacatatgtgccactttacccacatttcataaaaataagtgaaatttctctgttttggtgc

SEQ ID NO: 8872 - DNA, 651 bp, Sorghum bicolor
  Clone ID: SORBI-28MAY03-CLUS61641_1
gtagcttgcagagcctacctggatggtgcccaggttggatgcctttctggtgatggagtgcaggacgttgatgaaggtgacaagagctgctcggtgaggttcaagcagtcactgaagagacttaatgaggaacttctgatggagttcactgcgaagggtgcggactgcgacaagttcctcaccgagaaggcaagatctggagcttccacatccgcagcggataccacactgaggctgtaaggcagagtcggcttgctctaagaaataaacttaaccattcaagctacggctcctatcctcagtcgatagggggccacaccgccacacatcaagtttaatgcctgcgctgccgttcatctaactgctttctgtaggtagtctatgtaaatatccctacctagctcttctggtaaaacataatcgacttattcgggtttagggacaccattctaccatataggtatataatagcctgtaagggtatttatgtgctgctttatctgcggagccatcgtccgcagctcggcagcttgtgtcgacatatgacgttagcttgtgtcgctatatgatttgggatcaccatttggatatcaaaatgaggttgatcaggcgattcctgcctaattcgttagtgtgatctcagatctcgtt

SEQ ID NO: 8873 - DNA, 984 bp, Sorghum bicolor
  unsure (1)..(984): unsure at all n locations
  Clone ID: SORBI-28MAY03-CLUS6166_1
ctgcaatcgttgaacctgggctggtgtgatagcatcactgacaagggagtgaccagcttggcttcaggatgccctgagctcagggctgtggacttgtgcggttgtgttcttataacagatgagagtgtggttgcgctggcgaacggctgccctcacctgcgttccctgggtctgtactactgccagaacatcacggaccgcgccatgtactccctggccgccaacagccgtgtgcgcagccagggcaggggatgggacgctgcagtgaagagcggcggcagcagcaaggaccgggagcgggacgggctggcgagcctgaacatcagccagtgcacggcgctgaccccgccggcggtgcaggcggtgtgcgactcgttcccggcgctgcacacgtgcccggagcggcactcactcatcatcagcgggtgcctcagcctcacctccgtgcactgcgcctgcgcgctgcaccctcaccgagccgggcgcgtcatcctctccaaccacgcctactgatcgcattgtggagcactggacctgtggtgctgggatgtgtgcgtaggccgctgaaccgcgcgcgacggggctgttgtgtgaggtgcttttgtggtgtgttgtttgggcgtgtactagggtctctactctctagggagctgtattgaattgaaccgtgttgaagcaactgggttaagtttgttgtctgtaaaaacatggactgtatttgtggccttggcttttgagatcttggggctggtctcctggagcaccagaaggtagaagcagcagcgagatggccgcgaagccaccgctttgatagggatagggctctctcaccggctccagcgtcggtgctgtgctgctggctcgcggagtcaaccgcaggtccgcagccgtgcccagcgaggggtcgcagccgcgcgcccgtgcttgtggcaagattttctaggcatggcggcaaagtgagactattnttaggcacggcaaagc

SEQ ID NO: 8874 - DNA, 649 bp, Sorghum bicolor
  Clone ID: SORBI-28MAY03-CLUS6175_1
aaagcgcccgcgaattttgttattagtccccaaaaggtctcttcggcggcggcggcggcggtggcggtggcgatgtctctccccccggacggcggcggtggcaccggcgacgactggttcctcgactgcggcatcctcgacgacctcccggccgcggcctgcggggccttcccgtgggacgcgtccccgtcgtcttccaaccccagtgtggaagtgggcagctatgtgaacacaaatgatgtcttcaaggagcccaatgatgtcttcaaggagcctggcagcaataaacgtttaaggtcaggatccaatgatgtgccaacatctaaagcttctagggaaaaaatgaggaggaacaaactgaatgataggtttcttgaattggggtctacattagaaccagggaagccagtaaaagctgacaaagctgctatcctaagtgatgctactcgcatggttattcagcttcgttcagaagcacagcagctcaaggaaactaatggtagccttgaagaaaagattaaagaactaaaggttattcagctattttttgttaactcacatataatacattgtccttttatggtgagagcatgcctgtgttattcaggaatccataacatttcccagtagtactcttatgttcatctat

SEQ ID NO: 8875 - DNA, 657 bp, Sorghum bicolor
  Clone ID: SORBI-28MAY03-CLUS60357_1
gcgctcccttccgcgctcaccctcggctgccgtttacagtttacccgcgtgctccctctctctcactcgctctcggcgacgactcggctaccaccgccgccctacaccaggttcccaggtcttcgtcaggctcagtccctcctccggcaacgagcacccaccagttgacacctgatactacctgaatctaatgcttatcaatatgcctaatatttgctggcggagctttacttcgtgcagcatgtattctccatttaatcagttacaagggagttttactcaaagagtagatctatggagtacttcttgctcacaggctgcgaggcatcatgcaaggataggttcagttgatttctctgttaagaagaacgtgaagtcatctcaactgcaaaatgtgacatgttttgtcggtttagagcaacatttgaaatgcagactatcagcaagaaggcatatcctgaatgtaaagtctgatatactgtcccaccaaaatgtttctagtgtaagctggagtttgggaagtatgccacaaagaataggatgtgtagtctctggactaggttttgcagtgtctgggctggcgagtgctgagggtcctgtgaacaacaacatagatagcaccgaagctgacaagtcatcaacaaatttatctcatgg

SEQ ID NO: 8876 - DNA, 762 bp, Sorghum bicolor
  Clone ID: SORBI-28MAY03-CLUS60441_1
gaaatttccagagctctcgcgcgcgcggcgtcatggcggagcgcctcgccgcctccctcctccccgccgcctcgccgtccccgtccgcccgccgcgcgacggtcgcagccgcggccgccgcctctttcccctccccatgctccgcgcgcgcggggctgcgcctacgctcccgcccgccgcccctctcgcactcgcagaaggcggccgggcgcgggcgtggcgtgcgggtggtccggtgcatggcggcgtcggacgcggcgcagctcaaggccgcgcaggaggacatcaaggagctccttaagaccacatactgccaccccatcctggtccgtctggggtggcatgattctggtacctatgacaagaatattgaggagtggccacaacgaggtggagctgatggaagcttaaggttcgatgctgagttgagtcatggagccaatgctggtctgattaatgcattgaagcttatccaacctatcaaggacaaatacccaggtatcacttatgcagatttgttccagttagcgagtgctacggcaattgaggaagctggtggcccgaaaattccaatgaaatatgggcgggttgatgtcacagcagctgagcagtgtccacctgaagggaggcttcctgacgctggcccacgtgatccggctgaacaccttagggaggtattctatagaatgggccttgatgaccaggaaattgttgcactatctggagcacatacacttggaagatcaaggcctgaccggagtg

SEQ ID NO: 8877 - DNA, 885 bp, Sorghum bicolor
  unsure (1)..(885): unsure at all n locations
  Clone ID: SORBI-28MAY03-CLUS60451_1
gcacgaggatcgatttcaaggatttgacagctataaatgcatcttcagaagaagtctcgtcttggatagagactataaacaatgagcatgctcaaaataatgccagtggagaggctcgatttgtgggctcgcgggaagccacaagctctggcaaaaatagcacagcctcactacttaggtgcacaaagaaggataatttctcatttatttgtgaatgtttcttcatgacctcaagggtacttaatctcgggttgatgaaagctatatcagactacaaacatatttctcagcaacttgcaaggtttgaagatgatttggaatcaaacagagcagtgagagatcaaggagggggctcaccacagcttgagcaagatataactcgcttggagaagattgtcgagattttatcacaggacaaattctgttatgaagctcagatactacgagatggcgcattccttcaacgagcattatctttctacagattaatgatactgtggtcagttaacctagttggcggatttaagatgcctttgccatcacagtgccccaaggagtttgcttgcattccagaacattttcttgacgatgcaatggatttacttgttctaacctctagaattccaaaggctttggaaagctttgtattggatgactttctcagcttcatcattatgttcatgggaagcacatcttacattaagaatccttacctaagagcaaagatggttgaagttttgaattgctggatgccgcanagaagtggcttgaattctacagcatcgttgtttgaggggcaccaactgtgtcttgactatcttgttagaaatcttctaaagctttatgtggatattgaattcactggctcccatacacaattttttg

SEQ ID NO: 8878 - DNA, 635 bp, Sorghum bicolor
  Clone ID: SORBI-28MAY03-CLUS6037_1
catcgatcccgctccaccatcaccagctccggccagttccagttcagtcgtcgtcccggcacgccgccagtgctcgtcgtacgtcgtgcttaataatatactcactttagatggcgatcaagaagggcggcgcggcggcgtcggggctgaagcagatcctgaggcgatgctcgagcttggggcggcgccagcagcagcagcagcagcagcacggcggggacgaggactacaacgaggaggacgaggagacgacggggctgccgtccgacgtgccgcgtggccacttcgcggtgtacgtgggcgagcggcggcgccggttcgtggtgcccatcgcgctgctggaccgccccgagttccggtccctgctgcggcgcgccgaggaggagttcggcttcgcgggcgccggcgccggcggcatcctcgtcctcccctgcgaggagggcgcttccctgccctcacctcatggctccgctgtcgccggcgctcgctcttctctcccagaagtgcaccaggtacctgcctctgaccgacggcgagctgggcctggtggcggcgacggcgttcacatatgaattcctgttattctcctaccacttccgcacccacatgggcttggaaaggctactaccaccacc

SEQ ID NO: 8879 - DNA, 594 bp, Sorghum bicolor
  unsure (1)..(594): unsure at all n locations
  Clone ID: LIB3476-037-P1-K1-F12
cggacgcgtggggtctgcctgccggcgcacactgcctctgatccaccgaccccgcgcggtccgacattgccgtgccccagccggcgacctgagaccagctcgccaccgccgggagccgagaccaaatggggtccttcaacggccacgtgctgccggggacgctgttcctagcggtaggcctgtggcgagtatggtccgcggtggcgcgcttcgccgccgacccaccttccttccgcgtccgggcgtggtgccccctcgagctccccaccagagcgccccgcctcctggagctctacgtggtggccggcggcgcgttcctcgacatgtgccttgagctcggcggcggcgtcctcgccggccgcggcggaggcgtcgccccggagtccagcctcatctacctcgagcacgctggcatgctcctcatgttcttcctcttcggcgcgctcgctctcctctcccagaagtgcaccaggtacctgcctctgaccgacggcgagctgtgcctggtggcggcgacggcgttcacatctgaattcctgctattctnctaccactccgncacccacatgggcttggaaggctactaccaccacc

SEQ ID NO: 8880 - DNA, 1299 bp, Sorghum bicolor
  Clone ID: SORBI-28MAY03-CLUS6055_1
gcagatcatcattcagatacttttgatcataatgagaatactggagaaactgtgtttgataaagacagtactaacttgcatgaagatgacaagagaaacaatgagaggtcagaagcggaaggaggacaaatcaacagtgcagatggtaatacagaagctaataataataacaatgaagatgaaaccaccggtcatgcagaagaaggcaagcatgatactgaatccaaatctactgatgagagtaaaaatgaagtcaattcaactggagatgatatgccccgaaacaatcattcacaagaggaaaacactgtggaggcaagtggagcgtctcatgatgaagtggtgcaaagcgatgaatcaaccagtgcaagtggaagtgggaatggatcagatggagaaggtgagaaaaaggaggcagttgatactcaaagtggttctgaatcccttcctgatgttgccaaggccgaagcaactgatgaccgtgctactggcagtcttcctgatgaaacagggaatataccatcagttcatactgataattcacaaaatgatgccagtgaaaaccaaggtgatgcaacttctgctacctcagattcatctgagcatggcactggtgaggctgtacatatagaaactggattggaagatgaaagtgcaacagcatcatctgggactggatctggtgatgacaagggtaactcatctgatagcacccctgcagaagaaaatactgagactgcatctggtgatgatgagaagggcatggaaacaggtacaaccactgaagctgtacattccaaagaagagaactctgagaacagcagtgtctcaactgaggcagagaactcccaaggagattcttcaagtggagtgaatggttcttcggaagagacatctaacaagggtgatggagctacagtaacgtctaacaatggtgagcaggtggatcccaaaattgaatctagcacatccaccaatgacgagcacaatgaatctcaaggggctgatggcagctctggagcaaatgactcaaatggtaacgaccctgaacaaactgggaaaactgaaagccagtgataccaccatcgagacacgaacattgttttattatacagatttgttcctggagattgaagaggggctagtgcacatagaaaaaatgttcacgtttgtggcttatcgtgatttgatactgccgaagtacaattgtgcctatcgcaagattggttatctgctatgcttattgcttatggcatgatttcttgtcaagttgtactagaatgagtcattattagtcgc

SEQ ID NO: 8881 - DNA, 1318 bp, Sorghum bicolor
  Clone ID: SORBI-28MAY03-CLUS6195_1
ctgttggcctctgcagcgtttcccgcccgatcccacctctgctctgctctgctcatgtgcgcggcgcgaggctcgagcccgccaaaccagggaggcaaagctaagcaaccgaccgcttcctctcagattccatctcactgcagcagcagcagcctgcgccgcttgtgctactgctgctacactgccatggcagcgcgcccggttcttccttctcctgctctcctcttgcttcccctgctgctgcttgtgactgcttcgtcaggtgccgcccatggctacggccacggcggcgacgacgacgacggtgcgggtaagctcagagtcgggttctacaaggactcgtgcccggacgccgaggcgatcgtccgcagggtcgtcgccaaggccgtccacgaggatcccacggccaatgcgccgctgctcaggcttcacttccacgactgcttcgtcaggggctgcgaggggtccgtgctcatcaactccaccaagggcaacaaggcggagaaggacgccaagcccaacctcacgctggacgcctttgacgtcatcgacgacatcaaggacgcgctggagaagcgatgccccggcaccgtctcctgcgccgacatcctcgccatccccgccagggccgccccctcgccccccaccttcgcccccaccggcggaaggtggagcaaggacgggaacctctaccaggtggagaccggcaggcgggacggccgcgtctccagcgccaaggaggccgtcaagaacctgccggactccatggacggcatccgcaagctcatcaggaggttcgcctccaagaacctcagcatcaaggatctcgctgttctctcaggtgcccacgcgatcgggaaatcgcactgcccgtcgatcgccaagcgtctgcgcaactacacggcgcaccgggacagcgacccgacgctggacggcgcgtacgcggcggagctgaggcggacgtgccggagccgccgggacaagacgacggagctggagatggtgcccggcagctccacgacgttcgacacggcctactacggcctggtcgtgaagcggacggcgctcttccactccgacgaggcgctgctcaggaaccaggagaccagggcgctcgtctaccgctacagggacgccgccgccgggtcggagcaggcgttcctgagggactttggggtgtccatggtgaacatgggcagggtcggcgtgctcaccggcgaccagggagagatcaggaagagatgtgccttcgtcaactagcgatgtaatactttactagaatagtatgtgatgatgcctgtgactgtcaattactcat

SEQ ID NO: 8882 - DNA, 801 bp, Sorghum bicolor
  Clone ID: SORBI-28MAY03-CLUS61966_1
gcaagggtagcaaaggaagaggcgtccacaattgcatacagtatcaatgatgcgactatgtctagcacacatggtactcgtcagcagggaggacgcgctgaaggcatgcagggacatgaagatttttgactgttcctgcctagtcgggacctcactggcacgctgcctcatcctcgccgccgcgctctgctacccaggtacgcccgtgtctccgggttcatcctccatcctgctcgccgccgcgcctgcgcggtcgccgcacggggcgagacgacctcttccgtgctcggggcgcacgtggcctcggtgccgtctccgcccgccatcagcgcggtccggggtgtggttccacgcgccggccgctcgctcgatcccgcgctcgtgcgctgctgtttcccgcgtgacgcggtcaagcctccgcacgcgggtgcttggtgggtcgcgctcctgtgccgtagtgccgtggtccgttcactccatcggggccgctcccttccgagcactctgattgcccctgctccctccttaccatgccacgctttccgccgtcccgttggaggtcgggggacctttttcgcgtctcggtccaatgttttgccgcctgactggtgcccttgcgctgcggccctacaatctggtgcggtcaaccttgggcctcctggtgcatgtagggaagggatccattgatgaagtgccgaagtgctttcaatccattggagcagttccctacagaacacactgattatccatgttgcttccttactattgtacaaaatacactgatgcaattgatttcggttg

SEQ ID NO: 8883 - DNA, 633 bp, Sorghum bicolor
  Clone ID: SORBI-28MAY03-CLUS62202_1
ggccctgcaatacatgatgaaggagcacgaggggaacgaagaagagaggatgagagccgcagtcggtaagtttgggctgtcagggaaggctcaggtgatgccaatgaggaacctgtcggacgggcagaggagccgtgtcatctttgcgtggctggcatacaggcagccgcagctactgctgctggatgagccaacaaaccatctcgatatcgagaccatcgactccctagcggaggcgctgaacgagtgggacggcggtctggtactggtgagccatgacttcaggctgatcaaccaggtcgctcatgagatctgggtttgtgagaatcaggcagtgactaggtgggaaggcgatatcatggatttcaaggaacatttgaggagcaaggctggtctatctgattaactagaagggaaggccttttttttccttctccttggagatttaccccttgtataatgtggtataggcacccaaagttttatctgtgtatcacattcagcaatcaccgagttgttatcgagtattagtagtaatatagatcatccaaacagtgtatcagtatcgagctgagtctcataataagaagcgaaagatttgtagtaataaagcaatattctcgtttcttttcc

SEQ ID NO: 8884 - DNA, 916 bp, Sorghum bicolor
  Clone ID: SORBI-28MAY03-CLUS62113_1
gcacgagggagttgtcctgatggagaaacattaacgcagcaagatggagtaattctactttttgatgcagaaagcccaaaccccattgcctcctggtcggtaaagaaggcatcgggtggcagcatttcttttgtaaaaggtgacgtctctttggatgcaaatgctgatagttcaagagaccacgaggcaatgttgctagtttatgtaaatggttctcatgaatacgccatctttgatccccggaagagtgaggtggttgttagcaagaacacgcacaagaagattcaagctgaggaatctgcaccaattggctacgcttctatttatggagaccttcaaaaactggagtcaaagaaagaggtctcagatgtcccattcatcccttcagacaggccttgggagaccatattcagtggatcgtctcatgttcttccgcctctcacaaaactatgttccgcgttcttgtcatcgttgctggagaatagacctgttggaaacgagtgagccgctccagagctatgtcccctcatacaacactagccagttgcaaaaatggaaatgcaggaggaaatccactgacctgaaggctatcgatgcatgcccacaaaggcacaaggtacttcagagatgctgggtggtgccgtctgagattggttacagaaatcacacgcgtgtgaggacatcggctgaatccaagctcattttgcagctgtactcgacggtcaacctactgatcgcagcaattttgttttcttctcagtttgacatgtaatcctgacagcaaaactagcaaattttggtgtgatgtctgatccgataatgcagtgcttgttgatgtgttacggcttttcagctaatgaatagtgtacggcacgaagttttacgcctgttatgagattaagctgtgtatgtttcg

SEQ ID NO: 8885 - DNA, 968 bp, Sorghum bicolor
  Clone ID: SORBI-28MAY03-CLUS62216_1
catctacatttgcactccaggaaggaaaattatgtggagcatctgatgcagaaagtttgatttatcttctatatttctcttgtggtggagtttgccctgagcttgactctgttgaaagtgcacttcagtggagggagacgtcatggtcgaggagagttatacagcagaagttgggcgacatctcagcagtgttaaaagcttttgcggattacgtggacagcctttgtggaactccatacccaatggactatgagatctggttgaaacgactgcgaagaacaattaatgaagatcatgggaaggaggttgacacgtcctcatcaagttaatactgcagcacattttcttgcaaatctaaaatttggaagatcaagagtgatcagccgattaccttttgttgttgttgtagataatttacttgtgaaaggtccataggtcatagtattgtccattgcatcacaccatttcttggatataagggtatttcaaagttgcaatctgctgctgctatcctcaatgggatcactgtcaatgttactattcattgtcttgccttcagcccttcacacaggagatacttgaggatatcagcaacatgatgtattttgtgaatctttggtaaattggtgagcctctgttctggttgccttcagagattctggtcccattttattcggttctggtaggcttcaggatgattttgtttttcttgtgatcagtatctaaactgttaatcagttggtaaatttgtaactgctctagaatagaggttacatagtctgctttttgagcttgactaagttatttgttgggcgtgatgttcaaggtcctgtaaatgatgttccattgagctgctcaaactcttatcctgctactgttcttgaatctctgtgcgtgggctgtggatgatctttgtttgcaacaataatgacatgcgtgtacaattgtttcacctttcattgaacttc

SEQ ID NO: 8886 - DNA, 482 bp, Sorghum bicolor
  Clone ID: SORBI-28MAY03-CLUS62221_1
acctcttgttgggcttcttcaggacaaaatcaataactggagagccccagcttttacattgacatccatccttttcgctgcagctgtgttttggttcattggtatatttgtccccagcgtcgatcggttcaatgaagagagtgaggatggccttactgtcgccgatagatccaatttcaggccactgcttgatgaaagcgacgagccacggacatttgactaaaatttgcgcaaatcgcaaccttttattttttggaagggtaatcttttagtagtccgtagtattcccttgtacccgcaacacgtgaaatgtaaatttgcatgcccgttggctgtacctgtacatatatgaggtctatttgccttgcgttttttttaaaacttctttgtacaggctacagaagcaagcaagagtgctagatttttcggattgtaaatgacaattgacaacttactggctagaattttattcccccgtttgg

SEQ ID NO: 8887 - DNA, 619 bp, Sorghum bicolor
  Clone ID: SORBI-28MAY03-CLUS60935_1
caatggttgaccttcgtctccaggtcgtcgccaccgtcctgggcatggtggccctggcggccgctgccggcggcagcagctccagcggcaagcagtccgagttccaggaggtcaccgtggacgccatccatcagggcttcaagaacggcagtctcacctcgacggcgctcgtccggttctacctggaccagatcgcccgcctcaacccgctactccacgccgtcatcgaggtgaacccggacgcgctggcgcaggcggcgcgcgccgacgcggagcgctcggcctcccgcggccgctgcgccgtcggcctgcacggaatccccgtcctcctcaaggacaacatcgccacgcgcgacaggctcaacaccacggccggctccctcgctctgctcggctccgtcgtcaggcgcgacgccggcgtggtggcacgcctccgccgcgccggcgccgtcatcctcggcaaggctaacccttccgagtggtccaacttccgccccgtcgagtccggctggagcgcccgcggcggccagacgctgaatccatacgttctgtccgcgacgccatgcgggtcgagcgccgggcctggcgttgccgcagcagccaacatggcagcggtgac

SEQ ID NO: 8888 - DNA, 1228 bp, Sorghum bicolor
  Clone ID: SORBI-28MAY03-CLUS6098_1
ccgggccccgagaaaccctaactcgaagagccgcgccgccgtcaccgtcgtctctagctcgctcgctcgctcgcgctctccgcccggatcggagcgctcggttcaaggaggagcgtctcggcgttgaaggcgaccgcgtcagccatggcggacgaggagcacctggagaggagggaggaggcctcagagcttgcccccttcgatccgacgaagaagaagaaaaagaagaaggttgtcatccaagaaccttctgatgaagtggacaagcttgcagagaagacagaaacattggcagtcacagaacctgctgagcttaacttcactggaatgaagaagaaaaagaagaagcaggtggatcttgattcatctcttgccgaccttggagacggggaggacagtcaagatgatcaagctgtagaggaacaaggggaaggcattgagcttggaggtggccctacatacccttgggaaggaactgaccgggattataaatatgaagagctgctggacagagtgttcaacattcttcgcgagaacaacccagatcttgctggggataggcgtaggaccgttatgaggccaccacaagttcttagggaggggacaaagaagacagtttttgttaattttatggatttgtgtaaaacgatgcataggcaacctgagcatgtgatgatgtttttgctcgctgaaatgggaacaagtgggtcacttgatgggcaacaaaggttggtgatcaaaggaagatttgccccaaaaactttgaagcaatcctgaggagatacatcaatgagtatgtcatctgcaatggatgcaagagccctgataccattctgtctaaggaaaaccgtttgttcttccttcgctgtgaacagtgtggatcttcaaggtccgttgctccaatcaaagctggattcgttgcgcaagttggtcgtcggaaggcctgaacacaaaacaaagctttgcattattagtcctgtgtgctgccatatgatgttagaattgagcttgtgctccgttttggtaaccaattttgcactacgaccattgtggtcgtgtatttcttgttttctgtgtcatattaatgcagctgagtttcaatttatggttgccttaatatctatatatggctggaaactggaattggggccataccaaatcaacaatattagattatttgctgactacagattcttccgtgcaatgttgagcaagatctgtcaacaat

SEQ ID NO: 8889 - DNA, 990 bp, Sorghum bicolor
  Clone ID: SORBI-28MAY03-CLUS60986_1
gcacgagggggcgatggaagcagccacggcggcgggatgcaggtggtgccctatggcgcggccgcccgcggcgcgcagcacggaggcgggatgcagatggtgccctacggcgcggccgcgggagggtcgcagcacggcggcagcttcagggcatcactcaaggtggtgctgctccacggcagcctcgacatctgggtgcacgacgcccggcacttgcctaacaaggacatgttctccaagagtgtagctgagttcctcggcccgcgcatcaccagcgctgttggcagcaagatgtccagcgcgaacatgaccagcgacccctatgtcaccgtccaggtctcctatgccaccgtcgcgcggacctatgtcatccccaactgtgagaatccagtctggtcgcagaacttcttggtgccagttgggcatgaggccgcccgggtcgagtttgttgtcaaggacagtgatgtcttcggcgctcagatcattggtgtggtgtccattcccgctgagaagcttctgacaggggccaggattcagggtgtctaccccgttcttgagcccaatggcaagccatgtgctccaggagctgtactacatttgtcgatacagtacatccccgtcgctcagctcacaatgtaccaccatggcgtcgttgctggtccagacagtattggcgtacctcatacttacttcccgcttaggcgtggcatgagagtgaccctgtatcaagacgctcatgtgcctgatggttgtctcccagacatatggcttgacaatgggctgcgctaccagcacgggcagtgctggcgtgatatctatgatgccatatgtcaggcaaggaagttgatttacatcgtggggtggtctgttttccacacaatccacctcgtgagagatggcactcaagctccatcacttggggacctgttgaagatgaagtcacaagaaggggtgcgtgtgctgctgcttgtttgggatgatcctacatca

SEQ ID NO: 8890 - DNA, 633 bp, Sorghum bicolor
  Clone ID: SORBI-28MAY03-CLUS60999_1
gcacgacgcttgaatctgtccacctttcctcgtcctcttccccaatccccatggccgccgtcgccacggtctcctcttgcgttccgcctacccttcccgagtgcgacggttacgacgccgccgtcctcgtcgacatgcggtgctacatcgcagacctccccagctccaccaccgcccggggcaccacgagcagcggcctgcccatccaggtgactttccatgccgcccgcccgccgctcctctcccacttgtgcgtccactgccccgacctggtcctcaaatcgaagcccagggttgtcgccacggacgccgacctcgtcctcctccgcgtccccatcgaccccaaggtcacctccgatatacggtactgggactacttcctgtacaagccacgctcccatcggctggacctgctcccgaacccgcacccccggagcttcgacgacaccgccaccgccctcctcagccgcgaagacggcggctggtatgccgtcgccgccctctccatcaggtgccccgtgcacaagcgcaacagcgacgtggtcgtcaagtgggaattcgacctccacctgtaccgctccgacgacgtttccaaggggtggatctccaagcgcatgtcagtgaaggagttcg

SEQ ID NO: 8891 - DNA, 723 bp, Sorghum bicolor
  Clone ID: SORBI-28MAY03-CLUS62668_1
ggcctcgacaaaattaatccaaggtacatcccattactaaaggagacgtttacgttcccacaaagcttgggcatattaggtggaaaacctgggacgtcaacatacattgctggcgtacaggatgatagggccctctacctagatccccacgacgttcagatggcagttgacattgcaccggataacttggaggcagacacttcgtcgtaccactgcagtgttgtccgagatttggctctagaacaaatagatccctccctggctattggtttttactgtcgtgacaaagacgactttgatgatttctgttctcgggcctctgagttggcagaaaaggccaatggagcgccactctttactgttgtgcagtcaatcgagccattgaagcaaatgtataaacaagatgatgggctgggctgttctggcagtagcatgggcaacgacgatgaccttgatggctctggagaagcagaggagtggcagatcctctaaacaaggcgaacaccgatgacatgttgggctgaaaaacttgcatcgaacacattgtctgaattgccttgtttgcgtgtgaatacaggggattatttgtgatgacagggtgtcgttgggtgccagcgtcccttaggaggaaatgttcaaaacgttacaggtggaaatgttcaaaaacatacacttgtggatgatcataactatatgtatttattattccatattctaacacca

SEQ ID NO: 8892 - DNA, 821 bp, Sorghum bicolor
  Clone ID: SORBI-28MAY03-CLUS62722_1
atgaagatagaaaattattactggattggaacaaacgtctagcaataattgaaggaacagcagaaggacttctgtacctacataagcactcccgattgcgtgtcatacatcgagatcttaaaccaagcaacattctcttgggctgggtactgagtccgtatctctcagattgcgcccttgctatatggtcttgctcacaaatcagacatgtaaacacttcgagctctccgtctcgtgctcatggctatatggctccagagtatgcctccgagggcctcttctctatcaaatccgatgtgttcagctttggtgttctcattcttgagatcattagcggaaaaaggaattctggtatccatgattgtggagatttcatcaatatccttggatatacatggcagctgtatgaagagggaagatggaaggaacttgttgatacttcattgttatccatgcatcattcagatgaaatgataatgaggtgcatgaacattggattgctttgtgtacaagagaatgcagttgatcggccaaccatgctagatgttgttgtaatgctaagtagcaagactcagatcctggctaagccgaaccacccagcatatttcaatgtacgggtaggaaacgaagaggcatccactactgctactactgtgtcatgcagtgtgtcaatgagatgactatatctgtcacaagtggttgatagtttttgtttgtgatgtatggttattcttgagccaatatgtatagaattattccctctgttaacacatgtaagcatttttagcatttaaaatttatccataaagaaaccatcattc

SEQ ID NO: 8893 - DNA, 756 bp, Sorghum bicolor
  Clone ID: SORBI-28MAY03-CLUS631_1
gcgtccgagactgacaaagcgtcgatattagatgagacgattgagtatctcaagtccctccaaatgcaagttcagatcatgtggatgacttctgggatggcaccaatgatgtttcctggtgctcaccaattcatgccaccaatggctctaggcatgaattcaggttgcatccctgcagcgcaaggcctaagtcagatgccaagattaccatacatgaaccaccccctgccaaatcatatccctctgaactcatctccagctatgaatccactgaatgctgcgaaccagatgatgcaaaacggtcacctcagggaggcaagtaatcacttccttcacctagatgggcgaacagcggtggtacctcaggtaccaggaccccatgtttatggacatcaaatagcacaagccgaagaacccaatagtatactggaagtggctgctagtactgttgtgccaacttctagggcagggcaaccacctagttttgatggagtttagaatgaggaaaatctcgtaatttgttgcactgatagactgacgatgcatagcataggtacctcgagttgtatatctgtacagaagtgtcagcgacatattctttgacatctaagcttagttttagagtattattaggagtctagtataggtaacaagacaactgcctgtctaccaccatattctatctgtggaagaattcgatctgcataccactgtgcagtatattgttcaagagagactggaatggatgagtattat

SEQ ID NO: 8894 - DNA, 1095 bp, Sorghum bicolor
  Clone ID: SORBI-28MAY03-CLUS63600_1
aggcgggtgatgccaaaaacatggagcactcggtttaccagagccgccctgtgcctttggggcctgggcctgggtccgcctgctgagaggcttgatgtgcctgcaaatacatcttttcacaatgctattcttggtgcatgtgcaagagcagatgatcttatggagatggagagggtcttcaggcacatgaagcatacacagtgtgatcccgatgctgtgacatactctatcttggtggaagcttatcgcaaggaaggaatgaccgataagatttatgctttgcatcaggagaacccagctttggttccgactgattttgtcatggtttaactgacccactgactgaatcacggtccagaaatgttaaatcctggttgcattggttgagaatcttcttgctatccacgttttggaattgataatgctactaagcagagtggcaaccattctccaactccattttttgtctgttgtcctgcagagttagtatagagtatagatgtctcctccaactcaagggggtttcagcgagatgtacccacgaaccacagtatgtataactcagataagatacaaggagttataaggctctgaaagtgcctcagcaagattctgtccagtttgagttgccaagtatttgaaaacagagggagttttctgaactgatgaatgggaaccaaattgtatgtttatcctgcactatggcactgttaatcctgttcttgacaagacaggggtttgggagaataaaagaattcctattccgatggtaaagctttctgtcgccctactctgtaccagattactttcctatgcccaaattcttccggatcaatagttggaactttttcacatttttttcatcaatatatagccatgacttttagtatgttgcacatgtactgaacttggaatatgtgtacaaaagggtaggcattaagttttttttagcacccttaaagtgtagtttagtgatcatgtgtatttcaccaaacagtatgttaaggtagtggataaaatttgatttgtcagattccacactttacaggtgatatgttgccaaccctgtagccaagtgatagatcataaggtttg

SEQ ID NO: 8895 - DNA, 1122 bp, Sorghum bicolor
  Clone ID: SORBI-28MAY03-CLUS6371_1
aaacgggaagcacaaaatagagggttctagtgtgccgttggttgtcaaatgggccgatacagaaaaggaaaggcaggctcggaaagcacaaaaggctcagttacagctatctaatatgcccagtgcaagtccaatgcagcagtcttcagtatttggagctttacagatgggatatatgcctcaatacaatggatttggctatcagccaccagggacatatggacttatgcagtaccctttatctcctatgcaaaatcaaggccccttccagaatatggttcaacctcttaatcaagggaactcgataagaggagtcaatcctgaactgtctcccagttcagttcaaaggtcctttgcaatgcagttagggagcccttatcctgctatccctggtatgcagtatcctgggtcatattcctggggttccatgaacaatcgtccttttggaaattctcacaattcaatttcaattaaagttccaaattcgaatgccaattccgccatttcttctagtcccagcagcaatgccggtggacaggttgaaggtcctcctggagccaatctatttatttaccatatcccacaagactatggtgaccaagagctttccagtgcctttcagagttttggtagagtactaagtgctaaggtgtttgtagacaaagcaacgggtgtcagcaaatgcttcggttttgtgagctacgattctcctacctctgcacaggcagccatcaataggatgaatgggtaccaattaggcggtaaaaaactcaaagtacaactcaagagagaaaacaacaacaagcacagtaaaccttattgacaaaaaggcagcagctgttatgaccataccacgccatccggtccttggtacatatttgtcggataattgaccgtccccacattgtttcctctgctcccctaccccctcaggcagctagtgagaccagggcctgtggagagaccgtgtaccctcttttgttcaattcacattcttggagattcgtcccctcgtgtaattcattgcagcacccataggccgtagcagcagtttgtcccttgatcagaatcacttgtacacaaagacttgccgattcatttaattgttacctcctctaactg

SEQ ID NO: 8896 - DNA, 692 bp, Sorghum bicolor
  Clone ID: SORBI-28MAY03-CLUS63770_1
atcaaaagcaagacccatccatctccagcaaatttgaccagcaaccctgagcaaaataattcaactttgaaaggtcatccagatcaacaagtgaattcaacagcagtgctgggcaaccaagtacagcctttgactaaccagacatcgttgcttgagttggattctcctccaaatggcaccttggctctggtaacagatgtccaaaagtccacatctggggctggagatgatggcagcagcaatacctcatcctccacccctgtggacaagaagacggacggcgaagatggtcccaaagaagatgtggatgtgtccactaaaataatgaacaaggcaatgagtgaagatgaagtcgttccagagtgataaggagatctctcttctcagcttctggtgtaacctgtaagtttgtaggacttggtttatctcctagacttggagatgcaatgcaagcaggctatcttgttgcgaccatttttttgtataagtttgataggtgtctgctttgtattgcctaattagtaagtagcccatcataatgatctgggtcaagtgaagaacaagaagcatgtacccacaaagaaatatagcgattctgcagctctgaagctttgctgctggaatcaaatgccaactaggcagctatgaatgaaatgtccatcgcagtccacttttgtgtacttttcaagttt

SEQ ID NO: 8897 - DNA, 500 bp, Sorghum bicolor
  Clone ID: SORBI-28MAY03-CLUS74715_1
cttgaagtgcccccacgtacgcactcgatcgactagcttacctcccccatccatccatccatccatccatccatcatcatcagtcgagtgatggagtgagtcccatccttatcgcctctctcgctgctctgcgcgacgtcaacctgtccttggacgctaagccaaaggcaaagagagaagaaagcccccctcctcccccaccgcgcgcgcgcgactaacagccggacacgtacgtgaaaaaccaacgtacgatcgaggagtactcctatgggcgttgcctcgcgcgcgccgccgccgcacacgcaagcgtggatcgacccagagagatcagcgccgccgccgccgccgctcaccagcagggcgcccgccgcgacgacagggctccgtcgctgctgccgccgcaggcatccagccgcgacgaggcacaggcggcggcggcaggaggcggtggtgtgtggtggcggcccccgttgcgcgccgaggacgagcacgccgtcatc

SEQ ID NO: 8898 - DNA, 792 bp, Sorghum bicolor
  Clone ID: SORBI-28MAY03-CLUS74766_1
tactgggatgctctaattacccttctaactacacctccgaccaggtctccgtcacctccatttacagcgagtaccaatcaccgccgcggcgcctgagaacgcatcccagtccagccttccatgtgcggcagggcccggtgcaccctcagcccggcccaggttgccagggctttcggcttcccctccgcctcccccgtccccgtccgtgggcgtgctgcccccgctgcgccggcgcgcctggggcgcaggttccggccgtcgtacaacgtgttgcctggggcgtacctgcctgtgggcgccgtgcggtcacgaccaggctgcggcgacagagaacggggtgcggatggggaggggccggtgatccagtgtatgaagtgggggctggtgcccagtttcaccaacaagaccgagaaacccgaccatttcaggatgttcaatgccagatcagagtccctaaaagaaaaggtttcattccgtcgactaattcaaaagaataggtgccttgctgcagtagaagggttttatgagtggaaaaaatatggatcaaaaaaacagccatactacatacattttcaagatcataggcctcttgtctttgcagccttgtatgatatgtggacaaattcagaaggagagatcaaccatacattcactattttgactacacgtgcctcaacttctctaaattggcttcatgatagaatgcctgttatcttaggcagtaaggactctgttaatgcttggttaaatgatgcttctgtaaaacttgaagaaattactgcaccctatgaa

SEQ ID NO: 8899 - DNA, 1575 bp, Sorghum bicolor
  Clone ID: SORBI-28MAY03-CLUS74843_1
tactggattgctcgttcactcattcatttgttccccaccgcgagctcatccgttcccaccgcgagttcagtcgttcccccactgcaagcctcatccgtgcgagcgctgagcggacggccctccgaccccttactccctctccccttcgcacgccccgcgccagcagcaagatctgtcccaggagacgacggagctgcaggaggtgcgcgctcgcagcggcgccgacatgaagcgcgacctcacgtggtgggacctcgcgtggttcgggtcggcaccgtcatcggcgtcgggatcttcgtgctcacgggtcgggaggccaaggaggacatcggtcttgccgtcgtcatctcctacgtcgtctccggcgcctccagcatgctctccgtctcgcggtgtgtccgagtcgctggtgggtcctagcggtggtgccggtttttttcgtgcgtttttttcttttgagcacgacgatggggttgaggacggctatagggcctcctccgctccgcctccgctgcgctctcctcctccagccacgagattcgctcttccaccactgccggtcggtgtcgggcccggtcgaacggcccctgcctcctctcctttcgggccggctgctctttgcccccttctgttgtaggccatttcggaggtctagattttacaaaatacaaggagagagagattttgatcttcattttttggaaggtggttgctaagaaaggttagtttaggtctctcttgcctctttttgttcattcttgctcaatttgagcaactttttggatctagaatttcaccacatgttagagagaagagtagctaggttaatatctttatttgctcaaatgaggttgcttaagattgttagatgacgtctcttcctttttcattttttgcttctcactttagtttatccaatatatatttagttatttccatgaattgtatgctcttgtgtatttatgtggagagagaaatataggttattttccttagttttttaaattatgtagtttttgtcttcatttctcaatttgatttaattatccactatgtatttatgtttcatgaatggtgtgtttgtatgtagagaggaagataggtttcttaattaattaagattttatgttactaattgaaaaatatgaaagagatttatctatttaccactatgttgttggctgaggttacttagcagggttaatatcattcttctaccttttagcgcaccttgctttgaggtctttaaattggaaagtatacaagtggaaggttttcatcttcatttcttcgaagacggttggtgatacaaaattagctaataaatatacttgttttacatttattacaattaattcattatattttttataggtaatgatgaagagatcattctagatgtataatttatcaagactagatccatcatatatatatacgcgtggtccataggattattaatgctgctaagaaccatgcttggagaacaaagacaaatcacacatattgtccatatatatactgcaaaaatatttttgtatttgatgacactgaactaattattctcatctagtc

SEQ ID NO: 8900 - DNA, 773 bp, Sorghum bicolor
  Clone ID: SORBI-28MAY03-CLUS7487_1
gcacgaggctcctccgggctccgtccgcccgcccggcccctggatttggaaccaacaaagaaacctgccgcccaccgtttccgaattcccatggccgtctaagaaccggaggcacgggaacagggatcgcagatccgccaaaatcacacctcctagttcgtcctccgtcccaatctcttcccgggccagtgaggcggcgcgacttggtgcctgcatcgagcccaagacatggaacagcctgaggagaaccctgaattcccaagctgtgatgcctactttcaagctatccagtccaagaagaagttgccactgtctttgcaagaatcgctaactgctgcctttgcccagattcccgtctcatccttccctgaggttccaactggtcgagtcattgaaattcccggtgatacttctgttcttgacgctgtaaggactctctctgaacagaacataagggcagcaccagtgctcaatccagaacctggggctcctactgattggcaggggaggtaccttggtgtcatcgattactcagcaatcatccgttgggtactagaaaatgctgagcttgccggtgttgcactctcggctgcatcagcaactgctgccggagttggcatgggtgctgttggtgcggttggggtggcagctttgggtgcaactggcccagctgctgtagctggcttaactgcagccgcaattggggccgctgttgctggtggattaactgctgaaaagggtgtggcgaacgatgggctaactgctgcagatca

SEQ ID NO: 8901 - DNA, 783 bp, Sorghum bicolor
  Clone ID: SORBI-28MAY03-CLUS64301_1
cgatgccatcgttaacggtattgagaggctgattgcacttggtgctgttcacattgttgtcccgggcattcttccaacgggctgtctcccactcttcttgacattgtttactattagtgtttcctcaacctcaagcgacacagacttcgatcagcacggctgcttgaaaagtttgaaccgtctgacagagtaccataactccatgcttcagaaacaagtacaaatactccaagccaagcataggtcaacaaggatgatgtacgcagactactcctccctggtgtacaaaatggtgcaacagcctcaagagtttggattcagaaatcctttggaaacgtgctgcggggcaggaggcaagtacaacttcgacgtcgccgccagatgcggcatgcccggcgcaacaacaccttgccgcgacccgtcggctcgcctgagctgggacggcgtccacccgacggaggcggccaacaagatgatcgccgacgcctggctccacggcccctactgcaacccacctattttaagttgaacaaatcatatcataaatatgcatgcagactctcgaccgtatgtcgtcttatcttaataagaacacggtgacctgttggcatgtagcagtagcatcgtctgtttatcaagctggtcaaacccctggcctccagcaatactccctccgtccccgaaaaaatcaattcctagaatccgtgccagtcaaactttttaaagtttgactaactttatagaaaagagtaacaacatctataatataaaatgcccattata

SEQ ID NO: 8902 - DNA, 586 bp, Sorghum bicolor
  Clone ID: SORBI-28MAY03-CLUS64384_1
ctggatactgatgacctatggattcgagtcctgcttcatggacaacatcggcttcctggtgcccaggctcgtgctcggggtcgtcattcagcttctctgcagctacagcacactgcctctctatgcaatcgtaacccagatggggagctactacaagatggagatcttcaacgagcatgtgcagcacggcgtcctggggtgggcagagaaggccaagaagagatcggggttcaaagagggcagcagctccccgaccgctgaatccatgcatggcgaagatgcggcataggattggaatggtgaggctaacgggtagctggggaggacgacaataatgaggcagcagtcgcaaacagagagaaagcgatagtgatagcatgtttcggttgctctacagcaatggcttctacgtatcatactctcatgtgtggttacagacgagctgtgtaatttttgcagatagcttcactcgcaccagccgtaaaagtgtaaaacactgttagtattataatactaattaatggtatgtatcgatatctatatactcttataaagttaaaactcaattagatgttttatttttgtc

SEQ ID NO: 8903 - DNA, 584 bp, Sorghum bicolor
  Clone ID: SORBI-28MAY03-CLUS64471_1
gcacaaactgcaagcccatgatggctacattctgaagtgcctgctttcaccagaattttgtgatcctaacaggtatcttgccacagcatcatctgaccacactgtaaagatttggaatgtcgatggcttcaagttggaaagaactttagtcggccatcagcgctgggtttgggactgtgtgttctcggtcgatggtgcttatctgataacagcttcttcagacaccacagcgaggctatggacgatgtcaaccggagaggccatcagggtgtaccagggtcatcacaaggccaccgtgtgctgtgctctccatgatggagctgaatcagcgccctcataagcatgttgtggactgcttttctgtacatactttggattgcagaacttttcagcactcttgtaacctaaagacctggtagtgtttaacgctcagttgttgaaatgcggggctgtagctgtatgttgccgcaagcctctggggttgcgtacaaataatctgcgggcagatgctgttggtggatgattctgcaaaaactttagtgatgacttcattttgttctatgaattggaatgtagcaatggtt

SEQ ID NO: 8904 - DNA, 787 bp, Sorghum bicolor
  Clone ID: SORBI-28MAY03-CLUS645_1
gcgtccggcagcattttgatgactgtatccctggaagaacttttgacaatttccagtttgtgaacttcactgatattatgtcaacaagtaaggatatgtcaaagaaggaggctgcatttgcccttgcagctcttatggaaataccttctcagtataaagcaactcaaggcctccgacctccagaaaagcatgcgcaaaggattggctctcctaggattcttcctcctccaaataaagttcttgaaaatgataatgctgcagcttcacatcctcctcaaactgcaagctcgaagtcaactggtattggcaaaagcactgccgacgagcaggtatgtcccatatgtttaaccaatccaaaggacatggcttttcagtgtggtcacctgacatgcaaggaatgtggcccaacattatcaacgtgcccattgtgccgtgcgccaattaccatgcgtgtgaggctctactcttaagacggtgtggcgtctggagggatgagaccaaacagtaaggagcaagaacattggagcgcaaggactttcactacaatcttgagatgtcaatgtcatgataacgatgcatgtacaaaaacgtctctgcctattcagtaatgttgttgatgagtaatttgtatcaatcacaagtaaaattctaatgttatcttgtaatagtagcagggaaattttgtgtccttgttgaatggaataccaccaattgcccagcaacgatagtaaactccatgtgcatttggaaggcacttgtgaaatgcagaatagactattcaatcttg

SEQ ID NO: 8905 - DNA, 486 bp, Sorghum bicolor
  Clone ID: SORBI-28MAY03-CLUS6451_1
gtgtgcatttcagattgataggggaagaagaccaggaattccccacccaacttgtcaatgggttccagtcactcactgctgagctatctcactatatccctgctatactctccgagctatgatagagccagaaattaggtagcatgtgaatggttgttcattctttcagttgcgggttaccaccaaatgtccatatttccattagctttggttgtatagttctaggaaccggaagttaactagtcttagaagttctgtaccgttttgcagcaccgattcctgattttggagtgtaaagtttgtataatacctagtgttatcggttatgcaccagttatgtgctgagtgccatgttttttgcagtttgctgctgtatcacaacgagaggacattttacaacagttgtattgtgatgttctgtagtgatacatagtgcctattctgaaaaaaaaaaaaaaaaaaaaaaaaaaaaaaaaaaaacataat

SEQ ID NO: 8906 - DNA, 1028 bp, Sorghum bicolor
  Clone ID: SORBI-28MAY03-CLUS64576_1
catggtctcactgcaaatgtgcgcaaaatgtttttggacatggacagtgaactatttgaagagtgccagcatcagtacatggagaaacaagcaaaagccaaagagatgcaggagcaacgagaatcagcatggagacaattggaagctgttgttgctgccaaggctgctggagatgatatggttttggtcaactaggtaatataacctttccacatcatttatttgttagtgcttgtgttcttacgttgttttagtcttgtaacctaaaactgtactgctctgtttatgtcctcttgttgttcttgttttgttttagcatatctgtgagatgcgttgccactttttgtactgctcaccttttgttttgacttggtcatggcagttcacaaaaagatggaatatatatgtaccaatgtttcaatttattatggacatttgatttttagtaatgtcaatcaaaccaagcatccataagtatgcaaacatcgtttgaaagggatgtttatgcttcctcaagatgattgctgctcacttatttcatgagcgtcacgtgcaccttttgagacaacaaggtattggtgctagttgcggtgctcttatatcaacattgttgacttgggactaccagatccatgttccttgcaccagtgaaaaaaagtgtggaccgagtttgaacacattggtggcagccaaggccaatcatgcagaatttctatgcctagtgaggtcctgctatggttctgacccgttcctttattcagcccctgcttttctgttgtgttaatttatgaataattggacttgtattaatccttcattgtttgccctagttccgtacccacaattgggaaaatcccagtagagaaaatgactgagctagattgtaagcttttatttatttatttttatttttattacttttctacttcggagttatttcagttcatgttgttgtatggaggtaacatcacgaattcagataaaaagcgcttttaacttagtttctggcatgatagcaatacaatggc

SEQ ID NO: 8907 - DNA, 673 bp, Sorghum bicolor
  Clone ID: SORBI-28MAY03-CLUS62328_1
ataaaaggcttagttgctgctgggagaaattatgagaacagtatttgcattaggaaagcatgtaattttttgctctcaatacaactcaaaactggtggctgggcagagagctatcgttcctgtgaaacacaggtctatgtagagggtcttagcactcatgctgtacaaactgcttgggcgatgctagctttgatttatgctggacagatggaccgggacccaacacccttacatcgagcagcaaaagtattgattaatatgcaactggagacaggagactatcctcaacaagaacatgttggcaacaccaactcctctgtttacttcaactaccccaactaccgtattttgttccctatttgggctcttggagagtatcatcgcaaagtacatgccaagagtaattgaagagagcccatgcaaaggaaaatatgatatgtagtattatgtcacatattaaagaaaaattatagtggaatcaatgaaatcacttgtattttctgtcatcaaatgtaattgggtagccacatatatacaagattacaatgggccatgtaatcatgtataactattgtttatgatgtatacatactgatacgtactgttatgaacaccccacaaataagtaacaatttggtttgtgtccaatccaattatcttgacttttgttcgc

SEQ ID NO: 8908 - DNA, 533 bp, Sorghum bicolor
  Clone ID: SORBI-28MAY03-CLUS6237_1
gcacgaggggcgcagccagcccggcgcccaaagcttctggagaacacctacccgtcttccctcccttgccccgccgtcgcgtgctcttcgaatcgaatcgcgccgctgtcgcctcacctcatggcggacaaggagcccgtcgtggagcgacccgaggcggctgaggaggaggacgcctcggccgccgccgccgccgcgggggaggaggaggacacgggcgcccaggtggcccccatcgtgcggctcgaggaggtagccgtcaccaccggcgaggaggacgaggacgtcctgctcgacatgaaggcgaagctgtaccgttttgacaaagacgggaaccaatggaaggaacgaggcacgggcaccgtcaagcttctcaagcacaaggagagcagcaaggtccgcctagtcatgcgccaggccaagacgcttaagatctgcgcgaaccacctcgtggcctccaccacgaaaatgcaggagcatgccggcagcgacaagtcgtgcgtctggcacgctgccgattttgcagatggcga

SEQ ID NO: 8909 - DNA, 793 bp, Sorghum bicolor
  Clone ID: SORBI-28MAY03-CLUS62402_1
taaattaatgtactcaggtgatgagtttctcaagtacttgcttgcaagcattgtcttacttcaatgaaaaagttaagtggtatgcaatgtgaatagcaacctcaactgatgacctaattgtttggatgatacgatcaaatatgttagtcttctctgcttcaaatgaatgccagtgtaggagtgatttgtaggcaatgcatgctgcagcagattttttgtcatcaaatctcctgtcttctaccagacttttaatcagggcatcgtggttttcctgtggaaggatgatggaagaacaaatgattctttacaggaggaataaccacctgctcctgcatcgtagcatatgcccacattaatgtgatatatgaatgagattttacagtatcttatataaatgtttgccaggagtgaccactgccggaacagctagtgcagaattacagcggagcaactcgatctctgactccaaggtggcaatcttgctttcgaatctaaacatatcctttttttagtttgtgaggctttctcataggacatgagtacaacccagaaaggaaaaaaatgtgaatgtgaagtatgcatattgtagtatgtacctctctatctgtttggatttatcttcatcagctgatgtaacaaccagtgattgttgtcgtagaacctggttttcagattccatatgggataaacttgcttcaaccctgccccatattgtggaggtagtatgtgggcaccatttgtaatataaacgatttagttttccaaagaataaatttattagtccctttcgatc

SEQ ID NO: 8910 - DNA, 629 bp, Sorghum bicolor
  Clone ID: SORBI-28MAY03-CLUS62517_1
ccttatatcggcttgaattcaagtcttcagatgcaaagaagattgctaaatcaaaattggcttgtaatccactgaatgaaattcagcagcaaatggttagactcagtgcagacagtcctgtagacaccaaacggatggcccggagcaggacaaaggctaacccggtagatgtcaatactaacatctattcagttccaaacaccgcagttcaagctaatgttccaaatgcttatcagccagggccacaagtggaccagatgacatatttgaacggtaatgtcgtttatgggcctcatctgccgtatggttactcgactgaaaaaagtgacttttattggaactcaaatgatgggacatgagaagataaacacatattcgatttatggcatatttggccttcaagttctaacagttcccgctatggttattgggtctattttattagcatgacccaccatcttcttttattaattgtaattggccctatctacaggcaacatctgtgaaacgttttcgtcctaaacttgtaatataggcgtataatgaaaatagcatctcctcgatgtgcagctggtatgtaagataaatctctggtttggtggacgagtaccctgtcgagttggtggctc

SEQ ID NO: 8911 - DNA, 825 bp, Sorghum bicolor
  Clone ID: SORBI-28MAY03-CLUS62587_1
tccaagacactcgcagagcaggctgcttggaagttttcaagggataatggatttgaaattgttactataaacccagcaatggttattggtcccctgctccagcctacactaaataccagtgctgaagcaatcctgaagttaatcaatggatcatctacatatcccaattcaagctttggatgggttaatgtcaaagatgttgccctggcccatatccttgcatatgagattccctcggcaaatggaaggtattgcatgggggaaagagttgttcactactcagaactagtcaaaatcatccgcaagatgtatcctaccattcgtcttccagacaagtgtgcagatgacaagccatttgtcccaacctaccaagtatcaaaggagaagataagaagcataggcattgagttaattccagtggagacgagcgtcaaggagactatcgaaagcttgaaagagaagggatttgttagttttgactcgagcaacctgtgaaacagaagtattactattagtacctgatactgcattagagacatgcatcagacttcgccattcacaagttgctagtagctttgatctgtaaggttacctaaaataaactgtggcacgtcgccacgttgtagcttttttttcggatatgttatgttttggtcggcttgggaaaacgtgatatatatggctagtctcgatagggattttatgtcccagctttcaacgcatctatattttagaaatagtcatctctctttataaatatggtgttataatagcatatttaatacccgtaaaactttaatgaaattcgattgagattggcagctg

SEQ ID NO: 8912 - DNA, 988 bp, Sorghum bicolor
  Clone ID: SORBI-28MAY03-CLUS6472_1
accgtccgccgtctccctcgctattgactatcggattccatccctctccccccgtcggcgacaatccgccgcccccaatccgcctgctaggtccttgcacctcgggccatggctgccgaagctggcccaatctccaaggtcctcgtcgtcgtagcgatgcagacggaggcgatgccgctcgtcaacaagttcaagctcgtcgaggcgcccgcccacgaatccacttttcctaaaggtgccccatgggttaggtaccatggcaactacaaagacctccacattgaccttgtattgcctggaaaggatgctgcttttggagtcgacagtgttggtacagtatcggtagctcttgtgactagtttttccattcaaacattgaagccagaccttatcattaatgctggcactgctggtggcttcaaggccaaaggagcaagcattggagatgtattcctagcatcagatgttgcattccatgacaggaggataccaatacctgtctttgacatgtatggaattggagcacggaaaacttttgcagctcctaatatcttgaaggaacttaatttgaaggttggcaaattgtcgactggggattctctggatatgtctccccatgatgaggaggtgatactgagcaatgatgctacagtaaaggatatggagggagctgctgtagcatatgtcgctgacatgttctcaacaccagcaatctttctgaaagctgtgactgatatcgtggatggggagaagccaacgactgaggagtttctgcagaacctgattgctgtgacagcggcactggatctggcagtcaccaaagtggtggatttcatcagcgggaaacgcatctctgatctttgaaagctcatggtcatgaaatccaacaccccaccccccctgctctgatgcccgattctagactaggatacaatacaacatggggtcaatgattttttcgatgtgttccatatgtaggtttcacatt

SEQ ID NO: 8913 - DNA, 693 bp, Sorghum bicolor
  Clone ID: SORBI-28MAY03-CLUS64782_1
atggagatataatccagaggacagtaggtgggtactatattgtacagggaagggcggatgacaccatgaaccttggaggaattaagaccagttcagttgagatagagcgggtatgcaacagagctgacgagtgtctgctagaaacagcagcagttagcatcaagccttctggcgggggaccagaacatctagctatcttagcagtgctaaaagatagatcggcccagtatgacgtgaatcttctcaagaggaagtttcagacagccattcagaagaaccttaaccctctcttcaaggtgagctatgtcaaagtcgttcctgagttcccaagaacagcttcgaacaagctgctgagaagggttctgagggatcaactagcgcaggaactctcaaatcggagcaagctatgacctttgggattgttcggccttctttcaaataaaggaggcatcgtttaccgcgtgtccattgttgatgtgttgtgttgtattatactattgtcaatgcatgtcaagatgatactacaaaattttcccctcttttgtaaaacttcaagccttatacgtttgttgcccttttgaaaagggaaccatattccagagaacgtttgtaaagggcaatacattttatctgatcatttgaaaggctaaaattcaaagaacccagatgttgcactggggttgtgtgtgtgtc

SEQ ID NO: 8914 - DNA, 408 bp, Sorghum bicolor
  Clone ID: SORBI-28MAY03-CLUS64858_1
aaattaccatcattgtttttgtccatggtatggaacaattgattttattggtcaatctcttccctcagtaaattcatggcgcccccctgcattcatcattgtcagaaaagatcagtcagcgtgtcccttgaaggaattaagggtagtaacagcaagttttttgcaacttactcccaagtgccttgtttttaaacttgttcatagatgagactgcttaagcctcgactgaacaaccgctcgagtgacccattttaggccttatcagcatttttgagccaaggatgctctgtttttttttttttcaaaaggagaaaaggtgctcgtatttcagtatacagcatttttaaacccctttgtttttttatttccaacaatggcaataacagatgaaaaacgtgctccctgtcg

SEQ ID NO: 8915 - DNA, 654 bp, Sorghum bicolor
  Clone ID: SORBI-28MAY03-CLUS64945_1
gaggtgtgccgaggctttcaagacatcgggccagcccacgcccggtccgctgccccggccccctccaccaccggggcggccggcaaacagcgcccctcgccccctgacaacacggccacctctcccctccacccatccctgaagaacccctacacttccacccattccagccgaacccgcttctgcgagtttcaccgcagcctcgctgcctccacctccggggaggttctcgacgcccgctcccacgccacggctgcgctgctcccacccgaggccgtaccggagctcctccatgccacccgggttcctacctcctcgcaagagcggcccccaacctccgcaccgcgcaaggtgcggtgctccctacgccagcacccctcccgcggtctactttgtaatttttggcgggcccgtggctcggtcaacaccgtagtttgattggttccatatggttgccgattcatatgaagatattgcaagtgttggttgaacatccttgaattcgcacgtcgtccatagttgtgagctcggattgccttccatactgtgcagttcatactttatatataactgtttgtgtacggtgctgttcccctccgtgccagtccaagggtttcgagctatcgggtgtggcgtcgccctgtctgctgccgc

SEQ ID NO: 8916 - DNA, 794 bp, Sorghum bicolor
  Clone ID: SORBI-28MAY03-CLUS65075_1
ttgacggtctactttatggtgtatcagattttgactatgttgctcaagctactgtatgttaactagttccagcttttttgtatcctttgtttttcaattgttcagtctttccctgtgtttcctttctatagattgcggttggtgttacatcttcactcgtcctgttatgggctccgtctatatttggcctggctggagtttgggctggtttgactacactcatggggttgcgtatggctgcaggcattctgaggttgctatggaaatctgggccttggtcatttttgcatgaggagccataagctgaggtttatcaattatcagcctgtgcagtttggagttgttaacttattgctggggatttacatcactgcaaatattatccaagtgtcatggactcagtgaagctgttacctcggtactcctctggctcagaagaaaatctgacttgattgcaattcttgtcgagagaataaaatcagtctgctagatggcatggcttagtgaaccattggcacgaccttttgctaactctttttttctgctagcagctgtgtagcttctctagatgaaaagataaaagggtcgtgtatagcgttgacgcatgtaactcaaggtgtttgatactgacgtgtttgcgccgttccataattcttgattttgttgcccggatggacgaacgatggacagtttggacactctgatcagatacagtgattgaggtgcctctgaatggtactcagtgtaaaattattttagaacctttttttgttgataaggtacatgcatgttcc

SEQ ID NO: 8917 - DNA, 942 bp, Sorghum bicolor
  Clone ID: SORBI-28MAY03-CLUS6497_1
cagctttggtgtcgtgcttcttgagcttgtcaccggaaagaagccagtaggggagtttggggacggtgtcgacattgtccagtgggtcaagacgatgacggacgcaaacaaggagcaggtgatcaagatcatggaccccaggctgtcgaccgtgccagtgcacgaggtgatgcatgtcttctacgtcgcgctgctctgtgtcgaggagcagagcgtgcagcggcctacgatgcgggaggtggtgcagatgctcagtgagcttcccaagccagctgcaaggcaaggagatgaacctcccagcgttgatgatgatggttccgcggcgccgtctgatgctccagcaggagatggatctgttgaagcgccacatgacgaagccactaacgagcagcagccgcaaccgatctcgcagtcttcgccgactactgatctcatcagcatgtgagagctgtgccacgcttggtttctctcattcctatgtttccttgtaatggtgaaattcggatgtttgaatatttctagcttagggcctggtgttttaggtctctgcacttaattagggtggtgtgagatttcagatatcttgtgtttatccatctgcatttaggtaggctgtagggtgtgtgtgaaatctaggccccagaatttctggtgtggtatgcatcatagcctcttaggacactgttctggatgtacatatcaagcctcctaatctccattttgctgttagaattgaagaaccatttagggggctaggagtctaggattctggagcaatcaagttcgttaatgttacctgttgtacttgtgttaatgttaagagtgagcaccccagcattcatatgttgtactgcattgcacttcaccctctagctagggaagaagttcaggtgcgtttggatgttgtcagttaatgcaacacctttccttgctttgcactgt

SEQ ID NO: 8918 - DNA, 699 bp, Sorghum bicolor
  Clone ID: SORBI-28MAY03-CLUS63795_1
gatggctggggagtaactgtaactcttggtgtaccaaaaacaaaaccagaagtgtctgctcattatgcatttcttctatccggaagaacactgaagggatctttgtttggaggatggagacctaaatctgatctaccttcattggtggataaatatgcagacaaggaaatccaagttgatggcctagtcacgcatgatataccattcagtgaaatcaacaaagcacttgagctcatgctagaaaacaagtgcttgagatgtgtgattcacatgccacagtaacaggatccgacagctgcacatgatttctaccatatgttacatatctgctttcccccttgatcacctttgtggctcaactgctcaagtacttatcagcacatcggagctcgactttttgcccttttctggtgtcctggtaaagttgttgtagatccagctacccaagtccagaattgtccagagaactagactgatttgcttttgtatcttcttattactttttcttcaggaattgtcttactgatgttgaatctgtaatggctgctctgttattttaatgttccaagtataaggcatcaagccaatattgttcttctgtttaacctttggtttgatgaattgagatttgaaggattcttgaatctgtaacattgtgtaggactgaataataacaaaattgaagtgaaaatattccct

SEQ ID NO: 8919 - DNA, 1483 bp, Sorghum bicolor
  Clone ID: SORBI-28MAY03-CLUS6396_1
gcacgaggcttagttcctgcacataccattttggatttctcaagcaaacacacttttgaaaatgttggaagcaccaaggagaagaaagcacgggttcaacgaatttttgctgcagggaagtcactgctgaactttgttcagatcgatcagttgaggatatattttgatccatcttccaagaaatttgtcatggccaagaaccctcctgtgtctaaggctaacaaccctcttaatgagtctcctgatgcacttaaaacaaatggcgctgacatggatcatgaggctgctagaacatttgactcagtttcctctaatatgggcacactgcagtctaatgtgcagtttggtcctgatagtgacgatgatgaagaaattgttttcaagcctatagcttctgaaaagtttctgaaagctccttcagacctgttggttaatgcacgtgcctatcctctaccaatgtctgctgctggctggccaaccaatgctagtttagtgtctgttcagagcactgcatcaatgtctctgactggttggccacccaatggtgggtcacattcttttctaagtactgcatctctgtcagctgctggtaattacaacattaaccagtcgcttcccagctcttctgttggttgggctgtcaatggtgagcaaaatgttattcctagcattgctccaagatttgaactcatgcagcctgttgaggagcctgcttccagctggacaagcagtggtgcacagcatgttgttcctcagcacataggtttaactttccaagatgttgtctctgaaccacgtgtatctgcatcaatggttcaatgttttaatagccctgactattcaaaatttctcagtgaacaagaaatgctgttaatgaatggactgaagactgtcaacataactcgaaatggctatctagagcagaggttgcaggctggattgagtggtgtacagtctattgggtattcgtctactgagcctgctggtaccactaaaaactcgatgcataatcatgtgaacattactggagagactgtcccctctacacttgattcagttgtaccttcaatagcaccatcaggtggcatgccaatgaaattcacagaagcaccactaactgcttcaaagaagaaccctgttagtcgtccatcaaagcctgttgggccgcctccaggatttaatcatgtaaccccgaagcgtcaagatgattctattctggttgaaaaactacagagcccacaggtcgatgattacagctggctagatggctatcagccatcgattgatgatgttaacaatttaagagctgtttatcctggtgtcggtgatactatcacttcatttgccactccattccccttccctgggaaacaacagatctctgagatacatgcacaaggggccaatgagaagacatggcaagatttccacctttttgagcctccaaagcagaatatgtgccaaaattactaccaaagaaatc

SEQ ID NO: 8920 - DNA, 582 bp, Sorghum bicolor
  Clone ID: SORBI-28MAY03-CLUS64052_1
tggcacatttggttacatgcctccagagtatgctcggtatggtgaggtttctcctaaagtggatgtctacgcttttggtattgtcctgtatgaacttctttcagccaaagaagctattgtgagatcaacagaattcactgatgcacaaggcctgtctaatctgtttgaggagactctcagcatgccaaaccctaaggaagctcttcaggaactgattgatccaaggctaggcggtgactatcccattgactcggttgtgaaggtcgcgtaccttgcgaagtcatgcacgcatgaagagcccaggatgagacctaccatgagatctgtagtggttgctctcatggcgctttcatccaaggaccatgagctaactcggggacaggattagcataccagtgccttttcagattattagatgaaagtaatacaaatcgatcgtgtacatatgcaatgtattttcattctgattttgtagcgctaaagtatgccagtaatattacttgctgctcggaatagacaattaaaaaacaatagtttaattcaatatatcagaagtggagatggccgagcggtctaagttgc

SEQ ID NO: 8921 - DNA, 781 bp, Sorghum bicolor
  unsure (1)..(781): unsure at all n locations
  Clone ID: SORBI-28MAY03-CLUS64281_1
ntgggagtcattcaaatcccctacagctgttaaaattgcacgaattgtcaatggggggaacaaacanaatctcagcaagattggcataatgggtaaggactcatcaatccagtcagctcctgctccagttaagtcttcaaaaaagaacaagtggaaacctgaggaaatcaagagcttaatacagatgcgtggcgaaatgaatgagaaatttcagagcgtgaaaggaagaatggttctgtgggaggagatttctgataccatgttgaaccaaggaataagtcgtacgccggcacagtgcaaatctctatggacatcgttagttcagaaatatgaggaaagcaagaaggacatggaaagcatgaagacgtggccgtatttctcggccatggataggattctatcgcagcaaggggaaatggcaacaaaagggtagaaaaaggctgtagtttagtggtagagatttagaacattgatatgttgtagcagagcccagtgaatctagtcgagtaatgttaagatgaaatgtccacaacatctggtgatccattgggatcggattccttttttgagtaagatagacggtagcacgagatcgagatggcttgactggctgggaagtggggcttcagggcccgtgaactccaggagttgggtagctgatgtatatgacaacctgttgtgtagaacaacctgacttgcaggaggtgggggttactattgagctgtatgagccacaccgttgattggttcagtgtacaaacggcatgtacgtgtctttttc

SEQ ID NO: 8922 - DNA, 873 bp, Sorghum bicolor
  unsure (1)..(873): unsure at all n locations
  Clone ID: SORBI-28MAY03-CLUS64176_1
catgcttcaagctcagagcatcttgatgagggcggcatcctcggcncaggaactaagaaggaaagagttgtttcagctgaagatgctgtgtgctgcatctgtctaacaaagtatggagatgatgatgagctccgtgagcttccttgcacacatttctttcatgttcaatgcgtagataaatggctcaagataaacgcagtgtgcccactctgcaaaacagagattgggggtgtggttcgatctttcttcggtttgccatttggccgccgccgtgtcgataggatcgctggaagaggtgtagcttgctcaagattcaatgtatagaacaatgttgcttttctgtgatatcctctcttacgcataaagagccctgctcatgttgttgcaatggtttgattgactgtcaagaaaagcactgtgtgcttgacttcaagacaatgacacctagtgaggaacctgatgctcctaggcgcaagtttctgcagaaatgtgaaggacctaaggtgctggcgtgctgctatactctgatgtaacatttttccaaggatgtaaatgaggaacatgaagttcacttgccaggtatattgcaagcaacttcacaggtcttctagcatcggccttggtgttctttactgccagttctgtgattctctttatcacggcagtgcactgcaggcttggtaaaatgtgaaataaagggcaatggcctatttttcgaacccaatgcctcgaagtcaataccctaccatgtatatattttgttgcttttgagatcctattacgttttgggtgagagtaaacccataacgtttctgacatgcacgatttattgtggcaagttttcatcagaaattcagaaaatacattgaagtc

SEQ ID NO: 8923 - DNA, 1302 bp, Sorghum bicolor
  Clone ID: SORBI-28MAY03-CLUS6552_1
gcacgaggcttcttcggcactctccgtcgtcctgcaaacccgtgttgccttttcccccaaaaaagaacttgacgctgtcctcctgctgccgcaccgctgccctgccgcaactcgcactgccgtcgcagctgcctcaatgcactcctccctctcttcatccgctcctatcagatccaagagcaaccccgtacctccgacactccactgcttctctccgcccctacgcgcctccgcctctcgatttgctcccatctgagggctggcaagcccatagtcgtgtcaatagccggcgccatatcgaagctgctagcctctctgtccgaggccgacgaccccatcttggccggcgccgaatcatcgatctgtggctgggttgtcatgccttgaccgagcggtgtcgatctgtgcacaggcagcttggatccatggttggatagtgtcaacaatgaccgggcgccacctcacccctcctctaagctgctacgctcccaacatatgccaagcttcccagttcgggccctttgttgggcctctgagagaaggatctggccaccaatgcagccattattaaaactacaatcagattagcagagacatgcacttcacatgcagatctcaggtttgctaatacgtaaacaaggtactcaagattacctcagtttgaaggctacacagtggagatttggagatttttaactaaggactaaaggtttctattggaggcggtgtgtactttaaagatagtgaagaattgttgaggacctgtgactgagactcaagaactagaaaaatgtagaaaaatgtttgaagaaaaggatgaaggacatgatgtaccaagtccgtgtggatgttgttaaggagtactacagggaaataaaacacagagaaatcaaggatgcaatagcgtgccatattgacctcgagtatgagcagtacaagcaagcaaagctcaagtggttgaatgatgaggtgtggttgctcctttgtgcttattggtgctcagatgtgtacaaggtaaaacgtaagagagggcaagcatctcgctcaagtagtgaagatattgctcaaaaccgaggagggtctagaccattcagagacacaagtattggaaaagtttggatagcaatggtagatgtggtccaatcattagccgcaaagcccaacaacgcatggacgactatctttgtgctgttaagaggatagaatgtgcaaacgaagaggatagagatggtgtagaccatgaagtggatgggcatgaggtcgagcaagagcaatatttgaatgggaaggcactatatgatg

SEQ ID NO: 8924 - DNA, 683 bp, Sorghum bicolor
  Clone ID: SORBI-28MAY03-CLUS65665_1
aagaaattagagtgctcaaagcaagccatcgctctggatacattagcatgggataacatcataggattcccggcctctggtgttcgcccgcggcttcgggggatcgcttcatgggctcaacaacacaatgctgaggagtcagatgccaatgaactcgagaaactagagaaactcctggcaaatgctttgaggaacacgaaaaccaaaaggatgttggcaaaacaaaacaatggtggtgccggtacaagtacaggcaaccagaacagcaacggacctagtagtcacgagtaaggagtggctttgctcagcacagagtgtgcaactgacaaatgaaatggggcgtgcatctgttgctgacagtgccgcgtagtattgttaggcagctaaggtttgtcaaggttagctgaggaagggaagttcaataacaggatgcagaaatggtgtcgtccttgccgaaccagaccctgttatgttgtcgcaccttgtttcttttcctagcattgtgcctgctgcttgatgtttgtacgggttgtgagtctgtgagatgcttcatgtttgtttggatgtgtcaacctgctgtgaccctcgtggagcctgggtctcacgctacttttaccaggtgtggtatgcagaagaagtgacgctgtataattatgcaagtttctggcagatttcaaattttc

SEQ ID NO: 8925 - DNA, 800 bp, Sorghum bicolor
  Clone ID: SORBI-28MAY03-CLUS6573_1
gccggccgggccgggcttcgtcccttggtcttcccaccaatctctctcccaatccgctaatcgctctttgctgctccaatccgctaattctctcttgaaacttgaaagggcagagaagggcgagatgacggtggagaaggtggacgcggcgctggcggacttcgacgcccacttcgaccgcctcttcgcttccccggacgccgcctccgacggcaaggtgaagctgctgctcttcctggccgaccgcgagcctgactcctccctcacctggtgccccgactgcaacgtggcggagccggtgatctacgagcggctggaggcagcactgcagggcaaggacgcggtgctcctgcgcgcctacgtcggggacaagcccacgtggcgcgacccggcgcacccgtggagggtggaccccaggttcgggctcaagggggtgcccacgctgatccggtgggaggatggcgccgccgccgcccgcctcggggacgacgaggcgcacctcaaggacaaggttgacgccctcctctccgttccttccatctgatctgagtaggctgctataacaatctgtgattcagttcatgtatgccgaaccaaaagctgggaaattgagtgaatgaagctaataaatcagttcatgtatgaggaaccagaagctgggaaatacgtacggtacgtacgtaataaagccgctaattcgataatagtgaagctagtaattcgatggttctctgtctcattttgcattccaaaatctggattgtatttcacgttgttgagtgaatcctaagataatcatc

SEQ ID NO: 8926 - DNA, 673 bp, Sorghum bicolor
  Clone ID: SORBI-28MAY03-CLUS66040_1
ccgcgaggggtaccaactagattatgtatttgactggaccattatgaagtatcctcagtttagagataaaagcaaacttcagtctagtggcaagattagtgggttggcaggcccttctgcagaaaggactgatagaactgcagctgaagctttgtttagaagaactggatctggttctggtcacaatcgagaacacaccaagcacagaagtcttctagagtcactgatgccatccaagactgttgattcggataaaacaaggccatcatcatcatcgcgcaacggaagcacgtcaagaagagccgtgctttcatcaagcaaaccaagctcttctggagatccaagcgacccaaaccgcatgggtcgcctggtcccaagtagcagcagccgtccaccgactgcccaaagggcacatccttcaggtggagctgagatgagatcatcgtctttgtcaaaaatcggaaggtcttcacatgatgatgctatcaggaactttgagctcctctcacttggtgcagacaggagaaaataaggagctgacgaaatgggctagggtatggattctggatgatgacgatggagtgctggcctgctgggggtattatgagcaggcagctccagtatttgtatgttgaaaaatattcttttcgaaataaaagagatgatttaactt

SEQ ID NO: 8927 - DNA, 746 bp, Sorghum bicolor
  Clone ID: SORBI-28MAY03-CLUS6614_1
ataaagcatacattcaacaagtcaagaaaaatgctcaggctttggcatcagctttgctcagaagaaaatgtagattggttactgggggcacagataatcacttagtactttgggacctcagaactcttggcttgacaggcaagatcttcgagaaggtttgcgaggcatgccacatatctatcaacaagacaccaatttatggggataacggctcgatatcgcctggtggtgtgcggattggaacacctgcaatgactactagaggttgcttagaagaggactttgacgtgattgcagacttcctcataagggctactcatattgctagcaatgttctgaaagaacatgggaaagtgcaaaaggagtttctaagaggcctacagaacaatagggatattatagaactccgaaatcaggttgaggcatttgcgtcacagtttgcgatgccaggttttgatgtatgaatgtgcatatatactgtagtcagcagttatccagattcacagcaacattgccatcccttcagttcctccaatactagcaactattgcttccaactgcacaatgtctaggagagttttttttattagctgttgattcaaacaattatgtacagcaggttgtgttgagttataatgtagtgaaccttggtatgacgggttactataggagatattttcttgtcactacaacagaaccttttgttgcctttggagacctgttgttgccgaggctgaaaaagcttt

SEQ ID NO: 8928 - DNA, 1321 bp, Sorghum bicolor
  unsure (1)..(1321): unsure at all n locations
  Clone ID: SORBI-28MAY03-CLUS6611_1
gcacgagggaaaaacaaaaggagaaaatatggcttgccatcgagcatataaagaatggtgaggcactctgagtgccacatacagggcttccaaaaactatgctgagagaattagaaatatacctaaagacatggaccttgttgggtggcactacctgctcttatattttggatccaaagaattcaagaaggttagcgaccaaaactcctccaaccgtaagcaacaaaaaccacacatctgacgggtttcaaaaacttctctaagtgtagcttcgagctgagaaacgaagaaactggtgaagagcaaagtgatcttcttctttggaggagcactcacacaaaacatgggaattggtcaaattctatgtcagctacagtatatgaaaatacagccttcaaaattggtgagattggcttacgacctaatacacaaccactatcatgtgttgaggagaacatgattttccagtcatgctacaaagaagtcacagcagtcaaatcatcaaaattacatggccatggatatttgtctaagtatcgaactcgtaaagaacttatgaaagagaaccttgaagttcatgcacgtgttgaaactgctactagagggaagagcattgcttttgaagcacaggttgagaacctcaaagaacagattgcgcacgacgctatagagagggagagggtgagagaagaaatgaggaagatgcaagaggagctggaagaaggaaaaaacaaataagagaaatgaaccaagactntcttaaaatgatggcacaacacaaagaaggaactctgattgaaaatacaccacaaaacaatgagaatacacaagctgcaccaaccatacaagacggcgatgagactgctgaacatgaagaagacaatgtcttcgagcagactcagcctgggagtattgtcacagtacaaagagatgcagatactcatcgtactaagaatcctagtattgtcagcaaaaagcttttcaacgaaaatactgaacaagtgccaccatcgaaggcatatatcactcaacaacagctgttgaataaatcaagatcaagcaaaaggaggtaggtacacaagatttcagagggaggctcgtcaagcaacaacattggtgacacaatgacatatggcgatgatagaaaactcatctcaagagcggcatagatgttaggaagtctagtctagttgcatatttttaaattttttggaataatgagagaactccatttgtgattttagctactatttgaatcatttgtcgtgctattggatgatgattgagtataaattaatatatgcgagtgcaatctcatttg

SEQ ID NO: 8929 - DNA, 689 bp, Sorghum bicolor
  Clone ID: SORBI-28MAY03-CLUS64577_1
tgaacaaagagaggggcctgtcaactggcagctcaagtgaacacgttgggctacaaaagtttaggattgattcggaatagtcagcctgcaagcagctcatgatgatgtgtgcatcgaagaaatacacattggattatcttcttccaagccagatttcatacttgtcgtaaatagtatgtggaaaatggcgaaaggggtaaacatgagtgtgccagcttcagctgggagagggagttaccccaggtctgggtggcttggcaatggaggagttaccccgggtctgggtggcttggcaatggcggcagtgcagaactgaatgctgctgtctactgctcccgtcgacttctttggaagctgaaacaagacttcacacagattttgtacagttctagagttgtatagatgcatttagaaaaaaagaggtgtacagcgagttttcagctgtgattcgccatgaaccgtaacaggtttcgttcgccgttgcagcatgtgcaaatcgggcgctcgtacacgcactgtcaccattttttagttcaatgggggggaaaaaatcatcctgattggccgcaacctttgcacatttatccgttgcccatatattgtcactaatgctgggcttgttatttgttaatgtcagacaacgaaagacggtctctttggtcactacgaatgtacaaaaaggatagttt

SEQ ID NO: 8930 - DNA, 683 bp, Sorghum bicolor
  Clone ID: SORBI-28MAY03-CLUS64594_1
cttcggtgttcatgggatgttttgaaacagccctagaattgtgacaattctggacaaggggtttgctgacatttaggttctttgatgcgagtggagttccaattaactgtcagctgttgaattcaagtttgtccgacacactgttttccatcggcacactgtaaattttgcttcgagaacatgtatgtcagaatgcgttgatgttttgttatcaattaatgtttattgtaaaaactttttttgatctttggacacatttgttttcagtcctgacttgtggaacatccgaatcagcaaaattgtgaagctgactgcgtggagggcttgctctctattcctgcttattgtcactgctttgtgcgttcctgcgcaactttgctggcgggtcccacatgctgtgtcgcccgcttcggcctttgtttggcaaggtcgtagaagactagaaggtatatttgagggcagtttctggcgtgtaaactatccagcctgtggcatggtacttcggtgttctccattggcacactgtaaattctgcttcgagaacatgtaaataagaatgcgttgatgttttgttatcaattaatgattattgtaaaaacattttaagaccattcgaaacatttgtttcgagtccagattgtgtaacatccgaatcagcaaaatttgaaaaaaaaaaaaaaaaa

SEQ ID NO: 8931 - DNA, 982 bp, Sorghum bicolor
  Clone ID: SORBI-28MAY03-CLUS64607_1
cggcgggcagcgcgccagacgcatctccggcccgagcgccacccgcgccatgcgctccaggctcaggccgctcaccaccttgggcggccgccacgtcttcccgagattggtggcctcctcctcctcgtcggtgtcgtagtcgtcccgatcggccttggccttggccctagcaagcgccgccttccccatccagtacttgtcgggcttcttcagcgccttcttctcggtctccaccccggcgaccttcccgaacgcgagcgcgaacaggtgcgtcagctcctccggcaacgccacgtgcaagccccactccttggccagcttcctcgtggcctcccgcgcgccgaagcaggcgacggtgatgcgcttgtcgtccaggaacgcgcggagctgggtcatgttgttgctgtagaagttgaggcggtcgccgtcgtacttggccttgcggacgcggcagccatacgcttcggggctgtagacgatggcgcgggagccgccgaggcagagcgcgatgcagcggatcgggttgtcgtggtcgttggggctgaagtcggtactgcccctggcgcggtcggaggggtcatggccgcgcagcgcgacgaggcccgcgacgaggggcgcgcggaggcggcggccgcgggcgacggtggaggcctcggcgagccagcgcttggtgacttcgtcgctcgaggagaaggtggtgtcgacggcggccaggttgcggccgatccggagtacgccgacgtcgccgtcgtcgacgtagtcgtcgtcgcgccgccaccaacgttgccttgggggatcgggcctcgccagggtgatctgcacaggccccttcatggcgttcgacgacggcgaaggattgggaggtggggaatggggtttttggtaggggggtttttgtggcttgggggaggagttggttgtcgaattgcttgctggctcaggcggcgtggaagccagccaggcgcccaggctttcctcgtgc

SEQ ID NO: 8932 - DNA, 852 bp, Sorghum bicolor
  Clone ID: SORBI-28MAY03-CLUS64696_1
aacttcagcttgaggcatccagaaatgccagtgaggtcaaaaaaacttcttttagatggaactccatctaccttggtcagcataattggatacaagcagtaccgacgcagtgcaagggacatgtactacttcctccaatccaatgtctgcatcaagcagctcgcatatgcaatgctagagcaggtcctcgtgacagtcttcccagagcttcgccagctaatagacgacatacatgagaaggggcgcaaagagcaagcctcattcacataccaactctgaccctagagactgccaggataaacatgctactccagagagtcgtaacagttttgaacacacttaaattgctccatggtgagttactgaaacacaaggctttgcaattgtatttccatggtgcgaagttggattgacgaagcgctcggtgcttaacgaagcttataccccagcaatgatctgtagttctgtacatatgtatatcaagttgtgtaaattagctccttgatgtagtaaaccaggacaacttacagtaagatcttgtaggtgaatgtatggtagcattctttaattttttccccccaagatttaagctgttctctccctgtcttaggctgaggcatgtaaagttttgaaggttcaagtgtatagctgtactgtatgtgttgccaagtaaatcaaaatgttgtacgagatgccatctcggttttcgcaatatttgtccggcctgcatagtttggaggcaaaaggtatgtactttttcttttacttaccaaacaaattgagtgttgctttgttgttttggataaagtaaccaactgtaatattcaaagagcacaaatttacttgtatttt

SEQ ID NO: 8933 - DNA, 595 bp, Sorghum bicolor
  Clone ID: SORBI-28MAY03-CLUS66691_1
gggctcccacccacgacatgctcagcaagctcaagctgatgaacctgttcatcctggagacgctgaggctgtacagcccggtcccgctgatccggcggcggacgcggtgcccggtggagctgggcggcgtggtggtgccggcggacgcgctcctgacgctgccgatcgcgacgatgcaccgcgacagggaggtgtggggcgacgacgccggcgagttcaacccgctgcggttcgacgccggcaccaccaaggcggcgcccaagaacctgagcgcgatgctggccttctccagcgggccgaggaactgcatcggccagaacttcgccatggtcgagtcaagggccgtggtcgccgcggtgctgcagcggttcaagctcacgctgtcgccggagtacgtgcacgcgccgaccgacgtcatcacgctgcgccccaagtacgggctccccatgatcgtcacgagtgttgatgatgcgtagcgcgagatgatctactatgtaacactgggctgtacattatcaaattagtgagcgaagactaattacctgtttactagttcgcctttgccatgaataaatacattagcacaatcttgtgt

SEQ ID NO: 8934 - DNA, 1423 bp, Sorghum bicolor
  Clone ID: SORBI-28MAY03-CLUS6670_1
cccacgcgtccggaccgttttgctaatgaaagttcaggatcaaggttttctgacttctcagcctcaagcactggtgactttagaaatgatgtgctttctcctagctctcaggagacaggctacagcagtccctcagtccaccattcaagaaatgtctctgctgacaatcctcaatcccagaaataccctaatgcagcttcgcaaatagatttcaatggagttcggcgttcacagcgaacagcttcttctggaagttttggatcatttgatggtagctcagtttccaacaaatcatttgaatcaggtaacccgcctgatgcaccacgaggacagtcagcccattgtgctgtaaacaatcagactgtggcttctcccgaggcttgttcgacacaacaatatgcctcgccacccaacaatcacaacttggtacctcagaaacctgctgatttaggtagccaaactgctgccaccaggaaaccagtgcaacatagtggcgctcagattgaagctgtggtgtcagcacatgctccagtacagccaatgacttccacacctcttgacctctttgaccaatcaactgtgcaacagcctgtcacatctgctgcaccgatagatctgtttgctggctttaatgaacacttaccagcttctcataatacagataatgtatccagtcattctgatgttgctaaagaacctgcccatagtgttgttcagaagggcatggtaccatcagctgaagcactcgccacgtctcatgctgtgcaccaagatttattcagtctgtcaattttgcaggaaccagcaacatcctcatcctctcagccaatagatctatttgctgactttgaccaacatttgtcacatttttctactgttcagaaaattccatcagcagctccattgcctgctaatgatggatgggctttcttggacatgcaacatggatcgttgacatctgtttcaaatgtgcaaggtcaggtgcctgctgcatccccttcccctccatctgatggtattggtaaaggaattggtcaatcaacattaccaacttcgccaccaaatgtgattgggtcacaaagttctccagctatgatggataactggagtttaaatgctgaggaagtgaagatccctgtccccaaagaaaattctcagtcttggaatgcttttggtgaatctactcagagcacatcaaataatctgttcacatttaatactatgcctcaagtagaagctcatcaattctctatgccaagtggtccatatgttgaagccagaactccacaggattagctaggggtgagcctgaaaggccaactcctggggatatgttttctggcttcaatgtttcacatgttgaggtggttggaccatcgtttccttcatcactccagccccatttgggtggcatggtctctca

SEQ ID NO: 8935 - DNA, 712 bp, Sorghum bicolor
  Clone ID: SORBI-28MAY03-CLUS6671_1
cattggcgagggaccgtctaggctgcttcaacctctccattgaaggccatgctgaatgtgtaaagtttgtcaagaaattcaacattcctcttctggtaactggaggtggtggatacaccaaggagaatgtagcaagatgttgggctgttgaaactggggtccttttagacacagaactcccaaatgagattccaaacaatgaatacatcgagtactttgctccagattatacactgaaatttgtcaatttgaacatggacaatttgaacagtaagacctatctcagttcaatcaaagtgcaagtgatggtgagtttgcggtccatacagcatgcgtttcgtgttcaaatgcaagactctgtcctagatttttataattgagattttgacacttttgaacgtgatcctgatgagcgcgttgccaagcatacccaagtcaccgtgattctgagtaatgatgagtactcaatgacaaagattgacacgattcagcacgctaatctgcttccaaggaaccggtgtaaatggaaactgttgttgtgtagctcagcagccttgtgatggagtagtttgtcagtcgacagtaggatctaacttagcaggtcaaagtgattgtgacccctcctgaattacacattctagtacaactttgctcatttttcagcattgcaagaatgcaaattcctcagtggtcccggtggttcgggtctcaa

SEQ ID NO: 8936 - DNA, 728 bp, Sorghum bicolor
  Clone ID: SORBI-28MAY03-CLUS67097_1
tcagctgttgcgctgcttggatactcgttacaactcacatcttgtatcttaacttctatgagcttgactatggatggaacatgaaagtctgtgtggtgatggctgtggttcaacttctatcatgggcaatttggggtggtgtaagcagacacccggcacgactcaagctttggacagttgtttttggaggtgcactagctatgcttctcgaactctatgactttcctccatacatgggctatgccgatgcccactctctgtggcatgcaagcacgattccactcacgtatctctggtggagcttcattaaggatgacgctgaattccgcacctcaacactcatcaagaaggcaaagtaagcgaaggggccacaggttggttaatataggatctgggagggtacagatttcatggtctactcaaggaacattgggacacagtgggtcatcagacattatgaaatgaaacctcggtatatttgccccccttcatgctcatgtcgtcagtcccagaaagacattcatcttcgtccactcgtggttttggtacacaaactcagcatcatctccttcggggtacatattatgcccttctgatccgtctgctgattgacctgaacgtatactgtgattaaatcggcatcttatgtttttcttttgtactggtggggctcgcaaatttttgtcatcgcctattctattgtgcaaaattggctgaacaatgggctg

SEQ ID NO: 8937 - DNA, 697 bp, Sorghum bicolor
  Clone ID: SORBI-28MAY03-CLUS67114_1
cgcccatttctgtgggtgctgcgggaggacacccggagcagcgagggcgccgcgccgctcggcggggagcgcggcatggtggtggggtggtgcgaccaggtgcgcgtgctgtcgcacccggccgtgggctgcttcgtcacgcactgcgggtggaactccacgctggagagcatggcgtgcggcgtccccgtcgtctgcgtgccgcagtggacggaccagggcaccaacgcgtggctagtggagaggatcggcaccggcgtcagggccgccgtcagcgacaaggacggcgtgctggaggccgacgagctgcggaggtgcctcgacttcgccacctccgagatggtgcgcgccaaggccgccgtgtggagggagaaggcgcgcgccgccgcgtcggagggcggctcgtcggagaggaacctcaaggcgttcgtcgccaagcagatcgccggcggcaacaactaggccgtctcgctacatgattattattgccaactatgtgcccacgacagctggcatagatactatccaagacgtaggaaatggaactctatactacaactgtacttacattgttgctcttgctggatttggttcgattccaattaattactaagcatctatcatgtacatgcatgtatgttcatgtcttcatgatatgtttaaaaaaatcaagttcttcagaaactcaaggtaaaat

SEQ ID NO: 8938 - DNA, 705 bp, Sorghum bicolor
  Clone ID: SORBI-28MAY03-CLUS66718_1
atacaggaacctccggtccggacaagctagcgcatggtaacgtggttggacctgaccatctcatctcatctcatctcatctcatctcatccgggaatccgtccgccagcgaggcgcatcagccagcgccgtcgtcgtcgtcgtgtcccgcgcggcggtgatatggagtacgggtggctgctgtccgcggcgctcgcggcggcgctggcctcgtgggcgttcgacgcgctggtgcgcctcgtgtggcggccgcgcgcgctggctcggagcctccgggcgcagggcgtgcgcggacccccgtaccgcttcttccacggcaacctcggcgacatcaggcggctccgcgcggcgggcgccggcatcaggcttgacgtcgccgaccacgacttcactcccatcgcgcagccgcagttccgggaaaggatccccctctacgggcgcgtgttcctgtactggttcggctccacgcccaacatctgcgtggcgggctccgccctggcggtggccacctgcggggcgccgctggcggcgcagcagcaggagcgccgcgcgaccgtcctgcgcggccacctcgtcgagctccccgccgccgtcgtctccccccccgcggccggcggcagctgctacgagggggggcgacgggtcctcccgcccctcgagctgctgctcttcgccgcctcctccacgcttttcaatgttcatatcc

SEQ ID NO: 8939 - DNA, 702 bp, Sorghum bicolor
  Clone ID: SORBI-28MAY03-CLUS65105_1
tgtcaaggataagacttcacaggattctaactcgtactacatattaactatgatctccttggtttctatcgtggcttttgtcattaccttctcgtttggtatgggtgccattccatggctcatgatgtctgagatcctcccagttagcatcaagagtctcggcggaagcatcgcaacactggccaactggctgacatctttcgccataacaatgacgacgaacttgatgctaacctggagtgttggaggcactttcctctcgtacatggttgtgagcgccttcacccttgtttttgtcgtgctttgggtgccggagacgaagggaagaactctagaggagatacaattttcgtttcgctgagcattgaacatcagttgcaaagattcttcgagtttttctcttggaaggcaagggtcggtatctgttgaacaggaaattttgggcatccttctcaacgcacacaaattttttgaaaggactcaacgtacacaaattgtcctaggtgaagatcacgaattctttctgttgatacgacacgatgctgtcaaaaatatttgacatgtaaatgctagagcagtgactcttatcatattgctctcttcttgccttcagcgatgcaagatcaacagtgcaatgtcaaagtatatgtaaaaatggatggttgggcgctaactgaccaatcccagctttcgaatttgtcg

SEQ ID NO: 8940 - DNA, 752 bp, Sorghum bicolor
  Clone ID: SORBI-28MAY03-CLUS65264_1
aaatatttttatgttttgcaactcattggatatttcgctggagttgccttctactcaagtttggatattttttctatatctagacatcattgttacttttgtaagaccatatcgttgtgaatgcaaaggttagtctcatttgtatatttatattattacttgcatttttccttacccattctcataaggctaatgcaacacatatcaaatccaaaaatgatgcatgatgcagccctcacatctttggactttggcaggtacaaggtggtcactcaagtgtttcttatacttttactgacacataaaaatgatgcctgatgcagccccaacatcttcaggctttggcagcaacaaggtgatctctcaggtgtttagattggtcaaacagttagtgccctagcttggataaggtgttggcgctatgaaaggtatgtcagagattcatcctccggcgccaactgattctccatggacacaaatgtttgaggcaagcgaccaaagctactggaatcgcaatcaatgttcatgaaacaaatatgtatatttattgtatcaaacactttgtacataaactaatgtgccactgctacctaaaacatggcacattgttgaaaaacatcaggtaccaaccgtacccgtgccacctataaactatcatgtcatgtacaattaagatgttactgcagccgtaaaactcatctatgtaatattagaactacatgtataatgcttaatgtctaatctgtcgtgtt

SEQ ID NO: 8941 - DNA, 712 bp, Sorghum bicolor
  Clone ID: SORBI-28MAY03-CLUS65499_1
cagccctacttcgccaggatacagcccaacatcaccgagctacagtcctacttctccgagctacagtcctacttctccgagctacaatccttcatcagccaagtacagcccttcgcatgcatactctccaagcagcccccggatgactccatatagtcagacttctccaagctacagtccaacgtcaccgacatactctccaacgtcaccatcatattcacaaccaagtccatcgtacagcccaacaagcccgttcaacacctctggaggacctagcccagattatagcccaacctctccaaattacagccctagtggaagctactcccccactgcaccggggtactccccatcgtccacaggccaaggtaatgacaaggatgacgagagcaatcgttgaaggcgctgaaggaacggtgatggctacatgggaagatcgagcctgcggtgcctcgcttttcgtttccctttttctctaatgtttctgtatggttgaactctgagagtaaacttatttttcttaagctgctaatagcagcgagagttgtttatgtatgatactagaactaaggactgaactgtgctgcgacttgctaagtggttcaccgcatggtggccgttcagacttcagagtaaaaatagtaactgatgatgataaaatcgtgacggtattattggtactattatgctatgattatataccataagatct

SEQ ID NO: 8942 - DNA, 875 bp, Sorghum bicolor
  Clone ID: SORBI-28MAY03-CLUS65606_1
tggggtatcatcattaagcagcagcagctcattctcaaaatcacgagccgcatcctggagtgggacatactctgagcagtatagtgcttttgcgggcactcaatcacctgacagacagacgatgccttcaccactcatgcctggcaaaccatcacacagtcgttccaacagcaactcatcactgcagctcaatggattggcagaggatcttcatgaggttgagctctaactgatcactgctcagcatgacctcatgtcttgtatccacaaagacagccatggcaaccgctgacggttccagaaaccccaaagcgggtgtcagaaaagaagctgccctcacaatgctgatcacagggatgacacagttggaatgggttggtgccactttgcacgagattctgggggcgcgctctaaaccaccgaggtgcgtcagacctgtactaacagaaatgcagggtttttgaacattttgtagttatatctcctatacaactaaaaagaagaaaagtaagggcaagggttgggtgggccttgtttacaggtgagaagaggagagaagcagcatgcagatgcccttgtacagataatctgcccctacccaatttgtttaaacgcaaagaaacccacacccccactccatattgattttcgtttttgggagaaggatagaagagaaggtgtgttctagtagtgtgagaagcatggctctgtagagtgttgttgttatatcattatatggtgtagtgtcctagccgtatacacagtatattatcactgtttattctttggagacgaatcgattctttcatcttgaaaaaaaaaaaaaaaaaaaaaaaaaaaaaaaaaaaaaaaaaaaaaaaaaaaaaaaaaaaacc

SEQ ID NO: 8943 - DNA, 778 bp, Sorghum bicolor
  Clone ID: SORBI-28MAY03-CLUS67341_1
gtgtattagtgtgctacggatgctgaaactgctcaacgacaagagcaacgaggaactcggttcggttagtagggtactgcctccaaggagcatcggttacccatttcatcatcctcttcggcggcgccggcgcccacagcaccgaaccctcatccagcttccttccacccaagcacgccgggcacccgtcgtcgccgaagcccccctcctcctgtccccgctgcactggtactggattggatcagagtggactgcgtcggttgggtccagtcctttcgctgtaggctgcggttgcgtttgcggattcctctcctgcgcggcacacgctgagtcctactcctatccgcccctgctgcagtctcgcggcaggcaatggcggggttcggatggagagtcggctcaaagttgcagagatggggatggagctgcctccggagcttctcttctgctgcagttccgtctcagctggagaatgtcggattcatcggacttgggaacatgggttcccatatggcaaggaatttgatcaccgctggatataaagttactgttcatgatataaatgaaaaatccatgaagaaattctcagacgatggaatccccacaaaacagtctccacttgaagtatcagagtcgagtgatgtcataatcaccatgcttccttcatctactcatgttttagatgtatacaatggacccaatggcttgctttttgggggcgaacgcctgggaccatggttatacatagatttcatcacagttgatccacaaacatcca

SEQ ID NO: 8944 - DNA, 848 bp, Sorghum bicolor
  Clone ID: SORBI-28MAY03-CLUS67354_1
aagagagaaaaaaacctgcacgcttcctctctctcggaaaaggaaaagaataaccggggacacttcctcttctctcatctctcagaaaagaaacagaaaaattctcaaaaaaaaaagaaaaaatcttcctcttgacatttgctttgcgttgctttgcttgctctagtctcggctcttgccctgttgcccatagctccaagcctcaaacgatctcccccatccatcccaccaccgggacgcatcaagcagccggcgatggggtccgcctccgccagcgtcgccaccgccaccgcgcacctcgtcgccgccaccgcgctcctcctcatgctcgcgcgaggcggcgagtccgtcagtttctggctcccgccgccgaccgccggaggaggagggggcttcctcggcggcgcggaccgatacctaactcgggaggagcactggatgaaccagaccctcgatcacttcaacccgacggaccatcggcaattcaaacagcgttactatgaatttcttgactactaccgagctccaaatggcccgatcttcctctacatctgtggagaatcctcatgcagtgggattggcaataactacttagctgtgatggcgaagaaatttggtgctgcattggtttctcctgagcatcgatactatggaaagagttctccttttaacagtttaacaacagaaaatctacagttcttgtcatcaaagcaggctttatttgatcttgccgttttccgccaatattatcaggaaaccttaaatgctaagtataatcgctctggggcagacagttcttggtttgtttttggaggatcatatgctggagcactcagtgcttggttcag

SEQ ID NO: 8945 - DNA, 793 bp, Sorghum bicolor
  Clone ID: SORBI-28MAY03-CLUS67394_1
gcacgaggctgcgctccaggtgcttaggaccatcggcgccaagttcgatggtactggccagcccttaaacgttctgatcaccgcagcatcaggtggtgtgggtctctatgccgtgcagctcgcaaaactggctggtctccacatcactgccacctgtggcgcacgtaacgtagagctggtgaagagcttgggcgcggatgaggtgcttgactacaggacgccagagggtgccatcctgcagagcccctcaggtaagaagtacgatggcgtcgtccactgcactgtcgggatcagctggtcaacgttcgagcctgtgctggccaccaacgggagggtgatcgacatcactccaaacttcactgtgttcctcaaatcggcgctgcacaaggtgaccttcgccaagaagcggctggtgccgctgctcctgtcgcccaacaaggcagacctagagttcctggtcgggctgctgaaggacggcaacctcaagacgctgattgactcgaggttcccgctgagcgaggtgagcaaggcgtgggagaagagcatcgagggccatgctactggaaagatcattgtcgagatggtaggctaatctatgcgtccattacctacatagacttccagggagaatatacttaagcatgatctaggcagttggacactacagggttaaggtcaacagatatggagtactagtgtctgagtttggtcgtcgtacaaattaaattattcgtgagagtttggtcgtcgtacaaattaaattattcgtaagtggtgaaccagtttacaggct

SEQ ID NO: 8946 - DNA, 746 bp, Sorghum bicolor
  Clone ID: SORBI-28MAY03-CLUS67430_1
cagtcatggagctccccaatggggtggagaacaagcccggtggttgtatcatgctttccaggggaggtagatctggaatctttctgatctatgttaaagagtttcagcttcacatcttccaccacaggatgggtgccaatgacccaggcaactggtccctagtggattctgtttctttgcgtcaggtgtgctctaatctggatatggcaagctggcaatttatggatggacctagtgttggtgttaaattatgcgctgttggggacaacgcggagtttgtgctcttggagatatttggtactattgtattcttggatattataagcaggcaagccgagaaggtttatgagctgacaccagaggataaagagttggtcagtgtccgtcccctgatgttgatatggcctcctgttttccctcagttgaaggatgcatattatgaacaaaaggagtgatgcgaggctgaaaatacagctttagaggaaccagatcagtttcaaattccaaagctcaacccgcggccaaaagatgaggatgagaagcataacaagatcactgaatgacgtgctttatgacgagcacaccctattccgaggtgtagtaaaaatgagagaataaagggaggctagttcatgtaaatagcaactctgaacaaaatataggtgttatattacttgtttagatcattggtatgccacgctttgctttataatccataataataaatcttagatcatcaagtgtgc

SEQ ID NO: 8947 - DNA, 1102 bp, Sorghum bicolor
  Clone ID: SORBI-28MAY03-CLUS6744_1
gtcgaggtcacccgctccatcaccaaacataactacctggtcctcgacgtcgacgacatcccccgcgtcgtgcaggaggctttcttcctcgcctcctccggtcgcccgggaccggtgcttgtcgacatccccaaggacatccagcagcagatggccgtgccggtctgggacacgcccatgagtctgcctgggtacattgcgcgccttcccaagcctcctgcgactgaattgcttgagcaggtgctgcgtcttgttggtgaatcaaggcgccctgttctttatgttggtggtggctgcgcagcatctggcgaggagttgcgccgctttgtggagatgactggaatcccagtcacaactactcttatgggccttggcaatttccctggcgacgacccactgtctctgcgcatgcttggtatgcatggcacggtgtatgcaaattatgcagtggataaggcggatctgttgcttgcatttggtgtgcggtttgatgatcgtgtgacagggaagattgaggcttttgcaagcagggctaagattgtgcacattgatattgatcccgctgagattggcaagaacaagcagccacatgtgtccatctgtgcagacgttaagcttgctttgcagggcatgaatgctcttctggaaggaagcacatcaaagaagagctttgactttggctcatggcaagctgagttggatcagcagaagagagagttcccccttgggtataaaacttttgatgacgagatccagccacaatatgctattcaggttcttgatgagctgacaaaaggggaggccatcattgccacaggtgttgggcagcaccagatgtgggcggcacagtactacacttacaagcggccaaggcagtggttgtcttcagctggtcttggggctatgggatttggtttgccggctgctgctggcgctgctgtggccaacccaggtatcactgttgttgacatcgacggagatggtagcttcctcatgaacattcaggagctagctatgatccgaattgagaacctcccagtgaaggtctttgtgctaaacaaccagcacctggggatggtggtgcagtgggaggacaggttct

SEQ ID NO: 8948 - DNA, 778 bp, Sorghum bicolor
  Clone ID: SORBI-28MAY03-CLUS67469_1
gcacgaggagacgaacgagagaaagcctgtgagcttgcccgcccgcgcacacaaccgcgacgtttcccgacccgtcactccaccaccaccaactcgccctgcacacacagtccttcctgcacacgcgccgcccggcggctgcccgtcacgcactcatataacgactccatacggtccagcaagccactcgccaggcagtcgggaagcgcgaccgcaccagctcctgtactacctgcagacgcccatcggccagaacactcgcgtagccaggctagtccaagattctctcagtccggtcctccatccggatctcgccgaggcgtgcaagattactgcttcgccgaggattaattagccgccggccgagcttctcctgagagtcggcagcttttctcggtcccgatttgccctctgctgctcgtggtgcgccgctctcctagggccctgcaggcgaagggaaggatccgaatcaacatggccgcagccactgccgccgccgcttctaccatgtccctgctcccgatctcccagctcaggcagcagcagcacggcgcgggcgccgtggtcgtgttccggcggcgggcccgggacgcgcggcggaggcgatacgtcgtgccgacggcgaggctgttcgggccggcgatcttcgaggcgtccaagctgaaggtgctgttcctgggcgtggacgaggagagcaacaacaagcacgggcacccgacgacgccgtcgccgacttccccgccgctgccgctactgccgcggacgtacacgctgacgc

SEQ ID NO: 8949 - DNA, 792 bp, Sorghum bicolor
  Clone ID: SORBI-28MAY03-CLUS66349_1
gggcgatggcctgcaaaccagatccttcacatttattgatgaatgtgttgaaggtgtccttaggctaacaaagtctgacttccgtgagcctgtaaacattggaagtgacgaaatggtgagcatgaacgagatggcagaaatagtcctgagctttgagaacaagcagctgcccatccaccacattcctgggccggagggtgtgcgtgggcgcaactcagacaacacactcattaaggagaagcttggctgggctccgactatgaggctgaaggatgggctgaggatcacctacttctggatcaaggagcagcttgagaaggagaaggctgagggcatggatctgtcggtatacggatcatccaaggtcgtgcagacccaggccccggttcagcttggctcccttcgtgccgctgatggcaaggagtgaacttcgactgcgcgccagtcagttgcctgaggctcagacaacatgatataccagtatacacagtggtttcagtttccatgatttgtagtcaccacctatacaccatttcttgattcacttttgactccacaagaggatggtttggatgatggatattttgttggcaattaggagattcagttcaaatttgaactaaatacaaaaaaattctgacaaaatacccatcgtccaaacacataataatttccatgtttctttttctcttctgtgtctgtacaatagcgtattaaagaggtacaacgcttctgtaaactggtgtcattttatttcacaaaaatagcaatgaataaattaaggtccagcat

SEQ ID NO: 8950 - DNA, 1103 bp, Sorghum bicolor
  Clone ID: SORBI-28MAY03-CLUS66451_1
cggcgtcgctcgccctaggcggcaaccagtgacacgagctgtcgccgccgcgcgcctgccgcctgctgctctggccgccccgtcccgtccgtcgccttcggcagccgcgcccccctgccccggcggcgccgccgcaccggcgcccttccggcgccgccggcccgtcttccactcgctctcggtctccccccgtggtcccgctcctggcggcgcccggcggccggccggccgcaggcccttgatggccgtcctccctggcgcggagttcgctcgcggcacctttgccccggcagccccccgtaccctttcccgtccgggtcgcattccctttccgacggtggctggccgacgcagccccaggtccagattcccgaaccaaaccccccccgaactggtgaggggaagcagccagacacccgcacctttcccgttctagccggtgcggtgaggggcttggacttggagtcgagtcgtcggcggcgcggagagctgatcgagttccacgcactagcttgcggagttgcaggtggccactaactagccagcctgccgcgggcggcgggcgcggagacagaccatggggagcccgaaccaacgacacggcggtggcggtggcagcgacgaggagggcgacgccggatcgtggcgtctgcgcatggacagcggaggcttcagcgtcccggaccggttccaccgccagccgccgcccttctacgccaggatcttcgtcggcggctcgcacggaaagcagaggaagatcgcaaagtactacaagaaacaagaaaatctactcaaggatttcagcgaaatggagaccatgaacgaacttggtggcttagatccgaatgctgctccttccgaggaagagcagaagcagttggcaaagagcgagaggtttgctattaacctgtccaacgtaatcaatctgatcctctttgtcacaaaagtcgtcgcttcaatccaaagtttatccatggcggttatagcgtcgacgctggattctctattggacctcctgtcagggttcatactttggtatacggcgtacaaaatgaaaaagcccaacaagtacaactatccaattggaaagaggcgcatgcaac

SEQ ID NO: 8951 - DNA, 715 bp, Sorghum bicolor
  Clone ID: SORBI-28MAY03-CLUS66455_1
agtaaaattgttcacttcatggatctaacatcaagtatgtataatttcagattagccatttttaatcctgacttatgatttgtgaaactaaactgatttaatcctttaatttcatattactctgcacaatgagtatggagctggtgaacctacaacaagtaaattcttaatgtgttgtgcccattatagattttaaaatgtactgattacccggctcaaattatttgtgctcttagtggacctgtatagtgtctgaggcttatgttgtttcgtcttgagagtcttttcagaagtagcaaactaggaccaatatgagaaagtgttgcagatccctgcctttggtcgtatttggtatatctcactggtatttctcaatcaactaactcatccatgctacaatgtcaatcagttttgctttaagtcccatgacatatgatgatctcatgaatggttctatttatcttcttttgaatgtagagagggaccagacatgtgcagtagctgctgcattgctatcacaagccctgttaggtagtagtagtagtagtagttacttctatttcttatattggtagtcagcttcgctctttgttttgactttattttgcaaggcaagaagaatgtggaccattgtactatctgatgtatgtataattttaaaatattatgattatatgtcccaaaaaaaaaaaaaaaaaaaaaaaaaaaaaaaaag

SEQ ID NO: 8952 - DNA, 679 bp, Sorghum bicolor
  Clone ID: SORBI-28MAY03-CLUS66490_1
agcttgcatacgtcgcgctcgactatgaacaagaactcgagaccgccaagagcagctcatcagttgagaagagctatgagctgcctgatgggcaagtgatcaccataggcgcagagcgcttcagatgcccagaggtgctcttccagccatccttcatcggtatggaagctccaggaatccatgagacgacctacaactccatcatgaagtgcgatgtcgatattagaaaggacttgtacggcaacattgtcctcagtggtggatccaccatgttccctggcatcgccgaccgcatgagcaaggagatcaccgcgctcgcgccaagcagcatgaagatcaaggtcgttgctccgccggagaggaagtacagtgtctggatcggaggatcgatccttgcatccctgagcacattccagcagatgtggatctcaagggctgagtatgaggagtctggtccagctattgtccacaggaagtgcttctagacatcacctagccttatgctcttcgtggaaatatctttgtttgatgacatatctatgggtggttgctctgctatagcttgcagtttttgtgtatgccatatatatatccatgccctgtaacgttgtggagtcagctgagcactatatgaagtatgtagtttggtttgatatatattgattggattgttcctcgg

SEQ ID NO: 8953 - DNA, 1023 bp, Sorghum bicolor
  Clone ID: SORBI-28MAY03-CLUS6650_1
caggtggggaaagggcgtgatgttggcttgaaccaaattgcactatttgaggggaaagttgctggaggcaatggcgagcaagttctcagccgagatgtgtaccgtctagggcagttatttgacttcttccggatgctaaccttctttttcaccacagttggttattatgtctgcacgatgatgactgttctaactgtgtatatcttcttgtacggaagggtatatctggcactctctggccttgactactcaatatctcgccaagctaggtttttggggaacactgcgctagatgctgctttgaatgctcaattcttggtccagattggtatttttacagcagtaccgatgataatgggtttcattttggagctagggctgatgaaggctatttttagttttattacaatgcagctccagttctgttcggtgtttttcaccttttcgcttggaacaaggacacattactttggtagaacaatccttcatggtggtgcaaagtataaagctactggaagaggttttgttgttcggcacataaaatttgctgaaaattataggctctattctcgaagtcactttgtcaaagcgcttgaggttgctctcctcctcatcgtttacatttcatatggatacacgaagggcggttcatcttcatttatactgattactatcagtagttggttcctcgttatgtcctggcttttcgcgccttacatattcaacccttctggtttcgagtggcaaaagactgttgaggacttcgatgactggacaaactggttactttataaaggtggagttggtgtaaagggcgatagcagttgggaatcttggtgggatgaggagcaggagcatatccagacattcagaggacgtattcttgagacaatcctgagccttagatttctcatatttcagtatggcattgtgtacaagcttaaaattacagatcataatacgtgccttgcagtttatggcttctcatggattgtactcgctgttatgggtcttcttttcaag

SEQ ID NO: 8954 - DNA, 775 bp, Sorghum bicolor
  Clone ID: SORBI-28MAY03-CLUS6777_1
gcctcagattgcttcagtaggctcctgctgccttgttggtgtaatctgtgctgggactctctatgttgcaaacctgggcgactcacgtgcagttcttggaaggcttgttaaggcaactggagaggctgtggccatgcagttgtcatcggagcacaatgcgtgccatgaggaagttagacaagagctgcagtcatcacatcctgatgatccacatattgtggttcttaaacacaatgtttggcgagtgaagggtctcatccagatctcaagatctatcggagatgtatatctaaagaaaccagagtataacagagaacctcttcatagcaagtttcggcttcgagaaaccttccagaggccgattcttagtgctgaccctcaaattactgaacatcgaatacagccaaacgatcagtttgttatatttgcttctgatggtctatgggagcacctcagcactcaggaagcagttgaccttgtccacagtagtccccgtaatggaatcgctcggagactagttaaagccgcgatgcaagaagctgccaagaagagggagatgagatattcagacctcaagaagatcgaccgaggtgtgagaaggcatttccacgacgatacaaccgtggttgtgctgttcctggattcaaatgccatgagcaaagcaagctggagcaaaagcccctctgtttctatccgagggggcggtgtaacccttcccgcgaaatccctcgcacctttctcagctctggcacagttgaacagcacctactgaagt

SEQ ID NO: 8955 - DNA, 758 bp, Sorghum bicolor
  Clone ID: SORBI-28MAY03-CLUS67841_1
tccagagctctcaaacttcctgggatgttataaaagctgcaaagcactacaagctatttcagcgtgcgactcatgtctactctgaagcaaggagggtttacgctttcagggatactgtctcctcaaaactcagtgaggaagataagcttaagaaacttggtgatcttatgaacgaaagccattacagctgcagcgtgctatatgagtgcagttgccctgagctggaggagcttgtgaaagtctgtagagacaatggagcactgggagcacgtctcacaggagctgggtggggtggctgtgcggttgctctggtcaaggagcccatcgtccctcagttcattctgaatctaaaggaaatgtactacaaatcaaggattgagaggggagtaatccagcagggtgatctgggcctgtatgttttcgcgtcgaagccatcgagcggcgcagccatattgacgttgtaggcgggcagaggcagcctccattcttttacgagcccgctgtaaattcgtagagtccgtaccctggtcccagatgtggccctgtaaaacatggaataagttacttgcatctcgatgaacaccgaactgttgtaaaacatggagtattaaattatctcaggcaacacacgcattaggcatgttgctccagatttgagagacgagttcgtggctggctgccatggatgaatgaagttaaaagaaaagaggaataatccgaatcttatccagagggcgtatctatctatgccccgtggt

SEQ ID NO: 8956 - DNA, 710 bp, Sorghum bicolor
  Clone ID: SORBI-28MAY03-CLUS68007_1
tactggcattccacaaagccgccactccccctgctgacggatggggtggtgctccccgtccacttcccggcagctcctctccacggcctccctcttcgccctcggcgcgggcctcctcgccttcggcatccacctctcctacgtccacgtcgagccccagcgcgctcgcacgctcgctcgggaccagttcgtccgcgactacctccgcaagaagcacgacaagtagcccgccgtccgtggtcgccctctcccggaccccagacccccaggcggttgcttagcagtcggagacgatggccctggccccatcgaggtccggtagcgagcctgtgatcccggaggtggagatgaatgccggcgccgaccaggccgcctcaacggtgcgggtcaccgtcgttcaggcgtcgtccgtgttctacgacacccctgcgactctcgataaagtggagaaattgatagcagaggcagctgggtatggttcacagttggttttgtttccagaagtctttgttggtggctacccacatggatctacctttggactggttatcggcaatcgaactgccaaaggaaaggaagactttcagaagtatcacgcatctgccatagatgtgcctggccctctagtggcccgctttgctgccttggccggcatgttttttcatgagtattaccatgctttattctttggggtagaaactttacccttt

SEQ ID NO: 8957 - DNA, 692 bp, Sorghum bicolor
  Clone ID: SORBI-28MAY03-CLUS68017_1
attcgtgccgatccgcgtctcctgagtccatcctcctgaccccctcggcctcgacagctgcggagagacagacgcacacgccgcggtcatcgatgctgctcatggactcggcgcgccgcgccggctgctccccgtccccggtctgcttggacctcagcgtcggcctttcgccgtcgtcgccggggagcagcggcccggaaacgacagctgacactgacgacaggcttgaccgtcccgccgctggctgcagggtggcatcgtccctgtctgacgagcaggccaagaccctggaggccaagctcacccaggtcagcgaggagaaccgccggctcaccgagatgatcgcctacctgtacgccagccaggtcgcgcggcagagctccagctcccccgacaccaccagcaggaagaggagcagggacagcctggagccgccgtcgaattccagcgacggcaacggcaacgccaaggcggagcccggtgaccatgccgccgtcgagagcgccctcagcgacgagggcacgtgcaggcggatcaaggtcaccagggtctgcacccggatcgaccccgccgacgccacgctcaccgtcaaagacggctaccaatggcgaaagtacggccagaaggtgacccgcgacaacccgtccccgagagcctacttccgctgcgcatacgctccctcctgccccgtc

SEQ ID NO: 8958 - DNA, 734 bp, Sorghum bicolor
  Clone ID: SORBI-28MAY03-CLUS68170_1
aagccaagggaagttgatcctgttcttgagcaaaaatggagattgcttgagattgaaagagagcggcaagatgctctcagtacgatcactgcaacaatgggcagagctgttgttcttggtgattatgtgctagacttggaggatggagtggacttggaggatgttgatagtgatgctgatgttgatgatggccgtgggacagaaaacactcgtaggatgcttctatttattatgcgccaagttgctcaacatcatcaaaaccaaaggcttcagaatgcgaccggtgcatctgacaatgctgaggacaattatgtggtgagcagtggtgccaatggaaccacaccatacccttaccccttggaaggggaggacgagaatgatatggttgtggccggaggcagaagcactgatgtgctccgaccagagaggaggcgccgccgccgccgcaggaaccgtggaagattatttttaggtgctaattgagaggaaaggtggcctggtgaggtttaaccaccagaggagtacatacagaaatgcttccctggtgcctggcattcatcatttccggcctcaatttacttgttcatgatcatgtaccaagtagttatgttaacatcagctcattgtttgccatcagtgtatgttatcttacattcttttctttgtgaaaaaggaaaacaccgcatccatctcttgcggtttgtgtagcctctatttctgtctactgctttcgc

SEQ ID NO: 8959 - DNA, 695 bp, Sorghum bicolor
  Clone ID: SORBI-28MAY03-CLUS6811_1
gcacgaggacatgggctgccgcaagaagatcaagatggagggcttcaacgaggaggatgcgtggagcctgtttcaagctaatgttggcggcgacaccatccatggccacactcaaattcctgcacttgctagacaggtcgctgccgaatgcaagtgcttgcctttggctctcgtcaccgtcggccgcgccatgtcaaataagcgcacaccagaggagtggtccaatgcactcgacaccctcaaggcgtctctgccctccggcacgcccggcttggacaagagcacgcacgcgctagtgaagttctgctacgacaatctggagagcgacatggtgagggaatgcttcctgacctgcgcgctatggccggaggaccacaacatcttcaaggaggagctcgtgcagagctggataggactcggcctgctccccgatctcggcgacatcgaagaggcctacaggttcggattctcggtgattgccatcctgaaggacgcgcgcctgctggaggccggggacaaccaccgctgcaacatgtacccgtcagacactcacgtcaggctgcacgacgtcgtgcgcgacgcggcgctcggttcgcgcccgggaaagtggttggtccggcaggcgccgggctcagggagcccccacgcgaagagggcgctgggcgcgcgcgcaaacgcggtccctgatgcacaac

SEQ ID NO: 8960 - DNA, 886 bp, Sorghum bicolor
  Clone ID: SORBI-28MAY03-CLUS67135_1
ctggacaagcaggtgcggggcatgctgatggacatcatcaaggcacgcgtcgccaacaaggacaccgccggctacgggaacgacctgctcgggctcatgctggaggcgtgcgcgccggagcacggcgagacgccggtgctgagcatggatgagatcatcgacgagtgcaagaccttcttcttcgccgggcacgacaccacgtcgcacctgctcacctgggccgcgttcctgctgagcacgcatccggagtggcaggacaggctccgggaggaggtgcggcgagagtgcggcgacgaggtccccacccgcggggacgcgctcaacaagctcgctctggtgaacatgttcctcctggagaccctgcggctgtacggcccggtgtccctgatccagaggaaggcgggatcggacctcgacctcggcggcatccgggtacccgagggcgcgatcctcaccatccctatcgcgacgatccaccgcgacaaggaggtctggggcgacgacgccggcgagttcaagccggagaggttcgagaacggggtgacgagggcggccaagcaccccaatgcgctgctgtccttctccagcgggccaaggtcgtgcatcggtcagaacttcgcgatgatcgaggctaaggctgtggtcgccatgatcctgcagaggttcgcgctcgagctgtcccccaaatacgtccacgcgcccatggacgtgatcaccctgcgcccaaggcacgggctccccatgctcctcaagcgcttgtaggtgcaattgagagtacgactagagtcgcattcatagtgccagactaccagtgtcgcatattccattttatagtatttttttgtacaccagataatgttactttgaccccctctaacaattgctc

SEQ ID NO: 8961 - DNA, 733 bp, Sorghum bicolor
  Clone ID: SORBI-28MAY03-CLUS67234_1
actcattccacacaacaacctcacctcccgatcaagtgtcaacggcaaaaccagctttctttcaatttcaaccccagcaagaaaacacaaagccatctagcagaagatttcctacacggccgcacgtgcagaccccatcgatctgactgagaggcagcgcctcggcagtgaccgcgagccatggatctggcctggatggtggcggcggcagtcgcggcggtgctggcgtcgtgggcgttcaacgcgctggtgcacctcgtctggcgcccctacgccatcacccggagcctccgcgcgcagggcgtccgcgggccggactacaggttcttcaccgggagcctcggcgagatcaagcggctccgcggcgagggcgccgccgtcacgctggacgtcgacgaccacgacttcatccccatggtgcagccgcatctgcgcaagtggatcgcgctctacggccggacgttcgtgtactggaccgccgcgaggccgaacgtgtgcgtggcggacgtgaacgtggtcaggcaggtgctcttcgaccgcaccgggctctaccccaagaacctcatgaacccgcacgtctcccgcctgctcggcaagggcctcgtcctcaccgacggcgacgactggaagcgccaccgcaaggtcgtgcacccggccttcaacatggacaagctcaagatgatgacggcgaccatgtccaactgcgctctgtccatgatgtccgagtgggagg

SEQ ID NO: 8962 - DNA, 665 bp, Sorghum bicolor
  Clone ID: SORBI-28MAY03-CLUS67257_1
tgcggtggggctggaaatggctcggctgcaaagatatgtaacaacatggcaatggcaatcagcatgcttggggtctctgaggcctttgctcttggtcaaaaccttgggatcaaagcaaccactcttacagacattttcaactgttcaagcgctcgctgctggagtagtgatacatataatccagttcctggagttatggaaggcgttccatcatcaaggaattatagcggtggtttcacttccagactaatggctaaagatttgggtttggccatggcttctgcatctggagtcggcttcaaatgccccatgggttcagaggcacttgaaatttaccgaaagctgtgcgaggatggctgtgaactcaaagacttctcgtgtgcattccgacatcactatgctggcaaggatgaagagtgatcttggacttatgctgcaaattttcctcctttcgaaatcaataaaacaacaaataagttattggaatgcttacagtgtaagctgtgtagcgttgtacttgtaccagagaggcagagacatggttgttgagctgtagtgatgatctgatcccctttgtaaaactagtattggtttgcttctaggcaaatcgagcaatagactgttctgggacagattcacccatgagccaagaacttccaatttcc

SEQ ID NO: 8963 - DNA, 661 bp, Sorghum bicolor
  Clone ID: SORBI-28MAY03-CLUS67295_1
tatgaaactgaagtgcccacctgcagtggttgctgcccgagcagcaatatcccgcacagcatttgcaaagggccttcgtcctcagcccctgccaacaaaagtactggtgatcgcattgcttggtatggcagtaaatgttcctctcggcatctggagggagcacacacagaagttttcaccgcagtggtttgctgcagtgcatgcagcagtgcctttcatagggatgctcaggaagtctgtgctgatgccgaaggcagccatggcccttactatagctgcctcaatactgggtcagacaatcgggtcaagagctgaacgtatcagattgaagaggaccgcggcagcaaaattagcaagagagggccatgatgctgctgctgactgcatcaaagcaccaatgagtgtgaaaagcgggaaccattcgctcagagttgaaagcactgtggttgcaggtgccccagcagttcttgtccctgccgttgctgctttcaattgatgatgacaggaatggcttattccgattatatcagcatcgctgattgtattgttgtattaattactgtacctttgagtttaagaaagaaatacttgttacgtcaaacttttcattccgttttggaggcacatggcagtgaataaattcgagaacattttcagagcg

SEQ ID NO: 8964 - DNA, 656 bp, Sorghum bicolor
  Clone ID: SORBI-28MAY03-CLUS68307_1
agcggcgtgacgagtcggggagacctgcccgctacggcgagggccccgggccaatcccctcctccaacctcgcttcttcccctcctcctcctcctcctcttcccccacccctgcttctttccccttcccccttccccctctctctctcaccccaccctcctcctcggcttcctcatcatccgccccaccgagactgtagtcccctcctcctactgcaaggcccgcccgtccgacccgccgcttcctcgcgtctcaggttcgtgcctggtggccgactctcgcggtggcggtggttctccggcgccgcggttgggcaggggacgagcgggttagggacagagggggtctttgctgcgattccgtgatggcggcgacggcggcgatctgcgtggaggacgaggcgacctgcgccgccgcggaatgcgcgccgggggtcgagaagctggatctcgctgccgccggcgccggcgccgacggcaaggccggcggcggcaagaggagcgtctacctcatggactgcgcgccggtctggggcggcgcgtccacgcgcggccgcagcgccgagatggaggacgcctgcgccgcgttcccgcgcttcgccgacgtgccggtgcgcctgctcgccaggcgccgggacctcgacggcctgggcctcg

SEQ ID NO: 8965 - DNA, 732 bp, Sorghum bicolor
  Clone ID: SORBI-28MAY03-CLUS68360_1
aaggttttggtgtccaagcgcacatcctcatcgtcgccaccgtccaagaccaagaagagcaagacgacgacgacgacgactacccaaaacaacaagccgcaccgcgctgctgcttcgctggcaacggagcaccacaacgacgacgacgacatgctgatgatgctggtggccgaccatagctgcgacgaagagcaacagcatgccgctgttcgtctggccagcaacaccaacttcaactccaagagccgccgcgcctcgtccgacgacgactgcgacgaccgccactcggcgtccgcgtcgctggacaccgaggaggccgcctctcacgtcagccaggctgcggccgaagaagcggagccgcaacaagacgaccagctagcagaggcagagcagcagccgccgccgatgggcctcgacctcacgctcggattgctaacgtcgtccgcgccgccgcccatcggctgcagacagggaggaggctccagcgcggccgtcgacgagccagccggtgtcataggcttccgcttcctctagctagccggtcgccgtcgccggagcggaaatacatacatacatgctcctacagtcagtcctatggatgatccatttatttgatgtagatttaggcccaaaagttgcaagggaacagacgaatcaatccttacttgtttacattaggcttatttttctctggtcgagtagtttgttttttttcgaaaagtttataatttt

SEQ ID NO: 8966 - DNA, 594 bp, Sorghum bicolor
  Clone ID: SORBI-28MAY03-CLUS68482_1
ccagcattgcttcgccgcctgaaattctttgtgcgaaacgcgtgctgggaatctgggcggggatgatcggcggaaccgccgtccagacgctcatcctggccatcatgacagtccgctgcgactgggaaaaggaggccatggtcgcgagcacgcgcatggacaacatgtcggaagttcggtgatggcaggatgtggtggtgtatatgtatatgactgagcacccgtgaatttttaagctttgggggtcggggatcgtgtgtttctgcgtgtttgtttcgtcaaatctttgccgtttggaaaggcaatgcagggtgctcaggacaaaccacggagcaagacggatcgacgaggcagcttgaagacggaggaggcctggcttggctctgatggctttgttggttttgcttgttgcattcagttttttgttgtaaccttctctcgccttccgggtatttccaggcgcgagaacatttctcgtatttgtgcagttgcgtcgtgcaagcatgtcccaccaaaaagtaaatgtacaagcatgccgaatggatcttgtttccacaatttttttttaaaaaaatactaaaaatgttcctctcc

SEQ ID NO: 8967 - DNA, 680 bp, Sorghum bicolor
  Clone ID: SORBI-28MAY03-CLUS68680_1
ctactggaactcaactgcctctgtagccccatctctgcccctggctacaacgaaccggactttagcgatcgatcggatcgacgacgaccatgaggtactacgccgagctggccacgaagactgctcttcttcttagccttgtggtcgtcggcgccgccgccgccgccgccggcagcatcccgccgagtaacgacatcctgcgccaggtcccggcggcggtgtacgtgttcggcgactcgacgctggacgtcggcaacaacaactatttgccggggaagaacgttcccagggcagacatgccctactacggcatcgacatgccgggctccggcaaaccaaacggaaggttcagcaacggcgacaacaccgccgactccgtcgcgaagagcatgggtttggagagtagccctccgccgtatctgtcgttggcgtcaagttccgaccaactggtccagaccgctctcgccgccggtgtgagctatgcgtcggcaggagctggcatcctggactccacggcgggaagaacgaaggcaacaacatcccattgtcgaggcaggtgaagtactttagagccacctggtctaagatggtcgctagcaatggctccgaggcggtgagcgccctgctctccaggtccgtcatcctcatcggcatcggcggcaacgacatatccgcgttcg

SEQ ID NO: 8968 - DNA, 546 bp, Sorghum bicolor
  Clone ID: SORBI-28MAY03-CLUS6898_1
gacagaatctgcgctccgcttcttcccttatccgaagcctccagcctccctctcgaatcccacctccaagctccgatccatggcgtctcacgatcaccaccactcccacgagcacgagcacgagcacgggcacgaccaccaccattcccacggggacggcggtggccatggatcggggggatcgtgggtaggggaggacggccgcgtgtggcactcccacgacggcctcgcgccccactcccacgagcccatctactcccccggcgacttcaccaagcgcgcgccgccgctcgcctcgcgcaacttcgctgaccgcgccttcaccgtcggcattggcggtcccgtcggcaccgggaaaactgccctgatgttagcattatgcagattcctacgcgacaagtatagtcttgcagctgtacgtggcatgactctgtcttctgattcttttacagaagctatctagtttcctcgccaaactgaaaacgcaatgctacatatgatttcgagatatccatctataatctagtgcttcagttttgcccctgc

SEQ ID NO: 8969 - DNA, 777 bp, Sorghum bicolor
  Clone ID: SORBI-28MAY03-CLUS6899_1
aaggaaggaaaacgagggggaaagagaaagacaacaagccagaaaagtctcctctcccctgctccgttcgtccgcccctcaccgtcgtcgcccaatctcacatggctcggcgtctccacggccaatccgattccaacctcaccgacggcgcgcgcctccgtttctccacctccaactccagctccagctcttcctcccggttcctcctcgccgcccccgccgacgacgcctccctctgtcggatccaccgctgaccgggccgctccgtctgcgccggcctgatcaccggctggttcttggcctcttcgcttcctgcgccgcctagacgtcgccatgggcaagagtaagaggaacaagggcggtcgaagtggcggtggtgccgatgaccagcttgacggtggcagcgatgccgatagcgtgacctctatgtcgactgcgctgtctgaccttcagctcgcgcaggccaccgagcatgttagctcgcaggaattcgttcttgacaactacattgacgctctctacgagaagaggggatccacaagagagaaagcactgggcgctcttatcgatgcttttgaaagttttgtgcttcttggtttagtggaaaacaagcttactgtcaattacactaggtgcgggaagtagttcgcacgaaataatggatgagtcacatcaacagcttttgagagttctccaaacttggcctgatgcaccaaaaatgatctctgcacttgattgcttagcagttgtcacatttgttggtgcaactgatctttc

SEQ ID NO: 8970 - DNA, 645 bp, Sorghum bicolor
  Clone ID: SORBI-28MAY03-CLUS67625_1
aaaaaaaaaaaaacccctctcgctctcaggccctcaaatcccactaccgaaaggaaaacgagagcagcagcagcagcacccgcggccgcgggctccatttcttcttccttgcttgagcactcgcctttgcctgcctgcgcaacgcgtacttgatttcaggagagtttagctagctttggtggcatcggttctttgtttcatggccgagatctgctgcgaggtggcggcgaccgggtcggaccggaagggggagtgcgtcggcggggacgccggcagccgagcggcgcggaagcggaggatggagatccggcggctcagggtggtggccgaggaggcgtccgccaagaggcggaggctggaggcggatgaggaagacgcggtaaggagaccggcgccgaggtacggcgtgacgtcggtctgcgggcggcggagggacatggaggacgcggtgaccacccggcttgggttcatcgacggccaccacttctttggggtgttcgacggccacggctgctcacacgtggcgacgtcgtgcgggcagcggatgcaccagatcgtggccgaggaggcgaccgccgccgcgggctcgtcggcttcggacgacgcggcgcggtggaggggtgtcatggagaagagctactcgag

SEQ ID NO: 8971 - DNA, 697 bp, Sorghum bicolor
  Clone ID: SORBI-28MAY03-CLUS67655_1
gcacgaggcgcagttcgcacccttcccattcgagagccccctccattgccgtcctcgagcagcttgcccgtccgcggaagcggatggcctcgatgcctcccccaagcgctgcgggcgccgactctgatcagattttggtagaagtgaatggctttacaaggacactgattttgaataggccaaagcagctaaatgcgctctcctcaaccatgattatgggactcttgaggtgtttcactgcttacgagaaagatgatggagttaaattgttgattatgaagggtaaaggaagagcattttgtgctggaggtgatgttgctggagttgtccgatctatacataaagacagctggaaatatggtgctgatttcttccgaaatgaatttttgttgaattacataattgcaacttataccaaacctcaggtttctcttcttactggaatcgtcatgggtggaggtgctggtgtttctttacatggaaggtttcgagttgccactgataacacggtttttgcaatgccagaaacagctctcggtctctttccagatataggggcctcatattttctgtcccggcttcctggattctatggagagtgtgttgctctcgctggcgccagattggatggtgtggaaatgcttgcatgtggtctggcaactcattttgtccattcaaataggctgctattgttgga

SEQ ID NO: 8972 - DNA, 890 bp, Sorghum bicolor
  Clone ID: SORBI-28MAY03-CLUS67668_1
agctataaacaccctgatcatccggcaatgacaatggggtggaatttcaccttcgccttcctgttcatcttctcttcgtccaatcgtcctccccaacttgcgccatgaacgggaagcagagcctacgccatggccgaacagcgtaccacttccagcctgccaagaactggatgaacgatccaaatgggcctttgtaccacaagggcatgtaccacctgttcttccagtacaacccgcacggcccactgttcggcaccggtaagctctcctggggccactccgtctccggcgacctcgtgaactgggccttcctgggcacagcgctggacccgacgtcgccgttcgacgccgagggctgctggtcgggttccaccaccacgctcgccgatggccgcccggccatcctctacaccgggcgcgacgccaacgacgtgcaggtgcagaacgtggcgttccccaagaacccgtcggacccgctcctccgggagtggcacaagcccagctgcaacccggtcgtcccgcagcccgccgacgtgacgcgcaacaacttccgggaccccaccacggcgtggctgggccgcgacgggctctggcggttcgccgtcgtggccgaggtcggcggcgtcggctccaccgtggtgtaccgcagcgcggacttcgtccactgggagcggaacgccgcgccgctgcacgcgtcccccgacgtgcctgtctgggagtgccccgacctgttcccggtggcagagcgcggcacggaggggctcgacacgtcggtgagcgtcgggcccggggtgaggcacgtcctcaagctcagcaaggccgccgacgaggactactacgtggtcggccggtacgacgatgagaccgacacgttcgcgccggtggacgac

SEQ ID NO: 8973 - DNA, 845 bp, Sorghum bicolor
  Clone ID: SORBI-28MAY03-CLUS67732_1
cctgcacgagttcggcacgaggtcccggctgcagccccccctggcgggctcccgcccgctgctcgcccgcgccgggcccctcggcgccttcgccgcgcccctcgtggaccccccccgcgccctctacctccctcccgccgccgcctcgcccggccgccccctgtcgagccggtccgggacgccgccctcgccccgcccgccgcggcgcccgcccgcgcgcggcccgtctccgccggggacccccacgaccaacctgctgaagcagacgctggtgggcaccggcgcgctgctcgtcggcgccgtgtcgctcttcgccttcgccgcgcccgtcgaggacttcctccacgccctgaaccagcctccctccgccgcgtcgtcgtccaagccaagcttgaggaaggaagagctgctgcggctacctgtggaggtgatgcaggatgacgacctcgccgcggccgccgcggaggccgccgacggccggccggtctactgcagggaccgctactaccgggcgctcgccggcgggcagtactgcaagtgggacgacctgctcaactgataaatacctatatatagtgcggtagtgttgtgatacatgcgcagtacgccatggtgccattgccatgttgatacgacgcggcaagacaacatgtattttgtcagaatggaaattttgtgactcaactttgctggatgtgtaatagatagcctttctccgtcgcctcgcttgccaaaacaaagagttagtgcatcacacaacatggagacagagcggcatacgaatctttctacggtccaccaaggaaccaccaagtataacagagttcagaagtaccacattacag

SEQ ID NO: 8974 - DNA, 687 bp, Sorghum bicolor
  Clone ID: SORBI-28MAY03-CLUS67734_1
atttgcaggtggcattgacacttgtgctgtcacgatgatctggatcatggccgagctgatgaggaacccttgggttatgcggaaagcgcaagctgaggtgcgcggtttggtggggaacaaaccaagagtggacgaagaagatgtcaagaacctcaggtacctcaagatggtggtgaaagagaacttcaggctacacccaccggggaccttgttggttccaagggagaccatgaagagctgcgtgatcggcggctacgatgtgctgccgggcacaagaatctttgtgaatgtttgggcaatggggagagatcctaccatctgggatcgcccggaggagttcaatcccgagaggttcgacggcagccatgttgacttcagaggctccaactttgagcttctcccgtttggctcgggacgaaggtcatgccctgccatcgccatgggtgtcgctaatgtggagcttgccttggccaccctgttacattgctttgattggcagctccctgaaggaatgaaggaggaggacatcgatatggaagaaactgggcagcttgtttttaggaagatggtgcctctttgtcttgtgcctattaagagagtataattgcattggaggatgacaggctatacgtacattctcttaatatattcagttcaaatgaactactttcaatattttgttttttt

SEQ ID NO: 8975 - DNA, 634 bp, Sorghum bicolor
  Clone ID: SORBI-28MAY03-CLUS69650_1
aaaaaaactccccaatctggtcggcctccgacggagcggagaggaggacgcccatccagccaagctcgcactcggacctctttcctcggatatgtagcatgtcttgatctttcccagctgcggcgaccgaggaatcaaatcgaaccctttctctgtcctccccatcagaccgtgtcggattcgattgcttcagggtgggttgctactgatccaatccgtacgtcattcatcttgggccgattgccagggaaagagggaaggatggagttcgggaggaggaagcccatgagccttctggagctctgcatccggaaggccatcgacaacctccgctacatcgagagcgtcgacggcatcgagatggatctgctcaagcgcatcctgccgcactgcacgctggagcatctcaccaaaatcgaggagaacaccaagatggatcttagctcggtaactgatccgctgtggaagcgattctattttcgagaattcggtgaggagcatacgaacaaagttatcgcgagactgaagagtctgaaggagactcggtcagacacgaaatacacatggtggaagctcttcgaggcaagacaaaagaaacagaagcaagctgaagatgagatggttgagaaattca

SEQ ID NO: 8976 - DNA, 958 bp, Sorghum bicolor
  Clone ID: SORBI-28MAY03-CLUS69721_1
gttggacaccctctccgatttgtacgagaccgtcaccattacccaggctgttatcttctgcaacacccgcagaaaggttgactggctcaccgacaagctcactgctcgtgatttcaccgtctccgccatgcacggtgacatggaccaggctcagcgtgacctgatcatgaaggagttccgatccggctcttctcgtgtcctgatcgccactgatctcttggcccgtggtatcgatgttcaacaggtttccctggtcatcaactatgatctccctgccaaccgtgagaactacattcaccgaattggtcgtggtggtcgtttcggccgaaagggtgtcgccatcaacttcgtcaccgctgaggacgtccgcatgatgcgcgagattgagcagttctacagcacccagattgaggagatgcccatgaacgtcgccgacctcatctaagctcaatctaaatttttttttttgaaaacagcaacacgggtcttccaatatccgttaccaggctgcgtcatcagtcatcagctatttatgagtggatgatacagggcagcctgacatctttgggaggagcttacggagaaatctcttgttgcagttgttgatagatctcgtttctagagtaccgcgctggaagggcggcaggccttcccatacgcgctgccgccggtccggaaggtgaacgccggggaggaggtcagaacttcgacttggccgcatggcaaaaggcttcggggcagtcctttgcgcccttaatacctttggggggtgcatcgggggctaccaaaagtaatgcaacggttttttttaaaacctgctttttgtctctgttatttagggtgtcgttatcatgatgaatgcttttctttttatatttcaagattttgaccagattctgcgtgactacaaatgccgcgtgactggataggatatccttgaattgtgatctataatacc

SEQ ID NO: 8977 - DNA, 652 bp, Sorghum bicolor
  Clone ID: SORBI-28MAY03-CLUS69701_1
tcagagagttcatatgaggcttgtgcttgcaagcgctatggctctttgcttcaagcagaaaaactatgcaactgcaggacactttgcaaggatgcttcttgagaacagccctcaggaggcccaagcaaagaaggctagacaggttctgcaagcttgccaggacaagaacgattctcaccaactgaactatgatttcagaaatccattcgttgtttgtggcgccacatatgttcctatctatcgtggccaaaaggatgtttcctgcccttactgtggatcccgatttgttccttccatcgaagggcagctttgtaccatatgtgagcttgctgcggttggggcagatgcttcaggcctcctctgctcccctacacagtcgagataagcaatggtagttagaggtcccctatattctttctagtgtcaagttccaagactttatcatatattttaccagggagtttactgattgtaaggaataagtattatacatgtttttgtcgagtttttttcttttttgtgttctgttaccataatttttgtttgctctcagcctgctctcatctctcctcacctgccgtagcgttgtgtcgtttgctcgtccttggacgctagccggggtgttggcgggggcgccgaacccaattttctt

SEQ ID NO: 8978 - DNA, 532 bp, Sorghum bicolor
  Clone ID: SORBI-28MAY03-CLUS69792_1
ctactggatccaccacacccacacgatgccgccgcctctccgctgtctcctgctcgccttcgtcgtcctcctctccggcttcccccgtctcgcccaccccttcacggctctcgagtccgaccagatcgcccgcttccaggactacctccgcatccgaacggcgcacccgtcccccgactacgccggcgccgctgccttcctcctaccctacgccgcctcgctcggtctcgacaccaccacgctccacttcaccccgtgcaagaccaagccgctgctcctcctcacctggcggggctccgacccgtccctcccctccgtgctcctcaactcccacatcgactcggtccccgcggagcccgagcactgggcgcacccgccgttcgccgcgcaccgcgacgcggccacgggccgcgtctacgcgcgcggcgcgcaggacgacaagtgcctccccgtccagtacctcgaggcgatccggggcctccaagcggccgggttcgcgcccgcccgcaccgtccacatctcgctggtcccc

SEQ ID NO: 8979 - DNA, 599 bp, Sorghum bicolor
  Clone ID: SORBI-28MAY03-CLUS69762_1
cctactggggtcggtacgatttctccgtgctttcttcctccactcgctcgtgacgcctccctctccgcatcgcctggattgtcctccatcgccgcccctccgccctgacctcgtcttcttctccgtcgtcgccaccgtgcagtaccacacctccgtctcccgactccgcagggcggcgcggtgatggtatgcccatcctacgctggcttcgctgccgcgcacgatgaagtaggcctcatcctcgctccccacgccgtggtgctcgaagagatcccagggcaacgccgcaacacatgcagcagccggcaagcaacaaaggtgagatcgttcgtcggattcgcaggcgcaggtgagagctttcttgcacgccgccttggctcccatccatcggtcacgagtctatgcactaatttccgtagcgggatttgggcagattcttcatctgcagtgcccaaaattccgatccagattgcacggtttgatagctcgctggttcgattcggtgtgctccatgtttctgttcggggatctatctaccttgccgtcgggccaccgctgttgatctgactggcttagtcttcgtgagccggccgcctgag

SEQ ID NO: 8980 - DNA, 815 bp, Sorghum bicolor
  Clone ID: SORBI-28MAY03-CLUS8247_1
aaaatcccccatttttgcggacaccagctagccacgccacactcccaatccccgccgcagctggttccctgctccgttcgtctgatccagcggctgaatccgcagaccaccatgggattcgacaaggaggcgagctcctcgtcctcgcggctcgacgcggcgccgctgctcccgcagcacgggctgcacggcggcggcggcggcgggcacctgtcgtcgcagcccaagacgttcgccaacgtcttcatcgccgtcgtcggctcgggcgtgctgggcctcccctacaccttctcccgcacgggctgggcggcggggacgctgctcctcctcgccgtcgccgcgctcaccttccactgcatgatgctcctcgtcgccacacgccgccggatcgccgacgagcaccccaagatcgcctccttcggggacctgggccacgccgtctacggcgcgcccgggcgccacgcggtggacgccatgctcgtgctcagccaggccagcttctgcgtcggctacctgatcttcatctccaacaccatggcgcacctttaccccatcggggccgagtccccggcgtccccgctcctcacggccaaggcgctcttcatctgggccatgctgccgttccagctcggactcaactccatcaagacgctcacgctcctcgcgccgctcagcatcttcgccgacgtcgttgacctcggagccatgggcgtcgtcctgggccaggacgcctcaatctggctcgccaacaagccccccgtgttcgccttcgctggccccgccgagctcctctacggcctcggcgtcgccgtcta

SEQ ID NO: 8981 - DNA, 1716 bp, Sorghum bicolor
  Clone ID: SORBI-28MAY03-CLUS82521_1
gctccgacactcatagacagatagcagaacacacgcgccgtgcacgcttgcgcaaacccaaggattgccgctctgttcttggtctcctcctcgggtgaccgcaggggcaatggcgattaacggggaggaggcgccgcctctgctactggacgaggccgcgcgcccgcgccgcgtcgcgctcttcgtcgagccgtctccgttcgcttacatctctgggtataagaaccggttccagaacttcattaaacatttgcgagaaatgggggacgaggtcattgttgtgaccaaccatgaaggagttccccaagagtttcatggtgccaaggttattggttcatggagcttcccatgccccatgtatggaaaagtacctctttcgctggcactcagtcctaggatcatttcagaggttgcaaagttcaaacctgacattattcatgcatcttctcctggaattatggtttttggtgctctagctattgccaagctactcggtgtccccctagtcatgtcctatcacacccatgttccagtatacataccaagatatacatttagctggcttgtagagccaatgtggcaagtcataagattccttcatagagctgctgatttaactttagttccatctgttgctatcagcaaagattttgaaactgcccaggtcatatcagctaacagaatacgcctttggaacaaaggtgttgattctgcaagcttccatcctagatttcgcaatcatgagatgcgagtcaggctaagtgacggcgagcctgaaaaaccactagtaattcatgtcggacgttttgggcgtgagaaaaatctggatttttcgaagatggtaatggataggttgcctggtgtaagaattgcatttatcggagatggaccatacaggtgtgaactagagaagatgtttgaaggaatgccagcagtgttcacaggaatgatgcagggtgaggagctctcgcaggcatacgccagtggtgacgttttcatcatgccatcagagtcagaaacgcttggccaagaggtcctagagtccatgtcatcaggagtgcccgttgtcgcggcccgtgccggcgggatccctgacataatcccagaggaccaggagggcaagacgagcttcctgttcacccctggcgacctggacgactgcctcagcaaggtccagcagctgctgacgaacagggagttcagagacaacatggggcggactgccagatccgagatggagaagtgcgactggcaggcagcatcgaagacgatccgcaacgagttctacaacgccgcgatctggtactggcgaaagaagcgtgcggagctggtgaagccgctgcagtggctagcacagatgttcctgccggcgcctgaggtccgcagcatcaagcagtgctgaggcctctctccacttgtgggacgatggtgttgcttgcagccatgatccagacaagtgatggatggatggaaagcaagacatgcatatgcactccttgtaaattcctggtgtatagtgctgtgtcgataggtgagatagttccccgtttttttatggaaattggaattgggttgtgattgttgtggcaattccatcgattacatgtgtgttgtgtagcaaatcagaattggaatgtgctatatatcttgatggaaattgtaacctgtaaatcatgattaggccattaattaaatgcatgagtatgctttgtgctc

SEQ ID NO: 8982 - DNA, 933 bp, Sorghum bicolor
  unsure (1)..(933): unsure at all n locations
  Clone ID: SORBI-28MAY03-CLUS8258_1
gtttagtcctaaaatggatcacctggtgtgttttcttcctggtacccttgctcttggtgcaactaaaggtatcacaaagagaaaagctcttgaaagtaacttgttaactgatgaagataaagaaaatctccagcttgctgaagatcttgccaaaacatgtgttgagatgtactttgtgacctctaccggccttgctcctgaaatagcttatttccacattgagggtgatacagaaggggggcctgatggtgggaataaaagctccaagtatatcaatgatatcataataaaaccacttgaccgtcacaatcttctacgcccagagactgtggaatcactatttgttttgtatagaatcacagaggatcccaagtatagggagtggggttggcagatctttcaggcttttgagaagtacacaaaagttgattctggtggttacacatcattggatgatgtcacaagcctacctccttctacaagagataaaatggaaactttcttccttggagaaacattgaagtatttgtatttgctgtttgatgaaaacaatacccttcccctagataagtatgtattcaatacagaggcccatcctcttccagttatgcggtctgcagaacgggcttcacattctgtgtagtttcccaagattatagctgttgtactatggtgagaagtacagatctgtgacaaatatacttcacaacatagttggaggaatgagaaattgagaatcccttgcgtgacctgttcttggaggcaaactcatgattctggaaacgtcatgcttgatttgaggatttggggtttttacttgtatttattggaaggcccatacaacttttgtactctgtagtctgtactacctaacttgaaattttgaaatcagctagcaattacaccaagatttttatcttcnaaaaaaaaata

SEQ ID NO: 8983 - DNA, 741 bp, Sorghum bicolor
  Clone ID: SORBI-28MAY03-CLUS82626_1
tcccgcgcctcacgtacttgacggcggtgatcaaggagacgttccggctgcacccgtccacgccgctgccgctgccccgcgtcgccgccgaggagtgcgaggtggacgggttccgcatccccgccggcaccacgctgctggtgaacgtgtgggcgatcgcccgcgacccggaggcgtggcccgagccgctccagttccgccccgaccgcttcctcccgggaggctcgcacgcgggcgtcgacgtcaaagggagcgacttcgagctcatcccgttcggcgccggccggaggatctgcgcggggctcagctggggcctgcggatggtcacgctcatgacggccacgctggtgcacgccctggactgggacctcgccgacggcatgaccgcggacaagctagacatggaggaggcatacgggctcaccctgcagcgcgccgtgccgttgatggtccgcccagcacccagactgctgccgtctgcatacgcagcggagtaggggaggaaaaaaacatattctcgctggctatcccgttgcctcctccgtcccgtcgcttcattttcctcgtcaaataaactgggtgtggctatttgccggtcgcttttatttcccaataaatcagcaaacaatgctttcagctataccttttatgctaagcgaacacagtctacatggattgtatattcttgtattagtacgggatgtttatctccaaaataaaagtagtactccctgtgccccg

SEQ ID NO: 8984 - DNA, 684 bp, Sorghum bicolor
  unsure (1)..(684): unsure at all n locations
  Clone ID: SORBI-28MAY03-CLUS70238_1
aacttccgtttctttcctcttgtccaccgcgttctccaaaacctctttgacgccgcacccgcacagcacgccggcgggcggcggccatggcgtacctccctccccacaagcgccactccagcaccacagcctccacgcccacccccgcgcccaacccgccacctccgtccctctcctcctccctccgctccctctccctctcctccccgcgaggccgcggccgcggcgccggcggacgccacccgcgcgcttctacttctacaaagatcatccacgccgccggatgcatctcccgttggtccccgctaccgcccttctcccctggcggcgacggcgaggagtacaccctccgcctcgagcccttcgcttgcgcccccatcgagcacaggaccggcgccaaaccccttgccctcgtcgtcgcctccaccccaggagaaggctcctccggatccactacggcggcggtcactgccatcgccgagaggttccttcccgatctccttgccgctgcggagaggaccaaggtagagggcgcgcctaaggatgagttggttaagctgagtctcgtggcaaggctgggaaaggtgctcttcgagtgccagcccggtggatcgcccgtctcactggacacactccgccaggcagcanaagcaggggaagatggttccaagagccagttgcgta

SEQ ID NO: 8985 - DNA, 865 bp, Sorghum bicolor
  Clone ID: SORBI-28MAY03-CLUS70421_1
gatttgcttttgcagttgcagctttagctgagcagcagcatatgcatggagagtcttctagcgcatcagcttgccaaacaccaaggtttgatatccttagcagatcagacagatcctctacagaggatctgagtgtagttgggagcagctcttcagattccagagttgaggaaccatcaagcagcagtacacaccgaacaatagagggttcagagtattctaattctaatggccggtggtccgaggttgctgaggctggaaccagtattgctgaagctgatgttatagtggaggctggtgttggcaattcgtcaacttcagttgggtccaacattggttctagcagtgttcccgatagctttgaggagcagatgatgcttgccatggctctttctttggtggatgcccgttctagagcaggttctccagggttagcttggcgatagcatttggtggtaggccctttcactccctttatttattcttttcgggttttctgcgttttgttcttagagttcctattaccacataaaacacaggattaggtggggaacaggctcaaacttgaagaactggtcgtgctagttgtgaatagtgggggtaaatctgtacatttgaagccagtgattggctaattttacctcttttcttcttccgtttcatagagggagaaattttattgtttcagtctcaggcagacttctgccaacacagttcataaactgtgcctgatgttgcaaacatttgtgtaaatacagaatctcactcacgtttttcatgttccagttgttttttcctgctatgtcgaacaccttgcatttggtgaaatgagatgagatattatagtttcctaaaaaaaaacaaa

SEQ ID NO: 8986 - DNA, 754 bp, Sorghum bicolor
  Clone ID: SORBI-28MAY03-CLUS70426_1
cgcaatgccgacaagaagcagagcttcacgccacccacgccgcagccgaccctgccgacgaagcgccgcaagggcatcccgcaccgcgcgccgttcggcagcctcatcgtcgagtactagctccctcttgcacggcggcggcggcggcggctgctgcattggcactacacgcgcgcggtaaagcaaaaagtactcttcaaccaacggaattgaatcgcacagtggggagtcagtgaatccaaatccatgccatgcctgaatcaatccgccattacggcaatggaatgggatggccaccacttcggtggcctggcctggccgccttcctttgcgcactttggttggtggtgcttctcgaggtggatgccatttgctcgctggctttgctttccacaaaggaacgaagggagaaagaaaggtggaggaagaatcaaaactagcttttcatcacttttgtgttaggacacaagaaagatatatatatatttctttctgatagaaatatatgtacatttttagtcttgttatatgtttcaaatcatcatagtggagcagtatagctagctagcttttgtgatgcttttactagattattattaggttgtctgaagaaaccatgttcaggagataaccttgttagtactacaaggtactagtaataagctactggaggtggtgattgccatttagcaagcttttgtggtgacctgtggtgcttaaattgtgttagtcacaagtaccagttcctggtgtc

SEQ ID NO: 8987 - DNA, 744 bp, Sorghum bicolor
  Clone ID: SORBI-28MAY03-CLUS7044_1
ggaggcggacccagcctctctccacagctctcgagaaacctccatccagtcgagggcaggctccatccttcctccagactccagaggcaccacagacacacacacaccaatggctcccagcaagctcgccgtggtcatcgccttggtggcgtctctcctcctgctcaccaacatcaacaccaaggctgctccgggtccgggcggctacccgccggctcctccgctcggccctccgccgcaccagatcgtcgaccccgccaaagactgcgggggcgcgtgcgacgtgcggtgcggcgcgcagtcgcggaagaaccggtgcgcccgggcgtgcctcaagtgctgcagcgtctgccgctgcgtgccggcgggcacggccggcaaccagcagacgtgcggcaagtgctacaccgactggatcacgcacggcaacaggaccaagtgcccgtgagtgcggctgcggggtggcagcggcggtcagcgtgttccccggccgaaagcagcctcagttccatgggcgcaccactgccacgccacgtcttgtatgatccgaccccgtccgcgccgtagatgtactagctatctactccgtagtagtctacagtagctagctcctggttgatgatgctatgctgtgttgtttgtttgctggtagtactgctctatccttgtgatgatgtcgatgggctttctgtaaaaagggcgtgcctttctcagtttctgtagcagtaaaatccatctgggttg

SEQ ID NO: 8988 - DNA, 1045 bp, Sorghum bicolor
  Clone ID: SORBI-28MAY03-CLUS70492_1
gcacggcggcggccggcgggccgccggcgcgccacgcggccgcgggggccgcgcccgcacccggaccttttttccctttccctttcccggctcgttgttgccggaggaggaaagagagagagggccagagggtgagggagagccggagaggaaatcttccactgacttctcccgtgtcgtgttgcctgcgtccgccgctgcctcgctgcgacgcgtcggcctctcctctcctctcctctcctcaccccgcgcgggagggagcgggcggggtggttgcggttgcggttgcggttgcggtggtggttgaggtttagtagagggacccggggccgggctcggccggccgttgggcccctggcggggcgaggcgaggcgagggagggtgaggccgtggggaggggatggggaaccaggtcggggggcgccggcggaggcggccggcggtggacgagcgctacacgcagccgcaggggctgtacccgcacccggacatcgacctcaggaagctccgccgcctcatcctcgaggccaagctcgcgccctgccacccgggcgccgacgacgcgcgcgccgacctcgacgagtgccccatctgcttcctgttctaccccagcctcaaccgctccaagtgctgcgccaaggggatttgcacggagtgcttcctccagatgaagtcgcccacctcgtgcaggccgacgcagtatcctgaccaaattcacttcaattctaatccagtccagtctgatgctcttgttgagtgtgtgtgtttcttatttggggttctctggtgttactaaattgtgccggttattgctcacttcatcagttgcaactgcaaaacccccttaacttaccttgtaacaaggtgtccgtattgcaagacgctgaattatgcagtggagtaccgtggtgtgaagaccaaggaggagaagggcatagagcagcttgtgagtgcccatacaaaccgtgttctgtttctgagttggctgctttggtttatttgatcgccaactggttggaattgggaaaatttttttggatagga

SEQ ID NO: 8989 - DNA, 797 bp, Sorghum bicolor
  Clone ID: SORBI-28MAY03-CLUS70520_1
attttcccctctgctgcttgcttcgcttcgcctcacctgccgctgccctgacctgcccacacattttccttcctcccggtcgccgcctgaaaaccgccgcgctctccgccccgccgtcttcctttgcgtggaggagcaaggacgacaagaacaaggctcggctcttcttggagatttggagagcaagggtctgtctttctttctctgtctctgaagggagcaagaagaggatcggatggcgattgaccacgactccccgttcaaggagctccgcctcaagaaccgcaggatcatgggaggcggcggccctgaccctgagccggaggaggaggaggaggaggccgccacggcggcgtacgcggagcagtggccgcgctggctgcagccgctgctgtccgcgcgcttcttcgcgcattgcaagacgcacagcgactcccaccgcagcggcgagtgcaacatgttctgcctcgactgcagctccgccgccgcgggcgcgggcacgcgcgcgctgtgctcgctgtgcctcgcgcacggccaccgcgaccaccacaccatccagatccgccgctcctcctaccacgacgtcatccgggtctccgacatccagcgcttcatggacatcgcgggggtgcagacctacgtcatcaacagcgcccgcgtcgtcttcctcaacgagcggccgcagcagcagaagccaggctgcggcggcggcggcaaggccgcgtcggcgtccgccaacctctgcgaggtctgcgcacgcagcctcctcgacaacttccgcttctgctccctcggat

SEQ ID NO: 8990 - DNA, 666 bp, Sorghum bicolor
  Clone ID: SORBI-28MAY03-CLUS69291_1
ctggcccgcgcccgccatggccgcgcccggctccccggggccccttccccgcctcgatcggcggaccatggagtgggacgaagctgggcgcatcccgccctctgggtaccgccgcttccctgcccgcccccagcctgcttcccagcgctgcgccgccccccctccgccgcccgcggcttacagggacgtcggccgtttcggccgcggtgggttggggcggtttccgggctggcgtgcccgcgggtggcttgcgccgcgcgcgcgcgacgcggtggggtgcggcggctactgggcctgggccgacgggcccccgggttctggggatggtgcatcccgtgggggtgtgttcgttgctggggtcgctgctggtcctggtggctcccggggattggtgcccggtcgggggcgcgccgcagtgccctcatgctcagggtggatgtgtcccaggccggcgcgcgaccgcgtgcccgcgatctgtggtgccctctcaccctggtcaccgtgctttcgctggcgtgggctctgtgttgccctcgctttttggttacggtctgtaggatgttgggttctctctgttgtacttgattaatggaaaagatctgtctggtctttgtctcggactgtttgctgcggtaggccatcctttatttacttgtcaaaaacttg

SEQ ID NO: 8991 - DNA, 646 bp, Sorghum bicolor
  Clone ID: SORBI-28MAY03-CLUS69549_1
aaaaaaagcccactccacacttccagaggcagtcacagcagctgacagctcccgctccctccagcagcgtcagcacatcgcgccacccaccagtcactcccccaaggccccaagcccccaaatcacgatggagcccacgggcacgatcgtcttcgcgtccgtcggcgtcaccaacttcggcttcgacgtcttctccgtcgccgtccctacgcccgcgtccgcggaggccgaggccggcgtctccgctcaggagctcgacgagcggcgccacacggacggcgtctccgtcaacttcaacgcccagttcgcggacgacgctggcgacgcggtcgcgttcgtgtccgagcggacgggagcagcgagcctgttcctctcccggccgccggggtccgaatccgaccgccccgagccgctcccggccgcggagggcagcctgttccatgaccgccccacggtgcgcggcggtcgggtgtacttcgtctccgcgcacgagaagccggaccggacgttccagagctgggcggccgtgtacgcggcgcgggtgggcgagcggaaggcggagccggagaggctcacgccgcgcggcgtcgtggacatgagccccgccgtgtccgcctcgggcgacctcatcgccgtcgcgtcatac

SEQ ID NO: 8992 - DNA, 657 bp, Sorghum bicolor
  Clone ID: SORBI-28MAY03-CLUS69589_1
agtggacctagcagtctatccaattgcagctacaagagccctatgctgaaaaaggctaggatggaggctaccagtcaagcaagattgcaatctgctatccaaaagaacacttttgcgaggtcatctcagccaataaggacgacctcttttagtggacagccagtgagaacaactaccattcatagacccaattcaaccatcactaccaccaaaccgattcatagacccaattcaaccatcactgacaccaaaccgattcatagacccaattcaaccatcactaccaccaaaccgattcataggcccaattcaaccatcactaccaccaaaccgatggtaaaaagcaggcaaattcagaacagcaaactgatggaaaaaagcaggcaaattcaaaacagcaggcccaaattctagaaaatggtttgctgcgatgtcgcaagatcaacttccagagctcatgtgtcctctgcagaaagcacctcttttgtacaagatgtgttactttgcacccgtagctgtgcacttggaactgtatctcaaaaggagtagcacaatttttttgcaaaggagagacttgccaattgtaacatatgagggcgcattaccaatatttgtaacaaacaatttcttgtattaaagaaaaaaaggtttggtttc

SEQ ID NO: 8993 - DNA, 906 bp, Sorghum bicolor
  unsure (1)..(906): unsure at all n locations
  Clone ID: SORBI-28MAY03-CLUS6964_1
aaaaaaaccccgtgctctttctctctccctctgcgcacatgtgggcccatcaaaccaggaggccttatcacttcggcttcctcccctttcttctaaaaatcatttttgttctctcgctactgagatccacttcatgttctacttcttcctcttctcaaatctagagtgttggtaacgatgggggctagaaccagtggtttcgtgtgcggggtgacgagattggtcggtctctcctttgagtgcaggctgcttggccgcagcgccggcgttggatctgaccacgcctcgacgcgattcacctcgcctgacagcgtcgccgcgctctccagcagggataaccaggctctagatcgaagcacccgcggcgacaaggacggtgcagacggcgccggtggccgcaacaagctttggttctccaaggaccaggccactgtcatcgaggtgtgcttcaagatgcacagcacgctcaagcccgtaagctttttatcattatttcttgtcatcaggttgttgattccgttcgctcgctgattcatggcctagtggtgtctaatactctaatcaagatttgatcttaggccttgcagaagcagggctgattcatggcccagatgggttgatctgttctcttttgtgcatccctactcatcaaatctacaaaatactcttcttgaatcaagataatttagttttgtgttgcaggcttgataagtttctttttgtctgtttcttgattttccttggtagactaggttgaacatgtgctgctgcagtaacttctgatgatggaagcttgcaaattgcacaggctaatttagtggcgttggcgttgtgtgtgttgattcacaggagtgtatccatgttttgtnaaaaaatatgatagatgaatgtgtaactgatggatgc

SEQ ID NO: 8994 - DNA, 760 bp, Sorghum bicolor
  Clone ID: SORBI-28MAY03-CLUS69646_1
aaaaacaaaaaaaaacacgcacctatcctatcctctcgatctctcccgacacagacggccaaaggcgacgacgccctacgggcggcgagccgacctccgcgccaacgtgtgggcaggacggccgcgacctgcctcccgcagtcccgctggcctcctctctctcttccccttgctctctccctctccatcacggcgcggatagggtgacgatggctgccacaggtgggtgcgacggctgcgagcgccctcctcctttccccctcgcgactgggccccgccagcgtcgcttgccccaggtgctgcctccgccctctgctccgtgtgcgttcatgtgctgcaggtgctacaggaaaccctagcagcctgtgctaggggtcgcgatggcccagcttcgagccttcgacccaaccctcggcggtggtgccttactccagtgtggacatgctcgccggcgacagcagcggcggctaccaggttgttgtccctctgccaactacgtgggcgatgagtttttgcaggactctcatgctctcttgactagagaggatgatacttgggaagattgcgttctcattcataaaattcgtaagcttggtagcagcacaatcaaattaaggcgccgattttcgccgactgaatctccagttcttcgtcctgtttgcctcccggacttatgcaccggcatctggggcggggaccgaatgcccgagggcttcccttcacaagtcctgccatggtcttcgtcatgtatgccaacctg

SEQ ID NO: 8995 - DNA, 642 bp, Sorghum bicolor
  Clone ID: SORBI-28MAY03-CLUS70818_1
ccctccggatttctttcaggctgttcttttttgttctgtgcgactgcatctcctccatttaatttccttcaggcgcgcggcggtttcagagttttcattcagatgacgacaccgacttgcaccaccaatgcagccttcttcttcctcctgctgctgctggtgtgcgcctgctgcttcgccaccacccttgcctgtgaccctaatggcgatggcgccaagttcgggtacatcggctctatgggtcctgctcactggggcagcttgagccctaacttcaggcagtgcgcgagagggactcaccagtccccgatcgacatctccacggccgaagccgttctcaacccggggctgcagccactccacagggactacaccgtcgccaacgctaccctcgtcgacaacgtcttcaacatcgccctgcgcttcgacgacgacgacgacggagctgcagggagcgtgcggatcgacgggaaggtgtactggctgaagcagatgcactggcactcgccgtccgagcacaccatcaacgggcggcggttccccgtggagctccacatggttcacgccagcgacgacggcaacgtcaccgtcgtggccatgctctaccggtttggcagcaggccggaccctctgctttggcag

SEQ ID NO: 8996 - DNA, 776 bp, Sorghum bicolor
  Clone ID: SORBI-28MAY03-CLUS71121_1
aaaaccagcaaacacaatcgttcacaccactcccttcccctcgctctcgcaccagaaatcgccatgcactccctcgcccaaatcgtgcctccgactcccctgcctcctcgaccccacgcacctgcccgacccgttctgacctcacgagtcgcgagtccccatgaccttcgccgaacccttgccgtcgagcgccctgacacggcgacgacgcgctcaaccgcggccaggggcgccgccaccgtcggttcctccatgacgtctgcctgcgggttcgaaccacctccgccggaatagggcaacaaggagacgacaacatcgccgtcgcgccgccccaccctatgcccctgtcccggccatcgcgtggtgtcacagctccggcgctccgtgcctccgcaggaccatggcgggccgccgcctactcagccttgggaatccatctggaccatggcgggccgctgcctactcagccttgggaatgcatctggtatgtcgatctatatccccgcctgtctctatccccgtggctctcccatcttggagaatccatgtacggggataggtggatcccgattcccgaccgcgagcgaaatgaagagcgcaccggcgaagaagagcaccttgttgcggctgaggtgccagccagctagccccatggggacgaagagcacgacgcacgccgcaaccacgcccgcctgcgccgtggctgaaactaccggccagctggccaacctagcggccgcctgtgcttcacccgtaagcgcgcgctcgagcggcga

SEQ ID NO: 8997 - DNA, 726 bp, Sorghum bicolor
  Clone ID: SORBI-28MAY03-CLUS71152_1
tctctcgcactttcggccctgtttggtccccctcccccaatctcggaggccttaggctccagaccgtcgcccctctatttgctcgtctcctgtcctggcacttttttgttccgttcttattgatttctccctgcgtttgaccacagagccggtctgtcggtgcagcttgattttttgtgcgaactctatgtggcctgagtgcaccgcccctcgaggagctcgcttgcgttatcttgctcccctccgcagttgatgcctcgtcttgagacaaccagatcatggttccagtgaatactgatgctgaactaaatgtgtgacgcagctctcaggcctccgattttgacttgcctgctttgctagcatcattcgggggcggcgtcgatctctgttgaagggtcactggcatcacacatcgggtcctccattccggggccgccgccaccctcgcacgcgggtccgccccatccctcgccggcatcgcctacccgccgccgccgtcagccgccctcgctggcgcgcccctgccctcgcctgctgcgcttcctgcgcccccgccctcgcccgcctcccgtgttggtcgtcgccgtgagccgtctgcgctgtcatttttatgtacttttcttcgggtcgtgggttattgtgtacgttttgtcgtctggtttgttcgtttgcgtggtttttgtgcggtttgggtcgtttgtgatatatataaatgtggtttgtgtt

SEQ ID NO: 8998 - DNA, 833 bp, Sorghum bicolor
  unsure (1)..(833): unsure at all n locations
  Clone ID: SORBI-28MAY03-CLUS7140_1
actagcacactcacccccaccccaccccacctccattcctccaccgtcctgctcggctttctggcatcatcactcccctgctcccgctcagggaattcattcattcattcaagtggaggcaatcagattctatgatggagttcaaaactggcatttttactgtggccatactagccattgtgctgtcctcaccagcagttgctcagaagagcccacctgctccatcagctacaatccttccaccagcgccagcacccgcacctgcgccacgccatgttgacctcgctgatctcctcagtgtggccggaccgttccacaccttcctggactacctgcagaagaccaatgtcatcgagaccttccagaaccaggcgaacgacacaaagaacggcatcaccatctttgtgcccaaggactctgcgttcgccgcgctcaagaagacaacatttgccaacctcacccaggaccagctcaagtccctgctcctgtaccacgcgttccccaaatactactccctggctgagttcgacaaactgagcactctcaacccagtgaccacctttgccggctcgcagtacacgctgaacctcacctacaacatgggcaccatccaagtgaaatcgatgtggtccaaccccaagatcagcagcagcgtgtactcaacccgcccggttgctgtgtacgaggtcaacaaggtcctcttgccaatgcaaatctttcagagcgacccaccgctggcgcctgcccctgctcccgcccctgactcaaggcctctgatgttgctcccagnccaaggtcaggngaatcagcaagcgcaaaggcgaaggcggatg

SEQ ID NO: 8999 - DNA, 616 bp, Sorghum bicolor
  Clone ID: SORBI-28MAY03-CLUS71421_1
gttcgctgttccgcagccgccccctttccttcccattttggcgtctcgaagccagtagattaatcatctctcgatccacaaatcgctcccctctctccatctcgctccctgaaatcgaggagcgctggaggagacgccgcagagcgcgttggctcctagggtttgccggtcgggttggggctccgatccggtcgtgcgggtatgaggattcgggagctccgggatgggctggaggtggaggacgacgagcgggagcaggagggatcgtggggtggcggcggcgacggggaggtggtcgcggttgtgcgactgcgggcgaagcgcgcgctcgtcggcgccggcgcgagggtcctgttctatccgacgcttctctacaacgtgctccgcaacatgttcgacggcgagttccgctggtgggatcgcgtcgacaagtatgttttgctaggtgctgttccgttctctagcgatgttccgcgcctgaagcaacttggagtaagaggagttgttacactcaatgaaccctatgaaactctggttccaacatccctatatcaggctcatggaatcaatcatctcgaaattcccacaagagactacctgtttgccccatccctgg

SEQ ID NO: 9000 - DNA, 728 bp, Sorghum bicolor
  Clone ID: SORBI-28MAY03-CLUS69833_1
ggagcctcagccacatactcactaatactctctctaatgcaagtcacatttgagaaggttattaagaaggaaacgttctcagtcgtgttgaatatgcagatatatacagcactagtggcaacaatagcttctcttgttgggttatttgcaagcggtgagtggaagactttagagggagagatgcatgccttcagctcagggaggttgtcatatgtgatgacacttctatggactgctgtatcttggcagatagcttctgtaggagtggtgggtttgatctttgttgtgtcatcactcttttcaaatgtgataagcacactagctctacccatcattccagtttttgctgtgattttcttccacgacaagatgaatggagtgaagattattgctatgttgatggccatctggggatttgtttcatatggataccaattatatattagtgacaagaaagctaggaagacttcagtaagtgtggaggagaattcctaagtgcttgttggcttattacattgttctttgtggctcctataccactttaagttgctggtattgaggagatactagttattgtagccaaaaggaagctcattaaagaatctcaggctgcagaattcataggtatatacttctgttagtattgtcatatgtacggttgtattatccccaagataataagaataacatttccggaggcatgctctctagatttctaatcctctcgt

SEQ ID NO: 9001 - DNA, 727 bp, Sorghum bicolor
  Clone ID: SORBI-28MAY03-CLUS69859_1
tgagaatcatgaactggcgagtattgtgctggattacaaaagggagtgtggccgggatagtgtgctgcagtcacacacctctgtgcagacggattgcaacagtgagtctggagaaacaaccttgcactgtgagcatgtgctgagccttgaatcaggcccgaccatggtaaaggcccggaccatgtggaggcctaagcgaaccaaggcccaagaaacagtggttccatcttcattttgagttgtgtgagatgttggggatgtgattttggcagcaaactatttggtaaaagatcagaatggttaccagtgtcctctattgtggaagcaaatcacacaaggcaagcaagatctaaactaatttaattatgaagtgtgaaaaatagaggagatacaagtgggtcacatggaggaggagacagaaccggggagatcgaatacaaaggaggcttcctgtgcatggtttgttcctgttttttcttttccttttgagttctttcttacgacaatcttcggtcgcacaaatgggtgttgtaagtattgatctgtagctacaagtgtatgaaggggagcaagtgtttcccgtacatgttccttctggggctatgtccatatgttatataagccccttgaaaacagctttgtcgcagccatttccattcagagaatttgaatctcgtatattgtatttttctgatattaaaattggatattattactcttctccagg

SEQ ID NO: 9002 - DNA, 676 bp, Sorghum bicolor
  Clone ID: SORBI-28MAY03-CLUS6989_1
aattccacctcgccatcgtcctcccctcgtctccaaaaggaggcgccgctcctcgtctacgccgtccacttccctctctagcctcaacgcctccgccccccccactcgcgagaccctagctagccctagcgccacccgccgactcacccggagggaggaggaggaggaggaggaggaggccttcgccgtggtcgtcggccgaggagcaggcgccaggatgttcgggtaccagaagggcgtcgacgtcgaggcggggacctccgccgccacgggcggcggcgcgcgccagctctacccggggatgcaggagagccccgagctgcgctgggcgctcatccgcaagatctacgtcatcctctccctccagctgctcctcaccgccgtcgtcgccgccgtcgtcgtcaaggtccgcgccatcccgcacttcttcaccaccaccaacgccgggctcggactctacatcttcctcatcatcctccccttcatcgtgctgtgcccgttgtacttctaccatgagaagcacccagtcaacctgatcctgctcggcctcttcaccgtcgccatcagcttctctgtgggcttgacatgtgcctccgccgccggcctcgtcgcgccgcatcccgcggtgctggccaccgggctgtgcgactccggcaagcctttcgtctgggtgctg

SEQ ID NO: 9003 - DNA, 898 bp, Sorghum bicolor
  Clone ID: SORBI-28MAY03-CLUS70140_1
catggaggaagatggtagccttgctatccagaaggttgaattgaatcaggtacgccacttggtggaagacatatcctgtcttttcaaaggtcttgatctaaggctgatgttgtgtaagaaaaggatcctgaaaaacttagattctgaagtggaaaatgctgtaaagagcttggtgtctgctgctattattgatcctaatgtgaaaggggggattagatggccacttggaaaggagtcaattggtgagaggttcagcatagttggggtgtggcacacaaactacaaagctttcagaaatgaaaccatgaggctcaagctaaggcatgctgacagattcgatcaccggagctcgactggggaagtttcaaatgaagttacattcaaactaactgccatttctcgcaaactggaggaagatgacccggtggagaactctgtgaaggagatgctggagtctgcggtccaaatgatttgggacaatgcgctgaactaccagatcgtaccttgagcttggctatgcagacaatagttcttccttggagatgcaacacgcgagttgatttctttgagcgcctctgtatatagcgtccgttttgtcatgatctgtcacctgcgatggttagacctgagtgctaaaatatgggatttggttgtttggcaagttctacttgctccaaaaatctgaccagtggccacaataaattggagtggttctcagcacaacttgttgattgctttgcttgcggtcgtatgtttggtattgggctattgtaaacgggcagtgaactctccttggggttagtttttcagaaatgctatatcacacgtgtgttttatttgttgttggcacacaaattttatagccgctcgatgaagaaggtagcgcttgatttctccg

SEQ ID NO: 9004 - DNA, 712 bp, Sorghum bicolor
  Clone ID: SORBI-28MAY03-CLUS70198_1
aaaaaaaaacagaaatagttcgcggtctcttgcgccactccggctccgccaacgccgccgcccgccacagccgccgcagacgagatgggcatcaagggtttgacgaaactgctggcggacaatgcgcccaaggcgatgaaggagcagaagttcgagagctacttcggtcgcaaaatcgccatcgacgccagcatgagcatctaccagttcctgattgtagttggaaggacaggtatggaaactcttacaaatgaagctggtgaagtcactagtcatttgcaaggaatgttcaatcggacaataaggttactggaagcgggaatcaagccagtttatgtttttgatggcaagcctcctgatatgaagaaagaagagcttgctaaaagattctcaaaaagagaagatgcaactaatgatctgaaagaggcagtagaggcaggagataaagatgcggtggaaaaattgagcaagaggactgtaaaggtcacagcgcaacataacgatgattgtaaacgactgctaagacttatgggggttcctgttgtagaggcaccttctgaagcagaagcagaatgtgcagccctttgcaaaaatgataaggtgttcgctgttgcttcagaagatatggattcccttacttttggggctccaaggttccttcgtcatttaatggatccaagttccaagaaaatacctgtgatggaatttgacg

SEQ ID NO: 9005 - DNA, 875 bp, Sorghum bicolor
  Clone ID: SORBI-28MAY03-CLUS71912_1
ttcaatttatgagtttttttactgacttttggtgagctttaattttagattagtgtttgctccattgacgatcctgtcaatgcgtcattttttgaatcctatgaaagtgcacactccatgcatgatttgactggttccattgcgaagaaacttggtgtccaagctcctccagttagaattgacagccaagcaaaatatggtgctctggcccgaggcgatggtgccatttacttgcgctttccgcacaaaggttatagagagaaaatatgggaccatgcagcaggctcaattgtcgtgacagaagctggaggcatagtaacagatgccgccggaaatgacttggatttctccaaagggagatttctcgatctcgacacaggcatcatagcaacgaacaagaacttgatgccatcgctcctgaaggctgtccaagaggctattaaagagacgaaccaggcttcctccctcttgtagctgttgcagtggtcgacaaaaatattagttgcaattctgtttcattttcatagtgacgaacaggtgtgcatcctttttctgtggcattacagttagtctactgaatttacaacatctatcccattggtgataagacaggcactcttatcacgaatcacaggataagttggttaaatttgcatcattgtacaacatcaaataatgtaaatggctgaaagctttgaataaattgtggaattactcatgtcaatatagatgatttggtgtattatcccttgtagtaatgctgtagctgttgtatctatctgctgttttttccccatgtgaatgagagaaccattgccttctgtatatttacaaaggattcatcaggtttataaaacaaaaaaaaaaaaaaaaaa

SEQ ID NO: 9006 - DNA, 701 bp, Sorghum bicolor
  Clone ID: SORBI-28MAY03-CLUS71856_1
aaaaaaattaaataccctagccttcggtgggtgcacacccaacccacctcctcccccgccgccgctcgcccgcctgccggcgaagcgcgcggcgaagagatggcgttgtacctgctcttcgaggtggcgtcggggtacgctctcttccacgcgtacggcatcgacgagattgggcagagcgtggacgccgtccgcgcgtccgtgctggacctgcagcgcttcggcaaggccatcaaactcaccggcttctcccccttctcctccgccatggacgcgatcaaccagtgcaacgccatctccgaagggatcatgaccgacgagctgaggaacttcctggagctcaatctgcccaaggtgaaggagggaaagaaggccaagtacagtctcggtgtcacggagcccaaggtcgggtcccacatcactgaggccacggggatcccctgccagagcaatgagttcgtccaagagctgctccgaggagtgcggctgcacttcgatcagtttatcgaccaactcaagaaatctgacctggagaaggctcagctaggcctggggcatagttatagcagggccaaggtcaagttcaatgtgaaccgtgtggataatatggtgattcaagctatctttctgttggacacactcgataaggatatcaattccatctccatgagagtgagggagtggtattcgtggcattttcc

SEQ ID NO: 9007 - DNA, 692 bp, Sorghum bicolor
  Clone ID: SORBI-28MAY03-CLUS72011_1
aatatgcaaatgtactcttaaacctcttccccagcgcgatggccgccgccgccgcgggagaaacaccggtgggcgtcggggctccgccgtcagggcctctctactccttcggacccccgcggccggagctcaatcaaggcctcacctacaccgccgcgttccggtgcgctgatgcggacgccgttaccaccttgattgagttctactctagtaaatacaagagctcggcgccgttgccagggtggatcaagaggattggtaaccggcagataaccgttgatggtgaagttgtcactgatccagatatgactctcagggatggttctaagttggtatatcatcgttttccctggcaggagccatttgcgccatatttgctggaagtgctctacgaggatgatgacatggttgcccttaataagccttctggcttgcaagttctgcctaaaggcctctttcagcagcgcactgttttagcacagcttcaattgaaagactggaagatggcctcatcttgccgctccaagagaaaagatgtgcagtcacatccagtacctgttcatcgattagggaggggaacatcaggcctcctgctttgtgccaagacaaaggttgccaaagttcgacttgcatcttattttgccgagggtgctgtacttgcggcacctgcacaccaaaatcacacactggtc

SEQ ID NO: 9008 - DNA, 1290 bp, Sorghum bicolor
  unsure (1)..(1290): unsure at all n locations
  Clone ID: SORBI-28MAY03-CLUS72030_1
ttctcgagccccagcttgaaatccgcccccccgacacgggggcaagcngagcgaaaatcgaatggctcccatcttcgccgcggcgtcccacgcgtccctcctccccctctcccacctcgaccgccccgccgccggccgcctagtccgtggcactctcaggccccacacctcgggcctccgcttgcgccgccccccgggggcaaccgggcgcggccgcgggcgtggccgaggaggcatccccgacgagtggggcgagcgttcgccgccaggcgcccccgagccccccgcgcagcccgatccgctcatcgacgacgaggacgactccgccgacggcaactcacgccctatcgtcatcgacgagtggggcgagcccggggcgcccgagcccgagccgccctccgccgcggacccgcctagccccgccgcagacgacgagtgggaggaggagccagaggcgccggcgccggacccgaccccggctccggcggcggcggaggaggacgagcaggcggtgaagagggaggagctcaagcgctgcttggtggacacggtgtacggctccgacctcggcttccgggcgtccacggaggtcagaggggaggtcgtcgagctagtcacccagctcgaggcggctaaccctactacggcgcccgtcgagacatcggatctcctcgacggcaactggatcctcatatatacagcatattccgagcttctgcctattctagctgctggggcaacacctttggtcaaagtaaagcagatatcccaagaaattgactccaaaagcatgacgatagtcaatgcttcgacccttacgactccattcgcatcattttcattcagcgcaactgcctcttttgaggttcaaagtccgtcaagaatagaggtccaatttaaggaggggagctttcagcctccggtaatatcatcatctgtggatctacctcaacaaattgatatatttgggcagaagatcagcctggggccagtccagcaggcactgaatccattgcagcaagcatttgctagcattgcagggtccatttctgggcagccacccctcaaggtaccgattcccggcaacaacagagctcgatcctggctcttgactacctacctggacaaagacttaaggatctcgagaggtgatggaggcttgtttattcttgcgaaagaggggagccctttgctagatctattgtaaatctggtgctattattttttaatctttgtagtatttggcaatttgtctaccaatgaattgcagactggggccaatccagcagg

SEQ ID NO: 9009 - DNA, 744 bp, Sorghum bicolor
  unsure (1)..(744): unsure at all n locations
  Clone ID: SORBI-28MAY03-CLUS72087_1
cctgtttttgataaacttgaagctgaactggcaaaagcaatgctttctcttcctgcaagcaaggggtttgagattggcagtgggtttgctggtacggactttactggaagtgagcataatgatgagttctatatggatgaggctggaaatgtgaggacacgaactaatcgctcaggcggtgttcagggagggatatcgaatggtgaaattatttacttcaaagtggcttttaagccaacagcaactatcggaaagaaacaaaatactgtgtcaagggagcatgaggatgtggaacttttggcaagggggcgccatgacccgtgtgttgtccctcgagctgttcctatggtggaatccatggctgcgctggtccttatggaccagctcatggcgcatattgctcagtgtgagatgtttccgctgaaccttgccctacaagagcccattggctctgctagcagtgcatctgaactggaaccaaacctatcataatgtctgtcgtggagcatggccctctagttttccttgtatcgaaattctgggctttgctaagcagtttgcagttttgaaccagcataaaccctcgatcattgtatctagatattataaagtgaatgaatatatcgagactgaaatgcattaatgtttttgtgatgtttagacatttattataacagatatttagccatttcttttttggtgagaggacngcatgatgtcgtttgagcaataaagttctttttt

SEQ ID NO: 9010 - DNA, 692 bp, Sorghum bicolor
  Clone ID: SORBI-28MAY03-CLUS72167_1
aaaaaaaaatccctcgtgctctccgtctctcccgatgtcggcgtcttcctctcccacggtctctcgcgatgcacctcctcccgcgacccgctctcccaccgctgcttcctccctctccccttccctcgacatggtggccctgtgctcctgccgccccttcctccctctccatctcccccgacgtggtagcctggaggccaagccccagtggtaccgcctgaccgtggtgcgtccttgcggcgcgacggtgtcctcgggtggcggcgtccagtgtgccctgccggcggccgtccctagccacggcacggcgtgagcagggccctctgctggctggcggcgcaggtgctccctgaggcggactcctcgaaaccctaggtttctgtactcgcggacacgggtgcccggtggcgggctcggccgcggtagtcccgtcggtaagcacgaaagccccagcacgggcagtcttctgtcgcgaccgttcggtgacgcccgtgcttgtcaccttcgattttggaacatcgacgtcggccgcgtacccttcgagatgcaaaatggccaggctcccaccagtgacctcactccagatgcaatggcagcagggctcccgtctcaccataccacgaaggctcgttgcagcaacagcctgtgtgcattaccggcctttggttctatagcaactcccataaaacata

SEQ ID NO: 9011 - DNA, 1267 bp, Sorghum bicolor
  Clone ID: SORBI-28MAY03-CLUS7060_1
gcacgagggttgttgtgctctcgatggcattaactccgttgctcaatgaagttggaagaagagtagcagggatcattgatgaaagatctgaagaaaaagaaaagcctgctgagatggtgaattatggtgccactgaacctgttgtaattcttggttttggagagatgggacaggtccttgctaattttttatctgcaccattgtcatttggaattgagaaagacacagaaggatggccatatatcgcatttgatctaaatcctgctgttgtaaagtcagctagaaaatcaggatttcgtgtgctatacggagatggttcacgcccttcagttctgcaatctgctggcataacgtttccaaaagctatcatggttatgtatactggaaaggaaaaaacaattgagtctgtaaacagattgcggcaagctttcactgcggttccaatatacgctagagctaaagacctctcgcatttgttagatcttaagaaagcaggtgcaacagacgttgtcctggaaaatgctgagactagcttgcagctaggttcgatacttttgaaaggactgggcgtcatgtctgatgatgtatccttcttgagtaagcttgtgagagactcaatggagctgcaagctcaggaagcactaaaagacattggggaccaagatgttgatatcatgaagcctcttcaggtaagagtttcagatttagtggatagcaatggtaacagttcaagaatggtagcccaggagcaggcgttaagtctaagcaggcgcccagatgtaaaggcaataaaaccggcagtgacaaacaggatacctgatatgaaggtggaaaatgaaaatccaggatatgactttgacagagtagaatctgaagatggtgtggcatactgtctattggaatctgatgatggaagcgatgaagcctccagtacaagcaaggaaatgattgatcaatctgcttgatgcaagctcctataggtttcttgaagcacttgtagagactgcaatactgcaaatctaaagactgaaaatactgcgcttgagctgcgcacccgtacagcataaagccatgcagcaaccataaacagttgaagatggagaaactttcagctgacaaattttccaacgcagctgattgcatggatttggtagcatccacttgtaattagcaatatttcagaatatagaatagcattttttcacagcacagattatattgattgaagccacaatgtaataaacttccattgataggtatattctgt

SEQ ID NO: 9012 - DNA, 654 bp, Sorghum bicolor
  Clone ID: SORBI-28MAY03-CLUS70618_1
gcctactggagcctctccatcgaccggggaagtcacgcgcgttcgggtcagtgagaaaaatcgccccgcagcccgcatttccccagccagcaggcagcagccttggtgagacctcgcgttgtaccgtacgtacgtgacatcgccggaaaccagcgtgccgcccaggacgatggcgccgcgccagccgctgctccccagcttcctctacgcggcgtcgtcgcccggcggcagggatgcgcggcctccggtggtggtggcgagggcgccgagcgagccgccgttcggcaagatcgagatgttctcgcccgcctactacgcggcgggcgccatcggcggggccgcggcctgcgggttcacgcacgccgccgtcacgccgctcgacgtcatcaagtgcaacatccagatcgaccctgccaagtacaagagcacctcgtcggcgttcggcgtggtgatgagggagcagggcctccggggcttcttcagggggtgggcgccgacgttcgtgggctacagcgcgcagggcgcgttcaagtacggcctctacgagttcttcaagaagaagtacgccgacatggccggacccgagtacgccgcccagtacaagaccgtcatctacctcgcgggatcggccaccgccgaggtcttcgccgacgt

SEQ ID NO: 9013 - DNA, 824 bp, Sorghum bicolor
  Clone ID: SORBI-28MAY03-CLUS707_1
gcacgagggagcgacacgcgactgcttttctgcttcatcttcagttggtagctagtagcttacacgttcacgcatcactttccgggctgtcgtggtggtttagcgcagctgagcagagcggggaaggaagcaaggaagcgaggaagaagatgacctccgtgagcgcgaggcccgttggcgtggggtactactccggcggggcgaggtgccaccagcgacggtcgcgggtgcgggtgtcggccgcgcccgcgcccgcgaggtcggcgacgatgtacgaggtgctggccgtcgaggagacggcggggcccgacgagatcaaggcggcgtaccggcgcgccgcgcggcggtggcacccggacgcgtgccccggcggcgccgaccgcttcatggcggcgcgggaggcctacgaggtgctgtccgaccccgagcgcaggcgcggctacgacgtccagctccgctgcggcggcggcgccgggttcgccgactgggaggcgcagctggccgggctgcagtggcgcgcggcggagcggcgcgggcgcgccggcggggagacttggggcagcaggatgcgccgggctgccgcgcagccgtcgtcacggtagcggcgtcgccggtggctgacgactggctggcccttgatagctgatagtactaagtactttttttcttcttttccctttcctcttcgacaatcgaatggttcgagaagctgtaattgcgctgttctacagcgttttcacctgccaatcgccaagtcgccatcctcgtaccactgtttgtggaagcagttttcagtgtacatgctgggcattgcttatctaaaa

SEQ ID NO: 9014 - DNA, 746 bp, Sorghum bicolor
  Clone ID: SORBI-28MAY03-CLUS7072_1
gccggcctggccgggaaaaaaaaaaatcacctctcttcgcggaaccaattgcgtattttcttctcctgcctttagctcccccgttcttccagaactttctcgagacctgaatccaccctgacccagcggtccccatggcctccggcgaaggtgtagttgatcagctgtccggggcggctggcggcgaggcggaggccaagatggagacggagggggagcgggaggggccggtgctgtacctcgacctgacgagctaccagctgcacgatctgagcgaggtggagatcccgcccacgctggaggaggtcgacctcaccgccaaccgcctctcttccgtcgacccacgcatcggccaactcccccgtctccgcaagctctccttccgccagaacctcctggaagacgacgccgtcgcgccgctctcgtcctgggagactatcgccggattgcaggagttggtccttagagataacaaacttacaaggattcctgatgctggcatattcaagggtcttctggtgtttgatgtatctttcaatgagatatcttccttgactggtatgtccaaggtttccagcaaattgaaggaactttatgtttcaaagaatgaagttgcaaagatggaagagcttgagcatttacatgcgctggaaattcttgaacttggtagcaacaggttacgggtaatggaaaatcttgaaacattgacaaatctgcaagaactgtggttgggaagaaatcgaatt

SEQ ID NO: 9015 - DNA, 697 bp, Sorghum bicolor
  Clone ID: SORBI-28MAY03-CLUS70750_1
acgactaccgcaggatgacccgcgccactcacccgccccagcccccccccccgccgcccgcttcccctcgcggcagccaccccccctcccccccccgcctcccccagccggcggccgtcctccgggcggagcaagaccgggtcgccccaatggagctggcgcacccattgaacaggcacctagaggggaactctcgctgagtcgtcatcaacaatgcggcccatgcagtccctattgccgacccccaggaagcgtgccggagcgccagagagttcttcgaggagccggtcgctggagctgcaaccgtggtccacaaggtgtagctcccgccaatggcggcccggtctccgctaggcatccgccgccggctgacccccccacggccgagacgtggacatctctcccccctcgtgcgatgcactaccggcattggcctagccatccctgacccccgctgtaacggcaaccagagcagaccacagtggctccaatccgagtcacatccctgtgttcttcccgttctcgcacggccgtcttttgcatcccctcatgcccgtggcaggactctggcaaatcgttgagtaacgtggcgcacaaactttggattattgatgcgcggaagcactctgccctcccgcagttgacccggccgccgccgacctgctcgggccgccccgaccgggtgttcccaatggag

SEQ ID NO: 9016 - DNA, 643 bp, Sorghum bicolor
  Clone ID: SORBI-28MAY03-CLUS72380_1
agagaagagaggcaggcaaggagcccactgcccacctggtcctggttccaccacaccgcagctagcggcaatgtcgactcgccggcagcaccgccgcggcttcccgctggtcccgctcctcctctccctcctggcggccgccgcgtacggccgcctcatctccgacggcgccccgtcagcaccgctcctctcggtgatccgcctctcgggctccccgccggccgcggccgcggggaaggcggccgaggagaagtgcgagcagtcctacggtttcctaccctgcaccaccaccgtgctcgggaatctcttcctggtgctgacctacgggttcctcatgtacaaggcggccacgtacctgtccacggggagcgagctgctgctcgagatcatggggcccggcctcgtcggcggcctcctcctccctatcctcggcgccctccccgacgcgctcctcgtcctcgtatctggcctctccgggagtaaagaggaggcacagagtcaggtactgatcggaatggggctgcttgctggttccaccgtcttcctcctcaccctgctttggggaacctgtgtcgttgttggcaagtgtgaccttgggccaaaccgtgaggcagttgatgtaacagacaccaagggcttcagc

SEQ ID NO: 9017 - DNA, 799 bp, Sorghum bicolor
  Clone ID: SORBI-28MAY03-CLUS7251_1
attcccccaaacacattgccaccgccgcctggcctcccctcacctcgccccctccgccacgccgcgagccgcctccccagtccccctagggttctcgccggagccggggggcggcgagggagaggagggagggggatggggcgcggggcgtccgcggcggcgtacacggccgccgcgctggcgtccgcggcggcggcgacggtggtggcgctgcggctcgttcaccggcacctactccactacgccgagcccacgcaccagcgcttcatcgtccgcatcatcctcatggtcccggtatatgcagtgatgtcatttctttccctcgtcttaccacatcaagcaatctacttcaattctattcgagaaatctatgatgcttgggtcatctacaatttcttttcactttgcttggcatgggttggaggtcctggtactgtggtggtaagtttgaatgggcaatctttgaaaccctcatggttcctgatgacttgctgtttaccagctattcctctagatgggcgttttatacggagatgtaaacaaggctgtctgcagtttgtgatcctaaaaccaatcttggttgttatcaccttcatactttacgcaaaaggaaaatacgaagatggaaacttcagtgtcaaccagtcctatctatacattactatcatctatacgatctcatactctatggcattgtttgctcttgcactattctatgcggcatgcagagatctacttcagccatataaccctgtgccgaaattcatcataatcaaatcagttgtgtttctaacgtatt

SEQ ID NO: 9018 - DNA, 686 bp, Sorghum bicolor
  Clone ID: SORBI-28MAY03-CLUS72524_1
aatgctctccacctatctctcccacctctctccatccccctcctcggtcatttttcttaccctttctcccaacgctctgctctctctctagaggctcatgaactgaaaaatttcgtgttgtttgtgttgagatttgagatgggaaagaaggcccgaatccttctcgtgccctctgggattcatggcaaatatatgtgattttgtcttcactgtgttctcgtgatttttcttttttgttcttgtccatgatttgattttccaggagtttggattgattgcaagtgatgatctttgggggatagttttgtgcctagatgaatttcatcttaccaaattttgggttcgattcatggagctttggctaagttctcgttgattttgtggccgtcgggttattttgttcttcccctctgtgttctgctcgtgatccttctctgcgtgctgatggggagtggcagtagtgctatcagcgccggtgctctggcacctcgcgtgctcagttgagcggcatctacacctgagcctcggtgcccgtgtctctagcagagtccagaccgtcagtttctgtgtcgtgtttttcttcagttttgttcttctgttcttcctttatttcttctctgcgtctagctaagttgagctccaggttccgagcactgtctcttttgggtgccgtcgtgtgggtgagc

SEQ ID NO: 9019 - DNA, 1016 bp, Sorghum bicolor
  Clone ID: SORBI-28MAY03-CLUS7257_1
gctcgccgctgggcctcggcccgcaggcggcacctccacctggacccggcccccctcgtcagacacccaagtacccacgcggcacttccacaaggacaaggtggatagcgagcccaccgcacgtctcactctctctctctctccgacgaccggtggactcccgccgccgtcagcgccgccgtcgccgccctgcgctaggtgccgaggccttcgtcggtatcttcgccggcgacgggcactcaccaggtactcagccatggtttttcttgaggcagagatgtcatggaatgtgctgatctcacctagccagctggaccgcaagggcctcctgctccgcaaggctatcattgtgcgtcttctggaggatgtcacaaacaggagggcttccaaagagcatggctactacgttgccgttagtcagctgaaggcgatatctgaagggaaagtgcgtgagctaactggagatgtactgttcccagtctcatttacctgcatcacactgaagcctatgaagggtgaggtcatggttggccacgtggacaggatcctcaagcatggtgtgttcctgaaatctggacccgtggagagcattttcctggctgagaaatcgatgagcgactacaagtacataggtggggagaatgcgatgttcatgaacgaccactcaaagctggagaaggacactgccgtgcgcttcaaggtactggggttccgctggatggaggctgaccgccagttccagctccttgctacgattgctggtgacttccttgggccactgtgaactgcttccacaggttaaatgggttccaatgtacattgctcgttagatggtggatggatgggtggatctgatgtgtggaattaaactttgctgccagtagtttgctctgtagtgcctgagacatggtaggtcttttagatgctgataccggtgacatttggctctggtctgaatgtatcagtgtactttgatgaacagtggttgtccatggatgtcccctttctatgcttgc

SEQ ID NO: 9020 - DNA, 700 bp, Sorghum bicolor
  Clone ID: SORBI-28MAY03-CLUS7258_1
ataatccagagtttgaggatgatccagatctttatgtgctgaagcccacgcgtccgattggaattgaagtttggcaggtaaaagctggttcagttttcgacaacattctgatttgtgatgaccctgagtatgcaagaaatgttgttgaggaaacttggggtgctaatagggaggctgaaaaagaggcttttgaagaagctgaaaaggagaggaaagctagggaggatagggaaggtcaaaaggcaaaggatgatggtgggcgccgaaggcctcgtaaaaaacactacagagatcactgggatgactaccatgatgagctatgaagtccccaaagtattgcattcctcaaagcataagctggaagttgctttggacattgtggatacttttcaataataattgattcgcgaggcccgaacaacctgaagtgtttcttgctatgtgccaaaaaaataatcaactacaggattgagatgtaacggtctaaaacacaaaactgaagatcttttctgcttcctgtgcaacagcaggagattccagcgaaaacttggctctggcactgaaatagggtggacgaggttctgttcgttatgtctgtaacacggtgctggccatgtgctagctttgtaatctcaaaacattgtctttgcctcaataatgtaagttggtcatacgatgatcccaaaatttactgcacacc

SEQ ID NO: 9021 - DNA, 751 bp, Sorghum bicolor
  unsure (1)..(751): unsure at all n locations
  Clone ID: SORBI-28MAY03-CLUS72587_1
aagaatatgtttgcgttcagatagtctctccatggaggctgggggcagaggtgctgacaagaaaaatcttaatgatcagagagacttgttccaacgaatctcagattttattaagagtggtgagtgccctgaagaatcacttaggatttcaggcaagaatggcattttaagagttacaacatggcgtgaatcaatacagttgaactatatgaggcggtttcttgggcgaggattcctgaagcattcacaggataatgatttgctgcatgagatctttgacatcaaaattgatcgtactgaaaacatgtcaaccactaaaaagaaaatgtttagatccgaagaagagaaaggaagagctctgaagttgaataaagagcgtcgtctagctcaggagaggaaacagaatatcttgaacgagcaatatggatagaacctacccagaataccagagtttttgtatagtcgaactgttaccagatagcgagtgctgtgtatatgacggtatcgatgcaatgtcacaatggtgaggtgtattgcccggtattgatgggtaagtagaatacagtttcataccgaggaacatgtacagcgtcatgtttgaaattgcttgctccaaacattgagtattatagaaaggatcatgtccgttgtgctgtatagaattttctctgcttgtgcaaaggagatcttgagtttagttaatcacaattgtacagatccatccnggcttgtggatgttcgtatagcgtgg

SEQ ID NO: 9022 - DNA, 1004 bp, Sorghum bicolor
  unsure (1)..(1004): unsure at all n locations
  Clone ID: SORBI-28MAY03-CLUS71576_1
aaaacaggaggacaagcaaagctaccggccagacagcagctatagccctaaagattgacctgacctgacctgatgagatgagattgcataataagtaagggaatttatttgaaagatgcatggtggctgctggatcctagctagctagctagctagagtagtatttctattgtgatgtgctctcaagccaagcatgatatgggtggaggagaattcaggagctctttgctgcagcagatggtgtggagccgtcggggcgggccggcggcctgcagccagctgctgcggtgtttgctgcctccccccgcggtcgagcccgagctgccgggccctctcggggcctcctccttggtgcccccctggtcgtctcctgcttccatgctccgccccctgcgcctccttccatgctcctctggtggcctgcctctgcctctgccgccagccatgctgaacgacagctctgctacttctgatctgcatgatgggcgggaaagcaacatgccggagtcatggagccagctgctgcttgggggattagtcggagatcatgagagatacaacgctgccacagctttactgtcaaaaggattagaggaggggcctgcagcttacaatttctatgggcatgggcatggtggtgacgagatccagacgtcggggaccaacagtaagtctcatcaggtgagccagacgctcttggcgtcgtcctctccaaggtcctgcatcaccacaagcctcggcagcaacatgttggacttctcaaacaccaccgtcccggcaccagagctgaagaatcatcactccgataactcttctgagggtaacagcgctgcaagtggttcggctccaaagaaggctagggttcagacctcttcttcagcacagtctactctaaaggtgagaaaggagaggcttgnggatagaatcacagcacttcaccagatagtatccccatttggcaagactgacactgcctccgtcctacaggggactataggctatat

SEQ ID NO: 9023 - DNA, 888 bp, Sorghum bicolor
  Clone ID: SORBI-28MAY03-CLUS71606_1
gcacgaggggccgtggcggcggcgcgcgcctacgacacggccgtgttctaccttcgcggccggtcggcgcggctcaacttccccgacgagatcccctcgctgtcgctgtcggagggcgagcgcggggacggggagaccgaccccgccgccgatggtggcggcgcaggcacgctgtccgcggcgtccatccggaagaaggccatcgaggtggggtcccgcgtggacgcgctccagaccggcatgatggtgcccccgccgcaccaccgcgagcgccagaggcaccaccaccaccaccaccaccaccaccacctgccgcagctgcgtgtccacgcgcacgcggaggaggagcaccaccagcaggagcagaagccgtcgccgcagcggccagcgtggagcgggcgcgtcaagaacccggatctaaaccgggcgccgagccccgagagctccgacgccgagtgacaagcgagcgagccagcgacaccgcaaggctcaacgtcaacgacgacgtccgttatcggttgttcccattcccgcgacgacgcccagcactacagcatatgccgctgtcgtccccgtctccacgtacgtacgacgatcccagctgacccggccgcctgcctacccgtccatctccatgtccgtcctcggcgactggatggatggtcgctgggtgggcggcgcggcgcggcgagggttttcgatacgttgtttgtggataagcacgaggggggagggcaggcacgcagctggggcgcgggtgggcggcgtgggcgggcgggcgggcgggcagcaggcggagacggaggaggcggccgccacaagtggcggtctttccaaatgtcaaaaaggacagctgtaacagtgatgagaaaaacaagtcatcatcct

SEQ ID NO: 9024 - DNA, 466 bp, Sorghum bicolor
  Clone ID: SORBI-28MAY03-CLUS71652_1
cctccccccggcgatcctcgacctaatgcccgcgtgcccgggtcttgccaccgcggccgcgggcctcgtcgccgacgcggaccccgaccaggccgcgaggctgttcggcgtctccatcgggctgaagcggatgcgcgacgaggacgacaccggcgacgaacaggcggaccacggcgccggaggggaggtgaagacggaggcgtcggatccgcaacaacagcagcatcctagcagtagcaacgagccatcgccggaccagcacccatggcccatataccggcccacgcccgtgtaccattctatgcggccctgcaatgggccggaccagggtgccgggtccgaccaagacgggtccaactccaggtgagtgggcccgccccaccttgtagaagcttctagtaccaattaatcgattgccatattatatgggcaaataattatcatcttagaaacagaataaataata

SEQ ID NO: 9025 - DNA, 624 bp, Sorghum bicolor
  unsure (1)..(624): unsure at all n locations
  Clone ID: SORBI-28MAY03-CLUS71741_1
aacaagcttatcagcattcgatcgctccagctagctgcagagccttgtgttgtgttctcttctgctcgatcgctcggcagtcagcagcacaacactcttgctactatataattcgtccaggaataatcagttcaaaccaatggtgcaggagagggcagcatggggcgccagcgacggcggcggcaacctggtgcaggatgccgtcgactacaggggctgcccggcggacaagtccagcacgggcggctgggtggcggcggcgctcgccctcgggatcgagctgtgcgagcgcctctccaccatgggcatcgccgtcaacctggtcacctacctcacgggcaccatgcacctgcccagcgccgctgctgccaacgtggtcaccgacttcatgggcacctccttcctcctctgcttccttggtggattccttgccgactccttccttggacgatacctcaccatcgccatcttcgccctcgtccaagccatcggcacggggctgctggcagtgtccacggaggtgaggcagctacngccgccgccgtgcggatccggcgcggctgggtcgtgcgagcaggccactgggctccagatgggcgtcctgtacgtgtgtctctacctcat

SEQ ID NO: 9026 - DNA, 1675 bp, Sorghum bicolor
  Clone ID: SORBI-28MAY03-CLUS71753_1
gtcttttatttaattcttttaaccttgaataacaaggttaatctaatatttttttatacctagaagtaggtattagtttggtttctttgactctttttttagaactcatctagggtaggcaagaaaatagacaatatactgcgatagatagcaattaggttatgtttctatagatgctacttccagagctttgattatctagtgtgcatggtcttgataattaagtgaacccaaaacatcctgctatgttacatgctcatatgcttttggtattttattctaaactttaagttccctctgattggaaactgcatgaatccatggagcttagaaaccagcaaagggtatatgctgatttgttattcttactatcatataatatggcaattctttcccttccaagctgaagataaatggcggtcttaactctacttacgatcggaatcaatttggtgtcagcgattagggatggttttgctgccttgaagtatatttgtgattactgcatttctattatatatctgcatagttagtaactttcaaagttttttgtcgtgtctgcatagacaccatttaactagtttgctcatggagtgtctcatgtaatataatgctcttaccttctgctaatagaactgtgatgtcaatatgctgtattgccgttggttctattttgtaatgatgaagtgcttccttgctttggtgtggcgatgatcatatcgagtcacctgattgcaaacttgagtactgttaaatgaatttcacttaattgtgcttctttggttccaggcatattctcctgatgatgactgcatttgcttcagctgcctttggttatctttgcttggtagtcgtttgtatttttttttcttgtttacaactttacattagggggtagtgacactgcccgtgccggtcccaagcccggataaaagtggagggggcacggttgaatggttaacagtgaagtctcagaattctgagttgtctacagtatatgggtaggctctggcatcaagagaataaatagtagtatatactgtagattcaacttagcctttgattgtgtcgcctgcagagttctagctgagagatgtaaaagtggcacaatttgaaatggatgtaatttattcaatgtttgcagcttttgaatttgccagcagacacagacctggggtatattcaaatgaaaagaggatctctgttgtagaatgaagatattttgctaaatttcctatgggccaatggtctgaaatgagaccgctgacacacacacaagtccgccaacagcgagccgctccctctgaataaaatgagattgtaaattggaaatttgatgactaggttacgctccggatctgtcggtgcctcagtcggttgctgccgacttcggggccccttccggttttgctgtgtggccggacttcccttccggtcaaggtgaaccctttgataatccttttgatggtcgttgttactttactcttgtggaggagagtgatgatgaggaatctgatgtgtgaccttgggcaagtaaaacttgttgtgtgatctatggtttatgtaataataagttccgaaccttttatgtaccaaatacttatggtttgtaacctttgaacttaagttgcaatctttgttatgtaaactttccgcttttactctgatttatctt

SEQ ID NO: 9027 - DNA, 771 bp, Sorghum bicolor
  Clone ID: SORBI-28MAY03-CLUS73006_1
aaaaatcgcctccacctcaccagagaaatcctcctgctcctcctccctagtccctagccaaatttttttctatcaaaccctcttcccccatctcagatccctctcccgtcccagctcgatcctgcccgatggccgccggatcgtacgccgccgccgcccgacgctgaccgaccaggacaaccacctccggcgacccccccgagcacccacgagatggtcgcggaggcggcgccgtcctcctcgtcggcgatctggtcgcgccgccgcgacgagatcaccttcgaccgcctccacaagttttggagtgccctgtcacctcgtgcacgacacgagctgctaagacttgataaacagacccttattgagcatgctcgcaagaatctgtactgttcaaggtgtaatgggctgcttttggaaagtttcacacaaatagtcatgtatgggaagtcactgcttcatgaaggttcatgtgagccaaggattcaggaagttgaagcagaagaagttcaggacccttcagttcatccttggggaggcctttcgacaacaaaggatggcatcctaactcttcttgattgcttcataaatgcaaaatctcttcatgtgatccagaatgtatttgacaatgcacgtgcgagagaacgtgaacgtgagatgctttaccctgatgcatgtggtggcggtggcagaggatggattagcccagtgatacctaactatggcaggggccatgggacacgggatacttgtgctttgcatactgcacgcctt

SEQ ID NO: 9028 - DNA, 818 bp, Sorghum bicolor
  Clone ID: SORBI-28MAY03-CLUS73031_1
acatgcccaagaagggttctgtctccccggtgcctttatggtggccctggtcctttgtgtcagtcggagcttctctccttcgttgaccgggtgcctcgttggttcccctggaaagaactagccattatgcctgtgcagtggcatgctttagccctgggtttgtttgcatcgataatagcaccgtttggaggattttttgcgagtggcttcaagagggcgttcaaaataaaggattttggtgacagcatacctgggcatggtggaattactgacagaatggattgtcaaatggttatggcagtgtttgcatacatataccaccaatcgttcattgcacctcagaacttttctgttgagataatcttggatcagattataagaaaccttgcatatgatgagcaaaaatacctgtacgagcgacttggggagatcttccatgagaggcaattgacgcaaagctgactgttagcctgcttatgaaatgcatgttatgttgtgtatttaaagcctttgggtcattctgtagctctagttcgtgtatagcatcatggcatattggcatgactgtaccgtgatacagcggagtacttgttcaaaccactgtatagaatggtagaatggagagaatacatgggttttagccttttacaggtgcctccactgacgctgcctgattcactccccttgtcatcatttctgcactctttgtaaaaggggggctggaaagttttattctttcttatcacttcgtggtgctggcctcagattaaatattcgagtattcacagaatataagatgaagcagggctagttcttgt

SEQ ID NO: 9029 - DNA, 770 bp, Sorghum bicolor
  Clone ID: SORBI-28MAY03-CLUS7313_1
gcacgaggcaccaaaaaaaaaaaaacgcattccgcagtccgcacacgcgcggctggagggctgcggctgcgtggcggaggcgacggccgacggcgttgcggacgccgtgggtgggtgtagaggccgagagggagacgcggggaagctagctgctagcgtagccgggcgcggcgggcgtgggggctcgcgctgcgctgtcgctccatgtcggccaacggcgagagcggcggggatccggcggcggcgcgccgccggtgggatctcaccaacaaggggcccgagagcactccaatgttgaaagaggctgtggaaatgtctacagatgaagaatcagatggtgttgttatatgccatctgaatggtaacaccgatggatgcgacgaaaccattagtggtagtcgtgatgatgatagcccagaaggccaggaaactaattccattaaggaccctgatgtacaaggtgacacacaggaagacaagtgtgtaaatcaagattcactgaagttgattgatcaagagaagtctgctccccccaagtccccagcaaagtctgcgactgccagttctggatcggagaggcctaaacgtgttgttccccaaccattctctctttctacgcaaagaaggtcatcgggagtaaatggtggtgtgaccaatccatcggcaaataaggataaatctggtgataaaagtagcatatctccagcaagcatgacaaagaagagtacgccggtggcaccttagaagactttgcagcctgagcaggcatt

SEQ ID NO: 9030 - DNA, 616 bp, Sorghum bicolor
  Clone ID: SORBI-28MAY03-CLUS73611_1
atatccactttctcctcctcctcccgcctgctccgtcccgctcccccgcctcgttcaccgacggaaacgagaggccgccgcacgcgaccgcgacccgaccaagcccaatgtcggaaggcccggcgcggagctccacggcggagtcgtcctcctccgcggcgtcctcgtcggggctcgacttcgaggacaccgcgctcgccctcacgctccgcctcccgggctccgactccgacgtccgcaagcgcgccgcctccacctccaccccagtcgccggccgctgctccccgcgggcctctgcctccaacgaggcaccgcccgcccccaaggcgcaggtggtggggtggccgccggtgagccggaaccggcggaacgccgcgctccccagcagggggaagttcgtcaaggtggccgtggccggcgcgccgtaccagcgcaaggtggacctcgaggcctacgcgggctacgaccagctgctcgccgcgctccaggacaagttcacctcccacttcaccgtccgccgtcgggtggggaacgacgagatggcgctcgtcgacgtcgtcagcggggcagagtacgtgcccacgtacgaggacaaggacggcgactggatgctcgt

SEQ ID NO: 9031 - DNA, 965 bp, Sorghum bicolor
  Clone ID: SORBI-28MAY03-CLUS73247_1
tccggcctctcttggttttggtgcgggcgtccgtgacaggcgggcttgcttccccttgttcctgctcggctacggcctcaatgcaacatgtaatagcagtttgtaatgtacaagggtttattggtattgctttattgagacatggcagcacacccgctaaacgctgacacaggagattatgggtgtcgtttctttagacgccacacagcatttgaaatgtgtccctcacccatgagatgatgggggtggcttttgatagggcatcggagcaatgtttactggagcaccaggtactacggctcctggaaccggggcatgcatgccataggccagatgaggtggagcagaaacaggtagtgtaacaggagttccaacagctgagacaagagggccaccaactggctgtccaattgttgtgccataagcatcgacgcctggaggtgtattcgctggctgtggggattgcttagatggtttcccaggatttgcagcctgaccatttgtttgacctgtgattggaccctgtgccgttgatgcatctccattgttcacactggtgatgtcatgtatacttgatcgccgcctctctctgttcattgagttcagacggataaagtacttctgtgcatgactagctacttgagttggagtccttgagatcacaaagttacgtgagatgctccgccagtcacctttgccatacttttcaagtccaaggaggaacaatctgtgctcgtcctctgtccaggcgatgcccttcctgcgctcctgctcggccgacttcgccgaccccttgtccccgtgggtccctcctcccccacctcccttcttcccgccgccgccgccgccacccccttcctcggcggcgccgtcagccgcgtacgtcggaagcggcacgcggcccgactcgatgccgtcgacgtcctccaccagcagctcgtagtgccgcctgacctcctccggcg

SEQ ID NO: 9032 - DNA, 726 bp, Sorghum bicolor
  Clone ID: SORBI-28MAY03-CLUS72190_1
cggcgacgccgccgctcccggcgaccccccgccgcggctccacttcaccgttctttctccctcaccaacccgccaaccaaaccttcatctccaatggccgcgcccgtgtcgcagccgccggtggccgccagggcgtccacgcggttcctcccgcgcgggataggcgcgctcccggagtccgcccccgcgtcgctccgcttctccgtcggccgccgccgccgcgccgctcgcctagaggtgaaggcatcgggaaatgtgttcgggaactacttccaggttgcaacctatggcgaatcccatggagggggtgttggttgtgttatcagtggctgcccacccagaattcctctctctgaggcagacatgcaaatagaactcgatagaagacgtccgggtcaaagtagaataacaaccccaagaaaggagactgatacatgcaaaattctatcagggacacatgatgggatgactactggcacaccaattcacgtctttgtcccgaacacagatcaaagaggcggtgattacagtgaaatggctaaggcgtacagaccatcccatgcagatgcaacctatgacttcaagtatggtgtcagagctgtgcagggaggcggaaggtcatcggccagagaaaccattggcagggtggctgcaggagctcttgcaaagaaaattctgaagctcaaatcaggagtggagatcttggcatttgtttctaaagtgcat

SEQ ID NO: 9033 - DNA, 996 bp, Sorghum bicolor
  Clone ID: SORBI-28MAY03-CLUS72264_1
ccgccatgtccaacatggggctcttcgaggccgagatgagcagcgactccttccagctcctcggcatggctgagatgggcatgatccctgccattttcgcccgcaggtcgaagtacgggacgccgacgttcagcatcctctccttcatgagcttccaggagatcatcgagttcctcaacttcctctacgggctcgggatgctggcagtgttcgcggccttcgtcaagctacgcttcaagaacccggacctgacgaggccgtaccggatccccgtcggcacgaccggggccgccgtcatgtgcgccccgcccgtcgtgctcatcaccaccgtcatgtgcctcgcgtcggccaggaccgtcctcatcaacgccgccgtggtcgtcgccggtgtcgcgctgtattatgtcgtggagcacgccaagaggcacgcttgggtcgagttcttggcgcccgtgcctccggctgacagctcccatggatcaaccacggcgcctgacgccgccgccgacctcgaggatgtccgcgccgggctgctctctgacgagtcggcagacgaagaaggaagcaaggttgagtgaagaatcgtacatttgccgttcggtgtacagtacagtaattccagtgctttcatggtgtttgctggacccaggccttgtttagttccgaaaactgaaaagttttcggaactgtagcactttcgtttttatttgacaaatgttatccaatcatggagtaactaggcttaaaagattcatctcgtgatttacagataaactgtgcaattagtttttattttcgtctatatttaatactccatgcatgtggcgtaagattcgatgtggcggggaatcttgaaaagattttgctttttggagtgaactatgttgggtattcttaacatcattactaaaagtagactaagttctctaaatctagtaacggtgccaaaaatgccaaacctatccctcacaccacttaagccaagttgtcatcccc

SEQ ID NO: 9034 - DNA, 875 bp, Sorghum bicolor
  Clone ID: SORBI-28MAY03-CLUS7227_1
cctcgggcgcttgtggcggaagtggtcttggggcgtgtgtctgccggagctgctacttgtgtcctgtcttgtctcgtgactttagtaggccggggttttgccaattccattccccaaaccttttcagggtgggtgggcggctccacctttttgccggggatttccccgccggtgggtccttccggtcggcctggggaaaggaaggcccctggggtggtggccggaatcgcccgggcgaaccggttggtcccggaggctcaggggagcgcgcggactctggcgcatctctcgggctcctccgctttcagtggacacgagcgctcgggcccttatttcagcaaattgtgcttaaagattctggagttgattgacaaagatggtgattcagacacttcagtgaaaattgctgctatttcttcgcttgaaacactagcaaaagaatatccctctgacaatcctgtttatagcaactgccttgcaacaatcattgatcaaattggctctgatgaggcagctgtgtcttctgcgttaattcatactgtgggctctctgataaatgtggttggatcaaaagcattaccacaactcccattaataatgaaaaatataatgctaatatcacatcaaatttcatgttgccctagtggaaattatgctcatggttccactagaactgccgctgaactttctaaccaagacatagctgtgctgctatctgcactgacaacaattgaggtgattgtggaaaagctgggtgaatttgttaatccatatttgaaggaaatacttgatctggtagtactgcatcctgaatgtagcactcaaatgcttcccaaattagatgcaaaagcagcacatgttcgagacctactgac

SEQ ID NO: 9035 - DNA, 1183 bp, Sorghum bicolor
  Clone ID: SORBI-28MAY03-CLUS72280_1
ttggcctctggatttcctatcgatttcttccacacctaccggcgcccgggaacgaccctgttccgatgctacggtcgccgccgctgccagtgccactacgcccttccgctgtccgcgcctccccgcttccgccccctagacctagagctgcaaaccctaacaccgagtcgacgacgacaacaactgccgccgcctcagcggacagagcggccaccatgggcgcggcggcgtggtggcggcgcgcgctgggtcagcggttcaacccaaccggcgtggccgcggtggcggccgtcgcggcgtccaagccgagcctggcgctgccgcacgtgtcggtgcaagacatcaggtggctagactgggctgaactccgccgcgccgggttccgcggcgtcgttttcgacaaggacaacacgctcaccaccccctacgcgcccgcgctgtggccgccactcgcggcaacgttcgaccaatgccgcgcgacgttcccgcccggtgcgctcgccatctacagcaactccgcagggttgacggagtatgatccggacgggctggatgcgagggcgattgaagcggccatcgagggggttcatgtgatcaggcatgatacaaagaaaccaggtggaccagctaatgaaatagagagttactttggttgttcagcctcagatcttgtgttggttggtgaccgttacttcactgatgtggtctatggaaacaggaatggctttttttacagtactgacagaccctttaaacattgctgatgaatcgtacattgtcaaaagggttaggaaactggaggcgtacatcatcaattattggtacaagaaagggtacaaaccaatggagcatcctttgctcccagatgcaagaagaatggtgaagtttgacccatatgacgactcagttacgaccagaatatagtgtaatgatatatgttgcacctgctcacagtagaaattccccggtttgccaaaaaaaaaaaaaaaaagaaatccaccggtttctttctccagtagagtgagatctgttgtttgtagctttgtagaagattacaagggagaaacatatggtgtgtagagatttgttgttttttctccctctcgagcagaatgcaatttagggaaatgtctgtcgtgtgcgtgaacattactttgtccttgttcattttgcatgaagaaaa

SEQ ID NO: 9036 - DNA, 1232 bp, Sorghum bicolor
  Clone ID: SORBI-28MAY03-CLUS7423_1
gcacgaggcaggtgtccgaaacggatcaccaaatccctccggcgtagccgagagatccgacccccgccgtgaacccgtgatcccatggccgccgcgacggcggcggcgcggcgggtcctctgcgcccgcgccgtcctcgccgcctgcctcggcgcggcgccgcgcggggcggacgcgctccgctcgctcggcgtcgggggcgacaaggcggccgacggggacacggccgtcgacctcgacgcctccaacttcaccgccttcctccaggcgtcgccggagtcgttcgcggtcgtcgagttcttcgcgcactggtgtcctgcttgcagaaactacaagcctcactatgagaaggttgcaaaaattttcaatggcccagatgctgcacacccagggactattgtgatggcacgggtggattgtgcatcaaaggtgaacgtggagctttgcaataaattctctgttgaccattatccttacctagtatggggtccaccaacaaaatttaatttggctcagtggaaaccaaagcaagagaatagtgaattagaattaattgatgatgcaagaacagcagatcggttacttaaatggataaataagaagatgggaagctcatttaatttagacgacaaaaagtacgagaatgaaagtatgctccccaaaaatgcttcagatcctgaacagattgttcgagcaatttatgatgttgaggaagctacagctcatgcattgcagataattttggagcataagatgatcaaaccagacactcgtgactcacttattaggtttttacaaattttggtggctcatcatccatcaaagaggtgtcgaagaggatctgctgagctacttattgactttgatgatcactggcatacaaacctctcaagtttgcaagacagttctacattgttgaaaagtgcaggagagaaaatatgtggaaatggggtgccacgtggatactggattttctgccgaggaagtaaaaaggaaacgagaggatttagctgtggtctatgggttttgctgcattcactaactgtccgaatcggagatggagagagccaaacaacatttacatcaatttgtgatttcatccacaatttcttcatctgtgaggaatgccgcacacacttctatgaaatgtgttcaagtgtatcagtccccttcaaatctgcccgtgaccttgctctctggctatggaccgcgcataacaaagttaatgagag

SEQ ID NO: 9037 - DNA, 1163 bp, Sorghum bicolor
  Clone ID: SORBI-28MAY03-CLUS74273_1
gcacgaggccggacctgacccacctccagtacttctacgagctggacctatccaacaacaacttctccggcgcgttcccggactccgtggtgccgctgggcgggctgctgttcctggacctccgcttcaaccggtacgcggggaccgtgccggcgccggtgttcgcgctcaccgtcgaggcgctgttcctcaacaacaacgggttcggcggccggatcccggacacgttcggcagcacgggcgcgcagtacctggtggtggccaacaaccagttcacgggtcccatcccgcggtccatctacaacacgtcggcgacgctgtcggaggtgctgttcctcaacaaccgcctgtccgggtgcctcccctacgaggtggggctggtggaggggctcgccgtgttcgacgccggcgggaacgagatcaccgggccgatcccgctgtcgttcggctgcctccgcgacgtcgaggagctcaacctggcgagcaaccagctgtacgggcaggtccccgacgtgctgtgcctgctggcgcggaacgggaagctcgggaacctctcgctgtcggagaacttcttccactcggtggggcaccactgcatggagctcgtgcggagcagggtgctggacgtgcgccgcaactgcatcctggggttccccgaccagcggcccccgctcgagtgcgcggcattctacgccgaccccaccaagcactgccccttcatcccgcacatcccctgcgatttgcctgggtacaagccgccgcatccgcatgccgccgccgaagacgcggcgccggcgcacggccatcctcaccaaggccaaggtggtgggaactgatccatgcgcgccgaaaggggtcgattcgtcgtctctttgcctttgtgatcgcatgatttgatcgcgtcgtgacgcgtgcgccgcatttgggggagaaaataagttccaccgctgctctcgttgtgttgtgtggtggtgtcgtgacagtggggttcaaaaaaaagtcaaataattaaccgccgtttaccaaagtcaagtgtacgtgtaccagttaggttgttcgtgaattcgtgaccggcgcgccgtcaaagtaaatactatatgtaacctgtccaattgtccatgctgtagtgctgactactgctgtcaatatcgtgggagtcgttg

SEQ ID NO: 9038 - DNA, 764 bp, Sorghum bicolor
  Clone ID: SORBI-28MAY03-CLUS74375_1
tggccacggagctcgcggtgacgaacggcgcgtcgtcgccgatggcactgacgtgcgccgtgcccaaccacctgcgggtgagcaccccggacgccacctacgccctggggctcctgggctccgactaccgcagcgtggagcccgcgctgtcggagttcagcatcatcccaccggactacggggccgtgcagcagtccgcagcagggacggcagcgcggcaccggtgggcgaacagaggcttggacatgatcctctcgggcgggcaggaccgtggcgcggcggacgagcccgacggcgaggaggacgacgactacaagcacatgacggatgtcatgtgccgtgtgtacagcaacgcgcccaaggaattcaccatcatcgacaggggcaggaggaactcggttcgcttgcacaggaaggggttcgaggagctgtacgtcttcagcccgggatcccagtaccagtggtacggcaaatatgcatacgtggtcgtagggcctgccatgctggagcctgtgatgctgggacctggagacacgtggcagggagctcagcacctgctcaaccccaatctctaggaatgctatgtgggagaactgatgaccctggacatgtcacatgttcgtgtacgtgtatccagatcagcagatgaggccaggcgagacgcaaaataattggaaatccaaataattagcgagtacagatgtgggaaatgctgtccatagtgaattcctgatgacagtgttcaatattagaattattggtcg

SEQ ID NO: 9039 - DNA, 767 bp, Sorghum bicolor
  Clone ID: SORBI-28MAY03-CLUS74376_1
caatcaagtttggaagtgcaagcttctttgacttcaaaaggctggttttcgacaatattacaatagttgatgcacatcgaggacttgggatgcagatccgggatggagggaatgtgagtgatgtcatgttttcaaacattaaaatgagcaccaggtactaccatcctttatggtggggcagagccgagccaatctacatcacaacttgcccaaggcacccagattcaaaagaaggcaccatttcagacataagattcatcaacatctcatcggtatcagaaaatggtatttttctggctggatcgaagcacgggctgctccgcaacctgaaattcaagaacatagaccttacctataagcggtggacaaactacacaggggggctctatgattacaggcctgggtgccagaagatggtgaagcacaagactggtggcatgatgctggagcatatctccggcctggagattgacaacgtgaggatgagatgggcaagaggaagcctgaagggctggaacgttaaccctatcctcttccgtccgtcaaccattgacaaactgtcttttcatgactggcagtcagtggatgttcagtaaatttaagtggcacaattgtactacgtgtgtatctatctgaataaaggggtgattctttttgtgaaatactgaaatgtgttaataagcaatcccaacagtgtttaagcttctgcaaatggtgtggtttgctataatgattataatgattctgaattcaaatgttcaatttcc

SEQ ID NO: 9040 - DNA, 730 bp, Sorghum bicolor
  Clone ID: SORBI-28MAY03-CLUS74543_1
cagatagcagctgaagcaataatgacctttatgtcaatcatacactctatagttgtacagcagagtcaggagcgccaactaaagaagaagtcagataacatggatagcaagttccagacccagttagagaaacacagtgaaaatgcaatgcaaaattcagcccagcctccaaataagaatcactattcagtatcaaagaatgaaacgaaactggatgcatttagaaagcaggttgaggaggagaaggccagatacctaacctctgtgagagtaagccgagccatgacactgaacaatctgcagacaagccttccaaatgtgttccatgctctggtgggcttctcaggaatgtgtgtgcaggcatttgaaggtatcagcagatgcagtgaagttgctgttattcactccggagcggcttcacctgctatttgctcgtgaccttggttcgatgactgtgattattcattgtaagtaggcaaagtataaactggttccacgtgaatacccttcgcttctaatttccagaacttgaatagttttcggcggattatgtgaagtcaatataggcataatagtcttgaatagatcacaaagtctcaatttgagaagagatggttacctctgaggatagtggtagaaatatgaagtatcataaaacatatgtggctttaaattctggaaaggattcatgcagactttaaattctcgtggtatgataattctacatctc

SEQ ID NO: 9041 - DNA, 345 bp, Sorghum bicolor
  unsure (1)..(345): unsure at all n locations
  Clone ID: SORBI-28MAY03-CLUS74605_1
cacaacacagcatccccaagaccaagacataccggtctcagctcgactagctcggcactagcttcatctagtagcttcttcgatccacgatgggtatgcaatgggagcccaagtttaattttggggacattggccaacaacatatgaacaacggtaacaccttcaacgtgggtggtaatcgtgagtacaagcgtcagcaagcggcggcggggcaggggcactatggtggtggcggcggtggtggtggtggaggaggaggaggatatggatacacatacggntanggatacggnggtcctccaacacatccttctcaaaagccatcgacttatggtggtggtggtg

SEQ ID NO: 9042 - DNA, 665 bp, Sorghum bicolor
  Clone ID: SORBI-28MAY03-CLUS72659_1
ctactggaggtgcacctgcttcctcctaaactatcccgtggaccccaccacccatcgagctctgcaggctccgccgccatggcgatcgtcgcactgttacagccctggagcttgctcggcttccttgcggcgctcatggcgctctggtgggcgtgccgcgtgctggagtcgaccctgatcgtcccgcggcggctcggccgcgccctgcagtcccagggcctccgtggcaacgcgtaccgcttccccttcggcgacctcaaggagctcgcgcgactggccatggctgctcgggccaagcccatgccgctctcccacgacatcacgccgcgcgtgaatcgcctctactacaacctcatcagggaacatggtaaaatttcggttacctggctcggtccgacaccgagggtgatcgtgaacgaccccaagctggtgagggagatcatggccaacaagcttggacacttccagaaacgcaagcacaccggcatcgtcaggcagttcgccaacgggctggtgaaccacgagggtcagaaatgggctgcgcaccgcaagatcatcaacccggcctttcacctcgagaagctcaagaaaatgttgcctgcgtttgctgcgtgctcaaacgagttgataactagatgggtgggctacgtggagtctgacggagc

SEQ ID NO: 9043 - DNA, 675 bp, Sorghum bicolor
  Clone ID: SORBI-28MAY03-CLUS72729_1
agagaggaagattatccgtacaatgggagggacagcacctgcaagtttgacaagtccaaaattgttgctcaagtgaacaatttcagtgttgtatctgttaatgaagaccaaattgctgctaatttggttaaacatggtccactcgcaattggtatcaatgcagtcttcatgcagacatacattggtggtgtgtcatgcccatacatttgtggaaggcatctggatcacggtgttcttttggtcggttatggatcggctggttatgctccaatccgcttcaaggaaaagccgtactggattataaagaactcctggggtgagaactggggtgagaacggatactacaagatttgtaggggtccacatgtgcaaaataagtgcggtgttgattccatggtctctactgtgactgccattcacagctctaagaaggaataggaacctattggtcctcttgtctgttgtctgtacataccactgcatttgatttgatcttacactagaactcttgtcattgagggctgcctatggtattatgtgaaattgttttcgatggctttactgtttgtttgggttggtgtattggggccatgggactagttatgtgttagcaatagtaatgtttgtaaaatatcaagtgtttgaacatttgctaaaagtatgctatagatcaaa

SEQ ID NO: 9044 - DNA, 871 bp, Sorghum bicolor
  Clone ID: SORBI-28MAY03-CLUS72767_1
acgccgctcccgctcccccgtggcactcggcgctcgccgcctccgccgccgctccccttcgccgccggcggcgcccaccaggccccctcggctagggtttggtactttggtctcggggactttgcgggcgatcgcaatggagggcggcggcgcggaacaagcacccgaggcggcggcggaggtgaaaaatccgaggtgcttcatggacgtcaccatcggcggcgagatggaggggaggatcgttgtagagctctacgcgtccgtggcaccgcggaccgcggggagcgtccgcgcgcgcggccccgggggggggcgcgtcggcgccgccagcgcctggccgcttcgctttgcgggctctggcttcctccgggccctgcacgagtttatggttcaagggggagacataactgctggagatggaacggggggagagtcaatttatgggtccaaatttgaggacgagaattttgttttaaagcatgagaggaaaggaatgctttcaatggctaattctggtcccaacacaaatggttctcagtttttcatcactaccacccggacacctcatttagatgggaaacatgttgtttttggtagagtgataaaagggatgggggtagttcgctctattgagcatgtcactgtcggagaatctgactgccccactcttgatgtcaaaattgttgattgtggggaacttcctgaaggtgctgatgatggagttgtaaactttttcaaagatggtgacacgtatccggattggcccaatgatcttgaagagaagcctgctgaggtttcatggtggatggatgctgtggagtctgctaaagcttatgggaatgacaatttcaagaaacaggactacaaagca

SEQ ID NO: 9045 - DNA, 1268 bp, Sorghum bicolor
  Clone ID: SORBI-28MAY03-CLUS72798_1
cgatgctccagttacttctaaacatccacctgtggtgtttaatgagcagaatacagtgaaagtctctaccgagcaaaagacacatattgagccaaagacacatactggtggtgttatcatcagtagctctattgttcccactgaaggcactgttgtaactgttggaagtataactgttggtgggatttcacttaaacctgtgaaccaggagcctgttaaatcaccagatggaacaaatagtatagaaagtagccgaccaagacctcagcaagcaagaaaatctggaaagcatcagcatgttcttcggcctatagagaaaccacatggtaatgatggtgttttgtgggcaccagttaagccaccattgcagaatgagcagtctgatggagccatgccaaatgcagcagtagctgacctcactcaaccgtcagggaaagccatcaatgatggggagaatgtgacaagaacaaagagggctgaaatggaaagatatgttcctaagcctatgtccaaagagctgcaacaacaaaatccaagtcatgataaggaagcaattgataagcccagtgctgctaaatcagatgctgcagctgaacccaagaaaactagcaaaggacacggaggcaaatataatccttcttggcgcaagaggaatccaaatgagtcagctttggtggcaccagattctgttgagcaagcagacagctcttatgaatcaaaggaggttcagaactgctccgatcagaatcagcctgttgaacttggcaagcaagatacacaggtaaaatccaatgcagatgctgctgctgagaatagctcagctccagctcaaacagttacactattggccggtggtgcgaaagaacatagtgcagctaacaggcaaaggcgacagcatgttaaggctcaaagaaatgaagcaagtagctactcaaatgagagcaaaggtagagagggcaagaatgatgttgtctcagcaacatcggtcatggattcaagctcatccaatcacaggaatgtgccaagatctgatgtgaaaggcagcggggtagtttctcattctagagcctggaagccaaaagccaattcccatcctcagaacagctcagatggcaagattgctgttgaagggccagtggagtcccatggaggtgggcttgagatcagcatgtccaaaggatctgatacaactacacatcaagacaccagcactaaaccgatgaaaaggagtgatggcgctgatgaggtctcacatagcaaacaggaga

SEQ ID NO: 9046 - DNA, 617 bp, Sorghum bicolor
  Clone ID: SORBI-28MAY03-CLUS72806_1
tggtggcgcggttggtgcgcagccccgtcgcgtacttgcggtcgcggaagctgaagaagtaccactcgttcgtgctcagcttcgcaacgtcagggagttcccacggctcgtgggtgtgcagatccacctccaccatggctgcaccggcgccggcgagccgctcgttggccacctttccgtgcaggtagtggcacaccagctcctcgtcgctggggtagaaccggaaccccggcggcagcgtcagctcgatgtccctcagccccatggctagctcctgctccagctactactacaccttatttcctgttatatatatatatatatatatatatagtatcttcaattccttctcctcctaacttaagtttgtatatctggacagcaatctgtatatattggagctcgaagaacgacgacgaactatatggatgagacaaatgaacctatatatgcaggctgcagcacgttgatctgaagaagagaagaaggggggagtgatgagagagagaggggacagatgagatcgaggagtaagaaggaattggctgcactgcacacatctactactactgctatatggttgatgttgcttgctgtagccggatgagtttgtgtgg

SEQ ID NO: 9047 - DNA, 729 bp, Sorghum bicolor
  Clone ID: SORBI-28MAY03-CLUS75065_1
aaaggcagaagcctctctcgctctcttcgtctctcccgatgcgacggcgtcactggcgacgccaccaacggtgccggcgacgcctccgcctccgcctccgctcccgtccccaccccgcctctgcttcctctttctccttcctccctcgctcgctcctgatgcgggagtgcgacgggggctgcggtggcgtgggcgtcgtatggccgcaacctctgcatcggctcccctcccctcttcctctccctctcgatctagcgtttggccctcacctgctaagcctccggcgcggcgcaagtgggtgcaggccgtacgtccgctccggtgagggccgtcaacggccacggcgccgccgcatcggccgccgccaggggccccgatgctggtgcccccttgacacggcctcatcctggtcgcttcgctgctcctctcgtcgttttttcttggtttggtccttgcccctccctctctctctccttgcctctccctgcaggagctccccttcaagtgtgttgacattgctcccttgcatgatttcctgatgtgaggttggaccaaacaagaccctattcccgtgcttttcatgggccctcaccttcgttgtctgcggcccctgttggttcccctcttcctttaatctgatcatttcctcttgtttcccactcttgcttatgatcattgtctgtgatgattgtctacgacgtcaaattatatgttgctggttctaagcgt

SEQ ID NO: 9048 - DNA, 778 bp, Sorghum bicolor
  Clone ID: SORBI-28MAY03-CLUS75143_1
aaggggtacttgaaagccgctgagcttgatcctagtaatgaaaatgtcaggcagaatattgaggtcgcaaaaaagaaactggctgaacaacgagtcccaccagaagggcaggtagttctccaggtcaagaattcttcgctggctggtcatctgatattggtgcaccaccaccaggacattccataagtataaatttgaatgacatttttggtcaagcaagtgtcaatgctggcggtcaaggatcaagtcaaacagggaattcaaataaccatactccacctgcttcgttcccaactggtgctgctgttcctcccccctttgccttctcgggctcaggcaatgaaggaactcaggcacgccaagcttctaatggacatgaaggggaacatggtgaaccaggcgtacacagggatgatggcatccatataaatgtggctggagctagacccgagcaggctgcggaggctttgagagctgtgatgcaaatgcttgggccacacatgactccacatgaaggtgcacctagaggaccaggttaatacgtgggaagtaggaaaatgtgttatgcggcgtattgttgaattgtcgtctgcaaaagtcttatacaggacattattttgtctttccatcctgatgaagaatggaatatcttgtgccccttatagcagtatgtctgtgctaaaattccaccttaatggttgctggcacattttgctcaacttacctgttcggttcatcttggcggagatgtatcattagctatgctgagtcttgtttg

SEQ ID NO: 9049 - DNA, 672 bp, Sorghum bicolor
  Clone ID: SORBI-28MAY03-CLUS75225_1
aaatgtcagtataaaatattcttttcaagttctactctttagttctggtggctggcgctgccctgggctgcatgccctccctagccccctctctctctggctcttctttgtttctgaacctaaaatcatctttgggtttccattgatctgagcttataaattaatagtacatagttggagttgcatatttgtgctaagagttaagcacgcttcccatgatgattaaaattatactcgcgcacatttctactactgtgttgggtggtgaaggagctttcacaattgcaggaccctttggtttgcctccaaatctatcaacagtatgtgcttgctggaccaaggtcgacactgtagcatggacactataaggatatgctgtaggcctctccaagatggcgtttcgagtgaaggtgaagatctctcattggactcgactcggatgataacgaagatgaagacatctctattgaagtggatttcagtcaggaattctgagggagctgcttccactggccttcaagttgcttgattaccttgagaattggaaacagtctacatgttcaatgaattatttagcttgaaataaaagctttacatatgtatcatcaatgacattcttcgtgtgcatatcatccttttctgaaggaaagatattaaaaaatggtttttctt

SEQ ID NO: 9050 - DNA, 904 bp, Sorghum bicolor
  Clone ID: SORBI-28MAY03-CLUS7528_1
atgatttccgtgaagcttatgcatggctgagccataacacagatgttgatgacaaggttgcttcctggtgggactatggttaccaaacaactgcaatggccaacagaactgtgattgtagacaataacacctggaacaacactcatatagcaacagttggtacagcaatgtcgtccccagaaaaagcagcttgggaaatcttcaattctttagatgtcaaatatgtgcttgttgtctttggaggacttgttggataccctagcgatgatatcaataagttcctttggatggtacgcataggaggtggtgtgttccctcacatcaaggaaccagattatcttagggatggtcaataccgtgttgatgctcaagccaccccaactatgctgaattgcctcatgtacaagctttgttattacaggtttgtggagaccgatggaaaaggttttgatagagtaagaggatatgaaataggaaagaagcatttcaagctaacacattttgaggaggtattcacaacccaccattggatggtccgtatatataaactgaaaccccagaagaacagggttcgaggcaagttgaagaagttgaaggctagtgccaaaactagttccacacttgcggcagggcaaaagaagaacccgtggcaatagatgaagttaacaatagtaccatttacttgatacttggttctaggtcaactgcactaggttcgtgaaccagaaaaccacagaactagattagagatgtgcactgttgtatttgactctcgttatatgttcttgcaaccggccagagtgccgatgaaatttttgatagaccagaggaagtttatctatcccatgggtagagattggatgctgaatttcttggcgaaagggttgcttaaactccccagtgt

SEQ ID NO: 9051 - DNA, 716 bp, Sorghum bicolor
  Clone ID: SORBI-28MAY03-CLUS75584_1
tactgcaatcatgtgtcactcaccgaccggacttccgtaaacgccaccaaacctctgacccttctcggggccaaggccaaagacgagagagcacacggcacgacaccagcgcttcccccacgttccgagcgcctcccgtcgcgtcccgtcccgtcctccttgctcgcattccgagttccagccagccagccagccaaccaactgaaccaaccaccgctccttcttccttcctccccccctcgtctcaccaccgagagcctccgagagctgagctgcgagagagggaggaaaaaaaataatccgacggaaacgacaagggcgcggcgagggcggggacggggaggccctgctgggcgcgggggcgccaagcgcatggcgtcgtcgagggtgatgccgtcgtcctcgccgtcgcacacggcctcggatctcgcgcgcctggcgcaggccgccagcaggcccggcggcggcggcggcggcagcgggctgggctccatgaacgtggaggagctcctccgcggcatctacggcgagatgcccaccccggcgccgcccgcgtcggagcccgaacgcccgatgtcgccggccccggcgccggagatcgccacgcggaagacggcggagcaggtgtggaaggagatcactggcggaggtgccaccggggaagccgtggctcccggggcggctcaggctgccgtacctgctggcgccggaggcgc

SEQ ID NO: 9052 - DNA, 639 bp, Sorghum bicolor
  Clone ID: SORBI-28MAY03-CLUS75478_1
ctactggatccgcagtctgcgcacaccaccaaatccctacctcctctcattcactcgcccatctcaccaaccatggccgccgcgtccgactctgacgccggcgcccagcagccgcgcgacgaccccagcctcctccctttcgcctccttctcgctcgccctctccatccgcgcgccggccacccccacactcgcctccgtcccctccaccatccacctccccactcaaatctctacactcgccgtctgcctccacccctccgccgcgcaggccccctcccgccgccccacccgcctcaattccgccacctcctccgtcatcgccccgctgccctcctcgacgccgggcctctcccgctccttcccctcgggcgcgcccgccgccgcggggcgccgccgcacgctcgtctggttccgcgccgacctccgcctccacgaccatgagccgttccacgccgcagcgggggcgtcgtcctccctcctccctgtcttcgtcttcgacccgcgggacttcggtaagtccccctcggggttcgaccgaacgggcccgtaccgcgccaacttcctgctcgactccgtcgccgacctgcgccggagcctccgcgcccgcggcggggacctggtggtgcgcgtgggcagg

SEQ ID NO: 9053 - DNA, 883 bp, Sorghum bicolor
  unsure (1)..(883): unsure at all n locations
  Clone ID: SORBI-28MAY03-CLUS7367_1
gccggccgggtcgcgaccgagaagacgacaggcctctcccctccgcgcggctccacaggagcgcaaaaatggcgaccctctccatggtctccgtccccgtcgcaccctcctccctctccctctccacccggggccgcacctcctccgtatccttacccgctaagaagggaggaatcggtcatggtggcttgcggatcgagtgcatccgtattggtggtgttgagattccaaaccacaagagggtggagtactcactgcagtacatccatggcattgggcggtcacgctcacgtcagatcctcttggacctcaatttcgataacaagatcaccaaggacctctctgaggaggaggtcatcaccctccgtaaggaggttggcaagtacatgattgagggagaccttaaacgtttcaaccgtgtggcgattgagaggttgaaggagattaggtgctacaagggcatccggcacaagcttggacttccagttcgcggccagaggacaaagaacaactgccggacactcaagggaaagagggcttcagttgccaagaagaagtcacctgcctcccaggatgaataaatcgggttgccatgtatttaagttctgtctcattgtgtgtgtgtgcgtgcgtgtgtgtgtgtagcgctactactgctgggtattttgtttcgagattttatgctgccattgacaaatcatggggaagccatcagctgctgcagattttgtagcagggacatactagcttatatgggtcggttctataaatgaaggtcaaattcttgnttacatcccagggacatggttccctgntttggtatccctctgcccccacctgtgcttgatgcaagggagtcagactgctcctaatgaaatactat

SEQ ID NO: 9054 - DNA, 1028 bp, Sorghum bicolor
  Clone ID: SORBI-28MAY03-CLUS73927_1
gtaattttttttagctttcctgcttgctcttgatgcactttgctctgcaatttagccacctgcattagatccacaacaacatatcaggttcttcacatcctaactgcatcaatacaatgaatgaaagcatttaaaataatttgtcatcattagcctctgtggatagtttttcttttcattaattccctctgtgtaggtacatcacaggaactgcaatattttaaatctaaatgcactcgttcatttgttcctcaagtatgttgtttttgttcataacatccttactgttattcagccggtaaattttaaatgctttcattcatggaaactgctataatatttttggaatgcacacactgtttttgaccaaatataactttaagcgagcttgaattagaatttagaaatgttgatggtaaatgagctctctgctacagtaagtcaggaaatatcatgaatagcagaaggatgcaccccagccatacccatacatgggcatatgtagcagccaaaattgtgatcagttcaatgtcagtcctagcttcctaggcctatcacctgatttcagctagctagcttgtcagtgcacctactccatcccgaacagatagttgtagtactggggagccgtgctggtgctagtgctactggtaacccaggttccattgtttccggtggagccctcgtagccagctgatccagaaaccatagcagcagcagcagcagcataaggaatgttgctggcatagccgttgccctgcttgctgctgctgctgtcttgctgtcccattgcacccgtagtggtgccccacatgacgccactgccggtgttgctgctgctgtggctgctggtgcccatcgtgaagtccacgtcctcgccgctcccgtcggcctcggtcgcggcagccggcccccgctgctgctgcgccgcctgctcgtaggcctccgcggcctccgcccgggtgcccttcgcgcccggcggcagggcctgggtcccggccaccctgccgatccttgcctgccaccgg

SEQ ID NO: 9055 - DNA, 671 bp, Sorghum bicolor
  Clone ID: SORBI-28MAY03-CLUS74063_1
ctactactgctagtactctccccacaagcaacccccctccatgatagtgctccctctgagctaaggctctctcacctacccacccgcgatggccgcaatgccggcgccggcagcgggcttggccatcctggtgctcttcgccgccgccctgccggctctttacgccgatgacctcaacagcgacgcgcaggcgctgcaggcgctgcgctcggcggtcggccgctcggcgctgccgtcgtggaacagtaccacgcctacgtgccagtggcagggcgtcacctgtgagagcggccgcgtcgtggagctccgcctccccggcgccgggctcatgggcaccctcccctcggaggtgctgggcaacctgtcggcgctccgcacgctctccctccggtacaacgcgctcacggggcccatccccgacgacgtctcccgcctgtccgagctccgggcgatctacttccagcacaacagcttctctggcgacgtcccggcgtctctgttcgagctcaagaacctcgtgaggctggacatcgcggggaacaagttcaccggcgagatctcgccggacttcaacaagctgatccgcctcgggacgctgtacctcgacgggaacagcttcaccggcgcgatccccaagctgcagctgcctgcattggagcagttcaacgtgt

SEQ ID NO: 9056 - DNA, 636 bp, Sorghum bicolor
  Clone ID: SORBI-28MAY03-CLUS74202_1
gcctctgagcgcacaacgctgcccgcccgccgcctcacctcctcgggcccaagctgcatctttccctccccattaatcctccccctcttgcgcttccccttccccatcagtctcgccgccatttcccctagcctgctgctgctgctgcttccccaaacccaagccttcgattcgaccgcccgggctctcgagccagccttccgcgccgtcgtggttgcctcgcttggcgcagctagccatggatgaggtccctgccaccgccgccgtcctcgacttccgacccggctcgtctccaccacgcgtctccgccgtcgcgcgccgtgccgcggagtgctcccccgacaccggcggtgcagacgaggcgacgggaggtccaggtttcgggaacacagccgccgtttcggcggagttgacggggtcaaattcggccggtcccgatatccaggctgtggattgcgatacatcgggaggcctttttggcggtgacgctgggggcgttgaggttttgtgcttagagaatgctgcggagctcgaattggtggaaccaggtgttttggacgtgagattaggagctccagtggaggagcgccatgaccggacgttggatagtacgggattgggctctgatgaagctgg

SEQ ID NO: 9057 - DNA, 690 bp, Sorghum bicolor
  Clone ID: SORBI-28MAY03-CLUS74189_1
gtgcgggtgggctatctcccccccctccccttctgtctgcaccacctagccgaccactaccgccgccgccaccgtacggcaggtgccgaggccttcgtcggtctcttctccggcgacgagcacccatcagagtataagtagctgctgtcaaagtgtacatgagcaatggtttgtgttgggtccaaagcaataagacccaaggggagcacaggaaatggcttgggagatggagctttagatgatagctcacacaagaagagggcaaggaaggataagagcgagaaaccccggaaagggggtcacagctcgagtaaaggaccttctgtagggaaacctcagcatgggaaggataggaagcagagcagcgatgatgggaagaaagggaaacggcgaggaaaggaccatcattcaggaagctctgtgatggtgaatcccaggaccaggaacctcaacaatcaggatgcattaccatcctccattacatcaaaaccagtacaaaatgttcttaggaaaagagttgatcctgaaactgcaaagtactttatggagatctcaaatctctttgataacaaggagattgattgtgaagagcgctcgactatatgtgctaatgccttagaagaatctagagggaaagagcttgaacttgccaccgatgctgttataagccacaccttgcaggttcttata

SEQ ID NO: 9058 - DNA, 889 bp, Sorghum bicolor
  Clone ID: SORBI-28MAY03-CLUS76525_1
gtatgcagctgtcagttgccgatcgttgcttgttacaaatgatgagatgcgagaccacttgtttcaactgcttggcactagttttttccctaggtggaaagagaaacatcaggtcagactaactttctccgggcgtggccctacccttcacttgccacctccctattcaattgttattcaggtgatggaactaaaatctgtataaagtctacatccctctacagaaacaatcatatgccttgaagaaactgaacagcacagtggatgctattaccattgttggcgtgtaggaatctgaagatggaagctggcatgtaccaacaacaacaggtgatgatatagaaaagccccggcagtggatgtgcactactagaaaatcttcgaagtagatgggttttgattttggccctgtataattggtacagaatggtgctagtcttgttgggaagagtggcgtgacaaatcctgaaaccagcaaaggttaagagcaatagcaacttgttgactcgaatgaaagctgattaaagtagcgtgggtgcttatagaagtgatgaatagtgaacagccagccatgggatatgcatttttgttgttgttgtaataacgtgatgacttgcatggttgggtgtttgttgtttattgcccacccatgtaattcttgtttctagatagattcagagattcgtggtaagactatactccctgtttctcccaatattcaaagattcaatgtcgtcgtctactgctatctgatttctcattagcacacatacctctggtgcccaaatggttattgtgttggggtgtgtctagctgacaggtgattgatgaggggctgcttttacatcggtcacctgtttggattttggagcgttgtacagtgaggtaa

SEQ ID NO: 9059 - DNA, 1026 bp, Sorghum bicolor
  Clone ID: SORBI-28MAY03-CLUS76643_1
ggagggcgctggaactggcggtgcaattgcgtactttagatctatcttggagccagtgaaggtgtgggtcttgacatctcttgcccttgtactccctggatacatcagctttgccttggcaatgtttcctatagtcgctgtcaagcccgcccgccattggttggtgtcggtacattgggttgtggcccctcttttcggatcccgcgacccgcttattcgagcgccggcaagggttagatatgtgacactcaatagaacatttagttgtaataaagcttttgaagaacttggctacaaacctattgtgacactacaggacggtttaaggaaagcagtgaaattgtatattcaattaagtaataaagatttatctaagagatagtaaagttgtgatgtaagacaactctacccggaatatcataagccaaagccagaggtgatgatgtctccacaaataaaaatttcaaggttgtctgcttcatgagggctacgttggctgcatcacagcctgtatgttggttgtgtttacggatcctgcgcattgcttttctggccggcgtgtgcttttgttgacttctagaggtttgggtgtttgctttctcgccctcttatcatgtgaatggcgtggttccgttgtgacatttcatattcttcacagttgtgatgtaagacaactctacacggaatatcataagccaaagccagaggtgatgatgtgtccacaaataaaaatttcaagtttgtattcttcattatattaagaaaagctatataatagcctataaattagttttgattaaggatcaattgcaatgctctaatggcaggcatgtatttatgttgaaatctagatgatattgtatttgctttatggtcctcttatcatgtgaaatgtgaagttgatgccatcataactagtgttgatcccttgatttgatagtaagtaacccaaaaatttttgtattgctagttcctatgaatatgttaaaacttatgaatttataggttttcaaatattatcttaca

SEQ ID NO: 9060 - DNA, 719 bp, Sorghum bicolor
  Clone ID: SORBI-28MAY03-CLUS76679_1
ggatttgcaaacaacacagggaacctggcaggcacccaccacctcacctccgccgacagcgagcacggccaccatcacccctgccatactcgctttgactccgcgtctgggcgcctagtctattcctcctcctgccaagaatcccgccagttgcctaccacctctcccggactccgcgttcctgcctgagcagctaccgagagtagagggaaggcaggcgctcagtctaatggggagggggagcgcgatggcgcaagcccttgcgctcgtcgccttgctcctcgcctgctccgacgtcgccgtcgtcgcggcgcaggagactgagaggatccaagggagtgctggtgatgtgcttgaagatgatcctgtcggaaggctcaaggtatatgtctatgagctgccccccaagtacaacaagaatatactggcaaaggattcgagatgcctcagccacatgtttgctacagagatattcatgcatcgcttcctcttgacgagcgcggtccggactctaaatccggacgaagctgattggttctatactccagtatacacaacgtgcgaccttacaccatggggtcatcccttgactacaaagtctccacgaatgatgagaagtgcgattcagtatatttccaagcgttggccctactggaacaggacggagggagcagaccatttctttgtcacaccacatgactttggagcatgcttctatt

SEQ ID NO: 9061 - DNA, 643 bp, Sorghum bicolor
  Clone ID: SORBI-28MAY03-CLUS76757_1
tttgcctccaatccagcagcctggccaagcacatcctcaaatcagacctggcatgcacaatgtgcctcctgtggcagctggcccaggccatcactatgcaaagccccgaggaccaggaggccctagccggtatcctcagggtgggaatcaagggggaggctacaatccaaaccgtggagggcagggtggtggctatggcagtggcccgtatccccagcaagggcgaggacctccttaccctggtggtggaatgggtggagcagctggtccgcggggcagtggtgccagtggctatggagctagcgggccaaactaccaacagggtggcccatacggtgcgtccggtccaggtcgaggaccaaactactctcaaggtggctcccgcaatcagcaacagtatgggaactggcaataatatggcaggcagtatcatgccattgagatgtatgtatctgcagaacctctgcagtttaagcatgttgtaagatgtatgtcatgattagtactgtaatacagtccagatatatctcaaaagtgctgtatatgactccagatgtaagattatgatcgagatatttttagtacttgaaacctttgatccatttactggaaggatggcatagagatatagcagagtttgcta

SEQ ID NO: 9062 - DNA, 793 bp, Sorghum bicolor
  Clone ID: SORBI-28MAY03-CLUS76851_1
cccgattcgaaaggagggttgtcgcctcgcgtcgcgtcgtctccctctggttccggcggctatggcggtggcggcccctggccagctcaacctcgacgaggccccgtcatggggctcccgaagcgtcgactgcttcgagaagctggagcagatcggcgagggcacctacgggcaagtgtacatggcgaaggagacgggcaccaacgagatcgtcgcgctcaagaagatccgcatggacaacgagcgcgaagggttcccgatcactgccatacgcgagatcaagatcctgaagaagcttcaccaccagaacgttatcaagctcaaggagatcgtcacctccccaggtccagagcgggacgagcaagggaagccaattgacggcaacaagtacaaggggagcatttacatggttttcgagtatatggaccatgacctcaccgggcttgctgatcggccaggaatgcggttcactgtgccacagattaagtgttacatgaggcagctgcttacaggcctgcactattgtcatgtcaaccaagttctgcatcgagatatcaaaggatctaacctcttgatagacaatgagggtaacttgaagcttgctgatttcggccttgcaagatcattctcgagtgatcacaatggaaaccttactaaccgtgtgatcactttgtggtatacacctccagagttgctacttggaagcacaaagtacggtccagccgttgacatgtggtcagtgggctgtatttttgcagaacttctcaatgggaagccaatattgcctggaaag

SEQ ID NO: 9063 - DNA, 1055 bp, Sorghum bicolor
  Clone ID: SORBI-28MAY03-CLUS9431_1
gcatcagagaaggcattggttgctggtttgggaggactcaatctctttggtgtcatcattcttggaaacttgttgaagcaaatgactgtgacacctggtggactgatctcatttgcagcacagttatatcctttgcttcagatatacgctggctccttttttgcaatacctttatttagatggtttctgctacgcaagaccaacaatgacattagaaagaggaataaggccagagaacagcgagctcaagaactcgtgtctccagattcttctctaagaagaaagtggctcagtgcacgcgatatggctgaacggaaagtaattacgccagaggagatcgtctatactactgaaaaggatctattggagcaggattatgaagtcaaggagtgggagaggagatttaaggagcttgaatcagagtgatggacatgaccaatatacttgacgttcgtagtagctctacatggtcctcacatcagacttggtggtaattttttatctgcatccaatggagtggaagatatatctgactgaaccactcaaccaagtgaaattggatggtactggaccttactaacagtcatatcactaccagcccaccactgactacttcgctatgaaagttttgtggaagctgttggtttaattgaaatcgaccattgtttgcaagctgatgtacatatctgtggcattgatctgcatatttgcatagttccattcacaggactggagatcaaattcagaattcgacacgaaaaacagggatactcggtttgaatggagtcccatcagaagttcagaacatgtaaaaagatcagtctgtaaacaggggactcagactttggcattcgtagcagaactctgtcctgtctaggaatagacatactgttataactttcagcctgttgaatcaattcatgatgggaacataacaatttcttgcattaaacagaaaatgtgtatcaacatgtccagtttctatactccatacacagagaatgaaacaagggaaatctaccaaggtcaaaagaacagagttacatagtattgat

SEQ ID NO: 9064 - DNA, 835 bp, Sorghum bicolor
  Clone ID: SORBI-28MAY03-CLUS9419_1
gtctctagtcgtctcttcgtggcaacctgcggcagcggtctgagcgcgttcatcgatcctattttcgattccatggcgtgcagcttctccccttcctcctccgccacgaggctccaggccgtggacgccgcggcggcggcggcggtgggggtgaagaacggcagggtccccctcaacctcaaggcttccgtcgcccccgcccagaggtcactcggactcggttgctgcagggcgaccgcgcgacaggaaggggctacacaggaacccaatgttgcagtttcttcggcccgtgcacagctggacctcctggaacaactgacgtcccctacacctgatggcattgctggcttagagaatggcgtgcctacagaatcgcgtcagcgtgctactatccgtcagcaattgtcagcactagccaatggtaaggtggtcgacgagttcaccctcccactgggcaggaagctgaaggaaggcctgaagagcctcaacaaactcaccgtgtcacagaggaggaacatcaagaggcaggccctgcttacccaggtcagtgggcgggatgactcggtgttcttcgcgactgttggggcgtttgtgctcgtcccgcctttcgccattctagctattgctgtcataactggttatgtccagctctttccatgataagaagatgtgtgttatttaactagttattatctccagactggcatataggaacatgcttttgctctgcaatactaggactgtatatatataatcgtatatacatagcaatattttgtatgtggggtcagtacgaaatgcagaatactgaataccaatacagataaggaattaa

SEQ ID NO: 9065 - DNA, 691 bp, Sorghum bicolor
  Clone ID: SORBI-28MAY03-CLUS94558_1
ctactggacgggcttaggcacagtgacaaaggtgcggtctctctgcctctctggtatctggtgccacatcacgtacgccctctgcggcgagaagatggggaggacgatgaagccactggcgtgcctcgcctgggcattgtcactgatcaatgtcgtgatggccgccgattacgtcgtcggcaacccgggcggcggctgggacgggaggaccgactacaagtcctggtccgcagcccagactttcgctccgggagatagcctaaccttcaaatacaactcataccacaacgtcttggaggtgaccaaggacgccttcgaagcgtgcacgacgacggaccccatcttctacgacaacagcggcagcaccaccatcgcgctcaccatgccggggacgcgctacttcatctgcggcgcgccgggacactgcctcggcggcatgaagatggtggtccaggtcgccgaccgacccgcacccaccacacccagttcgccgccggcgctaccaccggcgccgcctatgccgtcggctccagcgccggcacccgcggctgcgccaccgagacgtgcagggcacaagaagcacaagaagaggtactgcccgcctgaaaacctgcatgcgccggcgccggcgccggcccccacagtgcaggccgccgaaccagatttcccgttagcgatgtttgctccagat

SEQ ID NO: 9066 - DNA, 970 bp, Sorghum bicolor
  Clone ID: SORBI-28MAY03-CLUS9514_1
gcacgagggaaagaagggtcagagctgtgattgacaaatttgctgaacgtggtttgcgagcacttggtgtagcttaccaggaagtgccagatggtaggaaagagagtcctggaggaccatggcaattcattgggctcttgccacttttcgacccccctcgccatgatagtgcagaaactatcagaagggcactccatcttggtgttaatgtcaagatgattacaggtgatcagcttgctattgggaaggaaacagcacgtcgtttgggaatgggtactaatatgtacccttcatctgctttactcggacagaataaggatgagtcaattgcttctttaccaattgatgaattgatcgagaaggctgatggcttgctggagtctttccagaacacaagtatgagatcgtgaaacgcttgcaagcaagaaaacatatatgtggtatgactggggatggtgtaaatgatgccccagctttgaagaaggctgatatcggtattgcagtagcagactccaccgacgcagctcgtagtgcttctgacattgtcctaactgaaccaggccttagtgtgattattagtgctgtgctgacgagtcgggcaattttccaaaggatgaagaattacacaatctatgctgtatcaattaccatccgtattgtgcttggttttatgcttcttgctctgatatggaagtttgacttcccaccatttatggtcctgatcattgccatcctcaatgatggtaccattatgactatctcaaaggacagagtaaaaccatctccacaacctgatagttggaagttagctgagatttttgcaactggagttgtccttggtggttatttggccatgatgactgtcattttcttctgggcagcgtacaagactgacttcttcccgcgactgttccatgttgaaagccttgagaagactgcccaggatgattttcagaagcttgcgtccgct

SEQ ID NO: 9067 - DNA, 627 bp, Sorghum bicolor
  Clone ID: SORBI-28MAY03-CLUS9552_1
agaaagagctgattaagaatctctacaataaacttcaactagaaaaacaggccagcaaggagaagatatcatttggtcgatttgaagtccatgagcttgccgtcttcttccgaaacccggctgggcactatgaggcgatcaatcggaactgctcaaactactacctgtctgaggaatctgtcgccttgttcactgagcaccacccggtgcacccagcatacataatcgggcagatcgttcacattgagcggcgcatagtgcacccaggtcagatgggaggagctccacgccgtgatagcagtggtggccgtcggtcgcccgcatccatgctcaacccctacaaccttcctgggggctgtgagtacttcgtggtgactgttgccatgctgcctgatgctgcccgttgaaacaaaacaccttcctgatcctgcctgacaattggctgctgaaatgaagggagaaaattgtcaactgtatatatactgaaatttattgctatagactctcgattctcagttgcttcctcaagttatgtttgtatatatgatcatcttcacggtgtaaatagactcggctactgatgctagacatctcttcgttcaagcagactgaacattctttcagcta

SEQ ID NO: 9068 - DNA, 641 bp, Sorghum bicolor
  Clone ID: SORBI-28MAY03-CLUS77447_1
ccaggcactcgcggccccgaggttacaatttacagctatcaagcgcggcgcggaggcgggagcagcgagcagcgcgcggccggcgaccccaccagcaaccggccgcgcggccgcggttgcctccgtcggctgggtcctcgcctcgatggtggggatgtaccagcaccagctccgcgacgaccccctcggcaccctaggcggcggccactgcggtgaccagccacgcatcgccggcggcggcgcctcctcctcctcctcctcctcgttgtcctcctctccctcggctgttctcgccccgctgcctgcagaggcgcatggcggcggagagccgcggcagcggttcgaggcgctcgccgacgggggaagcgtgctgcgcggcgcgggaggcggcaaaggcggcgtcgtgggtggggatctgggggtgctagtgcggtggatgcgggagctcgcagcggatcccgtggctccccttccggcgccatcagagcacaggccgaggaagcggcacgtgctggccttgcggcgcgctcgctaccttagattggaggacgtggaggacgcagaagagcttcccagcttctacaagaaaaggaagctctactgggacaaacaaaaaaagaaagggtgcttgaacatgccaa

SEQ ID NO: 9069 - DNA, 606 bp, Sorghum bicolor
  unsure (1)..(606): unsure at all n locations
  Clone ID: SORBI-28MAY03-CLUS7745_1
agnaagcggcagcttatggatccagtggatcgcgctgcgatgcagcgacagaaacgaatgatcaaaaaccgcgagtctgctgcccggtcacgggagaggaagcaggcctatatcgccgagctagaatcgctggtaacgcagctcgaggaggagaatgccgagttgttgagagaacaggaagagcggcaccagaagcggcttaaagagctcttggaacgagtgacacctgtcattctgaggaaaaaaccatcacgagatcttagaagaacgaactcaatgcagtggtagatttgagccaagctcagtcgccgtctccttacagttataacatagaatttgcccttgtatgtcatttttctatttatatgcgccaacttagttgtagtaccttagctgaaatagcatgggcaattagccgacacaaagcttaaatgaaatcatattatgtaggagtgctcatgagtcatgaccaagaaaggtggttgttcctgtctggtcgtgtttcattcttcttggtttgttttctatttcttgtcaaacctggcaagtaagtttagcaaggaagtggacagtcttactccaataagcaggctactcgaaatcaaa

SEQ ID NO: 9070 - DNA, 564 bp, Sorghum bicolor
  Clone ID: SORBI-28MAY03-CLUS7741_1
gcgcgggatgcaacgtcagggggcttccctaataccccatcaaccactccgccacagtatgcagcgtcagggggcttccctagtaccccatccactgctccgccacagtatgcagcatcagggggcttccctaacaccccaactggtgccccgcctggcattctgccacaacagttgcacacttcgcagcagatgccgcctcagcatgaaaatcagtcacgaggcacacctggaactagccaaccgccgccatcagcatcatactaccgttaggttgaatcttcttttgctattgtacttggcctgtttatgtttcactgagtttgttatttatcatgtaatactgcaataccgccgcccggggctgcccttagaccccagcgaccgctccgccacagtttgcggcggcagggggcttccctcgtaccccatccccgcctccgcctcggtccgcaccgtcacgggccggccctggcaccccgacgggtgccccgccgggcgttctgccccgaccggcccacccttcgctgcgcttgccgccgctgctccactgtcagtcacgaa

SEQ ID NO: 9071 - DNA, 365 bp, Sorghum bicolor
  Clone ID: LIB3476-038-P1-K1-G11
atcgagaatatgcagtatgctgttactgtagacgttcttcatactgtgttctcatcatttggtacagtccagaaaattgctatttgtgagaagaatgggggaacacaagctgattcagtaccctgatgtaaatacagctgctgtagcgaaggaagcattggaagggcattgcatctacgatggtggctactgtaagcttcacctgtcatactctcgtcatactgatctgaatgtgaaggcacatggtgacaagagcagagattatacaattccagctggcgtaacccaaggagtgccacaaccacctggtgtacaagctacatcctttgggtggcaaggtaaccttcaagctgctggggcatatg

SEQ ID NO: 9072 - DNA, 581 bp, Sorghum bicolor
  Clone ID: SORBI-28MAY03-CLUS775_1
cacaaattattgaacgtttggagcaaggtgaactcaagcttcgtgtcagaacactggaatcggaaagagcatttcaaagagttgccgctgtacagaaaacaattggatatggagttgctgcaggtagtttggtgaaccttgcaacaatgttgtacttcaattcaatccggggaccagcaaccattgcatactccctctgcgcattcttcgggctgcaagttctgatcgggcttgtcaaggttaagaagttggatcggcaggagagactgataactggcactgcgtgagctgagttcttgatcaatgagtgagaactgaaccgtcacttttcagcgctgtgcgttgtcttcacgtctcctttttttggcctaattttacccccagcgggatttagcataggcacggccccccggtgtatgatagctgtatgtagatgagataacagataaagatgtacatagtgtataatagaaattctacatgtattgttcgcttccgtggagtagcagatacgtacaggattttctttttaaaatgatgatccagggttaaatgattgatttggtggttttattgttctg

SEQ ID NO: 9073 - DNA, 650 bp, Sorghum bicolor
  Clone ID: SORBI-28MAY03-CLUS77584_1
ctactggtccgactccgactccactacccctatccccaccgcgaactgccggaggaatctctggcgatggcgccgccacccgctacggttgccgccgtccgccaccacagcccgcacctgctcctccgccgcggcggcgggggtctcctcccaccacctccggcccccgccacgctccccttcgccacgcggggtgtggcctccgcgccggcgcgcctgcgcctgccgccgccacggttctcgctctcccctgtcccgaagagcctctccgcctcctcctcctctcacgtccccgtgcgctccctcttcaccggcatcgtcgaggaggttggccgcgtgcgccgcctgggcccgccgctcgcgccgtcgtctggcggcggcggtggcgaggctcccgggcttgacctggaggtcgagaccagggacctcctcaccaggacgcagctcggcgacagcgtggcggtggacggcacctgcctcaccgtggcggcgatcgacccggccgcgtccacgctcaccttcggcgtggcgccggagacgctccgccggacgtccctgggcgggcgggcccccggcgacggcgtcaacctcgagcgcgcgctcacgccgtcgtcacgcatggggggccacttcgtgcagggccacgtcga

SEQ ID NO: 9074 - DNA, 1005 bp, Sorghum bicolor
  Clone ID: SORBI-28MAY03-CLUS75695_1
ggcctgctcctgctcctctcttctcttctttgtctggaaaattcgaaccctaaagcgccggtgccgtctccgggtgcgggctcacctcgcggcggcgggaccttccgttcaagcgtcgcgccatggctcagctccgcgagtacaggatgaccatgacaagcaaggatggattgggagatgagggggactactggtggtcgctgtcgctgtcgaggatgcacacatttttcagacaagtgaatatattgatatgtctgctcctgcatcgattgatgcatatggctatgtcgaggatccacatgttcctgagtgtggacagtggaaggcctctaagctcccgtggttccagtgaagagcagggtgtctctaaaatttatgtgctgtccgaacaaccaatgcctcccctgctgctgattctctggttggattcaggcgccacccaccatgctgtgggcgatgctagaattctttgtaaccttcgggatccacctgccggaacagccgtcagagcagcagatggcgtccggctgctcgtccataaaattggcgacatactgacacaatgcatcaaaatccaagatgtgtacctagtccttggactccaagagaatctcataagcgttcgtcagctcgcgaaggacaagaaaatagtcaccattttctatgagaactatgcggagctgtggcgcgaggggaagatggtcggtggcgcaattgctgacaatgtcacatccctctaccagctacgctacttgacgatgccgacgggagatcctgaggctggcacaagtaggtacatacgagaagaagccatggacgtggctaccgcaagagaagcgacgaacaggagcagcttcctgcagctcctctcgctgtccaattcgacgtcgactgagacgaagatgatccacgcgtgcatacatgttcttagcaactgctacaaatctgaggatggattgcgtgtacagaacatgttttctgccgccgccgctgactcgacgtaca

SEQ ID NO: 9075 - DNA, 587 bp, Sorghum bicolor
  Clone ID: SORBI-28MAY03-CLUS7531_1
atctaaagatcttctgactgtttctagtgaaaagccactctaatgtataggagataagccagtccgatgtacagtctagtttaaattgtttctagctttttctttaattccacgtaaggctatctgaaaatcttttgacgtgtttctaatgacagacctatgtacaggagataagctagtccgatggagaggagatgaacatattaggcatgagtgcatggagacatgtggactgtaattttaatatacacatatttatgtagcaagacgtctgatgcatccttttttagctcagcttcttttatgttaggatgtgtagataaagagtatgaatgaaaacttcagttctagaactcctgcccaggaacaggacaaatatgatgtgttggatgttcagatcagatgcttgaaggatgaagaacaagattcccctcaagattagtttcctcaggattagttttttaggtagtggtgttacagtactgtatagttatttttagtatatgatttttttagttagtgaatcattaattgtatacacttacagattgggtcattttattgctatagaataagctactaaatag

SEQ ID NO: 9076 - DNA, 542 bp, Sorghum bicolor
  Clone ID: LIB5051-002-A1-XP1-A5
gccggccgtgtccaaaaagtaaatcttctgaatttcgtattgcgattatgtgatatctatgtgctgtttgaagaatagatctgataaggagataagctagtccgatggagaggagatgaacatattaggcatgagtgcatggagacatgtggactgtaattttaatatacacatatttatgtagcaagacgtctgatgcatccttttttagctcagcttcttttatgttaggatgtgtagataaagagtatgaatgaaaacttcagttctagaacacctgcccaggaacaggacaaatatgatgtgttggatgttcagatcagatgcttgaaggatgaagaacaagattcccctcaagattagtttcctcaggattagttttttaggagtggtgttacagtactgtatagttatttttagtatatgaatttttttagttagtgaatcattaattgtatacacttacagattgggtcattttatatctatagaataagctactaaatatcagtttttaaaaaaaaaaaaaaaaaaggccccta

SEQ ID NO: 9077 - DNA, 505 bp, Sorghum bicolor
  Clone ID: LIB3476-035-P1-K1-E9
gacagacctatgtacaggagataagctagtccgatggagaggagatgaacatattaggcatgagtgcatggagacatgtggactgtaattttaatatacacatatttatgtagcaagacgtctgatgcatccttttttagctcagcttcttttatgttaggatgtgtagataaagagtatgaatgaaaacttcagttctagaacacctgcccaggaacaggtattggctcagttgtattccttctaaaaatttattgattcattgtatttcttctaaatttataaattcataggaagatcacatattttcctaaatatgttcttaatgaagcactctacattttcacacaggacaaatatgatgtgttggatgttcagatcagatgcttgaaggatgaagaacaagattcccctcaagattagtttcctcaggattagttttttaggagtggtgttacagtactgtatagttatttttaagatatgaattttttaggtagtgaat

SEQ ID NO: 9078 - DNA, 727 bp, Sorghum bicolor
  Clone ID: SORBI-28MAY03-CLUS76020_1
tcttgttttttggtccctttatcatgggtgttgcaactgtttcctacattcctccgtagtccgggcattcatctcgatccgtctgcctcccatctgccgactcgctcctccctaaaagacaccgctcgccccgcaccaggccctaggccgccatctactgacttatcctcgccccacagagcaggcctgaacaggtaactaatatttctgtcactgaaggtaagaaagccacatagttggctccagaactacacccaattttgtattatacaacgaacccacttgaagatttgagtgagagcaacaagcaaccataacatactggtctagccataaattaatgaattcagctctgagcttctgtccatcaagaacagtttggggtcaacaaactcaatagatgcccatataattggaattcatcaagcattctgctgcatccaggatcaggttcacgtttcatattgtcaatttaccgcgcttctgtcagcagtggctaaagttctttctttatgttttacctcattccattataattaatgttttacgcagcagaagcatagagcaacttccgcttgggcttgtaaatctcccaaagcttgaacaatagtttcccggctggctattgtttcttcttcatggtgaagcattttccgtaatctttgtactagaggagtatcaccatggccagtgcatacaataagcatagcattatcaggtagggcac

SEQ ID NO: 9079 - DNA, 694 bp, Sorghum bicolor
  Clone ID: SORBI-28MAY03-CLUS76081_1
ccggatgcataatggtaaatcctatgtagtaccaatttggttctgaaataattccagtaatagttagcatgtctatattgcagatgtgcttaagtgcatttaataaagatgctgatcttgatgttctgaaccatccaatcctgaacttcttttactacttggtatgtttttttcattcaaataaattgtttgtgcaggtttagagttaatagtttctcaggtgcatctttgaacttactttgtgatatcaattagatctcttatgtatgatctgtcgttgcacttgctgatattcttttctgctggtgtccgctgtgtcttgtgcagctggttgagattgtacccttgtctttggtgttgttcatcttacggaaactgccgccaaaacgtgggattgcacagtaccatccaatacattagtcaggattccgaaatgtgcatggtccattgctaacagttccatccaattgccaactacaacaaggcaaatgtgagttttttagatgaaggatgagacaccatatacctttctttgtaggttaatagctttcatacgaagtaggtctggcaaatatagcttgttaaaaatgtaacctcacggtttgttgtaatcccaattcccaacaactgtcaccaatacaacctatttcttgaattgaggcttccggttgtaaacttcagaacagaagacaac

SEQ ID NO: 9080 - DNA, 1513 bp, Sorghum bicolor
  Clone ID: SORBI-28MAY03-CLUS76199_1
ctactgggtggattgtttagcatctaggccatatctcccctgccctctctctttcctcttctatcatcttccttcttcgacccaccaaccctggttgattcaacgcgccgcgcggcgcctagtattcgccgtctcacggtgacctgttcgtggaaattccatcatttatacgtagagataggctcagatgacacgagcaattattcgcgccagtgcttccaacgatacagaggcagcagcggacagccgagagcagaattattaagtcggattcggtgggcaagcacgcacggagcgattgagctgaccgcgcgatggagaaggggagcagcgggctgtcctgccgcgccgccgtctgcggcgtcgtcgtgctcctcaccgtcatcgccttctcctgctcgctcgccgcggaattccacaaggtcaaggagaaggacatgaagctggacggcagcctctgctcgctccccaagagctccgccttcgagctgggcgtggccgccatcgccttcctcttcgtggcgcagctcgtgggcaccacggcggcggtgaccaccgtgttggccggcaagcctaagaagagctccgccgccagagggcgcgccgcgttcgtcgcgctcctggtcctctcatggctgagcttcgcggtggccgtgatcctgctggcgacagccgcgagcatgaaccacgggcagcggtacgggcgcgggtggatggacggcgactgctacgtggcccggagcggcgtgttcggcggcgcggcggcccttgtcgtcgtcacggcgctcatcaccctcggcctcaccttcgccaccgaatcggccgcggccgcgggtgccatggcgacgacgcccgcatcgtcgtcgtcgtcatcagccacatgcacaaggaggacacatctcgacgcggcgtcggcggacgcggaacagccgggcgggcgatccaagcaatgaggcagacaggctggctggggcgcggcgcggggcggaccaaccggaggcggctggtgagcggcaacgttcgtgccggccgcaaaaggccgcgccgcgcggcgcggcgcgcggccgcccctccggggctggctggcggggcaacggaaagtggcagacggccgccggaccagaccggtggggccgtgccgcggaggcggatggattatggatataccgctggttggttggatatttagcagccgcgacagaggtacatacatactgttttactgtccccattacagcgttactgacacgtttactgactcgcccgtgcaacatgtaaatgacacgagcggtcattgcaaaaatgcaaacataaatcatacggaaaatcccccttttttccctttgcctgttgggtgtttgtgtgcatgtgtaccaacctttttttttttgaaacggcatgtgtaccaacttggtcctagtgggcatgttcagcttggccccttgattggctgagccttgacgctgtactgtgactggttacaataatgcattcgaaagaacattttttcatg

SEQ ID NO: 9081 - DNA, 645 bp, Sorghum bicolor
  Clone ID: SORBI-28MAY03-CLUS76492_1
gccgcggcgtacgcggccatggccaccgcccgcgccggcaaggccgcgcgcctcagggaccgccgcgtcgtcgacgtcgagtacaagaggataccctgcgagtacgccaaggaccgcaacctgtcgatacgcgtggaggagaagagccggccgccgagcgacctctccatcaggttcctgtaccagggcggccagaccgacatcgtcgccgtcgacgtcgccaccgtcgggtcgtccaactggcggttcatgacgcgggaccacgggccggcgtggagcacggcgcaggcgccggcggggccgctgcagctgcggctggtggtgaccggcgggtacgacggcaagtgggtgtgggcggagtcggaggtgctgccgcgacggtgggaggccggccgcgtctacgacaccggggtgcaggtatccgacgtcgcgcaggaagggtgctacccctgcgacacgcaccagtggcagtaagaccccgcacgggctcactgtggattgtatacattgtttgtacagctctttctttctctctctttttttttggggtttgtttttgctttccgtccattttcggatggatggacgaaagatatgaaaatgatgagcggaattggagagtgaaatcaaatcaaatcaattccc

SEQ ID NO: 9082 - DNA, 947 bp, Sorghum bicolor
  Clone ID: SORBI-28MAY03-CLUS78371_1
accatcaaagagagcattgcccgttataatgatgttgctcttgctgcaaaagagaaagaaattcctgtccgagggtatgtgtcttgtgtggttggatgcccagtagatggaccagtaccaccttcaaacgtagcttatgtagcgaaagaactttatgacatgggctgctatgaagtttcacttggtgataccattggagtcggtactccaggtaccgtggctccaatgcttgaggcagccatgtccgtcgttcccgtggagaagcttgctgtccacttccacgacacctacggccagtccctctcaaatattctcatctctctccagatgggagtcaacgttgtggactcctctgtcgctggcctcggtggctgcccgtacgcaaagggtgcgtcagggaacgtggcgacggaggatgtagtgtacatgctcaaagggctgggcatcaagacgggcgtcgacctgggcaaggtgatggccgccggcgagtttatctgcaagcacctgggacgccagtctgggtccaaggcagcgaccgctctgagcaaagttactgcaaacgcctcgaaactctgacgctagactaatttaccatgatcccctactgcagatatttgcagtaaaattagcgcaaggttacaaacaccccgtggcctctccagacggcagcggagcatcactgcgttccggctccccccccttacatgttctcagcaaacgggaatggagcatcagtttgttccagcttccaatcattacatgtctacaacatctagatctcatttacgctagcctgtcacactaaggacacaatgggaattgtctaatgctgtgatgatttcaacgaaacagtgggaaatgtctaatgctgtaatgcattccacgaaagttgatgggttagctacgatctctattacggtttgcaaacttacagcagattcaccctc

SEQ ID NO: 9083 - DNA, 780 bp, Sorghum bicolor
  Clone ID: SORBI-28MAY03-CLUS78388_1
gcacgagggtcctctcctctccgtcctggactcgcgcctcgcttcctccctcccaaccccacccgctgaagcttctaggagctcctcggctcggctgaccccgagctaacgagctcaccggcgggcaggaggatgctggcggcgcccaccaaggtcggctctaggctggcctctccgcacgcctcctcgtccgccagtgctgctgctgctgtggcgacggcgctggcgagctcccccgtgctgggctctgggtctggggtgctctcaggcgccgggttcggcgagacggggagtcatcacgcggcggacgcgccgccgccgcccccgccttgcagttcctcgggcgattcaagggaatattgtcagcggaagagactggtgaatcaaaggcagtcaacgctacaaggaggcaaagtgactgctgcattgggcgatcatgtttctggcgcacgctgttcctcgtggagtcaacatattaacagatacttttcatcttcttctcatcaagggaggatatgggccgggagcaaggttctacatgacctgccacagtatgtaaaaattgtggaagtagggccacgggatggtttacagaatgaaaaggacattgtaccaacacctgtaaaggttgagcttatacgaagattggccacatccggattacctgtggtggaggcaacaagttttgtatctccaaaatgggtacctcagttagctgatgcgaaggatgttatggaagcagttcggattattgagggtgtgcgtcttcctgtattgacc

SEQ ID NO: 9084 - DNA, 815 bp, Sorghum bicolor
  unsure (1)..(815): unsure at all n locations
  Clone ID: SORBI-28MAY03-CLUS78605_1
agtcactgctgctgcatctgtttcggtgcactctgtccctccctccctcttgctctggtttgccttcttggtcctctgtcttcctcctcctcctcccctccttcccggacgctgcaggcttcgctggttgggtcaactgtctgtgcagctgtgccctccctcttcttcctgctcagcctcctctgctcgatctttcattgcttcattccactgctgcagctcttcttggcaggtttccctgtactctcttctgactggtccttgtttcagtttctaacggttcttccttctgacagccacagcgccctgtagattcagctccattccctgctggctgcagctccctgtcaatctttcgaggctgcagagctttcagttcttgctgctctgctttcttgctcctcctctcaactctgcatttctctccttcctctcacctctgctagctagctagttttctctctggcaaacggacggaggagacgccgccattagatacattggataaggagcaagagcaaacatgagacctctaagcagcgtcggcgtcgggctggccgtggtgtcgtcgctgctcctgctagcgctcaccgcggagctctactacatcttcgtgcacaagcgccggcagcggcggcgcgcggcggccatctccgacgcggcgtcgtccccgtcctcgtcctcccgcgagctgctccagctcttctgcttcaagaagccgccgccggcggcgctcgcgtccacctacgccgtccccgagccagccgccgccgtggccgtggccgtcggcgtcagcggcgacngcggcggtgccg

SEQ ID NO: 9085 - DNA, 637 bp, Sorghum bicolor
  Clone ID: SORBI-28MAY03-CLUS78645_1
tgagcgagccatctccgatatgcaaggggaagccagagtttccatcccactggtcgtttttggtcacatgcacaagagcctagcctacgggagaggcttgaggaagatgatcgcctctggagccaaccacaccatatatctgaacggagcagttgtgcctagagtgaaattttccaaaacaattcctaggtatgagcaaaatcaacccgaaggaccaggatccgtagctccagcacgaggcgcgttcaccattgcggatctctctgaagggcgtgtggagaagatctctgaggtctgggtgctggtgagtggtgccaggactgaggtcgaggaggaaatcgtcttgtataaacatccttgagagcatatgtgacgaaaatgtatctgttgtgaatgctgtaaatgcgctgggcgatgcttaagttgtttagtgaatgttacaaactggcttgtgtgccaactgaaagcagcactttattatagagcctgtaacctaatgtgcttgttttcgtctgtgatgttctgccatggcttctactttattattactagcaaaatgtccctgtacttcgaaaatgtaatttgttgcatggtcatttagacaatttgtttctcggaattatttgaccatcatgat

SEQ ID NO: 9086 - DNA, 842 bp, Sorghum bicolor
  Clone ID: SORBI-28MAY03-CLUS78656_1
caaatccaccaaccaccactcccaagagaagggattccaactttggttacatggagtcaaggaggaaatgaggtgttcctggaaggatcatgggataactggacatcgaggagggcattaaagaggtctggcaaagatcacgccatcttgttggttctgccatccggagtttatcattaccgccttgtcggttagggggcgctgtgtctcttcccgcatccacccctggcagctgttgaacggcggcgagccgccgacctcctcgttgcccgggattacgttccggagagcctcgacagcgtagctgagtttgaggcacccccatctcccgaacacagttatgacctgcaatacccaggtgatgaggaattcgccaaggaaccgcccaccctcccgccccagcttctcatgtctgtccttggggacaccgacaacactgacaatcaagcttcaaagccacagcacgtcgttctcaaccttctggggaagggtggggatcgcagtcgctgctcgccctcggcgtcacccatcggtttgaatccaagtatgtgagctttgtgctttacaaaccgctgaagaggtgatgggtactgtgagtggaagaagagaatggtggctagggactgatgaaggtgaataatgtgtgtgtagctgacattgtagcgttgtatagaagggaaatgcaggaggtcctaactgatctttttatgtttctttcactttcgacgaaagcaataaattagttgttgcctgagatatttgcggaaatgaaagggaggggagtctcacaagagcttcactccatgcatgcttcgtgcaaaaaaaaaaaaaaaaaaaaaaaa

SEQ ID NO: 9087 - DNA, 695 bp, Sorghum bicolor
  Clone ID: SORBI-28MAY03-CLUS76902_1
acttcaaccccaagacactgagcatcgagcccacacttctgctgaaccctccgcttgactcggacatcatgacggaggagatattcggcccgctgctcccgatcatcacggtgaagaagatcgaagacagcatcaagttcctcaagtcgaagccgaagccgctggcgatctacgccttcaccaggaacgagaagctcaagcagcggatcatcgacgagacgtcgtcggggagcgtcaccttcaacgacgccatcgtgcagtatgggctggacagcatcccgttcggtggcgtagggcacagtgggttcgggcagtaccacggcaagtacacgttcgagatgttcagccacaagaaggcggtgctcaagaggagcctcctcgtcgaattcatgttccggtacccgccgtgggacgagaccaagatcgggatgctcaggcgcgtctaccgtttcgactacgtctcgctcttcctcgcgatcgtcggcctaaggagataaaagcagccggcggtgatgagtgaataatccagcagacagaatttaccactacagttgctaatggacaagtttgagcagcaacggttatggattcgtttatatatatactactggtcgatgaatacaacaaagcgtctatactgttgttttgtacgtgtctgtcaaaagatttaagaataatcgattatccttttagtt

SEQ ID NO: 9088 - DNA, 894 bp, Sorghum bicolor
  Clone ID: SORBI-28MAY03-CLUS76907_1
cttctctcggcgtagtgtctccccctggggttatgccggcccttccccccggcgacccggccgtccctgtctcgggcctaccaatcttccccacccacgccgttgtcctccccggcggcgctacccgggtccccgaaggcgtccgacccctcactggcgttttccacgctcttggtcacttccaattagatggtattccacctgctcccgctggtggtcctcctgtccaagctgccgtggtgtcggaccctggtggtgtcttggtcctcggtgctcgtgttctagccgccgctcatccctccctgggcccggttaccgccggcgggggaaggcctgcccttgtccccagtgatacgaccgtccctgtggcggagctccagatccttgccgctgattcgcagaatcagcccggcgttgctatgcatggtctcgagcgagactgcccctccaccaagcatactctctcgctcggaaggttcagcgtcgatggcggcccacccgccccaggacgacttccccgaatgggcgtcgcctgcgttttgggcgctgatggtatctcggacgccggtgctggtgctttcgctcctggaaaatccaacaagattactattaccaatgccatgggcagccgctcctaccaaggcgtcggtcagctgctccgtgctgctggctgtcgtatgccacgagccggcggccttccgggggggatcgttgccggatccggtcgcgatcgtgccggcccctctgccgagcaagctgtgtaagttgagtggctctgggtctaattcggggaatctgactttggtcagcgtgtgtggatgtgcgatgtgggtttggtttggatcgttagtatccccgaacccattcctaataaatattactcctactttacat

SEQ ID NO: 9089 - DNA, 728 bp, Sorghum bicolor
  Clone ID: SORBI-28MAY03-CLUS76967_1
ggtgtacgagatgctccggatgcagccgccggtgccgctgcagtttgcccgcgcgcgcagggacttcgtgctgcagtcccacggcggcgccgcgtaccaggtgaccaagggcgaggtgctgtgcgggtaccagccgctggcgatgcgggaccccgaggtgttcgaccgccccgaggagttcgtgccggagcggttcctcggcgacgacggcgccaggctgctgcagcacctcttctggtccaacggaccggagacggagcagccggcgcccgggaacaagcagtgcgccgccaaggaggtggtggtggacacggcgtgcatgctgctggccgagctcttccggcgatacgacgacttcgtggtggagggcacatccttcacaaagctcgtcaagcgccagccgtcgccgagcttgtcgccggcagccgcagccggagcgcaacagtgacatgatgcatatataggatgatatatcgcgcggtgaccacgtcgccgtctcgccgacgccggccgagtagtaacgtgtgtttgtcatgcatactgtgtgttggacttcattccaacgattgatcggtgtctctctctcccggccgttgataataaaacacttgtgcaattgcaaagtgtgggtgcatatgcaggcaggacgtacacacttgtatagtgaattagtgatgcgctattgctgctgcaaacaaattaaatgaacatctcctcttcattggcct

SEQ ID NO: 9090 - DNA, 1506 bp, Sorghum bicolor
  Clone ID: SORBI-28MAY03-CLUS77118_1
ctccagccccctcaccaatggattatagcgattggtctatatcactggacacctgttcaagctcgtaatatcactggactatcggccccacgcttggctggccccacacgacagtggcttgaacaggtcgcaacgccagcgccagcgcgtgacggaaaaatatcatgctagttgctctcgttccccggttagttgagctctttcccttcctcgcttcgaaccaaatcaaatcggagcggcggagcaaaacgatccctcgcctcgctctccttcgattcagctcgaccagggccctaatcgggaagctaatgccacgcaagtccccggggctgtagcgccacccggcttcgcggtgggcatggaggcgcagaacggcgccggcggtggggcgcccgtggtgctcaacgtgtacgacctgacgcccatgaacaactacctctactggttcggcctcggcatcttccactccggaatcgaagttcatggtatggagtatggattcggagcacatgagtttccaacaagtggggtatttgaggtggaaccgaaaagctgtcctggtttcatctacagaagatctgtgtggatgggcacaactgacatgtctagagcagagttccgctcgttcattgaaaatcttgcaggaaagtacaatggcaacacgtatcatttgatttcaaagaattgcaaccattttacagatgatgtctgtaagaacttgaccaggaaatcaatacctgggtgggtgaatcggctagcaagagtgggttcatttttcaactgtctcctaccagaaggcatccaagtttccacagttagacacgtccctactcatcctgcattttctgatgatgatatggattcggtatcttcatcgattattggagacagtgatctggaagagttggaccaacaccttctgccatcaactactgatgcccattctatagacgtgccaccaaagctagccaaagatcttctctgaattattcaagcctttggggtccacatagcaaggataactttgactgctgcagttgatgtccactgactgcttctccgggtgattcaggattgcgggagtgtagatgaatgctgctgattgtattgattctttgcgaccgagtttgttacatacacacatagctctcgacagaaatggcatgctttctaattctttgcctgttatgacttgtgagttgtgacttcatcctaagtatcttgtgttcgagtgatactgtacgcactatagacgtgagttgtggcactgcggaactggcctgtccgaaagaggcaccaggctgtggatcgtgattcgtgatagggataatactgaaagtctgaagccccctgtgtgccaatccttatctaggggccttagccagcacatgttgtaagtaccatagaagtatttatgtttataatggcagttccgtggctgattgattttttgtgtgctttttgtgtttggactggatcataatctaaagtcccattggaagagag

SEQ ID NO: 9091 - DNA, 765 bp, Sorghum bicolor
  Clone ID: SORBI-28MAY03-CLUS77158_1
accctagcttgggccttggctcgcacctcgatcgcactcgcagcagcagcagcagcagcaaccaacctccactgccgcccgcaacgcacccgagaggcgaggagggggaagaaaagcggcggcggctgcggcggcggccaaaaggaaggaccaggaaagcagcaggcaaggtagcagcatcggattggttgggtgcccggccggccgagcgtaccacaacacctccatcatggggaggtcgccgtgctgcgagaaggcgcacaccaacaagggcgcgtggaccaaggaggaggacgaccgcctcgtggcgtacatcaaggcgcacggcgagggttgctggcgctcgctgcccaaggccgccggcctccggccccgcggcgccgcccgccgcccccggcggaccgactacctccgccccgacctctggcgcgcccacttcccgcgggagctgctcggccgcggcatcgaccccctcaccctccgccccatcgccggcgcccgcgccgccgccggcccccccggctcgtcccaccccgacatccccaacgccgccgtcgcgcccctcccgccgcagctgctgcccagcggggccgtcgcgacggccgtcgtcaaggtgcccaggtgccccgacctcaacctcgatctctgcatcagcccgccgtgccaacagaaggaagacgaggagctggacctcaagcccgccgtcgtcgtcaagcgggaggtgctgcaggccggccatggcggcagcctctgcttcggctgcag

SEQ ID NO: 9092 - DNA, 904 bp, Sorghum bicolor
  Clone ID: SORBI-28MAY03-CLUS7932_1
gctattgcatacatatatacactgatttttgtaactgttccttcaatggcttctgtctacaatgaatatgccttgaaaagccaatatgacactagcatttatctccagaacttgtttctgtatggatatggagcaatattcaacttccttggcattctcgggacgctattattccaagggccagaaagttttaacattcttcgaggacattcacacaaacaaacctctcatatgtaacttcttttctaaatatctctcttattcttcttaaacatgtatgaactcgtattcattttcagtttccacaatacttactggcctagcttctgctgcattcttggggcataccttgaccattaattttctcttgggcatatcagtggtgtttatttcaatgcaccagttcttctctccacttgctaaagtcaaagatgacaaaccagctgacttaatagagttggaagatacacaaaatcaccggtcatctgaatcttcttttgtaaatatgactgctggtgccgctgatgatgcgagccatcggattggaactgatgagagacaaccactgttgcctacatgaactagtttcttgaggtaggatagaagctattttttttttccgtgtgagcagcagatttcatgtagcatttgagttgaataaactattgtacactgtaaagtcaaaagaaagaaagaaagtaccaacgtgttctccaatttcttctttcatttttgggatgatgaggcgggtggccggccatcagtggccgtgggagtgacacatcagcatacattttgataggcatataattcaatagggattttaccagatacgaatacttgtaacaacaaattttcctggagctgtatatgaacaacagcgaatgtgataatctttttttgt

SEQ ID NO: 9093 - DNA, 837 bp, Sorghum bicolor
  Clone ID: SORBI-28MAY03-CLUS7941_1
gcacgaggccaccgttacttgtgctcagccagcgcaatcccattcccatcggagaaagagaaaaccatcccatccgaatcggggtccccggtagatctgcactgcacgcccctgcaccagacggagcggagcgccgccggtctcttccggtcagcggccatggaccgcgacggccgcccggggtggctgccgtcgatgggcttcgcgttcctcagcttcaactgcgggatggccgtctaccgctcctgggacgacccctacaccgtcgctttcgtcctcgccgcctacgccgccctcgtcctcctcttccgctgcctccacctgctggagcgacgcagggaccaccgcctcaagctcgccgtctgggccctctccacgctccttacgctcatgttctcgtacaaggtcgccgccatgatgccgccctgggcacagctgctcgtctgggccctggggatcctcaccatcgtcgccggattctacgccttcttcgtcgcccgcccggaggagccctgacctcaccgatccctcccttcgtctccatggcaggcatcacatggatacttgatgagcattacagagaggacccttatgtatgtctttgcagcatgcgaagaagatacgtaacgagagggaaccttggcaagttgtgtgaaggttgtgggagcactcttgatgttgaaagggttggtttggttgtagaagtaataaaaaagtagggtttggcttgaactcgtgaacccccggaaagagattagctttttgttctgaaagcgcaggttattatgtaaaaacggtttgcttgcatctagaggtgaatgtttgagacctctgtac

SEQ ID NO: 9094 - DNA, 510 bp, Sorghum bicolor
  Clone ID: SORBI-28MAY03-CLUS79628_1
gagctgagctgcgcacgaggaatcgctcccactcccggctgtccggagagcgcagctcagccagccgactccactttcttggatgccgatggccgcggcgaaggcgttgagggaggtggcgaggacgaggagggggagctgggcggcggtggtcgggcgccggtgcttgtccagcgggagcggtgggccggcggcggagcggaaggagggaggaggaggaggagcgaaagcggtgaacctgttcacagccgtcaaccaggcgctccacatcgccctcgacaccgacccccgcgcttttgtcttcggagaggatgttggattcggcggcgtctttcgctgcaccacaggtctggctgatcggtttggcaagaacagagtattcaatacgccgctatgtgagcagggtattgctggatttgccattggcctagcagcaatgggtaatcgagctattgcagaaatccagtttgcagactatatctttccagcctttgatcagattgtcaatga

SEQ ID NO: 9095 - DNA, 697 bp, Sorghum bicolor
  Clone ID: SORBI-28MAY03-CLUS79633_1
accagccccctcccgacgcctccgcggcgacgcccccgccccgcccggacgcgcccgacacgcctccatctctctgcccgtcgcctcggggctcccgccggcggccgatccgaatgggggcgggaaccaatggcctgagcaacggcgcgtccgcggccgcaggggagcgcgcggacgacgggaccacggtgttccggggcacggcgtactcgccgctgcggaccacggtggcgctcgcgctgtggctcggggccatccacttcaacgccttcctcgtcctcgcctcgctcttcctcttcccgcgccgcgtcgccgcactggtgctggcgacgcagctcttcttcatgttcgtgccgctcaatgataagagcagattgggccgcaagatcgccaggttcataagcaagtacgtgattgggtattttcccgtcactttgcacgtggaggactacggcgcctttgattccaacagagcttacgtgttcggttacgagcctcattctgttctgcccatcgctgttgggatcctcggggaccttgttggattcatgccgctaccaaagatgaagattcttgcaagcagtgcggtgttctacaccccattcctaaggcaaatatggacgtggttggggttggctcctgcatcgagaaagagtttctactcctaccttggagctggttatagctgtattatagt

SEQ ID NO: 9096 - DNA, 645 bp, Sorghum bicolor
  Clone ID: SORBI-28MAY03-CLUS7960_1
aaaaatcccctccacctttccgctcgtggccgcgcgggcgtcatgcgaacgcaggcacctcgcctcgcccgccgagcgctgtccgtcgcggagcgcacgcgccgtctgccatccctccacacgccttggtggccgacagtccgccgtccgcctcaagaccggccgcctagcgccggccgccgtgaggcgagagcgccggtcgtcgtccgccgtgagccccgagtgcagtcgatccacgcctcggcccgagtgtcgttcgtcgtcctcgagagcgtcgtcctcgatctccgaccgcgacagctccgtccttgagcgccctccgcgacacagtcgtccttgatcgttactgtccttgtgtgccccttcatacgtccctgccaccgatgccaatgccatcggaagcgaagttccgcgcgtggggatcgggtgctccccgggttccgcctccgctcccccttggtggtggccgagcgctgcctcctgggccttgccatcccctccggggaggacgccgcggccctccgcggccgcctcggcgtcgccagggcatcccttcggtgttgcacacccatggcgctagcccgtccgcgtgccggggactgcggctgctggctcccggctgcgcgcgggttcttgcacattggc

SEQ ID NO: 9097 - DNA, 388 bp, Sorghum bicolor
  Clone ID: LIB3476-042-P1-K1-B2
gtcctcgagagcgtcgtcctcgatctccaaccgcgacagctccgtccttgagcgccctccgcggcagagtcgtcctcgttcgttaccgtccgcgcgagccccgtcctagagcgccgcccgtgactgctttgttcttggccgcaacaagcaccgtcgcgccggtcacgaccacctggaacctgaatatcaaggctaaggaactgccgaacgacctctccaagctgtacgcaacggcctctcgaactggtcaatgtcattcccttggtcccctctaatttcctgtgtctctgcatatttgttcagcaaatctctgctttattattgcttcatcttgttcctatgccttatttggaatagccactagcaatcttgctctgacaactggaca

SEQ ID NO: 9098 - DNA, 748 bp, Sorghum bicolor
  Clone ID: SORBI-28MAY03-CLUS7967_1
gcggtcctacccgggctacgccgacgaccccaccgtgcccaagggcagcgtcacgcccaccttcgccgccgccgcgctcttgatgggcaacgcgcgctgggacggcgtgccgttcctcatgaaggccggcaaggcgctgcacacacgacgcgcggagatccgggtgcagttccggcgcgtgccggggaacctgtaccggcggaacatcggcacggacctggacaaggcgaccaacgagctggtgcggacgcgtgggcccgacgaggccatctacctcaagatcaacaacaaggtgccggggctgggcatgcgcctcgaccgcagcaacctcaacctgctctactccgagcgctaccgccgcgagatcccggacgcgtacgagcgcctgctgctggacgccatggagggcgagcgccgcctcttcatccggagcgacgagctcgacgcagcctgggccatcttcacgcccgtgctcagggagctggaggacaggaaggtggcgccggagctctacccctacggcagcaggggccccgtcggcgcgcactacctcgccgccaactacaacgtcaggtggggagacatcaccagcgatgacgccgccttctagttccatccatttacgactccgagtacaagttgattttttttgttcgtgtacccaactagtaattggtccatcctgtaaattccaaagaacgcggtccatcgatttagcctggtcgcttggttgaaaaggcctgcctgg

SEQ ID NO: 9099 - DNA, 399 bp, Sorghum bicolor
  Clone ID: SORBI-28MAY03-CLUS7758_2
gtcttaataaaatctaacagtgggggcctcccctgctgtttttcctggttcaaaaaggacaaaactaaatcatcttacattttggaatggagataaatcttacagaatcaactgctgggacaaagcactaaatgttctatgcatgtcatttttccatttcagaaggagtacatccattacaagcagttaaaagggtggaaccatttggttgtgtacaaatctggcatacatggacttggtctctacacatcagtctttattccacgcggctctatggttgtagagtatgtgggtgaaattgttgggcaacgggttgctgacaaaagagagatcgaataccagtccgggaaacggcaacaatataagagtgcatgttatttctttaggattgacagggag

SEQ ID NO: 9100 - DNA, 944 bp, Sorghum bicolor
  Clone ID: SORBI-28MAY03-CLUS7758_1
gcacgagggtttgctgcaaagtgagcctgaaggtgagcacaatgaaaatgttggcttttatgggcgatgcatggatcacaccattgatttttctagtcacgttgatcctaagaaagaatacttgagaagcaacaattggacatgtgcacgtacagagggttttaaaggtcgaaagggagaaggcttttttgatagtagccgtaagaaatatgaagagtacagtggtgagttcagtgtttcccaagaacagataaatgcttggttacgcataaatggttcaaagccttgcggaagaggacagaaggagtacatccattacaagcagttaaaagggtggaaccatttggttgtgtacaaatctggcatacatggacttggtctctacacatcagtctttattccacgcggctctatggttgtagagtatgtgggtgaaattgttgggcaacgggttgctgacaaaagagagatcgaataccagtccgggaaacggcaacaatataagagtgcatgttatttctttaagattgacagggagcacattgttgatgccacccgcaaaggtgggattgcaagattcgtcaatcattcatgccagccaaactgcgttgcgaaaataatctctatcaggaatgaaaagaaggtaatgttctttgcagaacggcacataaacccaggggaggaaattacttacgattaccacttcaaccgggaagatgaaggccagaggatcccttgcttttgtagatcaagatactgcaggcggtacctcaattagttcccggtgtgccattgtggcgtaacatgtctatataacatttcttttcattgtttcggactgcagttcatgtctgctgtatataaactgtaggaatttgtatgtagaactgtgaagtcagatgttatgaagctgtatgtaagatccgtatagtcccatgtgacga

SEQ ID NO: 9101 - DNA, 994 bp, Sorghum bicolor
  Clone ID: SORBI-28MAY03-CLUS7782_1
ggtatttatcctgaggactacgagattgaaagggatcagctgatttacttgtgggtggcagaacgtattgtgacgagcaagtctcctatgcaagatgtaaaggatgtagcagagagctgtttcaatgaacttgtcaataggaacatgattcaaccagaatcctattactacagagtacatgatatgatgctcgatctaatcataaagaggtgcagagaaggtaattttgtaagtgttgtgcacagtgcacaggtggtggtagaacggcaagacagggttcatcgtctgtcagtcagcttgagtgatgttccagatgatgactccatatttcagctggccactaattgctgccgatcacaagttcgttctcttgtcttccttggagcatcaaaatggatgcctccactgttagagcttaagtctcttcgggtgcttttccttcaatttccgaagcacctgaagacaatggacctcacaggtgttggccaattgtctcaactgagatacttaaaggttaatgggatattctattcagatacttctattgtgctaccaagtgaaattggaaggatgcgacatttggagaggctggaaataccttatacatacatttgcagcactccatcagatattgttgacttgccacgcttgtcacatctcatcttgccagaggatacaagtttgctagacgggattgggaagatgaaatctctgcgtacgctgaggtcatttttattagcagagagctcaccagaggatattaagggcctcagcgaactcaacaagctggaagacttgcgggtgcggtgccgcggaggcagatacaaccgcgagcataggccgaaacgagccgatggtgatacgccgactgctatatggatggatgctctgattttttccctggagaaactaagtaacctcaaaagcttttgcctgtcatctgaatttactgctgtcaaagccgatgccctgctcttgctttcacctcctttcc

SEQ ID NO: 9102 - DNA, 742 bp, Sorghum bicolor
  unsure (1)..(742): unsure at all n locations
  Clone ID: SORBI-28MAY03-CLUS7761_1
gctctccaatctgcttttcttccaaagccttttaatcttttgtcactctgttgctaacacggtgaattgatttttagatcagccacagcagcctcccccccgctgcgccgcaggcgcccccccctcccccccgtgcccccccccccccccatggcccgatcccctccctggacgtccaatctcggccgcggccgcgagctatcgagcgccgtcgcaaccaccgccatgagcgtcgtcgcaaccgccaccacgagcgccgtcgcaaccgccgccacgagcacgttgtgaccgccgccacatccctggacgagatcgctgtcaggaccaccaccacctccctggacgagagcgcagtcgggaccaacgccacgagcgtccgaggccgccggtggcaaccgtggagttggggatgtgtgctgccctgctaaaagtttgaagaacatgatgttgtggtgttttttttgttagagtttgcactttgagtttctgttcaactgctccctatgcgattgttgtcttcttctcccctcccatcggcgggcggtcggccaacggccaggcgcagggtccggcgctggatgacctcgcctagctgctcgcgacgcgagccacccctacaccggcctctggcgccgctccagctccttctctcgccccccgctcctgccctagctcccggcgctggatgacctcgccaagctgtacacgacgctngcgactcctacaccggcctctggaactg

SEQ ID NO: 9103 - DNA, 1008 bp, Sorghum bicolor
  Clone ID: SORBI-28MAY03-CLUS78222_1
gcacgaggcaaccacactgctttcagcaacttagcggggatcgagaagtactacaaatctgttggtgttgacataaagctagatccgaacatgaaagtgccctgctcaattgtgcatgggaaccaggcatggacaggacatgtcttttcattcttgttgcaagcatatggaagagcagttcctgtatacgttccagtctacttagtccctgcacttggagttcataggcagcatctcctgaaaagggcttactcaattatcgggaagagttttctaggagtagcaagatctagtatgtttctctcagtatactgtgcatctgcatgggcttggacctgcctgctttttaggaccttccacagagccaatacccctcttgtcatccttggcacgtttccaacagggctggcgttgcttatcgagaagaagagcaggagaattgagatatccttgtattgtcttgccagagctatcgagagttttttcacatggatgaccgatgcaggactctgccctccaatactgcagataaagcgagccgatgtggttgtgttcagcatagctacctctatcattatgcactgctatgcgcaggaaagagaagtcttccggtccaagtacctgaatgtgctggactgggtatttggtgtgccaccaccacctgacagtgaggacaagaattgctatcgaccagatgaagccaagaaatgccagtgacatactggcttgtagagttcgttgcatgatttttgtctggtcatgtgatcctagcgcgagactatacccattagagggtttagtgaacaaaccttgtacaggactcttcgcgacaaatcgggacatagtggatatagcaaaatagatttattcaattgatttatcaaaacgatgccctggtcaattaaatggccatgtgtggttgtaacttatgaccttgatgtcatgatgtgtgaatgtaacttatggtctttgaaatcgttaaaatgaaattgtccattctattgtttc

SEQ ID NO: 9104 - DNA, 1313 bp, Sorghum bicolor
  Clone ID: SORBI-28MAY03-CLUS7824_1
gtctcggtctctcgctctccacgccggcgaccggagaaggggcagcgcgcgcaggcgacgcccacggcgacggagacggcgaatctgtggccctcgcgcgccggcttcggcccagccccgcggcgacgctccaggattgaagggggcatgagaaggtggacattgttgctctagtgatttgattaccggagatggtgttggtggcaaagcagcaccgctgcacacactctgcgagctgcgtttgcatcaagggccacctcagtgaggatgctctgtacctcgtcttcaagcacatgaactggaacccgaggctgattgctatcctgtcatgtgtgtgcaagtggtttgacgaggttgccaagcaggtgctgtggaaggagttctgtaatgcgagggctccgaagatgatgctggatttgcattcaggtggcagccacattgttgatgggaactggaaagcgctggggaagctgctcatctattgcaatggctgcacaaaagggggactgtttaataacatccatgttccaggccattttgtgttcaggacacgcttttctaggactgcaggcaggagtttcctgcctctgccatgcaagtctgacgtcctttatgtgtcagatccatgcgagcatcttgatcagggggaagaaggtgacttgggtttcttccgaggcatctttaagtcattcgccacttcaagggtaaagaagatgttgattgagaagcgggctaggtttcatccaacggagttgtgcccttattgtaaggccaagctatggaacatgttccaagaaaatatgattccaaggagtgcttccgctaggttgggtgcctatgatgattctgttgagtattttgtatgcctgaatggacatgttattggacttggtaccctgctaccactctcagactcagaggaggcagcagatgagtaatcatcaagaacgtgaatcaggtttggaagattgaagcccaggacttgtgaaatgatactgaatcttggctgacttgtgactagcagagagtgagatgacattggttcagcaaactgtggcacaacaagaatctgtgatgggctccgcattggactgcagctgtgttcttcagggggtgtcttgcatcagattggaaaaaaaaagaagagctattttatagtgtctctcctttatttattgatatgtcattacttgtttttgtaactggaatcaagacactagacgtcacctcgcttgcctgtttagacatgttcgtatcatgtgtagtgagatgttctatttagcgagacttgtgatgttaaatttatgctcatg

SEQ ID NO: 9105 - DNA, 631 bp, Sorghum bicolor
  Clone ID: SORBI-28MAY03-CLUS78260_1
agcaccaccgccaccgctgccccagactcgcccaaggcctcggcgtccacgactaccacggagggcgacgagtcggtacactccgccggctcgcctccttcctccctcccggcgttcttcccgccaccgccgccgccgcagcagcagcatcccgagatggcaagcctggacttcacggaggcgccgtgggacgagtccgccgccctgcacctcaacaagtatccgtcctgggagatcgactgggactccatcctctcgtgatcaagatgaacccaacaacaacaacaacaagcagatgctcaatcacgcgcgctgtaatttttgtcaatggatttaattaattaaccgtggccgctccggatccgatggaatattagacatcggccgtagcgactacgagtagggtttaaggagttcgtcggacgtagaggacagggtttaagctcatcaagattttccatttagtcgtcaatatcattgttaagattattcgttagtgtcgtcgagtgtctcctggttgcttggccggttgttttttctctcccggcaaaggccagttgagggtgtgagtgtaatggagtatcatgtaactactgttggctagtactgaattcgaatttgctagtcattc

SEQ ID NO: 9106 - DNA, 637 bp, Sorghum bicolor
  Clone ID: SORBI-28MAY03-CLUS80239_1
cgtgcgacgacggcgccgacgcgctcgccgccggcttcgacgacgcgctcgggtctctcctgtccagactcgcctccgacgacgacgaccaccgcctggacggcctgacctactccctcggcgacctagcccgccgcctcctgccgatctcggcccgcccgtcggcggcagggttcgccgacgtggacagcgcctgctgcggcggcggccggctcggggcgcagagcgtctgcgggcagccgaactcgacgctgtgtggcgaccgccggcgccacctcttctgggactacggccatcccacgcagcgcggcgccgagctcatcgtgtcggcgttctatgatggccccgagcagttcaccacgccggtcaacttcaagcagctcgtccgccgggcatgagtgtcaacagcagcaaaacacacacgagcgtgatgattagttagtagtttagtacgagtactttgttcatcgtctctctctctctctctccctatccttcaactctgacatgtgggtctacttgtcccgtaccctcctcccaaatcaatcataacttgaaagtgagacaacggagcatgcggtggcccgttaccactagtacatggatattgatgcctataattaagggggattccttt

SEQ ID NO: 9107 - DNA, 1749 bp, Sorghum bicolor
  Clone ID: SORBI-28MAY03-CLUS80396_1
aaaacccagggcctcaccagtcgccgccggccgccgcaaccacgcgccacgacgcgatggctcacctccggctcctcttctcctactcgcggcgccacccacagcaccaccgcctgctccctctcttccacttctcctccgacgccaactccagctccgccccgccgccgccaccgcccattaagcccgtctcctacgcgccgaagccgcagcagcaggccccgccccgcagccgccgatgccgccgcgggagtggacgcagcaggatatgcggtacgtgaaggacgcggggccgatgatctcgcccgtctcgtacccgtccagggtcgcgccgctgccggaggaccggccgctcggcggggtggcggggccgggcctcggccgggggctgcggcggctcgcggagcggacccagttgctcgccgcgcgggcctccccgtgctgctctggcttgcccctcgtgctggacctgctgccggccccgtcgctttccccggtcctcctgcggccgctggtcgtcgcctgtgtccccgtcggcgccctcccccctgtctagacgagtgcaaacgataagaagcggaattttattgaaactgttgaagctcatgtgatattaggtgttgatccacgtcgtggtgaccagatggttcgtggcgccttaacattgcctcatggcactggcaagactgttagggtagcagtatttgctgaaggtcctgcagcagatgaagctagagctgctggagcagatgtagttggtggcgacgagttgattgaggagatccgcacaggaggaggcaaactaagctttgacaagtgcatagcaaccccaatgttcatgccccgactttcaaaggttgctaggatattgggtccacgtggtttgatgcccaatcctaagctagggtctgtgacgaatgatgtctctggtgcggtcaaagcggcaaaatcagggcgtgtcgatttcaaaatcgataaaactgccatagtgcatgttggccttgggaaggtgaactttactgaggagagtttacgtgaaaatataggtgcttttgtgcatgcacttttacttgctaagccagtgggcctaaagaaaacttcaaaatatgtaggatatgtgaagaagttcacactgagtagcacaatgggacctggatttcctgttaccataccatcactatctgtggccgctgatcattataacaaggtgcaagttagctaagccaatacaataaagcatcgaatgtagctttctttctccaatagcggtgggctagatggcggcttgtttggcagtggagcgcaaccgataaccaggttgagttttggatggctgactgtttttgctgttggggataataactttgtggacatggatcattcagcaaacattatcgtctataagtttcttttgtccttgggtcactgcgattttgagattgctgttctgctccacttgtgtcatccagagtctcatttgttgtacgaaatgtaatattgaatttgttactaaaaagatggtagttttagagattcttatttttgataagaaatgaaggattgcaccatgcttctcaaagaatctggaatgtacacccacaagcgagaatgagctaactggcacaatgcactggagctattgttcagtttttattggcttccttttagagttatgtttgaggaatatgtttgctgtagctgaatgttgttcgagttatctcattgcgccgttccatgtgtggagaaaaa

SEQ ID NO: 9108 - DNA, 600 bp, Sorghum bicolor
  Clone ID: SORBI-28MAY03-CLUS80406_1
ctgccaaatgtgacacggagtcttgcatggcggtggggcttcctcctgtgcttcgcctggtgtctccgccaggaaatttcaaacagacattgaagctggccaggtgggcatcaacgtcccgattccagttcccctgccattcttctccttcacgggcagcaaagcttcattcgcaggagatttgaatttctacggcaaggctggcgtgcagtttttcacccagatcaagacgatcacgcagcagtggaaggagtcgccggcacagcgggtctccctctccatgcccacctcgcagaagtgagacatcaagcacccccaccccactctccgaagcttcactcctctggacatagacatagacccaatgcatggccccagttgtccaggggattggtaggcccggcagcactccatgcatggggtgctcgctctctcttttgtcggacaccatgcatgctcattcaaaacatccaagagcgctgctcattctgctctgtaaaagttatagaatactgtaaaagccccaggtctgtagatcgagtgtcatgtgtaaacccacaataagaggagaaataaaaatgccggctgtgctggtcctgg

SEQ ID NO: 9109 - DNA, 703 bp, Sorghum bicolor
  Clone ID: SORBI-28MAY03-CLUS8021_1
gccggccgggacccagccacccgtctcctgcaactcatttctcccgagccccgccgtgagcctccactcgccgccgccgccgttcgcccgttccagcttcgtccatggcttccctcaccggatccgctctctcctttgcgaggcccgtcaaggcaatcagcattaagtcttcctctttctctggtttaaggaaggataatgtagccttccgcctgcagccagtgccacaaagattcgcagtctgctgtcctgctaaaaaggagaccgtggatgaggtttgtaagattgtcaagaagcagcttgcacttgctgagggcactgatgtttgtggctcctctaagtttcaagaacttggtgctgattcattggacactgttgagattgttatgggccttgaggaggctttcaagatcactgtggaggagtcaagcgcacagtcaatcgcaactgtggaagatgctgctaatctcattgacgaacttgttgcggcagaagcagcaaaagcaaaataattgcattaaactcatggtcgcagtgctttgggtgcttaccctgctcctgtaccagcgcatcccttcttgttctatgcccctcttgttctaccctccttccctttttctaccctggagagctgtttctttgtcatgactgtcattgtggatctcgcggtactattatcatattgaagattctgtgcttgtcc

SEQ ID NO: 9110 - DNA, 661 bp, Sorghum bicolor
  Clone ID: SORBI-28MAY03-CLUS80510_1
acctgcccgccatttgccatggcctcgtcctctctcttccccgcgccgcgccccctcccctccccgcgccgccccgccggccccccccccgccgcccccgcgcgcgccgccccctcccccgctcgcgccccctgccccccgcggcgcgcgccgcccgcgcggccgcccgcccgccgctccgcccgctggccgcgcggcggccccggcgccccccgtgcgcccgccttgggccggtgggcggcccgggcccggcgccgcccccgagccgccgccctcccgcgcagcgccaacgcgccgcccgcgcgccccccccgcccccccgcccccgacggccccgcgtggtcgctgcgggggggtctcgccagggtcctgccaaaggtccgccctgggctcctgcttttcaccgggctttttctgggcgtggccgcggcggtggcccacctcagtcccccttctgtcaccggtctgacagagataccacagggtgcccctctcgtccgcttctcacctgctcccctcgtcggctctgcgttggcaaagcgttggcccattttcagaatatgaaagagctgggttttgtgttctccgcgctttcctacaataacctcttccgcctctgtgccgcctgagggcggcccgtcggggtccccatggtgatggc

SEQ ID NO: 9111 - DNA, 879 bp, Sorghum bicolor
  Clone ID: SORBI-28MAY03-CLUS78726_1
agagagtcgctgagccctattttacagctagccccccggcccatccagatccagggacccagcagttgattcgcccggccacatcgcccgagcccgctaaacccaaactcgtcctcatcgctccggcgcggcgacgaggcacccggccgccgcgcgatggccgacggcgccagcagcagcggcggggcacagaacgggggtgagtcggtggtgactgactacggccggcgccgcacaacctgtggctactgccgatcctccgggcctgcgcgcggctcccacggtatgtgggctaacagtctgaaagctgatgactatcaagctcttcttgatcgtggttggaggagatctggttgttttctttacaaacctgagatggaacggacatgctgtccctcatatacgatacgcttgaaggcaaatgatttcatttgttccaaagagcaaggtcgtgtacttaaaaagatgcaaaggttccttgatggtgaccttgatccacatattggaagtccccagtgtaaggcaagcccaacaaagcgctcacttggtgaacctctgaattcaccaacctcgaaagtatcaaaggtatcagcaaaagagtttcgagcaggcatgggtccaaatatatcgaaagaagacgacgtcacttgttgcctggcaagcaaaatcaatgaggccgcagatacatgcttccaagggggggtatttggttcagttcaactccccaaagctattgtgaagactgttaaacctcaagtcaaaaggaaagtaggagaatcagtgcaagaaaagaaagtcggagaagcagtgcaagatttggtttatacgtgcaacataagtttccaaatagtggcagcagttcgacgtgcattgcctaaa

SEQ ID NO: 9112 - DNA, 619 bp, Sorghum bicolor
  Clone ID: SORBI-28MAY03-CLUS79069_1
ctgggctcgcttcttcttccccctgccctgtttccgaggaacggcggccgccgagaacaatcgccggccggccaccaagaacaatcctccagccagccttactgtagtgtagattttgtttactgactgaactcgagcgtcgcgtcctccgcccgccggctccgtcctgcgaccagacgccatgtcgtcgtctctagtgtccaccccattcgccgccgcggcgcagaagcagctcctggcggcgcccgtgccgctgcactcgttcctcctgagcagccggcgccagccggggcgtcgtggcggtgccggcgccatccggtgcgcggtcgccggcggcaacggcctgttcacgcagaccaagcccgaggtgcggcgcgtggtgccgaccgacccgcggggcctgccgcgggtcaaggtcgtctacgtcgtgctggaggcgcagtaccagtcgtccgtcacggccgccgtgcagcagctcaacgccgacccgcgccgcgccgcggcgttcgaggtcgtgggatacctcgtcgaggagctccgcgacgaggacacctacgccaccttctgcgccgacctcgccgacgccaacgtcttcatcggctccctcatcttcgtcgag

SEQ ID NO: 9113 - DNA, 663 bp, Sorghum bicolor
  Clone ID: SORBI-28MAY03-CLUS787_1
cgagcatgatggggggaaccaataagccacccttcttcccagccgtatatcaggccaccgtcgccatgctggcttccatgaagcccgccgatgccgtcctcctccaaccgccggaaatcgccaccttcaggctgcgggtctccgagtcccatcgtggctcgctgtcctcgacccccctcgtcgcgtgcgccgacaagggcctgctcgtcatctacggtggccgctacttcggcccgggctcgtccttgtgcggatgctacctcgtctacgacgccgtcgcctccgccgatcgcctctccacggtgcccccggcccccgacgcgggctgccacatcaacgggatcgggtcgggagccgttgtcctgcgctgccaccaacctggcccttcctcctccgccgcctacctcctcgccgagctcgccacctcggcgcagcgcaaattccccgaccccgatgatggtgtcctcttcctgtggcgctccgacgaacaacccacaccccggtgggccaggaaggaggttcatctcccccgtgaggtgtgctgggcgcccgacaagcacgtattctacagcgacacctccttctccgggcccggcggctgcctgtgctgggtggatctgctccgaggtatcgtcgtctgcaccaacccttgggggccggagg

SEQ ID NO: 9114 - DNA, 268 bp, Sorghum bicolor
  Clone ID: LIB3476-047-P1-K1-G1
tagatctagacatttcccccctcccttcctctctccccaatctccccttgtcctgcgctggcaccaacctggcccttactcctatggcggctacctactcgccgagctcgccacctaggcgcagcgcaaattccccgaccccgatgatggtgtcctcttactgtggcgctccgacgaacaacccacaccccggtgggccaggaaggaggttgatctcccccgtgaggtgtgctgggcgcccgacaagcacgtattctacagcgacacc

SEQ ID NO: 9115 - DNA, 660 bp, Sorghum bicolor
  Clone ID: SORBI-28MAY03-CLUS7907_1
gagatgacttctaatgcctatcgcaaaaccagtgtcagtccatcagctacgatgctgaaagctctgcctgtgcggttcctcgcctcgccggagcccggtgggttgagccggcgactaccacgacggtcgctgcggttgatttcggcagcgctcatgaccaaccccgcttacttcgaggtgggcagattcttgggtgcccatggcttcatgaacatcacaagttactcatcatctcaatttggagagccttcaaatgttgctggtattcaagaccttggtcttggatattcaccagaagagattgatcagttaaggatccaagatatcggagaaggagaagtcacgattagactttacgagggaagagttgttcaaggtccattgaggggcacacaggctgtatttaaggatttgacgtataccctggaagccgtgctggtgcttctgaagctgatttgatggcactgaatgagttaaggactcatgcttttcttcagagtgatgctagtgacatctgcgcgaacattcagtttcttttaggggcctttgagacagcaactggagaacagtggcttgccttccgcgatgatgggagatatagtgctgcagactatgcgaaagtagctagcgcaaggcaattgaaggagcaatctgggggga

SEQ ID NO: 9116 - DNA, 551 bp, Sorghum bicolor
  Clone ID: SORBI-28MAY03-CLUS79137_1
cagtcaagcataaggatggtgtcctacgcattgctgaggatgatctaatggaagaccctggagttctggatgcggtagatgaagagacagaatttccagctctagtggaggaggaggaggcccttcttgaaacagtacttggtgaaaggtgatggatgccatggaccagggagggggttcctacttgtataggaagaggaggatgaggagactctgattgtagtccactcagccaagaagtagaatagaatgaatgaagctggcgatagatactagtaccagttggttttgaacaagggttgcatttgtaattgtaagcagctgcaccctgcaaagtgtatattccttggaatggattagatgtgcagcaaagcaaagcgcataaaattgagctaactagcctaggatggacaatgcagttgatcagttgattgtctgctgctgctgttaatctctgtctgtgtaaactaggtagtatagatagctcaatgggacgatcaaagccatttatgctgtgcttatgtgttgaattaataaatgaaaaccccccc

SEQ ID NO: 9117 - DNA, 902 bp, Sorghum bicolor
  Clone ID: SORBI-28MAY03-CLUS8153_1
aagcagtgaaaatattagagaaaaggttaatatagaccagaataggggcaatgttgagaaggtctttttgaatagttatattcgaactgacaaatctcatggttttcgagctttggttgtaatggaggatcattcactcttgttaattcaacaaggtgaggttgtttggagtagagaggatgggctggcttcaattgttgatgtaacaacatcagaattgcctgttgagaaggatggtgtatcagttgctgatgtggaacacaatctctttgagtggcttaagggacacatgctgaaactcaaaggaactctaatgcttgctaatgctgatgaagttgctgcaatccaagcattgagactaaaaagctctgagaaaaataagatgacaagagaccataatggatttcgcaaactacttgttgtattgacaaaggctggcaaagtgatggctctgcacactggagatggacgcgttatctggtcaaacttgctgtcatctcttcgtgcctccagatttggtggaatgccttctgcattaaggatataccaatggcaggtcccgcatcacagtgtgatgcgtgaaaacccatctgtacttgttgttggcaaatctggagcagaatcttcaactcctggtgtattctctattcttgattcatattctggagaagaactgaactctatgaaacttgaccattctgttgtccaaattatccccttgacactgaaggattcatcagagcagcgacttcatctgattgttgattccaattccaatgctcatttatatccgaaatctccagatgccctcaatgtatttcttcatgaaatgtcaaacctgtatttctactctgtagatattcaggcaaatgttattaaagggtattcattacagaagtcat

SEQ ID NO: 9118 - DNA, 699 bp, Sorghum bicolor
  Clone ID: SORBI-28MAY03-CLUS81698_1
agggcgccatgccatgcgttcacggactgcaagctcgatctgcccctgttgcgtgtcggtccacgcatgcgtgtaaccaccgcaatcggccacactatatagagctcaggggagcagcagtgctgggacaccggacgggctccattatccacagcagcagctcaatcaatcagtccgagaggcagcctattcttgccaatcccagagtcgagcaatctagctagcatcatccatggcgccggcgtccttgttgttgacgcgagtggcggcggcgacggtggccgtggcgtgcgtggtggcgctcggcgccatggcgcagcagctgtcgccgacgttctacgacgcgagctgccccaacctgcagagcatcgtgcgctccggcatggccgccgccgtgcagcaggagccccggatgggggcctccatcctccgcctcttcttccacgactgcttcgtccaggggtgcgacgcgtccgtgctcctcgacgactcggcgacgctgacgggggagaagaacgcggcgcccaacgccaactcgctgcggggcttcgaggtcatcgacgccatcaagtcccaggtggaggccgcctgccccggcaccgtctcctgcgccgacatcctcgccctcgccgcgcgcgacggcgtcaacctgctgagcgggccgacatgggcggtgcagctagggcggcgggacacgcg

SEQ ID NO: 9119 - DNA, 656 bp, Sorghum bicolor
  Clone ID: SORBI-28MAY03-CLUS8172_1
gtggcacgaggcaagtccgacgcgctccgctccccctttccctttccgaagcttctcgacccccctccacctccctcacatggccgacaacgcgaaggccgaggcggcgcgggcgaggccggagtcctcgcaggaggaggaggaggactggaaggaggccgagggggacgtcgccgaagtcgaccgtgccgccaccaatggcgccgtgcccacggacaggccgatccgggtctacgccgacggcatctacgacctcttccacttcggccacgccaagtcgctggagcaggccaagaagctgtttccaaacacatatcttcttgttggatgctgcaatgatgagttgacacacaaattcaaaggaagaactgtaatgactgaggatgagcgatatgagtcacttcgtcattgcaagtgggttgatgaagtaattccagatgctccatgggtggtgacagaagagttcttggataagcataacattgattttgttgctcatgattctctgccgtatgctgatgctagtggagctggtaaagatgtttatgaacatgtaaaaaaacttggtaagtttaaggagactcagcgcactgatgggatatcaacatcggatattataatgcggattgttaaagattataatgagtatgttatgc

SEQ ID NO: 9120 - DNA, 1188 bp, Sorghum bicolor
  Clone ID: SORBI-28MAY03-CLUS81740_1
tactgcttatatccacacattctcactccctttcctccattattcgattcctgtatctttcctttgaatttctacaatccaaatggggccttggcttcgggtgaagctaaaatgatttacaatttggaacggagtaagcacagcagagaaagaaatccagtagaattggactgggagcattgatgcagttgcgcttgttcattcatatgataatgaaagatctggtggacatcagaagacaaaactatcagctcttaatgttcctcctatggggcttctttacccaagggttcttgttccagaagagtaccctccacctcctcgatcttggttccaagactatgatgacatgttggaggatacctggcaaacaagtgatggtctttaccctagtgggaatggtggatttggcatgtgggacagttatccagtgttttccactagattaaagaaatttgagaacattggcctcgtagaggccatcattagtagcgttctttcaacaggacgtgttgaccttcaaaggaagctgttctgtagcattcagctggttggtggtgcagcttctacagctggccttgcacaagtgctggagcaaagggttcgcactaaaatttcagcaaaccaatctattgagaaagttgaggtgttgcaatctaggacttatccattatttgttccatggaaaggtggagtgattttgggtgtccttgatattggtagggatgcatggattcatagagaagactggattaaaaatggtgtccacatcgggagtggcagaaaatataaggattcctattttcttcaggcgcaagtaatgtgctactacaatatatgacaggttgttcgactgcaaaccatcttagaacatgatcggtggactgcgattaacttgcgtacacgatgcatcagtttcattggtgctggctgctgtatttttgggttcggaggtcggtcatcaacccgagacctggactaagggctggttgttcgctcaagcactttgatgtttctgttagaagtaccccagtcttctggcgttctaaagatgtactggtactcaaatttctccagtaatttaattcctcgccaatgaaacatttgagatcttgtatggtgttccctattgactttgatttgatgttggggttcatagtttaattccaatgataataaatatataaa

SEQ ID NO: 9121 - DNA, 718 bp, Sorghum bicolor
  Clone ID: SORBI-28MAY03-CLUS82013_1
gagcctagggctggacgaggcgcacttccagcgggcgttcggcggggcggactgcggcgcgacgctgcgcgccaactactacccgcggtgcccgcagccggacctgacgctgggcctctccgcgcactcggacccgggcgccctcaccgtcctcctcgccgacgagaacgtccgcggcctgcaggtccgccgcggcgacgacggcgagtgggtcaccgtgcagcccgtccgcgacgccttcatcgtcaacgtcggcgaccaagtccagatactgagcaactccgtgtacaagagcgtggagcaccgggtggtcgtgaacgccgaggaggagcgcatatccctcgcgctcttctacaaccccaagggcgacgtccccatctccccggcgccagggctggtcaccgccgggaacctgccggcgctctacccgccgatgaccttcgacgagtacaggctctacatcaggaataagggcgccaggggcaaggcgcagatcgaggctctcaagggccaggcatcgccagaaaaataattagaatagccaccacctgtctactacgtacagtacagtactagctgattaataaacaactgcatgtgtatcctaatgcatggcaattgttaatcgatctggaagttagttggcctactatctgattgtaataacacatgtgtacaaccaacttattactactacctttggtactacttactattt

SEQ ID NO: 9122 - DNA, 1106 bp, Sorghum bicolor
  Clone ID: SORBI-28MAY03-CLUS8200_1
gcacgagggagagtcttccatattgtcctgcacatggtaggcaccctaataaaccgatgtaatgccggctgtatctcgttatatgttagtggtcataatgaggttgaagagaggcataatcatgactggatgctgcgaagagcaaacttctctggaggctatgtatgtgtcaaatttgagattagggttagaaaatccaaggacaatcttttgagttcatcaagcagtgagataaggcatgggtccaaacccaacaattctgagatggggcttagcttcaatatgtgtaaagaagattgtgcaggtgatgcatggtaacatttcgtctctagcagtttctaaatgcattggagaaaccatcatgcttgtcctccagttccagttgcaacctgtgactccagtctctggagcgtcctcagatttgtaccgatcgtccgccattcccaactttaatgggctcagagtcctccttgcggacagtgatgacaccaaccgagctgtaactcacaggcttctggagaagcttggttgccgagtcctttcagtcgcttctggtgtccaatgcatgagctcctttgctgccgagtcatccttccagctggtgattcttgatcttgccatgcagacgatggacggattcgaagtagcccgcgcgatcaggaagttcagtagcaatagttggctgccgttgattgttgccctagcagcaagaatcgacgacaacatccgggatcgatgccagaggtcaggaataaatggcctgatccagaaaccagtcacactagctgcactgggagatgaactgtatagagtccttcagaacaattaaaagagcctgatgcatggttctcatttctttcaatctcaatagattgctgtagcttgatcggtagtcactctgctactagtttctgccaggttagatccatacaatcacaaaacatttggttggggcaaaaggaaaatgtataggaagctgaaagcatccgctttttgcttggttcctcggtgaaggacgacgacagaaaggtacaaaattttggagagatgatactgttagaacttagactcattcattgtaaaccctcagataagccaaatttaga

SEQ ID NO: 9123 - DNA, 762 bp, Sorghum bicolor
  Clone ID: SORBI-28MAY03-CLUS79702_1
ttcggcacgaggaaggaagagacctgcgttgcgccgctggtctcccatccatccattttgttttgtccgctagcttcttcacctgtcgttccagtaggagtcttgcttatttacccctcctcctccacaacgtccagtccagatcatccgagctagctagagagcaaaacggaataatctattcccggtgatagattaaacaaaacaaagtatcttctctgtctgcgtgcggtgtgccggccatttccacctgttcgttcgcccggctcctcctcctcctcttctggttctagttcgtcgccggcccttgcgccgcagcagagagagggagattcatggagctggggagcgccgtttcggcgcacagatgtagcagctactacacggcgacctacacccactgttccataggcttctccccacgggtccgcgccaccagctgctggatccgcgcggcggctgagggcgacgacggcggggcagaccgccgacggagaggcgccagcttcgccgccgatgggcccagggtcgtcgaggtcaccgctgcccccgtggccactagcggaggcggcgccggcggagcagccgggagcgcggcggggttcggagcgcgggacgccgagctcgccatgtgggacaagctcggggccgtcgtcaggctcagctatggcattgggatctacggggccatggcgctcaccgggagattcatatgccaaatggccgggatagactgcacggggggcttccatccatctctca

SEQ ID NO: 9124 - DNA, 783 bp, Sorghum bicolor
  Clone ID: SORBI-28MAY03-CLUS79839_1
ggcaaaaattagaatcacatacaacactgggaaatgagctcgtgccaaccactgggaaatgagctcgtgtcaagcataaaagtgacaaaaagttaaatatccccacacggtaaacaccacgaacgacccaaacgaccgcacggccgcacccagagagcccagacgcgccaagccgctaaccaaaggccacgccaaagaggaccaggccgccgtccatgtcgtccgccgcggcgccagatccagaccagccgccgcgccccgtgcgcttcggcatccttggctgcgcctccatcgcgcgcaagcttgcgcgcgccatgctgctcgcgcccggcgcagccgtcgccgccgtcgggagccgctccgaggagaaggcccgcctcttcgccgccgacaacggcctcgacgtcgcggccacccttctccacggctcctacgaggcgctcctcgacgacccggacgtggacgccgtctacctcccgctccccaccagcctccacgtgcgctgggccaccgccgccgccgcgaggggcaagcacgtgctcctagagaagcccaccgcgctgtgcgccgccgacctcgacgccatcctcgccgcctgcgacgccgcgggggtccagttcatggactccaccatgtggatgcaccacccgcgcaccgccaggatgcgggacaccgtcgacgacaaggacgccattggggacatcgcaacggtgagctgtgtgctcaccttccggccagaccttgccctcctccagaatgacatcagagtaaagccagatcttg

SEQ ID NO: 9125 - DNA, 665 bp, Sorghum bicolor
  Clone ID: SORBI-28MAY03-CLUS79916_1
tatctctatggcaagcttgcagagcacacaggtcattctgttgagaagatccatgaggacctctctagggtgaagcgcttcgacgctgaaggggctctcgaatatgggattattgaccgtattatcaggccttctaggatcaagaaagagggctccactgcccaaaggagggatatgcgaaatctgggacttggctaatagatgctatcctattgtatcagttttttgtgtgctggactgcgctactccaaacttcaacttgcagtttcagactctaggacttaaataatagataacacgataagcaggaaggctggatgaagtagggtgtagcagctcttccttccatttcatcatatgtatcgagaaatgcagaacatcggacttgatggtgcgacgtgcgagaatgtcgttgttggagggcaatgtaactgttcgaagttctacgcgtaggtgttttgttggtgtgcagtgtttagtacgcttttgctaactgtcagtattatattgctggtgtttgttgatgaacccagcaaagaaaaagaccggagggccctagcctttaggcgtctcgtgcgctacttttgtaccatcaatcaggtgcccatgttttggatggagactacagttacatgcaggagtaccactactttctctttccaggt

SEQ ID NO: 9126 - DNA, 1412 bp, Sorghum bicolor
  Clone ID: SORBI-28MAY03-CLUS79966_1
agaaccaactcgatcgatcgtcgagcaaagcagctagcctagctagtaccatcgtttgcgagtgtgatcgagctactagctgcagagtgatcggaacgttgtctgagtaggtatagaatggcgcggcgacagttgatcagcggcggcctcgcagtcgcggtggtcgccgtgctgtcgtcggtgctgatctgctcggcgcacccggtgccgggcggacacggcggcgggttcccgccggcgctgctgcagccgcacttctacgaccacgcgtgcccgcagatgcaggccatcgtgggctccatcgtggcgaaggcgcacgcggaggacccgcgcatggcggcgtcgctgctccggatgcacttccacgactgcttcgtgcagggctgcgacgcctccgtgctgctggacgccgacggcagcggcaggttcgtcaccgagaagcgctccaaccccaacaaggactccctccgcggcttcgaggtcatcgacgagatcaaggccgcgctggagcacgcctgcccgcacaccgtctcctgcgccgacatcgtcgccgtcgccgccagggactccgtcgtcctgaccggcggacctggctgggaggtgccactggggaggagggactcgctgacggcgagcctgagcggctcgaacaacctcatccctgcgcccaacgactcgctccccaccatcatcggcaagttcgccaaccagggcctcgacgtcgtcgacctcgtggcgctctcaggagggcacaccatcggcgactcgcggtgcgtgagcttccggcagcggctgtacgggcagaacaacaacgggcaggtggaccggacgctgaacccggcgtacgcggctgagctgcgggggcggtgcccgcggtccggcggcgaccagaacctgttcgcgctggaccaggcgacgcagttccggttcgacaacctgtactaccacaacatcctggccatgaacgggctgctcagctccgacgagatcctgctcacgcagagccgcgagaccatggagctcgtccaccgctacgccgccgaccagggcctcttcttcgaccacttcgccaagtccatggtcaagatgggcaacatctcgccgctcaccgggaccgccggcgagatcaggcacaactgcaggagggtcaaccacttctaattctaaggaggatgcatatatatatgtatgtatatatatatacctgcgcctgctgcttggctggccacatatctgtggtgctttatgctttgacgatttcattctgggtgcgtgcttcgtgtttcatacttgggttttaagtgtgcagtagtcgtaaatgattgaaatttctgtttgagtttggtgccgctcgatcttaagttgatttttcactccatgtaatttgcaattcgtgtacgaagtaaggttcc

SEQ ID NO: 9127 - DNA, 610 bp, Sorghum bicolor
  Clone ID: SORBI-28MAY03-CLUS82315_1
caaggttgcgcaggacatcgccgtggaatgggagaagcaaacctccacaatatgatgatgatgacgacgacgacgataatgatgatgatgatggatgcccatcaacttaccgattgatgacctctcatgcatgcatggacctgcgaacttcagatatctcgtcatcaagcatgcttgtccagcaaaagtgcaaaacttgacatgaatttggccaagagttgtccaagcacaaacagattcagagacagatcatcttggagcagacaagttcagggaaaccatccacaataaaccaagaaacagaggagaagcacagcagcggatccagactccggaggttccgaaaactggagagcgagaacctcatggtcatggtcatggatgcttgggcaatcgcaacaaggccggattgagcgcgtcatgtgtagagcccagattttgctgtacccttgggcccttatatatgtacagagtgttgttattattatgtagtaaagttgtgtatagtagtagtacctctagtggttggtagaatgttagcgttgacatgcatgtgtaccatcttgatgtttatgtatggagttgacaatgagaatgacctattctattt

SEQ ID NO: 9128 - DNA, 673 bp, Sorghum bicolor
  Clone ID: SORBI-28MAY03-CLUS82154_1
aaagaggagagaaaattgagccacaaaaacttgaaatatctgaagccaaagatgacaagaaacaggactcgaaagatgatcaaagtgtacaggaagaatacataaaggcttattatgaggccttgaggaaaaagcaggaagaggaagaagcaaaaaggagaatgcagcaggaaggcaagatttctgtcccagattctcaaactgaacgccaagtgggcaagaaatacaagcgggacgatgatgatgaaggtattgaatgggaagagcatcaacctacagggaatgcaaccgaaacatacaaattggcagatttgaatgcggaggcccaagaatctggcgatgaggaagatgataatgagtgggaggagggttaatgcttgaaagataacaggcgacccctgctccctcagaaattttgaactggtatcccaccagaggtcgaaaatatttcactggcctgattatgtcgcacgcatgatcaagagaaacttgtccaaatgaaaagccagctcctatatttttttttagttgaagatgtacaaaatatacttaaacatttgagcagagggtgaacatttttcccctgttattttgaagagctgttgtagtcttgtagactattattgtgcatctgtttgtctgaaaggaattacagagttcaacttttacacgt

SEQ ID NO: 9129 - DNA, 634 bp, Sorghum bicolor
  Clone ID: SORBI-28MAY03-CLUS82382_1
aaggtcaaatctcgtagaagccccccgaggcgaggagaaaaaaaacgaaggtccgtcgagtaagactctcctccctgaggctgggatcccggcggccggcgccgcgacgctgttcggcagccatggactccgggacaggaagctccgctgatcatattcgtgacgcgtctctacctggttgcgcccgtaacgggtccaaggcgtccaggtcgctggtggcggtggcgcagacaaggcgttcgacgaagtgcgtccgtggttcggaggcaccaaggcttgacgaggcgccgggtccgcagcaccggccttgggcggacctcccaccagacatccacggcgtcgtggccggtcgcctcgccctcttggaggaccgcgccaggctgcgctccgtctgccgagggtggcgtgctgcagcgcgcatccaccggcggctgccgccgtgcccgcccctgctggtgctgtcagacttctcgttcttcagcttccgttccgaagggaccctgatgggtgcgtgtcgccgcgtcccactgccgggaagggagacagcggggtctggcaacgtccgctgcgtgggctcgttcgaggggtgcctcgtgggcgtgaagaacaacaaaagtcgttactttggcgacct

SEQ ID NO: 9130 - DNA, 691 bp, Sorghum bicolor
  Clone ID: SORBI-28MAY03-CLUS82388_1
atattgtacgcagcgcagaggtccaccaaggatggcgcccaaggttcagaaccggtgcccgagtccgacggccgtgctcctgctgggcgcctgcctcgccgccgcggtggcagcgctcggtgccgcagaccacgacgccacggccagcaggccgccgccggtgccgctgcctggccacggaggcgcccggcgcgtcctcgtcgccaacgggctcgggctgacgccgcagatggggtggaacagctggaaccatttccagtgcaacatcaacgaggcggtcgtccggcgcaccgctgatgcgctcgtcgccaccggacttgcaaaggctggctacaagtacgtcaacttagacgactgctgggcggattaccaaagaaacaaagagggatacatggtcgctaatcccaagacattcccgtccggaatcaaggccctggcagattatgttcacagcaaggggcttaagcttggcatctactcttcagctgggacaagaacttgcagcaacaggatgcccggatctctgggccacgaggacaaggatgctaaaacgtttgcgtcatggggtgttgactacttgaagtatgacaactgctacagagacggcactcctgaaaccgtgaggtttgggcgcatgtctcgcgcgctgaagaactctggccgcccaatcttctactcactttgcgaatgg

SEQ ID NO: 9131 - DNA, 665 bp, Sorghum bicolor
  unsure (1)..(665): unsure at all n locations
  Clone ID: SORBI-28MAY03-CLUS82418_1
accaacccattgcatctccctcctccctccctctcactctctttgtttcgccgcccatccgtctctctcatctcatctcatacatactccaatactccatcaatccatccatcacacaccaccagtgatcgatcactcgacccataatcgatggcggcggcagcagcagcagcagacgcatcatcagcagaagcgccgccgtcgccgccggcggcgagccgggtggtgtgggtgaacgggccgatcgtggtgggcgcggggccagcgggtctctcagtggcggcgtgcctgcgcgcgcgcggggttccctgcgtcgtgcttgaccgcgccgactgcatcgcgtcgctgtggcagcgccgcacctacgaccggctccgcctccacctgcctcgccacttctgcgagctccctggcttgccgttccccgacaactacccggagtaccccaccaagcgccagttcgtcgactacctcaacgcctacgcggagcaagcgggcgtccagccgaggttcaaccaggccgtcacgtcggcgcgctacgacgccgccgcggggttctggagggtgcgcgccgacgacgtcgtcctcgccgaggacgccgccgccgtcgccgccggcgctacgacgacngagtacatcggccgctggctcgtcgtcgccacggg

SEQ ID NO: 9132 - DNA, 557 bp, Sorghum bicolor
  Clone ID: SORBI-28MAY03-CLUS8244_1
atgaccttgacaaaagcaatgctcagaccttccaactagagagaaccgctgattcacgggttgtcaacatggttcagcttgacttctcctcaaaccatgggaacttggaacttacatgcatctatcgcttcagggtgcatggcagagagcctggctcactcaacactggagcctgatctgagacatgcataccaaagcgtgacaagattcttgcagcatttctgctgatatgagctttggttcagtgtttcgtggtagtcggagcacatcaagccccctaccacagacagttcttgaacaggaggaagaatgaatggaataagatgaggcaaacgaatgttcaggtcatgacaagggaccagcgccagtgcaccagtattgactatgttcttttcaaaaaaaaaaaagtattggtaatgttggttttattctgttgcacattgttatgaacagctccgacatgtgtaccttgttggatttcttttgttcggctgttcatagtttggcttcaaatttgactgtgtttgcatctcaaaaaaaaaaaaaaaaaaaaaaaa

SEQ ID NO: 9133 - DNA, 581 bp, Sorghum bicolor
  Clone ID: SORBI-28MAY03-CLUS80604_1
gcagaggattcagttgtctggaaaaaagggaggagcccgtgttctgtctgtctcctcgccctcctctcgctctccgacgactcgtgggccgccgtcgccaccgccgccgccgccctaagccaggtgctgaggctttcgttggtctcttcgccggcaacgagcacccaccaggatgaattctaagcgtaggaggagtcatagcccagttgaatacaaggaaggtcgtgacaaagataatgatacttctggaaggaaggataactcaagagatctagatgacacatgtgatgctagaagaggtcatgaatcgggtaggcactctgataagcattcctatggaacatcacgtgaatccaagaggcatgatgactataggaggtaccatgataagtacgttgatgattatggtaggaaccatccaagagcctctcggtcagaccgggaatcaagggctgatacttattatgatcgctcaaaacatgatagcacatctggtagatcacgtggtgaccatcgagatgttggcagatacggagaaaaatctgtcaatcgagatcaaaggagtataattgaaggaaagc

SEQ ID NO: 9134 - DNA, 797 bp, Sorghum bicolor
  Clone ID: SORBI-28MAY03-CLUS80717_1
gcacgaggcttttggataattatgttcagaggggtcctagattagtggatgcccaagcaagatctttgctgattcattcaaagcgatcaaaaaggcacatgtctctgaaacaacataagaaatgtggttcatttgatttagatggtacattccacaagtatgacttctataaaccaatgcatgagatgtggaaggattatatcagagagcttatgaaagtaaccccgaaaaagaaattgtctgaaaacctcctttcagcagatcttcacggggcccttctaatagtggcagaatgcaaagctgcttcatatcaaggtgtaaacggcatcatgattcgggatactgcagagacatttggaattatatccgaggacaaccgcttccgagttgtaccaaaagctggttcagttttcatacttcaagcagactgctggaaagtcacactgatcggcgacaagctctcgcccagggagaagttgaaggaggaccagcgtcaacaccgtgcacaatcgcaaatcagatagtttccaatgtgccaactgttttgtcacagaatttttgtcccaggaacatttgcttttgtttaggtcctgccacttaagcatggcatttttattctctctctagaggctctgacatttcctagcgactgactgacagcttgagatgtaaagggtgaccgacattactaatctcaggtgtgtgaccatgagtccggtaatccggtgactgattattgattagggccgtcccaatgccgggtttctagttgtagtttccaagagaaaaaatgaaca

SEQ ID NO: 9135 - DNA, 679 bp, Sorghum bicolor
  Clone ID: SORBI-28MAY03-CLUS80826_1
gcacgaggattccattgccgcttttcgctgcggtgtattgtgtcctctgggcttatgcagctggtgcaggcttcgccttccttcagtactgcaacctcaactccttgagaacaaagttcatactcagcatctcgatattcctgggactgtccatcccacagtacttccggatctacgagatgttcttcggcttcggaccagttcacacccattcagtcgcgttcaatgtgatggtcaatgtcatcttctcgtcgccggcgacggtggccgccatactggcctactttctggacgtcacccacctgtactgggaggctagtgtgaagaaggacaggggttggttctggtgggagaagttcaagaactacaagtatgatgccaggagcgaggagttctaccgtcttccttatggcttgagcaggtacttcccctcgctttaggatgccgagaggaagatgacagaccaagttctatgtaactggtggagcgtagaagatgaacactagttcaaggcaatagaaccatatgttattatcaagcagttgggaaggagcttgatgttttgatttaccttataaagcattttggatgataaacttttgtaattactgggagagtaggatggtatcgccatcaaccagggggagaattctgcaataattcagtcaccattttgctc

SEQ ID NO: 9136 - DNA, 673 bp, Sorghum bicolor
  Clone ID: SORBI-28MAY03-CLUS81174_1
agcgcttgtcctgcgcggcgcacggaagcccacctccatccgccgcagcaccgcacccgcgtgcgtcggctgcttgctttgctgcccgcccccgccgacaccgagcgccgccactcccaccgcagccatggcggccccgccccgcgccaccgcggtcctcgcgtggggttccggggaggacggacagctgggcatgggagggaacgaggagaaggactgggcccactgcgtggaggcgctggccccctacgccgtcaccgccgtcgtcgccggcagccgcaactccctcgccatctgcgacgacggccgcctcttcacttgggggtggaaccagcgcggcacgctcgggcacccgccggagaccaagacggagagctccccgggccccgtcaacgacctcgcgggtgtcaagatcgtccaggcggcgattggcgggtggcattgcctcgcagttgacgacaaggggcgcgcctacgcctggggggggaacgagtacgggcagtgcggtgaggagccccagaggacggaggacgggacgagggcgctctggagggacatcccgaccccaaggcgctgcgcgcccaagctcaaagtccggcaagtagctgctggagggacacattcagtggttttgactcaagaaggtcacgtctggtcatggggacagccatgg

SEQ ID NO: 9137 - DNA, 1136 bp, Sorghum bicolor
  Clone ID: SORBI-28MAY03-CLUS81298_1
acatccagctccagggtaagctttctcttgtcaccggctgagcaaggagaggcaagagaccgggagcaacagctgcgagatggccgcggcggagacctcgggcacggcgatagggacctcggggagatgggcactgcacggcaagacagccctcgtcaccggcggcacccgcggcatcgggcgtgcggtagttgaggagctggctgcgctgggggcggccgtgcacacatgctcccgaaaggcggaggagctcggcgagcgcatcaaggagtgggaggccaggggattccgcgttacgggctccgtttgcgacctctccgagagggaccagcgggagcggctgctccgcgaggtcggcaaccgcttcggcggcaagctcaacatcctcgtaaacaatgtaggaacaaacataaggaaaccaactactgaatttactgcagaggaatactcgtttgtgatggctactaatcttgaatctgcatatcacttgtgccaaattgcacatcctcttttgaaattatctgggtcaggcagcattatattcatatcatctgtttgtggaatggtgggtgtctttagtggaactatatatgctatgactaaaggtgccattaaccagctaaccaagaacatagcatgtgaatgggcaaaggacaacataagagccaactctgttgctccgtggtacatcaccacttcacttacggaaagacttttggcaaataaggatttcgaggaacaagttgtgagtcgaactccacttggacgtgttggagaacctgaagaaatatcggcacttgttgcttttctttgcatgccaggtcccacttatattaccggccagacgattgccgttgatggaggtatgactgtgaacgggttttacccaaccaagccctaggcggaagctgccatgtctggatcgtttctgcggatatgctgatttgtgttctgtggcagaaaaagtacggttgattgtggcttataagttaaagcgattcttggaagttggggggaaaaaggctaataagatgtacgtaaaggtgagcttatgttggatattgttcattacatgtttacgtaattctgtcagagccatgtgaagaatgttgagtttagatctgaccagtttctgc

SEQ ID NO: 9138 - DNA, 736 bp, Sorghum bicolor
  Clone ID: SORBI-28MAY03-CLUS8_1
ggctatggaagaagaaaggatgtggaattgctatttccttccacttctcccactcaaactgtatcagtgtggactgttgatggaatcctttctcatgcccaatcaaaacattcaaatcccaaggtcgagaagtatggtaaaatcaccaaacttgagctgaaattaggtggtgacaaggctgttggtagaaagaactaccttgctgcatcaaagctctacactcaagcaattgagctggatcctgatgacgcaacattgtattcaaacaggagcctttgccagctacaaattggtgaggcaaacaaggctttgcttgatgccaacagttgcataaagatacggcctgaatggttgaaaggttactaccggaaaggtgttgctctcatgtcactcaaggagtacaaagaagcatgtgatgctttcttggctggactgaagttggaccctacaaatgttgatatggagaggatgttcatggaggcaattgaggccatgaagaaggaccatgttactacatagaccactaccatcaattagaggaactggcaggacttgtggactctatgctgccattttgtatatatatgtgtagcacaactatatgtagaaagttgtgcggactaacgctattacacggatttgtctaaaaccgtggtagaggtgcactattttgtgaactttatttctcaaaccaagcaccccctttaacttccaagtccaaatggtcccccttttc

SEQ ID NO: 9139 - DNA, 777 bp, Sorghum bicolor
  Clone ID: SORBI-28MAY03-CLUS82723_1
tactggaaaaaaaaaaaaaccaccccccaacgctcagtccaacgccaagcgcgcctggaccgtgaaccgagcaactcaaaccatggacgtgccgctgccgctgctgctgggctccctggccgtctccgtcgtggtgtggtgcctcctgctccgccgcggcggggacgggaaggggaaggggaagcggccgctgccgcccggtcctcggggctggccggtgctgggcaacctgccgcaggtgggctctcatccgcaccacaccatgtgcgcgcttgcgaaagagtacggcccgctgttccggctccggttcggcagcgccgaggtggtggtggccgcgtccgcgcgcgtggcggcgcagttcctgcgcgcccacgacgccaacttcagcaaccgcccgccaaactccggcgccgagcacgtggcgtacaactaccaggacctggcattcgcgccctacggctcccggtggcgcgcgctgcggaagctgtgcgcgctccacctcttctccgccaaggccctggacgacctccgcggcgtcagggagggcgaggtggcgctcatggtcaggcagctcgcccggcaccagcaccagcacgccggcgtgccgctgggccaggtggccaacgtctgcgcgaccaacacgctggcccgggccacggtggggcggcgcgtgttcgccgtggacggccgcctcgacctcttcacggcggggacggacacgacgtccagcacggtggagtgggcgctggccgagctgatccggcacccggatgtgct

SEQ ID NO: 9140 - DNA, 793 bp, Sorghum bicolor
  Clone ID: SORBI-28MAY03-CLUS82820_1
cagcctccactaccagatggttactttggtaatgtcatcttcactgcgacaccacttgctgaggcgggcaaggtgaccagtgggctggcagaaggagcagcagtcatccagggagcactggataggatggacaacgactactgccgctcagcgctggactacctggagctgcaaccggatttgtcagcactggtgcgtggagcacataccttccggtgcccgaacctagggctcaccagctgggtacgccttcctatccatgatgccgacttcggatggggccgtcctgtgttcatggggccaggcggtattgcatatgaaggtctggcgtttgtcctcccaagtgcaaatggagatggcagcctgtccattgctatctctttgcaggctgagcacatggagaagttccggaagctaatctgcgaagtttaaacagaatgtcagcgccgactattgaaggatggtgttatagggcaagaggctttatgttgtacccaaattctcccagataaaatactgaagtttcaagtgaacccagtggctgcactttcacttttgaagacttgcagagtaaattcatggccacttacttttgtgcccctttgggggatgtttttggcaaatctataattgtacgggttaccaatagacgttgttttaggggaaagatcaattatagagaaagggtagacattttctgtgaagaaacatagtaaaactcattgtaaggaacaagctccaatagcaaactcgatgtggggttacttgatcatggaataatttatcagtacaa

SEQ ID NO: 9141 - DNA, 819 bp, Sorghum bicolor
  Clone ID: SORBI-28MAY03-CLUS82920_1
gcacgagggagaggagcaggggaggcagtccagtgcccacgctccacagaagagagagatggcgatgcggatggtggcgacggcggcagcagtggcgctggtggcggtgatgtgcgtgctggcgccccgagcggcggcgcagacgacgccgaactgcgcggcgaagctggtcccgtgctcgccgtacatcaacacgacggggacgccgccggacacctgctgcagcccgctcaaggacgccgtccagaacgacctcaagtgcctctgcgatctctacgccacgccggagatcttcaaggccttcaacatcagcatcgaggcggccctcggcgtctccaagcgctgcggcctcgacgacaccaccaccgcctgcaagggactttctcctacacagtctcctccaggttcaccatcaggtggcagtggcagtggcagcaacgccggtcatcgcactctatctgtcggtttcccaggattgatgagcttgttcttggctttgtggtctgcattggcataaagtctagcacgctgcagacctgcagtggacaactcttgtcttatcccgcggtagatgatttgcacctacaatgttttgagatggtgatgctaggctgtatgtattccgacacaattaaacatttgttttgctgtgtattgatgtggtcagccagtagaatggtgtatctgaatcagaatttgttttgctgctgtgtattcatatatggtcagccagtagagtggtgtatctgaatcagaatttctcattggtttcttcatggtgttgtattagactcttgcacaattaaatgaaaggttctt

SEQ ID NO: 9142 - DNA, 598 bp, Sorghum bicolor
  Clone ID: SORBI-28MAY03-CLUS830_1
ccccgcaggtagtgaaagcagatgaactgagagatgatgaggcatacgatgacattgtggaggacatgagggaagaagggcacaaatatggtaaactgcacgagacccatctacttctcttaccctcttgttttaaaagcttacattctgctgttatcattatgattgatacagttactgaaatgttttccctttgtgtttttgtcttttgtgtgtcttttttgtagtcccacataatgccattgcagagtgttttatagtccgaccctatgcaatattggcaatcgggccttaacccacagaagacactatgcttttgagtttgattaatcattatattattagcctcttgtctatatatgtactcactaacacttggacaggtaacttggtgaaagttgtaattccacggcctgaccccagcggtgctcctgttgctggtgttggaaaggtgttcttggaatatgcagatgtggagggctcgaccaaagcaaagacggggatgcatgggcggaaattcgacggaaaccaggtggtggccgtgttctaccctgaggacaagtttgctgctgagcagtacgactgaaagttgtagaat

SEQ ID NO: 9143 - DNA, 885 bp, Sorghum bicolor
  unsure (1)..(885): unsure at all n locations
  Clone ID: SORBI-28MAY03-CLUS831_1
gcacgaggacgcgtcacacctaccgtgcctggtgccttctgacctgagcccagacgccgcccctttccttttcggggtctcctcggtgaactagatcggatggacccgccgccggcgaggcgggcggcgtccaagcggcgggaccgccgacggcgcctgcggcagcggcaggctgcagccacggcaacggatgccggtgcggtcgtgctggccgtggagccgcagagcgcagcggtcacagccccggtgactccggccggtgctgcttccacgccggcggcgacggcgaggggcaggaaccggagaaggcctcggagacggcgtcatcggagcgccggaccggcagcggcggcggacgaagcaccggctgcgtcccccgttgtagatgccatttcaattcaagaagatcctgccccacaagcaagttgcgctttggaagcaacggcagcacatctgagcgatattgtgctgcaaactacgactgagaagataatgagctcagataaaacaagaaagagaaattttcaggctggaagtaaggcgctaaaagattctgcggctgatggtgctgcttgctcttctcttgcccgccctgaacattctatcagagaaaatgaagcctcaaggagcaagatatttaagagatcagatgtaagattcccgattgatagttgcactgcacaaggaactgatatggattatcacaagatgaagagtgctgatttgccagggaacctggaaaaagtataccagaaaagaacatgtnctggccacctctctttgcagaaatcggaagaatatagggaaaatgaaaatgtaccttcttttaacttcaacagcttacagggagggaaaaagagaagggaaaaaaaaaagaagggggaa

SEQ ID NO: 9144 - DNA, 772 bp, Sorghum bicolor
  Clone ID: SORBI-28MAY03-CLUS83183_1
gcacgaggattactactactttcaaagctagctgttcatcgctatccgggtccggcgggctccgccgggggtgcgcgcggcggtgggcgggcgaggcgcttgtccactgctgcgctgcacgccctcgggcgccggcctgcgccgccccccgccgccgcggttcccttactactactttcaaagctagctgttcatcgatatcagggttcagggggatccatcggagttgcacgctgcttttatctgaagaagatgttgttcagagcagtgcagcacgccctcaggcagggaaacagccgagctggggcgccggtggtggccctgctgcccggcgtcggcgtcgccgccggccacttctccacggccactactacagctgatgactcacagaggctggccggtaaggtggccctgatcacgggcgccgcgagtggcatcggtgcggcgacggcgcgggagttcgtccgcgccggcgccaaggtggtcctagcggacgtccaggacgaccagggccgggcgctagccgcggagctaggcgcctcctacacccgctgcgacgtcacggacgaggcccaggtgtcggccgccgtggacctgtccgtggcgcggcacggcgcgctggacgtcgccttctggaacgccggggtcgtgggttccctgtcgcgtccggcgctgggcgcgctggacctcgccgacttcgaccgcgtcatggcgatcaacgcgcggggcgtgggggccggggtcaagcacgccgccagagtcatggcgcctc

SEQ ID NO: 9145 - DNA, 658 bp, Sorghum bicolor
  Clone ID: SORBI-28MAY03-CLUS82098_1
ctcgaagccatccagaaccaaggggcacaccacaccacagactcaggcctcagctcatctctcttcaagaactcgaggtctaatcgtcccagctgcgggcggcgccacgccaggggaggaagggccagcagccagacacacacagatggcgagctgcatgcaggagtggccggagcccgtcgtccgcgtgcaggcgctcgccgagagcggcctgtccgtcatcccgcgctgctacgtcaagccgccgtgcgaccgccccgtcgtcgtggccccggcggcgccaacggcagtcaaggagacgaattcgaataaggcggccgaggcctcggacatcagcattccggtcgtcgacctcggcgagctgctgctgcaggcgaaggacgccggcgccggcggccttgtcgggaacgtcgtcaccgaggccgtcgcgtccgcgtgccgcgagtggggattctttcaggtggtcaaccacggggtgcgccccgagctgatgcgcgcggcgcgggagtcctggcgcggcttcttccgccgcccgctcgcggagaagcagcgctacgccaactcgccgcgcacgtacgagggctacggcagccgcctcggcgtccagaagggcgccgtcctcgactggggcgactacttcttcctccacctcgcgccg

SEQ ID NO: 9146 - DNA, 801 bp, Sorghum bicolor
  Clone ID: SORBI-28MAY03-CLUS8211_1
ctgttctgttgcagaggagaggctgggacgcatcatactgtaaaaggggtggactgcagtgtacaacagttggggaagagccagtaaatctgttctacatgttcaaagatttgtcagctgtgaatgtgaaggcaacttcgctgaacctcttacatgatgaccctgaaatgctaggttaccttgaacagatcggtgatgttgctcaggagggaaacgttcttatctcaccaatggagattcaggcatacaagttagacctacaaccaccatcaacacaggaagagtagtttgccaaaacagtacatgcatacagtcctacaagacagtgaagatggatcttccctaaatacttgatagtggcagctacattgtactggaacagctgtgctgcatgtatatgtgtcattctcttggcatacggttagtgattgaacctctcgaagttgcagctgaggcatttgattgcaactttgtcatccacgaaggtgcatacacttattgttcttagttttggggcacattgaagcagagctaatttgaataccgtagactagtgtgttcacacaattactgtgttgctccggccaatgctaacacaatgataacttgtatcagagcaagttttgtattattctgttttgcttgcatcctttttgtagtgccatcatcctgctggcaaaaacctgagatagtttaggtacatggttcttgctttcgagatctttatattgtatgtacagaattctgcttctaagcatgcgcgtattgctggcaatgctttgcccgagttctttttcgcgg

SEQ ID NO: 9147 - DNA, 791 bp, Sorghum bicolor
  unsure (1)..(791): unsure at all n locations
  Clone ID: SORBI-28MAY03-CLUS8204_1
gccggccgggttccgatcggccgatctccccatccctctcctcccctcttcgtcgatcgatcccaccaccgcgccgaccccgatggcctccgccgcctcatcggccgccggcgctggcaaatcgctgttccaggggctccgcaggttcctcaagaagccatgggagatcacggggccctgcgcctcgcccgagtaccgcagcgcgctgcctgacgcgctcgagtaccgcgtcaagtgcccggccaccgtgcgcgacgaccgcgacaaggccatcgtgcccacatccgacccggagacagtctacgacatcaagtacttcacccgcgaccgccgccggaaccgcccgcccgtgcggcgcaccctgctccgcaagcccgagctcgagcgctacatggccaccaagcagttcgaccccaccaaggacttccccgtgccgtacgtcaacaccaccgtcgaggaggacgacaacacgatcggcggtggctaccagaagtgactcaggaaagcttgctgatttgatgctggttaatttgtcaggcatcctttgcttggactccgtcagaagctgcactattttgattccagctattaaatatccctttttcttttattccaagtggaagtttactggttgtaaaagatgatggtggcaataatatggcacttgtggagctcacagagatctcatatcttgtaacttgtattctgaaactgtctacctgatacaaatgattctgtttgatgcaaaatttaagatttctatttcaaaaaaaaaaaaaaaaggcccctan

SEQ ID NO: 9148 - DNA, 481 bp, Sorghum bicolor
  unsure (1)..(481): unsure at all n locations
  Clone ID: LIB3476-045-P1-K1-E11
gtaaatataaaggcgcagtagggtnggggtcgatctatcgagatgtcgtggagcgagaacgagaacagcaggttcgagctggcgctggcggatatcgaagaagacaatccggggcgacaaggccatcgtgcccacatncgacccggagacagtctacgacatcaagtacttcacccgcgaccgccgccggaactcgccgcccgtgcggcgcaccctgctncgcaagcccgagctcgagcgctacatggccaccaagcagttcgaccccaccaaggacttccccgtgccgtacgtcaacaccaccgtcgaggaggacgacaacacgatcggcggtggctaccagaagtgactcangaaagcttgctgatttgatgctggttaatttgtcaggcatnctttgcttggactccgtcagaagctgcactattttgattccagctattaaatatccctttttcttttattccaagtggaagtttac

SEQ ID NO: 9149 - DNA, 776 bp, Sorghum bicolor
  Clone ID: SORBI-28MAY03-CLUS82308_1
cgggccggcgggacggcaccgtgtcgctggcgtccaacacgggcacgctgccgtcgccgttcgccgggttcgcgggcctgctgtcgagcttcgccaaccgcgggctcaacctgacggacctcgtcgcgctgtcgggcgcgcacaccatcggcgtggccagctgctcccgcgtcgccccgcgcctgtaccaggggaacgccaccgccgtcgacccgctcctcgactccgcctacgccaagacgctcatgtcgtcgtgccccaacccgtcccccgccgccgccaccgtcggcctcgacggcggatcgccgttcaagttcgacagcgggtactacgccagggtgcagcagaaccaggggacgctggcctccgacgccgcgctggcgcagaacgccgcggcggcgcagatggtggccgacctcaccaaccccatcaagttctacgccgccttctccatgtccatgaagaagatgggacgcgtcgaggtgctcaccggcaccaatggacagatcaggaagcagtgccgccaggtcaacacctcctgacgacctgatcctgatcctgatcctgatcgggctacgctcgcgctcactcatcaggccatgaatgattcgtcttcatttttcaaatgccttgcctacctgcctgatattagggttggcgcgcatcaatatattgaggcctgtcctcgcaaaatctattggtttgttattactcatgtgttcggcgattgtcttgtcttacaaccaaaaaagaaaaatgtaagatggctcgctgct

SEQ ID NO: 9150 - DNA, 761 bp, Sorghum bicolor
  Clone ID: SORBI-28MAY03-CLUS83813_1
gcacgagggcgcttcgctcgcccctcaaatccaccgcggactcgagctttgctcggaggagacgagacgacccaagacttgctcagctcccccctttgcttcctgcgcaatccctgcggcagcgccttttctttcattcaatggacagcgactacgttgccagcctgctcatgggctcatccgcccatgcgctcgacttcgccgcgctggacaccgggttcctcgacacgctctgcggcggcgccggcctctttggggtgcccggggtcgccgcggggactgggtgtggcagcggcggcggcggcgggtccccggaggggtcctcggtgtccgacccggcgtgggcgcgcgccagcgacggcggcaatgccaggaagcgcaaggcgccgcccacggggtccgccggcgggaaggagacctgcttgggcaaggctgcggaggccaaggttccggacgggaagaggtgcagagtgggcgctagcgacagtccggtgaagcccaaggtagaggaggcggcggcgagcgacgcctcggttgaagtcaaagggcagaagaagggcaaggggaagagcccgaagccggcagtcgaaccacccaaagactacgtccatgtccgggcacggcgaggtcaggcaactgacagccacagccttgcagagagggttagaagagagaagattagccagaggatgaagtttctacaggacctagtgccaggatgcaacaaggtggttggcaaggcactcatgctcgatgagatc

SEQ ID NO: 9151 - DNA, 1021 bp, Sorghum bicolor
  Clone ID: SORBI-28MAY03-CLUS83853_1
caagatgaagccctacatcccggacttcaagctggcgttcgagcacttctgcatccacgcgggcgggcgcgcggtgatcgacgagctggagaagaacctgcagctgagccccgcccacgtggaggcgtcccggatgacgctccaccggttcggcaacacctccagcagctccatctggtacgagctcgcctacatggaggccaaaggccgcgtccgccgcggccaccgcatctggcagatcgccttcggcagcgggttcaagtgcaacagcgccgtgtggcacgccctgcgcaacgtcaagccgtcgcccgacaacccctgggaggactgcattgaccgctacccggtggagctcgtcgacggcttccccacgcacaagccgcagcaatagtccctagaagtatcagctctctcctgtatcccaacccgcctcccctcctctcctctccacacatccatccatccatggacacagaaatcttagcctcaaatcctcatctggctcatctagctggctactagtgacatatacaccgggcgagggcgggtctgctttccctggacatgaatgattgcattggaagaatctctaggctttccctgcacaggtctgctctgctctgttcagttctgtaaccaagtgttcggcagcattcggtctttggtgtgtacttcatggatcattcggtccgagagtccgagcgagagcatggtccccctcccccagcttgtggctgcacctgaacctgaacctgagggtaagttttgagtagtgctgatgattgttatatgaacatttgtctgttcaaccattgctgccagcagccgattgtcatttaccggcactctgtagtggtccaggctctagattacaggggaagggccgctccttcctttcatttctaccaaaaaggtcatgttgatgacgaggaaggagtgtcttgtgtgtgccgattgacggatcgatcgagtctctgtttgtcgtgttcaattggaaatcttgcccttgctcttatttact

SEQ ID NO: 9152 - DNA, 614 bp, Sorghum bicolor
  Clone ID: SORBI-28MAY03-CLUS8389_1
gcacgaggctcagttttccaaggagaagcttgacaaacttatttctgaaggcccacgcgtccgtgacgttatacgttttcattactatgttcagtaccatctatatatacaattatcagaggcagcaacatatgcaagaaagaaaaaggttatcctgaaaggtgatttacctattggtgttgataggaatagtgtcgatacttgggtatacccgaccttgtttcgcatgaataccgctactggagcaccccctgattattttgacaagaatggacaaaattggggttttcctacatataactgggaggagatgtctaaggataattatgggtggtggcgaggtcgtctgacacagatggcaaagtacttcacagcatacaggatagaccacatcttgggtttctttaggatatgggagcttccagatcatgctgcaacaggtttagttgggaaatttagaccttccattcctcttagtcaggaggagcttttaagtgaaggtctatgggatttttaatcgaatgagccaaccatacattcgtcaggaaattctagaggagaagtttggatccttttggacagtcattgcagccaattttctaaatgagtatcat

SEQ ID NO: 9153 - DNA, 625 bp, Sorghum bicolor
  Clone ID: SORBI-28MAY03-CLUS8413_1
cccacgcgtccgcccacgcgtccgcccacgcgtccggctcccccacctccgctgccgccgccgcggcggcatctcccggcgtcgcccgcagcgggggcctcctgcgccgctcgcgcccagtccccggcgtcgtgaggtgtaaaaagattgattctctgagggcaatcaatggagcactgccttgtattccggtgtccgacaggtcgctactgactcctgtaaacttgccggttttccgggatccaaacatgaggaacgacacgaggctgcgcatcttctcaggcacagccaatccttccctttctcaggaaatagcaagttacttggggctagaacttgggaagattaacataaagaggttcgctgatggtgaaatatatgttcagttgcaagaaagtgtacggggctgtgatgttttccttgtgcaaccgtcgtgccctccagcaaatgaaaatcttatggaacttctgatcatgattgatgcctgtaggagagcatcagctaagaatattactgcagttatcccttattttggttatgcaagggctgacaggaagtctcagggccgggaatctatagctgcaaagcttgtagctaatatgattaccgaagctggtgctaaccg

SEQ ID NO: 9154 - DNA, 643 bp, Sorghum bicolor
  Clone ID: SORBI-28MAY03-CLUS84265_1
gcacgagggaacagccctccctgtgactctgcgagcgagcgagcgcgcacacacacagactgagcggcggcggcagaggacagcgcgaggggagaaagagagagagagagagagagagagagagagagagagagagagagggggttggatcggctgccggacgactcgaccggccggcccgggaagtaagggaagggaagggaaaggatcgatggatcggctgccggagtcgacccggggcagcacgatgcgcaagtacgcgtcggaagccggcgggctgcgcgcggcgcggcagggcccgcacgggcggtcgctgacggcgcgcacggcgcacaacatgtcggcggcggcgctgcgcaagaagtcggacgcgtcgctggtgcgcaaggtgccgttcgcgccgctccgcccggtgctcgccaacctgcaggaggtcttcctcggcaccaagctcgccgtgctcttccccgccgtgccgctcgccatcgccgcccagtgcgccaactttggccaggtgtgggtgtttgcgctcagcttactcggcctcattccactcgccgagcgtgtcagcttcctcaccgagcagatcgcaatatacaccggtcccactgtgggcggcctcctgaacgcgacgtgcggcaac

SEQ ID NO: 9155 - DNA, 674 bp, Sorghum bicolor
  Clone ID: SORBI-28MAY03-CLUS976_1
cggacgcgtgggaactctggagaggagaaaatggtcctgagctaaagcatgggttccagaagcaatttagaaacattagtgcaattatggactgtgttggatgcgagaagtgccgtctgtggggaaagctccaagttcttggtcttggaactgcactgaaaattcttttctccgttgatggagacagccatttgaatcagccattgcagctgcagcgaaatgaggtcattgcagaaaacaatcttctgaacaaactctcagagtctgtcaaatttgtacatgaaaatcaatcatcaattgctgaagtcattgttaaactggtcccttcctcttttcaaagagttgaatctgtgcccactcggacactggagtagattaacagatgttggactgatgttttgaaagataaacatacatgcgaagctgtttccatgggcatgagctcgtattacctgttgtagctaactctacccaaaatgtaaattagtcttagattatccaggggtggctaggacctctcttcggtgagctcctggcaaatcaggggatggcgttccttgcgccaaacttgtacagaattttctccagcgggttctggcaggccggtaacggccctgtcgagtgttcctcccctctagagcatcggtcgctctgaccctgtcgggctcgctctc

SEQ ID NO: 9156 - DNA, 1040 bp, Sorghum bicolor
  Clone ID: SORBI-28MAY03-CLUS115211_1
cgaaaacctcatcctagtcgttcatattctgggattctttggcattatgatcccattgacatacatgtcggaccataagacaaaggaagaggtctttactcagttcctcaacgggggtaactttgccagtcaaggtctttcttggtttgtgggcatgactgggtgtgtgtttgccttcgcgggaggtgatgctgcagtacacatggctgaggaggttgccaatgcctcacgagccattcctcgcgctatcatgctcagtgttgcgatcaatggaagtctcggatttggcatgttgatcgcaatgctattctgtagcggcaatatcgacgatgcattgagcactccaaccggctatccttatatcgagattttccaccaagcaacaggctccgtaccaggagccttggctatgctttccataaacctcatcatcggagggttttcggtcattggcatgcttgctgcaacatctcgccaattctggtcctttgcacgtgatcgtggtgtacctggctggcgatggtggagtcgggtctcctcaagacatctcccaacctattcggtctatttgactatgactgtcgcctggcttcttggccttatcaacatcgggtcggccgttgctttgaacgatatcacctcgatggctgtgtctggcctgtatacttcctatctcattgtcgcagtgctgcttctataccggcgttgtcggggagacattgctgcatatgacgagaacgccgaaactgtcatcaatgtccccggcgcaccacttgtctggggaccgttccgcgtgccgggcatctggggcatattggtgaatatctacgcgtgcatctatatggtcatcgtcattttcttcagtttctggcctccggagatgaacccaagcctcgcggatatgaacttcagcgtagtagggactgtgggcgttgtggtcttggcaattgcatactatcttctacgggctcggcatgtaacaagggtcccgtcaggaggttgggtggtaattagatgtgggatagctaaaggtggattac

SEQ ID NO: 9157 - DNA, 598 bp, Sorghum bicolor
  Clone ID: SORBI-28MAY03-CLUS11540_1
cctactgggaccacaacaaaccgctaagcaagcacgagagagaaaacaatcacaatgacctcacacgtcaacaggtcgctgccttttctcatcgccccgtcggaggccacgcccgccggcgccctccccctcaccgccatggacagagctcttgcttcccttcctatgacagcgctgttcgtcttcgagaaccccatcgatcagccagccgaaaccatagcgagagctctgtcccgtgcgcttgttccctactacccaatggccggccgcctcaccatcaccggcgaccagctgaaaatcgcgtgcaccggcgagggcgtcgcgttcgctggcgcgtccgcgagctgcaccctgcaggaggccgggctctccggcccgcgtccggtgatcaccgtcgaggacctcactatgaactacgccggccagtacagcacggaggaaccgccgttgttgctggtgcaggtgaccgagttctcctgcggtggcttcgccgtcggggtgacgtggaaccacgtcgtcaccgacggcgccgggatggcgcagttcttgcaggccgtcggcgagtttgcccgcgggttcccttcttccccttctgtct

SEQ ID NO: 9158 - DNA, 991 bp, Sorghum bicolor
  unsure (1)..(991): unsure at all n locations
  Clone ID: SORBI-28MAY03-CLUS11550_1
gccatgtcgagttcctcaggagcgctagacaacttggtgacttcctacttgtgggtgtctatgacgaccagtctatcagggatagaagaggctgtcgtcctataatgcatctccatgagcgtactcttagtgttctttcctgccgctatgttgatgaagtcattattggtgcgccatgggaagtttctaaggacatgatcactacgtttaacatttcattggttgtccatgggactgtagctgagggcaattcagctggtgaaattgatccttatgctgttccaaagagcatgggcatttttcagacaatcaggagcccaaaatctataacaacattgtcagtggcgacaagaatagttgacaatcatgaagcttacaagaagaggaacttgaaaaagaaggctagtgaagaccggtactacacacaaaagaaatttgtttctggagactagtgctgcacatatttctgccagtagtcttaggaaatgcatgcgccaccctgtgttgatgttattctacagcagagactggaacagataatcagcaatagaaaggtcacaacgatagattgacagccaagcaatggtggggattgtctggatggaccaagctaggagagaaaaaaaactgtcacattcttctgctgtcgcccttttaggaacgctcacatgacatgaagagttcacataaatgattctttttttgactttgttatccctggagcctggaggggatatatatatatatatgtagctgaaggccttcagcaaatcattgttgtatacttgtgtgttagtgattagcattgcatactccctgattgtaccatggtatattgaatgtttatactgctgaaaaaaaaaggaccttgtgatggtcagatgtttaatttattttttgacagtcttgttttgtgttaatccctaatgttcgtcnaaaaaaaaaaaaaaaaaaaaaaaaaaaaaaaaaaaaataaaanaaaaaaaataaa

SEQ ID NO: 9159 - DNA, 811 bp, Sorghum bicolor
  Clone ID: SORBI-28MAY03-CLUS115602_1
gcacgagggccgcccgccgccaccgggctcaccgtctacctctccggcggtcagggccaggtggtgggcggcaccgtcgccggaccgctcctcgcctccggccctgtcgtgatcgtcgccgcctgcttcggcaacgccgcctacgagcgcctccccctcgacgacgacgagccgccgcagcagcagctcctgcaacaggctcttcctcctccgcaaggcatggccggtgcctcctcctcctcgccgcccccgccgctgtcattgcccggacaacacccgctcgccgaccagctcccccacagcctcatgaacggcctccctctccccgccgacgcctacgcctgggccaacccgggaggcagcggcgccggccgcgtcgccccgtactgatcgatcgaccgatcggtcgatcaccgtaccggacttctgatccggacggacatggaaggaaggggaacgacgaacaagcgcgcgcgtgctctagctttctgctgcttcatcatcgccatcgaccgatcgacgacgacggcggcggcggcggcgacgacgacgacgacgacgaggcggctgctgctaagagtcaatccacctcccgatccccttcccttttcggcatcatctttctctgctaattaccttttcttggacttcttgggtcgttgctgttaattccctggtgtaatgaatctgcatgccatggatgcttaattagtttacctccgtagtagtgtaattccgttccccctgatagcagtagcagtgcttggatcggaattcggaaccctgtgtcagtcttcggttaaactgtttc

SEQ ID NO: 9160 - DNA, 762 bp, Sorghum bicolor
  Clone ID: SORBI-28MAY03-CLUS11590_1
ggccttggagacgctgtcgagcagggccttgtaaaggctgttggagtctcaaactacagcgaaaaacgtgtccgggatgcctacgagcgcctcaagaagagggggattccactagcttcgaaccaagtgaattacagtctgatatacaggaacccagaggaaaacggggtgaaggcggcttgcgatgagcttggcgttactctgatcgcttattccccaatcgcccaaggtgctctgacaggaaaatacactccagagaatccccctaaaggtcctcgaggacggatatacacaccagagttcctgacaaagctccaaccacttatcaaccggatcaaggagatcggagaaagctacgggaggacttcaacccaggtggtgctgaactggctggtgtgccagggcaacgtggtgccgatccctggcgccaagaacgcggagcaggcccgggagttcgcaggcgcgctggggtggagcctcacggccgacgaggtggaggagctccggtccatggcgcgccaggtgaagcccgtcatcggcttcccggtggagaagctgtgagcggtcggttcagctgggagttttggtcaccgccgctcatcagaaaacctcatggcagtgacaccaggccagtgtagtagtgtatagtaggactataggtagatggacaaagcgtaccacttccattgcaagactgcagacgatgtattctactgtactgtacgtaatgtaacagcgaaattcaacagcactagtgtagta

SEQ ID NO: 9161 - DNA, 585 bp, Sorghum bicolor
  Clone ID: SORBI-28MAY03-CLUS85607_1
tcagccgtggagcagggctaccacggggtgcgacccgggtggacgcgcgtcagcctcgcgtactacacgtcgacgcaggaggccgagttcgtgttggacgcggttgccttcgtcgccagcttcggccaccggttcctgccgctgtacgccttcgactggaaaaccggagactggcactacgaccacaggcacggctgcgcccgtgggctcgtgccaaaccacgtcgtcggcaatcctggtggacgagtcaaagccgagaacggctaccagagctacatggcattcgcgcactgcctggcggagtccttggctactagtaccacttgcagtgggccgactagcactcgtgctaaacgtattcccaagagcgtcgacccacagttagtctatttcctcgtgtgagtcgtcaattctgcaggggatatactgctccgtcctattgaacatctgagtacggttagaaatactggaggataatttcatggtacatgaggtgattggaagaacatacatacagatcgatcggggtgtatgtttatgccgtcttgactcttgaccaattatcagagcgatgagattcaactc

SEQ ID NO: 9162 - DNA, 1050 bp, Sorghum bicolor
  Clone ID: SORBI-28MAY03-CLUS85626_1
gcacgagggaacatcctggcggcgtgggcgcccagcgagatgcacccgcagttcgcggacgacgtgagcctgaccttcttcatggagtccgggacgtcgatgtcgacgccgcacctgagcggcatcgcggccatcatcaagagcctgcacccgagctggtcccccgccgcgatcaagtcggcgatcatgacgtcgtcgaacacggcggaccacacgggcgtgccgatcaaggacgagcagtaccggcgggcgagcttctacggcatgggcgccgggtacgtgaacccgtcccgcgccgtcgacccggggctggtgtacgacctcagcgccggcgagtacgtcgcctacctctgtggtctgggcctcggggacgacggcgtgaaggagataacggggcgccgcatcgcctgcgccaagctgaaggccatcaccgaggcggagctcaactacccgtcgctggtggtgaagctgctgtcccatccgatcaccgtccgccgcaccgtgaccaatgtcgggaaggccaactcggtgtacaaggccgtggtggacatgcccaagggcgtgtccgtggtggtgcggcccccgatgctgcggttcaccaaggtgaacgagaagcagagcttcaccgtgacggtgcggtggaacgggccgccggccgtgggcggcgccgaggggaacctgaagtgggtgtcgagcgagcacgaggtccggagcccgatcgtgataccgccggccaaggccgccgcgtaggcgtagctccccaattcaatctgcttaacggccggcatgaccgtgctcgtgtcgtgtcgtgtcgtgtctccagggaagaaggtcatgagtacttcagtagcggtaggtaatcatgagtgtgccccgtgtacgtatggcgaaggaagtaggcatcatgcggctgttgtataggcaggcagggtacccgatcatcatctgtgaagcagcaagctcagctgcagtggcaatggcaatggcaatgtcgcgttcgttctgtatgtaaaaaaatggcggaaataattaatcgtttcgaaacccccc

SEQ ID NO: 9163 - DNA, 675 bp, Sorghum bicolor
  Clone ID: SORBI-28MAY03-CLUS85714_1
ctgttggcctaccggggcatctcttgtcttgtcttaccactcgatcggattaggttaccgtcagcttaaaccacaatttattcaccaatcggatatgccgcttctcgtttcatcatcaaccaataatgtgtctactggcgctgcatctcctgtaccagtaccagcagcagcagcagcagcagagcattccgatggcctcctgttcgatggtctcgttctgggccatggtgacgacgtcaacaataaggccaaggcggacaacgacgactatgacgcaccgaccgagagactggagtggctgaggtcgcagatcatcggctcggaagcagagttcgcgtccccgttcggcactcgccgcatcacgtacgcggaccacacggcgtccggccgctgcctgcgcttcgtcgaggagttcgtcgctcggaacgtcctgcctttctatggaaacacccacacgacggacagctacgtgggcctgcacacgagcaagctggccggcgacgcggcgcggtacgtgaagcgcagcctgggcgccgggccgcaggacatgctgctgttctgcggcacggggtgcaccgcggccatcaagcgcctgcaggaggtgacgggcatggccgtcccacccacgctgcgcgccgccgtgctggccgcgctgccgccgaccgaccggtgggt

SEQ ID NO: 9164 - DNA, 922 bp, Sorghum bicolor
  Clone ID: SORBI-28MAY03-CLUS8514_1
gtttgttgaatggagtgctgttcactggtggatcagagaagcaaggtgtatattttgagacgataaaaaaagtgtttcagtatgttttggacaagaatgacgcaggtgaaccatttcctttgtttgcccaatgtcttggctttgagctaataagcatgattgtcagcaaggacaataatatcttggagacgtttgacgcccagaatcaagcatccactcttcagtttcccagctatgctttggagggctcagtgtttcaaaggtttgaccctgccctcataaaaaaagtcagcaccagctgtcttgtcatgcaaaatcatagatatggtatatcaccaaggcgatatcgagagaatgatgcactatcaagtttcttcaaaatcttgactacatcacctgatgaaaacggcaaggtctatgtctcaactgtacaagcctataattatccaatcacttccacgcaatggcatcctgagaaagccatttttgagtggaggaaaccaatgattccacacagcgaagatgcagtacaggttactcaacattttgccaatcattttatcagccaagcacgcaagtctccaaacaggcctcctgccgacaaagtgctggataacttaatttacaactacagcccgacatttagtggaaaaaaatcgaaatcatttgaggaggtctacatctttgcctgagactgaagtggacgtctgggtgtcttcaggaatcagcactgcattgctatttgtatcgaggtccattgtattgtgattgtgtattacgcgtggtacctggaagtgtacagatttcgttgactgcctgtattgcagtaacctttccgggtagctctgtaattaatatgtatgtatatataagcaggaataataatgtaatgaactgtaaaatacttgtatggagattttac

SEQ ID NO: 9165 - DNA, 385 bp, Sorghum bicolor
  Clone ID: LIB3476-050-P1-K1-E12
cccacgcgtccggaatgatgcactatcaagtttcttcaaaatcttgactacatcacctgatgaaaacggcaaggtctatgtctcaactgtacaagcctataattatccaatcacttccacgcaatggcatcctgaggtattttagttgttgttctgggagttccatgctaatatattattattggctctgcctttgttttttcttgtgcactgcattttttctaaaattaatattcacaaaatatcaaattgtggccactcaccagataccaagggctctatacaaatataaaattggcctcacttaatgcaaaaagccatttttgagtggaggaaaccaatgattccacacagcgtagatgcagtacaggttactcaacatttt

SEQ ID NO: 9166 - DNA, 624 bp, Sorghum bicolor
  Clone ID: SORBI-28MAY03-CLUS85956_1
tcccagcggcgccgggcaggacccgtccatggaccccgcgtacctggcggcgctcacgcagcagtgcccgcaggtgcaggggagcgacccggcggtgcccatggaccccgtcacgcccaccaccttcgacaccaactactacgccaacctggtcgccaagcgcggcctgctcgcctccgaccaggcgctgctcgccgacccgaccaccgccgcgcaggtggtcggatacaccaacagccccgccacgttccagaccgacttcgtcgccgccatgctcaagatgggcaacatcgaggtgctcaccggcaccgccggcaccatccggaccaactgcagggtggctagctagtagactcacatgcatgtgtgttggcgggcggcggtgtgattaaaatcatacggtgacgaactgtacgtacggcgtagagtggtgtgatgtggtccgatgatgaaaattgtacgtgtccatcgatcgagggctgtagttgtgtacgtagtacagtacgtgctagttacgtatacgcatcagttgcttatagcttgtgcgtcttttttttgtgttatatacacttttttgtcctttgggttttatacgtgtttatggatcagtgatatagctttatt

SEQ ID NO: 9167 - DNA, 1190 bp, Sorghum bicolor
  Clone ID: SORBI-28MAY03-CLUS83253_1
aagttttatttctctttcttcccctcgattccggccgaataagatggcggcggccgcgcgcctcctcacgcgaatctctaagcgggccgtcccctctgtggcgcttgcgggggcggcgaggcggcggccggaggcggcgtcgctcctgggggcgtctgtgctagcggcggtggagccctgcgcttcgatcaaggtcattcctttgttgaatcagctggctccatactcgacatctgcatttcagaggtttgggttttcaacttcagccccacaacaagatgataaggagacaaacaaacacacagatgatggggttaataaaagcgttggagtgagtactgaagcttcaagtgaagccaataatgtgcctggaaccgagaaggcacaggaagcagattcagaagacctagacctatcagaagaggaccttgtgaagctgcttcttgagaaagatgaatcactgaagtctaaagatgaagagtttaaagatatgaaggataaggttctacgcagctatgctgagatggagaatgtccttgccagaacaaagcgtgagtcagagaacaccaagaagtatgctatacagagcttctccaagagcttattggatgttgcagacaatttgtctcgggcgtcatctgttgtcaaggaaagtttctcaaagatagattgttctaacaattctgatgaagctgtaccactactgaaaaccctactagagggtgttgagatgactgagaagcagcttggagaggttttcaagaagtttggagttcaaaagtttgatcctttgaatgagaagtttgatccaaacaggcactatgcctttttccaaattcctgatccttcaaaaccatcggggactgttgctgctgttgtgaaggttggctacatgttacatgatcgtgttcttcgcccggctgaagtcggtgtcactgaaggtggtccaactgaagagccagaggaaaaatctagctaataaactgaggatgctggctgcacgcatcaatgactactgtccttttttggttggataagcatacatcatatcataggctatgttctgactagatctgtgagacaaatcaccatttttgtagtatgttcaacgagccaatttgttgaagctagtccagaattctcttttttcttggtcggtaataaaaacgagatggtagaacatgtacatt

SEQ ID NO: 9168 - DNA, 650 bp, Sorghum bicolor
  Clone ID: SORBI-28MAY03-CLUS8332_1
tcaaagggtgttgcagccacaaatacttctcccacgcgtccgatcgcaaaattagcaaaagatactgatgatgagctaaatcagatcaataggaagctggaggaactccggaaaatggtggttcacagatgcaggaaaatgaccacagatgagaagaggaagctgggtgcagggatctgccacttgtctccagatgatcttaacaaggcgctagaaattgttgcacaagacaatcctagcttccaaactaaagcagaagaagtggatcttgatatggatgcccagagtgagacaaccctatggaggctgaaattctttgtgagggaagcactggaacgacaggccaacgttgcctctgggaagatggacgaaaacgccaaaagaaagagggagatatgcaatgctctggccaaaacagcatcgaaacggatcaagaagcaaccctagccatcttccagatctttgactcgcgtccttctgtgattgttaagaagtttttttggtaggagtagccattagctttgtgaaaggatttcctgcattttttgtggagctgtgtatatagtacactgtctgtccagtaacaagtgatttcatgtgtaaccatgagctgatcgctcgatctgaccaaaacaacaaacattgttcct

SEQ ID NO: 9169 - DNA, 1307 bp, Sorghum bicolor
  Clone ID: SORBI-28MAY03-CLUS83652_1
ccaataatgacgtcaaagatgagcctagctcaagtgagtcagcggaaatagagcaaggagagtgaccagcgcaaggcatgctgaccttattgatacttatgtggcttcatatttatgtacgtggatcatgcttttgtatggtcggtggtttggccattactctgacaacaaactgatagatattacaaacagatagttattctaatctggtctgggtgcctggccagctctatagctatcgtgtgaacagtagttccctatttgacacctatatatatgacccatatttgggttcttccttccatggtccttgcaagcttgaatttctcttatctgatatacaccttcaatgtccatcctaaatttgcactgctgttcaatttcatcctatttctgttagttggctgtggaccgagttagttcttttgtcatatggacaaaatttatccctaaccatttggccttctcccaatattgctcgaaccatctagtgcagacatgtgaaccagcctctctaaaccctagatcaggtggccatggagatggaggccaacaccatgactagtgaagacagtggtgctctgatggcgggcatcacaatagggtgaaggcatggtcacatagggtggcctcacctggcggtgcacggggccgatcgttgggcgacctgaggcgaggctagttgcggcatcctgaaggcagccatctcagtagggtggaggcacgcttgcccagggtggcctcactatggtgcttggggcctgatcatgtggcgacatgggtcgccctcttcccatggcatgggagcatgcatgtgtcgctacaagggcagttgcgggtgatagctcgaagtcttgctcactcggcgacacgggcctgagccaggcttgggtgatggcttgaggtatgctggcccgatgatggaggtggggcttgtggcctgatggtggccttaacctgaggcacaggtcgatccgcacatggtggcgcactggcgtgctcgcctggaggccctgggttggcctctcctagcaatggcgcatgcgcaacaacaaaagcatcatgaatggcttaagggtcaagaagtggctcaaatcagtctaagtcaatttccatagagttttcttcgatcaatggacaaggataaaaggaggatgcaatgagcacgatgagtaaaagaaggctgagtgtgcttctcatatgtttaattttttgtcccatgtaatggatttggatttggtgtgtatgtgaaccagaatgaatatgagaacttaaatgtgtgtgcaccacatcagtgtttgaagcgg

SEQ ID NO: 9170 - DNA, 638 bp, Sorghum bicolor
  Clone ID: SORBI-28MAY03-CLUS83675_1
cgccatcgcgcagggctgtgcgctccacgccgccagccgcgccgactacaccattaagtgccgcacccacgaggattaccaccgcgcgcggtctgttgccacgctgcagttcaacggccacctcgcgctgcttgtgatcgccggcgcggccacttatgcggcagtcctctccagggcaaaccgacccccgagagggtatagtgttctgggcaaggaggtgcagatggaggggatgccgattatgtcacagttcacactggattcggatgaggagaaggaagacgaagcgatcacctctacagtagctccagtggcaaatggcgcagagtctcatgacgagatcccactgcacgaacctgattccaagtgacggagatgaaatttgggctgttcttctgtcgattagccaagtggaggaggatgtcaacagagctgcagtacactggggctccatgcttgtgtgttttggtacatcattttaatatggttttcactttctgatatttggttaatatgtggaaagaaatcttgcttagtttgatctgcatagattagagttaatatctgtaaaatattgtaatttgttgggttcacatagatctttcagaaataaagttaacacgtgttcatctttgaga

SEQ ID NO: 9171 - DNA, 1188 bp, Sorghum bicolor
  Clone ID: SORBI-28MAY03-CLUS83741_1
agcaagcgaggggatcgcatatgagtggaactacgttgtggaaaaccaatatggaaatgatggtatggtagcaggcaaatgccccaaccgcgcagagtctccagccatggattccaaaagccagtcgcttgttctgatgaatttcttcacgactagcccgagtcagactggtgtatgcggaaataattcagcgccactcgttagcatgctcaaaacgtgccatgatgcttcaggcaatcggtggcccaactacattgctgttgatttctacatgaggagtgacggtggaggagctcccttagctacagatattgcaaatggtcatatggtatgcggatgtgacaacatcgcgtattgcaaggcgaattcgacctttgggacctgtgtgataccaccgccgccgccgccgtcgccacccaaggcagccaccccaggcagcagaggctcaacagcagggggcgatgctagcgcgggaatggcccggtctcatcatctgccctcgcaatggagcttcttcttgggactgccttctctgcttcttttgttgctctcgtgagagaactggagattggtttttctgcttttgtgacatgctgttccgatggatcggagctcggaggtagttccgtttggtccgtaacatcatcatgcatgtgatctgagctgagctgtatatttgtgtttactgagcaacgtagtcagatacagaaatcagttaaattcatcattcatttctttgattctgttgttatcttgatgttttaagttccttcgaaaaaataagggtggtggtccttgaacttggatgaaagaaaacatggcagaaacgtagggcccctgttggcagaaacagggatgcatcccataccctcagtgacgtgcaagccggcaatctatagaagacaaattttgctttgggacaccgaagacaaaatgtacttggtcagtctataccatgaacaccaaaatttggtagataccattatgaaatcaaaattacttgttatagcacgccgcaatggctattttcttaattttctcaaatttaaggagaaagaaggtcatcttctacctccttgttggtgtttgggttgaaggtcacacctctgggcgtggccgagggtgagggtgtggcctttgatttctcaacgataacaaataaatacaacatggggctcggtcaagctt

SEQ ID NO: 9172 - DNA, 893 bp, Sorghum bicolor
  Clone ID: SORBI-28MAY03-CLUS8637_1
aaaaaaaaaaaaaaccagtcaacactgacctgcgagctagctagtgaggtcgggcggccgtccatcccaccgcacaccgccggtccagtccccgccggtgccggagggggtgaagccgtgaagttgaagttaaaccaggtctgctcgaatccatttcatactgactcggagaatcttctggatcttatctgttatctcctctactcttagaggcctccaccatggaacatgacggcaagaacctgactgtcactgaggttgtgcgctcggtgcagctgctcaagattgacggctattccgccacctctaccatggtggggtcatcggagttcatcaaacccagatccagatggaacatcgatggccacgagtgggaggtccatttctaccctgatcactgtcagttcctcgaggacgaggacgtcatacccccatttgacgacttcatccaatgggtcgctctgaagctcatccttgtcagtgaacctcagagggacaagctgagggtgaatctgagctgccggcttgtatgccccagccagcggcatcttggtccctccgaagagaagagtgtgtcccatgtatttcaccgtggctccaaatgctcgcctgaagttctcctcatgacgaaatatgatgtaccatcgtcaggttatctcgtgaatgactcactgaccgtggaatgcacaatcaccgtgctaggaggagatgaggagcagcccctgccagtgccaccaccctcggacatgcacaagcacttcggtgagctcctgcagagccaggaaggagtggacgtcatgtttcatgtctctggagaatccttcgccgcacacaaggtcatacttgccgcaaggtccccggttttcaaggccaagttcttcggaggcttggag

SEQ ID NO: 9173 - DNA, 1201 bp, Sorghum bicolor
  Clone ID: SORBI-28MAY03-CLUS86480_1
gcgatcagtcatctcctcccgcggtctcgctctcgctctcgccggagagagatcagacgcgccgccgccaccgccgccgccgcggggccatggacgcctcctaccgccgcgccggcgccgggagcggctccgctccgcgctccgtcgacgacatctacaaggactaccgcgcccgccgctccgccatcctccgcgccctcacccacgacgtcgaggagttctacgcgctgtgcgatccagagaaggagaacctgtgcctgtacggctacgccaacgaagcgtgggaggtggcgctgccggcggaggaggtgcccacggagctgccggagccggcgctcgggatcaacttcgcgcgcgacgggatgaaccgtcgcgactggctcgcgctcgtcgccgtccactccgactcgtggctcgtctccgtcgcattctactacgccgcgcggcttaaccgcaatgatcggaagcgtttgttcagcatgatgaatgatctgccaactgtgtttgaagtcgtctccggtggtgtgaaacaatctaaggagagggacagatccagtactgacaatggtggtagaaataaactgtcagcaaagcaaacaagtgagccgccattagaaaataatgtcagggagcctgatgagggctacgatgaagacgacggcaaccacagcgaaaccttgtgcgggacatgtggtggaatatacagcgcagatgagttctggatcgggtgcgatgtgtgcgagaagtggtaccatggcaagtgcgtgaagatcacccgcacgaggcggagagcataaagcagtacaagtgcccaagctgctgcaattcaaaaagacctaggccgctctaggcctgtagcaccgccctcctcacgggaggacggccatggatggaagactgaacaagcagggagatcagatcgagctactcctttgcgcaaggtcaataccgccttgcgatgtttactgtatcttttcgattaagcttacatatgacgaacgatggtgatgctaatgttggtgggaagatcacacatattgattatataaccttgttgtggtttctccatgccatggagagttatggtagagtctgtatgttgccggaggaataggggcaggggaagcctttgtaacgtttctaaaggtgaattggtcagtttaataatccgtgaggtttatgttaatatattctttttcct

SEQ ID NO: 9174 - DNA, 709 bp, Sorghum bicolor
  unsure (1)..(709): unsure at all n locations
  Clone ID: SORBI-28MAY03-CLUS8651_1
tgcgccgctcgagccggccggactgcgggaaccctantatcctccccaaacctaccgcccatctcgcgccgccgccgtctcctcctcccccaccccatcccggagctctctgctcgcgcaccctcacctgcccgcgccgccctccaccaccaccaagatgaacaaggagaggctcatgaagatggccggcgccgtccgcaccggcgggaagggaaccgtgcgcaggaagaagaaggctgtccacaagacgggcacgaccgacgacaagaggctgcagagcacgctcaagagagtaggggtcaacaccatccctgcaatcgaggaggtgaacatcttcaaggacgatctcgtcatccagttcttgaatcccaaagtgcaagcttctatcgcggcaaacacatgggtggtcagtggatctccacagacgaaaaagctacaagatgttctgcctgggatcatcaaccaacttggcccggacaacatggaacatctgaagaggattgctgaggagatgcagaagcacgtggctgctgccggtgctgcggcgcaagtcaaggaagaaaacgatgatgatgttccagagcttgttcctggagagacttttgaagaagtagctcaggaggcaaaagcctgatcatagactccaaatagtgaaatgttactcgaccacccctgtgaagtcatggttttcgagtgatggcactcttgc

SEQ ID NO: 9175 - DNA, 1454 bp, Sorghum bicolor
  Clone ID: SORBI-28MAY03-CLUS8657_1
ttgcagctaatcatctctggcagctagtggtggcacgtgctgatctcaacggtcatttgaaggcattgaaagattattttcttttagcaaaaggtgactttttccagtgttttcttgaggaaagccgacaattaatgcgtttaccacctcgtcaatctacagccgaagcagatctcatgattccatttcagctggctgcactgaagactattggtgaggaagacaagtactttaccagagtctcattaaggatgctatcatatggtatgaaaagtagtacatctcagaaagatctccaaaaacccaatgcttcagagctttcttcacaaggaaaagctacatcagaattagcacttgatgggtgggatagtattgctctggaatattcagtcgactggcctctgcagctcttcttcactcctgatgttctgtccaagtatcgcaaggttttccagtatctcatccgattgaagaggacacaaatggaacttgagaaatcctgggcagctgtaatgcataaagaccatgctgatttttctgagtactgcaaggatcggaaaaataactctgcaacacaactgcgtcgacaacgctctaagcctttgtggcgagtaagggagcatatggcattcttgatcagaaacctgcaattttacatccaggttgatgtaattgagtcgcagtggaatgttttacaatctcatgtgcaagattcacatgattttacagagctagtgagctttcatcaagaatatttgtcagcactgatttcacaatccttcctggatattggatcagtttcaaggatactagacagcataatgaagctttgcttgcagttctgctggagcattgagcaatacgaaactcgcccaaatattgctgagattgatcacataactgaggagttcaacaagaagtcaaattcgctgtacactatcttgaggagcagtcgccttgcgggtagtcaaagagcacctttcctgaggcaatttctgatgaggctaaatttcaactctttctttgagaccaccgcaagaggagtgatgaattcaggaaggctgcgcccaagcactgcaggtgctcagctgtaacaggccgttgatgtgcgaattcatctctcgatttttacacgggagtggcggtatggtggtggttcctgcaagagacaagggaggaggttttgtagtttatgtaaattattatgatcgggtagtggttgtcattccggtgcggtcgattcatgcttgcgccgttgttgtgtttttctgtgcttccgtttgtcaatgctatccagttcgtgtggcatcaattgtacgtccgcaaactgtacgctcattcatcgtgggaatctggggacagcacagtgaaatgtaagtacatgttctttcgaatgagctgctggcacttctgagctgctgtgtgttataatatgatacctgtcgtaacaggtt

SEQ ID NO: 9176 - DNA, 1138 bp, Sorghum bicolor
  Clone ID: SORBI-28MAY03-CLUS8660_1
ccaaaggtcaccatatgcaggattatcatcttcaaccttacccaatgatacaagaatggctgcttctcctaatcttggccgagattcatcgagaacaggtaaaaggctcaaacctatcaagagagccctcggccggcgctccactacggtagaggaagatgaggtaggagacgatgagggtgatgaagcaaccaagatccaggcacccacttctgggttacgaattcctccatcctcacctcccttcactaactctttgtgccatatttatttggttcctaaaattttaaagttaaaatttactgtcttcgattgagtcgtggcgggatacatatggaaactctaccatttgaggttgtgctagaagatgtaggacaacaaaggaatatgcagcagcaaggagggaaagatgcagcatcaaggagcgtgaataggatcaagtccttgctgtcgaaacggaagtcatctgttgttagtgcttcaaatcattcagaaggaatacagaggaagtcatctgactcacatgtgcattatgtgagatctccggtacttaatagaatgctacactcaccaaggatgagccactctccggtactatctgcaagatcatcatcttcgtcttcatctgatgatacaagaattgttatttctcctgatcttgggccaggttagcttgaccttgattcatctggaggcgaccagtgcgtcgtcgtcgttgtctctgttacggaggtgtctagttgtgcctggtgggggtgcaagacagggagaactggtgaagaaaatgatatttttttgtctttatagatatctttcagtttagcatttcaactttatttatgttactgtcttttggaatagcagtgtactttgcaccttgcgatgaaatgttgctctggttcaagctatggtttagtagtgtgttgtgcgccttgcggtagagattcccagagagaaacatggttctcttgttagaagtttcacaggttcacatggttctcatgtctttcagtctagcatttcaacctccatacatgtacacttttagagattattattattattatgaactgtactgcctgttcaaatgaggtcagtaaaagttgtattatatgtttactttattcaaatgaggtcc

SEQ ID NO: 9177 - DNA, 1085 bp, Sorghum bicolor
  Clone ID: SORBI-28MAY03-CLUS86811_1
gcacgagggtgctgcacctcgccgcgcaggcgggcgtccgccacgcgatgcgggcgccgcaggcgtacgtggcgtccaacgtcgcgggcctcgtcgcgctcttcgaggccgcggcaaggcacgccgacccgcagccggcggtcgtgtgggcgtcgtcgtcgtcggtgtacgggctcaacaccgaggcgccgttctcccacgaccaccgcaccgaccggcccgcctcgctctacgcggccaccaagaaggccggcgaggccatcgcgcactcgtacaaccacatctacggcctctccatcaccggcctccgcttcttcaccgtctacgggccctggggccgccccgacatggcctacttctccttcgcccgcagcatcgtcgccggcgagcccatcacgctgttccgcaccgccgacggcgccgacgcgcgccgcgacttcacctacattgacgacgtcgtcaggggctgcctcggcgcgctcgacacggccggcaagagcacgggctccaagtccggcaagaagtccgggcccgcgccgctccgcgatcttcaacctcggcaacacctcgcccgtcacggtgcccaacctggtgtccatcctggagaagcacctccgcgtcaaggccaagaagcacgtggtcgagatgcccggcaatggcgacgtgcccttcacccacgccaacatctcactcgccagggagcagctcgggtacaagccctccactaacctcgacgtcggcctccgccagttcgtcgactggttcctgtcctactacggcgtcaccggcggggccggcggctcgcgcctcgccgccgtgcccgccctgtcgttctccttcccctcccccgctgccccggccgcggccgccccgcctccgccgccccggcgcgttccccgccccggccccgccgtcctccacctagggtgctcccggttgtcgtgggggccaccgggcgagcagtgccctgcatcgtggcgaggggcgtggtggaagaaagctaatggggagcagtattttcttttctctgttttttcctccctccaccatcttctcttctttgtgtaaattggtcgctctccatt

SEQ ID NO: 9178 - DNA, 852 bp, Sorghum bicolor
  Clone ID: SORBI-28MAY03-CLUS84311_1
gtgccgcacatcgcgggggaggcgttccagctgacggagtggtacacggtgcccaagggcaccatcgtgttcccgtccgtgtacgagtcgtcgttccaggggttcccggaggcggaggcgttcgacccggagcggttcttctcggagtcgcggcgggaggacgtggcgtacaagcgcaacttcctggcgttcggcgcggggccgcaccagtgcgtcgggcagcggtacgcgctgaaccacctcgtcctgttcatggcgctgttcgtgtcggtggtggagttccggcgggagaggacgcccgggtgcgacgaccccgtgtacatgcccaccatcgtgcccaaggacggctgcaccgtgtacctcaagcagcgatgcgccaagttcccatcgttctgaggaagaattctgagctggttggtgcctctgcctgcctgcctgcctgcctgcctcttgtggcctgcttgtcctcttgttcctgcttgctgcctgccactctccctctctgcatctcggttcctgctgccgcttttcttttcgatttcttggcgggggcaggtcgtgtccgtcgccgtggttctttgcttcattggtgttggtggtgtgatgatttgatttgtaggttgtggtgttggcttgctcgtgtcctgattttcaggccggccggcatggtccattcaattattttgttggcgaacaaattggcttgggtttgggtgggtcgggactccacactccctgtcactgaccgcagcagctgtggaactgctcggccagggcaaagggtcccaggaacccaaaggagagcgttggggttagggaagtaataatactagcttatcatgaatgaacaac

SEQ ID NO: 9179 - DNA, 699 bp, Sorghum bicolor
  Clone ID: SORBI-28MAY03-CLUS84487_1
agaacagctgatccccaaggtctttggtcaaagtgtaggacgaaccacgctttctgtaatagcaaccagcttcagtttttgcaagggtttaggaaccaaatgcttgatgccgtgaagggtttttctgcgtcaaggcgaaatggtttgttcatcaactcatgttttgctcattgccagagcgagagacaggatacttggtatgcgaacaactcgccacgtcttggtaacaagaaaatcgctgacgctgtcggtgattggttctttgagaggggagacgccaagtacacagactgcccatacccttgcgatggcacttgccatcatcttgtgttcaggggagaccattaagactattcttcaacacgaacaattcagaaatttcagatggtaaaaggaacaaaccccaatgggtacagaaacaaggtatagatacagagaaggtgcaagtggttggcttgcccatgtatgttcatcagtcgatcatatgattgataggacagggacctcgcctgcgaatgcgcggaggtctctgcattagcttcacatatcatcatgatatcgatttttttcattggaaaaatgtatgattacctaccagaacatttggaccctattgcctatctgtataacattataacgtacattacatattcatttgtgtaacaggaaaaaatatcttgcgcttgtcctgccgatggt

SEQ ID NO: 9180 - DNA, 979 bp, Sorghum bicolor
  unsure (1)..(979): unsure at all n locations
  Clone ID: SORBI-28MAY03-CLUS8470_1
agcgcctccaccacctcgactccaggccacgcgggacaaccagaccaacccgcccggagcagcaaagcataggcgcgcgagcgctccctcacgagctccccgcctcacgcctcgtcctcccgcctccccctcctgatcctcggccgccctccggcctgccgccgtcaccaccctccttccgccgagcctcggctcccgtccgcagcagccacgtgcgacgacctcccctgctcctgagaatctgcggagctcggcatggggtgaccagatcggggcgtggctcggtgctctccagctgaattctgctcgcggctcgtctcggaggccagcggagatggcggacgccggcgtggcgcgcggcccagggagtgctggcgatgctctgttcagggaactctggcatgcttgtgctgggccgttggtcacagtgcctcgccaaggcgagctggtttactacttcccgcagggtcatatggaacagcttgaagcatctacagatcaacaacttgatcagcacttacctctgtttaatctaccacccaagatcctctgcaaggtggtcaatgtagaacttagagctgaaactgattccgatgaagtttatgctcagattatgctacaacccgaagcagagcaaaatgagcccaccagcccagatgctgagccacccgagcctgaaagatgcaacgtccattccttctgcaagaccttgactgcttcagatacaagtacccatggtggattctctgtcctcaggaggcatgctgaagaatgtctgccccaactggacatgactcagaatccaccatggcaagaactggtggctaaagatctccatggaaatgaatggcatttccgtcacatctttcgagggcaaccaaggaggcatctacttacgacaggctggagtgtttntgttagctcgaaaagattggttgctggtgacgcgtttatctttttgagaggtgagaatggagag

SEQ ID NO: 9181 - DNA, 728 bp, Sorghum bicolor
  Clone ID: SORBI-28MAY03-CLUS84560_1
gagctcttagtaccccagcctgcacctgttgccttctcctccttcccacagctaactagcaatggatactcccacgggcgagcaccgggaggaagagctccggaaggggctcctcgttttcttcttgctgcttaccgtgaactccggcctggtgatgtacatctcgtggggcgacttggtgtcggtggcctccgtcggggtcacctacgtcgccgtcggcctcctgctcggcaggcgcttcggttgctgggagccgacaaccgacggaggaagacggtggctgggctccgtcatctgcttcctcttcctatcgctcggggtccttcaggtatccaggttggcgcgaaccgccgcgtcctcgacgacgtcggcgccgatgcttgtggcggccgccggcgcgaccgctctcggggtcgcaggctgctgctcctacttgcttcaccgacgcagctggtcgaagcagcatcgccaggaagcaatcttcttgccgcttaggcaagatccgcgcagttgattggatatgatctcctctccactccaacgagatacgtatatgtgtgtacttctctagagagatggcgggctgtgtcagaacgtaatagtaatatcaagatgcttaatttcgtcccaaaaaaaaaaaaatcaagatgcataaatgctcgaggagggggtcaatcttttatgttactggcgtgctgtttacagatggttgtactgcgaaaatggaa

SEQ ID NO: 9182 - DNA, 655 bp, Sorghum bicolor
  Clone ID: SORBI-28MAY03-CLUS84764_1
aaccaaatttctcctccagcgtctgcgtgtgctttgtctcgtggcgacgactgagcgaccggcgccgccgccgcctgccgccgccgctcggacctccgccagtccttcgggcccagcgaaacgagcacccagtagtcaagatgccccgctacgacgatcgttacaatgatcgttacgatgaccgttacgatgatcgttacggtgggaacacacggctgtatgtgggtcgtgtctcttcccgtacaaggacacgggatcttgaagaccttttcggcagatatgggaggttttgggggcttacccaacctcggtgtccatggtgggagggtgcccttggtgcaattgctggctgttctcccaaagttgaaactttgctgattcttttgaaaaaaaatacatgttttaatggaaattcacagtcatgacttgtttagttccttctgaccggcgattcatatctctacttgcttcttgacggtgttaatgtttctggaaaccatttccgcagagtgcgttatgtggatatgaagcatgagtttgcgtttgttgagttcagtgatccccgagatgctgatgatgcaaggtatcaccttgatgatagggagttcgatggtagccgattgattgttccgcctgtttctgaattgtattgcag

SEQ ID NO: 9183 - DNA, 981 bp, Sorghum bicolor
  Clone ID: SORBI-28MAY03-CLUS87422_1
cctactggagttccatctctctgtctctcgcttgggaaattgggaggacgacgaggaagaggaggcgcgtgccggcacccgaccgtcgactaccacgctacgacgcggcaccgggataggtgctcctgagctacgaatccacaccccacgcccacggccaatccgctgcgtgcgccgcggccttagcatgaggtggccgctggcgatctcgactcgccgccgccccctccttttcgtccttctcgtcgccctctacacgattcctgggacattctcatcgaggcaagtcacactcgatactgttgagatatttactactcatgaatggtttggcaagccaacagtggctttccggtgcaatggagagaacaaaacagatttgccagatgtgaaggaggcgcacacgctatatacatttaagggtgaagaatcgtggcagcccttgacagagcttccagaaaagaaatgcaagcgatgtggtttgtatgaggaggacacatttaaaactgatgtctttgatgaatgggagatgtgttcgagtgatttcaagggtggaaaatacagccggattaaggaaggccagttcaatgcaacattcctatgtccaaactgcaccgcctcaactggacaaggaaacagtgaacctagcgaagatttggaatctaagaagacatcggttgtggtcatcataatagttagtgttcttgcgtcagtccttgtcatcattgccttgttcgggggctacaagtactggcagaagaagaagagggagcgagaccaggcgcgattcctcaagctctttgaagaaggagatgaccttgaagatgaactgggccttagcaatgaaatctaaaacagtgcgtacagtcgtacttccgatgtcttcagttgtagtttccgtgtatgatgtatagaatgtgcaattttttcacttagaaattttgtagtgtatagcatccagtagtttagaagaaacggtcc

SEQ ID NO: 9184 - DNA, 952 bp, Sorghum bicolor
  unsure (1)..(952): unsure at all n locations
  Clone ID: SORBI-28MAY03-CLUS8747_1
aacgtgtcatcgtgtggttcactttacgcctacatgtcatcaggccgtcaaggttgccaatgtgcagagctacatgggcggtttgaggagatcacattccaagcagatggagagcagtgtgatttgcaggaatctgcaggcagctctgatgatggaggtggccaaacagagcattatgtcaaaagcaaggagtccactcatgtgaatggccttgtacagatgggtagaagagatctttctaatcagctntgcttcagttcatttcaagagcaatcatgttcatctaaccgttacgagaatgacaataaccatcacacaaatgggttcgacatgaagcatgaggtaaagattgccaagtcaaagcacggaaaatggcacagttaaagagggctatccatccatctcttgactttgacaatgcatatggagtaaataggatgaagccttcactgaacaagcttcaatctttccatattggaaagaaccacagtttccgcgtgccaacaagcccgagtaaagtaagtatggattatcattctgacgtgaacagccaagtatggcatagcaggcaccccgatccgggagcccaaagggcccggcattgtgaggtcaatgcagctgggagcagcccggattatgtgtttacagcgaggcgctactatactggagctcagttgccgccaaatctcccgagaacaaaatctgtaccccccctaagtgctgtcgacgcctgaaatgctcttgccctgtaaattttatagagtgtacatctgttttggttctttttgtatccattatgaaacatagttgtttagcaggagactgaatgtgacgaggctgagctgtttgtaaatttccatcttgtgaatccacagaggttaggctgtacaagtgcaatctacatcatttgcctcactgggaacaacctgttttatcctccttaataaggcga

SEQ ID NO: 9185 - DNA, 1434 bp, Sorghum bicolor
  Clone ID: SORBI-28MAY03-CLUS87579_1
atctggtatatctgcaaacaacttcaggttttcttggacacttgcttatctcgttatcagtcaaagaagattgaagcaggagcatctattggagcaattggagctcaaagtattggagagccagggactcagatgacactgaaaacatttcattttgccggagtagctagcatgaatgttactcttggtgttcctcgaatcaaggaaattatcaatgctgctagaaagataagcacgcctattatcaccgctcagcttgcgccagggaaagatgtgctttctgcgcgtattgtgaaaggatctatggagaaagcagtgctcggcgaggttgcagtcgctatacagattgtcctgaagtcaagtcagccaaacttgattgtcaaacttgatatgcaacttatagaaagtctccacatgggaatatctgctgattctgtgcagctgtcaattttgaatcatccaaagattaagctaaaatctgagcatgtccgtgtcattgatagagccaagttgagaatatatccagctggaactgataagcgcaaacttcagcttgaactgcacaacctcaaatccatccttccaaaagtgattgtgaagggcattccaactgttgaaagggttgttattgacgaagttaaagtaaaaaacgagacagaaagataccaattgttggttgaaggaacaaacctcctggcagtcatgggtaccccaggagttgatgctacgaagacaaaaagtaatcatatcatggaaacgaaccaaacgcttggaattgaagcagctaggagatctattattgatgaaattcagtacacaatgaaaagtcatggcatgaacattgatcggagacatatgatgctcttagcagatttaatgacatacaagggtgaaattctcggcattactagatatggcattgcaaagatgaaaagcagcgtgctgatgcttgcttcatttgagaaaacctcagaacatctattcaatgcctcatacagtggtcgtgaggatcagatagagggagttagtgaatgcattatcatggccattcccatgcagctcggtaccggtattctcaaagttaggcaaaggctcgaccatgtgcctgaattcaagtaccagccagacccgatactgtcgtgatacatacatgtggagtgaagctggaactctgtacatatcatcatacatgcataggttagcgtagggcaaccgtggcggctgtcatttctcagccgaacatctagctagtgtcattccatctccatgaggcagactccgggtcaacagcgccctcttcggctggcaacacctgctacatctacttatgattgtgctaaatatctctacaggccaataaagcctgggaagaataattgtttttcctgatgttgggctacaattagacgtcccggatgactgaaaagtcagtct

SEQ ID NO: 9186 - DNA, 946 bp, Sorghum bicolor
  Clone ID: SORBI-28MAY03-CLUS87682_1
ccctcggccccgcggccgcgcccccgccccccccccgcgcgcccccgcccgcccccccccccccgccgcccccccgcccgggccccgccccccccgccggcgccccccccctgccgccccccccccccgccgccccccgccgcctccggcgccgtcccccccgcccccacggcccttccggcgcccccgtcgcggcgcccccctccggtcgccccccgcctccggcggcggcccccccgtcgccgccgccccgccgccggcggcgccccccccgccgccgccccccctccgtcgtctgccagccgtgctggggccgccttgggtcgctggctcccgctcccgcgccctccctgcctcgtcccctccgggctgcgcggccgccctccctccattccccggcgacccatcagcccggctgagcccgggcccgaggcccctgcagcatcgctgcaccaggatgagggaccgtcgggccgccactcccctgtatgccagtccctgaattaaggccctctttttacaattgtttctgcagatgcatggctttgaggcaccatgggccggcgagttctctataaggtgcgtcccatctcaggtgcttataaccagtgcattaattgaaggcactaagttaagtgaagccgtgtgatgcatttgaagggatgtcagtgatgatatcgaggacgaggatgatattgatgatgtgtgatgcatttgaaggaaaataattttggcccctaggttgaaataaaataatttgggctagttgtccttgagctatgtatgtgctgactgctggaacttatgttagtcggctatgtcttatgaagtattgtcctttattaacgtacttgtgttggagactttgtaatatgcttggagtgcaagtggtggacactttgtgatatgtctggactgaaattagttgaatatatgaatgtatgaa

SEQ ID NO: 9187 - DNA, 619 bp, Sorghum bicolor
  Clone ID: SORBI-28MAY03-CLUS8788_1
tcaagtcagcaaaatatggattatcctataattgatgaggctaagctcgatcagttccttttcagagtggaagcagctcttcatcatgagacgcaaggcagcacagatggacacaagaatcatgacagtagtaggggtgaccagaaaagcgacagtgaagttactccattggacactgatctgaccagccaaaacgagttcaataacagcaacgaggaaggtctctttgacaaatttaaatttaggaaaggagtagggaggctctgcagacaccctgtattccagttcagtaggtccatgaagaagtccgatgaagcagagcaagcttgtgtatagggtatgcctgtgtagttgataacaccgccatttctgcaacttgtttactgtgtaggtcttcagctattctcctagattgtctgccctagaaagtattagcccctttattagtaccgatttgggtgtatatgttactatgtcagttggtcacttctcaccgtcctaattgttagaaaccatcatgcagatctactgtaagtgtagtgatcattattgatttgtcagatacaatctcttgtatgatttttcattttacgtgaagatttgcttggtgcttaaatct

SEQ ID NO: 9188 - DNA, 665 bp, Sorghum bicolor
  Clone ID: SORBI-28MAY03-CLUS85968_1
cccggttcctcccgtacgccgcggtgcttggccacctgtcgggcgcgtcgggggtgggcgcgtcggcgtcgcaccacgtcgccgaccacctcgtggcgctcttcggcgccgacgccagcgccaagttccgcttccaccgccaccacggcaacagcagcggcgccgccgcgcgcactgacgacgacgacgccgggatcctgctgagcgggtgccagacggacgagacgtcggcggacgtcgcggcggccggcggcggcagcgcgtgcggggcgttcagcgccgcgctgcaggccgtgctggcggcacacccggcgccgatgagcaaccgggaggtggtgctccgcgccagggaggtgctcggcgagcaggggttccagcagcacccctgcctctactgcagcgacgccaacgccgacgcgccgttcctggggcagcacgagtcaatggccaagagcaactgagcaaggaggcggctgccatgcccacgcgctctcacgatcacgattcatcccctgcaatttgtgcgtgcgcttattattatttatattagtaaataaataactacgtgtatgcagcatggtcatgccattacagatttctccttataatgtattgtctacctgcaattctgctataaatagcattccctcacgaagtgaaccaaa

SEQ ID NO: 9189 - DNA, 734 bp, Sorghum bicolor
  unsure (1)..(734): unsure at all n locations
  Clone ID: SORBI-28MAY03-CLUS8603_1
cggcgcggcggtgccccgaggtgtgcgcgtacccgttcgcgatcccgtcgtatgtccccgggcggaaggcggaggcgccgccgaacggggacgtcggcgtggacgggatggtcagcgtcatcgcgcacgagctggccgagctcgcgtccaacccgctcgccaacgcgtggtacgctgggagtgacccctcgttcccgaccgagatcgctgacctctgcgaggggatctacggcaccggcggcggtggcgcgtacaccgggcagctcctcacggatgcgcgctccggcgcggcgtataacgttaatggcgtcggtggccggaggttcctcgtgcagtgggtttggaaccccgtgctcagctactgctccggccccaacgcgctcgaccagtagcagattcgactagctgttcttgctgctgttccggtttcatttcatctgcttgaaatgaaatggaattttgccatccgttgtcattgtgcaaaggatgatgattctgctctgcctctagtgcattggatttccttgctctggaaatccatgggatgtttctgtatagagttgttattattaatggcacgtttgatggggggagaaagaaggtggtggtgatgactgatgagcaggaggaggatggcaatggcatgtcttatgaggtgaatnttggaacttgttattattaatagtaagatttacctgtttaccanacaagactttgtcgaatatttatttaat

SEQ ID NO: 9190 - DNA, 768 bp, Sorghum bicolor
  Clone ID: SORBI-28MAY03-CLUS86367_1
agcaccaagctagcagcgtctttctcccttcctgctttctctctcgcatcactcctctctttctcacacacaaacacaggaaggtatcgattgaagaaataagatggttggaacaatggaggaaacaagcaggaggatccctgggtacttcaagaacaagggcatcctcatcactggcgcaacaggcttccttggaaagatactcgtggagaagatactgagggtccagccggacgtcaagaggatctacctccccgtgcgtgcgccggacgcagcatcggccaagaaacggctggagactgaggtgatcgggaaggagctgtttgggcttcttcgggaaacgcacggcaaggggttccagtccttcatcgaggagaaggtcatcccgttggccggagacatcatccacgagaacctcggcgtggaggagccccagctgagccagatgactcaggagctcaacgtcatcgtcaatggagctgccacaacaaacttctacgagaggtacgacgtggccctggatgtgaacgtgatgggagtgaaacatatttgccagctcgccaagcagtgccccaatctcgaggtcgtcctccatgtgtccacggcctatgtggtgggcgagaagcaaggggtgatccaggagcgggcgttcaagcagggcgagacgctgcgggagacggaggcggagctggacatcgacgccgagctgcggctggccagtgactaccagcggcaggtcgccggcgacgacgcggagcagaagaacga

SEQ ID NO: 9191 - DNA, 675 bp, Sorghum bicolor
  unsure (1)..(675): unsure at all n locations
  Clone ID: SORBI-28MAY03-CLUS86368_1
gcacgaggcgcagacgggttggggaagaaggagagaaaaaaaaaaaaaatcgcagcctgccagactaaccctagcatctcatctcagcagcagctagggtttgagatggcggcggcggcgcgtcagcgggggacggtgaagtggttcaacgataccaagggcttcggcttcatctcccccgaggacggcagcgaggacctgttcgtgcaccagtcgtcgatcaagtcggagggcttccgctccctcgccgagggcgaggaggttgagttctccgtctcggagggcgacgacggccgcaccaaggccgtcgacgttaccggccctgacggatcttacgtcaagggcgggagtggaggaggcggaggcggcgggggtggctacggctcccgcggaggcggcggatctggcggtggcggccgcagctatggcggtagctggggcggcggccggagatctggcggcggaggtggagccggcgcctgctacaagtgtggcgagcctggccacatggccagggactgccccagcgccgacggcggcggtggaggctacggtggcggcggtggcggctaccgaggtggcggaggtggctgcttcaagtgcggtgagcctggccacatggccagggactgccccagcggaggtggaggctacngcggtggcggcggcggcggc

SEQ ID NO: 9192 - DNA, 820 bp, Sorghum bicolor
  Clone ID: SORBI-28MAY03-CLUS86447_1
gctcgcggctccccgcctccccgccggcgctcctcctccagcccctcctccccgccgccgctcccctcctcccctctgcttcttccttcccatcccctgctgcttccaagccaaccccaccggcaggcatgcagggcccgcagcgccacgcagcggcggcccgcagggccgcggcgcagcaccgcccgcccccccgcccccggccgagccgcccgccaacgcacggccgtggccacgcggcagcggaggagcgtccgcagccgcagctcctcctcctccgccgcccaaggtgtaccgcgtggagccccgggagttccgggacctcgtgcagaggctcaccccccccccgcccccggccccggcgcccccgcgccggcggcgccgcccccccccccgccccgccgccgccccggcgcccccggggcggccgcggcccgcgccccccggtcggcgcgccggcgccctgccgctcgtccccccgcccccgccgtggttctcgttccccatggccggcgcggtggaggcggcgcagccccagcacggcgctttcctctagctagcttcctgcctgtgtgcgacggaaaagaggtcgtagaaattagcatcctttgtttttgtttctttttttccttctaaatacaatcttttttttccttttaaaataatataaaaaaaaggaggaggaggaaacctaattaagcagcagatggagctagctttcgatcgccttgtaattttactctgtctcttctgtatgatagatagacatatataggtgtgtaataatacagtactagtaataaattaagaaacagtagtg

SEQ ID NO: 9193 - DNA, 722 bp, Sorghum bicolor
  Clone ID: SORBI-28MAY03-CLUS8380_1
gcgatctactgtcaaatgcaagatggtggcttgaagaatataagtttgatggatttcgatttgatggggtgacctccatgatgtatactcacgcatggattacaagtggcatgtgaccgggaactatggcgagtattttggatttgctactgatgttgatgcagtagtttacctaatgctggtaaacgatcttattcatgggctttatccagaagctgtatccattggtgaagatgtcagcggaatgcctacgttttgtattcctgtccaagatggtggtgttggttttgattatcgccttcatatggctgtcccagacaaatggattgaacttctgaagcaaagtgatgaatattggaaaatgggtgatatcgtgcacaccttaacaaatagaaggtggctagaaaagtgtgtcacttattgtgaaagtcatgatcaagctttagttggtgacaagacaattgcattctggttgatggacaaggatatgtatgatttcatggctctggacaggccttcaacacctgtcatcgatcgtgggatagcattacataaaatgattaggcttatcacaatgggtttaggaggtgaaggctatctaaatttcatgggaaatgagtttgggcatcctgaatggatagatttttcaagaggtcctcaaagtcttccaaatggctctgtcattcctgggaataactatagctttgataaatgccgtcgta

SEQ ID NO: 9194 - DNA, 801 bp, Sorghum bicolor
  Clone ID: SORBI-28MAY03-CLUS8880_1
cccacgcgtccgcccacgcgtccgaaattgagcagagtgacagaaaacaatgacaggggaaccttgttcttgtaggaaccaggaagagcagaggctgattttggccggtatgatgtgaagagagttgttcggaccatctacgtgctcttctctaggagcgaaataccaatagcaaaagaaggccaagagattatggaccttgcagacttgtcaacacctcttccagagtggttgactgaggatgatctagctgtgtatgcttcactctatgagaaatcgggtttccggtatccaatggaaatgccatataggtcgctccataaaaggatgccaattgaagatccaagattccaagtcccagtgtttgttgtcatgggggagaaagactatgtgttcaagttccctggtgttgagtccgttttgaaagatggcatcatggagaaattcacaccggacctaaagatcacctacatccctgaaggaagccatttcgttcaggagcagttcccggacaaggtgaatgatctcctggtcagtttcttgaaggaccaccctgtggctgcatagatgttctagcagtccatgttcactgtcacaagcaacacctacgataggaaaaactgctatgtgtagtgtcgccagtaaaggaacaatctgatactgaatttgcatcagctttacagtgttctgactgtgtttgcatctagcgtgtgaaacaagttttaaaaatcaagcagtattgattgcataaagcatcagtgttcttgacgaaaatgattataaagaccgaaaattcaagta

SEQ ID NO: 9195 - DNA, 715 bp, Sorghum bicolor
  Clone ID: SORBI-28MAY03-CLUS89020_1
gttccaaggatgtggtacaagtgcaaaatggggaacggatttctgctctgtccacaggaagagtttgttgggcggtgacagtgccatccctgaagctttgcctgccccgtcagaaaaacgacgtcgtgccaagaagcctaaaaaggcagcgaagctgtctgagacctcccaagagaatgtcacaacagcagctattgctggtaacagcacgcaacacatgggcgttcttctcatagctacccctgttactaaccatgacatgttaaccaagggtgtgacagtggcggcgccagctgcaatagcgcccacgcagatagtggcgccacttgccatcaaatcaccaacaccatctggatcggtggctgcaggagcagagagggaggcgggagcaagcagggagatgctgggtctgtagaaagatggtggcagtgcataatttgggaggcttggagacacctggccagatagctctctaattattgctttttagactgagaaacctcgaaactttaggaaggttgcaatttgacaggcttgcaccgtcaactgactagttatgtcctgtgcctttctcatttgtaaatctgtaatgcgaatctctagttgttcttgtgtatgttctcctgggccttgtaactttggacaataagcaataatattgtgtcattgcctaaaaaaaaaaaaaaaaaaaaaaaaaaaaaaaaaaaaaaaaaaa

SEQ ID NO: 9196 - DNA, 1040 bp, Sorghum bicolor
  Clone ID: SORBI-28MAY03-CLUS8905_1
gcacgaggatgatatctgcaacattctcttgcataaagcaggccatggctcttggctgcttccctaggattaagataatccatacttccaagaaagtcatgggccagatttacatacctgtgatgaattggtttctaatggtcatgtgcatcatcatcgtggccacttttaggagtaccaatgatattgccaacgcatatggcattgctgaagttggcgtcatgatggttagcactgcactggtgactttggttatgcttcttatatggcaaaccaacttgttccttgtgttatgcttccctattatttttggtgcagtagagtttgtttacttaactgccgttctgtcaaagatacaagaaggagggtggttaccgttggctttctcatcactgtttctctgtataatgtacacatggaactatggaagtgtgctgaagtaccagagtgagatgcgtggcaagatatccctggacttcattcttgatctgggagccacacttggcactgtaagagtcccaggcattggacttgtgtacaatgagctggtccagggaatcccatcgatttttggccaactattagtcacacttccagcgatgcactctacgattgtctttgtttgcataaagtatgttcctgtcccgtatgtcgctctagaagaaaggttcttgttccgaagggttggccagaaggactaccacatgttccgctgtgttgcacgctatggttataaggatattaggaaagaagatcatggcttctttgagcaacctttggccgacagccttgaaaagtttcttaggagggaagcccaggaaattgcgctcgaggcaagcacaatggaggcagagcgtgatgacatatctgttgtatctggagtgcctcagtctcctgcttgtgatggggatctgcaaactccactgctttctgatcagaatcaggtgataacaacagaatggtcaccacagatggtagcgatcctgtgcttccctcagttccatgtctgcagaaaaagaacctggtttagagtatgagct

SEQ ID NO: 9197 - DNA, 614 bp, Sorghum bicolor
  Clone ID: SORBI-28MAY03-CLUS89070_1
gacccctccatgcaccttccacacctcacgagtgcggaggcaccgctgggcgccccggcatttacatccggcggcacatcggctgtggccatgaacctgctcgacatgggctgttcttcgcacaacatggtgatgaagatgacaacatcatgtggctctgccagtgacatgccgctgaacagcggtggtgagcgcttcggtgccgccgccgattggtcgatcctcgacaagctgctagcgtcacaccagaatcttgaccagctcttccattgcaagttcgggggaacaaccttagcagtgcctcgccattatcaacagcagcagatgcagcagcagcagcagcagctcatggaaatgagcgcgtcttcactgcataggctgcctctccattaacttattggctgtcaaactgagatgagtgatgatatgatgagatctccacaagttttccaagtagcttgattaaacgatatgcaattaagctgtgcttggagaagacgggttcttgtaattttcatggatcagttttccctctatttcaattttactctgaagttttagcagttctttgaaatgtttataatcagctccggtttcccccccgtgtgcagcaa

SEQ ID NO: 9198 - DNA, 1207 bp, Sorghum bicolor
  Clone ID: SORBI-28MAY03-CLUS89124_1
tctggacacacgcaaagcccccgcctcatctcatcaagtcctgagtgcattgctagctagctcctagctgagagagagagagccatggccaagctccaagtcactccggctgccgcgttcactgagtacaaagagcttatcttccaaggcctgtacctgcaccacatgttctggaaccgcccaaaggccaaccaagctcggatcatagaaaacaaggcaccgcttggtattggtgccaccgttgttaacaactgggaagtatatgacgggccaggggaaaacgcaaagcttgttgcccgtgcacaaggctcgcatatctatgccgggaaatgggccaattccttcagcctagtgttcgtggatgaaaggttcagtgggtccacacttgaagtgatggggatagtagttgaaactggggagtgggctgttgttgggggcaccggtcagttcgctatggcaaacggtgtcatctccaagaggttgcataaatcgacaagcgatgggaatatcatagagcttacaatccgtgccttttgcccacagctcaaaggaacaatgtatccggtcataaaagttgggccattcggtgggagtggagggtctgcaatggacatcacagaagcacccaggcgtctggaaagcatcaccgtttacgctggcgtggtcctggactccattgcattctcctacatcgacaacagtggtcagaagcgctctgctggtcgctggggtggccccggtggaggagggcctcacacgatccagcttggcgagtctgaggtgatcacagaagtgtctgggacattcggcacctactacaatgccaccacgataacctccatcaaattcgtcacaaaccttaacaagacctatgggccttggggcggcgggcagggtgcttcattcaccatccccgtgcagccaggcagtgccatcgtgggcttcttcgtacgcggtgcgacatacctccaggccattggtgtttatgtgcggaccctctagacactgagaagcagccgctttgcagatccagtttctttcatctcatttcctactagttggatcgtcgctaaagttctcagtgtggcatgtttacccttctacgtacttcacttagttgctattttccctaataaagtactgtggtcagtgtgatgtatgttacctctgtcatgaattttcacaaataaagacctccattcatgct

SEQ ID NO: 9199 - DNA, 625 bp, Sorghum bicolor
  Clone ID: SORBI-28MAY03-CLUS86843_1
aacttgttccctcgcacaccacaccccggcaaagcgaccgcgagcagcctctgcaactctctctctctatcgatcgccgggccacgcagcaggcagcagcgacgcgcgcacacaagtgaaggggaagtggttggggggggggtttctcgtcctggctatgagaggtttaaggcggtggctgccgttctgcggcggcggcgcccgcggctgcggtgaaggaggcgccggcaggggagggggcgtggcggacggactggtgtgggatgtggccctcaaggcgcacgcgtccggtgactactccatcgccgtggcgcaggcgaacgagtcgctcgaggaccaggcgcaggtgctggcggccccggccgccacgctcgtcggcgtcttcgacgggcacggcgggcccgaggccgcgcggttcgtcaacaggcgcatcttctcccatatccaaggctttgcggctgagaacgggggcctgtcggcggaggtgctccagaaggcgttcggcgcgacggaggaggagttcataggcctggtgcagaagtcgtggccgtcgcagccgaggatcgtctccgtgggctcctgctgcctggtgggcgccatcgagggcgggacgctgtacgtggcc

SEQ ID NO: 9200 - DNA, 1263 bp, Sorghum bicolor
  Clone ID: SORBI-28MAY03-CLUS8688_1
caaatatcttggaggttggttatgtgatgctaatgacatacttcttgaaaggaatgatttccctttttatggggaatagtccttttggcatgtctatttgttacctctattttttatggtttttgatatgtatgaagaagtgggcatagacttctgcaaaaaagataattgtttaacatagtcttctatgtttggtaaatgcctatgtcctcaatttgaggatgtcattttcttcaatgaaatgtaaacatttagttttaaatataacttaatcagccagtcattgaagtcttgtaataaaaaagaaaatttctagaagtgacattgtatggtgtgatctggcaactcggatgctgcttttgctttttatatcttatgaactgctgactgatttacattccatttccaattcatgctttgaggtgatttggagcatacacatctggtcaagggcttggactatgctctacttcacaaagtgcggagtgaaattgaaaagaaacctgatgcagaggatgggaaggattctaaatcaagggcaacaaaagaggatcaggcagtctctttccgcactgcaactgcaaagtctgtctatcaatggatcataaagcctcaaagcataataaaagagaatgaattgtttcttcctggtcggatgtcattcatttacaatatggaggagggaataactaatgatattccaacaactcttcataagagcaaagctgattgccctgtaccagaggagatggtgactgtcagcgtggatggttctgtacttgacaggattgctaaaattatgacataccttcggcttggatcttcagggaaggtcttgaagaaaaagaaaaaggagagagatataaaagggaagaacaatttggcaagtggtgactatgatgagtctgtaaaaccttcccaaattaatggttctactctgaaacatcaatcagatatgccaccaccaccagctccaccccctcggaacaataatttcaatggaaaggagaaacaaccagtccctgtttcaagagcagatgatgatgacatttttgttggagatggagttgactattcagttcctaacaaggaaatgagtcagagccctgtttctgatatggatgaatccccacataaccatcagaagcagtccaatttcactgaacccatgtatggcccagtaccaccatctgaacctgctcaagcttggcaacagcagaacgggtatgatgctgttcaagcccagatggcagctgctggata

SEQ ID NO: 9201 - DNA, 684 bp, Sorghum bicolor
  Clone ID: SORBI-28MAY03-CLUS86933_1
ggcgtgctcccccgtgttcgaaagcatgttcatgcacgacctgagggagaaggagtcgtccacaatcaacatcagcgacatgtgcctggagtcgtgctcggcgctgctgggcttcatctatgggacgatcgagcaggggcagttctggaagcaccggctgccactgctggcggcggccaacaagtacgggattggcgacatcaaggactgctgcgaggagagcctgctggaggatattacctcggcgaacgtccttgagcggctccacgtggcgtggctgtaccagctggagcggctcaagaaagggtgcctcacctacctgtttgtgtttgggaagatttatgatgtgagggacgagatgcacagcttcttccaccacgcggaccgcgagctcatgctcgagatgttccaggaggtcctcagcgtgtggaagcccatgtgaatgagttgaattatgatgatggtgtgtctctggctttctgtgggtatggatgggagaaaccatcagtattgctgagttgttcgtgctgcctgccaataggattgaagcattcctgcccctgtgagatgcgtttcatgatgttaaaacttgttcggttgcaatgtgtagagaggatgctggttatgtaagagtatggtgtacatatttgaaacgaaaaggttctcagaattcgaatggaagtt

SEQ ID NO: 9202 - DNA, 990 bp, Sorghum bicolor
  Clone ID: SORBI-28MAY03-CLUS86978_1
gcaccacgaccccccgcaccacttacctaacgctacctgcttttacaccgcggcggccgcgttgagctcggctcgatcgagttcgcgtccgtcccagatccgcccgtcgtgctcctccatcgctcgcgcaaagatgaagatcacggtgcgggggtcggagatggtgtacccggcggcggagacgccgcgccgccggctctggaactcggggcccgacctggtggtgccgcggttccacacgcccagcgtctacttcttccgccgcagggacgcggacgggaacgacctgacggccgccgacggcagcttcttcgacggggcgcggatgcggcgcgcgctggcggaggcgctggtgcccttctacccgatggcggggcggctggcgcgcgacgaggacggccgcgtcgagatcgactgcaacgccgccggggtgctgttccagggggcggacgcgcccgacgccaccatcgactacttcggcgacttcgcgcccaccatggagctcaagcgcctcatccccaccgtcgacttctccgacgacaccgccttcccgctgctcgtgctccacgtggcccacttcaaatgcggtggcgtggctatcggcgttggcatgcagcaccacgtagccgacggcttctccggcctgcacttcatcaactcgtgggcggacctctgccgcggcgtcccgatcgccgtcatgcccttcattgaccggtccctcctccgcgcgcgtgacccgccggccccggtctacccgcacgtcgagtaccagccggcgcccgccatgctgtcctccgagccgccacaggcggccctcacggccaagccggcgacgccgcccgcggccgttgccatcttcaagctctcccgcgccgagctgggccgcctgcgttcgcaggtccccgcgcgcgagcgcgagggcgcgccgcggttcagcacgtacgcggtgctggcggcgcacgtgtggcggtgcgcgtccctggcgcgcgg

SEQ ID NO: 9203 - DNA, 777 bp, Sorghum bicolor
  Clone ID: SORBI-28MAY03-CLUS8712_1
tcgggatcatctcttcttcggagcacaaccgagtggttccgagcagagttgaaggagcgggagatggatgcggagaaggctgttgctgccgctgaggcggaacggaagagggaagaggaagttgagaggctgctcaacaaggtgtggtggtactcgctgttcctctacttcggcaccatgatcgtggcgatcgcgccgaacttcgcgccggcgcccagccccgccgccgccgttccgtccctcctcgcctgctacgacgtccgctaccgcctcaccgccgtcttgttcgccgtggtttcgctggccatgcaggcgatgctggcgctcgtcctggagaggaggcccgcgccggcgccgcacctgacaccgctggccgcgtggccgctcggcatcttcacctggatgttcgtcaccacgttctgcctcagctgcctctcgttcggcgtgcggaactactactacgagtggacggcggccgtcacgtccgcgggcaacctcgccatggccgcacgcaccgtgatgcgctacttggcttgaggaggacattgcagtgagctgagaccttcaagagagttctaatcatactgtggctggggtatcatgtccatctgtcgttacgtttcttcgttagtgtctgtgtctttgatgagttcgaagtttagtagtagtaataagactagtaattagcaggttgcctttttgtgatggttgtgctgaacaatcctttccctagcgttcgtaaaaggtcggtagccttgatatggaaccgtgggtggc

SEQ ID NO: 9204 - DNA, 1088 bp, Sorghum bicolor
  Clone ID: SORBI-28MAY03-CLUS91451_1
ggcgcgggacttcgtctacatcgagaaccagtacttcctggggagctcctacgcgtggcggcggcagaacgacggcgtgacggtggaggacatcaacgcgctgcacctcatccccaaggagctgtcgctcaagatcgtcagcaagatcgaggccggcgagcggttcgccgtctacgtggtggtgcccctctggccggagggcgtgccggagagcggctccgtgcaggccatcctcgactggcagcgccgcaccatggagatgatgtacagggacgtcacgctggccattcgcgccaaggggctccaggacgaccccagggactacctcaccttcttctgcctcggcaaccgcgaggcgccgagccccggcgagtacgtgccgccggaccacccggaccccaacaccgactacgagagggcgcagcaggccaggcgcttcatgatctacgtccatgccaagacaatgatagtggacgacgagtacatcatcgtgggatcggccaacatcaaccagcgctccatggacggcggccgcgacacggagatcgcgatgggcgcgtaccagccgggatacctggcgaccaggaaccggccggcgaggggccaggtccacggcttccgagtctccctgtggcaggagcacctggcccaggcggcggcggcggcggcgggcggagatctcctccgtccgtcgagcctggcctgcgtgcgccggatgaaccaggtggcgaagcagcactgggacatgttcgcgagcgacgcgttccggggcgacctcccgggccacctcatggcgtacccggtcagcgtgctcgacgacggcagcgtcgtggcgacgacggaatccttcccggacaccaacaacgccaaggtgctcggcaacaagtccgacatcctcccgcccatcctcaccacatgatttaatcatcgattatgttgaccacccgccgtggaattgttgtttaatttattgttatgaagcgcaagtgagagaagcagcgtgtgtgtgacaagtgtcaagtggtaatgcaactattgtaaataccatcgacgtgtgttgtgattcatatgttaacaaaagcagaata

SEQ ID NO: 9205 - DNA, 1319 bp, Sorghum bicolor
  Clone ID: SORBI-28MAY03-CLUS9157_1
agaaaaaacacacgaaattaaaatcccacggaaatcggagacccgaatccctcgcccccaggccccgaatcctacccgaaacctccgagctcgctcgccatttggatccgcctcaccgccgccgcccgcccgcccgtccgccggtcggccttgactgctcctccgcacgcggcgcggaatctaccttgggctgggagatccggggaaacccttgttcccgggcgttccgggctcgaatcttgctgcgggaatggagcacgtggttggagcgaggtttaagcttgggaagaagatagggagcggatctttcggggagctctatctcggcgtcaacatacagaacggcgaggaggtggctatcaagttggaatctgtgaaatcaaggcatcctcagcttatttatgaatcgaaaatatacatgtttctccatggaggaactggaattcctaatttgaaatattttggagtggagggtgattacaatgtcatggtcattgatcttcttggtccaagtctcgaagacttgttcaactactgcaacagaaagttctctcttaaaacagtacttatgctagctgatcagatgatagccagggtagagtatatgcacacgagagggtttcttcatcgtgatatcaagccagacaacttcctcatgggcttaggctgtaaagcaagtcaggtttatgtcattgactatggccttgcgaagaagtatcgagacctccatactcatagacacataccatacagggaggacaaaaacctcacaggaacagcacgatatgctagtgtaaacacccatcttggagtagaacaaagcaggagagacgacttagagtctcttggttatgtgctgatgtacttcttaagaggaagccttccctggcaaggcctgaaagctggaacgaaaaaacaaaagtatgacaaaattagtgagaagaaaatgctaacctcaattgaggccctttgtaaatcttatccatcagaattcattacatacttccattattgccgctctttgcgatttgaagataagccagactatagctatttgaagaaaatcttccgggatttattcatccgtgaaggttaccagcctgattatgtatttgattggactgtatcaaggcaagctgcggacaataacagattgcgactgagcgggaagacaggtgggttggtgggaccatctgtggatcgggctgaacgagctgcaacaagacatgatgttgcggaaagattcactggtccagctgatgcatttactagaagaactggctctggttctggtcattatggagaacacacaaagcaca

SEQ ID NO: 9206 - DNA, 670 bp, Sorghum bicolor
  unsure (1)..(670): unsure at all n locations
  Clone ID: SORBI-28MAY03-CLUS917_1
gccggccggccgggagattatctctctctttctcatccctccagttcggagtccacagaggagagagagagatgaaggagggatcgtcgtcggggggaggggcgttcgctgggggcagcgatccgaggcagccgtcgacggcgaagccgtacgcgccgccgaagctgtcaccccaggacctgcccatcgactatgcgggcttcctcgccgtcgtcttcggcgtcgtcggagtcatgctccgctacaaggtgtgctcgtggatcgcgatcatcttctgtgcacagtcgttggcaaacatgaagaacttcgagaatgatctgaaacagctctccatggccttcatgtttgctgttatgggtctggtgacgaactattttggcccccctcgtccaggcagcacaaagcgctaatctgtggaagaacaccatgtgcctcatccttcataggatatctagccaatctttttggtgcttcgatagcttgccatcggtgctgacatttatgtatgtccaatttgagcaaacgttataggtatggacatcaaattaatggaccggtacatgtataatgctcaataatttatctgtgcagtactagtacacactgtttgaaagagtttttggtgcctccgatcaatgcttcccacaaaaaaaaaaaaaaaggcccctan

SEQ ID NO: 9207 - DNA, 839 bp, Sorghum bicolor
  Clone ID: SORBI-28MAY03-CLUS918_1
cgcgtccgcccacgcgttcgatcggagtgaagaaggcatcggcgaatttgtggctggcggtggtggactcgatagcgttcctgctgctgccgccgcggatataaaagggaaaatccccgccggccgggtcgcgacctcgcgcaaccaactaaccaaccacctcgctcgattcgccatcgacctcgatccagcccagccagccgccgccgccgccgcagcagcagcagccatgtccaaggtcttcaccctcgaggacgtcgccaagcacaacaccaaggaggattgctggctcatcatcggcggcaaggtatatgatgtgacgaagtttttggaagaccacccagggggtgatgatgttctgttgtcttcaactggtaaggatgcaactgatgatttcgaggatgtcgggcacagcaacactgcccgtgcaatgatggatgagtacttggtcggtgaaattgacgcatcgacgatcccttctaggacaaagtatgttccccccaagcaaccgcactacaaccaggacaagacccccgagtttgttatcaagatcctccagtttttggttcccctggcaatcctgggcctggctgttgccgttaggatgtacaccaagtcggagtctgcttagctttgttgcccttgcccccctcgggattgtaagagtcgaacttgtcgaataagctagcaagagttttgtgaggttttattacatgtgtaacttatcatgaaattcatcgaatgttctgagctgttgtgggttctgtggtccttatatgtccattttgtgcgttagtgtgatcgggatgcatcgtacttaactagatttattatttgtc

SEQ ID NO: 9208 - DNA, 712 bp, Sorghum bicolor
  Clone ID: SORBI-28MAY03-CLUS9192_1
cgagaacctgccaatgcacgccggttttgatgagatacagcctgagaaggatgtgcagaaacctagtaccagtgtggaggattatagtatcaagaatcatgttgggtctgagagcgttcagtttgatgatgaagggaaacacctctcagatgatgatgtggagatgagagatgacacgcctgggtacggttcatctcacgctcaagatgatgcacatggttttgttgcccatgatgatggcaatgagtctggtgaagattttgatgaaaaatcaggccacccttcagagcccacagactgcaagagctgtgatactggtgcctcatgtaaatgttggttgaagaagcatatgacatgcctgtataaccaagcaaaggaaacaagtgctatctggtctgtggtggttgcagctgcactagttggtattgtgattttgggacgttggcacaaagataaattgcaccttaaccagcttaaatggcgctctggctcagcagtgagaggatgatcaacaagtggtttgtgctgatacaactctgatgagtcaattcaactgaagtcataaccaagatggttgttgcagtattgttgtgacgatgatgaaaaggagtatgttcaatgtaataatatgatgttcaactgtaatttcacttgccgcctacaatgatgagtgcctcgtgggcttttaagatgtcaaattcacttgtgctat

SEQ ID NO: 9209 - DNA, 913 bp, Sorghum bicolor
  Clone ID: SORBI-28MAY03-CLUS87924_1
gagagtggcaggtgggacatgatgaaatcttcaccaataccatgtgatgttgatttcaggcctagcatccttgtcaggaatatcttgtattggccgttgaagtcaaagcatatccttgcatttgagttggtcacacataggttatatcatattgagtgtccaccagagacacatgatatatacaggaggaatgtccacatcatgaaaacagaggatggtggtctaggtcttgctgctctggcaaaatttaacctgcgcctgtgggcatgggaaactgatgctgagggtgttacaggatgggtactgcgccggatcattgagttggatagattcctgccattggatgtatcgtctctgccctcaccagaaaatggttcatgtggaaggcctcctgtcaggatgttgggtcttgttgaggatgatgatttggttttcttatggacaataactggggtctttgcggttcatctcaagtcaatgaagttcaaaaaagtgtttgaggctgatgtctccaaaactgtttatccctacaaaggttttcacattgcaggtcttgttggatgtggcggtggaaatgttgcagctgaataattgtagactggtatctgctggcttcctttcgtcaactggcaagcagataatagcagatgatatctgccgacttctgattgtcgttcctgcataataaattataagcagtgacccagtgacataatggtaatcctaagaggtgccaacgtgaatctctagttctttggtttcatatattttgttgtgttggttgtgtatctaccttattacgacttgtaaggatcgtttggtgtttaaggtcgtaacggcttaatgctgtcgtgattcatgtggtcgtggtcttggattatttgaatatttatccttgtgttgtttgttgagg

SEQ ID NO: 9210 - DNA, 656 bp, Sorghum bicolor
  Clone ID: SORBI-28MAY03-CLUS88124_1
tcggaggtgggccactggcgtctggacccttttcggggtgcctcgctcttcctggcttgggctatccattgcgtcgccgcggctatcctcctcttgcctccaccgagccccctcttgcctccacggggggcactatgggcgcttggcgctggactacgtacgcttggcgcacgcgaacatccgtcggctgcgcgccaagagcagccgcccctgggcccaagtgggatacggcgggtcccctgtggctgtggtgggctccacttgcgccctggcagaccctccttgcgaccactcctaccctccttgagacgacaccggcgcggctcgggcccagcgtggcgcctacccggcccagccacgctccgacgcctgcctgccgctggctgttggcgctgtccggcctgcttctggctcctacccccctctacctagccctacggtcatgtcccgaacgcctcctggttggtcggcccccggatcgtccgctgccctggaccctttttgactacggaaagcgcaagtctctttcgatccagtcattgtgatgtcaagctctgcggatcgatgatttttcctgctaatcagttggtctctcactctcacgaacacacaagcataccatgcctgctgcctgcgcctgcttcctggaccatgcc

SEQ ID NO: 9211 - DNA, 895 bp, Sorghum bicolor
  Clone ID: SORBI-28MAY03-CLUS8808_1
gtgaaggccgtcaagaaggagaagaaatgccccttcgccaccgtcaagatcgaggagatctccgatgacaatgatgctggatgcgtcgccatcaaaaaggcatttgctaagggcaacggcaagggaaagaggaaggagctctccccacaggatgctgcattgctcatccagatgacctacaaggctcatcttggtcaccgctcccaagtgcttcgctgcctgcgcgatctggctgtggctaaagccaagctcaaggagctcaggtccctgttctataacatctcctacaggcaccgcattgcacatgaccatgaagagcgccagaggttctctgagaagatcatcgtactgctcatcactgtcgatgcgctcgagggacctgactacatggtgaggaccgcgaagaaatctatgctagaggagcttgaagcaatgctggaagttgtggaccctcaacccccagggaagcagagatcactgagccgcaggaagtttgatctcccagagggtggagccatttccgatgagaaaatggctgctgcgaacaaggccgtcaggatcatcgaggagggcaagtgatgcagagtagagggagccaccaccttgttagtggcaggatatcatgcctaaatcctgatgaaagctctgtagcagcagcatatctattcgtctatcgtctaggagaagtttagacctgaggcaactccgcactttgttgagacttacgattatcctagagggagctatgtctgcactctgttgtaccttcaatgttatccatgctttactgtgaacctgtagtatgtttctagacaagtcaatttgagctatggaatgtctcgggaggtctagatccatatctatatgtatgtgcaaagtgctttagcaacgatct

SEQ ID NO: 9212 - DNA, 911 bp, Sorghum bicolor
  Clone ID: SORBI-28MAY03-CLUS88477_1
gcacgtggccgcccggagccgagttcccccgcgacgccccggcttaaatacatgaagatggatgtaaagaacatgtcagattttgggtctggttcatttgatgctgttattgacaaaggaacactagattctctcatgtgtggccaaaacccccccctcgcgccgccgctccgcctcgacgtcgcgccccgcctccgcctgctcctcggcggctgcggcctctccgcttttggggatcccaggttccgcgtgcgtctcctggaggtcgtcgacatcgggacagcttcgctccttgtcgtgcaaaggtgggagaaatgccccgaccagcctcaacgggaactcacgaagccggtgcctttggacgtcgctggctctgcgcctggtgcacttcttgccccgattcccgatggccccctcgtctctctctggggtggccgcaacgcccgcgcgagtgcggcgtcgatgcttggggaagctgccaattgatttctcctataacccatctgaaccgacgtgcgtaaccagtgtagcaaataatgtagagctagaacagatgatgtacctcaaatcgttgttgcttcattgaataataataaccagtgtgtgaataatgtagaacagatgttgtacctctgcgtctcttgaaggacatggaaaattggacagtaaagctccatgtcatagaaagatgggagaaaagctcaaaccagaataaatgggaactgacaaaaccattgcctttagatgacgatagcacatcactagttgcacttcttggcccgaaacctgatgtccactacatctatgtctgtgtaaagggcaacggtggcgcaagtgcgggttctaaagttggagaagctgccaattgatttctcctataacccatctgaaccgacgtgcgtaaccagtgt

SEQ ID NO: 9213 - DNA, 967 bp, Sorghum bicolor
  unsure (1)..(967): unsure at all n locations
  Clone ID: SORBI-28MAY03-CLUS8878_1
gcacgaggaaatagccactgctccaccccgtgtgggccatggcgcggggccttctgggttggcacctgcattacagaatgacaggcaatcaggccctgaggaagcaaggactagtggttggtcatcaatggaccggcgtcgtgccccactaccaattacaagcgtggggacattatctaagcagaaagcaccagtagggaatgatgctactgtttctagagatgctgtgatatctggaccaaactttctgggaaggtcaagtggatcttcaaggaggcctgttatttcaactagccacgatgtggtggccactgatagttctgagccttcacgagcacgtacaactgatgcaagccctggggcattccgcagagcctcaggtccccagagaagctcacctgtccattctgcagaacaaaagcgctcatcctcaggccggcatccatctaatgtgaagaactatgattctgctctcaaaggcattgaaggtcttaattttgatggtgacgagagggttcagtactagagctgcaagaaatactacgtccactgtaaaaatcataatcaggtggtaagcattgtgtttcctgttgagttttggatcaacaggaaataaaatgctggaaggaggatctgatcacgtgttgggcggtttcaggtggtcctctgagcaaggtaaataaatggtcctatctgaggcgcttcaagcctagctctcataatgttgttacgctatgtatgtaaatgtctcttatagtgtgaatgtcaggcgcccggattcatcagtctattttattgttcaattccttaagatgttccattttgagttgctgaatcttgggacaacaaagatgtgagactggtaggactttatttggaaaactggaattcgagcatgtagaatttttaaatcggtttattggacaaatttgtctgaacatgttcctgactagtaatgtgtgctanc

SEQ ID NO: 9214 - DNA, 1265 bp, Sorghum bicolor
  Clone ID: SORBI-28MAY03-CLUS88764_1
catccaaaagtagcagtggcaatagcctgcagagttcattccataagccatctaaggcaaaccaaactttgaagaggtctacaagccaaaaggatttctttcattctcgagatagcagctctagccattcttcaattactgatgacgagtctaggagttctcactctttccatagcagaaatcagaatgaaggctgtgtagtttatggtctcagcaaggatcacccaattggtgatggggctggaaatgtattgtatgatgtaatgcggaaagaagttaggcaagctgttgaggaaatcaggaatcagcttgaaaaggccgtgacaaaatccgaaccttcagaaaagccaataagcagtgatgcacaaccaacccaagttattactgagctccgaaggagctacactagtaaattggaagagtcagagaagcggaagcaggaattgttggctcagttggcagcagaagaacaacatggtcatgagctcacaaaaatagttagagaattgctacctactcctaaaatgactgcaaatttacaaagacagccgcgacacagaagaaggagcaatgatagatcacggatgtcaaagcgacttactgaagaggctgagcaatactttgaagatttcctgtcgaatgttgaagatactgacttttcatcttttgatggagagagaagtgactcaagttcagccaggaaagacctgttacttaatgctacgacagaaactccagttgcacgcccaaaagttgctttacctgcagaggcagatggcgttgtccttccctggctgcaatgggaaactaccaatgaccttcagacctcaccgtgcaaaaccaaggcccagggagaaagtaccagatgcagcactagcaatcagactacgagcagccgtgggagttggagccctggagaccatgccacttcagttgcctctaaagatagattactgaccaagttcggtgaagttgggatttgccgaagcatctgccctgattatgttcgaaccttgtcgtcgtttcacattgacgactatttgcatttgagacagagtgaggatctcctcttggagacgtggaggcagaaacacagaatcgactctggcggcctagccctgtgcagtaaatcgacaatattgtagagtacagccaaataggtagttgatggagttgagttagaataaatgcttagatttttacctttggctgcgatggctcgtgccgcctggcgtgtatagatgcatgcattgtggttaacaatt

SEQ ID NO: 9215 - DNA, 978 bp, Sorghum bicolor
  Clone ID: SORBI-28MAY03-CLUS9331_1
acagaatttatgtccagtggaagtgtgtatgattacctccataaacataaaggtgttttcaaacttcctgctttagttggagttgcaatggatgtgtcaaaaggcatgaactacttacaccagaataatattattcaccgtgatttgaaaactgcaaaccttctgatggatgaaaatgggactgttaaagttgctgattttggtgttgcacgtgttaaagctcaatctggagttatgactgcagaaactggtacttaccgttggatggccccagaggtcatagagcacaaaccctatgatcacaaggctgatgtttttagttttggaattttgttgtgggaactactcacagggaagattccttatgagtacctgactccactacaagcagctgttggtgtggtgcagaagggattacggcctacaattccaaaacatactcatgcaaggctttctgagcttcttcagaaatgttggcagcaggaccctgcccaaagaccagacttctccgaaattttagaaacccttcagagaattgcagaggaggtaggagatgagcacgaggggaagcacaaggacagatcacctgggtggtttcttttcagctttcagggggcggagccattgagacacggttgaagaatgaagacttgtaatgtacatggtcccggtccatccttgaaggacctacaaccagcgcctgttcctcgcacgtcagcaccagtacacagaaatacagacctgctgcagctgcagctgactgaagtggcaatttttagctgcagccatcgctttccgcctatctgctcgttattcccgagttccattattacccaatgtaacataaggagaggaagcttgggaactgtacatcatcatcggtctgatttctctaacagagtgtaatcttgctgtagatgaaaataataaagccagattgcaggcctgtggcatgattcttttaagattccatcattt

SEQ ID NO: 9216 - DNA, 648 bp, Sorghum bicolor
  Clone ID: SORBI-28MAY03-CLUS92711_1
gcacgagggaattatagttgtccgtccatgttgctttctacgtgcaaaagagcatatgactgaactctgttcttttattttctttatttcaaagacaaaagtacatgttgcctcatctttgattttgttacctgcataaacctcatgatatttatacagcaggacgtaggatatgcaggatgcttaggaggcagggtatgcaggatgcacggcgtacaggaccatgattgtttctggtgtgttcgtctttgtcactgctgcagaactgcccaatttcctgattcttgttttccctgacaagcaattccaaacgactaacaaaaggttcatgtcgcagacacacaaccacctctgctccttcacacaatagtcaacgtcgaaccccgcagttgatgaaacgcagcaacaacatagtacaactagcaaagactacttcaataggagcctgttgactatgtaatatttaggctaatatacctacaatcatccttagtgacttagaaccaatagcgtctatctcagaccaacaacgtgtatgtaatattttaggcaaacaatgtcggatcaatggtcacaaccaccccaacaatctaattatgttctgtaatataagagccgacaaccaccctatattgctcctatatgttc

SEQ ID NO: 9217 - DNA, 1071 bp, Sorghum bicolor
  Clone ID: SORBI-28MAY03-CLUS9357_1
caggtccacgctttgcactagccattccctgtcgccgacctcacctgcctctccatggacggcggacgagccgcagccgtcggcggcgacccctctcccatcgctgctcctaccaatccctcggcgctgagcagcaggcccgtcgatgtctcctcgtttacccacaccccgtgctactgtgaagaaaatgtttacatgttatgtaaggagcttatcagaaccggagtggctgaccctgcaggcactgatctttatgttgttttcatatcaaatgaggaaaagaaggttcctctctggcatcagaaagcaggccattctgacaacggatttatttgctgggattatcatgtgatctgcatccagtctaggcgaagcaaaggagaagttcttgattttgtttgggatctggactccgatcttccttttccttccccattcatccaatatgtttctgatgcgattcaaccactatcattcagcaattccagatatgcaagactcttccgtgtgattcatgctcctgtgtttcttcgatcatttgcctcagatagaagccatatgaaggatcctgaggggaactggattcagttacccccaaaatatgaaccagttgtggctgaagatggaaccaccaataacctcaatgagtacatcatgatgtctgtggaggatgtggcagacgtagaaagtatggctaatgatgtttactacaacaagcatggtgtggtgctaaatgaaacgattttgcctaaattctttgctcagctgcctggtccagatacttagccagcgctcttcctgtttctcaaagcagcatcaggattttctattgtggagggttactctgtacacttccgttgtgcactcccaagattacgaattaaaatatatgggcgcgattgtgcacatggtgtctctaagtagtgtttcagagaggtcctggtcagttttagaatgcagaatgtgggaatctcgtagttccatcagcctagacatctgaaagcttcatcttatcccaaatacggcatagatagatgatgatcgtgctcgcctaataatgatgactaggcc

SEQ ID NO: 9218 - DNA, 648 bp, Sorghum bicolor
  Clone ID: SORBI-28MAY03-CLUS93711_1
ctggtgccatagagctatctagctagtagcaggctagcagcaatatggctcacgttgctggtgacattgccgttctagtgctctttctctcgttgtcgtgccaaattattacggtggtgtccggcggtgcctccgtgcttggccgaaaggcagggtctctggcgacgaacgaggctgcaggtaatccagcagggaagaagggcacggcacagtacgcggtcattttcgacggcggcagcacggggagccgtgtgcacgtcttccagttcgacaagcagttggacctcgtcaagatcggcaatgaaatccagttcttcgcacaggtaaagcctgggcttagtgcgtatgctggtgaaccccaagaggctgccaagtccatcgctcctctccttgagaaagctcaaagtgtcgtccctacgtggctgcaacacaaaactccccttaaacttggtgcaactgctgggctacgactaattggagatgagaaatcggaagaaattcttgaagcggtccgtgatcttgtcagaagcaagagcaaattccaatacaacccaaattggatcactgtcctcgagggatctcaggagggatcttacctatgggtcgccctgaactacctattggggcgtctgcaaacgctcctgtggt

SEQ ID NO: 9219 - DNA, 978 bp, Sorghum bicolor
  Clone ID: SORBI-28MAY03-CLUS9372_1
ggtgatgtagcaaatgctgaaagacgggcacaggctgcggctcaagcagcggcacatgcagctggtgcgcaggtgacagctgcacagcctgggacagctcaagctacagcggtttcagcagcagctacagacccatatgcaggtgcatatgccagttacccctcggcatatcagcagggagcccaggctgcagcatatcagcagggagcccaggctgcggcatatcagcagggagcccaggctggggcatatcagcagggagcccaggctggggcatatcagcagggagcccaggctggggcatatcagcagggagcccaggttggggcatatcagcacggaacccaagctggggcatatcagcaaggaaaccaggctggagcatacacctatgcttatgatgctgccacggcttacgcatatgcaggttactctggctatccaggctatgcgcaaagtgcagtgcccaattattcctatgccgtacctccgcagccaagcagcggtgcaactacagaggccgcaagcatgtatggcgcagctggtagtgctggatatcctactgcgcaagttcagccgagcagtgccactgcaaatgcagcgcaaccacctcctccaccaccgcctgcagcaccatatcctagcacatatgaccaaaccagaggagcccagaggtgaaaatctgtgatgtgaaccagatggctgtctgccatgcacatttgttgagcagacaattatatagaattctgtcatgtcccttttgtagattgatgactggttcagttatgtagattcagtcgctgatagcttaattggcatgatagaagagttgatgtatgctcaactgttggtacatcggttgattggcttagctgttggttaaggatgattcggtacattaatgtggcattacaaccaaaaaaaaagtgtagcgtcgttattctgtattcttttatatcatctatttgcaagtattcc

SEQ ID NO: 9220 - DNA, 572 bp, Sorghum bicolor
  Clone ID: SORBI-28MAY03-CLUS8913_1
tgaagatgctgacctcgaggatttctatgattacagcagcagttatgttgatgcagaaggcaagcaattggttgctgttgatgagtctaacaacaacattgagctgggaaccggtgggtctgagctagtaataacaaacaagagtgagaaaggcacacgggtcagaacccttggttctagggaatttatccgctactatcgccagaaaccacggccttctgtcgcaacagaccgtgcacttgcactttcactggcttccagctacaagaacatgggtttggtgacagttcagtctaaggagcagatggtaaggctgaaagttctccgtgcaatgaacaagaccggggtcgagacgatgcggaacaagattgggatgaagagcaatgtgatccggaacctccctaagaactgcccgtattagacactgccttttcctgcacccagtctggagcttctccggacatttatggtgtcttatgggttcttgtcgatcattgacaatgttggtgcttaagatatttggaatatggttatcccttccatacgaaatttttgttgaactctgtgaggtg

SEQ ID NO: 9221 - DNA, 753 bp, Sorghum bicolor
  Clone ID: SORBI-28MAY03-CLUS89972_1
cagcgcagcgtgaaggatttatctgcttgcttcctaacttaccataccatttcgtcctcgttccaagatcacgggcttgagaccatgaccaatgattgttgccatccagttgccaacggcaaacaaaatggccatatggataaaaagagcaacactgtatcactgcctccatttggcctcgcagcacacaagatacaaggttccctctggaccaaccccataacaggagatcacagaaagatggacgtcctcttcggtgcggcggactcctggttgaagcagcttggagtccagcaccatgacttcaacttcttcatcactcaccccatgtgaaccactgatctggagtagcttgcaaagaaccacatgggttcagtttgaagctactaatattacttacaccaccatcaacagtagcgaaacgtttacagtacagtgcgctcgtaaagtgagtctaacaatcgcaggatagatttatacttgagtttactgcagcgaataccaaacatgtcggcactcaaaaaggttttctgtttcttgtttcgtggcagaagatgtaactgatctgtacagaagttttgcaactaatttggtatccaatgtgtggttggatccatattgtagctgttgcttgtgaactttagtgcccccgagaatgttagtccaggatgaaactgcttacgcagactccagttggacctaaatctgttgatgacagtttcattctcttctacaagtaaggcagttgtacgc

SEQ ID NO: 9222 - DNA, 954 bp, Sorghum bicolor
  Clone ID: SORBI-28MAY03-CLUS90146_1
tgcgccgcgccccatctctcctttcgtccagctctccaccggcggcaggaggcgccggcgccgccgctagcccgtggcgagatgagcggcgggagcgtgagcgccgtgttctacgcggacaagtaccacccgatccaggctggcagcatcgacggcacggacgtcgcgccccacgacaacgcggtcctccgcgccctcatctgctcccaggccggcctctatgaccctttcggcgaccccaaggcctccggcgacccctactgcacggtcttcgtcggccgtctctcgcgccagaccgacgacgacacgcttcggaaggcgatgagcaggtatgggagggtgaagagcatgcggctggtgcgtgacattgttacaggtgcttctcgtggttatgcatttgttgagtatgaaactgacagagagatgcgtcgtgcctatgaggatgcacaccattcaattattgatggcagatactcacaccacaggggtcatcgcaagcgcagacggagccaagaactgggcgaactatctccaccagaggaagacgttagctatgaaaaggagagaacttcagacgaacctggtcgcagccctgatcggtaccatcaccatcggcatcacagggaggatacatatgagagcagacactctcaccacagggaggatacatatgaaagcagacactctcaccacagggatcgccgacgccatggggaccggcatcactccaagagaagcgaaagccgagattacagggactaggcctccagttacctagactacatcaatgtttcattatgtaaactctgatctcacaggtatttatgtactccttgatctagtaaggtctgctgctacttgtaggctctttgccttatagaggagtaaaatgagaagatatgaatcgtgtattcgtgtgtcgaattatttgttcggttttgttgtcaaaacacc

SEQ ID NO: 9223 - DNA, 735 bp, Sorghum bicolor
  Clone ID: SORBI-28MAY03-CLUS9050_1
gaacatcatgaggacgcacatgaccatgaggagtttgagttcagtgaagtttttgttcaccaactgattcacacgatcgaatttgttcttggtgcagtctccaacacagcttcataccttcgtctttgggctcttagtcttgcacactccgagttgtccactgtattctatgataaagtactactaacggcattggggcttaacaatatttttgcccttattatcggtggcattgtctttgtctttgccacggttggtgtcttgcttgttatggagaccctgagtgcattccttcacgcgctgaggcttcactgggtggagttccagaacaagttctatgaaggtgatggttacaagttcgccccattctccttcgcactgattcgtgaggaggaagattgagctcgccccaacatttgtatttattgtagccgatgtaaaatctatctttggtggcctttgttcccagaacagatcattttttcatctgttgtctccgatggatcataaacctcagtccctttgtttaagcatgggacgaacagcatcatttttccttccttagctatgcagaggatttttttggttagctggcaacaaatatggggtgatatcacccttgtatgatgctaataagtagttgccgattgggtagtatgttggatataaataagcactgtatgaaggctaaacattcccactacgttcattgtcaataaagagtgctatttacgc

SEQ ID NO: 9224 - DNA, 974 bp, Sorghum bicolor
  Clone ID: SORBI-28MAY03-CLUS91359_1
gcacgaggccccaacatcggcttcaccgccgacgacgtgatcctgtgctcgctgcccatgttccacatctactcgctcaacaccatcatgatgtgcggcctccgcgtcggcgccgccatcgtggtcatgcgccgcttcgacctcgccaggatgatggagctcgtggagcgccaccggatcaccatcgccccgctcgtgccgcccatcgtggtcgccgtcgccaagagcgacgaggccgcgtcccacgacctgtcctccgtcaggatggtgctctccggcgccgcgcccatggggaaggacatcgaggacgccttcatggccaagctccccggcgccgtgctcggacaggggtacggcatgacggaggctgggccggtgctgtccatgtgcctggcgttcgccaaggagcccttcaaggtgaagtccggcgcgtgcggcacggtggtgcgcaacgccgagctcaagatcgtcgaccccgacaccggcaagtccctcgcccggaacctccccggagagatctgcatcaggggccagcagatcatgaaaggttacctgaacaacccggatgcgacgaagaatagcatcgacgctgacggttggctgcacaccggcgacgtcggctttgtggacgacgacgacgagatcttcatcgtcgacaggcttaaggagatcataaagtacaagggtctccaggtggcccctgcagagatagaggccctgctcatcacccacccaagcatcgccgatgccgctgtcgtcgggaaacaagtcgagccggaaatcggagaaatcccggtcgcctttgtggccaaggccaaagggagcgagcttagtgaagatgacgtcaaacaatttgtggccaaggaggtgatctactacaagaaggtccgtgaagtgatcttcattgacaagatccccaaggccccatcgggcaagatatgcgcaaggagtaaggaagcagcttcagcaacaag

SEQ ID NO: 9225 - DNA, 1120 bp, Sorghum bicolor
  Clone ID: SORBI-28MAY03-CLUS95915_1
ctactggacgcctctttttcctcccggcagcaatggagacggcactctggtgagacgagccaagcagccagccctggctcctcgatggcgtgcctggcgccacagtttctgtgggcgccgtctgccgccgcccacgtgccttcctcctcctcgtcctactccaggtgctccgcactccgcgtccactgcgccgtcacctccgccgttgtcgtcgaggaccgcaccaaccgcagcgcggcgcagctgaagctcgcttacgccgctccggcgattcagagaaacttggaggcaactctggcatcagaagcacttctgaatgaagaggcggtagtagcagccgcagccgcagaggcagttgctcttgccagagcagctgctgaagctgtgcaagaagttgttcagatggtacaaaaaaataaccatcagcccgtaattagacaaaaaaagggtgtggacaactacttggcaaatgaaatccttcgcacagagatgcagtcgagcagtcctgacatgtatgctaataattctttgatggaggatttggagtcttttggtatcatggcttctgaagatgagctcgaggcttatgcacagtatgctgagaacatagctgtgaaatctgctcgtcaatctgagcgaagagctaggagaactagagcagcaataaaggctagcacaactcgctgtgcttcacaaaaggctgcatcatcctcaaagaagaagcggtccaagggttcctcatctagtatgaatcctttaggttccttgtggaagatgactggcaggagacttcttacagccaaggaagaggttgagttctcagaaggtattcaggatcttttgaagcttgaagcgatccaagctgagcttacagagtacaatggtggccagccaaccttctcgcagtgggcaacagcagctggagttgatgagaaaactttgcggaagcacctgaattatggtatttattgcaagaacagaatggtaacatctaatgtgagacttgtaatctctattgccagagagtttgagggccctggaatggacctttatgatcttattcaggaaggaatgcagggccttataaggggagctgaaaaatttgatgcatcaaaaggtt

SEQ ID NO: 9226 - DNA, 645 bp, Sorghum bicolor
  Clone ID: SORBI-28MAY03-CLUS9592_1
aacccatggggtgtcactccattcaagaaggtcattagtttgccttcccgcattgatcctcaccaaacctctgctgttgtcaccctccatgggcagctatttgtgcgtgcaccatttgaacaatcaaaataatgttgatgccacaatgaagcacaataatacaagtttgccttatgggtgggattatactgttgtgacatgagcttagagttctcaccctgaccgtcgtcaaaaactagttccttgctgatcctaatgcttcaaccatgcttgatctctcctgtatcaagttaaactcattagttgacatagttctgtgtgtattcggctgtgcccattggctgtgaattgtagctaaagcaaagttactaagcctagagtttaggatgttaatagcctgatgctcaacatgtccatggtttcttttcaatttaaccggcataaagtgtactgtttgtagcaatgtagtatgtagcttgttcccagtatttgagctctggaacatggagtcaggtagattcattgtatgtaactgttgccggtgcattgctaatttgctattcaacttgtattgtcaatcagtctgaaattctatggcctccccttgtaatttgcctccgtatgtataactttgtacctcagtac

SEQ ID NO: 9227 - DNA, 644 bp, Sorghum bicolor
  Clone ID: SORBI-28MAY03-CLUS96099_1
gcaatgcggttttttatctaggcatcaccagcacagggcaagatattgccacggaggtgttgggatctgtcgctggccgcatcagaggcgccatcgatcggatggatgacgagctagtgcgctccgctatcgattactttgagatggccgagatggatagccgacctccaaggggcaccttgtcgcagacggtcctgcatattttcagctggttgggcagaccacaatacgatgcagattttgggtgggggaagccagagttgatgtcactggcggagagccaatgcgggggatttgtgaacttgatgaacgatgacgatggtgctggcaacggtggcgtccgtttgcacatgtgcatggaggctgtaaatataaaggagatggagcaactactttatgcaaagctagctctagcagcttttgctactaggaaaggtacttcatgtgatgattacctgtctcgataaggtacaccttgacgattgaggttttgtaagaataaaaggtcggatacaaataaggttggatggtctactggtttggttgtatatcatatcatatcaccacactatatgtaagacctgtaattgtgtacgattctgtcatttaagggaaataaaaaacgttgtatggtttgacatgct

SEQ ID NO: 9228 - DNA, 1367 bp, Sorghum bicolor
  unsure (1)..(1367): unsure at all n locations
  Clone ID: SORBI-28MAY03-CLUS96603_1
ccaaggcagactgacgacggccaccctcacattgcgtcattgcctccctcgtcatcgtcggctcgtcgccgtggcgatggcggacgccagcgacaacagcatggcgctggtgcacgcgcgcctggcagtctccgcggtggcgccgccgcggatgctgaggcagcggcagaagtgggaggtggagtacgcgcgctacttcggcacgccgcggcgggacccctccgcgccgccgccaccagggctccgccacatcatccgaggcgtccaccgccaccagggaacctggatccccgcctcatgccccgcttccctctgcgtctcccaccccagcctcccctccgcagtccccgtcctcacgatctccatcggcgacgtcgtcttcgaggagcactttgtgtcgattctcaacttctcttggcctcagattacttgtgtgatgcagtgccccatcagaggtagcagggtggtattcgtgagcttctgtgataagtctaaacagatccagaagtttgctgtacgtttcccacagctctgtgatgcagaattgttcttaagttgtgtgaaggaatgctcatgcgaaaccatggacatgataccgtctggaagtgactatgtgtgtgaagattcatcaacatctgaatatattgcttataatggacttcaccacaggccagatgatgcttcaggctttgaggagcagagttctgatcacacaatagatgaaccaacaatgagctaccatgaggaacaagatcagcctgttcttgagcctctcagtgctagcaacactagtaacagctactctgctgtcccccctagtttcacccatgtcctgacggctcggtcaatggcttatgtccctgaggaaccctgtcctggggcggcttccctccctgcccctctacacgtgcatgcactggatgctcctcaggatggtgcctctcccgttccgtctgccggtcatggcctcgatgctcctgcgggcgctgatgccggtacccttacatttggccctctggctccgttgtagtcttgtttcgctgctgttccctctcttgatatgttgttcaagcttgataaagtcattgatgaacttggtggtgacatgtcgctatagatagcaaaaccacttctgtggtgaaggaatgcagatctgtctggtcatatttactactagaaaagcaggcacgctttgtggcaccctacagcgcatctcccaaaagttcagattgtgaagacatagtatgaagagaattttctatttgacactgataacagtgctttcttatttgacactcanattcaaaatctttcttatttgtccactctctcttctaaatgacatttgccctcatggactcctgtgc

SEQ ID NO: 9229 - DNA, 964 bp, Sorghum bicolor
  Clone ID: SORBI-28MAY03-CLUS967_1
gcacgaggcttgacttcagaagaaggcgtttttcgtaggtttacacagtcgttcttcctagcaccacaagaaagtggtggctattttgttctcactgatatatttaggtttattttggaaaggaaaccagctgagatagttcaaggccccacggaagaaaatgaaatcagccagaatggtagacctgcatctgaaacatgctcagcattaccagaacctattccagctgacaggaatgtgatctcagaccatgtgacagctgagagtaacgtcacagagaggcaagttagtgatccctctgctaatgggactgccattgaaaataatgttaaaacccagccacctgtgcaagtgcccaaagaggaccccaaaaaggccctagttgctgctcctgcccctccaactcagacagatgttactaagaaatcttatgcatccattgtcaaggtcatgaaggagggcccactgactcctccagttgccaaaacaacgtcatcagttcccaaacagaagccagctcctaaaccagtgtccaaggctgtcgaaggtccggaaaaaccatccgtgaaacctacccaggctattgaaactggtgatgggattgttgctgaaaacaattcttctcgcaatgagcaaggctattcaattttcgtcaagaatttgccttaccatgccaatattgaaatggttgaggaggaatttaagaaatttggtactataaagccaggtggtgtccaagtccggcacaataaggtcgatcgctatgtttatggttatgaggagtacgagtcccggcagtctatgcaagcaggaattgaggcatcttcggttcatatggaggacaaagtagtcggcattgaggctaagagagccaattcacgaggtggccgtttccaatctcgcatgggagcataccatggcgataacttcatagggcgacggagcggctatgtggacaatgcca

SEQ ID NO: 9230 - DNA, 782 bp, Sorghum bicolor
  Clone ID: SORBI-28MAY03-CLUS9198_1
gaggctcggggcgggtgtcatggcgctgcgtgccccctagcccagccgcctcccccaacctcccccctcaccgagaggagagaccgagacagagagacagagagaaagaagggaacaacaggacacgggagagagagagagagagagagagagaggagaggtccatttccgcgtcgtctccgccccgcagcagccccacccaccacatggccgcgccgccgggtggggcccacgccggcgccggcgccgcggacccgatgcaggtggaccagccgctccctggcgccgccgccgccgccgccgcagccgcagcacacggccccgccgacgccaagcatgctggttctatgattgaagggagtgatccagtcacgggtcatataatctcgacaaccattggagggaagaatggagagcctaaaaggactatcagctacatggcagagagagttgtgggaactggatcatttggaatcgtcttccaggcaaaatgtctggagactggtgagactgttgccattaagaaggttttgcaggacaagcgctacaagaatagggagctgcaaatcatgcgatccatggatcactgcaatgttgtttccttgaagcattgcttcttctctaccacaagcagagatgaacttttccttaacttagtgatggagtttgttcctgagtcattatatcgtgtgttgaagcattacagcaatatgaaccagaggatgccgcttatttatgttaaattatatacctaccagatatttcgaggtttagcctatatt

SEQ ID NO: 9231 - DNA, 648 bp, Sorghum bicolor
  Clone ID: SORBI-28MAY03-CLUS92019_1
atctcgatctcgatctactatactcctactgtactatactatagagctcggctcgccgcagcacgacgatgacaatgctggtccccgtcgccgaccggaggcggggcggtgcgcggtgaccgggggccgggggtgcgtggcgaggtgccgggtggcggcctcgctccgctccggggagtggcgggtccgggtcactcacctcgctcctactcttgttttcggccccggcgagacggaggcaatgctcagtgatgcgctctgtgatggccgtgccacccttgcctcggtcgatgtctgcaacctagatcaccttaccatagcattggaagggggggatgttgttttccacaccgctgctgcggatcctagtcagaacaacttgcaacttcactacaaggttaacgtggtcggaacgaggaatgtaattgaagcttgcaagatatgcaaggtgaaaaggcttatacacaccagtactagtgctgttgtgtttgacggtgttcatggactttttgacgtaaatgagtcattgccatacccagataagtttcctgatgcatatgcacaaacgaaggtagaagcagagaagttagtcatcaaggccaataacattaatgaccttctaacttgttgcttacgtccgggtagcat

SEQ ID NO: 9232 - DNA, 790 bp, Sorghum bicolor
  Clone ID: SORBI-28MAY03-CLUS9205_1
gccggggccgggccggggcatcgatatcaccttctaggcttctaccagcagccgagcaccggaaagcggaaagaagcaaaattagcggtgtgtcactgccatctacggtggtgtgtcgctccaatctacggtaagcataaatggcaacagttccggattccctggtctggcagatcgtgaggaagaataactccttcctgatcaaacagtttggcaatggcaatgcgaaggttcagttcagcaaggagcccaacaatctctacaatgttcactcctacaagcactctggccttgccaacaagaagaccgtgacagtgcagccagccagtggcaaggaggctgcggtggtcctctcgacaaccaaaacaaagaagcaaaacaagcctgccagcctccaccacaagtctgtcatgcgcaaggagttccgcaagatggccaaggctgtcaagaaccaggtcggtgacaactactacaggcctgatcttaccaagccagctcttgcaaggctgagtgcagtgtaccggagcctccaggttgccaagtctggagtcaagaagaagaacaggcaggcaaactaagacaacaatggtcaatgactcattttgtgctatcaaaaacattgtggatgggtggcgtttatacagctttcaagatttggagtatgaggaaatgtgcttataacctgctatggattttcatagttgactccacctttgtataattgtaccggtgacatattattgagcctatgaaaatattttatcaaaaaaaaaaaaaaaaaaggccccta

SEQ ID NO: 9233 - DNA, 1062 bp, Sorghum bicolor
  Clone ID: SORBI-28MAY03-CLUS92443_1
ttcacacacacacacgtaaacgtaatattctatcccatggctgaatccaagtgaaatggcggcggcgccggggcgacggcagcgatgatgctccacggccgcgtagccattgtcaccggtggtgccggcggcatcggctcggccgtgtcgaagcacctggcgtcgctcggcgcgcgcgtcgtggtggcgtacatcggcgacccggcgcctgctctgtcgctggtgagcggcatcaactccagccaccccggcgagagcctcagccagcagccgcgtgccatcgcggtggaggcggacgtgtcggacgcggcgcaggtaaaggcgctgttcgacgcggcggcggcggccttcggcgaggagctccacatcctggtgacgctggcggcggtgctggactactcctacccgccgctggcggagaccagcgaggcgacgttcgacgccacgttcggcaccaacacgcgcggcaccttcctgtgctgccgcgaggcggccaggcggctggtccgcgacggccgcggccgcatcgtgaccttctcttcgtcgggggtcgggtcgctgcgccctggctactcggcgtacgcggcgagcaaggcggcggtggaggtgatgaccaagatcctggcgcgcgagctgcgcggcacggggatcacggccaacgtggtggcgccagggtccacggggacacccatgatgtacaccggcaagacggcggatgacatgcagcggtacatcgccgaggcgccgctgggccggctcggcatgcccgaggacatcgcgccgctcgtcagcttcctcgctagtgatgctggccattgggtcaacgcccaggtcctgcgctgcaacggtggcaccatctagtagaggcggtgcatctccatggctactacttcctttcaaccatcttattataactagtaaaagtgtctgtgcattgcaacaaagtacgtagcttctgatacggtcaccctctcactagttgttaatttgataattttttaacacacctttcattggttccaacatgcatgttttataaatggattctatactatcattata

SEQ ID NO: 9234 - DNA, 658 bp, Sorghum bicolor
  Clone ID: SORBI-28MAY03-CLUS9271_1
gtattcttccgtttggagcagttttcgttgtgcgctccttcctcccggcatcaatctggcttcaccagttctactacatctttggctttctcttcctggtgttcattatcctcatcatcacctgtgcggagatcacgatcgtgctgtgctatttccagctgtgcagtgaggactacatgtggtggtggaggtcctatctgacctcaggatcatctgcaatctacctcttcctgtatgccgggttctacttcttcactaaactgcagatcaccaaggtggtgtcgggcatactgtactttggctacatgcttcttgcctcgtgtgctttctgtgtgctcactggtgcgatcggcttctgtgcctgcttctggttcacaagattgatttattcatctgtgaagatcgactaggcatgttgcatgagcctgcagagagtatgctgatctgaagcggcctccattttccactgagtttctttttttcctgaattttcaggaaagctgtactttaggtgttagcttataaaccatttatgcccactgtggttcagagttgtataaggatataggacactactgccagcttcataggggccaatttttcgttcttgagaactgctgtatacgttcaatccatggctcattatcgtctgccaccc

SEQ ID NO: 9235 - DNA, 555 bp, Sorghum bicolor
  Clone ID: SORBI-28MAY03-CLUS9319_1
cccacgcgtccgcccacgcgtccggtgagaaccacggtacgcatgacgcgggcaatgtacgcacagcttgtgcagcagaactttcaggctcccagggggtacccgatgcctaggagggaggaagggccagagaaatggatggaggcagagctggggatgaagattgcctgcgggttcgagatgatgtaccaggagagaagacgccagggtgaggaaggtaaagggagcacgtgggaggtttacaggaagagcttggaggcagctggatgctttgaggggctgcttcctgggtcaatggagtataagagggtcatggaggatgcaatgcaatattacaagagctctaatttgtattcccgaacaagggagatactgagtgaaccagtgcggcgaattgatgaaatcctatcaacgccatactcggccgatgaatttaaaggcactgatcttcctcctagtgatgatgactcctggttgtatggtggggatgatgagttaaatgcggaactccgtgaaaggcataaggaactggaagagtatgaagctgcgaagaag

SEQ ID NO: 9236 - DNA, 552 bp, Sorghum bicolor
  Clone ID: SORBI-28MAY03-CLUS98630_1
acacttcgatcaatattctcctccagatttctacacacgggttgggatcgctggggtcccagcagactcggtgatgaagaagaccaaggctatcgaggacaactggatgccggtgtgggaggaggagttcagcttcccgctgacggtcccggagatcgctctgctgcgggtggaagtgcacgagtacgacatgtcggagaaggacgacttcggtggacagacggtgctgccggtgtcggagctgcggccggggatccgggcggtggcgctcttcgaccgcaaagggaacaagtacaacaacgtgaagcttctcatgcgtttcgagtttgcctagcctgatgtcttaccgtgagtgagacgacgattgcattgattgatatatacattccatattattatgtatcttgtgtgaacattgcaacctgagcgtgctttgtacatagatagattgcttggattggatgatatgtgcaacacttgatcagcaaacaattccttccgttccgttgttatgatcaaataataataaggcagcgtccttatgaataaatt

SEQ ID NO: 9237 - DNA, 641 bp, Sorghum bicolor
  Clone ID: SORBI-28MAY03-CLUS985_1
ctgatactgatcctatctgagcaactggatttggtctactggatcaaggcgaatgaggctaacttcaccccagtgtatatggagtgtttgatgcaccaagaactgccgttaattcattgcttgctggctgggaataaaaacataagagtcctgatgagaggttaacacaagaattcaaggaacaccataagaggtggatgagagattccagtcaagtgtttaatttgcttcctttcttggctttaattgggtgcacatggatcagcaacctaccggtgtggtgtgcagttcatggatctcatcattactgtgtccaaggtcattgtatgcaaaggagcagaccacggttgtaaacattacaagacatgttttctatttatttatagcacatataatttgctaagtgttaaccatgtgcgtcaaccgatgcgcgccatggcgcgcgcattgcactggtacaatggcctcttcgtgttcggagattcattcgccgacacagggaactagacatgttttctatttatttatagcacatatactttgctaagtgttaaccatgtgcgtcaaccgatgcgcgcgatggcgcgcgcattgcactggtacaatggcctcttcgtgttcggagattcattcgccgacac

SEQ ID NO: 9238 - DNA, 579 bp, Sorghum bicolor
  unsure (1)..(579): unsure at all n locations
  Clone ID: LIB3476-013-P1-K1-H1
ccggtcgccacgcgtccattccagcaggttaattgcttccttctggctnnnnattgcacatggattctgattgtacaagaatgctaggacagaaacttgcctcccagatagcagtaacttggatgccatgctttactgcttgtacaaagggcctcctagctagcagtaacgtggatgacaagctcttctggttgtacaaaggttgctactgcccaattgctccctctatgatttatgcatttcatatcctgtttggtggtttcacagctgctacaaatatagatccacagatatttatctggcccattagtgacattttcatttttgggaaataaagacatcagatggccatgcattcatctggcctaattaatgctatgttcaccccatacaaactcacggtgaggcgcctaatattacctagaagcttaccattttcactttcggcagcttagggcatgatatggtcagacataattatctgctttattagtgccattttcgtatttatccagcaaggtttacctcttatgtatatggcttttagcatntggatacactcccaatagttagcactct

SEQ ID NO: 9239 - DNA, 808 bp, Sorghum bicolor
  Clone ID: SORBI-28MAY03-CLUS9877_1
gaagattcctctcctccccacgcgctgcctctgctccgctcatggcgtccgcgccgagcaccacggcgcacaccctcgcgccctctcaccgcacgccggtttcctcggccccccgcggggcccgccttccggccgcgttccgcctctcgtgcgctcagcccgggccggccggatgccgcgcggcgtcaggtcggctcgttcgccctcgcgcgcgcgtccggtgcggcgcggcggcaagcccacgcgggcagccacgcgtccgcgcggaggtgctggagtcggagctgcctgtgctcgtggacttcgtcgccgactggtgcgggccgtgccgcctcatcgcgcccgtcgtcgattgggcctcggaggaatacaatgagcggttaaaaattgtcaagattgatcatgatgccaatccacagctgattgaagaatacaaggtttttggtctcccgactttgattctcttcaagaatggccaagaggtgccaggtagccgatatgaaggggcaatgacaaaagataagttcaagcaatacctggagcctctcttgactacaacagtcgcttaaggtcattgcctgcagcttgagcactgtggatgccagtggcattggcttaccctacgtattgggaatgttgaagaatttttccttacatgagcgtcatttttagtttgtaattaactacgctgtgttatcatgtttgactgtatgattgtcctttttgcttatattcggtacagtatacatgaagggttgtgatgagataagccacacactaattttaatacaagccaagcttgttttcg

SEQ ID NO: 9240 - DNA, 461 bp, Sorghum bicolor
  Clone ID: SORBI-28MAY03-CLUS98790_1
tccgagccagagcttgctcctggtgctactcacaaggccgccatcgccgagatgcttgttgaagacgagaagtccggtctcatggttgatgaggaggctcctccccagtacgagccacgcaattagatttcggtttctgagactctgtacttgcccgcattttagccgtagttgataagaaaaggggaacgcacactaccaacacagccttctacggcaggcgtgttattgataccaaagattgtatgtttttaaaggattcgggctcgggataggcgttatgagtatggtggatgggattatgtcttatgaactggatggctacgtacacgtcagactcggcgtgactttctttggtaacgatttgaaatcattactgtcctttctttaaagattcggcggtgtctatcaggttatggatggtctaggcactgttggctaaactttaaataaatatatcg

SEQ ID NO: 9241 - DNA, 933 bp, Sorghum bicolor
  unsure (1)..(933): unsure at all n locations
  Clone ID: SORBI-28MAY03-CLUS988_1
atactactacaacctgtaggggtgttgcagcgcggcgcgttgtgccggtcgtgcccgtcacgttgtctccactccgtcgcctctccgtccctgcggctccgcgggcggagaattaaatcccccgttatcctctctgccactagcgctgccatcgccgatcgttggatccagccatctcccctcgccgtccggcgtccgctctgcgcctctgcgtgcgcgcgcgcggggcacggccccccccccccttttggagccttgcgccgcggtcctttccccctgtccgaatccgcctcgacgtgtccgcctccctctcccctctccacgtctcgcttcctgtgtgtgtgctctgctcgcgctccttttgctgcgctcttggtatctgtgctcgcctctcctcgcctgccttccttcctttgccgccgctgccacgcttcttcccacttcttgccccgccgctctctgctcgtaccgggtccttcttggctggcagacgccactgcgtgcgacccgcgagagctagctgtgcccggcgcgtgcgtgcgtgcgacgatgtcgtcggcggtggagaccatctcctgctccaaggtcgacgtccccgccggcccggagccggaggagaaggccaagaaagcagcggtgcccgcggagcacggcggcgacgcggcggcgcccatcaacggcaagtgcggcgaggcggcgccgcgttgccacgaggaagaggaggaagatgaggaggacgcccccaaggtcatcgacctcggccccatggtcagcatcaaggagcagctcgagaaggacaaggacgacgagagcctgcggcgatggaaggagcagctcctcggcagcgtggacttcaactccgtgggagagacgctggagccggacgtgaagataatgagccctgcgatcctgtcgccgnggcggcccgacatc

SEQ ID NO: 9242 - DNA, 879 bp, Sorghum bicolor
  unsure (1)..(879): unsure at all n locations
  Clone ID: SORBI-28MAY03-CLUS13789_1
gccggccgggccgggacctgcgctgctgctgtcgtgccaggtcgccggccatccaaaccagccgccgctccttggctgggataggtcggcgcgcgcgagggattacgccgacgatccacccgccgccgcaggctcaccggtggccgccgcagcttgcaggctcgctcattccgtacgtcactattggttcccggcgaggctaagcgcgagcgcaaccagaaccagaaccgtaccagctggtttattggagatgtatccagctaagccctgcgcgccggccgggatggcggtggcgccagtggtcggcttccccgtcgccggagctctcaggcagcaatggtcgtcgggcctcttcgactgcttggacgactgccacatctgctgcctgacgtactggtgcccgtgcatcacgttcgggcggatcgcggagatggtggaccgcggcgcgacgtcgtgcgggacgagcggggcactgtacgcggtcatcgcctgcctcacggcgtcgcagtgcacctgggtctactcctgcacctaccgcgccatgatgcgcgcgcagttcggcctcccccgaggcgcatgcgccgactgcctcgtccacctctgctgcgagccctgcgcgctctgccagcagtacagggagctcacggcgcgcggcctcgaccccgtccatggctgggacttcaacgccgccatgtacccgccgcccacgcaggggatgcgacgacgctgatcgctccgtccatcgatggatatgatgaggtccagttcattggtttgttgatgacagatcgagacagagtacaaggtatatatattcgatcagttgtttagcgtcgtcggagatagatgctacntgtgatcgtctgacaacagtgcagc

SEQ ID NO: 9243 - DNA, 469 bp, Sorghum bicolor
  Clone ID: SORBI-28MAY03-CLUS13777_2
ggcagatatccgacctgaaatccaaggagcttagcggccatgacatctttgctcctccggaagatccacggcctcgcaactcggagaacggctcaacctcgcagactccgggcaaaaacgcatatgtcctgacctctgaactgacctcgtcctaatataaactcagttacaacagctccagtgttgctcactgttggtggttgttctcacaacaggtaagcaatatcaaatttggcgaggctgacgaggacagcgtggtgaagaccgcgaagaagatccccaccaagaaattcaccgacctcgcgggcaatatctttaagggcgacgagacccctggggcggcggagaagcacctgagcacggcgaagctgaaggagatgacaggcagcgacatctttgcggacgggaaggccccctcccgggactacctgggcgggatccgcaagccgtccggtggggagagcagcat

SEQ ID NO: 9244 - DNA, 672 bp, Sorghum bicolor
  Clone ID: SORBI-28MAY03-CLUS13777_1
ataagaggcagatatccgacctgaaatccaaggagcttagcggccatgacatctttgctcctccggaagatccacggcctcgcaactcggagaacggctcaacctcgcagactccgggcaaaaacgcatatgtaagcaatatcaaatttggccaggctgacgaggacagcgtggtgaagaccgcgaagaagatccccaccaagaaattcaccgacctcgcgggcaatatctttaagggcgacgagacccctggggcggcggagaagcacctgagcacggcgaaattgaaggagatgacaggcagcgacatctttgcggacgggaaggccccctcccgggactacctgggcgggatccgcaagccgcccggtggggagagcagcattgcgctggtttaacagcagcagctgcagcaacaacaatctgatggacatagcagcccctacatcatttgtttcttcctcctcgccgtcgccgtcctaggagtgatcttttctgtatattagggagtctttttggttttttatcctttccttggaggactgatcgattggaacccccggtttgctttcctgtttcccgtgacttgcgccaggttttcgttgttaatcccctctgcatggtggtgttgtgtgggtatgacaacaacgcatggttatctctaatttaaca

SEQ ID NO: 9245 - DNA, 671 bp, Sorghum bicolor
  Clone ID: SORBI-28MAY03-CLUS1379_1
ggcgtccgggcaaacctactactgctacaagccaacaaaccaaggtccgcccctaacaagcagttcccaaagctacaacttgagcacacacataagcaaagccatggcaaaggcacaggcaatggccgcgctgatgctgaccgtcttggtggtcctggcggcgtctgccgagatggcgcacggcgtctgcaacctgtcgagcgccggcatccgggcgtgccagccggcggcagccatccgcaacccgacggagcagccgtcggccgagtgctgcgccgcgctggcgggggccgacctggcgtgcctgtgccggtacaagaacgccgccggcgtgtgggtgaggttctaccggatcgacatcaaccgcgccatggggctgccgggcaagtgcggcctcgccatgccagccaactgctgaggcatggtcaccgtgcgtcactggctcatccacaataatgcaatgcaactgctgatgccgcgcgcgcgtgctgcgtgcgtattctactgctatatatagctacgacatctatcgaataaatgaaggcgcacacaaagatatgtgtgtgtctcctgtgcttctcctgggtgcacgtactgcactatgttgagctgtgggtgagcttattgatcagtgcagaagtttgtatacattactattctcaaagagtgta

SEQ ID NO: 9246 - DNA, 660 bp, Sorghum bicolor
  Clone ID: SORBI-28MAY03-CLUS13888_1
gcccgcggcccgaccgtcgagtgtcatccgccgccgcctcgtggtcatggctgcccccgccgaagctcatgctcatgacgccgccgcagccgctgccgcgggcctccgcctggactacgatgtcatcgtggtgggcgcgggcatcatgggaagctgcgcggcgcacgcggcggcgtcccgcggggcgcgcaccctccccctggcgccccgcggcccccgcctcctgctccgcgcccccctcggcctcccccgccccctccgcgccgcccacggcgacgcccgcttcccccccgtcgcccgcctccccccccgcctcggccccgtcgccggccccgccccccgcctccgcgcccccgccccggccccgccccgctcccgcggccccccccccaccccccccctccccatgggcccgcgctccagcgcctccctcgccgccgccctcgccaacatcggcgccgaggaggtacatggccgacgacctgggcggcaggtcggggcggcgccttccccttcaccgtcccggacccgtccgacgagtgggtcaccgcgctcagcgaccacggcggcgtgctcagcgccaccaaggccgtggctcatgttccagtcgctcgccgtcgcgaaaggcgccgcggtcagggacaacaccgaggtcgtcgg

SEQ ID NO: 9247 - DNA, 1007 bp, Sorghum bicolor
  Clone ID: SORBI-28MAY03-CLUS99156_1
gcacgagggaaatactgcggtgtctcccaatgccatcagtgcagcctcagaagaaattatttcatttcgcgcgggggacagtgttccaccttcacagtgcccaggggcctgtggcccaccttctctggcagagttaccaagccctcagaagggatgtttcatgttcctcagcggccatataccagccttggtactctgcgggatcagatcatataccctctctcaagggaggaagcgaagataaaagttctttcattacatagatctggtaacaattctagtgcctctgtcctgctggatgatcacctgaagacaattctagagaatgtccggctgctgtatctcctagaaagagaagggtgggattctacaccaaactgggaagatgttctgtcgttaggagaacaacagaggcttgggatggctcgtttgtttttccatcatcctaagtttggtatcctcgacgagtgcaccaatgctacgagtgttgatgttgaagagcatctgtacaggcttgcaactagcatgggcataactgtgatcacttcctcacaaaggcctgctttgatacccttccatgccttggagctgaagcttattgacggcgaagggaactgggagctatgtgcgatccagcagtgaatgatggtacccattaggagttgatgccatcaaatgcactgtcagctgcatgtacaaaagcaagcggctagccccattgccattgtgtatagacaatgtagacggtggcagcattgctatgttggaaggtgttgtattcttgtcagaatctgcctcacgttgaggagcagcaaagccgtgttagtgaaatgaagtgagagggcacgtgattgtgagccatggtttgtggtgggggttcgttcgcctcgaggtgttttggacttgagttgctacatagtagctggatagtagagcagatgggttgtgagttagaagctgtgtatctattgactcattgccttatattgattctgtttagtagatgt

SEQ ID NO: 9248 - DNA, 782 bp, Sorghum bicolor
  Clone ID: SORBI-28MAY03-CLUS9928_1
gataggtatggaggtatagattaattatacaataaaaatatcaatacatacgtggacttcgtggaaattggaaaataggacggagggtattgtatatattggcgggtacagtgtagctactagctagacgtgtggcttccacccgtactgatcgctcctcaccctcacctgtcacctctttctataggctccaatactccactggtccaggatcgaacacgcaccaccatgccgcccggcggaggaggcaaccgcgacgccgcgccggccatgcacgtgctgatgctcccgtggctcgccttcggccacatcgtcccgttcgcgcagctagcacggaggctgctggcctcctcctcctccgtccgcgtcacgttcgtcacggccgccgggaacgtcccgcgcgtcgaggccatgctatcctcggcctcctcgtccgccggcggcagggtgtccatcgtgccgctgcgcctgccccacgtgccgggccttcccgagggcgccgccagcacggcggagctctcgctcgacggcgccgagctgctcaaggtcgcgctggacggcgcccggccccaggtggccgcgctgctagccgagctccgcccggacgccgtgctgctcgacttcgccaccccgtgggccgcccacgacgccgcggcgctgggcgtcaagtcgctccatttcagcgccttctccgccgtcgcgcgcgcctacctcgccgtccccgcgcgccgccccgagggggcctccccgccgccatcggcgcgcgacctcatgcctcgtgc

SEQ ID NO: 9249 - DNA, 682 bp, Sorghum bicolor
  Clone ID: SORBI-28MAY03-CLUS99338_1
gcacgaggcccaatccggcgctgcatccgcgtgtggccactgctggatgctccaggtcgctccgcgcctgggtggcgctgtccagtcgtgccccctatgcgcccctgtctcggtccgctcggagtctatgctttgggcggctggcctgctttccgcgcctctcgttccgcgcggcatccggtgaccaagactgtgtcagtggagtttggcaggaaggacaacattgcctgcatcctgctccatcctggaaccgtggacactgacctctcaaggccatttcagagaaatgtgcccaaggataagctcttcacaagagagttctctgtacagaagcttctctccatcattgacaacgtcaagaaaagcgacaacggcaagttcttcgcgtgggatggccaagaaatcccttggtgaatggtccctcaacactcgtttgagtctaaacaacgtcattgattttaattcgacgatgcttttttctgttcaacacgcattggtccttttcatgcttatcaaccaaacaaataaaacagtcacttgcccccggcagccataataacagattcgtcaaagtcagggagaatgtgacggtcaacaaagacaaagttaaagtcaaagtcaaagtactgttgactgatttgttatgagaaaaatagattcggatgatgaactcaaacgaatt

SEQ ID NO: 9250 - DNA, 572 bp, Sorghum bicolor
  Clone ID: SORBI-28MAY03-CLUS99386_1
ggttggtgcgtcaccaccgctgccggtatcgcttcttaccctcttgacaccatccgtcgtcgcatgatgatgacctctggtgaggccgtcaagtacaagagcaccatggatgccgcccgccagatcgtcgccaaggagggtgtcaagtctctcttcaagggtgctggtgccaacatcctccgtggtgttgccggtgctggtgtcctctccatctacgaccagctccaggtcctcctcttcggcaaggccttcaagggtgcgcctggtttaacgccccctgaccagacatgtgtgtggcggtccagcgatccggggggggattaagctgcgggcttcgcatggtgtccgctggttaaaactaaaaggcgagatcgaagtgcaggtcaagggaagttgtcacagatacccgacgtggtcctctgaaacagcagctctttacgggttagagtggcataggcacggcgtcttttccggctcgcgctgcgccgtccgttcttggccgctcgtcctctttcccccgcgcggtgccccggggctgtccgtggtcaatagaaagttatgggtttctttgt

SEQ ID NO: 9251 - DNA, 447 bp, Sorghum bicolor
  Clone ID: SORBI-28MAY03-CLUS100298_1
gaggaggagcgcgcggccttcctcctcatggcgctctcctccggcgtcgtgtacgcctgacttcacccccacctagcaccgcacccgaaggcgggtgagaggaggaggccgccgctggtgctgcaagccgccgatttggtagacgggcggcatgatctgagcccagagagatccgcatctctctttaccccctttttccccctctggatctatgctaagttttcccggctaagtagtagttcgtcagttcgaacaaagcgagttaataatccgtgtccgtgctaggctagtagcagctctgttcctcccccgtcccgttccttgctgttcttgccccccacctcctctagttgtaatcctaccgctagtagtgtgctagtagctgtcttgtaaccttctcttgcaatgtaaggagagattatgatcattcttgcaagcgagtagttg

SEQ ID NO: 9252 - DNA, 823 bp, Sorghum bicolor
  Clone ID: SORBI-28MAY03-CLUS99791_1
gcacgaggcttcttcacgagcatcctggcgacgccgggcggcaccaacaccacgtcgggctccgtggtgacgggcgccaacgtggagaaggtcccggggctcaacacgctgggcgtctcgctctcccgcatcgactacgcgccgggcggggtgaacccgccgcacacgcacccgcgcgccaccgagctcgtcttcgtgctctacggcaagctcgacgtcggcttcgtcaccaccgccaacaagctcgtcgccaggaccatcgcgcggggcgacgtcttcgccttcccgagggggctcgtgcacttccagaggaaccccggcaccgagcccgccgccgtcatctccgcgttcaacagccagctccccggcacgcagtccatcgccatgacgctcttcggggcctcgccggacctgcccgacgatgtgctcgccaaggccttccagatccccgacgagcaggtggccaagatcaaggacaagttcgcgcccaagaagggatgactgagtataatgaagatccagatatataacgagaaattttgttgaaactggtcagtgtcgtctcagtgattgattgattgattggtctgtttgtgattctgccatgcatgatgcaatcgtgtcaaatggccggcttccgttgtgatcgtcggttaagtgcgtgtgtggtgtgacctgcagaagacgaatgagtcggtaggtgtctcgatcgcttgtaataagttgctgcaggtctggagaacattctatctgttaatgccctattattagctcaattatttgtaaaccatttgatattattactacgtattgcacctacctt

SEQ ID NO: 9253 - DNA, 1117 bp, Sorghum bicolor
  Clone ID: SORBI-28MAY03-CLUS97580_1
gcacctggattaaatatactcgcgctccagctcgccatttctcccctcccctccccttctcttccctaatcatctcagcgaatccaatcgagcccaaggcgatggacaagcagggtgcgggcggggacgtggaggtgccggcggggctggggctgacggcggcggagtacgagcagctgcggtcgacggtggacgcgcaccaccgctacgccgtgggggagggccaatgctcctcgctgctggcgcagcgcatccaggcaccgcctgccgccgtctgggccatcgtccgccgcttcgactgcccgcaggtgtacaagcacttcatccgcagctgcgcgctccgcccggaccccgaagccggcgacgcgctccgccccggccgcctccgcgaggtcagcgtcatctcgggcctccccgccagcaccagcaccgagcgcctcgacctcctcgacgacgccgccagggtcttcggcttctccatcaccggaggcgagcaccgccttcggaactaccgctctgtcaccaccgtctccgagctcgcggaccccgggatctgcaccgtcgtgctcgagtcctatgtcgtcgacgtccccgacggcaacaccgaggacgacacccgcctcttcgctgacaccgtcatcaggctcaacctccagaagctcaagtccgtcgccgaggccaacgccgccgcggcagccagcttcgtttccgtcgtccctcccccggagccggaggagtagcggcggccgaaatcggggaagaaagcaacagcaagttttgggcgttttctgttatttcacttctttgggaaagggtttctgtgaattacaaatctgatcatggatggatttggactggacaaggaggggtccggtcagcttgaattaggtgtcattgcaagggtgcaccctgtaataatctctctttcatctcctagattccttcctttcatctttacttcttccagaatttggttaatttcagctttatgtgattggaatgattccttaggaattgctgcttctcgtatatctttgcattgcatattcccattgtatgttctatcgcattgcatatcttcatgcatgtgatccatgcctagtttgatcctcctaga

SEQ ID NO: 9254 - DNA, 752 bp, Sorghum bicolor
  Clone ID: SORBI-28MAY03-CLUS97833_1
gcacatttcagtagccgtgcactgtttgctcattgattggctctttgttttcttccattttgttaagctaaccttacctgtccagagccttctttgctgcttcctccgggcctccctgttattattattatttttatttatacgaaacccctctccctctcttccgctcgccccgcctcctcctgccctccctcccttcggacacggtgctcgccacacctcgtgcggcccagtactctcgtgcgcccagggcagctcctcttgctcaccaatcatatcggacaaggtattcttgacaccaagtacagtccagtactgttgtacggccaggacaagatattcctgtgtgaagaattttccgtgcaaacaaagatgggcaagcaaaagattgtgctcaagttgcccctggatgacgagaggaagaggaggaaggccttcaaggctgctgtgggcatgaatggtgtgacatccgccacgatggagggcgacaagatcataatcgtcggcgacggtgtggaccccatctcgctaacgaccatgctccggcgcagcctcggctacgcggaactgctcagcgtcagctccggcgatgacaagaagaagggcgacggatatggctacgggagcagcggtggcatgatgtacggtggtggcggtggtggcatgggcggcagcggcgcatttggtggcggcaaagaggggctcggcggcagcgagagcgggggtggcaagagcagcagcggtcatgcatg

SEQ ID NO: 9255 - DNA, 762 bp, Sorghum bicolor
  Clone ID: SORBI-28MAY03-CLUS9820_1
ttcggcacgaggctaccgactatcataccgccggtccgccgccgcctccgctcgaagactcgaccgcctcgtctgctcgcccggcccgtccctccccgcgcgcaactgtctgcgccgacgaccataagccgcctcatcgccggccgcacaaagatccgtggtaaggaaagcacgacgacgtggacgtgcagtagaattgtgaatcgccgggaaaacatccgttggcggcggcatgaataagcggccccgcgacgaccactcctccttcgcctccgcgcccaagcgccagtacggcgcaggcggagggtatggcgcgcagcaggggtactcggaggagcggaacagcgcgcggcgggtggccgaccactacagcgcgaggtccaaccagacgctcgaggaacgcgagaacagccccatcatccacctcaagaagcttaacaactggatcaagagtgttttaatccagctgtatgcacgcccgggcgactgtgttcttgatcttgcttgcgggaagggaggtgatttgataaagtgggataaagccaaggttggctactatgtaggagttgatattgctgaaggctcgataaaagattgcatgactcgctacaatggtgacacagatcaacaaagaaggcaaaaggtcagtttccctgcacggcttatttgtactgattgctatgaggctcgtctggatgaatatttatatgaggatgctccatttgatatatgtagctgtcagtttgctttacattattcatg

SEQ ID NO: 9256 - DNA, 1079 bp, Sorghum bicolor
  Clone ID: SORBI-28MAY03-CLUS9852_1
gcacgaggcccgcgcctcgctcccctgcgccccgccgcccctccccccccccccgcctgcgccggcccgccgcccgccgcttccctgccctctgctgccggcgacccctctgctcccggtcgtccggcccgtccgggcgcgctacccgcacaacgaacaatcactctagaagactcggtactccttggtgtgtcatactctttggtagcaatcttaccattcttgagaagaggtacatctgtctgtcagcaatgtccatagaagagaggaagataagtatgataagcaagagcactatgctaaatccaaatgcagaggaatttgttccttcatcccttagatctgtcaatgattcctccaagagatcagatgcaactatggttgtctcagggccatctaaagaatccagcacagacaagccagagtccattttacgaagtaactctgatgaagaagcacatcagtactggcagcaacagctccctgatgacattacccctgattccttacccctgggacaagatgaaagtactggacctgacagtctatcactcacaggcctgtccataaatgatggcattggcacatcaatattttctccaaaccaggcactgagcatgcagcaccatgcttcgccttttatcagggacaaactgagcccacgcgtccggattaacttgtctggcccaacttatatggatgaacggtcccaagccacaattttgagtccaactgcaggttccatgagtccaaatgctgctccatgggtgaagactatgaggaatggggtacattataacacaagcagaagggataccagtcactacaatggagattctagcattggagcttcattgcacaaccttagtgatgtgtatggaagcaggcgcagcttaagctcgactatggatatcatgagtcagctggagagtaaggttgatggacgacttggtcagaacctcaggtcactgtcatttggaaattcaagtcctccatcaccagcatcatatgcccaaaatggcttggaaactatagtaatgaatcttttggctgccaaacagccataatagatctattca

SEQ ID NO: 9257 - DNA, 934 bp, Sorghum bicolor
  Clone ID: SORBI-28MAY03-CLUS98598_1
gcacgaggattgtgcagagaattagagagatatatgtatatacatcgtggaatcaattttgttaacgttttggctccggacatcctagaataagtcccactgccaatagatcttatcgacaatacctccaccgctccgccccgcggcacacacgggtcatcttctagctactacccctagactggccgggtgttagctagctcagcaacagctagagcttttcctcaaagccctagctggtgtgctttgctactggtcaattaggtcaccatgggcgactcctcatcatcagcatcttacatcagaatggttcaccatatgatagagaagtgcatctgcttcaacctgaacaaggaagagtgcatggatgcactggagaagcatgccaacgtcaaccctgtcgtcactgccactgtgtggaaggagctggagaaggagaacaaggagttcttcgagacgtacaacaaggagcgcgaggaacgcaacatcatcgaggcggagacgatggagcggatccagaagatgctctccgaggcggcggcctccaagagctccgacgacgacgacgacgatggctagctagctagccctcgatccattagctctagagctatagatctcatcagctccctgcatggactctcatcactcatgtacgcaccagctcctcccattagctccgatcctctccatgggagcacgaccctccccgtaccgtacgtaccgtcatatatgagaccattctatggctaacttgcttattagccactaatcaacaacataacatgcatctgcaaggaccatgtgcatgcatgatgtgtgtagtacgtctggttattaggaccagaaaaaaaaaatgctttgtattacgatgtactcgtgtagaaagatgcatatatattcgacccaatatatccatactcagaatctcccc

SEQ ID NO: 9258 - DNA, 619 bp, Sorghum bicolor
  Clone ID: SORBI-28MAY03-CLUS10136_1
gcacgaggcgcaggtgcatctgcacgagctcggattctccgatctcagcaagatctacgtcttccgggggaccaaggagatctccaaggaccagattttggatcagcttgggctggcgggggctgggcgcccgcggttccccaagatgccacagcaaccaggcgggccgcaggtgaatgggatgcattcgctgtccacggccggggtcaacaggttcctgctcccggtgtcagagtgcgagtgtgcactaagcacgttgctggacgagttgcagcctgaccaatggccagtggaggccgggaaccgggcaatccggtgcaccggtgttgcgctcagtgtggctgctggtttgcttggtgcttgcatgcctgggacaggtgcaaggatcattgcattgctaggtggtccatgtaccgagggccctggaatgattgtttcaaaagaattgtcagaaccagttagatcacataaggatcttgacaaggacgcagctcctcacttccagaaagccattaaattttatgatggtcttgctaagcagttagtcagtcaaggccacgtgttagatgtttttgcatccgctctcgatcaggttgggctagctgagatgaaagttgct

SEQ ID NO: 9259 - DNA, 700 bp, Sorghum bicolor
  unsure (1)..(700): unsure at all n locations
  Clone ID: SORBI-28MAY03-CLUS10197_1
gccggccgggctcgcgaccgcgaaccgaacaggcaagaagaggtagagaggaagaagaacacgcctcgttgggctagcttgggcatcatatatatcgatcatatctttgccgccatgcatggctccatatatacctaagcctagctagctagctagctaggagccaccatcgatcatcagctagcagcttcttctagctctcttctcgatcttgtcttctctgagagccggccggcaagcaaggcatggatggaaagggcgccagcatagcaagcaaggggattaccatgccatagctgccttgctagctagagagtgagcaggcgcgcgcgcatgaaagagaccaacaaggtcacggcggaggcgatggaggaggaggaggaggaggaggaggaggaggagcggtacgtgaaggtggggacgaggttctaccgggtgacgatgaggccaaacggcggcggtggcgccggcgacgccgtggcgcgtcgtcgtcgtcgcctccactacctcgagtcctgctacctctgcaagcagagcatcgcctgcgaccgcgacgtcttcatgtacaagggggacgcggcgttctgcagcgaggactgcagggacgaccagatggacatggacgaggcgctccacgcggcggcgcggcgccaccgcctcctgcagcgctctccggcgtccgcctccntcgcagtcgtcg

SEQ ID NO: 9260 - DNA, 454 bp, Sorghum bicolor
  Clone ID: SORBI-28MAY03-CLUS102018_1
gcacgaggagatagactagtagtctctgcatactatctctatcttcatacaactctcacatctcttcatcaccatgaatcggcaacaacattacacacagccgtaccagacggcccccacccacaggtacccaagcaccagcagtgccttcagtgccagcgcaaaccccaatgaagactggaccaagatcaccgatcttgctgagcgcaggaggatacagaacagaatagctcagcgcaactaccgcaagaagttgaagaagcgcctggaagacctcgagaagcgagctgcctccaactcggcgtccccggaacagaagccggtagagctggaaagacccagcgcccagaagaagaacagtacatcctccgagtcgcgagaccctcatagcttctccacgttcgacagccagacatcccaagcctcatcgatgcaattcatgccttttgacgac

SEQ ID NO: 9261 - DNA, 504 bp, Sorghum bicolor
  Clone ID: SORBI-28MAY03-CLUS103427_1
gcacgaggatccaatccactcgaaagagcaaatctacacaactacaagacgattttattataatacagcctgtcgcgacaacatcggcgatccttgctataacgaccaaacaccaccacctctccaccacaaccacacacagctctccttcacaatggagcccacacctcgcccctcaagatcatcttccacctcttctcgcaacaagtccaatctcagtcttgatctctctgacctcccgccgctgatccaacccactcctccgtccaacacgctcctcttcaccaacctcaacaacctcgacatctttcttcccgagaacctacaagaaatccgcagcctcatcgagaaagtgtcacccatccactcgtttgcgccgctcaagtcctttcgtcgcattatcgtctccttcttcgacatcgactcctcattagccattcgtcagatatgggacggaaaggccatcatgggcgagcgcatcagactctactttggccagaccac

SEQ ID NO: 9262 - DNA, 684 bp, Sorghum bicolor
  Clone ID: SORBI-28MAY03-CLUS102671_1
gcacgaggctggtttttgccccctttttttttgggtgccccctcgaccctttttttttcttctgatttttcccctctcgttggaccttgagttgttcagcaacgaaggaaagaatgcttggttttctaagagtttaagtttttgaacatcgtgatgttcaaaaaaaatgtcgtccactccgctctcttctactgcgtcgtcctcgaaatcgagctcttttgccatggttccctccatgccctcttcttctgttcactctggtccaattgctgaccaccgcccttttctctctcgtccccaatcgagtcaattgattgttggtcctcggcctcaactcgatcaacgaattgttggtcctcgacctcaatctgaccaacgacttgttcctcaaccagatcaacggattgttggtcctcgacctcaacaaattgctggtcctcgacctgtcagtcctcatcccgatcgacggattgctcctcgacccgatcaacagcttgtcagccctcgacctcaaccggatcaacgaattgctcgttctgatcaacgacttgtcagtcctcgacctcaactcgatcaacaaattgctggtcctcgacctcaacctgatcaacgacttgtcagtcctcgacctcaactcgatcaacgaactgttgcccctcgacctcaatctgatcaacgacttgt

SEQ ID NO: 9263 - DNA, 890 bp, Sorghum bicolor
  Clone ID: SORBI-28MAY03-CLUS10179_1
agcagagagagtgggagatcatggagctctgcgtctctaccaccaccgcctccgtccgcgccaccaccgccgcgcccatatccttcgccccgccccgccgtggcggcgcgtctgcttccaccgcccttccggtccaccaccgccgcatcccaactcgaggctggcgttgcgccgccagtgcggccgtgcctgacccggtgccctccgaagagcccgcctccgcctcctacaccgtcgtcgtcacggacaagcccgacactcctgccgacgacaaggtcgaggaagttagcgccgcgcctagtggctccgcggaggcgcctgtagcagagctggtgtcgtcggaggcgtccccgtccccggatggcggcggtctggatgagatactaagcaagttgaacattgaagtgactccgactttaatcctcactggatctgctgcctttgttgctttatggatcctatcttctgttgttgctgcaattgattcagtccccctgctcccaaaattgctggaattagtaggaactggttactcaatttggttcatcgcacgatatctccttttcaaggtacatctttttttgatggaacttttcaaggaaagcagagatgacctgtttgcaaagttcgaagatctcatacagaggattgtttgatctgtcgtcgatcttttgccacgtgtttaggctttacagccagcttattattaggttttctccctttatattttcaaatattactgaaggggtaaagaaggtcgtgtaaattttctcctcatggggtctgttatcagacttctcaagtttggctagtgtgcttcttcaggtcactatggatgtttttttactcaatcctatgtgtatactgtcaagtaaagcttaaaaaaagag

SEQ ID NO: 9264 - DNA, 494 bp, Sorghum bicolor
  Clone ID: LIB3478-011-P1-K1-C2
gtgaatcaataagctgagtgattaagctctagcttaacccttaacatttgcagaactctagaactccaaaggcacaacttgttatgaaattacgaatatcttaggtttgttgctccagattatgccagacttatcatgctatagcatattttattttggtaatgcattgattatttttaaaatagaaaagatactacatctattgtcttaaggtcatgattttatagcagctttcatatgcgaagataatttattttccagatacaaactttgtcttggatgatttattcgttgtcatgttgttgcttacttatataccgcgcctatattttccagttgaacattgaagtgactccgactttaatcctcactggatctgctgcctttgttgctttatggatcctatcttctgttgttgctgcaattggatcagtccccctggacagaagctatgtatgccttcataaatctgaactagtttagtaccaatgtca

SEQ ID NO: 9265 - DNA, 466 bp, Sorghum bicolor
  Clone ID: SORBI-28MAY03-CLUS98846_1
cgtcacacaagaaatggccgtcgccaaggacgagacattcggtccccttgcccctgtctttgagttcgagaccgaggaggatgccatccgtctggccaacgacaccgagttcggtctcgctggatacttcttctccaaggatatcagccgtgtcatgcgtgttgcccacaagttgcaagttggaatggttggtgccaacacaggcaagatcagtgctgctgaggcacctttcggcggtgtcaaggagagcggctatggaaaggagggcagcctgtacggaatggccgagtaccaaaacatcaagtctattaccattggcaacctcaacaattagagtgggagttgcataaaagcatttgagcgagcaaaaagggatttattttatttagcatgataatgacgaggtgggaaaccctcacagaacaacgaccgagattaaaagcatgatctcttgaataaaaagagt

SEQ ID NO: 9266 - DNA, 575 bp, Sorghum bicolor
  Clone ID: SORBI-28MAY03-CLUS98876_1
gcacgaggacatgacaagaagctgtttttcaaggtggtttttacattgtattttctagcagctttgggaagggtggtgtcaggcgctgcggttgcttatgctgccctatgcatcttctgcctctacatgtttgcacaaagcaccgatctgtttgatcagctcccttcttgggtccctgtgggaagggattctttggggggtactcaggataccgcgtgattttccacatgtaaatggaatgcagagttttccttttcttccactttctgtatatggtcctgcaggctaaatagcttgagctatagcttctatggcagccctacggtatcacaactgtactaggtagctatgatgaagtaatgatctttgtatatatgacacgcttgcaacttgccagatgccagcaccttgtatgtttttggagctctttgcatctctctggcttgacatggttggtcgtgagatggtgttgcctgatggtgtgttttgcctgtaacagttactacctgtaacggttactgcctgtaactgaacctgcagttgcaggatgggctatgacattgcgttgttcgtgt

SEQ ID NO: 9267 - DNA, 703 bp, Sorghum bicolor
  Clone ID: SORBI-28MAY03-CLUS9913_1
ctgcgagtcctccaaccatggcgctcgcactagcctctcttccaatggcgtctctctccttccactccgggaggatctctgcggcggctatcggaggcgtcgcccgcactcgcagggcggccccggtgggggtatccgcctccccgttcctccggagctccttcgtctcgtcctcttccacgtcgtccgcctccgcctcccccgcctcgctcgcggcggcggtctcggcgtcgctggccttcacctcctcttcctcgttcgcgggttcatctttaggaattgagttcagctacaatagaatgacaacacgaagatcccgtggtatgcagattagggctggaaaggctgccctctgcatgaccaagaggtcaagatctaggaagtcacttgcccgtacacatggtttccgcaggcggatgcggactacttctggacgaaaggtactgaagcgcaggcgtgccaaaggcaggaaggttctttgcacaaggacaaactcacccactgggaagaaaagattattctaattacactgcaatttgatgtgcttgcaactgtaagtgtactttctacttccaatcttctaagccgtcgtctatctgtaacaatcatgtagcatcctattcctgtttgtttggttaaaatatctggatatattatcttctccacataacttcaagttactgttttgggatgtcgtgtcctt

SEQ ID NO: 9268 - DNA, 417 bp, Sorghum bicolor
  Clone ID: SORBI-28MAY03-CLUS99131_1
acagacgccgtgttccccaacaatttcgttcgttctacggtaatcgtgagtgttcgtgacccatgatgatgatcatgcatgtatatatatggcgacaaagataatagcaacggcggtgaaggtttggacgtctccacgagcacctttttttactgcaatccactgatgacgacatggagagcagcctccggcaaggcgctcctcctaggtgtgcaaaacgtaggcctccctacgatatagccaattgattttttttccctatatatacattgtcaattcgtccctttttagttgtaaattaacttcggatgatgatgtcttttcgttcaaattggatgctgttgttagtctgtccattctctgaaactagtgctggcatatctaatgctagaagcatattcagaaagaatttgttcc

SEQ ID NO: 9269 - DNA, 1121 bp, Sorghum bicolor
  Clone ID: SORBI-28MAY03-CLUS99198_1
gcacgaggcccaactcgcgcccagcggcgctccggccctcagcgacggaggggcagtccctggctcggcggcggcgtcagcggctccccctcccgcctcgccccagccgcgccccgcccctccgccccccgcgcgccggcccgcgctccgccgcgccctccgcccctccccctcccgcctctcgccagtcgcggcgctcgcctccgccctccgcgcaccggccggcgaccctggcgctgcaagcagaaatggacattaaacgtcttgaggcagataaactggattgcaggctctatgtagggaacctggacttcaggatatcagagtccgaaataatcaagatgttttccccctttggaaagattacagctgaggatttcctgtggcacacacgtggtccaaagagaggcgagccccggggctacgcctttgttcaatacaccactaaagaggaagctcagttagcaaaggagaagatgaatggaaagttagtctgcggacgcccaatggtagttcaccttgctagtgagaaaagttctctagactcttcaagttcacatagagcagtcaaagacaaaaagctgacgggtggttcaggaggcaaatcacaatatactgatcgagctgcaaagatagctgctataaaaaacaagttgaaatctctggaggaagggggatgtagcacaaaaaaaccaagacttaatccagacaacttgacaggaatcagggaacagtctcataagaagttttgaagcgaggattctttcattcttcggaacgttgagtgcttgtgccctctcatactggtgacacttctaaagctgctgctattctataattctagcttcagttagttagtcaagtcacaaatgtagcgtttccacagtgcctcaaatatgtacaatagtttgtaccaatcatctttttttcctgaatgaatcgtccttttgatgggggaatcattgtgactacatactgtcttgttattgacaacatattatcagtgtgctgctgtggaagatatgtttcctcaacttaattgtgttgcattagtttatccacctgtattgaaatcactgacatcacttctctagaaatattatattaccattttgtttgtc

SEQ ID NO: 9270 - DNA, 438 bp, Sorghum bicolor
  Clone ID: SORBI-28MAY03-CLUS107175_1
cactggcgagcacttcgaggctatgcccaacgacgccatcgtctgcaacattggtcacttcgatatcgagattgacgttgcttggctaaaggccaacgccagctctgtccagaacatcaagccccaggttgaccgtttcctcatgcccaacggccgtcacatcatcctccttgctgagggtcgtctcgtcaaccttggctgtgctactggccactcttctttcgtcatgtcttgctctttcaccaaccaggtccttgcccagatcatgctgtacaaggccgccgacaaggcttggggtgagaagtacgtcgagttcgccaagaccgacaagctcgacgttggtgtctacgtcctccccaagatcctcgacgaggaagtcgcccgtctccacctcgaccactgccaggctgagctcagcaccctcagcaaggtccaggc

SEQ ID NO: 9271 - DNA, 615 bp, Sorghum bicolor
  unsure (1)..(615): unsure at all n locations
  Clone ID: SORBI-28MAY03-CLUS107383_1
ttccgctcctcctctcccacggccacgcacacctccccctcccgcgccaccgccaccgcgctcgcgacccccacctcctcccgccttcacacgagatctccgcggcggctttcctcgccgctcagcacacgcggcgcgcgagtggaagcgtgccggcagcggagcctgcaccggaccggccgagcgggattcgccgcgcgcgcgcacacgcggtgagccggtcactaggaaggcgagggcgcgaggctagatccacttatccgcgagatctcgctaccaagtttccgcatcttccagggagtctgtggtattggcggggactattcagagctcacacttatagtctgggctagctgctgatcctggtcggttggaggagatgcaaaggaatggcgtgctggaatgcagcgtttgtcactccaaggtggcagttccgagccccaggagtgtgtcgagggcctatgacaagcaccgcagcaagatatcatccaagtaccgtgcacttaatgtccttctcgtgtctggggactgcatcttggttggcctccagcctatcctggtcttcatgtcnaaggttgatgggaagtttcagttcagtcctatcagcgttaactt

SEQ ID NO: 9272 - DNA, 601 bp, Sorghum bicolor
  Clone ID: SORBI-28MAY03-CLUS10745_1
gcacgaggctcttctgctacctccctccactaccagtccaccaccaccacaccccactgctgccgtcgcttccccccaaaccctagccaaggggacacggtggccggcgatggacggcgacggaggaggcgctgcggcggtgcaccaccacacgcgctcccccgaggacgtcttccgcgatttccgcgcgcgccgcgccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaacccgcactggggataaactttgcacgtgatggaatgatcgaaaaagattggctgtctctagttgcagttcatagtgatgcatggctcctgtccgttgcattctactttggtgctcgctttggatttgataaagaggccaggagaaggctcttcaccatgattaataacctgcccactgtttatgaagttgtgacgggggttgctaagaagcaatcgaaagcccccaatggcagcagcaaaagcagcaaatctaac

SEQ ID NO: 9273 - DNA, 782 bp, Sorghum bicolor
  Clone ID: SORBI-28MAY03-CLUS107528_1
gcgcgaggctccgcccccgcgaccgcggcccgccccccctccccccccccgtgcccggcccggacacccccccggcccgcgccgccccccgcctccgccatggccccgtcctgggccgccgggtcggccggccggtcccccgccgccgccgccgccgccccggccggcgccgccgccggtgccgccgccggcccggccgtggccgctgaggtggtaccctcggcggggggcggctcgtacgcggtgcttcagtgcggcgaggactcggagtacgtgcgccagaagtacagcggctacttcaccgtcttccgcgcgctgctggaggaggacggcgagagctggcgggtgtaccgcgccgtccgcggggagctccccaccgacgccgaggcggcggccttcgacggcttcgtcatctccgggagctgcgccgacgcgcacgcggacgacccatggatcctcgacctccgccgccccgtccgccgcctccgcgccgccggctgccgcgccctccgcgtcggctgccgccccccgctcctgcgccgcccgctgcgcgcccgcgcgcggcggccggcctgcggctccgccatcggcgtggcaaggcaggcttaagctgacgagggaggaggaggagcaagttaccacaggagcaggaggaaattgggagcattccattggatgcctaggttttttttcatccttgttttgtgcttcatcagagctcaagagttgtacagaaactactattgaacgaagcattaataaagaggacaaggggataaaaa

SEQ ID NO: 9274 - DNA, 994 bp, Sorghum bicolor
  Clone ID: SORBI-28MAY03-CLUS10762_1
agtctgcagttctgcactcccccgagccagcaccacccagtcgcttcgccttcctccgcggtcgcaggggcagcgcggagcactagcagccgcgcgggcatcattgaatggctgcaatgatgggttcaatatctgcctatggttcttaccaaacaaataggcccagtgcactaaagcaggcacctcacatgcagttccaacaatgttgtagcagtggagttgggttcttaagcaagcactcacaatccatgcgaagtaagacacagctggctaaaagaagagctacgaataatggaattcatccaaagactactaggccccgggcacctattgtctgttctactggaatggctataatttttgttgcaactgaagtgcacccatggtgcaaaactggtggcctcggtgatgttgtaggaggactgcccccagctttggctgctatgggacaccgtgtcatgacaatagctcctcgttatgatcaatacaaggatgcatgggatacaagtgtccttgttgaggtaaatattggtgacacagtagaaactgttcgattcttccactgctacaaaagaggagtcgatcgtgtttttgttgatcatcctatgtttcttgaaaaggtatggggcaagactggagcaaaattgtatggtcctactactggaactgactatcgagataaccagttgaggttctgtcttttgtgccttgctgcattggaggctccaagagttctcaatctcaacagtgaacatttctccggaccatatggggaagatgttgtctttgtagcgaatgcatggcacactgctgttctgccatgctatctgaagagcatgtataagccaaatggaatttatgctaatgctaaggttgctttctgcattcataatattgcctatcaacgtaaacttgccatactatattcgcgtaccggcaacaccagctgacagtctcttgccatcatttgatcctattgacggatatgttaaac

SEQ ID NO: 9275 - DNA, 1034 bp, Sorghum bicolor
  Clone ID: SORBI-28MAY03-CLUS10056_1
gcagcacaacaccgacgccctcgacacccagataatgttctgcgaaggccacataccctgcgttgtggtggacaaggataccagattcaggatcttagaaagcagaagcaagatggcgaagatttctccggcggcgaccatggtcggaccggaggtggcctcaccgagagtcgcgacgttctcgtcgaggggcccgagtgcagagttcccttttatcctcaagcccgacatagctgcaccaggagtgagcatattggcagccaagcgtgactcgtacgagctcatgtccgggacatccatggcatgccctcatgtctccgcgatcgtcgccttgctcaagtcggttcacccagattggtcgcctgccatgatcaaatctgccattgttaccacagcatcggtgaccgatcgatttggcctgccaatccaagccaactcacagcaaaggaaaccggctgaccccttcgacttcggcggtggccacatacagccagacagggccatggatcctggcctggtatacgacctgaaaccggacgactacaccaacgacgacatcgccattgaacagctcaacctcccctccatcgccgtgcctgacctcaagaattccaccacgttcacccgcacggtgaccaacgtcgggccggcgaaggcgacgtaccgggcggtggtggaggcgccggcgggggtgaagatgagcgtggagcctccggtgatcgccttccagaaaggtggccctaggaacgcgacgtttaaggtgacgttcatggcgaagcagagagtgcagggtggctatgcgtttgggagcctgacatggctggatgacggcaagcactcggtgaggatccctgtagccgttcggaccgtcgtccgggacttcgtcgctgatgtatcttgatgatcgagttcgttctgggcaggatgtgtgttccacgttgttgattcttcacccttcgattcttttctcgctttgcaattaattcggtttactgtccaagccgccagccattcgtgtttttgtaataagaaaa

SEQ ID NO: 9276 - DNA, 1027 bp, Sorghum bicolor
  Clone ID: SORBI-28MAY03-CLUS10103_1
gcacgaggatgctcgtgtcgaattgcctgttccggatgggtggtgcggccatcctgctctccaacaggcggtctgacaggcggaggtccaagtatgagctggtgcacacggtgcgcacgcacaagggcgccgacgaccagtgcttcggctgcgtgacgcaggaggaggacgagagtggcgagatgggcgtgtcgctgtccaaggacctcatggcggtggccggagacgcgcttaagaccaacatcaccacgctggggccgttggtgctcccgttatcagagcagcttctcttcatgggcacactgattgccaagaaggtgctcaagatgaagatcaagccgtacatccctgacttcaaactggcattcgagcacttctgcatccatgctggtggccgtgctgtgctggatgagctggagaagaacctggagctaactgactggcacatggagccatcgaggatgaccctgtataggtttggcaacacatcaagcagctcactctggtacgagctggcatacactgaggccaagggcaggatcaggaagcgcgacaggatctggcagatcgcgttcggttctggattcaagtgcaacagcgccgtctggaaggcgctccggactgtgaacccggccaaggagaagagcccctggatggatgagattgacaacttcccggtggatgttccaaagatttcaaaggttggcggtgcttgaagaacttccctggttcttcttcttaggtggcaagtggagttggggtggttgtcaggggctgggcagaggtttattccattccattgtttccaccgtcagttcttgttttcagttgtagcatggcatctgtgaaggaacttgaagtagatgattcggttaggtagaaagggtgtgatttcttcggtagggtcgtctgaatgcctgatatgtcatatttttttcagattggggaaagcaattgattttcggtgtcgattcttcgctgcctgattgagacgtttcgattgtaggccaactgaaacttgaattcc

SEQ ID NO: 9277 - DNA, 1668 bp, Sorghum bicolor
  unsure (1)..(1668): unsure at all n locations
  Clone ID: SORBI-28MAY03-CLUS10104_1
gcacgagggttttcatgtgggatgcaaagaaacgtaaggacgaaatgccaattttcactcgggtgcatggtgttaagcgagcaacatctgtttgtgttggtgaaacacatatgcttgtgctctcaagtatatagcatcctgagtatccgcccaaacctaaaagccaaggcagaaaatccatgttagaatggaacagtggaacagaagagttggatgaagatatcctgtttaatgatgttcagcccaacagtggtttatcaggaagcagtggtgaaatgagcaaaggtgtgcctagcttgaaaagcctctgtgagaaggttgcagttgagtatttgttagagccaaaaaacgcaatacaacttcttgaagttgctgattccttggaagccaaggagctaaagaagcattgtgaggatttagctattcgcaatctcgattatattttcacagtgggagctccttcaattatgaatgcttctcctgaaattcttgtgaacttagagaaattactagatgagaaatcctcggagccttggagtcagcgccgtcttcccacaatgacagctacctatcccgctgtcattgacagtgatgtagaggaagatgaaagagaattccctaagccccgtaaatgtgggaaatctgcatcaaggccatctgcaatgtccagtcatgacaacttccttcagaaagactgcactgctgaacaagctgttactaagcagatcagagcacttcgcaagaagctgcaacaaattgagattcttgaggctaaacaacttgcaggtcatcagcttgacaatcagcagctagcgaagcttgagtctagggctgcccttgaaggtgaactttctgaacttcgcgttccctcagaggcatactcaacttcctctgcttgtccagcagaaggtagggcaaacagaaaacctgaggtttctaagaaacagaagagaaagaacaagcaggcaacacagactccgtctgtgaaaagtgagcctgggcaacaaatccccattaaggatcttcaagaagttctatcagtcaatgtctctgctgaaaaggaggcgtatgctgctgatccaatcaaacatatagaggctgccgctttcagcaacacaaaagacattgcttctccattggagaagaaagcttcgcaaccaacttcatcaaaaaaaaaaaaaaagaaaggtggcttatcgttgtttctgagtggtgctctcgacgacaccccaaaaccaagcctccctgcccctgttgtacctgtcacgccaaagcctgaaggacctgcctggggtggtgcaaagataaccaagggacctgcttcccttcgagatatccagagtgagcagagtaaaacaaatgagcccacatcgcccaaggcaaaagaccggtatgagaactcacctgatagtgctgggcgtgtgcgactttcttcattcattccagattcacactcaagcccaatagctgtcacacctgctcgtgcagtgccttnttntgaaggtgacaagagcacgccaccatggtcatcttctgctacctcacccaatgtatcacggccttcgctcaaggacatacaaatgcagcaggagaagcggcaccatggcatctcccacagcccgaaaacccacacatcangcttcgctttaccacaccatggcggatcac

SEQ ID NO: 9278 - DNA, 934 bp, Sorghum bicolor
  Clone ID: SORBI-28MAY03-CLUS10134_1
cgttctcacaggaagcacatgcttgcaagggaggtggaggccgcgacctggacgcaccggcgacagatgtacgctgccggaggagcccccaatggcgtgaagaggcccgattccaacgcgtggaccgtgccgaccatcggcttccctccgccgccgccgccgccgcctcctcctcctccttctcctcatccgatgcagcacttcggaaggccgctgcatgtctggggccatccgacgccaacggtggagtcaccccgggtgccaatgtggcctcggcatctcgtcccccgcaccccgccgccgccgtgggctcctccgccgccatctgacccggcgttctggcaccatgcttacatgagggggcctgcacacatgccgggccaggtgactccctgcgtggcagtgccaatgccagctgcgcgtttccctgctccacccgtgaggggtgctttgccatgtccacctccaatgtacagacctctcgttcctccaacactcgatacgcagtttcagctacagacacagccatcaagtgagagcatagatgcagcaataggtgatgttttaacgaaaccgtggctgccactgcccctgggactgaagcccccttcagtagacagtgtcatgggcgagctgcagaggcaaggtgtggcaaatgtgccaccagcttgtggatgatccccggggctccatagctagctgcttgtccctgcagtccaacaaaaagaatttgtcgacatgccttttctgtttcaaattttcatgagccatttatggaccactctctcttagttaacttgttcagggtcagagagcaaaacagtacatcctttcaggtttgagggaaatcaacctgagtacatccaagtacaatgtgccatgacggaataatgaagtcttggccttggcccgaataatcagtagctgccatctc

SEQ ID NO: 9279 - DNA, 767 bp, Sorghum bicolor
  Clone ID: SORBI-28MAY03-CLUS101317_1
ttcaagtggcaaatggtgaactcctgtcttcgtctaaggttattccagctactgtttggtccatgcaaggcttagaattccagcaggatttgaaggtcatacccctgtcctcatatgatatgattttgggtttggattggctggagcagcatagccccatgtagatacattgggcacacaagtggttacagcttccttacaaatctggtatggttcaactgactggtatcttacctgaagtacctggcgagtccttgcatcttttagttgatcacatgagttcccagcaagaagatactaagggaccttctgaggttcagagcttggtggaggaattcaatgatttgttccaacctccttcacagttaccgccgtcccatgcttgtgaccatgccattcctttgattccaggggccagcccgatctattctcgaccataccactttgcacctgctgtcaaggatgaaattgagaaacaagtcaacgaaatgcttcactctgggttgatacagaaaagctctagtccttttgcttcttctgttattttggttaagaaaaaggactagtcatggcattttttgtgttgattataggcagcttaatgcaattactcagaaaagtaaatatccagtgccgcttattgatgatttactagatgaattgggacaggcttcttggttttctaagttggatttgcgctctggattctgttgaatataaatgggcttttagcccaataattatatttgatgattaatttagggccc

SEQ ID NO: 9280 - DNA, 633 bp, Sorghum bicolor
  Clone ID: SORBI-28MAY03-CLUS10902_1
gcacgaggcggggtctctcgccgtcgctctctgtgctctcctccaccatttccccccccgaacctctcctcctcatcctcctcccgcttccccgtccggacaatcgaaggccctccccgatggatccattggaaatgcagcacgactcgaagaaatccaataagcccaaatattctaagttcacgcagcaggagcttccagcatgcaaaccactgctaactccagcaattgtcatttctaccttcttactggttggcatcctatttgtcccaattggtctcgcatcgctttctgcatcacaagagattgtggagctggtacatagatatgatacaagttgtgtgccctcggctgataaagttgggttcattcaggacactaaaacggacaaatcatgcactagaactctaactgtacctaagcatatgaagagcccaattcaaatatattaccagatcggtgacttctatcaaaaccatcgacggtacgtgaaaagtcgtagtgataaacaattgctgtataaagatgctgcacacttgacaaaagattgtgagcctgaagtttatggtgctgatggtgctccaatcgttccatgtggcctcattgcttggagtttgttcaatgatacatata

SEQ ID NO: 9281 - DNA, 779 bp, Sorghum bicolor
  Clone ID: SORBI-28MAY03-CLUS10916_1
cggcgttccccgctcccctccccgccgagatccatcatcgccatcagaccagaccaggtgctcggcggcgatggcaacccgctactggatcgtctctctccccgtgcagtctcccggcgccaccgcgacctcgctgtggccgcgcctgcaggacgccatctcccgccactccttcgacaccccgctgtaccggttcaacgtcccggacctccgcgtcggcaccctcgactccctcctcgccctcagcgacgacctcgtcaagtccaacgtgttcgtcgagggcgtgtcgcacaagatccggaggcagatcgaggacctcgagcgcgccggaggcgtcgacagcggggcactcaccgtcgatggcgtccctgtcgacacctacctcaccaggttcgtgtgggatgagggcaagtaccccacaatgtcgccgctcaaggagatcgtcggcagcatccagacacaggtcgccaagatcgaggatgacatgaaggttcgagcagcggaatataacaatgtaaggagccagcttagtgcaatcaacagaaagcaaagtgggagcttagcagttcgtgatctttccaatctggtaaaaccacaggatatggtcagcgctcgccagctgggttctctgctccctgttgttccgtactgcccccaagcgcactggttgtcaagctatgagtcactcgacacatttgtggtacccatgtcatctaaacagctctatgaagacaatgagtatgccctctacactgtaacactttttgctaaggttgctg

SEQ ID NO: 9282 - DNA, 997 bp, Sorghum bicolor
  Clone ID: SORBI-28MAY03-CLUS10929_1
gcacgagggcgccaaccacggcgccctcatcgactcccacgccgccctcgtccgcctcaacaacgcccgcatctcaggctacgccgcgcacgtcggtagcaagaccaacttctctttcatcaacagcaacatccttcacctctgcgcgcgccggcccggctgcttctgccacccctacggccacggcgtccccatcctgctctacatctgccaggccggccatttcctcgatgtcgccgcctgcaacgccacctcgtcctcccaccacggctccccgatctccgtcaccgatgcccgcctcgacgtcctctgcgcgcgcatcgtcaagtactactccctccgccgattcgtcgtcgagaccggccgcgcgcccgaggagtgggaccgcgcacacgacgccgccatgttccattactcgtccgggatgcaggccatcatggtcgcggtgggagtgtgtgacaaagtcagcgtgttcggcttcggcaagtcttccgacgccaagcaccattaccacagcaaccaaaaggcggagctagacctccacgactacgaagcggagtacgctttctaccacgacctctccgagcatccgcaggtagtcccgttcctcaaggattccgggctcaccgtcccgcccgtcgtcttctaccattaggccagcttcgtagagcgcgcgccatgtgctcgacgttatgaggaacgggtgttctccccccacttatttttccggttttgattagttagtacgatgtaaaagttgttgtgtcggtggttaatccattgtgattagacgagataggcatatcgagatagtaaaattttcgtgtgctgttggagttggaagatgtatattggggtattaggctaactccattgttatagaagaaagggaattgtttggggggtttttggcttcagcacgacagtaggcagtgtctggaattgtaactttagacgacatttcaatttattaagaaccagaaatgtattatctctt

SEQ ID NO: 9283 - DNA, 974 bp, Sorghum bicolor
  Clone ID: SORBI-28MAY03-CLUS109393_1
ccgcgccggccgggcctccggcgcgtccgcgtccggggcgtccccgccgtcctcccccccgcggtcccggccgcgtccgccgtccgcggcctcctccacccggccgggcccgcggcccgcgcgcccgccgggtgcgtctccacgctggacgccctcggcggcggcgcgccggccgccagcgggcccctcggccccgcccgccaggcctactcccggggcccgcgccccctgcgggcccgcgcggccccgcccccccccccctcccccagctcccgcacccggtgcggggggcggggggggggcctgcggcgccgggacggccgggccccgcgctccgtcggccccggccccgccgcccgcctcaccgggatgaccaacgagcagctggtggagttcgcgtgggggctggccaacagcggcaggccgttcctgtggatcatccggcgcgacctcgtcaagggcgacaccgccgtgctgccgccggagttcctggccgcgacggccgaccgcgggctcatggccagctggtgcccgcagcaggcggtgctggaccacccggccgtggccgcgttcctcacgcacagcggatggaactccacgctggaggccatgtgcggcggcgtgccggtcatcagctggcccttcttcgccgaccagcagaccaactgccggtaccagtgcaacgagtggggcgtcgggatggagatcgacagcaacgtccggcgcgacgccgtggcgagcctcatcactgagctcatggacggggagcgggggaaggagatgaggagaaaggcactggaatggagggacatcgcggtcgaagtggccaagcccggcggcacgtctcaccggaattttgatgacctggttcgcaacgtgctcctgcccaagaactaggcgattagctccgtctttgcacggtgtttctgtcagtgtcgtgtgattttgtcccctttggttatggtgggatgatg

SEQ ID NO: 9284 - DNA, 791 bp, Sorghum bicolor
  Clone ID: SORBI-28MAY03-CLUS10945_1
atattaaatgataggaagtgctaggaagtgaaatagaatgaaatagagccactttgggcttccctatgaaatgaggcatggaacggagccactacgaagaaattccgggagttacgaaagaagcttcggactcatattgttcacgggaggagagggacggggggaaacaaaaaaaaaaaaaaaaaaaagcagggcagagagagagacgtaaagccgccgcttcgtgcgcgtcgacgtcacctcgcccgccgccgggagccgtctcgccgcctgggtcccctagggctcccttccctcgcccggaccgggccggcgccggacggatcgggagagtagggcgactggcggctggggatggccgggaagaagcgcaaggcggaggcggcgcgcctggaggagacggaccgggcgctctacggggccttccgcggcgccgccaactcgctctcgcagctctacacgctcgccatgggcgcgcagaaggcctccttccacgccggcgaacgccacgccatggaaaaactttatgaatggatcctgaggcagcatgaaaatggcttgaggctaacagttgctgatgtagcctcccatatccaggtaagtttgcaattgttccttcatatgtttctatccaatttgaaaatggaaacctgggtaaaaacgtggatatattggcatttcatacatcatgtttagctctaaatatgtgctaagtgctactgacttgttgccttaacgaacaatgattttttgacaaatgagatgagatgaacttgccgttcttgcagact

SEQ ID NO: 9285 - DNA, 861 bp, Sorghum bicolor
  Clone ID: SORBI-28MAY03-CLUS10379_1
cggcataccaagccccacgggttttgtgatgaatatgcaaccttcagaagcagaggttggctttgatctccgcctgggtccaactgaagatattgaacagatcaaacgaagagtcaaagaggaatgggcaccagctcataaaaacttgacctaccagctaatgcagaaaggtccagtaacagatgtggctgggcgtcccatattcaccgcaacaaatgagtcgaacccatggtggtccatattcgagaaggccatcacctccgcgggaggaaagctatctaagcccgagatcttatcttcaaccacagattcacgctttgtgaggcagctgggcattcctgccctcgggttttctccgatgacaaatactccaatactactacatgaccataacgagtttctggaagataaggtgttcctgaggggcatcaaagtgtacgaacatgttattagagcactaagctcgttccaaggctgattcgtgaaaggaaagtgatgtttgcatgatttgtagcattgctggattcccgtctcatttactgaatgaaggtaagagcatcgaagctatggcctacaggtttctaataattggttcagtctcaaacatggcaaaggaaacattccgaaaccatcaggatatgtcaaatatagggatatgaatgataagcaaagaactgtaaatatgatttaggggttgtgaactgttgtaccacaatagcccaaaaaccactgtctctgttgatatattttctgatctggaggctgtatcggttttccccgtgtgctggagcaaaccgggtgttggaataatttctccccacgtggaacacttttttcctgtcaaaaaaatgcaagagaact

SEQ ID NO: 9286 - DNA, 750 bp, Sorghum bicolor
  Clone ID: SORBI-28MAY03-CLUS104768_1
gcacgaggagctcgccgccgcggcgtgacccagcgtagtacggctctcatccgcccacccagaccgctcgctatttcctttcccccctactcctcctcttccttcccccgtcgcggcgggagacaaagacacgcgtggagaagcaaaggctcggggctagatttgggaggttcaggaggactcactcaggagggaagctttttccggtcggccggcgacatggcggaggagaagagcgctctgcagtcggcgagggagtgggtcgtggagcacaagctccgggccgtcgggacgctgtggctcagcgggatcgtcggctccatcgcctacaactggtccaggccgggcatgaagaccagcgtcaagctcatccacgccaggctgcatgctcaggctctcacactggctgccttggctgggtctgggctggtggagtactacgatcaccaacaagggtcaggatccaaagtccaccaatacgcaaagcagttcctatcatctgatgctgatagcagtagcagcccacaaaaagagtagcagccttacgaagtaccatctgtggagtgggtcagtgggtgttattctctgatcaaataattttgcctatggcattctgtggcaacttaggcggagcttcgcctgattttctatgtaatgtaagctgctgaaacctgaattaaccgtgtatgaagatggtaccatgcatatgttttcctgaatgtcttgaaatgaaataaatggttttttttt

SEQ ID NO: 9287 - DNA, 575 bp, Sorghum bicolor
  Clone ID: SORBI-28MAY03-CLUS107098_1
gcacgaggtaccagaatggccctctcagtttcgacattgacagctacatgggtggcctgcctaggctggtgtacagaccggagacctggaccaaggtgagcaatatcatttttcttgattccccagttggagctggattttcatactctgtcaaagagcaaggatacaattcaagtgacaccaaagctgtcaatcatattctcatctttctgaagaagtggtttgaggagcacccagagttcttatcgaatccactttacattggcggtgattcatatgctggtatgattgtgcctaccgtcacctctgaaattggtttgaaaattgcattgcaaaataattccaaagaacctttgtaagggttttgtgtcctaaagaactgtaacttctgtataaacatgtgttggggaagcagttcccctgacgttattgcacaccatggcatggtcaccgacaggtaggccccggtgttcatgggtccacatgtcagtgaccaagtcatggggagtttgcatcagaggatcctcgtccgcattcaaacaatcggtggcactagccttttctttaaaaaaaaa

SEQ ID NO: 9288 - DNA, 843 bp, Sorghum bicolor
  Clone ID: SORBI-28MAY03-CLUS105350_1
gcacgaggcccatctctctcttccttatctcttacgcccgaggaacgtccagagagagaatggaggcgctgggccgatggccggcctggagcacacgcgccagccaagccaggggcttcgcatggccgggccaagcgctcgcgcagcggccgagccaggagctcgcgcggccatgtctggagctcccgcgacgggcgaggcaggggctcgtgcggccaagctcgggggctcgcgtggccgagcttggggccggccaggaggcatgcgcggcagccggccatggcttccagctgccatggcgcggccagtcctgcggccgggctcatgcggccaagagccggggcgcgctgcggccagggctcgaggtggccgggccaaggcgcggcttctgtcggcggggtgggccggccagagcggccgagcggctcgcccacggccacggcacgcggcggccaggtggccagctcgcggcctggtgcgtggcagtggcggccggctcggctgggccaggggcacgcgcggccggggccagaggctcgcacggccgagctcggccaggaggcgcggctcgcagccggcgtggaggccgcggcggccttatttccggcggcgagcgctcggtgcgttctcgtcagcatgtcttcaggacggcgacggttcggtttgtatgcatatagatgggtttggcacttcagggccattgtgtggttgcttcgggcaaccttttgggcaatagcttcaggccatgctcaagaaccaccgcggtgcttgcaagcatatccactggtgacgagttcgtgatgtgttcgtccatcacgtttgtgtgttgtggaactatttctt

SEQ ID NO: 9289 - DNA, 891 bp, Sorghum bicolor
  Clone ID: SORBI-28MAY03-CLUS110979_1
gcacgaggagctcgtggccatccccaagccaacgacgaacaccctgctctgttcctgttccagacaagagaaacgcgagcgaggccggcagcaacagagacactgctaccgactaccgaggcgggtgtcaccggcagtggcatgccctgagagaccacggaaaccacatgtggcctgcaggcgcggagcacccgatgggcatgggccacgggccagcggcgccgtcgccgaggccgagcacgacggcgacgcactcggcgtcggcgtggcagtcgccggtgccgtacctcttcggcgggctggcggccatgctggggctcatcgcgctgtcgctcctggcgctggcctgctcctactggaagctgtcggggagcatcctggccgcgggggagccggacgacgacgacctggaacgccgggccgctggcgcgggcgccggcgacgggaaggccgcggcggccggcaaggcggacgccggggagcgttggcgggagcacgtggtggtcatcatggccggcgacgagaggcccacgttcctggccacgccggcgtcgggccggggcgccccggacgacgcccgtggcgtggccgtcgtcagcgtggcctgcggtggcggcggttctggctccggccccggctccgaggacggcgaggaagagaggtgcgtcgagtgcggcgcgagatcttggccggctcgcgtggccgacgacgagccgagtcggagcgagctgagtggtggtagtggtagtggtagttctgtaatcagtgagagatgagagatccatttcctgcttctttttttctactggctccttttttttcccctgtgtgtgtgactgcgcctacatttatttgttttgctgtatactactagtagagtttttttttttt

SEQ ID NO: 9290 - DNA, 979 bp, Sorghum bicolor
  Clone ID: SORBI-28MAY03-CLUS11156_1
gccttgagtatggtagaacaagctgcaaaaccacttgctcgtcctgttagagtatgggttcttgatgctacgcctggcaaagttcgtgcagggggagatggtgaagatcaccctgctgaacttattgagtttctcagaagaatgcctgagcaggtttcttcaaaacaggaggttgtcgatgctcttgttaaaggacaattttctgtggatgttgcacggtgggtggccacaaatctgcgtcgaaccagtccattgggtcagcgatcatcttcaagcttctcatggacttttgacctaaatggcatctctgagatgtacaagtcctatgaggatactaacttatggaggattgtagagaatgtaccaaggggtgttcatattaattttttaaaagctgaacgaagtttgcatagatgggctcttgaagacctccaaagaattcatactgcggaggaattagctgcagatgagggtggaggagttgaaatgcatgtgcttgaagatgctggacactgggttcatgcagacaacccagatggtctctttagaattctgtcgtcaaccttccgaatcgaaactactataagaggaatgcaagactgaggatatccaatatgaggggaggcacgtccgaatcgattctactataagaggaatacaagaggatcaaaccttaattgatccagtgacaatctgaggggaggcactgacattaccagaagatgtgtatattacaagcagagagggtggagccatcatgtttctgaatgataggcgtctttgttcatttgttcattctttttttttaaaaaaaaaacaaagaagagtaaaatgcatacttagtacatataaacttggcaaatgggtgcacttagatacattatctctctaatcgctcgactcagttcaagaacttgtcaagtgggtgcacttgcatgacctttttaattgctgacctcagttcaaaaacatgcaaagg

SEQ ID NO: 9291 - DNA, 793 bp, Sorghum bicolor
  Clone ID: SORBI-28MAY03-CLUS11175_1
gcacgaggcccccccccccccccccgcccgcccccccccccccccccccccgccgccccctcccccccccggccccagccctccccgccccgccccagccgcggcccgctcggcggcggcgcgtccaagccatgccctgcccggcgccgcttcgccccactctggccggccgtcggccaccggatccggtggcaggatgaggcggatccatggcggacgtcagcagcggcggcggcggcggcggaagcgtccggtggcaggatgaggtggatcccgaactgcgctctctcgtctactctttccatctatcctggagcgcgattgacgtactgccgcgattgtttgttcgatctggtgtttagggggtgtttatttagggttcaactcgtgtctcctgggcgaaatccgcgaagaatgcattagtttccggatcgatgcgatgcgtgttcaattcaatcgcctagcgatgcgattggctatttcttcatctgttaaattgatataatcacccggtcggattttcttctcaactttctgtgtccagagaggagacaatggctggattatgcagggctctgcacaagggcagatcacctccggagggccttgaccaatacgtagcagatttcgaggaggccacattcgagaaagcaacaggatcgactacatgaaaatgatatctatcagggtcagtttcggccaaaaagaggcaaaactaaaggctaagattgctgcagaccgtaaacaaaagatgcaaatggtgcaccagatgaatcagtcggctaacatggtc

SEQ ID NO: 9292 - DNA, 788 bp, Sorghum bicolor
  Clone ID: SORBI-28MAY03-CLUS112712_1
cgccgcccatgctcggcaagcaccgtgccgtcacacgccaggctctcgccctgctccaggacaactaccccgagttcgtggccaagaaggtgtttatcaatgtgccgtggtggtaccttgcggcaaacaaagtgatgagcccattcctgactcagcgcaccaagagcaagatcgtcttctgtagccccggcaagtccgcggagaccctcttcagatacatcgcgccagagcaagttccggtccaattcggtggtttgtacaaggaagatgacaccgagttctccacctctgatgctgtcaccgagctcaccgtgaaaccatcctccaaagaaaccatcgaaatcccagccaccgagaactccaccgtggtgtgggagctccgcgtgctgggatgggaggtgagctatggtgctgaattcacccctgacgccgagggcggctacaccgtgatcgtgcagaagacgaggaaagtgccagcccatgaggagccgatcatgaaggggagcttcaaggtcactgagcccggcaaggttgtgctcgccgtgaacaacccggcgtcgacgaagaagaagctgctgtaccggttcaaggtgaagagcaccgccgaatccgccgccgcctgaggtgtggttacagcttccgggcagcacagccagctgcttgagcttgaccaccccgacgtaatttgatcgatcgccattagccaggtccacaggtccatacccgccaccatttgaacatgttgcatgataggagaggaggacaataaagagtttctctgttacttt

SEQ ID NO: 9293 - DNA, 695 bp, Sorghum bicolor
  Clone ID: SORBI-28MAY03-CLUS113735_1
gcacgaggctcagaacacctgcttctgcttacaattacaacatggccccctcaagaaccgccttgtcctcccttgcgctcctgctcgcgttgctcctctcgtgcgccgccgtgagcagcgcggcgcgaaggctggaggaggcagctcccaaggagggggagccgcacctgaccgtgccggagctgccagtgccggagcacgagctgccgccgctgcccaaggtcgaactgccgccattcccggaggtgcacctgccgccgttccccaaggtcgagctgccgccgaagcccgagatcccggccattcccgagttccatttcccggagccggaggaggaggctaagccatgaccgcgccaccgctgcgtcctacttggtcggtcgtacacgtgtgtgatttgtatgttcgtgctgggatatggatgtccgctcgtgcgtccgtgcgggcgtcagtgcgtgtgtgtgcgtgcgctgcttgcatagttgcattattggcttggtgtgttgctcgtgtttagatgcttgtttacttgcgggatccagagttctcggcgtgtgtcagcgccaaggacgaacgtactgtgcgtaagtgactgtcttgcgacttgtcaaaaaaaaaaaaaaaaaaacatgtgtatacggtccctcgtatgcttaatgtttgtcaacggagtatgaatatcatcattgtcagtg

SEQ ID NO: 9294 - DNA, 847 bp, Sorghum bicolor
  Clone ID: SORBI-28MAY03-CLUS11396_1
cggacgcgtgggttcaactttgagaagtcggtcgttgagatctctctggacagcatcaagcgtgtgaaggaccaggttgcaagtgagagaccaaccagaagtgctccactttcgacgtggtcactgccataatcttcaaatgtcgcgccttggcagtcgactttgcacccgatgctgaggttcgcctgggctttgcagccagcactcgccacctgctgagcaatgcactgccctcggtcgaaggctactatgggaactgtgtgtacccaggtggcctcaccaagaccagccaggaggtgaaggaggcttcacttgtggagatcgtgaccgcgatcagggaagccaaggaagctctgtcgtcgaggttccttgactggttgagcggcggtgccaaggagaaccactacaacgtatcgctagactatggcaccctcgtcgtgactgactggagtcatgtgggcttcaacgaggttgactatgggttcggtgagccaagctatgtgttcaccctgaacgacgatgtgaacattgttccctccgttgtgtacctgaagccgcccaagccaaagcagggcatcaggctggtgctgcagtgcgtggaagggcagcactctgccgtgttcagcgaggagttgcagaagcatgcatagagtgagtgtattccattctacagtgggaatttgttgtattttgttgtgtcaaattgctgctcccggaatttgcttgcaataagacagggttggtcatgtttatactttgtactattatcagcacgttacattatacatgtattgagcattgacagtaatgaaagaataatagtgttccatttgaaacaaattatttc

SEQ ID NO: 9295 - DNA, 676 bp, Sorghum bicolor
  Clone ID: SORBI-28MAY03-CLUS10770_1
atcggtcggctgcatcgaatccagtggctggtgggcgaatccggcggcggcggcggcggcgggagcgggcctagccgcgtgcgtggctacattggcgcccagcgtaggggctcaggttgctcgcagctatggccatgcctggccgcggggctccggacatcgcgctcggcgtggtggccacactcggctacggggctcgggacatcgtgctcggcggtggccacacccggccgtggggctacggttgcgtgcggcgaaggcggtggtcggggtgtggggcagcagcgacggcctcatcctcctgtagtttgtatgcttcttcttcccttctctgcagctaggatacttcaagtgttcttctgcaggtttgacaagatgtttattcctgaagttcacttgctgctaccatgtcggtgcctattcacggttacatttgctgagatatgatgcctggtaggacaccgtgcagcctgccaaattttgtagtacaaagaaattgaaaggaggcctaataagctgctgagtttgactgagacctcaactcatggtcctctgcttgtgtccatctgtagcaagccatcaactaacagaaaacagattgcggcaacaaggagctagaggaccaagagcacagccatcaagaggatgttagcagccaacttttgtgccctaccag

SEQ ID NO: 9296 - DNA, 733 bp, Sorghum bicolor
  Clone ID: SORBI-28MAY03-CLUS10775_1
acgactacgagtagccattgtctccacatccacccaccaatctcattctcattcagcaagcgaggaaggaaatcctctcgatccaattcccctagatttgatttgatttgaacctaccttgccaatcagatcacacacaacagcagcagatcatcacaaatcgcaagatgaagaaggcgtcgtcgctgtcggagctggggttcgacgccggcgacgcgtcgtcaggcttcttccgccccgtgtccgactcctcctcctcctccgccgccgacggggtggtggtgaccccgtcggcgcaccgtcggaggctgaccaaggtatccgtgatcggcgcgggcaacgtggggatggccatcgcgcagaccatcctgacgcgggacctcgccgacgagatcgcgctggtggacgcgctcccggacaagctgcgcggggagatgctggacctgcagcacgcggcggcgttcctcccccgcacgcgcctggtctccgacaccgacatgtccgtcaccaggggctccgacctcgccatcgtcaccgccggcgcgcggcagatcccgggggagacgaggctcaacctgctgcagaggaacgtggcgctgttcaggaagatcgtgccggcgctggcggagcagtcccccgacgcgctgctgctcgtcgtctccaaccccgtcgacgtgctcacgtacgtcgcgtggaagctgtcgggtttcccgggcaggcgggtcatagggtc

SEQ ID NO: 9297 - DNA, 840 bp, Sorghum bicolor
  Clone ID: SORBI-28MAY03-CLUS10782_1
aagaagacatcacttcataagcgcaggcttataagaggattgtagccctggttgcccagaggatatgatccctgcactgagagtactccacaaagtactacaacttacctgaggtgcagaaagctttatatgccaatgtcactggaataccatacccctgggtaacctgcagtgacccagtgtatgatttttggaaagattcgccgagatcaatgcttcctatataccgtgaacttatagctgcaggcttaaggatatgggttttcagcggtgatgctgattctgttgtccccctcaccgcgacaagatactccattgatgccctctttctaccaactgtcacaaactggtatccttggtatgacgatgaagaggttggtgggtggtgccaagtgtacaagggattgacactggtgacgatccgaggtgcagggcacgaggttcccctccaccggccgcggcagggcctgaagctcttcgagcacttcctgcgagatgagcccatgcccaagcctgtagatagcattcagtcattttagaattggttactgtctctgagtctctcgcttgatgaagacctggctgcgcattcttcttgctgtaacacattcgttgccacattttacaggccaacacgtttcacttgttcaataatccacattggccagccgtcacactccattgttacgagtgattttcagggaaaaacactgagctgccttaattgtcttcccctgttttctgtttttcctgttccttttttcttccgctttttggcagctcgaacctcaaagtggtttgtgttcgtgttttttctccttctattagtataacacggca

SEQ ID NO: 9298 - DNA, 657 bp, Sorghum bicolor
  Clone ID: SORBI-28MAY03-CLUS108024_1
gcacgaggccacagttgtagttcagagagaaagacgacaccgagatcgccgatagcaccaatcatggcgtccaactccaaggcgctcctcgtgttagcgctcctgctcgccgccactttcctcgtcgcctccgctaacgagcaagcccgtgagcaggccaaagaggagaagaaggcggaggtccaggactggcacggcggcggcggctacccgggtcgcggcggcggctggcacggcggcggcggcggctaccctggcggacactgccggtggggttgctgcgaccgcgggcactatggcggctgccggtgctgctcgcaccccgaccagataccggagcccatgtaccgccctgagctcgtcgaggtccacaactgatgagttgctgctacgtactatgtccggcgatgggcagcaggcacacgtactacgttcgtcctgtgtagtcaataaaagtttggttccaccaacgtcatgaatgaatgaatgaaataaaataaggtgaacgcatgcatgctttgtgtgcgtagttggaaacatcgatttgcgcggctaatcgattaataatgtactcttctatatcatgcatctcatggaataaatagacttatcattgttgttgtaaaaacacatcgccatagttaaaacatttctcga

SEQ ID NO: 9299 - DNA, 1008 bp, Sorghum bicolor
  Clone ID: SORBI-28MAY03-CLUS10838_1
gcacgaggtacacgaccgacgactcgcacagatcggagagtgagcgagcgagagatggccgggaggctaaccgcggcgggatcccgcatcctgggcggcggcggcgcacgcgccgcggcctccgccctccggcaccgcgccggcatgggcctccccgtcggccgccacatcgtccccgataagcccgtgcccgtgaacgacgagctggtgtgggataacggcacgcccttcccggaacccggcatcgaccgcctcgccccgcacatcggcaagtacgaggcgttggcgtggctgtgcggagggctggggttcttcgctgtccttggcgtggctgctgctgtgaacgacaaggcctccaagataccatatactcccaaagtctacccgtacgacaacttgagagctgaacttggtgacagaccattttagattattcatctgtttgatgacaaggcactttgatgaatttagctctatatctccttccatcgaggaaaagcagggaaaacttgtttaccttcgattatgctattttaaatacatggctccttgggaaattgttaagttactggaagatattaaagcttaagagttcctatcagacaaaatggtaatattgctttcaaatgttgaaaatctggaccctcatagaagatgtctgtgattttgcatgcctatagatatcactccacctatggtaagctaacattttgtaggaaaaaaaccggggaaatgggttggtggaattgaggtaacagattcactatgagcaaagccttctcttgctcctactgtttagcctttattcggtaagcagattcataagcagtgttttcctagacattaaacggtgtgaggcacctactgtttagcctttattcgggctaaatggtcaattaaatgggttcaaccgccgattaaacagaaatagggtaccacagtgtagcgttttcatggtgtttaaattggctaaattaatcactggagcactctctcggtttcatccgt

SEQ ID NO: 9300 - DNA, 1497 bp, Sorghum bicolor
  Clone ID: SORBI-28MAY03-CLUS11471_1
gcacgaggggaagaatacaagataaacaacgtatcgacagatgttattttatgtatttccagcatacctgatgtcaaaatttcgagtttgtcagatgacgaattcgacgaggaagaatgtcaagatcttcggctgctggccaagaatgaatcctttaaaaggcctactgttggtgagcttgaggagaaagcaagaagtttacgcagggacataatgagtcactggatcagtaaagaactccagaggctagaaagattaattgacagagcaaggcacgagggttggcacaaggagaagtttgaataccttgataagaaacagctcttacgaaatccatctgaacaacaacgtctacttgaagaggtcccacgagttattccagagatggaagatagtcaagataccgaatttcaagttacaggacaagacaaacctattcaaaagagtattgtcgctttacaaggtaccaatgggacagggtctccttttttgaagagctgcacagaaaaaaaattcaaaggtactgcggccgacactgatcgtgcttcggctggtttactcgctgcaaatccgggcgctactgcggccttcgctttttctcctgtgctaccaaagtatttacatcgccaagctgccaccgaagccaataatgctggtgatatttcacctattcaaaagctggatgctgaaggtgctaaagctagcactgatggtgataaaactgtaacagacattccgcacgggagcattgaagctaccaaagccaacactgccggtgaggcacctggagcatttttggaaaagcagtgtgctaaagctgctgatgttattaccattgaagacgacgatgacgacaacaacaatcatccttgttataaaggacaacaaacagcagtagttgcttttcaagaaaaaacagcagtagttgttgacctagaagctgatgatgccgggggtaaccatcccgtgcaacatgagacaaatagcagaggccatagacacgcgaaggtgaatggagaagtcccgcagcgcatttggtattaccttgatcctcagggtgaagagcaagggccatttataatgcagcacctgcgcatgtggtgggaaagtggcttcttcaccaaggacttcagagtctggagagcaggccaaactagtaatgaagccatcttgctcacagacgcactacagatgatgggctaggctagttaggagcctcgtagaagactagatgtattatatgtaggtatatgcattgcggaaaagcgggagggctttgaggcagatatatatggtctgcttgggtgtaaatcctttgttgtcatatatgtggtgacagtgtgacacccttaccctagccccaccctcacctcacccacccatcaaaaaccactcaccaaacaaaacaatggtggtttgctgggaaagatgtttcgttgggatgaaatatttctggactatatggactatccaattaatatccccgtgctgtgactg

SEQ ID NO: 9301 - DNA, 1132 bp, Sorghum bicolor
  unsure (1)..(1132): unsure at all n locations
  Clone ID: SORBI-28MAY03-CLUS11479_1
ggcctactaggaagccgaaaagaaaactcctcgccgccgtccctcaccacggcgacggccaccgcgacctcggccccgacgttgccgacggcgcccaccatgtcggcgtgctctcccgtccccacgctgcggcccgacgagcggtccgacctcctctcgctgctcgccgccgccgcccgcccgctcgccgacgtcgtcgccgacttcctcgcgcggttcccccgcgagcgccgcctccgcgtcggcggcgccctctccttcctcctcgaggacaagaagatgcttcatcctactggccgtttaattgcatttgcaattcttcatcagagctattcgccgcagacagcaaatccatatattcctatattgttaaatgcagcctgtgatgaaacgtcagagaaatcagaacgggcatttgtccagttattattgacttcatctagtggcaacaataacaacgaggtcctgaatcagtctgccgtagattacataaatggatctgtatcagcatctcaggattttttgcctcgggaacaacttgagaagcaatattgcagtactagtgtacattcccggcctcagattagtagtttcagagctgctatggttagaagtgctataccagatccagacgtgcctcaaagttgtgcaaattcatcagagtcttcgatatcaccacctggaagcaaacagaaatctgcctctgatgatagagatactactattgctgttttgcgccaagacaaatcggggggaaggttgggtccgcaatggattcggcccacacccccaagacttcctgtacttgatggggagctacaatggttgaaccctgacaataaccacgagctattatgggattatagcatgtgtgctgacacgagtcgaggggctgctatccgagatttgattgcaagagccttaaaaggttcacttgcacctgcccaacaggaggttcactgctacattctaatatttcttcaagatgatgatgattattnttatcaaattgcttgagctatgactaggatttcttttcctctttgtttcttatgataaattttatagccctattgctggataaatttatggcacctaggtgttatcactcctttttttttagacattcttt

SEQ ID NO: 9302 - DNA, 945 bp, Sorghum bicolor
  Clone ID: SORBI-28MAY03-CLUS114933_1
atctgatagacagaagttgctgggacaaaaaggctgtgtcgtgtggataacaggactcagtggttcagggaaaagtactcttgcttgtgcactgagtcatgagttgcattatagaggccacatcacgtatgtacttgatggtgacaaccttagacatggcctcaatcgagatttaagctttaaggcagaagaccgtgcagaaaatatacgaagagttggtgaagtggcaaagctttttgccgatgctggtatcatatgcattgctagcttgatatctccatacaggagagatcgtgatgcatgccgtgctctacttccagattctaactttattgaagtatttatggatttgcccctaaaaatttgtgaagctcgtgatcctaaaggtctgtacaagcttgcacgcacaggaaagattaaaggtttcactggaattgatgatccatacgaaccgccagttaatggtgagatagtaattacgatgaaagatggggaatgcccttcacccaaagcaatggcgaagcaagttctatcataccttgaagagaacggatatttgcaagcttagcacatatttgagaatattgatctgattcttgtgtgtccattacttgtggacacaatatgatctgttggccatgaataaaaggcatcaacacatagcaagtaacagaggcgcagtttgttcagaaacggaatacagattcattcgtttcattgttgatgatatttgtttcgtgtgtattgcgcttacacagctgccattcatctgcatcagcaattcagaatgcattcggttaactcgcgttaactgttcgtgtgaattggtagttgttctgtgcttgctaattgggtttactgttggcaatgtatttgttacaagtaaatgcaaataaattgtgtaatttgtatatcagttgtttcctctgggataaaaactgagga

SEQ ID NO: 9303 - DNA, 735 bp, Sorghum bicolor
  Clone ID: SORBI-28MAY03-CLUS11507_1
accttctcgcctcatcttatcccccgcctcctcctgccgctgctgctcactcccgacgcacgaagctcccattcccaagagcaatccatggcgtccaccaccctctcctccgccttcaccctcctctctcgcccctccacctccccttcccccaccgcctcgctcccgaggtcctccctcgccgtgccccactgccgccggggacgccgcgccgtcgccgccgcgtgcaccgccaccgagtcccccaagatcttggagcttggggacgccatcgccgggctcactctcgaggaggcccgcagccttgttgaccacctccaggagcggctcggcgtcaccgctgcggccttcgcaccggccgccgtcgtcgcggcgcctgccggcgcgggggccgccgaggaggaggcccccgtcgagaagacggagttcgacgtagtaattgaggagggtcccagcagcgcgcgtctcgccactatcgcggtggtgcgcgcgctcatagatctggctctccaggaagccaaggaccactctgtgggcctccatttgaagtttaaggatgccgtctgaagggacgaggccgagctccccaagaaacagctcgaggaggtcggcgccaagatatctatcgtgtgacactaggtataataggactcctttttttcttcaatttcttttctttgcatcccaaatcttttgtatccccacccattgtcgttcataaggaattgctgtttc

SEQ ID NO: 9304 - DNA, 644 bp, Sorghum bicolor
  Clone ID: SORBI-28MAY03-CLUS11521_1
aacaaaagcagtctgtgtagaacatattgaactgcggaatgagctactcacattgcttaacctacaaaagcagctgcaaagtaaagaggctgaagtttcagctaaccgggaaaattccttcacagaagcaccaagtacacctaagcgttctaatagggacattgatcgtcccttcaaccctgatgcaattgggtttacaggtgaaagagctggcaaacgggaccacaagcggaagaccactggaagatttatagatgcgcctccatcaccaccccagtccaagcggcctagaaaattgaagggatctgactgataattctgttcaaagagcaggggcgaaaatctgtagtcaaacaaccagcacttgcagccggtacagtcttgcagtagagatgaactagcacttaataggtctgcaacgcatctgtggaagttcattgagctggccagtcatgcagatgaaggaaccagctttcgttgctagatgtgcttgccctgacatcggggcatatgctgggtggacctagaatcacgtcggttttggatttgtagtttgtaatgtatctgttatatatgtatgtacagagataactgtaagatcgaaattgttactgctcagcagatttctgaattctgagtttggc

SEQ ID NO: 9305 - DNA, 685 bp, Sorghum bicolor
  Clone ID: SORBI-28MAY03-CLUS1100_1
ctctcatctcatctcatctgtcatctgtggaactgggggaagaccggagaagagatggcagtgacggcggaagcggcagcggagatagggttggaacggcgggcgtacgcgcgggtggggctcctcggcaaccccagcgacgtgtacggcggcagggcgctgtcctttaccatcgctgacttctccgccaccgtccgcctccgcccttcgcccgagctgctcatccagccgcacccgcaccacgacctcgtcgccttcccctccctccctcaactcgtgagtcgtttgcaaagtgaaggatattatggaggtgtccggctgctgatggctatctgtaaagttttctacaatcactgtattcaaaataatatcagtttaaaagctgaaaatttcaccttatcatatgatactaatattcctcgacaggctgggttgtcgggttcgagcgcgattgtttgtgctgctctaagctgccttcttgacttctatgatgtcagacatctaataaaagttgaaatgagacctaatctaattctcaacgctgagaaagagcttgggattgttgctggacttcaggaccgagtggcacaggtttatggaggactggtttatatggattttagccaggagcatatgggcaagctgggtcatggcatatacatgccattggatgtgaatctgcttc

SEQ ID NO: 9306 - DNA, 968 bp, Sorghum bicolor
  Clone ID: SORBI-28MAY03-CLUS109750_1
gcacgaggccgtcgtcgagcgagctgagccgagccgagccgagaccacgtccacgatgccgcagcagaacggcggcgggtgggcggtggaagcgcagcagcaggcgacgacgacgaagcagccggcgcggcgggggcggcccggcgaggtggtggtgttgctgctgctgctgctccgcgtgggcgcgctgtgcgccgccgcggcctcggccgcgctcgccgcctcctccgccaccgccacgctccggcgcgcgccgttccggttcctgctggcggccgacgccatcgtggcggtgtactcggcgttcgaggccgccgccgccgcgtgggaggtggccaggggcgtcacgctgctcccggaggccatgcagctctggttcgacttcggacacgatcagggcttcggctacatggcgctggcggcggcggcggcggccgcgcgggacgcggcgtggtgcggtggcggagggcgggaagggtggatgaccaccggcagcgcggcgtgcgtgcgggccgacgtcgcggtggggctcggcttcgcggggttcgccttcctggcgctcgccgcgctcgtcaccggcttccgcgtcgcctgtttcctcgccaccggctcccggttcccgccaccagcctcctactgatctttatacacatcgccggcgtgcgttcttgtgtgtgtgtgaacggcgcgtggtagatagtgaactttggcagcgtcatgagaatgcaagcaaagttcagagtagtagcaatagtaatttgacggcgtaccaaattaatgtaagatcagaccagatcagacgaagctagcgcactggtaattactgtacgtattagtagcgtgtatgcgcggtgcacacgtacgattgtgtgtcatcacgagcgagtgtgaaaaattttttgctcctgcgtcaagtggtggcgtgccagatcaaaattgacgaatgcgtggccggcgctgaactgctg

SEQ ID NO: 9307 - DNA, 797 bp, Sorghum bicolor
  Clone ID: SORBI-28MAY03-CLUS11019_1
tagtacaaagatataccagtgccaggtttggtacacgttcaactggtgatatactaacagatcaagaatcaacattgttgacagattatatttaccataccttagctgccaaagctagtggagagctgtgcttgaaatatatattttccttcggggcatttgcaaggaaacctcttctgcagtgcgcatccgattggaaagtgccgactactttcatatatggtcaggaagattggatgaactaccaaggggctcagcaagcacggaaggacatgaaagttccttgtgaaataatcagggtgccacagagtggacattttgtgtttatagacaacccttcagggttccactcggctgtcttctacgcgtgccgtaatcttttatcccaaaatggggaggagggcttcacatttcctggtggcctaatatctgcatgaagtggcatgttcaacaatcttatcgtgcccaacaatagtttatatgaagcaaagatatacgatggtggaaatctttgctcatttccaccaatctggaaatatttgtgccctcttccaccaatttgtttgtatacggattatgccgtgtatatattctgtgttgactgtaagaaacataatgtattaacattatgtaatgtatgtacgattctttatttgattttcaacttgcaatacgcaagaaccacattatttctgtgttgactgtaagaaacataatgtattaacattatgtaatgtatgtacgattctttatttgattttcaacttgcaatacgcaagaaccacattatttcagtg

SEQ ID NO: 9308 - DNA, 668 bp, Sorghum bicolor
  Clone ID: SORBI-28MAY03-CLUS11076_1
cctactggagcgcgcccccccgccctaagtcccaatcgtgcccacccagctgcgccgccgccgccgtcccgcgccccagtgccgcccctctctgccgccgtccgccgtcgtcctgctcgcccctccccgcgccgcccaactcgccgcgcccccggggatccgtcgcaagcgagctctgtcgaggggctccgttgccgcccgaactcgccgcgcccctggggctccccgcgtcgcctgctgtcggactgggtgtggagcggtcggagatcaggcccggcgtccacatctacacctggcgggccgtttacgcctactcccaccacgagaaaaggccgcttgaggggtcccggagtactcggattgacttcgttggcgttgtgggtgtgcctggatcgcgtctgccccgctagcattactccctacctgcgaggtgccacaaggcttcctagtgttccgcatcatgaacgacgcccactgatacgtccagcgggaagaagatgttatcgaaaagcaagagctcggcaggcggaagcgggcactgagggccggtccaactcaccaccaaggcagccgcaacctccccaatttcaagcgagcacttgaggctgcacagccggatgtgccggtgtcagagtttggggcatgggctgtgtcccacatgggctcgg

SEQ ID NO: 9309 - DNA, 1124 bp, Sorghum bicolor
  unsure (1)..(1124): unsure at all n locations
  Clone ID: SORBI-28MAY03-CLUS11075_1
gcagtctctgctctcaactgctgccatggcagccgcatccgacagcaccgacccccctccctccgtcacccacgacgatcacgaggatgacgacgatgaagaattcgatgacgatctggatgacgaagccgacgacggcggcgaacccccggcgtcctcatccgaggcggctcgcctcgaggccgtgctccggcggctgacggcggacgaggtccggatccgggtgcaccaggtcgcgatccggggctgcgaccgtacgcgcctcggcgccttcgacactgtctccatcaccctcgacgcggcgccgcctgggatccccggtagcgccgtcggcgccctcgttgacgtcgcggaggcccggcctcgccccccccgtcactgtcgcgtcctcccccgacgcggcgccgcctgggatccccggtagcgccgtcgtcgtcctcgttgacgtcgcggaggcccgcggtcgcgctgccggtgatttcggcgtcttcgcccacacgcagactagatcatgctcacttgaaggttcagtgaagttgattaacctatttggattctgtgagacctgggatgcatcaggtgcccttgaattagataagacagcagaactaagtgctggagtccaaatgcctagaatcggagcaataccaactccgctgttggctagaatatcatttctgtctgatgactggttaaagtcctcactcaaagaacacctgatgggcgtttctgttggcttgctctccaccatgaaccacaaccttgcgtacaacatgacatggagaaaattaactgatccaactcgcatgtcatccaattcagtacaagaggaattaggacatagccttttgtcctctattaagtacgcatacaaggttgaccaaagggactcaagcataagacctacacgtggatatgcgttcctgtcgtcttctctagttggaggccttgcaccagggagcaaatattcacgatttcttaggcaggaatttgatgttcgtgtggctttgcctctgggtgtgctgaatggcgctctcaatgccggagtggctgcnggagtcattcatccattggaaaggggatccacangatctgtctcaccacttttagaaagatttacttgg

SEQ ID NO: 9310 - DNA, 736 bp, Sorghum bicolor
  Clone ID: SORBI-28MAY03-CLUS11633_1
gaaagcttgggctgcccttcatctacagtttggtcaggtatcaaggcctcagtcatcagcatcttatgatgtgggtggcaattcaggtgtgggggtatactttggttacctgagaaccgtgctgtcttatgctaatccactctcctacctgaggggaaataccaactcatcaaatccagagctacagtcaaatgaaggacatggatctggtccatggagtgagccacggcctcttgttggcaatagaggccatgaagtgactgatgcaaactctgcaaacatgctgcgaaggcgctccagaccattcggtgccaatatccacaccctggggaacgaggatcaggctcctgctgacgctgcaaacgtgctccggaggcgctcctcgccagtcggtgccggcgtccacactctgggggtcgtggcgcggcggcccccggacgacagcaccgctttctcggacgggctctcgtcggggctccggggccatgtccctcaacaggctggggcggggcgcggccggggcgtctgcaccgccttatctgaccgcctaagtgggaggctcctcattcgtgggccccttctgccgtcgcggcgtctctggtctcgtgttgctggtggcgacagttatcgctaacccgtgatgttttacatttgtggaaacattgtacggtcgctgcatcagtgtactcgtatagcagatagcgacagatattttaaacccgaaatcattggttct

SEQ ID NO: 9311 - DNA, 688 bp, Sorghum bicolor
  unsure (1)..(688): unsure at all n locations
  Clone ID: SORBI-28MAY03-CLUS11645_1
cctactgggggtgttgctatttcatgtatcgctcgttgaagcaaaaactgcagagtaacatgaggcgtgctctctgtcacaagatcccgtgctgtggtaggacgaccgccgggccccggattttatctacgccctggattccagcgatttggccggggtcagtcgctactggaataaactttccatctcaaaaagacccatcttattatcataggaagtctgccaatttttccaccaaggtcacaccatcgtcacctccctccacggccatggagcccggcgcagacgaggtggcgttcgagtcctcggcgcatttccgcatctacaagagcgggaggatcgagcgcctgaaccggcctcctgtcctccccgccggcctcgacgatgccaccggtgtcacctccaaggacgttgtcctggacgccgacaccggcctttccgtacgcctctacctccccaagctccagcaggaacgtccgtccaagaagctcccggtcctcgtctacttccacggcggcgcgttcctcatcgagtcggccggctccgccacgtaccacgcctacgtgaacccgctcgcggccgccgcgggcgcgctggtggtgtccgtgagctaccgcctggcaccggagcacccgctcccggcggcctacgacgactcgtgggccgcgctccagtgggcggcgtcngc

SEQ ID NO: 9312 - DNA, 906 bp, Sorghum bicolor
  unsure (1)..(906): unsure at all n locations
  Clone ID: SORBI-28MAY03-CLUS1167_1
gccggccgggccgggacccttttctatcgctccgaggcctgggtccgctccttcccctcttctccctcactcctcgcagccgccacttctagaagcttcgaggctgctgctgcgcccatggccgcggaagccaagacgccgtccctcgctgaggaatattcacttccaccacaagaagttgcagtggaaaaggcagctgaggagaagccctctagtggtactgagactgaagctgctccctcaaccaatgatgaagctcctccatctgtagaagacaagaatgaaacttctgaagtacaagatactgctgaaaagtcagaagcagaagaaactaacactgctgcagaggaaacacctgctgcagaggaagcaagtgagaccactgaggaggaagaggctgagaaacctgagatcaagattgaaacagctccagcagattttcgtttcccaacaacaaatcaaacgaggcactgtttcacacgctatgttgaataccacaggtgtgttgctgcaaaaggtgaggatgcacctgagtgtgataagtttgccaagtactatcgatccctgtgcccaggtgaatgggttgatcgctggaatgagcaacgtgaaaatggcaccttccctggacctctgtaatgctacaatgcaaaagaactatgaactcacgatgttgtgccggcttctcttgcttccttggtaactggcgcccagttatcagggacagataaatcatccttttttggagctctctacaaaataagagattctttttgacttgaagaaatgcgtgntgctcttcctaacggtcatgntctgtgctgctgagaactagcgtccagntacatttttcctatacagntaaaatatgattcatgattcccaaaaaaaaaaaaaaaaaaggcccta

SEQ ID NO: 9313 - DNA, 590 bp, Sorghum bicolor
  Clone ID: SORBI-28MAY03-CLUS117086_1
gcacgaggccacctcctgcctctgcctctgcctgcgtagtttgcacaccacaaccgtctttcgttcccaagaaagcaccgccgccgctcttcgttctcgatcccgcaaggcccgtccttccatggccatcgcctcccgtgtcacgaagcgcgcgctgtccaccttcgccgccgccaagctcccggaggaggcggtcgcggccgcggccgccggcgaggcgatcgcggccacaaccgcggccgcggtgccgttggcgtcgtccgagcggaccgccatcgccagggcggcgctgctgcagttcgaggacaccgggcggctgttcgcgggggagccgacgtcggcgctgctgcgcacgctcgccgcgctgcaggcgctgtccgtgggcccgctggtggacgccgccaccgcggcgctgcggtcgccggcggtggccggcagcgcgctgggcagggccgcggccagggccacggcgtaccggcacttctgcgctggcgagaccgcggacgaggccgcggcggtcgtgcgccgcctctggcgcgggggcatgggcgggatcctggactacgggatcgaggacgccgaggacggcg

SEQ ID NO: 9314 - DNA, 592 bp, Sorghum bicolor
  Clone ID: SORBI-28MAY03-CLUS117176_1
gcacgaggcgaacaatggctcatcacgctctatctctacctctagccaccatcctcgcggtggcggtggcactactactagcccgccgcgctgcgggttacccgtggtatgtgtgcggctcaagcagcaacttcgtggctaacagcacataccaggctcatctcgacttggtcaccgccacccttcccaagaacgcctcctcgtccccggacctcttcgccaccgccgtcgtcggaaccatcccggagcagctctgggccatggggctctgccgcggcgacgtcaacgcctcgacatgcttcaactgcctcacccagggcttccaagaggtacccgacgattgcccctacgacagggacgctagcatctactacgacttctgtacggtgcgctactccgacgtccacactctacgcaacgacgacgacactggcccgatgataaacacgtacgtcgaaaccaacgacggaaatgtcacggcggcggacgcggcccggttcaagagactcctggccgacctcatcgacgccaccgtcgaatacgccgccaacagctcccggcggttcgccaccggggtaggccgacttcaacg

SEQ ID NO: 9315 - DNA, 1443 bp, Sorghum bicolor
  Clone ID: SORBI-28MAY03-CLUS11405_1
gcacgaggcttcaagagggtttggcggtggttccttctttggcagaactgctcaggcccctgcccctcaagctagcaaggttagtagacctgtagttcctgcaactgaccagggtaatgcaatcaaaagagatgtccagcatgcagccacacaagctacaggcaaatctgctacagctggagaaactagaaatgcatggactaattttaatcgacctgttagtccaaatgtgcagccacaccctactggccttaaaaagtcatggcatcagctgtttagtcgttcagcatcagtgtccccttgtcctgatgttacaacttcagttcatgatatgattcggaagccagaaccaaatggagctcaaataaacaatgctcatacatttctctctcagtatcctcctctggactacaagccaagttcaagccagtccatgcaatttccaggttttccaccacttaatgtagcacctcccagtaaccccctgcctcattttcctgctggacatatgcccttctatgatgatgcggaatcaacactgcttgaagaaccagagcaatttgaggacccatgctatgatccagatgcaattgcattacttgggccagtttcagaatctctagatgacttccctccggacttcgattgtggcttcctttcaagtgacattattaaagaatcacatgggaggccttcaccaattgagtctcctctctcaagatctcgtacggctgaagaaaagcctatcaaacccccgcactcatcaattgcacctggtggttccatactgcctgagactagcagtgaacaaggcacatggcaaatgtggagcacaccattggttcaggaaagtttaggtcttcaaggtcctcagagtcagtggcttcggcaaaacacaaatcaattcaaccatagtgccaaccttttcagcagcggaggtggagcaataagttccctgggtactggtttgaatgacagtgatccatggatgcagaaagcacctttccagcaattgccacctgatacaccaagcctgttcctttcacatgaaatgccaggaaaattacacaacgacttggtttttgggtctccaaacaaatcagcccgcgaacacccctttgggccgcctggttatttgtggcccaaggaggaactggcgctgaatggagctcaggaaggtggcggtgggcatatcctgtcgccgtccggcgcacatgttggcggtggtgttggcttattttcttcaacaagtcctgatgtacagtcactgtggtcattcaatgaaaaagagacagcatagaacgaacagacttttataatagaaggaagggggaaaaaaaattgtggagccaaggtttccttgcctcctctcttgtagggtttactaccgtcttaccgaggagataagctggactgtgttccttgatgttgcaaaaaaagata

SEQ ID NO: 9316 - DNA, 911 bp, Sorghum bicolor
  Clone ID: SORBI-28MAY03-CLUS114286_1
gcacgagggtcgaggagcgaggaggacagacactatagggagccagtcagcgctacagcacagccatggcggaggaagcagcagcgccggcggtggcggcggggacggaagccgcgccgccgccggggaagatgacgatggtggtcggggtggacgagagcgagcacagcttctacgcgctgcagtgggcgctgcagcacttcttcccgccgccgccacagccgcagcagtaccgcctcgtcgtcgtcaccgccaagccttccgccgcctccgccgtcggcctcgccggcccaggcgccgcggatgtgctgccgtacgtggaggcggacctcaagaaaaccgccctgcgcgtcatcgacaaagccaaagcactctgcgcacaggtgagcgacgccgtgtttgaggcggtggagggggacgctaggagtgtcctctgcgaggcggtcgagaggcaccacgccgagatgctcgtcgtcggcagccatggctacggagccatcaaaagggctgttcttggaagtgtgagcgactactgcgcccatcacgcgcactgcaccgtgatgatagtaaagaagccgaagcatcacaagcactgatcaatgatccagtttgacagatcactacgtatacttcaaataatatgtactgcaaagttgtgtatatgcgccagtttgtgaataattggatcatcaaccatcacacgttcggttgcttctgcaagtagtatccgatgcatgcatgcaatccttctacatggggattgggaattaccaataattgattgttctctgaacctcaaaacaatgtatttgtatcaatgtgttgacgtatatgtgattgcaacttctttactgtgagctgtgtgcgagtatgtacattttattaggtaagaaaatgttatatttcccttc

SEQ ID NO: 9317 - DNA, 1069 bp, Sorghum bicolor
  unsure (1)..(1069): unsure at all n locations
  Clone ID: SORBI-28MAY03-CLUS114476_1
gcacgaggctcgccgctactagaggcgagccacacgggtagagaaagaagctgggggtaattaggtgtctagctaataagtactccgtagctagctagtgttcttccacaaatggacgctcccgcggcggccgagggttccggcaacggcggcaagcacattgtgctggtccacggcgcgtgcctgggcggctggtcctggttcaaggtggccaccccgctgcgcgcggcggggtaccgcgtggacacgccggacctggcggcgtcgggcgtggacccgcggccgctgcgtgaggtgcccacgttccgggactacacccagccactgctggacctcctggcgtcgctgccggagggccaccgcgtggtgctcgtcggccacagcctcggcggcgtcaacgtggccctggccgccgagacgttcccggacaaggtcgccgccgtggtgttcctctgcgccttcatgcccgactgcacggcgcggccgtcgcacgtgatggaaaagttcgtggagggcaagtggctggactggatggacacggagatgaagccccaggacgccgagggcaagctccccatgtctatgatgttcggcccccggatcatccgagaaaagttctttcagctctgcgagcccgaggacatcacgctcgcggcatctctaatgagggtgagctcgatgtttgtggaggatcttgtcctccagcaaccctacaccaaggaaaggtacgggtcggtgcgcaaggtgtacatcgtgtgcagggaggaccacgccatcgtggaaaagttccagcgctggatggtggagaacaaccctgtggacgaggtgaaggagatcgtggcggaccacgtcgttatgctctccaggcccgacgagctggtgcgctgcctcaccgacatcgccaacaagtacgcttgacgacgctatcgatcatcagccgctgttcagcacatctacattgcttctcgatcggcagttatgcatgtcgtcgtgttttaattcatccccaaattctccactcgtgctgtgaaattgtgtacaacgnctattgagtcttgttaataatctg

SEQ ID NO: 9318 - DNA, 750 bp, Sorghum bicolor
  Clone ID: SORBI-28MAY03-CLUS114528_1
gcacgaggggaaggccgtgctcgtcgtcggctcgggcaactccggcatggagatcgcgtatgacctcgcggccgccggcgccatcacctccatcgtcgtccgcagcgagcttcatctggtgaccaaggagatctggaacgtggcgatggcgctgtccgcgtacctgccggtgtgggtcatcgacaagctggtgctgctcatgtgcgccgtcgtgttcggcgacacgtccaggcacggcctccgccgccccgccgtggggcccttcaccatgaagctcaccaccccggcctaccccgtcgtcgacgtcggcacctacgccaagatcaggaccggcgagatccgcgtgctccccgccgccgtcaagagcgtccgcggcaacgtcgtcgagttcggggacggcaagcgacaccccttcgacgccatcgtcttcgccaccggctaccgcagcaccgtcacgcactggctcaagagcgaggacgggctgatcggagacgacgggatggcggcgcggagctacccggagcactggaagggggacaacgggctgtactgcgccgggatggtgcggaggggcatctacggcagctgcgaggacgcggagctcatcgccggcgacatcagcaagctgctgctgctgcgcccccagcaggagcaggagcaggagcagggcaacggcttctagtggaatgtgattgtgattgctactgtgccgccgcactatcatatatatatttatattaaacatataaa

SEQ ID NO: 9319 - DNA, 1442 bp, Sorghum bicolor
  Clone ID: SORBI-28MAY03-CLUS11839_1
accagctccctccgccgtgctcctctgctcactgccttggattccgcttcgcttcctccggtcctctctccgccgcgcctccaccagtctccagggagcacgactgcgccacctctccccacttcccatggcggcgctgggcacggcgaccacacccgcagcagctcccggggcgccgcgctgctataatcggcacccgcggccgcggcaccacatcgcggcgcgccggaaccgggttgcctcggcgaggaggcttgacctgtgcgccagcgcctcaccctcacctgccgtcactgctcccgacatacccgacgaagctgtcgaggaacccttggtggagccggcggcggagacgaagctgaggaagctggcatgtccaatctgctactaccccctcgcgggctcgagcgatcagtcggacgatgcttccagtctcgaatgttcaacctgcaagaaatcctacccgaacaaacaggattactgggatcttacagtgtcagttggttcgatagagtactctgagtccatgccagcagcaacagaattgttcaggactccactggtatcatttctttacgaaagaggatggcgccaaaatttcatatggggtggtttcccaggcctagagagagagtttgaaatggcaaaaacttatttgaagccaacatttggagggactattgttgatgcaagttgtggaagtggcctgttctcaagattgtttgttaagagtgggctatattctcttgttgtggcactggatttctcagagaatatgttgaagcagtgcaatgaatacatcaagcaggaaaacatttcagatgagagattagcattggtgagggctgacatatccagactcccttttgtgagtggttcaattgatgctgtgcatgcaggtgctgcaattcattgttggccatccccagcttgtgctgttgcagatatcagtagagtccttcgcccagggggagtttttgttgcttcgacattcgtagcagatgttattccaccagttattccagtattgaggatcggacgaccgtacattagccaaataactggcaacaataccttcttatctgaagtggagtttgaagatctttgcaaagcatgtgggctggttgatttcaaatttgtcagaagtggattctatataatgttttctgccactaaagcaagctaattaagtagcagcaatcgtccagtagtttatgtcaagcctcctcggttttatactgcaaatggtttctttctgtgcattgtgcggttttgccctttgctcttaaggctggcaactttcctcaagggaggtgtgatttaaatagtgaatacacatgttttacttgactgacctcattatagcatggtgcatggatatatcagttatttgtatatagcttaatagatttttgcaattctacaatttattaacttaattt

SEQ ID NO: 9320 - DNA, 748 bp, Sorghum bicolor
  Clone ID: SORBI-28MAY03-CLUS11926_1
caaattccaggccgactcctccagccagccagcagcacaagcgaatcgagtgctcttgagcttcgcccccgatggcgtggtgcctctcggctccggccgccgccccgccggtggcggctgtgcccggcgcccttggcgtctccgccctcgcgcgtgcgccggttcccgccggtaggcggcgcaggtgggacgcgctcgtggtctgcgcggcccccgatgaggagaagattaccaagcggtcgcccctggatttccccatcgaatgggagagaccaaagcctgggaggagacctgatatcttccctaagttcagcccaatgaagacaccattaccgcatccattaccagctgatgatcctctggatgatgatgaagaggaggaagaggaagaacaaccacaacctcaggaggagccacaagaggatgatccagacaaggaagaacctgaggaagatgacccggacaagccaaccgagtaacttttgaatggcttgaactgtggtagatatagacagtggtaaaaaatgtgctacatctttggagcacgcaagagatctcagttctatttgaactgtttgttctgccggcttatataggctctagatgcataagtttgttatgacctcgtttgagcttttctaaagctatgaaagttttgtttcacggattgcagattacgtgcgatatctgtgatgacatgtactctcactttttctatcttaagtagcgtgtacattgcaagtatttg

SEQ ID NO: 9321 - DNA, 618 bp, Sorghum bicolor
  Clone ID: SORBI-28MAY03-CLUS119541_1
ctcccatcggccttgtccttgatccagcaaatcccacgaacgtccagccccttctgatcatctcccgccgtcacaccccccgtcttcaacatggttgctcggccagtgtcgcatctccttcgttcgcgctgcctgctgcgcaagcctcagaacactcaggccttctcaactcgcagcagcgtgcgtgccgctgaccatggcaatcactatgaccccccgaccggctggctgttcggcgtcaagcccggccagaaatacgagaaggaaggctgggagggtatctggtactacggattcattggcagtctgctagttgccggtgttgcatatgttttcaagcccgatacctccatacaaacctgggcccttgaggaggctcgtcggagacttgaggctgagggtatcctggaggaccccgagaaggtcaagaaataaacggatcggttcttgcgccaaatttgtacactgtacatagagagatcggaagaggattatttcggttggcgcttgtaccacctgccatggcagatatgatgttccgatcgtttgattagatggggttttcgcatgtccttccatttctgtttttatccgtccgccgactgttgtactacttta

SEQ ID NO: 9322 - DNA, 818 bp, Sorghum bicolor
  Clone ID: SORBI-28MAY03-CLUS11822_1
tcggaaggcgtcaatcctcggctaaagctgaatcagaacggaagcttgtcaagggccgtaagccctatcttcatgagtcacggcatcagcatgccttgaaaagggccaggggagctggaggtcggtttctcaattcaaagtcagacgacaaggaagagaactccgactcaagtcacaaagagaaacagaacggagttgcgcccaacaatggccaaccgtcaacccctccgtctcccaacggtgcatcatcagctaatcaggcaggcagtcgtgaatgatgattcagaactcacaaccgaagagattttagcccctgacgctagatgtggcatcagttttgtacagtaagtgctagcgggcagcagcgggatggtgtcagtcggttgttgtaggacatgttccatagaaaaaacatagatgagtcgacaggttttggagtattggtctggtcctctgtttattcacctttctgtacaattttagtattattgtgccccttcccctggatagcttcggtcagcgcttaagaaagttaagtgtgtagcatattggcttattttttttgctttgcttggacttggagatttggtagtggagttcataaccctactgtcctgcatcatcattcgtggggcaaattataatactcctagctggctatgtgtatgttgatgacaataaaccctaatgtaggacatgtgaccacctcatctgaatctagctttgttttgtttcctctgcttcaaaatgataccctcacaattggtcagagattcagagatcattttgcgcttgtcctgcatcctgcagcaatgcat

SEQ ID NO: 9323 - DNA, 779 bp, Sorghum bicolor
  Clone ID: SORBI-28MAY03-CLUS119629_1
gcacgagggcctcacctcacctcaccttgggagctgaatcaggacatgccgacagtacactgcggcactgtaaggatttaacagaacaaacaccgcatcatttctctctccctccctctctctctctctcctttttctttcgcatggtgcgcagcagctcatctttggacactgtttctgctcttgcttgctcggcctgttcttggtcttgagttcttgcttgctaggtcctcctgcggcggcggccatggcgatccaggtggtggttgagccgccggtgctgataagctcctgttggctcaaaaatggagcggggagggcaccatgtgatgacccaaatttggcaaagaccctgcacttgccagatctggtttgcatctaagtacacgtacaaaggggtagagagaacaccgtacgttactgctcgttactgatgaagagggttgttgttgttgttggatttgggcgtcatgaattaatggggaacatcatttgcaaagtttacttgaccaaggataacaggattgaagttccaagttgttcctttacattccattcatgttccggtggatctagatgtgcaatttggttcttattcatgttgctgtgagtacctatgcatggggcgtgggagtacaacattcatcttgagcacacgcaatcatgttcttaggttgctaaaatccagtttttacattgtaatgatttaaattttgttgctttaactatcctttggtaaagacgatcttgcaaagggttttgtcgatatattctggtta

SEQ ID NO: 9324 - DNA, 815 bp, Sorghum bicolor
  Clone ID: SORBI-28MAY03-CLUS1197_1
cccacgcgtcctgccacgcgtccgcaaggacgttgaggtgcgctcatctaccaaagaagactacaatgaagatccagtgcctaatgactcagagaactgtgacttctgctatcatacaaccaaattttccacaagtggttctccctctaaacatgtccgcagaaggcaatggagagaacgctcctgaagaacaagccaggccaacctaccaaaggaccttatcaggcggtctgcaaagccccagagccactgaagtcccccagaaggcgattctcgagaggatgaaatccaagagcgagtccaagtcctatcagcttgggcacaggttgtcccttaaatggagcactggagctggtccaagaattggatgtgtcaaggactacccaatggagctccggatgcaggctctggagatggtggatctgtcgccaagagcatcgactccgtcggcgtcaaggagactgcctcctttgtcccccactaaagtcacgtcgccaacatcaccgctcgcaccaattcaggcctccgtgccgcagccaagttaggaatttagagtagcttattatgccacgcaaatagcacgaaaccatgcttttcagctgttgttactgttattctggaatgtcatttttcggcactgcaaagatcacatgcctggtttgtccatgctgcttctccgctgttctgtggttccattcagagaagcacagtgcaatgttctccaaatgaaataggcgcacatttcagatatgaatagctttgaagcagatgtgatagtatgtttcattaccgtggttaaggaatttgcttatatt

SEQ ID NO: 9325 - DNA, 614 bp, Sorghum bicolor
  unsure (1)..(614): unsure at all n locations
  Clone ID: SORBI-28MAY03-CLUS14174_1
gccggccgggcttggtgcgaagctcgaaaagtcggctgacctcctgcattccttcttcccgttggatcccagccgccgccgcgagacgaagagctgagctcggcgactcccaggtctcgcgagaagatgccgaagcaaatccacgagatcaaggacttccttctcaccgcgaggaggaaggatgcccgttcagtgaagatcaagaggagcaaggatgttgtcaagttcaaggttcgctgctccaagtacttgtacaccctctgcgtctttgatgctgagaaggcaaacaagttgaagcaatcacttcccccaggtttgagcgtccaggaggtttgattggatacatgacaaagtcaagatgaactaccaaagcatctttatcagtagcagagcatgttattctatgtaattttggaacctaagctattagacctgtcagtgttggatttgtggatcttgaatttttggagaaatgccaatttacctcgttcaacgatacaaaaaaaaaaaaaaaaaagacctgactgcacgttaattcagatttatgtctgtgccccttccaacnnnnnnnnnnnnnnnnnnnnnnnngannaanaaaaaaaaaaaggccccta

SEQ ID NO: 9326 - DNA, 910 bp, Sorghum bicolor
  Clone ID: SORBI-28MAY03-CLUS17150_1
gccggccgggccgggattattccctccaatataattaaccaacaacacgatcgagtagctagctagccacccaccgtaccatggcttcttcttcctcctccaatcatagcttcctgctgctgcttttattccctctcctgctggtgctgctcctctccacaacggtcgtcgccgccgattctacagctacagcagaaaagtaccagaagtggtgccaagtagcatcagattctccgtcgtgcgtcaaggtgattgagtccatcccaggaatccaggaggtcgattacaataacgccggcaaggtcgccgacttgtgcttgcattttgctgccaataagacaaaggaggccaagggagctgctgacaccttgcttgccgcagaaaaaggcaagcctgcttccggttgcctcaaggcctgcgccaccaacatcaaatcaatggccgaggtattggtcaatcttcctgctgggcaggacgacatgaacgcctatcaaacctataaggaggtcagagccaagttcaaaaacgagaaaccaccagcctgcgagaaggactgctggaacaagacgtcatcgtcgtcatcttcagccgccgacatcgtggacaagttccatgatatctggaatgtggccaaagttgggaatatgcagattaattatatctttccttggccagatagcgacgacgacgataacatcctttaatttaatttaggtacgtctgcagggcatgtacgtacgatatatgaccatgcatggtgtgccatgtgagaccatgcatcacattagtagctattatttgtatgctttaatttcttctttttattttgtttgatttgaagagcatgcatggtcgatcttgagccacgcacccaatctttggcatgttattgtaaaatggtaataagttg

SEQ ID NO: 9327 - DNA, 656 bp, Sorghum bicolor
  Clone ID: LIB5047-001-R1-XP1-B5
gccggccgggcctgggattcactgcaattaaccaacaacacgagtagctagccaccatggcttcctcctcctcctccaatcatagctttctcctactgcttttccctctcttgctgctcctctcaatggtcgtcgtcaattctggtagtgcgccaaccacaacccctgcaactatggcagaaaagtgccaggactggtgccgagtagcatcagattctccatcatgcatcaaggtgattgggtccatcccagggatccaggaggttgatatcaataacgccggcaagatcgccgagttgtgcctgcattttgctgccaataagacaacagaggccaagggagctgctgacaccttgcttgttgctgcgaagggcaagccttccagttgcctcgaggcctgcgccaccaacatcaagtcaatggccgatgtgttggtcaatctcccttctgggcaggacgacatgaacccctacttcacctttattaaggctgtgagagccaagttcaaacacgagagaccaccagcctgcgagaagaactgctggaacaagacgtcgtcatcgtcttcagctgacgagaccagcatcgtggacaagtttcatgatatctggactgtggtgaaagttgcaatatgcagataaattatgtcgtccctt

SEQ ID NO: 9328 - DNA, 1071 bp, Sorghum bicolor
  Clone ID: SORBI-28MAY03-CLUS17369_1
gccggccgggccgggagctttaagcctttaactatccagtcctgcagccgcggcgttcgtgcatttcgtacaggcaacgccgccacaccggccggtcaccggagagaagtacagggccgtgcagcaggtttgagcgcagcacacgaccaagcatgacagactaccacaggatccaccctgtgagcgtgggctcgccgccgccgtccgcgccgccggagcatgccaagaaacccagccacgaccagctactaccggtgaccgccccgccgccgtacgcaccagcgccgctgcccccgccgcggcgccagcggaggcacagccggtgctgccggtgcgtgtgctacaccttcctggccctcgtcctgctcgtcgtcgcgctcggcgttaccgcggggattctgtacctcgttttccggcccaagatcccgaccttcaatgtggaccggctcaccgtcacccggtttgacgtgaacaccaccacggccacggtcaccgacgcgttcgacgtcgacgtgaccgccaccaacccgaaccgccgcatcgggatctactacgacggcggcgacgtcacggcgtccttcaacggcaccgtgctgtgccgcggcgccttcccggcgctgtaccagggccaccggaccaccgtgcacccgaacatctcgctcgccggggagacgcggctcgatagcgacgtcgcggcgcagctgctgcagcagcggcaggccgggttcgtgccgctcaccgtgcgcgcccgcgtgccgatacgcatcaagttcggcgccatcaggctgtggaagatgacgggcaaggccaactgcaacctggtggtcgacaatatccaggcaggcacgcagctgaacatccgatccaatacttgcagttttaagcttaagatctagatagataaataccttaattttatgaatttggccatattttgttcaaattgtttgtcatgtttctacagtgcattagttagttatatcaataagattacatctccttgtatatgacgatgaatccaccggttgagctctgcttcaacatgggtggtagaggtgtacaatttcgcta

SEQ ID NO: 9329 - DNA, 643 bp, Sorghum bicolor
  Clone ID: SORBI-28MAY03-CLUS17457_1
cgctcggcaccggccgggccgggaaagctaatgctactctccccccggcccccacccgccgccgcccacctccgcgcagctgcgcccaccaggacgccactgctcctcacgcgcaggccggccggtcctcctccagcttccgcctccgcctcagctgagttcccgggatccgttccagacagcgctcagatgccgccccgacggcggcggcgccggagcgtggccggcatcgaccaggacgagctcctcgaccccgacgcgcttgccgaccccgacagcagcttctacgagatcaacggcgtgaggctgcaccacaaggtttgcagccacgaggatgaggatgaggttgaggactcgtccagcgaccaaccctcgagtagcaccactgcctcagacgctgtccggaacagccagattggcctgcccatactgctgctgcacggcttcggcgcgtcagtcttctcctggagccgtgtgatgcggcctctcgcctgcattgtccgtgccaaggttctggcgttcgaccggccggcgtttggactcacatcccgggccagctggtctgctgatgacaccaagcctctcaacccgtactccatggcgttctcggtcatggctacgttggcgttcatcgactaccttg

SEQ ID NO: 9330 - DNA, 850 bp, Sorghum bicolor
  Clone ID: SORBI-28MAY03-CLUS17475_1
gccggccgggccgggataaatgtgctgtcaagtgtcaacagcagcacttgcctgtcagaatcagtgacaaaaatgtgcttctctcactgatttacgcagaagcatcccccactatttctccacgatctgttccttttctcggcttctcttctccagttgacttgctccatcgcctctccacgactagaggaggagggaggaggggagctctgatcgaattcatccaagatgtctgaggtggtggcgatggcggggcaagcctacatgaggcagctgcaggcgcacccgctgcgcaccaaggccatcacctccggcgtcctggccggctgcagcgacgccgtcgcccggaagatctccggcgtccccaagctccaactcaggaggctcctcctcatcgcgctatatggatttgcatacgctggaccctttggacatttcctccacaagctcatggataagtttttcaagggaaagaaaggaaaagaaactacagccaagaaggtcttagtagagcagctgaccgcgtctccatggaacaacatgatgtttatgatgtattttggtctcgtggttgaagggagaccatttggacaagtaaagaacaaggtgaagaaggattatgcatctgtccaactgacagcttggaggttctggccaattgtaagttggatcaactatgagtacatgccactccagctccgagttcttttccacagcttcgtcgcatcctgctgggctgtgtttttgaacctcaaggcagcaagatcaatcgcaaatactaagaaggcatagaggcagctatctatactaggagcggatgtcatgatctgagttgaaaacccatgtatat

SEQ ID NO: 9331 - DNA, 1570 bp, Sorghum bicolor
  Clone ID: SORBI-28MAY03-CLUS121243_1
cgcgcctgctccgcggacgcctgcgcctgcgccgctcccccggctccggctccgtccagtggttcatcgacgacgacgacgacaagccgcagaagcgggcggacaaggccgccgccgccgccgcgccgcacggccgcgtcgtccgcgagggcgtcgaggcccgcggcaacggggaccgctacgagggcgagttccacgggggccgctgcagcggcagcggcgtgtacagcttcttcggcaagggcaagtacgagggcgactgggtggacggcaagtacgacggccacggcgtcgagagctgggcgcgcggcagccggtaccgcggccagtaccgccagggcctccgccacggccacggcgtctaccggttctacagcggcgactgctacgccggcgagtgggctggtggccagagccacggcatcggcgcccagacctgctctgacggcagcacgtacgccggtgagttcaagggcggcgtcaagcacggcctcggctgctaccatttcaggaatggcgatcggtatgcaggggagtacttcgcagacaagatccacggtttcggcgtgtatagcttcgccaatggacatagctacgagggctcttggcacgaaggaaagaaacaggggtttgggatgtacgcgtttcggaatggggatgaacgagccggggagtgggattctggaattctgaagaactccttgcctctgtcagacccagctgttcagcgtgctctacaggctgctcgaagggctgcagactgcgccttccacctcccaagagtagaagagcaggtgaacaaggccgtcatggctgcaaacagagcggccacagctgcccgtgtcgccgcgatcaaggcagtgcagaataggatagatggcaagctatgtttcatcaacgtgtgaagtgagttccaagaactgcgcccttcttcacttgtaaactgtatattagagtagccaccaagagtggcaataactagttgctgaggttcgcgaccggagcagcacaaccgcatgctccgtgttggagtgataaatcagtatggttgggcggcagccaccaaagggttgagctgctgctgttttcatcaagaggttgttcacgtcgtgctggaatggatcgctgagagcaaggtcaccctgttctgttcctcttcctccttgtgcaagctgtaagttgtagatagctccatgcctccgctcatccatgtgtatcaatggtggtcggtggagatgatctatctaccagtgcctttctacttttttttatgctgcgcccccgtactggatgtgcattgtacatgtactttgttctcctgctcggatcagatgtttcaatggcaaatcttgccggtttgaacttgtggcgccatgtgcagggattctccatttgttaatcgtacttgaggatgcacatgggtgattataatctcatatcatgcagcctctgatctgctgatccatcctctgcatctgggctacctgcatctttttggacatttctttgggtccacttggccttgatgctccaagttcttgtactagaggcatgaataaatgaaagctgc

SEQ ID NO: 9332 - DNA, 588 bp, Sorghum bicolor
  Clone ID: SORBI-28MAY03-CLUS12129_1
gcgacaacggataacgctgtcctccttcggctcctcccctctcgttcctctcctctcccctccaatggcgaccgccatttcctctctagtaactcctccagccctccaccgccgctgcctaagccctgcctccgtctccgtctccgcccctatccgtatctccttccgggccgccgcggcgtctcaggcgtggcgccggggcttggcgctgcgggtgtcagcctcctcggcagtgctcgaggcgccagaggtggtggcggcgcggaagctctacgttggaaatgtccccaggaccgtcaccaatgacgagctccgcgacatgttcgccgcgcacggcaccgttgagcgggccgaggttatgtacgacaagtataccaatcgcagccgacggtttgggtttgtcacgatgagcactgtggaagaggccaatgctgcagtagaggctctcaatgggactgaggttggtggtagaaaaattaaagtgaatgtcacagagagcttcttaccgaacattgaccgatcagcacctgaatcggaacctgtatttgtggatagtcagtacaaggtttatgttggtaatcttgcgaa

SEQ ID NO: 9333 - DNA, 620 bp, Sorghum bicolor
  Clone ID: SORBI-28MAY03-CLUS1214_1
gcacgaggaattcattggctgctcaccatcgttgagtggagcaattcgggtaaacccgtggaacattgagtcaacagcagaggccatgaatgaatccatcgctttctcagatactgagaagcaactgcgacatgagaagcactatcggtatgtcagctcacacgatgttgcctattggtctaagagctatattcatgattttgagagaagctgtagggaccattttaggaggagatgctggggtattggactaggatttggatttagagtggttgctcttgaccgcaatttcaaaaagcttaatgtggattctattgttgcggattacaagaagtcaaagagcaggatcatactactggactacgatggaaccctagtaccacaaactacaatgaacaagactccaagtgaaactgttgttaacatgatgaataccctgtgtgctgataagaagaatgttatttttattgtaagtggaagaggaagggatagccttgaaaaatggttttacccttgcccagagcttggcattgctgctgaacatggctactttatgaggtggaccagagatgaacagtggcaaatacaacatcagacatcagattttggatggatgcata

SEQ ID NO: 9334 - DNA, 1249 bp, Sorghum bicolor
  Clone ID: SORBI-28MAY03-CLUS1212_1
gtacatgactaacatgacgcatgctatgggagcagcgttgacatatagacatgaacttggaatgaactacaatttcatacgcccagacttgattgtaggatcctgcttacagagcccacttgacgttgataagcttcggaagattggtgtaaaaactgtattctgcttgcagcaagattcagatcttgaatattttggagttgacatcggagccatccaagattattctctacgattcaaagatattatgcactgccgtgctgacattacggattttgatgcttttgatttgcgattgaggcttcctgctgtggttagcaaattgcacaagcttgtcaactgtaacggcggtgtaccatatatacattgtactgctggacttggaagagctcgcgtccgctgctgttgcattggcttatatgttctggattcttgggtacagtctcaatgagggacatcagctgctgcagagtaaaagggcttgctttccgaagttggaagccattaagttggccactgctgacattgattatcaaaaaacacaatcactttaaagtgggaagatgatggttcttcctctgttgaaatttctgggctcgacattggctggggccagagaattcctttgacatatgatgaggagagaggagcttaatttcgtgagaaagggcacattctgctcgcatagttgcctgaaggacggtatgaatacaaatacataagtattgtggacgaggggctatgcaacgagcatgagatgttgacgaaaccgaacgctgacggtcacgtgaacaactatgtccaggtctccagagacggtaccagtgacgaagagaaggagctaagggagcggttgactggtccagaccctgttctcacggacgaggaaaggctgatgatcagagagtacttggaacagtatgcggatgccggggagcgctaggaagaagaatgggctcgggtgcagtctgggagcagaacagtagaccatggtgatgcctgatgcagagacgagacgacggaccgaagccgacctgaccgcaccttgcttccttcccttcccggaaacgtcgggcttccttccccctgttgtccatagtacagtagcttaaccgtggaaaagggcacattctgctcgcatagttgaaggaccaaattgtacgtaagtattgttgaacagctgtgcagaaataataagtagtagcgtcaaactagtgactggaataatattaatagtaataaagttact

SEQ ID NO: 9335 - DNA, 1431 bp, Sorghum bicolor
  Clone ID: SORBI-28MAY03-CLUS12219_1
gagggtttaggcacctgcccgcgccggcgccgcccttctcacggttgcgtctcttccggctggagcggctcctaccccccacggcaggccccggctgcggcgctcggagtcaccatggagcttgaggggggagacaccatggagcttgacggggccgcagcagggcgtgcccacgcaagtggcggcggcggcggcggaagctcggctggcgaccgggacgaccggctgagcgctctaccggacagcctgctccacaccatcatgtcgttcctgaaggcccggcaggcggtgcagtcgtgcgtgctgggcacgcgctggaggcacctctggcgctccgtgccgtgcctcgacgtcgacctggatgagttcagggctgtgccgaagccttccaacaaccctgaccctgatgttgacaactctgatgttgaattcgacgaagaagacgatgactcggacgacggcaacaacgaagaaaccaagaacaatgagtgggacaactttgaggattttgctgatagcctgatgcaccactgcaacatcgctcagttggattccttgaggctgcatgtgagtaagagcagggcacctagtttcgccgataaacaagcaggcggatggctcaggcgcgcgatgaaatactgcaccccaggtccttgccgtcaactcgagggattgaggtccaccgattcctggcgcctcaagaggctctatctctgcaatgtggctctggactgccgtttcgcgattcatgtcagttcagcatgccaatcgttggaggacttggagctggatgattgcacatgtgcgattcacgtaatcagctccaactcactgaagagcttggttctgaaaaactgccgatggaatgttcttgctggtattgcttcgcccacactgaagaggttagctattgctggtggcacgaattcttctgacgttgtgctggttatctgggcccccacgattgctcgtctgtgcctcgatgtgcctcttcgcttcgccaaacgtattgcagtaaactagaggtttcgggtttccagacggtggcaaatccccgtatttattatctatgcttttgttttagtagcctatgtaagactttaaggagatgcatccttccaagtgctaaatgctgacttaagttgctcaacgctttctgaatccttagcgcatcgcttgaacacactttggatcatatgtcagcattcgttccttaacgtttctggttgtgactttcatgagaccattcaatgttcaggttcctttggcaggaggaacaagtttacagattattttcttgattgatgattctcgattagtacaacactgtgtgttttggtacccaagatacattgtgggggtttgggcattttaaaccttagctctgatgatctgatctttgtttgcccaattgtggttctaaatagttga

SEQ ID NO: 9336 - DNA, 970 bp, Sorghum bicolor
  Clone ID: SORBI-28MAY03-CLUS11767_1
cacaccactagtacacacttccagctctccatctcttcctctctcttccttcacagcacgcgcaacgccagccaccgagccagagcccgccaccaaccaagcgcgatgggcaagaagaagagcggcaacgacgcgcccaagcccacggcgttcgtgctcaaggtgccgatgcactgccgctgcgacgggtgcgccgacaagatccgcgccgccgtcaaggacctcacgctccgctgcgacggcatcgtgtcgctcgaccagtcggctctcgacaccaagggcgacctggcggtggtggccacggccgacccggagaggctccgccgccgcctgcgcaaggccaccggcaaggacgtcggcctcggcttccccaagcccaccaaggcggacggtggcaaggacaaggacaaggacgccgtgcaggcgctgctcgccggccttcagcagcagcagcagccggtgcacgcccacccgatgcctgccgtcggcacctggaacgcgctccagtacggcgggtacgggcaggcggcgtacccgtggggggtgctgcaacagcagcaggcgccgtacttggcgtcctaccccgccgccgcgtaccctgctgcttcctgggccgcgtacccgcacggcggcggatggctcgggttctgaccgaccggcggtggagcagagcaggagcaggtgatggatggagctttcgacgttgtagggaacaagtactagttgtgtcggtggctgtgtctacgtactagatttcgactgttgtctttgctgagaaacagcagtaatggttgcattttggtgtgtttgtgtgtgttgttggacgatgatgagttgtacttcattttggtagctcagtcagctgggctctcatctcaatctcatctcatgcatgctgctctgtaacggcacctgaaatcttttgcaccactcaaagtgttgtgtcaagaggaatgaagtaactccctcc

SEQ ID NO: 9337 - DNA, 1388 bp, Sorghum bicolor
  Clone ID: SORBI-28MAY03-CLUS11732_1
gcacgaggccgctttgatggaaatgtaccagagcatgggtgatgcacttgcccatcagtatggaggatctgcggcacataacacggttttccctgagaggcaagggaagtggaaggctactactcagtctcgggagttcctgaaatcatttaaacggtactacagtaatgcctacactgatggcgagaagcaggatgctataaatctatttcttgggtactttcaaccacaagaaggaaaaccagctctttgggagctggataccgattgctcgcggcatgtaacaacagctggggatgatcttatgtctgatagctaccacttgagttctgcacctggacataatgtgtttgtgggatttggagctgcattgaaccctggaaccacattgagccctgttccagcatgtaaagaggatttctcaaggatgaaacttacttcgtttgacaaacttatacaaagaacatgtagttcgataaggaatgtaagacttcattgtgatgctgatctaaagctaagtggaggtgttggaacttctggaatggcgccagatgcagctgagatacagctcaaaagcccgaactggttgtttggtcaaagaaaacatacagagacaatgccaactgcaaaagttgccctagttgaaaacgtgaacgaggggaacagagatgagccaaatgtctctctttgtggggaattaaattggctatcctcctcaggatcatgcgaggaggacattttcagaaggtatcttgcattcacaacagcggatgtagagaatggctggtatggtggaacacttatatatgaccgagatgaaaacagcggagcttacaaacactactctgaactctgccagggagctgtcatggatcctttcgagcacgaccctgagaaagagcggcattatgcagaggcccttatcgtggatcttgacgtttcaaatgatgcacgggtagaggccgaaatgcaagctgcgctggatgactaccagatcatagggtcggacctgagcattatcccttcatgcggagcactcgcggaggatccgagtcagctgacgaggtggatcattggagatgagaagctgcttgtgggtgctgcacagtagaccagtgcgtttctatggaagtttgtacagcaacagattaccattcatcgactcagcgtttgtgttctagttagctatttctctgaaacagttgcctgctgtatttagccttttttttttgtttggctgggagcacattcgaataatcacgatgattgaaagatggtgatgtgtttgcatgcggtgcaaattgtttttgatagtgcacgtgcatgcccatgtatcgattaaggatggactgtatgcaatttgtcaatgtaccagcgtggccttgctc

SEQ ID NO: 9338 - DNA, 873 bp, Sorghum bicolor
  Clone ID: SORBI-28MAY03-CLUS117980_1
gcacgaggcccacacattcactttgccttcgcttttgcctttgtgctgtaacttgcaaggaacgtcggcgagagagcgggggtcaggcgcacagaaactccgtcgcccgtgcgcgcggccacccgccgccccggagaccacaccggccaccggcgctcccgacgatggcgtccaggtgcttcttcccgagggacgcggccgccgacggcggccggcaccagcagtcgaaggccgcggcggaggcgctcgagcagctgcaccacggcgggcgcctcctgtccagggaggacgtgggcggcgcggtgcgcgtcaagatcgtggtcagcaagcgcgagctcaagcagatggtcgcggcgctcggcgacggcgctggcggcgcggtgaccgcggcagcggcggcggcggcggccaccagcgagcggcaccggcggcagcgcgcggcgacggcggggggcggctcgtcgtgcgcggcgggagcggcaggagggccgggcgccgagcagaggctgcagtcgctgcggcggcgcagcatgcggagggccgccgaggccgcgcgccggatgcaggccagcggggagtgggagcccggcctgcagagcatccccgaggaggttttctgaactgatgatgactgccagtaccagaccagtagatgatggtggcgttcttttctttgatgggctagtagtaatctctcttgactaattaatgggttggggttgggtacgttttgatcactgccttgatgctaagtgctactagtagatgcatgtgtacagcgctgttttgctttgggccctcgttatcatggctccaatggctgcttcatagtcctcggcgagtttctgcattttgctgaccctgtgaattttt

SEQ ID NO: 9339 - DNA, 942 bp, Sorghum bicolor
  Clone ID: SORBI-28MAY03-CLUS11796_1
gcgcaacccaagcgcatcgcagcggcggcaactcgtcggagcaagcaaagcaaagctagcgccttccttcgcacgacagggtaataatcaagctcaatcgaccgatatggctgagacgacaaacacgatggcggcgccgcggccactcctgcgccggatgctctcgttccgggagccactcctggtcatcccgtacctgctcaccttcctgggcgccgcggcgtcggcgctggcccgcagccactcgtcgctgctgcactcgctcgccagggcgctgttcccgcccgccaacgccaagcacgccgccgcgccgcacgcgccgtcgtccgctgccaccgccgccgccgccgcgacgtgcccggacgacagcgacggcgaggacgaggacgccgcgctgagcaaggcggaggtggaggcgatcatggccacgatcggcctcgcggcggctgggcgcggcgagggcctcgcgcccgccatagacctcgacgacgtccgcggcctcttcgacgccgatgagcccagcttcgcggaggtgcgggccgtcttcgcggtcttcgacgctgaccgcgacggctttatcggcgccgaggacctgcagggcgccctggcgcggctgggagtccggcaggacgccgccgcgtgccgcgccatggtcgtcgcggccggtggtggccgggacgcccggatgaacctgttccagttcgtcaggttcctcgagaacggcctgtgctgatgaggctgcagggccggaggagctgaccgttccttcatttttttttttcttcttcgtttcgtcgcctcagctgctcgtggcaggagatgagagagtgtaccattcagaggggtgttcgtcgggtgtgtgtttttcctcctgccatgagttttgggggtggactgtgcagcaattaacgcactaattcccaagttaagaacaatcaaatt

SEQ ID NO: 9340 - DNA, 268 bp, Sorghum bicolor
  Clone ID: LIB3478-034-P1-K1-A5
cggagagccactcccggcgcaatcccttcgcacgacagggtaataatcaagctcaatcgaccgatatggctgagacgacaaacacggtggcgctggaggtgggtgagactgaggacgatgatctggactcccttgtttctgccgagaacctcctgcctcccgctggtgccgctgctgacgttcctgaggataggacagtgcgtgtcaagtcgtgctgaggaagcaggcccttggcagacttctcgcgcgggacaacgggctggcttgg

SEQ ID NO: 9341 - DNA, 706 bp, Sorghum bicolor
  Clone ID: SORBI-28MAY03-CLUS118050_1
gcacgaggcacaagggtcccgagcacctcgccagaaacccgtttggccaaatcccggcgttccaggacggtgatgtcgtgctcttcgagtcccgagcgatcgcaaagtacatcctccggaagtacaagtcagccgaggccgacgacccccggcccggcggcgacctcaaggaggcagccatggtggacgtgtggacggaggtggaggcgcaccagtaccacccggcgctgtcgccggtggtgtacgagtgcctcatctacccggcgacgcgcggcgtccccaccaaccacaaggccgtggacgagagcctggagaagctcggcaaggtgctcgacgtctacgaggcgcggccgtcctcgcgcgcccgcccggccggggcctgcggccgcgtcgcgggccgcacccgctccccccgcccctgccgccgctcggcgacgccgcccgcgtccccccgcccctccgccccgccccccccggcctgcgggcggtggcccggggcctggccgtccatgaagaagctcggcgccaccatggctgctgctgccggtatcaagcaggcttaattgagcgcacgggcaaacgtccgttgccgatccccgtcccgtgctccgtcgcccgctcggcgtcgccgcacgcgtcgcgcctcctcgcgtccccgcgcgcccgcgcgtcgtgggtgtgcctggattaatgcacgcttgtgcat

SEQ ID NO: 9342 - DNA, 1408 bp, Sorghum bicolor
  Clone ID: SORBI-28MAY03-CLUS12521_1
tgcacacaaaaattcgccgcaggccgcatcattcccccagcgggctgcccgagtgcccgggaccgcgacttggcgcgtgggagcggatgggcgacgcgtcttcgtcgtcctggccatccacgggcgccgcggcggcctacgactacgagcgcgatccgcggtgggcggagtaccgtgcgagctccgccgtgccgccgcacctcttctcccacccctacgtccgcgcgcacctccagcagaagttctaccgccgcttcgtcgatccagatttctctgttcaaggaatgtcctcaaccacatctacccagccctcagcatcttcaggtggtgcatctacttcagctgatgagaatgcaaggcctcctgattcaggcactaattcttctggaccagcacgaagcatactgtctctacagttggaccagcggtcattacattttcacgctagtgcttgggttcttattgttgccttgattggcatctttccattggcaccacatgccctccagtacaagggatataggttgtcacttcttggcacaacatgtactacaggctatgctttgtttgctttgtacaggctaccccgagcagggaacctgcaggctgttcaggcgtggtgtcaccatgtaacttcatcaaaggattttataccattcatgtactgccttatgtttgctacatctaaactgcacttgaagcttgttttggtacctgtaatttgttgggcacttgaacatgtcgctcgatttctacggcgacattttactagctcatctttgtacaggacatacttggagcaaccttgtacatgggttgagacaaacacaactgcagtccactttctacgttcaaattcagagattttgttgggctttcttttgatcctatccctgttctcgcgacagcgaaatgttatgcaaacattcatgtattggcagttgctgaagctcatgtaccattctcccttcactgccgcttatcatagagctatctggcttaaaattggtcggacaattaacccatatatccagcattacaccccttttcttcatgacccgataaatgctggcatgagatggtggtttaggtagtttgaatgcagcaccgttagtcatgtaaagagatgcaagtatgtttatggtattatttcacatttgatccaaagagaatctttgagaaaattgctgcttgggagtgatgttattagtccccttgtgtggctttgagctgatgttaattcttagtagttagtatgatcagtaactctgtaactcttgtaactagagctagtagagatcttggcctgttaggcatgtactgaagttagatgggtaggttattgttgtgaccgaattatgttttgattttgactattgcgagccacatatcagtgtatcaaaaggat

SEQ ID NO: 9343 - DNA, 792 bp, Sorghum bicolor
  Clone ID: SORBI-28MAY03-CLUS12543_1
cagtggcatttgctgcaatctttacagtgcctggcggtaacaccaacgatggtgtagcagtagctgtgcacgcaacagccttcaaggtcttcttcatcttcaacgccattgcccttttcacatcgttagcagtagtggtggtccagataacactggttaggggtgagaccaaagcagagaggcgggtgatcgagatcatcaacaagctgatgtggctggcttcagtatgcacgacagttgcgttcatatcatcctcttacattgtagtggggcggcgcttgaagtgggcggctcttctagtaaccctgataggtggggtgatcatggctggtgtgcttggtacaatgacatactacgtggtgaagtctaagcgcacacgtaaaatcaggaggaaggtgaagtcaacaaggaggagcggctcaaactcatggcagcacaattcggagttctcggattcagagatcgaccgtatttatgccatttgaagccggtacagctggttccttcaaaccttttggcagtgatacaacacgaatgtatattataagcatcaatcacaacccttgagatgctagggggttaactttgtacattcaaataagctggtgtaaactgccattccccttgttcatgaatcagcgggaggcgacggtcttggttgtatactacttacagatagatttgtcatcagattatatagtatattatatattcagcatattgtgtcctccttgtgcatggctttgatcagaatcatgtcagccgctactcagttcaaatgacagttgcatg

SEQ ID NO: 9344 - DNA, 1013 bp, Sorghum bicolor
  Clone ID: SORBI-28MAY03-CLUS12562_1
gttttaggttgtacataactagacaagttccagattgaactcaggttccttttattgctttacctgcaatggtgcatcttcttctaagggtacatatgctgcgaagttgcaacctctatcttcatctgtatcgcttatgaaatgtgcagtaaactgcgagagtgtctgtgcatcagttctattcacaagctgggcatttccacttgtatatgattggagcacacactgagaagcaacttggtttgatgttattcctttcaagctttctatcactccaagcagctgcatatatgtcaaatgtacttatgaggtcaataataatttataagcttaaagcattcacgtctgctagtttctcttggcttttctgtttcttctgctgctattgtttcattgtgtatgcatgctactatactagttattagtgacagctaactacaattttcttagccttaagttcggagtagatgtggaatggaatagttcagatatgtgtctgagttttttttcccttgcaggaggaggaaccattgcccattggactatgctgcagagtttcagtttgtgtcctgcattgctcacctcaaagaatgacactgcagacaaaggtggaaacaatattactccgatcagttatggatgtatgtacatacgagaaaaaaaaagggtcaaaagtacttgggcacttggcaacaaaatggagtggtcatgaattatctatttcattgaggaaagattctcttgtactgataagtatattttaccttgcgctgacgaactgataatgacaagtgaatgggttcggatgtgaaaagttcagaaatgttattgctaagtttatttggaagttgccatggccgctaaagcgagcgcccacggcgagagcgccgtccagagcagcaccgccgcctgcaggcagcggcggctacgagcagcggtcattgccgtcaatgcgcggctcacgagctcttcccagctcgtgaagaactgtgatggctttggcccctgatggt

SEQ ID NO: 9345 - DNA, 1151 bp, Sorghum bicolor
  Clone ID: SORBI-28MAY03-CLUS12603_1
ttcggcacgagggccacgcggtaggcgccggcagcgacggtcgacgatcaccacacaggcacacacagccacgcgagcggcgaaactgcgggagccgccgccgatcagaagctacagcaatgcgatgatgtccgccgtcgcatcgtctttcccgtcgcgcggccacgcggccccgttcggcggctcgagggcactgccaccgccgccgtctacgcggcgcagcacgtccctccgccgtccgcgcgtctcggcgctcggtgggggcctcgagggagaggcggggaagatactggatccgcgcgccacgccgttccagatcctcggcctcgacgccaccaccgccttctactccgccgcccaactcaaggccgcctttcgcgcccgggtgaaggaattccatcctgatgtttgcaaggacccagaaaacgcagatttaataatgaggcgagtgatcgaggcctatcagatgttatctggcaaccaagaaatgatggttgaaaggaataatgttgacccatttgatgaacctgagtgtgaagctcgtgacatatttgtcaatgaacttctatgcattggcactggatgcccatattcttgtgttaaaagggcacctcatgtgttttcattttcagatgatattggtacagctcgtgcaatatctcaaggtaatggagaagatgaccttgttcagcttgctgttgggcagtgtccaagaaagtgcatatactatgtgacaccatgccaacgcactattttggaggatgttcttgctagtgtgttgatgccgccttacgatatcgctgaagcagcagttctggattccctcctttcgaaagcgaagtttgagaataacaggtacaggaagcccaaaagaggagcaaaatcatcctccgattatgttgattggatgtgatctgatcctgaggcacaaagggggatgccagttcagccaaggcagttcagtagatttttgttggtttttctgttctccttggtcagttggcatgacgcatagatgtattgtagtttacaaaatagaatatgtttatgtggacaaactgctttgtctgtggcattgctggtaattttcatttcattttctgacagagaagccggaccaagtcaatactgtaaacttctgggtataaatg

SEQ ID NO: 9346 - DNA, 695 bp, Sorghum bicolor
  Clone ID: SORBI-28MAY03-CLUS12595_1
atccaatgaattcctataaattaatcaactatgctcaccataggctatgcgatcaccacgctccgtacccacctctgcgcgtttttatgtagagccaaaaaaagagagttgctgaagagaagaagtccgcgagaaagatgggcctcggagtgcggctcttgcctccctctgcagctgatgccaccgcggcggcttcagtgaagtttgcatcaagatttgagaagaacagaaaggacaagagagcagcgatcaaagctgcttccatcttccctgagtcatcgagctcagcatcaaatggtaaactcgacctcgtgctgaagaggcggaacataaaagctggcgcagccaccacactgatggcaggcagggtgaagccatcctcctggcagagcgccagttcgacgagctcaaggacccggatgccggttctggcagcgcgcaagtaggcagcccaggctttcaagcttgtgaaatacttgcactgtgcgggaagtagctgcctggttctatatgaattatgatggaatgtacgtgttatagcttttaatgttactatggttttttggttgtatcatggtagtatacctaaaggattgtgtagggtcaggaacgaacgtgtaaagtaatgttaccattgttttggttttttttgacacagttgtcattgttttttgctgtatactggttgggacttg

SEQ ID NO: 9347 - DNA, 1097 bp, Sorghum bicolor
  Clone ID: SORBI-28MAY03-CLUS11988_1
gcacgaggacttagtcgagtgcagtcctacattgcaaaagatccagtataatactctgaaatgtgaagatgaacatgttgatgatggcaagagaacagttagcaagctttgtggagcccccatttgttggcatgcctccctcgaacaggttccctcaggatcaccaaccgtaatcattgcacatgaattctatgatgccttaccgatccatcagtttcagaaagcatcacgtggctggtgcgaaaagatggtggatcttgcagaagattcctcgtttcggtttgttctatctccccatcccacaccctctttaatttaccttgccaagcgttctgggtgggctagctctgaggagcttgagaggattgagcatattgaagtctgccccaaagcgatggagcttactgaacaaattgcagatagaattagttcggatggtggaggtgctcttattattgactatggaaaaaacggaatagtatctgatagtctccaggctatccgcaagcacaagtttgtcgacatattagatgatcctggctctgctgatttgagtgcctatgttgattttgcttcaatcaagcactctgctgaggaagcttcagatgacatctcagtccatgggccaatgacacagtcccagttcttgggttctcttggcatcaacttcagggtagaagctctcctgcagaattgcaccgaggagcaggcagaatcattgcgaacgggctactggcgactagttggagacggggaagccccattctgggaaggccctgaggaccagacaccaattggaatgggcaccaggtacttggccatggccattgtcaacaaaaagcagggcacgcccattccattcgagtgaaaaactcaggcatagctatccccttttcctccagtagggacaaataagtgttgtaactcctatagcattgttgagggattttgatgatcagcccagacagggacaatttttgctcctgctttctccggtacacgcaaaaacatagcctcatgacaatgtacgctactttcttttgtgaggtactagtaatgaagatgtgttgtccctactcacctgaagcaattcataa

SEQ ID NO: 9348 - DNA, 938 bp, Sorghum bicolor
  Clone ID: SORBI-28MAY03-CLUS12049_1
aagacgcaacatttggaacagttcttgcatctagagcaataaaggctgctcactgcttaacttccatccagttttcacccacatcagaacacatactattggcatatggtcggcaacatagttcactgttgaggaccattttcatcagtggggagaccagagttcctatgtacacagtcttggaggtgtatcgagtttcagacatggagcttgtaagagttcttcctagtgctggagaagaagtcaatgctgcatgttttcatccttcccctggatcaggtcttgtttatgggactaagcaaggaaaggttaggtttcttcagcatcatggtgcagtatccactcgctggggagaatgttcatgagatttagagcatgtgctttaaatgcagttctggacatattaactgaatctcagcatcacattcttatgttgctgaatcctatcttgattgtggcttctgcaacatcctggaagaggaacttatgctcaactgagaccatactttcatctatctccaagaccgagagggcctaacgggaaacatcagatttcagcctccaattactctgattaacgagccagtctttgcaatacgggcaacgagggctagtattttaggtgcagtgcagttaacgtgtgtaagaagccctgtctgttgagaaaatggacaagaaatcgcagcctcatccagcatgaattaccaacaatggttgactacttgtacaaggagaccctaaaggatacgggtcgcctgtatgaatatggatgcgagccatataccgacgcctggcctcccaaagatgtgatgtgtgctttgcttagttcgatgatatgatattttgtttttgaaactgttaccattttgttcttgtatacaaggctgcgagtaaatgtatttgatggaagggagcgccgccccaagcgctctcgtctt

SEQ ID NO: 9349 - DNA, 819 bp, Sorghum bicolor
  Clone ID: SORBI-28MAY03-CLUS1205_1
gcacgagggtgaacgcctactactcggcggcgctggtggggctcagctacggggacgcgcacctggtgtccgtgggcgccacgctgacggcgctggagatgctggcggcgcagacgtggtggcacgtccgggaaggccaaggggaaggcagcatctacgaggacgacttcagcggggacaaccgcgtcgtcggggtgctgtgggcgaacaagcgcgacagcgggctgtggttcgcgccgcccgagtggaaggagtgccggctcgggatccagctgctgcccgtgctgcccatcagcgaggcgctgttcccggacgtggcgttcgtcaaggacctggtggcgtggacgctcccggcgctggagagggacggcgtgggagaaggctggaagggcttcgtgtacgcgctggaggggatctacgacaaggaggcggcgctcaccaagacccgcgcgctcaatggccacgatgatggaaactcgctgaccaacctgctgtggtggctccacagccgcggcagcgtcgtcgtcggggacggggacgccgggttcacccgctgctgctggtaccgccagtactgccactgagcaggtgatcggctttcagtgaagagatcagagtggagttgatatgttgaaaagtcgtagtggttgttcttcgttgggttgtgattgtgaatgtttacgagtgtctcatgctacgcacttttatacagttgaataaagtttacttctttacgggagcttgatgacgctatctggtactagattgatcaaggattattataaaattctggctcggatgaggtgtttaaaataaaat

SEQ ID NO: 9350 - DNA, 1051 bp, Sorghum bicolor
  Clone ID: SORBI-28MAY03-CLUS12071_1
gcagaccttaagattccaaccaatagttccaacagtggtgggcgcactgagctgccgccaagagcatgttgtgttgtggtcgaatatcttgcgggaggaacactaaaacaatatttaataaagagccggcgtaggaagcttgcctacaaagttgttgttcagatagcactggatcttgctagaggattaagctatctacactcaagaaagatagtacatcgggacgtaaaaaccgaaaatatgctgctcgacacacaacgaaaccttaaaattgctgattttggtgttgctcgtgttgaggctcagaatccaaaggatatgacaggcgcgacagggacacttggctacatggccccagaggttcttgaaggcaagccatacaataggaagtgtgatgtctacagttttggcatatgcttatgggaaatatactgctgtgacatgccatatccagacctcagttttgcagacgtctcatccgctgttgttcatcagaatctgcggcctgacatccctcgttgctgcccaagcccaatggcgaacatcatgcggaagtgctgggacgcaaacccagataagcgccctgacatggacgaggtggtgcggttcttggaggccctagacacaagcaagggcggtggcatgataccagaaggccaggcaggtggttgcttgtgtttcttcagagcccgtggtccttagaaccaaccctgtccagccctcctctccatgcctataccatactacaaaattggagccagatctaggcctttattgctcatcggatagttgataccaaatagccccttcactgtgctgattgcagataagttgatgacaatctttgtgattggttgacactcgttataagttttatagtgatgtgaataccagtcaggagtccataatacagagggtttcagccaattcatggttgcattctcataatgggttgtttggggaaatcacatgatgggccctcgaggatgaactggggagaacaggttccgtgcctgtgaagcgatatgtgatattcgatccaccgtttttc

SEQ ID NO: 9351 - DNA, 857 bp, Sorghum bicolor
  Clone ID: SORBI-28MAY03-CLUS12106_1
gcacgaggcgggacagcatgtgccaccgcctccgccaccacacggccacggacctccgccaccgggacagcatgtgccgcctccacgcggccacgggcctccacccccgcaccagcaggcaccacctccaccgccgcctcctgaacctgtggcaggtcccggggagctgatgggactgtgccgggaggggcgggtgaaggacgccgtggagcttctggccaagggtgcccacgctgacccgcccgcgttctacgagctcgcggcagcctgctccaaccctaagctgctggaggagctcaggaaggtgcacgacttcttcctccgctcgcccttccgcagcgacctccgggtgaacaacaagctgctcgagatgtatgccaagtgtgcagccatgccccatgcccgcaggacgttcgacaatatgcctgaccgtgacatggactcgtggcacatcatgatcgacggctactcggtcaatgggcttggggacgaggccctgcggctgttcgagctgatgaaggagtgtatggcacccacaagtcagacctacctgcttgtgctcaatgcttgtgccaactcggaggccatcgaggaggcactcctttactttgatgccatgtccagggaccatggcattgagcctggtgtggagcactatgttgggatcattgaggtcttggggaagtcagggcatctcaatgaggctctggagttcattgagaagctgcctttcgagcccaatgccatggtgtgggagtcactcttgaacctggcccagatgaatggagacattgatcttgaggaccgagcagaggagttggtggtgtcgcttgatccattcaaggcaaaccccaaga

SEQ ID NO: 9352 - DNA, 646 bp, Sorghum bicolor
  Clone ID: SORBI-28MAY03-CLUS128172_1
ctgaggtgacgcaccgccgcgtggcgccgggggacctgttcatcatcctggccacggacggcgtgtgggacgtgctgagcaacgaggaggtggtgtccatcgtctgcgccaccccgcggaagcagcacgcgtccaaggccgtcgccgaggccgcggcgcagcggtggcggaccaggtacccggcgtcccgcgtcgacgactgctccgccgtctgcctcttcctaagggaccagcacgactgggccagcagcgtcgccgccgccaaggccaaggcggccgccgcgagacctccgcacgcccgctagctgctagccggggaagacgaagcttgctccggcgaacaagcacgccggcgtagcctcgtcgcgtccgtccgtgtccggcggcgttcttgctctactggtgtgccgcaaacggctgttttagtgtaccgggagtgtaattaagtgctgtaacatagtgttaattagtataaggtctagtgtttttacgacaaaggagatgaggagagaaaaaggcgggtaatttctcagttttgactgttgatcagcagtgataccatgcatggtaatggtatggtgtcggagcaagcgaatggctggcaggaacgccgtttgtactctgtggggcatgtaaaaaaattacc

SEQ ID NO: 9353 - DNA, 1154 bp, Sorghum bicolor
  Clone ID: SORBI-28MAY03-CLUS12853_1
gcacgaggagagaacctgtatcaggtcatacagtacttccaccacctccacccccatcaagcccgccgccagcgtctagtgcaaatgggagcaaaacaaattcttcccagccgtcagttgtcctgcctccaccacccccgccgcctggtttgccaccaaaatcaactgacatggaggccgctagcacttcaaaggacactcctggacttaaagaagatactgcagtgagggtcttaccaccaccgcctccacccagttttccaacgcgtcctccaaggcctccaatgcaatctgatatgctagctcctggagccatgagatttccaccacctccgccaccaccagattcaaggccaccccttatggctccaggagttaccaggccccctccacctcctccaggatttccgccgtcccaaatgccaatgccaccgtatggtgtgctccctggtccgccaccgatgcttaggcctccatttatgccaggaccccctatgcaactagatgagtttgctgccttcgtaccaaggcctcagttaccccagcagccatcatatgttaagtcagctgccccaacagttgtaaagagaccattagcacagcacactcctgagctgacggccatggttcctgcatcagttcgtgtcaagagagaatctgctctccccaaaccgaaaccaaaggtgcagcagcagcagcagtcatcaacagcatccatttcaaagccttcggtgaccctcataagaagtgatgcccagccttcttcagcagcgcccaagccgccaagtatggatgattcttatatggcattcttggaagatatgaaggaactaggggcacttgatgggtaactcaagtagagtaaatgcctgattgcacttagcagcttaattcatgaaaacctggacatggaacctaaatagtcggagatcatttcgtatgtcccaaaggaaaatcttgccttgatttaatcgaaaactgggaaaacaattgtaatctacctttaaatactaggctctttgtgacccaactgtacaagctggagatctttgaaactttaaaagctggcagcaaagaaatatctcccaagctgtatttgtgccctggctgatttgcagatattaatagtcgtgggtaatactattgatgtgctc

SEQ ID NO: 9354 - DNA, 872 bp, Sorghum bicolor
  Clone ID: SORBI-28MAY03-CLUS1287_1
ccgcgctctagtcgcttcgctcggggcggtcgactgctccggcggtccggccattgccgatccattcttctttagaggaggaggaggaggcagcagcagaggggaagggccggcgatggggcggacgagcgtggcgacggcggtggcggcggcgctgctggtgctggcggcgtgcgcggcgctgccggagaaggccgcggcgaacaagatcagcatcaactggaagcccaacgtcaactacaccgactggctgaagcagcacagccccttctacaaggacgactggctggtgttctactacacggcggggcaggcggacgtggtgcaggtggacgaggtcgggtacaacaagtgcgacgccaccaacgccatctacaactacagcaagggccgcagcttcgcgttccagctgaacgagaccaagacctactacttcatctgcagctacggctactgcttcggcgggatgcgcctcgccatcaaggccgagaagctgccgccgccgtccccgccgccgtccgccagcgaccagtcctctgccatcgccgccttcgccaggtcgcatgcggtagtcgtctacgccgccgtcgccgtgcttgccgcgctcctcaggatggtctagctgcgaagaatctagccgccggccccttgttttggttcgaattgggactcctttttgttcgttcctcctctctcatttccgtagtgtgcttgcttgggctctgaagatgagcagtagttgctgcgttgggttgaaaattttaaaattagtggtgtggatctgcgtaagcgattgattgagctgagattgatttttcaagtgtgaagaactctagcagtctagctgaattaaagtaacattagccttttca

SEQ ID NO: 9355 - DNA, 1003 bp, Sorghum bicolor
  Clone ID: SORBI-28MAY03-CLUS12896_1
gttatgttaaagatacacagggaaagtggtttaaggcagacgacagtcaggtgaaacctgtatctctggacaatgttatgtcaaagtgtgcatatatgttgctgtatgcaaggtgttcaccgcgggcaccaagctctgttaggcaggctatgggggacccagcacaccccaagaaggccaaacagaaggtggtttcaggaggaacaacatggcgaggaggttccttaaacaggcaccaagctggtcagcagcatagagaccagacggcagatgaccttacccatgcgtttgacgaatatagagatgtaccatattcgccttcagattctccgagtcctagcgagagttcatccctcttcagcaactcggacgcagggtcgcacagcactgtcagcaccgacagcagcgagagcacaaggaactcgaccagcaccgaggagtatgagtacatgttcggagctgctgatcagatgtactcaggaggctccatgggaggagcacctgtggagagtgactatccgacgtattcccgtttgaggtccagcttgaataccagctcatcaggccgggaggcatacagtgcggatagctctgcggagcacaggcttcagggcggttgggttgagggcgatgagagcccgtccttgttgtatactgacagaagtaatcagcagtggagcagtaagttaacagaccagtataggcagttagataggagcggacatgaccctggagaaaccaggggcggtgtcttatcgagaagaccatctagggacaggaccgcccaaacattttattgatgtgcagggtttgggctgtagagtaataatgtaatgtagcctgtaatattatgtcgctgcatatgtaaaaagatgagagaaatgtggtagtccattaaaagttaaatgcctaacttgatcacataatcccgaggaacctgtaacaaacattgcattttccatgggatcgacatagtagattataaggccttgtttagtttcca

SEQ ID NO: 9356 - DNA, 631 bp, Sorghum bicolor
  Clone ID: SORBI-28MAY03-CLUS12223_1
acacatacacaggttctgttcttccacagttcgcagatagaatggccgagctgctctcgtggctggcatggcttatcgcctccctccttgccgtctccttccttgatcacctagcacatccacgccgccgcggcctcccaccgggacctcgccctctgccccttatcggcaacctccacctcctcggtgaccagccgcaccgctcccttgcgggcctcgccaagctctacggcccgctcatgtccctccgcctgggcacggtcaccacggtcgtcgcgtcctccccggaagtcgcccgcgagctcttgcagaagcacgacgccgtcttcgcgacgcggtttgtgcccgacgccatcggcgaccatgccaagagctccgtcgtctggctgcccaacgactcgccgcgctggcgcacgctcagaaagattatgggcaaggagctcttcgcgccgcacagactggacgcgttccagcacctccggcgcgagaaggtgcagctgctagtcgaccacgtcggccggttggctcgcgccggcgtcgcggtggacgtcggccgcgtggcgttcgcgacgatgctgaacctcctctcgagcaccatgttttcttgcgacctgacagaccttgacgacca

SEQ ID NO: 9357 - DNA, 731 bp, Sorghum bicolor
  Clone ID: SORBI-28MAY03-CLUS12267_1
tgtgtatcagcttcggtgcaggtacccatgccttcacattggattggtcgaccggagaattcatccttacacatccttccatccaaataccccctagagggcagatatattcggtgaatgacgctaggtattttgactggcctgagggcttaaggaagtacattgacacaatcagacaaggcaagggacagcatccgaagaagtactcagctcgctacgtgtgctcactggttgctgatttccaccagacgctcatatatggtggggttgctatgaacccaagggatcatctgcggctggtttatgaggcaaatcctctcagtttccttgctgagcaggctgggggtagagggtcagatggaaagaacagaatcctcaacattcagcctgtgaagttgcaccagaggctgcccttgttcttagggagcatagatgacatgcttgagctggaaagctatggagatgtgcagcagaaggttaatcctggatatgaagtttaacgatatgtaaaaagcttcagatttttcaggtgccgaagcatacaataaggtaacagacgtgtggcaaccctatatttgcatacaataaggtagcccaccacaacttgcttgggactaaacgctttgttgttgttctctcttttctgccaaaatttgctgtacctttgagtgaagtattatgattttttttggcagcttcacaaccctgcaccctatttgtgaataatagaa

SEQ ID NO: 9358 - DNA, 643 bp, Sorghum bicolor
  Clone ID: SORBI-28MAY03-CLUS12319_1
agcagcccacaagaatccgccgcgccgcagacatgcgcccgctcatccgaaccgctcgctgctggctcctccgcgcgcgtgttcgcgccatggccacgcttcccatggcgccccccgccgccgccatctcctccttcaccacccgctccctctactccccttcttcgcgttctcaccgcctcctcctcgcccgcttcttctccgccgcgccggcgcctgccggggcgagagcgctccgagcggcagcctccgccgttgaggtgggcggcgtcaagatcgcgcgcgaggatgttgtgaaggagaatgacccgacaaacaacgtgccagacactatcttttcaaagattggcctgcagctgcacaggagggataaccatccccttgggatcctgaagaacacggtttatgattactttgacaagaacttcactggacagtttgacaagtttgatgacctttgcccccttgtttccgtcaagcagaattttgatgatgtcttggtcccatctgaccatgtaagtcggagttacaatgacacatattatgttgatggtcaaacagtcttaaggtgtcataccagcgctcatcaagctgagctgctaagggatggacatacacactttcttgtaactggagatgttta

SEQ ID NO: 9359 - DNA, 1286 bp, Sorghum bicolor
  Clone ID: SORBI-28MAY03-CLUS123190_1
gcacgaggatgcggcgggccttgggccattaattgttgggctgtgcgatgctgtcggtccccgtcctctctttctttctccccgtttcccgtcgcgacgaccgcgcggccgccccgccccggcgccgagctggcccccgccggcgtcgtcctggcccctgaatggaagggcgccgctcaaatgaagtatcatctgccgaagctgtcttggtgggagcactgtcgtctggtgttaatgcccccacatggtttgtgctcaggattacatttttgctcctggccttgtgttttacagcgatgcttgcgctagcattttcgtccaaaaactttgtaattgttgcgcatgttcttctgctcgtaactatcggaaccgtgctatttgtgctgcttaacaggtttctggctgaagttgggctcgtgcctgttgaacaacagatgaaggagatgggcatccacaaaacagaagccacagataaagacaaaagaggcaaaagaaactaatcagtgactgagttttataatatggaagacagtttaacaccttacatcatttgacagagtgacattatctcggatggtagaatgtgcattcacttcagacagtacaattttgcacaaatgatcatacacctttggacatactcctacttgcaaatggaaaccctggtccaaatctgaagtgaaaaggatgtagcagcagagcgcatcaagcctgctttccctcttccttgggtttgctcttctttttcttgatgtagcagaagcatgagcagcaggggatctgaaacaagaacttcattgtcagagaaatcaccaatgctttgttcggagaagtgtgcccaagggatttgcatgcaatgcgacccttaaatatactacatggatgcctcagcttatcagtggacattagaatttgtgactcaggtgtctttggcatgaagcttttaaccgcctctgatactttctttcgtttatgatctttgtgcaatatggccgtgtcagtgagcagaggagattttcactgaaagtaactatcgttcctttcgtttattctttattaaccctaataatgaacctgatttcagaagtcctgatagctgttgattctttgaagcttgattgaaaagttggaaaagcctttcgtcactcaggatgcaaggcatgttctttagctgcggatgggtgcaatacccgtcaacccgtgtaaccttttagtcgttcggattcagtgtatacgtgtaactctacaaacaaagttgtctaaatacatgtttcttctcggtgttt

SEQ ID NO: 9360 - DNA, 1109 bp, Sorghum bicolor
  unsure (1)..(1109): unsure at all n locations
  Clone ID: SORBI-28MAY03-CLUS12465_1
nnccgattgtttgaacaaccattcatcaagaatgacaaggtcacaataagtgagtggctgaagcaaactatagctacaaccggagagaatatgaaggtcaagagatttgcccgatacaacctaggtgaagggttggagaagaaaaccaggattttgctgctgaagttgcagcccagacagcagcgaagccgccgccatctgctcctccgaaggatgacaagcctgctgaaacaacagaatccgccgagaagaagccggctgttgcagtttcagcttcattggtaaagcaactccgagacgaaaccggtgctggtatgatggactgcaagaaagctctggctgagtctgatggtgatcttcagaaggctcaggagttcctcaggaagaagggcctctcatctgcagacaagaaatcttctcggctagctgctgaaggactgattggctcctacatccacgacaaccgcatcggatgcatgatcgaggtcaactccgagaccgactttgtggctcgcaatgagaagttcaaggagcttgtgaacgatcttgcaatgcaagtggtggcatgcccacaggtcgactatgtctcggtggacgacatcccagagagcatcatcagcaaagagaaagagatcgagatgcagagggacgacctgcagtcgaaacccgagaacatcagggagaagatcgttgaagggcggatatcaaagaggctcggagtgatggccctcctggagcaaccctatatcaaggatgacagtaagaccgtgaaggatctcgtgaaggagatgatcgcctcgctcggggagaacatcaaggtgcggaggtttgttcgatacaccctgggtgagaactgagtggtgtgaggcggtgatctccgtcacagtcctgacatgagaagttgggcacattttggttcaaggaggtgcgtagctgttagtctgtactcagttccatctgtaattccgtatcacctgttactgctgttcctggttcaaaagagtgaacttagtactttgtagatgatataagaggggtcagtacttccatcaaagcatacaacattacggcanaattaaattttgtatcttttccctgtgcttcgtttc

SEQ ID NO: 9361 - DNA, 976 bp, Sorghum bicolor
  Clone ID: SORBI-28MAY03-CLUS12493_1
gcacgagggagcgcggatctgctgcggagggaggaggagttctactcctccctgtttgattccgccaaaggcgatggcgccaagtcgcgctcacagctgatagagaagaagattgaagtcctcgaggacatggccaccaaggtcagtaaccggagatcacgaaagtggttgaatgaccgcttgctgattgaacttgtcccccgtcttcatgttgaagaaatcaaaggccttttcgcacctccaccgtggggtgaggaagtacccttgtcagcattctgcaggacaagtgttggtgaatgggatgccttcaggagcattgacatggatgctgaggcaagattgatgcaaaatatgaaaagatcatcccaaaaaaccaggaatcatgtggacgaaggggaattgattgcgctgaatgcctggcaccggatagatcgccaaactagagaagcaataaagagaaattttcttcctgatctgcttgaaatatatgaggaacgagttagggccttcattgaagatactagtgacaaggatgtgcttatgctgaacatccaggacccatttcagaggctgcttctgcacggtgtctgtgagttctacaacgtgagctcgacaaccacgagcagtgtaagagatgggaggccttggaagacaacccccatcaagaagaggcagggcacgggtgttccctccgcaatcactttagttaacttcctgaggatgaagaagaatgggtcccagtaacgttagttgtgtgaggacctgaagtttgggtgctcagaccttgtctgagtgtgtactgaagtatcttgttgtggcttaagaagacaacaaatttgatgctttagattccgtttagggctttaggctgttctcaaatgtaaattatcggtatttccttttgaaacacattgcaatgcaagtgatgggtcactggcaattacagtatgctcttatatcgcatcaacctgctggc

SEQ ID NO: 9362 - DNA, 625 bp, Sorghum bicolor
  Clone ID: SORBI-28MAY03-CLUS13147_1
gcacgaggcctacaagtgtccagtccaggtagcaaagagggcccgggggcacgcctcaggagatgggcatgctccatgtttgagcaggtggtgtcggatttctgctggcatgcgagggaagtagtgtcgtcagcgatggggctctggggctggccctgggggcggcgtggcccgtcgggcttcggctccgcgtccaccgccgaggaggtcaccgccggcgtcgacgccagcaacctcaccgccatcgtcacaggagcaacgaatggcattggaaaggagacggccagagtgctagcactgaggggagcaaaggtgatcataccagctaggacgctggagagtggcctgaaggtgaaagagagcctcgcagaacaggtcccgagctccaagctgcacgtcatggagatggacctgagctctctcagctccgtccgcgacttcgcgcggtccttcgattcatctcaccagcatctgaacctcctcataaacaatgcagggattatggcctgcccttaccagctctccaaggatggaatcgagctacaattcgcaactaatcatgttggccatttcttgctgacaagtctcctgctagacaagatgaaatcaactgctagagagacag

SEQ ID NO: 9363 - DNA, 691 bp, Sorghum bicolor
  Clone ID: SORBI-28MAY03-CLUS13185_1
ctgtggtgcaagacaagatttctgaggttgctttgagtcttattactgcgtatgatagcggtgaactcactcaagcactagccgagggccgtgatggttggcagaagtgggttaaaggttttggaaagtctatcaaaagaaagggcaaagggctcttcatgccgctccgagtactgttgaccgggaagcttcatgggcctgacatgggcggcagcatagccctaatacacaaagccggcatctgcggtgctgtgacttcacagtccaactttgtgactctagatgagcggttcaggatcctcaaggaggttgactgggagtcgttggcgaaggagcaagaaacccctgctgaatctgctgttcctgccgcttcatagactgccagtacgccttcatatcggtcagggatgacgctgcccacaatgttgcgcttgaggagttctgtccattttgccgtgtttttgtcacgttctgttccatccagtagcagaagttcagtggttaataaagcgattttttatcatataggttgatgctgtaatggggttaatattgaattattagatgaggatgctgtctgttatctacgtgcctacagtttctcgtttgctgaatacaggattgttacaggtgttcataagcattataaaaactgttccgccactcggatgttgctcgtgattgacataat

SEQ ID NO: 9364 - DNA, 438 bp, Sorghum bicolor
  Clone ID: SORBI-28MAY03-CLUS13063_2
atgctcttcaccttttgaagtgcaacctccatgatggatctcttgaaacagtggtcagtatgccattgaacttggtgtatgttcacgggaaaggggtaaattttatctatcagggacaccctttttcgcattacatggtgccatatgtggaatctttgctacggattggaccatgctaatgttattaataccaagttggttagggtccttgcggtgggatttatccacccggattgaagtcttagcagcctgggaatgggaacatgattctcgttcctgttctcatgttccacattccaggaatgtagacgttcctgaaacgccaatgttcccgttaggttgagtgtgtgtacgccttgaacgtctgcatctatacttgggtaattcacaaaaataaataaaaaaaagggtatgcttgaatgcggcttgtatgttatc

SEQ ID NO: 9365 - DNA, 714 bp, Sorghum bicolor
  Clone ID: SORBI-28MAY03-CLUS13063_1
gccggccgggccgggaatgaccttctgtgtgagctaagtggcaatctgtgctatgtccactccccctcctctcgtgaagtctccatttggttagcacaagatggacaaaacataataacatggtcactacgttgtcgtgtcaatctgcccgtaccaaggcttcttcgtgtttatgcttgtgcttcagctgatcaaggcacaatattcctctctgtggatgctcttcaccttttgaagtgcaacctccatgatggatctcttgaaacagtgggctcatcttacacagcagaatgcgatgagtccttaaagccagcagttggcatgacatttgaggatattgaattagccagagagttctacaaagcctatgctgcacatgttgggtttccggtacgtgtcagtcagcacaaagcgaagaatgaattgctgataaataagtgtttctattgctcgtgggaaggattccataaggccaaagatgagacacaatctgaacctgtacgcagcgggagaaggaagtgtggcccatggatttctgtcacctattacaattgaacagtactgcatgttcagtctaattctcaaagtccttggtgctgcagattcagggactcacttattaatgtgattgctagtgcagattgataccctttcttcagacagtttctggagcaatgtagtgtgtgttcaaaaaatatctaagcctgcaatcac

SEQ ID NO: 9366 - DNA, 841 bp, Sorghum bicolor
  Clone ID: SORBI-28MAY03-CLUS13187_1
cccacgcgtccgcccacgcgtccggaaacaaacaagataaataatgattctcagtttcttttcatgtactttgttgtattagttattcttcttgagtaaatgggtaaacttgaaaaatgttgaattatttacttttttgtaacacaatttatataatgtaggacttcagttttatacattaaaagtgctcatttatagttaatgtacatgcatatttctgtacactatatgaagagttgtacgtggattcgtggaaggctttctatacatcatgggcatcactttgtgcttgcttttctcattttctcaaaggatttcatgatctatagacccaagttgcacccttttttgaaatatgtgagggttaaatgtattatgttgatgggacatgtatgtgatggcttattcattggtgttgcttagtttctattcttgaggatttaggtgttcaatagtatactactatatcctcgagggattatagaagccctctttcatgcgtcaacggttctcctgcacgtctgatggctggcgatgcctgcaggcacgtccttcgtgtctatccgtggtggccggtggcggtgtggacaacggcaatggcgtggcatggtcaaagatgtcttccatagttttttatgcctgactttgatggtttttgtgtcagtggcatagtgtgatcttttttgatagagttgatgggtcaatgtaaaatattgatggctcatgtaattgatggcttactcataagaacaaatttgtatacattcttgagcatttatgtgttcatctgtatacaactatatgctatatgcatgtttgaagcactcttatatgcattgtt

SEQ ID NO: 9367 - DNA, 661 bp, Sorghum bicolor
  Clone ID: SORBI-28MAY03-CLUS13235_1
gcacgaggcaccgccggaggtggtggtggtgccgaagaggaagcccgccgcgtcgtcgtcgtcgtcgtcgtcgtcccctgcgccgaagaggaaggagaggcggaaggagtgggaggagatgagcgtgggcgagaaggccgcggagctctatgtcggggagaagggccttctcttctggctcaacaagttcgcctacgcctccatcttcatcatggtcggcgcctggatcctgttccgcttcgtcggcccctcgatcggcctctaccagctcgacgccccgccgctgccgcccaccgccgtgttcggcggcggctccccgtgacggcaccagagcgtcggcgtcagagtcgtttctgagtggggtacactaggtagagctagcgtagcggactaataataaggcaaagattgaggaagaagaggacgcgaatttcggagccaaaaattggatcttttgctggcaatggcaatgtggagtgtagatgcgcagttcttggagcttcagagcatgacactgctgaattccgggtttatctgtgcaaacatgtttggttttgtataggcaagcaattcatttcggtatgctcttcaattgagtttgagaagctgagattaagaggccatgctgcagccgtttcttgtaatgaagacagaaattttc

SEQ ID NO: 9368 - DNA, 1092 bp, Sorghum bicolor
  Clone ID: SORBI-28MAY03-CLUS13277_1
caacaccagcggcgagcaattgacttttggcaaaagcattgggataaaccaattcctctcaaactgaaacggcttgcccgtgaccatgagagatttctctgggcgctgagtatcgtgcaatctcgttctgtaaacttgaagttgagaatgggagccttcatccaagatgcgaatgtgctagctccttatgctgatatgttgaaccactcaccaaatgctaattgcttcctgcattggcgttttaaagatcgtatgcttgaaattatgattaaggctggacacgctatcaagaaaggagatgagatgacaatagattacatgagtggcgtgaacagcaaatttatggaaagatatggcttctcatcaccaacgaatccttgggagctcataaatttctcgagccctgcaacgattcacatggattccttcttatcggtcttcaatattgctggcttgcatgatgagctgtaccacaattccacattgccctcagtagaaaccgactttgtggatggagcagttgtagcagcagccagagcattgccaacatggtcagacggcgacgttcctgcaatacctagcgtggagagaaaatctgctcaggcgctgcaagaggagtgccgccaaatgttggattcattctcgactaccattgaacaagaccagcagatcctagattccgatgtgcatatcaacaaaacccgagaaattgcaatcaagtatcggctgcaccgaaagatgctcctacagaaaatcatggatgcactggatatctaccaggataaaattttgttctagctgtataggcggcactacctgtgctcagttagaacacagaactagtatcagttctactgctagtaaacttagggccatttgatgttttagggccctggagggcaggcagtcatcagaccctctagtagaaagggattttgtagggctgccttcagttaatagtgtttgtaggttgacagtagaggatcccaaaacgaaagcaacattacgaagagctggttgccacgaaatatagctgtaagttctagtcagcaaactgccatgtactcgaaattctttacatactgcacaaga

SEQ ID NO: 9369 - DNA, 930 bp, Sorghum bicolor
  unsure (1)..(930): unsure at all n locations
  Clone ID: SORBI-28MAY03-CLUS12625_1
gcacccgccccgcatccccgccgcgccaacacggcacccccaaaacgaaaccctaaatcctcgtccgcctccgccccgccgcccagccccccgcccccggcccccccgccgcggccgcccctccgcgcgccgtgcccgctgcccgcggccccgcggcccgccccgccccggcgcgggcgccggcgcccccgccgctgccgccggcccagcacccgcgcagcgcccccgccgccccgccggcccccccgagcggggccccgccgcgggctcccccccgggcgggggcccccccccggcccccgccccccccggcccggctggccgccgttttccgccggccctcctgggcctgggcccaggaggtgcgcgcgcggctccggcggctcgtctggggcctcgcccgcagcccactgggggccgagctgccgccagccccccccggggggcccatcccgccggccgcgctgcccccgcgccccccgccgctgccgatgtaatcaccttgattttgaactttgaagtcaagggaaggtggtgaaccatcttggttccttggttcttctggcaacaggtgttgtcaacttcatatcagcatgggcattgtgtcttgttagcagtgaagaaaatgttatctgtcacctaggatttcgttttgaggaaagccacactgccctttcctgcatcatcatgacgccaccagatgatttgctcatcagcatctttctcttgctgcctccacacccctgctacctacttcgttcttcccttgtatgcaagcattggcactccctcatcgtcgacaatcggttcctccatcgctttcaggcactccatggattacctttacttggtgtcttcaccaactccactcgcatccctcgatttctccctgctggggatcctnctaaccgtgttgctgcagcatctttc

SEQ ID NO: 9370 - DNA, 812 bp, Sorghum bicolor
  Clone ID: SORBI-28MAY03-CLUS12658_1
aagctggaaccactcccgcaccaaaccaaactaatcacctcttcccgcgacctcctccacggcgtaactccggagatccaccacccacgacccaccaccgcctgcctcggcaatggccgccgcgccgccgcccaccgtgaccaagtccccgccgtccctggtcccgccggcggggcccaccccgggcggctccctcccgctctcctccatcgacaagaccgccgccgtccgtgtctccgtcgacttcatccaggtcttccccgcccctacgtcggaccggagcccctcctccgcgatcgcggtcatgcgcgagggtttcgccaaggcgctcgtgctgtactaccccgtcgccggccgcatcgccgagcccgtgcctggggagcccgagatcgagtgcacgggggaaggggtgtggttcgtggaggccgaggctagctgctccctcgaggaggcgcggaacctcgagcgcccgctgtgcatccccaaggaggagctgctgccgcgtccgccggccgaggtgcgcgtggaggacacactgctgctcgcgcaggttacaaagttcacatgtggtggatttgctgtgggcatttgcttcagtcacttggtatttgatgggcagggtgctgcacaatttctgaaagcagttggtgagatggctaggggcctccctgagccatcgatcaagccaatctgggctcgggatgccatccccaacccacctaagccacccctaggtccgccaccatcattcaccgcattcaactttgagaagtcggtcgttgagatctctctggacagcatcaagcgtgtga

SEQ ID NO: 9371 - DNA, 586 bp, Sorghum bicolor
  Clone ID: SORBI-28MAY03-CLUS127179_1
gcacgagggttggataagataggacaaggtacatatagcagcgtttataaagcacgtgatcttgaaaatggaaaaattgtggctctgaagaaagttcggtttgccaatatggaccctgagagtgtccgatttatggcaagggaaattcacatcttaagaaggcttgatcatccaaatgttatcaaacttgaaggtttggtgacgtcacgcatgtcaagcagcttgtatcttgtatttgaatacatggagcatgaccttgcaggacttgcagctacacctggcttaaaattctcagaacctcaggtcaagtgttacatgcaacagctactttctggacttgaccattgtcataaccgtggtgttttgcatcgggatataaagggtgcaaatctcctacttgacaataatggcattcttaaaatagcagattttggtctagctacattctttaatcccaaccaaaaacaacatttgacaagtcgtgtagtaacattgtggtaccgacctcctgagcttttgttgggtgctactaactatggtgctgctggtgatctatggagtgccggttgcattcttgctgagttgt

SEQ ID NO: 9372 - DNA, 1104 bp, Sorghum bicolor
  unsure (1)..(1104): unsure at all n locations
  Clone ID: SORBI-28MAY03-CLUS12753_1
gcacgaggagcgtgaaaaggttaatgacacaattacaacatcaactacatccaaatcacataccaattcaggcttatctgaaaaagaaatgatccttgaaccaccantctttcatgaaacgcacgatggagaaaataattgagtttattctgacaaatgggaaggagttcgaagaaaaattgattgagcaagacagaacaactgggcgatttccatttcttctgtcttctaatccataccactcatattatctaaagtttctccaggaaaccgaagagtccaagtcacatggtagaagtcctaatcacaacgatagaagaggttcttctgaccggaggggcagaagaagtcctgatagcgatgatagaagcttccgtgagcgtgccaacagaagctctcgtgagcgctccgacagaagcgctcgtgagcgcggcgaccaaagatgctcaatggagcgcaaagacagcagttatggcatggtatccagtgcttctgatagaagctcagctggaccatcagagaagcagctgtatgacaaacaagggaagggtagattccatcctgtttgtggggtcaagaaggaacctactcggaaagtcaccgcagatgaagctgctgctatagtaatggcggctactcgtgggctgggtgctgcaaataactcacttaacaccatgaaaggaaccaatgacaatgttcgcacccatgcaagtaatgatccttcttccagctttggaagtttctcatctttacaggaccgagatgcactgtccaaacatatttcaaatagtgaggctgatgcttcacttacaagtagtggacagccccaaaaggaaggttttggaattattgatgatgattggattgcaaacactattgcaaaagctgctgctgcagcagcctccaaagaggcagattcttcggaagcttccatgacaaaggaacagaagctgaaagctgagaggcttcgccgtgcgaagatgtttgctgcaatcattaagagtggagacaaggtgaatgatttagctgcagcatcagatccaactagtgaagatgccaaggccattcctgatatgagtgtctctggacttgatctgcaatctg

SEQ ID NO: 9373 - DNA, 1180 bp, Sorghum bicolor
  Clone ID: SORBI-28MAY03-CLUS127886_1
gcacgaggctcgcatacgcgcccgagcaacgctttgtctgcgacgggcgcccgccctcctgccgccagaagcttccaggagcatcagcgatggtgtggttccaatgcgaggactgtggcgagaacctcaagaagcccaagctcgccagccacttccgctgctgctccgcgtacaagctgtcatgcatcgattgcggcgagttcttcagccaggagaccgtgcaggggcacacccagtgcatctccgaggccgagaagtatggtcctaagggacagaacaagccatccaatggtgtacagggtaaggcagataagccaaagccaaatgcagatgttgatatcaatgttgggctgtcgacacggcctccttggttctgtagcctatgcaagaccactaccacaagcaagcaaactctcttactgcatgctgatgggaagaagcatagggcaaaggcgaaagccttccatgcttctcagaaacaaacaaatggtgcagaacaaactccagatgtgaaggaagccggagctgtacccacaaaagaatctgttcaagtaaatggtggtatgagtggtgatcgtgaaagaaatgatgataaagatgctgcgaaaagaaaacgaatggatgacatgaccatagaggagccagataacacaaaaaaacagcatttaacgcagtctagagatgagaagtcagaaaacaaagtgaagagtaaggcagatgaactaacaagtggtgccgactgcaaaagtgttcagaaacaaaagatcaaatggaagaagattattactaaagcactgaagacgaacgcagatggagttatgaaactaaagaagctacaaaagctagtctccaaggagcttcaggaatgtggtgtctctaaagacgagggtctccatgctaccttgatggataaaatagcttcaagctccagattttctgttgatggcaagcatgttagactggtggctaagaatgaagaagaatcttagaaagaggttgtcagtcatttcttggcattgttcctggcctaattctttggtgtcaactttcagatggcttatagccaagttttggttaaattgagtgcatgaaccatcaattatatccatgacctgacggtatgggaattttgaatctgatttttcttggcaaccgttcaaaagtgaacttttaacacttt

SEQ ID NO: 9374 - DNA, 606 bp, Sorghum bicolor
  Clone ID: SORBI-28MAY03-CLUS1338_1
gcacgaggccgcgtgtcctgcattccgcgctggtgccattccttccaaccatccagccctctgagctccctgccttccaatctatccaattcatccctgcaggtcaggtcaggttgaggtccctcgtcgtcgccctcctcctccttcgtcgtcgttgcttccgcttccgccgccgccttcgccttcgccgcggaaactaatctgcacgggatcggtatcgtaatggagtacgacggcaagtacagcaaggaccagcagagcctcctcaacctcaagtgcgactgcctcctcttcgaccttgatgacacgctatacccattcaactctggcattgctgccgatatcatgaagaacatccaagattatatggtgcacaagctccgcgttgaggagaccataagcctggagctatgcgtcctcctctacaagcagtatggaaccaccatggctggcttgagggcgcgtgcgctccagtcccagtacgatgccttcccctgccttggcctcggctgctgcttctttcttgttgcttactggccctaacattaataaaccttgcttcttgctttcccccttcgcaaacttgtgttcacaaacggtgacaga

SEQ ID NO: 9375 - DNA, 1042 bp, Sorghum bicolor
  Clone ID: SORBI-28MAY03-CLUS13383_1
gcacgaggcgagtaaacaacatccattccccttcgatctcttcgctcgcggatccaccaccatcaccaccaccactcatgtcggatcgctgggatccaccacaatcgagggtggactgggttccgcacgaggccgaaattgaggttccaacatcaagaccatccaaggatgcggttcgggcattcatcatgtctccatcgggggattcatcagcagcaacaccaaaaccatccgagctcgcgatttctacatcaagcccaccacaaccacccaaggttgtggtaccagtgttgattaactgccacgtgaatgtcatcgatgaagtagaggagatcatcgaagagacaggaggcctgacgctgtgtcagagcatagcctccatcctcgagcacctcccgccgtgcagcagcagaatcgagagagaagaccaagaagagagggccaccgaagaagagatcaaccgttattgtgcggaggtcgaggcaccggcgttcgcggtcctgcgcgagcgcaaagcctcccgtcccagtgcgtggcgcaaggagccggtgacattcactcgcgcagacgctggctactaccgtgaggtactggaaggcatcgatcttcatcttcctcagctcgcagctgcccccgccgtaaattcattgacgcttcgtatatcttggccgccggaacatgaaatgcggtgttacccatgctcctgcttcctgtcaagctctcacgagaactttctcgctctctacttgggcgcctaccgacccagcctttctcgtccagggtgttacctggtgttggacacctgggcaaagtctgttgcggtcataccgagtctgcccatcggctgggtcactagtgaatcccactgcaacactgggacggctggggttgccatcctacgccatgatcttggccgcaacaagtacctcctcgccgagctctaccttcaccgggacgataagagccacctagcctcaaataaggcatccctttttctgtggtgttcatccggctctggaccatttgctgaccattggataca

SEQ ID NO: 9376 - DNA, 776 bp, Sorghum bicolor
  Clone ID: SORBI-28MAY03-CLUS13386_1
gctactgggctgtttgtcccacgcgtccggaaccggacaaattccccgtcgtcccgtagcaaagcaactcggacgcagactgcgtccaccggggatcttgatggagagctgggtccgcgcggtggtggaggccatccactcctctcgctcccaggccgtcatctacctcgccggcggcgcatctcaggcgctcggctggctcctgtccgtgcccggcgcgtcgggcaccgtcctcgaggtagtcgtgccctactccagggcttccatggcgcagctccttggcaagatgcccctgcaattcacgagcaagcaggctgcagaggacatggcgctggctgcgtacaatcgagcactcaagctttctggaccaggtctgcaagttatgggtgtcggatttactgggtcactggcaagctcacgtccaaaacatggtgaccataggttttatgtgtcaacgtggacacataattgcctcaggacatcacatgttaccttgtcaaagggtttacggagcagagaggaagaagacaaggtttcaagctactttttgcttaaggcaatagcacatacctgcagagtttctgcaaccattcagtcagacattcaggaacctgaaattccagaagaaagcatagaggaatttgatgaagatcaagagctccagcaaattattaatgggcaagtttgcatgaaagtctataattttgctgctccggtggaaaataacttcagcagaaaaataattctacctggttcattcaaccccttgcatgatg

SEQ ID NO: 9377 - DNA, 681 bp, Sorghum bicolor
  Clone ID: SORBI-28MAY03-CLUS13403_1
cccacgcgtccggcgctgagctccatcgaattcgcagcaggcggaggaccgcgaacacgacgagggcagggagcagcatccacaagccatggcggggagggccagcatccccactaacaactccgccctcatcgcaatcatcgccgacgaggacaccgtcactggcttcttgatggccggcgttggcaatgttgatctgcgcaagaaaaccaactacctcctcgtcgacaacaagacgacagttaaacaaattgaggatgcattcaaagaatttactacgagggaggatattgctattgtgctcatcagtcagtatattgccaacatgataagatttctggtggatagctacaacaagccagtccctgctattctggagatcccgtccaaggaccatccatatgatccagcgcacgactcggtgctctctcgagtgaaatatctgttctctgcagaatcggtggcgtctgataggcgataaaggaatccttgtgtagtagtaccctttgatgtatctatttttttatgtattgaaaagatggcaccattgggtgcgagcgagacatcaagaagcacagataataagcttgcaaacaataattggttgaaccaaaccaacacttttttttcataaaaggttggaatgctattttggtgcttgtaaaaaaaaaaaaaaaaaaa

SEQ ID NO: 9378 - DNA, 658 bp, Sorghum bicolor
  Clone ID: SORBI-28MAY03-CLUS1343_1
tggcgtcccgtccgccgcaggcaggcaagcacgcaggcctgccgtcccgagatggcggcgaccctccagtctccttccgccgtctgcgtccccgtcccctgcgccgaacggctacgcacccctcgtcccatctcgcggcgagttccccacaagcctgcactctcctgtagcagagcatgccgcgccggcgtccgctgctccgccgcaaacaagccctcccctcctccgcccaccactccggacagcagcgaggtaagctccatggcgaagatacggagtgaggtcctctccccgttccggtcggtgcggatgttcttctacctcgcgttcatggccagcggcacgctggggggactcatcgcgctcgcgcggctcctcccgttgctgtccgggtccgcgtccgaccccgcgcgggcggccgacacgctcaagggcctggggcatcgacgtcgcggccgtctcgctcttcgccttcctctacgcgcgcgagagcaaggccaaggacgcccaggtgggccaggctcgcgcgggaggagcgcctgtccaggctcaggctccgcgtcggcgccgccgagggcaggccgttcacgctcagcgagctgcggggcaccgcgcggctcgtcatcgtggcggggcccgcggacttcgtcgccgagtc

SEQ ID NO: 9379 - DNA, 788 bp, Sorghum bicolor
  Clone ID: SORBI-28MAY03-CLUS13766_1
gcacgaggcccattgcactccgtctgcgctagggtttttctccgcagccgcaccacgccgccggagcagcgcgagacccgaggcgagccacgcgcgcgcgagagagatgaggctcctgacgcacaacatgctggcgtcgaacgtccggggcgcaaccaccggctacccgctgacgctggaggcgaccaagtggtgcaccaaggaggtggagctcaacgccgacttcatccgcggcctcctccccaagatcgactggcgcgcgctcgtcgacgccacccgcgcgctcggcctccccgagctcctccccgaggagcagccccccgaggaggagatcttcgccgagggcgccgccgacgtcgagggcagcgccatccgccgcatccaccacgcgctcctcgaggtccacgtccaggagggttccctcgtctgccccgacaccagccgatgcttccccatcaacaagggcatccccaacatgatgctccacgaggacgaggtctgatctgtgtgtgtcagtttcgccctggccgcttttgcttgctcacctgctcgtcatggtctgtcgcgaagggtatccacggcttgtgaacttcgtactcagtcagattgtatctgtgaagtatggaatgcagtcttgcagattgtggccttataatatgatagatagccgtgtagtactcggaattcccgttttgtgttggtaatttggtgcacgtcatgctttgttctttactgtgggcaaattgtttgctgccctgtgactgaggaaatcgaaagatgtagttttt

SEQ ID NO: 9380 - DNA, 954 bp, Sorghum bicolor
  Clone ID: SORBI-28MAY03-CLUS130_1
gcacgagggtcattatacatgggctgaatgagcacagtggaaggtacttgcactttgctgagcagctgacagcatgtggttttggagtgtacgcaatggattggatagggcatggtggaagtgatggcctgcacggctatgtgccttcactagattacgttatcgaagacattgaagtgcttcttgacaaaattatgatggagaatccaggggtcccttgtttcctcctcggtcactccactggaggggccgtagtcctgaaggcatctctgtaccctcatatcagagagaaactggaaggcatcgttctgacatcacccgcgctgcgtgtgaagcctgctcatcctattgttggggctgtggcgcccatcttctctctggtggcacccaagttccagttcaaaggcgccaacaagaggggcatccctgtctcccgcgaccctgcggcgctgctggccaagtactcggacccactggtgtacacggggccgatcagggtgcggacggggcacgagatccttcgcatgtcctcgtacctgctgcacagcctgaagaaggtgaccgtcccgttcatggtgctgcacggcaccgctgaccgggtgacggacccgctggcgtcgcgggagctctacggcgcggcggcgtccatgcacaaggagctgcggctgtacgacggattcttgcacgacttgctcttcgagcccgagcgcgacgaggtcggcgccgagatcatcggctggatggacgggatgctccggctccggcggcagaccggatgaatggccggccgcaagggagcaagggcaaaggtggggttgtgttgtgtctcggttcttgatggtgtctcttcaaggtagtatctatagatttgtgtacggagatggatacatttgtgttctgtaactacagtacgtgtctatctatctaaataacagcgcgaagaggagtatggat

SEQ ID NO: 9381 - DNA, 1240 bp, Sorghum bicolor
  Clone ID: SORBI-28MAY03-CLUS13019_1
caggaaacttccggcagaacgcagaagaacgtggcggaccaaactgacgtgctcccgggcgggcgggcgggcggcgacggcggcggaggcggcatggagcaagagccgaaggcggtggcgaggaacaggaaggtggtgctgcgcgggtacatcgaccgcgcgccaagggaggacgacatggagctcgtcgacggcggcgccctggagctgcgcgtccccgagtgcgccggcggcggccccgcggtgctggtgaagaacctctacctctcctgtgacccctacatgcgcggcaggatgcgggacttccagggctcctatattccgcccttcaagcctggatcacctattgaagggtttggtgtggggagggtggtcgactccacttatccaggacttagtgctggtgacattgtttccgggatgactggctgggaggactacagtctgatcaccaagcctgaacaactcacgaagattcagcaaagcgacataccactctcttatcatctgggccttcttggcatgcctggttttacagcttacgttggattctatgagatttgttcaccaaagaaaggggagtttgtttttgtttctgctgcatctggagcagttgggcaaattgttggtcaacttgcaaagctccatggctgctatgttgtgggaagcgctggaacaaatcagaaggttgagctcctaaaggaaaaattcggatttgatgcagctttcaactacaaggaagagcctgacttgactgctgccttaaaaaggtacttccctgaaggcatagacatctactttgagaacgtaggtgggccgatgcttgatgctgtactactcaacatgcgagtacatggccgcattgcagtgtgtggtatggtttcccagcatggggtaactgctcctgctgggatccacaacctgttctccttcataagcaagaggatagagatgaagggattcatccagagtgattacgtacacctgttcccacagttcgtggatgacatcaccaagcattacagagatgggaagattgtgtatgtggaagatgtgagtattgggctggagagcggaccagctgcctttgttggtctgttcagtggtaaaaatgttggcaagcaggttgtgcgtgtgtctcaagattgagaccgtctacattctagtcaatattagatgagcattgtaatattagaacctctgttgcattgaacaataaagagaagcctcatcttgttgg

SEQ ID NO: 9382 - DNA, 1173 bp, Sorghum bicolor
  Clone ID: SORBI-28MAY03-CLUS12881_1
tggcggcgttctcgagccgaggccccaactaccgcgcgccggagatcctcaagcccgacgtcatcgcccccggcgtcaacatactcgcggcgtggaccggcgccgcctccccaaccgatctggacatcgacacgaggcgcgtcgagttcaacatcatctccgggacgtccatgtcctgcccgcacgtgagcggcctcgccgcgctgctccgccaggcgcacccggagtggagccccgcggcgatcaagtcggcgctcatgaccacggcgtacaacctggacaactcaggggagaccatcaaggacctcgcgacgggcgtggagtcgacgccgttcgtccgtggcgccggccacgtcgaccccaacgccgccctcgacccggggctggtgtacgacgccggcatcgacgactacgttgccttcctctgcacgctcgggtactctccgtcgttgatctccatcttcacacaggacggctcggtcgccaactgctcgaggaaattcgctcgctccggcgacctcaactaccctgccttcgccgccgtcttctcctcctaccaagactcggtcacctaccaccgggtggtgcgcaacgttggcagcaactccagcgcggtgtacgagcccaagatcgtcagcccgtccggcgtggatgtcacggtgagcccgagcaagctcgtgttcgacgggaagcagcagagcctaggctacgagatcaccatcgcggtgtcaggcaacccggtgatcgtggacgtcagctactcgttcgggtccatcacctggagcgacggtgcgcacgacgtcaccagccccattgccgtgacctggccgtccaacggtggagcagcagccatgtagactgatgctgttggcctgttgctactggctactgctgtgggaagaagaacagggccatcagatccgagatctccacgcatcatgcctgccattgtttactcgacttaaccacggaataattcagctgcccctaccatggttgtgtggaccaatggaataattcagttggttggagtagtgtacttatgtgattggctgcttgcaacttgcaaggccagagagggtgacattatggctgatggcgattgcatgtatgaacacgtttataatgacgcaatgatcattgtaccatcttcttttaaactggcatgtttaa

SEQ ID NO: 9383 - DNA, 938 bp, Sorghum bicolor
  Clone ID: SORBI-28MAY03-CLUS1305_1
gcacgaggacaaatgccatacaggagtggatcgagcgtgttgctatgataccagttgatggcaaggagggacctgctgatgtctgtgtgatagaactggggggcactataggtgatattgaatccatgccatttattgaagctttgggccagttctcttatcgtgttggtcctggcaacttctgcctggtgcacgtcagtctagttccagttttgaatgttgttggtgaacagaaaacaaagccaacccagcatagtgtacgtggtttgaggggactcgggctcaccccaaatattttagcttgccgcagtactaaggaattagaggataatgtgaaggagaaactctcccagttttgccatgtgccggcagcaaatattatctctttgtatgatgtttccaatatctggcgcattcctttgttgctacgggaccaaaaagctcatgaggctattcttaaagttctgaacctggaaagggtggatagcattgctcgagagccaaagttagacgaatgggttgcaagagctgctatatttgatacccttcatgacactgtgaggattgctatggttgggaagtacactggcttatcagattcatacctgtctgtgttgaaagccctcttgcatgcatctgttgattgccgcaggaagcttgttgttgatagggttgcttcaacggatcttgaggactccacggcagttgaggcacctgatgcatataaaacagcgtgggatttgttgaagggggcagatggaattttggtacctggtggctttggtgacagaggtgttcaagggaaaattttggctgctaagtatgcccgtgaaaagaatgtcccatatcttggtatatgtcttgggatgcagattgctgtggtggagtatgctcgtcatgtcatgaatctcaccgatgcaaacagcactgaaattgat

SEQ ID NO: 9384 - DNA, 637 bp, Sorghum bicolor
  Clone ID: SORBI-28MAY03-CLUS1314_1
taccggccggattccgtactggacagcgtcggactagctagctcgggagggtcgctacaggacactagtatacaccacaccacatcggactaggatcgcagcagcaaccgacggaggagcaacagggaacccgatgacaattgcagcggcggtgaccgcgcccacgtccgcgccagtgcacgtcgcgccgcgccacgccacccccgcggtcgtccagccccgggccgcgccgcgcagggacccgtccccgctaaaccccaacacgacgccggcgcaggcgctccgctcggccagccccgccggcgggtcttcttcttcttctgccgcggccacggatggcggcgccagggctcacatcgccaaccttgacaaggtgctcgggaagccgccgcaggtgccgcggccacacgccgccgcgagcagcaagcgggacggcgaggggcaggagccgctcaacgtcaggcacggcctgctgaacgcgctgaacctgtccttcttcgtgcccatgcccgggatgcgggcgcggacggccgccgacgagcacatgtccccgcgcagcctcatgcacatgcagcagctcctctcggccgactccccgcgtgcctcgccgcggtgcaccatcgcgccgcgctggcgg

SEQ ID NO: 9385 - DNA, 1470 bp, Sorghum bicolor
  Clone ID: SORBI-28MAY03-CLUS13555_1
ccctttcccttcctcctctgcttccggggaggaggagaggaacgagacgaagggcggcgcaccgggaaggaggaggacgacaaggaggaggaacgccatccttccttcctcttgcacgcggccggagtcctcgtcctcaaccctcctccttggccgccttggctccacttccgggtgccatcacaccacctctgccggcgcccaccggcacccatgtcgcccttctacctcgctcgcggtgcttccaagctagtgagaaggattacctcggagacatcagtcgagctcaagattctctccgataaatggcggcttctcctcgctggcctcattttccagtacatccatggcttggccgctcatggggttcattacttgcaccggccggggcccacccttcaagatcttggcttcatgattcttccggagcttgggaaagaaaggggttacatcagtgagacattgtttacattcatcttcctcacctttgtattgtggacatttcatcctttcatccttcagactaaacgcttctacactgttctgatatggcgcagggtacttgcgttcttatgtgtgagtgtttctttattgcaagtttttttatgtgatttcctgatcagatgataccttagtttctattctacaacttactaggaatatatattttttgtttcttcaggcttctcagtttcttcgaataataacattctatgcaacacagcttccaggacctaattatcattgtcgcgagggctcacctctggctagattaccaccaccccagaatgcagctgaggtctttctgattaatttcccaaaaggagtgatttatggatgtggtgacttgatattttcatcccacatgattttcaccctagtttttgtcataacataccagaaatatggaagcataaggttttgtaagatgcttgcttggtgcatagctgttgctcagagtcttcttattatatcttctcgcaagcactacagtgttgatgttgttgttgcatggtacactgtgaatttggtggttttctttgtggataagaagcttacagaacttcctgaccgatcggtgggttccacatcagtacttcctgtgagtacaaaggataaagataccaagttgaaagaagaaaatacgagattgctgaatggtaactctatggattcagctgatcggagaccacgaacacaaatgaagggggcgctaattgtgttggactgccttgcgggttgcctgaccggggcaacatggttatctcgcggggctggggcctcgtcctctaatggacggtccgcacatcgagcttgggtgccttgctccttgtggacctctggacacgtgactacctccgacggagggggttgtgtcacctctcgctcttcccggccgccgagctttggtgcccagctccgtgatctccccctgccgtctcactgcgacccccgttggaaatagtttta

SEQ ID NO: 9386 - DNA, 847 bp, Sorghum bicolor
  Clone ID: SORBI-28MAY03-CLUS13504_1
cggacgcgtgggcgcacccgcaaccctgcaactaataaaaaccatcggctagcgatggccggagcccgcgtgctgctcatcgtcctcgcggctgccgtcgcgctcctggccgcacgcccggtggcggccaccgggggagttgccggtgtggaagaagtctgcaggagcacacctttcccggatctgtgcaccaggacggcggggaagcacgccgagaagtacaaggtcgtggacgcggtgacggtgctggagatgcaggtggacgcgttcaagaagcgcgtcaaggcggcgcggagggtcgcgaagcaggaggtgaagacggcggcgccgacgcccttggtgcggagggcgctgaacctctgcaagagctactacctggacgccggggacaacctcggcgcctgcaagcgcgccatcggcttcagggacgccgtcaccatccgcgccaccatgagcatggtggcacaggacatgcagaattgcgacgaggagttcaggaaggccggctccaccaaccccatggaggaccacaacaggtcgctcatcgagatgtccgagatctgccgcacgctctccaacatggtcccttacgaacatacccattgattttttttttattttttccacccacaatgttcagtaacgtcgtcgtcgtcgtcgtcgtctaagtgcggcctaacatgcaatttgatggccgcgtgcgtgtgtgtgtgtcagtcgatgatagagctggacgcatgccacagttcatgcggagctagcgcgtcctccttttttctgtgttgctcatgcggctcgttgagaggcacgcgtgtagggcagctatatgtaattatatacctgctaa

SEQ ID NO: 9387 - DNA, 653 bp, Sorghum bicolor
  Clone ID: SORBI-28MAY03-CLUS13572_1
ctcctttcttggagacttggcgcctgccgtggcgtcgtggcggctgcaggcacctctgatagatatggggaatgaattggtaggttcttcagatttgaggcagttgcctgaacgacagcaccaccacctcaagattgtggaaatgataacattcaaatctacaaagagcctggttgagctaacatgctgcattgtgaagagcgcagtctcactcgagcgccttacattcgacacatttcgtggcgatgttaggtctccatgttgctcgggggatgattctgtcgttggctacagcaagtataggatggagcaagcatctagagcggtggaagctataagaatgtacattgaggataaagttgcacctacaactaagctgactgttctggagccctgcgcacggtgtcacgccaccgcttttgatgattaggattaggcagaccttgcaagagctatatccggtgctaggatggagtatcattagtgaattgtgcttggtttctttgattgttcggagcggtttatatgttttgtctagccacaaaggcaaaatcaaactactcttcttaggtttgattagtttggatgaaatagtattgccgtgtatgactttgagtacttgtttataatagatatatatcagtaccctttta

SEQ ID NO: 9388 - DNA, 1168 bp, Sorghum bicolor
  Clone ID: SORBI-28MAY03-CLUS13626_1
ccagttgatttgatcaatgtacaactgtttgcccaagggatcatgaatctgtctgaataccgtaaaaagctctatgagtatctcgtaacaaagatgaacgatattgcacccaacctgacgtctttgattggtgaagttgttggagctcgactaatctctcatgctggcagtctttccaatcttgccaagtgtgctgcctccactcttcaaatacttggcgctgaaaaggcacttttcagagcgctgaaaactcgtggaaatacaccaaagtatggcctcatattccactcatcattcattggtcgtgcatcagctaagaacaagggtcgaatggctcgatacctggcaaacaagtgttccattgcttcacgcattgattgttattcagagttgaatacatccatttttggacagaagctgcgtgaccaagttgaggagagactagacttctatgacaagggtgttgcacctcggaagaaccttgatgtgatgaaagccgccattgagggtattagtgcggtttcggaggatgttgatggtaatgagaagaatgatgtgtctgctaagaaaggcaagaaaaagaagtctaaaactcagactgacggtgaagcaatggatgttgataagcttgccgatggagaagatgaacctcaaactgagaagaagaaaaagaagaagcacaagcgtgaggagccacaggatgaagagatggccactgagccactcagtgatgatgtcaaacaagatgagactccaaagaagaagaagaaaaagacccatgaggcaactggggatgttgagcctaagaagaagaagaaaaagacccgtgaggcatatgaggttgttgagcctaagacagccactgaagggaagaagaagaaaaagaagaagtccaaaaccgagggcagtgatgagtagtcattttagcatctcaaatttaagtggtatttaatgatgttaataatcttgaatctgatttatatatatcaattgaaccagttgggcctcaattaggccccgttcggttagggtggaatgggaccaagaactgttccagctgatgaatcttatacaaatttgtgaaccaatctagctaggaatggttccacgccttcattcctgaagaaacgaacaaggtcttaagcttttcatgtgttggcaatgctgc

SEQ ID NO: 9389 - DNA, 944 bp, Sorghum bicolor
  unsure (1)..(944): unsure at all n locations
  Clone ID: SORBI-28MAY03-CLUS137_1
gcgtccggtttggttaccctggnaggcctaccttgtttaaaaatttgaattttggtattgacctcgacagccgcatagcaatggttggtcctaatggcattggcaagtccactatanctgaaactaatatctggggatctgcaaccaacttctggaaccgtattccggtctcctaaggttcgcatggctgtattcaatcaacatcatgttgatggccttgatttgacagtgaatccccttttgtacatgatgaagtgctacccgggtgtacctgagcagaagttgagggcacatctaggttcgtttggtgtttcaggaagccttgccctccaacctatgtatactttatcaggtggtcagaagagtagagttgcgtttgcaaaaataaccttcaagaagccacacatcattctcctcgatgagccttctaaccatcttgatctggacgcggttgaggcgctcatccaaggtttactcgtcttccagggaggagtgctgatggtgagtcacgacgagcatctcatcactggaagcgtggacgagctttgggtggtgtcagaaggcagggtgaccccgttctctggcactttcaaggactacaagaagatgctcaagtaacatgacatatacatgtgtctgttcttgtaccgtgataaagtcatgtagtagtagcatgtattttatcggccatagcctatattgagaggtacatggatggtgtggtgtaccgtatgcgtatcaattttggagttttttttggacataataaatgcagagagttttggtgacaccgtttgggtatgcatggacctcgtgatttcttggggaagttgtcgtgactagtgccgtacccgtggggtggttggactggttgggttgtgtcacggaagggagctaccgtgtttctcttggcaaagaaaaggggtattatatacttattgatt

SEQ ID NO: 9390 - DNA, 1405 bp, Sorghum bicolor
  Clone ID: SORBI-28MAY03-CLUS13320_1
ccatacttgtttttccacttggtttaggagttagaggtgctgccttggcaacagtgacctcagagtatgtgattgcttgcatcctcctctggaagctgaatagtaaagtagtactcttttcccgaaatgtaattggtggtggaatcatacgttatctaaaatcaggtggacttctgattggcaggactattgcagtactcctgaccatgacactgtcgacatcgctggctgcaagacaagggcctgttccaatggccggccatcagttgtgcttgcaagtgtggctgacaatttctctgctcaatgatgcgctagctctggctgggcaggctctacttgcgagtgaatatgcaaaagggaattacaagcaggctcgtttggttttatacagagttctgcagattggaggtgtaactggaattgcactggctgtggttctgttctttgggtttgggtctttctctgtgctgttcacaaatgatcgggcagttttagacattgccaaatctggagtctggtttgtcactgtttctcagccaataaatgctattgcagtcggggcccacggcctgcacctgggcgtggctgccttcgcctactgcatactctatgttctttgttggggcgctcgcggcagcattcctacttgctgctgctcctaagcttggtcttggtggtgtttggtctggtctagttctttttatgagcttgagagcagcggctggattttggagcattttgctgttgtgtgcaggttagggagcaaaggtggaccatggaagcaaatctggtcagatactaaactgataaatgacaagaaatgaccatgtctaggtgatttgacgggaagatggaaaccaatatcattgacagctaacgacaattacatgtaaataaccagcagaagttgtacattaagtagaagagtattaactgtctaggtccttatcttacaatcatataaattgtgaactactactaagttcagacttgaggaaaaggaaatattttcctgtactggagtcttgaacagaagcagcatggaagtcttaaattttacaattgttttttccccttgttttcaggttagggagcaaaggtggaccttgggaggctatctggtcagatagtgagtaaagcacagatatgaccatgtggattcgattgttcaattgatctcccacactcccacagccagcaggtaaagggtaatcgtagcaacaaatgtgcatactgctgcaggtcatatatagccctgcgtaacaggtagctgatgtagctctgtggaagatgtttcacttgtaatggtgttggatggctgggctgtcttgttctggctgttggacactagtagccagtaggagctcacagctttcaactgtactaggaagcttagttatatagt

SEQ ID NO: 9391 - DNA, 1077 bp, Sorghum bicolor
  Clone ID: SORBI-28MAY03-CLUS13207_1
gcacgaggccgccactgcccacgccacccaaaaactcatggccgcccctggctgcggcgtcaccgcgcgcccgcacctgccttccgccgtccctgcagccgcaagaaagctcttcttccgctgcagggccgcctccaccatgaacgaggcatcggcgagctcgccagacgccgaggagaagaagacgacgaccgtcttcgtggccggctcgacggggcgcaccggcaagcgcgtcgtggagaagctgctggccaagggattcggcgtcgtcgccggcacgacggacgtgagcagggcccgcggcagcctgccccaggaccccaaccttcagctcgtcagggctgacgttacggagggcgtcgacaagctggtggaggcggtgcgcggcgtcgatgctgtcgtctgcgcgacgggattccggcggtcctttgacccctttgctccgtggaaggtagacaactttggcacagtgaacctggttgaagcatgccgaaaggcaggcgtaacaagatttgtactcgtcagctccattttagtaaatggggccgctatgggtcaatttctgaatccagcctacattgtgctcaatctacttggcttaacactggttgcaaagctacaggcagagaatcacatcaggaaatcaggaataaactacactattgtaaggcctggagggctgacagatcaacccccaacagggaatatagtcatggaacctgaggacactctttattcaggatccatatctcggagccaggtagctgaagtagctgtagaagcattgttgtgtccagagtcttcctacaaagttgttgagattatcgcccgaactgatgctccaaatcgccctctgaaggatatgtatgctgcaattaagcaaaattgactggtctgtcacatcagttacacagaaggattgattagttatgtacaaagcaaatctacgcttcttagaatgacaggatggttagtttgttatacaaccatgaaccaatgaacactaaggagttctcagagtatagtctatgtatttggcatgctatattatacttataaatatccataagcccatct

SEQ ID NO: 9392 - DNA, 505 bp, Sorghum bicolor
  Clone ID: LIB3478-055-Q6-K1-A8
gaagcagtataattggcgttaattgatattgtttttatatgtacaatccatgttaccaaacacattggtatacagttggactgaatgctcatcttttactggagggagttcttctataagaaaaatgctcatcttgtatgcatattactatattagaaataatgggttgtccaataaacctaatccgatctagataaaggaacagtaatatgagtagaggtctccagtgtgttttagacttttagtgctttctcattttacttgtcattaccggaaagtactctttgtccaccaatagtttatgtatagcatttttgttgttgaaaattttgcaggacactctttattcaggatccatatctcggagccaggtagctgaagtagctgtagaagcattgttgtgtccagagtcttcctacaaagttgttgagattatcgcccgaactgatgctccaaatcgccctctgaaggatatgtatgctgcaattaagcaaaattgactggt

SEQ ID NO: 9393 - DNA, 1296 bp, Sorghum bicolor
  Clone ID: SORBI-28MAY03-CLUS13324_1
actcgcccccccacggtcggacccggaacgccgtaaatccgggcccgcggcccaacccaactcaggcagacactcgccgccgccgccgccgccgccgccgccgccgccgccgcggcatcactagagagcaagaggcggcggaatgacgacggagcggcaggtggcggagctgggtcccgggacggcgtgctgcggctggaactactgcggccgccgcctcgccgctggcgccgtcgacggctccgtctccgtctatgactcccagccgtccccctcgttcaagtggcaggcccatgagcaagccattgtgaatgtcgtctggcttcctccagagtatggggatgctatagcttgtgcttgtgctgatgggacactgtctttgtgggaggaggttgctgctgacgatcaacttccaacctggagaaagtgtaaaatctttgaggatggcaactctcatatactaaatgtacattttggattgcatctgggaagtctgaaaatggttactgcatactccgatggccaagtcaaggtctacgagctcttggattcattggaattagacaagtggcagcttcaggcagagttccaaaacattactgatccaatctccagatttggaaaacttgcatgcacttctgcatcgatagcatggaatccaagaagaggtggaagccaacaagctagttttgcaattggcttcaattcagattcacctcatttcaactcttgtaagatttgggagtttgaagaagcacatcagcgctggcttccacttgttgagctaggttcacctgaggataagggagatagagtgtgtgctgtagcatgggctcctaacattggcagaccatacgagattatcgcagttgcaacctgcaaaggaattgcagtctggcatataggtttgaacactgacgctgatagcggacctacgacacggaacgttgctttacttaacggccatgatggcgaggtttggcaactggaatgggacatgggcggtatgacactcgcatcaaccggaggagacggcatggttaagctatggcaggctaatttggatggagtttggcatgagcaggctgttcttgactgcagtggatcacgtgtctagggcctaggtgtttgagaaaacatttttgttcccagcacacttgctgcagaattctccagtatttccttcacttatccccatgaactattgttgtgtggttggtttgtcgctatcaaaattggaccattaacgttcgtgggaccgcattgaaaagtctagaaaaccgaggtacattggtt

SEQ ID NO: 9394 - DNA, 750 bp, Sorghum bicolor
  Clone ID: SORBI-28MAY03-CLUS13330_1
acgaagctgtctgtcccccgaccactccgccgcccgctccaatggcggcgccggccaactcctcatgccccaccccccccgcccacgccctccgcgaagctgtctgtcccccgaccactccgccgcccgctccaatggcggcgccggccaactcctcatgcttccacccccgcgcgaccgccagcccgccgtcttctctcagcgtcggaaccaaggtcttcgtcgggctcagggcgcagaccaagctcggttcgtcggagtcgtcatgcccgaatgtcagcgctgggttctacactgccgtcaaccggaggatctctctagggttgtcaaacaagaaggccaccagagcccgcatttcgatgatgcctattggtactccgcgtgtgccttacagaacacctggtgaaggaacttggcaatggcttgacatatggaatgctctgtaccgtgagcggattatcttcattggggacaatatagatgaagagttcagcaaccaagtgttggcaagcatgctgtatctagacagcattgataattccaaaaagataatgctgtacattaatggaccaggaggagatcttactccatgtatggcactatatgataccatgctaagtctaaaaagtcctattggtacccactgcttgggctttgcattcaacctggcaggatttattcttgcagctggtgaaaagggttcacgtactggtatgcctctatgccgaatttcacttcagtcacctgctg

SEQ ID NO: 9395 - DNA, 671 bp, Sorghum bicolor
  Clone ID: SORBI-28MAY03-CLUS13352_1
ctaaaccgcccgcgtggaaccctagcagcgattcctctccagtctcgtctccagcagtccagctcgatcgcgatcggcgaccagcagtaatccatggccgcccccactgccgcgccgctcgacgagggcaaggcgaagaaagtccttcgccaggtggagttctacttcagcgacagcaacctcccccgcgacaagttcctgcgggagacggtcgagcagagcgacgacggattggtgagcttgcccttgatatgctccttctcgcggatgaagtcccacctggggctggatgcagatgtgaaggccgagactctcccagaggagaccgtgcttgcggttgctgaggtgctccgccgttctccggtcctccgtgtatcggaggatggaaagaagattggtagagctagtgaactcttgaagccagatgagatcatagaacaagtagactctaggaccattgctgtatctccacttccttacaatgtaaagctggaagacgtccaatcttttttcacaaattatgcaaaggtaaacagcgtgagacttccacgcaatattgtcaacaaaaaacacttctgcgggacagctttggttgagttttctgaagaagaggaagcaaaaagtattatggacagttctttagtatttgcaggggcaaatctggaaataag

SEQ ID NO: 9396 - DNA, 895 bp, Sorghum bicolor
  Clone ID: SORBI-28MAY03-CLUS14004_1
gcacgaggcacttcgttgctcatgtacccctacacgcttcgggcggcggctagcagcagcagcagcagcagcacgggtctcgggttcgcgctcggccggatcggcggcacgacgacgagaggcggtggcggtggtgccgcggcgcaaggcttggtggtacccgccgcgggcgtagcacgcgggaggagcgtgtcgtcgacgccggccggcaacgcgcccgtgccgggcgaccagggcgtcggcatggagcagccgaagcagcagcagccgcaggtgcccgcgcaggacgccgccgccggggacaagaacaaacgacgcgacgacatgcacaagaccaccggggacgtgatgagccactcgttcggggaggggtactcgacgcggtcggacgaggaggggttcggcggcgtgtacggcgggaacgaccccgtggagcaccccggcaccgagatccatcctagccaccccgagtacgacacgtcgcagggttcggaggtgaaggagaaggagaaggcgcgccacctcaaggacgagaagcatgccaccgcctaggtgcaggcggcgatatcagtcggtgttgtcaacgtttagttagttagcgcccagctgagtctgcgttgctcccggttcaggggatgtcacgtactcgtggttcactgcttttgaaacactactatctcaatttagtaagctgtttcaaggagctttcgtgatatgtatgttatttcttttcttgtggtttttttatgtgataagctacacagttattttgaaaaaaaaaaaaaaaaaaaaaaaaaaaaaaaaaaaaaaaaaaaaaaaaaaaaaaaaaaaaaaaaaaaaaaaaagggcggccacccaaaaggaacacaacgcttacaaacgcgaccatgccacc

SEQ ID NO: 9397 - DNA, 886 bp, Sorghum bicolor
  Clone ID: SORBI-28MAY03-CLUS13909_1
gaaaatctccagatgactgcaaagatcgttgtggtttgcaatgatacaagcattggcccactgagcattattatgtttctattgggtcgctgcgtccttttctatttagtgaggtgaataatatacaaggggtaagtagcttattaatttatacgtatataatagggttataataggatgctttctacatgtcaatattcaattattaaaaatacaacgggaagataaaaaggttaggagaaggaatatgagttgtgatcctgtggggtatgaaaacaggtgttagctaggattcatatggaaatagggtggtagaggataaggattttcattttttattaggcatctttagttaaaattcatattgatttgatccttatgttcaagcaaggtgctcttgcattttcatggaaatatcttgtgtcaccactgtgtgatggatatcttgtttgtttgctcagaagtcaagatccatcactcctaaatgttgcttaaaatttaaagcaagttttatgtatctatggattctttagcctcgttggatatttttagccatatatttttcttctctgttgaaatcataacatgttcaaattatatatgttatccattaaatgtattatactatgattgtggtctaattctatacacttcggactccatatgggcaaggggggtgagtatgttttccagcagttcgaagttgacatctacatcaagattgagagttcgcgttttagactaaacatgaggaacaattaggatactttgagagctgacctataccaaggccatggacaattaatatattcgggtgaaaaatctgttgagattgttggaaggcgtattgtccagtcttcgttatcatgggaggacttcaaatgat

SEQ ID NO: 9398 - DNA, 404 bp, Sorghum bicolor
  unsure (1)..(404): unsure at all n locations
  Clone ID: LIB3480-057-P1-K1-A2
gaacaatgttcttgtacaaaatcagatcctgtgaactctctgaatgcagtaatgacagattcagaggatggcccatctccaccaataacagctccaagtgtcaggctatcagtacaaaaacctctagattcttaaaatgagataggagtgttcagtacaacaaggtcaagagaaacanaatagtattgtaaaggggaaccttttgaaatagaagacacanagagtaaagttggagcgcttactgctgacttctcaggtaggcacatgtgcctttgcccctctctactaattagtgcattatcatggccatttcgtattatcaagacaaaactgttaatgtacttgcaaaaataatcctttttttagcaatggtattatttggattgcatgtaattttgacgctc

SEQ ID NO: 9399 - DNA, 488 bp, Sorghum bicolor
  Clone ID: SORBI-28MAY03-CLUS14081_1
atacactcccacagccatccatcccgtcacccacccacccacccacccgtccacagccagccaaatccgcctccgatccagcgcccacccaccacggtttccagtgagtttgagcgaggtaagcttagatctgagcgagttctcgcgcgtcgcaggtaaagttcactcgaccctctcatctttttccctgctaatctcatctccttcttgctttggtttcgtcttcctcgagcagacagcgagagacccggggccttttagatcctgggcttcagatctgcgatttcttcttcttcttcttcttcggtttggttttagcagtctagggttgttagtaggttggtagccaagaggggttctttttccacacctcccttgtgcaagtaagttcctgctgagcagatctacccaccagtgccatctgtttttactgtggctgttgggttctgccagtttcttcattttgttcttggtttgctatttgctag

SEQ ID NO: 9400 - DNA, 619 bp, Sorghum bicolor
  Clone ID: SORBI-28MAY03-CLUS140_1
cgtttcgcaagttcagtacattaaaacatacatcagatcctgtttgctcaaatataacaatgttttgatgattgctgcaggtcctggagagaatgagacgacaagttggacccaccgcaaagagaatttgtctgcggaggacattgacaggtccgtggtaaagctatagacatgtacggctgtacctagcagcatcactcttgaaggagtgtacatagtaggtgaacatgagcatacaatggccagagttgacacagccattaatacagagcttcagtctcgtaggcggatagattgcctgtgattttcacttcataggttttggccattcgcaaaagaaaggttcaggtgaatagaggagtttgtatgtagattcagtcgggtcagtttattgacccaggtatagagtgcttatactccatactgcttcttcaggcttttctggtttggtgtgatactatatgactgtatcattatccttgtgctttgtaaaaccaatttgtttatgatgtagactttagaactgcagatgttcgctgtgcccaaacttatagacattggtcaagaaaggagtatgttgttgtatgttccgaactcttttactttatatataaattcc

SEQ ID NO: 9401 - DNA, 675 bp, Sorghum bicolor
  Clone ID: SORBI-28MAY03-CLUS14161_1
cccacgcgtacgcatcatcgctcctcctccgacacgcagcccacgtaaattgcaccggccgaggccgagacacaggtaacaaagccaacagcgctagctagccatggcaggagcccgcaccctgctcctcctcctcgtcgcggcgctctgcttagccaccgtgaacgcggcgacgctggcggagatctgcaaggggacggcgttccccgacatctgcaccagcacggtagggcctgaggcggcgagcaacccggtgctggacccgatggcggtgctgcgaatgcaggtggacgccttcaaccagcgcacggaggcggcgagggcgcacgtcaaggaggcggccatgacggcgtccccgaaggcgcggacggtgctggacctgtgcaacagcctgtacctggacgtggaggacaacctgggagcctgccgccgcgccatcggcttcaaggacgccgtcaccatccgcgccaccatgggcatggcggcgcaggacatgcagaactgcgacgagcagttcaggcagatcggcgagcccaaccccatggagcagttcgacgcgtcgctcgtcgagatgtccgagaactgccgctcgctctccaacatgatctgatctagatcgagctcgctccgttgatctccacggacgacgacgacgacgacacggtcggcgcccgt

SEQ ID NO: 9402 - DNA, 1136 bp, Sorghum bicolor
  Clone ID: SORBI-28MAY03-CLUS1421_1
ggagaagcggcagaaagaaattgttaaaggcgaccggtctattaaaaaattgagccgtagagaaagaaggaaagcttctcagattgagcgtgaaaaagagcgggaggcagcacgttctgttggacgggtttcttatcgtgatccttacagggatcaaaggagaagcccatcatatgaagcatattcaaggggcagaagatcaaggtcaagatcaagatctcgttcaccatcccattctcggcgtcatggccgtgggatgcatgctgaaagcaattatcggagcaagcagaaggctcctagggttgaatatattactgaatttggaggttctgatgacaccagtgaaccaaaagtttcagggatctctccaccttcgtctccaatacgaattgacatacctaaccggtcgggaaactcgacttttaatatctgaaatatacattggacgaacttttctctgatggagcttattacatcagtcctggtatcctgaagatgactatgtcaaggataggatagatcaagacatggtcatgatggtatctatggtgtaaacaactagttgttttgtagataggcatgcattttatggttccttttatttttgctaagcaggaagaagatttaacatgcatagatctacagtcagctgtggagtttatgacctgctcatctttgctccttgtgaattattatggctataataccccatatccttgcaggttgtcaggtggtcaaattcttgaggcacttcacagtgatcctgcgtcttctttgtctgtggaacaggaaagaactgcaaaacttttgaaaccaccccccaggtttgtcatgacgattacaatgttgtgaagagagcggctgtatgtgcctccgagttgcttgtgattgatattctgtgtttgtctagaaccctttactttattttccacgggcatgatatgccgtctcgacttgagcatgtctgttactggaaaactgtcttgtattcttcatcattactgacatgtgatttctgttaacagtacatcatcagcactcgctaaactaagcaagggtgcttctggaggaactggtaaactccccagactgaaaagaaagaaacaccacgaaagacgacttaaaggataatgagc

SEQ ID NO: 9403 - DNA, 681 bp, Sorghum bicolor
  Clone ID: SORBI-28MAY03-CLUS134350_1
caacttctttccaactagtttcactataaataagaatccaataacagtaagaatattttcaacacaaaagttctctcaaacaagagaaagaaacatacctttttcatatatagatttagaatatgttccctatgctaactgggttcattagttatggtcaacaaacaatacgcgccgcaagatatattggtcaaggtttaataattaccctatcccacacaaatcgtttacctataacgattcactacccttatgaaaaatcaattacatcggagcgtttccgggggcgaatacactttgaatttgataaatgcattgcttgtgaagtatgtgttcgcgtatgcccgatagatctaccccttgtggattggaaatttgaaaaggatattaaaagaaaacaattgcttaattatagtattgatttcggagtttgtatattttgtggtaactgtgttgaatactgtcccacaaattgtttatcaatgactgaagaatatgaactttctacttatgatcgtcatgaattgaattacaatcaaattgctttgagtcggttaccaatctccataatgggagattacacaattcaaacaattaggaattcgcctcaaagtaaaatagacgaagaaaaattttggaattcaagaacgattacggattactaggtattaggatttttta

SEQ ID NO: 9404 - DNA, 585 bp, Sorghum bicolor
  Clone ID: SORBI-28MAY03-CLUS13465_1
ctcgcctcctcctcctcctcctccctccctccctccctccctcccgcgcccacaagccgcagccggaagccgagcccaagacctagtaccaaacatggccttcggagctctcgtcgcgtcgaggctggccaggtccggccgcaccctcgcatccgccgttgcccagggtcccgtggcccagcggacagcgcctcctctgctctccaggcttggagcagtagctcgtcttctcagcacaaagccggccgcggcagatgtcatcggtatcgatctaggcacaacgaattcctgcgtctccgtcatggaaggaaagacaccacgggtgattgaaaatgcggaaggcgcaaggacaactccctccattgttgctaagaatcagaatggtgacctgctgatcggtatcactgcgagccgacaggcggtaaccaatgcccagaacacaatccgtgggtcgaagcgtctgatcggtaggacttttaatgacccgcagacccagaaggagatgaagatggtgccttacaagattgtcaaggcaccgaatggtgatgcctgggtggagatgggtggccagcagtactcccctag

SEQ ID NO: 9405 - DNA, 675 bp, Sorghum bicolor
  Clone ID: SORBI-28MAY03-CLUS13485_1
tgtgattcagttctgtgccacggcttttgcctactatgcccaagcaactgctgctcaagagatctttggccacacattgcaatcccttcgtggaattaagtatctttacaagtacaatgttttccagtatggctttgttgctcttgccattctcacactcttctactatgctatatttggatggagaaagaggaaaccaacaggaaggttccagctctcaaattgatttgctctgtaagtgaagcttgacggattcatcatatttgccccctgagttagttagggtcttagggatgtatatgatcaaccaaacgaaaccaaatcatcttctcaaagttgaggaactgcaaatggtgtaaattatcagctatgagacttcaaaggcgagaacggggggactattggttaccacgaacatggattttaaagtagaacccagttgactttgcagtgtacacatttcttgtatcggctcttcatttacgtctgtattattgctttatgattggctggtgatgttattcatgagagatgtttggtgtgtctgggggcgctttgcccccctttgatattcatttcttggctgtgtctggagttaggtcagttcattgcttttatatgtattatatactgtgattacaacacaaggttctaggttgtattaatgatgtcttg

SEQ ID NO: 9406 - DNA, 534 bp, Sorghum bicolor
  Clone ID: SORBI-28MAY03-CLUS13493_1
gcacataggaagccaagtgctgcgtttttgcattccaaaagagaccaaacagttggtatcatccatccatgatccctcgcacaccattttctagaacaggttgatgacagacacacaaagcaggggacagcgcttacaacaatacacagccgcatggcaaagctcttctcggcgccaagacttaaaacagtcttgacacagcaacgcaacgcaacgcaacgctccacaagacggtctcttcttcctcaacccaaagtcgtcacgtcgcacacaggaccatggccatctttggtgatgaggaatcacagtccagatcgctctgctgctgctgctgctgctgcagcgggggaggccggcgaggcagcggggcggttgccgggccggctgtgcagcaaggggctcagggccttgaccacgatgctcatgttgggacggaattcaccctcgtattgcacgcacagggcggccacagcagccatcttggctacagcctttggagggtattcatctccgagccttggatccacgcattgc

SEQ ID NO: 9407 - DNA, 754 bp, Sorghum bicolor
  Clone ID: SORBI-28MAY03-CLUS13550_1
catacccgagcaagacgaatgggtatacagtgatggtaaatcaactacttgtgttgccttcattcttgcaatgtataaggaggctggaatattcgcccctttctcggagtcgatccaggtcaccgagttcactattcgtgatgcatacatgctcaagatttttgaagacaacccggcaaggcttccaagctggtgcaacacagacacggacaagcttcccttttgccagattctcggagagtacagaatggagcttccagagtacaacacgattgaaccttatgcgaaaatgaacgagaactgtccgtccttacctccaacatacaaacgacccgcacgctgctgactatgagattgtcgtctatgtatctttctgcggctgctgcgtttacacagtagcagttgagtgctgttgctaagttgttctgtaaataaaagacactgtatatataggtgtttggtagatggtagttgttaccagtaacctagctacgacgtattcaggtaacaggttcacggttttcagtcgatcagttctgaagccacggggtcggcgaccaatatgagggttaggatttgcccgctcccgaaagttgcttatatgtatataggcaacattgttactttatctgtgggcaatattcttggttataatgtgtgaactccgtcaagaaatgaatctacaatgcaacgtcatttgattctgatatgtgaccttcgggtccgtggacaacactgttaacctgtgctcccc

SEQ ID NO: 9408 - DNA, 1139 bp, Sorghum bicolor
  Clone ID: SORBI-28MAY03-CLUS14369_1
gaatacaggaaccagcgtgcagctaacaccttgggttctaagggcatgtttcagttgatccaaaggaaggggtcttcaaggaatctgatggcactccttaatactgacggctcagtcaccaaagcttggcatgttggtacaagtgatggcaatggggatcttaatgttatcacaaagagcaggaagtctgctgaaaatcctatgctggatgcctcacaaattggaaaggcagaggcggtcaatctccagtttggtccttttgggatcagtgcctggatgagtgacacgggtggaaccagccatactggaagcgtagaagacctgagggctgataacgtggagactggtggtaggaactattcatcatgctgcagttcgccaaagatgtcagattctacttcgaaggagcttatggaagactactcggtatatggcagcgaagaagaagaagaagctgacgacccccgtgatgctgaaactgatgaagacctaactgatgaagaaagagacatgcacgagatagatgcaggctctgtggacgagcactcaaccaagtcggatgaggaatatgaggacttagccatgcgcgatgtgatggagaatggcgactggtccgacgacgagcaagttgtgagcaaaaccaagaactcaccagccctggagggcatccatgggagtggggcagctaaagatgatggcataaagggccggtaccaccacaacctggacctgttcctgaaaatgtccaaggaggtagctggcactggaatgccgtgcgcgtcatagcaccaccagacggggtgcagagaaggccggcgacacgctgcgctggtcccagcgggtgatatgtttcttgggcacctgcttttgtgatgctttgagctgtgctgtagagtagacactggtggctgtggctgtgccatgtacctgtccaaactacaaaatgccttcacctggctgtaaagagagcacctgtcgacctgatgctttgtccaggcaaccatgctctatcatatcctgtagtaggagtattatctttggcaataatgttccaggcaagggcaaatatgtatcctcgggggaaaaaaataagacccgcgctgttaataaagtcacctcacgggcctaaaatatgtgcc

SEQ ID NO: 9409 - DNA, 888 bp, Sorghum bicolor
  Clone ID: SORBI-28MAY03-CLUS14387_1
catttttcggcaatgaacaagctcaagaagatggcgttaagggttattgcagaaagcctgtctgaggaagagattggaggcctcaaggagttgttcaagatgattgatactgacaatagtgggactataacatttgatgagctcaaagatggcttgaaaagggtaggctctgaattaacggagaacgaaatccaggctctaatggaagcagctgatattgataacagcggaaccatcgactacggtgaattcattgcagctacgttgcacatgaataagctggagagggaggaaaacttggtttcagcattctcattttttgacaaagatggaagtggctttataaccattgatgagctgtcacaagcatgtcgtgaatttggtcttgatgacgtccacctcgaggatatgattaaagatattgaccagaacaatgatggtcaaattgactacagcgagttcacggcaatgatgaggaagggcaatgctggtgcaacaggaaggagaaccatgaggaacagcttgcacttgaatctcggcgaactcttaaaccccagcaaaacctagctcatattggaaggccttgtcggggtacattctcttggcatctgaagtttttggatgcgttgtcgatctgcgatctgctggcctattgagatgttgagtggttgtcctgtggtagtactaagatgctggagaattttcgtagtactggtggtatcagctagagaagagggatggtacaatgtggttactatgatcaactggttatatatgtatgagtatcgatgtagattgaacatggtctaaacattacttccctagaagtataacttctctgctgtcaagtgtcagtttagttgatattaaatggcaatttttttctct

SEQ ID NO: 9410 - DNA, 732 bp, Sorghum bicolor
  Clone ID: SORBI-28MAY03-CLUS14478_1
gcacgaggaaaatcctagggccggcgctgccgcagcgcgcactagtcagaggacaggagtcgtccggaggtggtgccttgctgcttcctcttcctcgtctcgcctaccacgaacagatccatccaatactccaatccaagcacgccgccgatccaaccacgaagccatggacgccggaggcgactggcgcgcccagctccagcccgagcggcgcagcaagatcgtgaacaagatagtactgactctgaggaagcatctgccggtacaagtgccagaggggcaggggctggttgagcttcaaagaattgccgtgcgattcgaagacaaggtgtatgctgcagccactacccaggctgagtacttacggaagatttctctcaaattgctgtcaatgtggagttacacaaatacacaacagaaccctggtccaggtagtagcaccaaagggaagaagcaaaagaagttgagatgccatttctgcaagaaaggtggccatcttaagaaggattgcttgaagagaaaattatggtttgaaaaaaaaggagttgcttatgatccaacccataagcggactaaagcacatgagaataaaaatgaaggcaccgtattgaaggaatcaggaattgcagagtaatccttgtgtatgtatgtatgtatgtcaccgtattgaaggaatcaggaattgcagagtaatccttgtgtacgtatgagatcgtgtgttttctatcctgc

SEQ ID NO: 9411 - DNA, 583 bp, Sorghum bicolor
  Clone ID: SORBI-28MAY03-CLUS14511_1
actgtcctgaaggatccacctgttgttgctcggcgcgtggcttgggcttttgtctttcctggagctgttgtgaactggacaatgcagtttgctgcaaggataacaaatcctgctgccctcatgactatcctgtctgcgatacagatcgcgggctgtgtctcaaggccagcggcaactcttctgctatagaaggaatcaggaggaaacggactttctctaaagctccctcgtggactggcttagtggaattgatggaccattgagcatataatcagatatggatggaaggtccaagcaggtttttgtgcgatccgtaggtcggctagtggccttgttcaggtgccctgccacattcctgtatgtttacccgccgcattgcaccgagatgcctggatttgctctgtattattgaaccctgctctggtgtaaagtttcacgatcgtacatgtatatgtcagacttgtattagcctatgaattagagaggccctgcacggatgttttaccgcggttgaagactattgagggccaggcaccataataataaagaaatagaactttgtctaaaaaaaaaaaaaaaaaaa

SEQ ID NO: 9412 - DNA, 830 bp, Sorghum bicolor
  Clone ID: SORBI-28MAY03-CLUS1458_1
gccacgcgtccggggtgaagcttgggaaggcagcctatcaagagctgactggggtaaagaagccaaagctggatgagcagggcgtgctccactggcctgttcttctgctatacccagaggtcatgtcgagtgacttcattgaggattttccagatacagatactttcttgccccaccttgatgtaatgttctcagaaagttctccaccattgccatgggatgagaaccatgcttacacaagggactcagtcgaattgtattatcagggtggttttggcaaacctttgtccaaaagtgaagtattaagatatcttctagaaggcactgtagatttgaaggcgcttccagatagcctgcttgatggggaagatgaagaacatgacagtagcaaatgtagcactgttacatcaactgatggctccagtaagtggatcaaagtaaaagaaggaaaaacacttcaagaggtgctgcaggataaaggctatatcgttcctgcaattcctgtgttctttgttgtttcaagaaagtccaccttctataaagatttcaaggctggaaattggtctttgccatgaaacaaaaccggacactaaggttcagcttaaattgatcttggagatggcaacggagatggcaagaaagcggaagatgcccgcttgatcatggtcctttggtttaaaaggagtgtgcttctttcagtatctgcagactgacagtcttttgtttgccaccgtttttcttgattgatggccgaggatatgttaccgcgatagacagaaaacacaaggcaatgtaatatgaattcccttctggaccgattcagcgtttag

SEQ ID NO: 9413 - DNA, 962 bp, Sorghum bicolor
  Clone ID: SORBI-28MAY03-CLUS14641_1
ctggatcctctccttccctcacaagttctgcaagcgacgagacagagagaattgcaagcaagagcccccctagcgtaccgagctaggtagccagccaaagagacccggccggccggcctcgttcagtttgatcagtttctccgatcctcccgatccatggctccgatggccacggcaccgccgccatcctctgcaccgactccttccagtccatgtactctcagatgctgtgcggcctggtggcgcgcaccgaggtgctccgcgtcggcgccgtcttcgcgtccggcctgctccgcgccatccgcttcctgcagctccactggaaggagctcgcgcacgacctccgcacgggcaccctgagcgccagggtcgtggagccctccatccgggacgccgtggccgaggtgctgacgaagccggacgccggcctggccgacctcgtggaggccgagtgcggcaaggacaactgggagggcatcatcacccgcacgaggcccaacaccaagtacctggacgtcatcgtcaccggcgccatggcgcagtacatcccgaccctcaagtactacagcggcgggctcccgatggcgtgcaccatgtacgcgtcgtcggagtgctacttcgggctgaacctccgccccatgtgcgacccgtcggaggtgtcctacaccctgatgcccaacatgtgctacttcgagttcctgcccatggacgccgcggcgtccggcggcggcgacgcgagccagctggtggacctcgcccgcgtggaggtcgggcgcgagtacgagctggtgatcaccacgtacgcggggctgaaccggtaccgcgtcggcgacgtgctccaggtcacgggcttccacaacaccgcgccgcagttccggttcgtgcgccgcaagaacgtgctgctgtccatcgagtccgacaagacggacgaggcggagctgcagcccgccgtggagcgcgcg

SEQ ID NO: 9414 - DNA, 870 bp, Sorghum bicolor
  unsure (1)..(870): unsure at all n locations
  Clone ID: SORBI-28MAY03-CLUS23094_1
atctccgtccctccccccgcccgccccctccatcccccacaccaccccacaccacaccacctcctcgatcacctgcttcgtcgccattatttccaccaccacgtaccaccacaaggccggtcagatcatgaggctgagctgcaacggctgccgcgtcctccgcaagggctgcagcgacgcctgcaccatccgcccctgcctccagtggatcaagtcctccgacgcccaggccaacgccaccgtcttcctcgccaagttctacggccgcgcgggcctcctcaacctcatcgccgccgcccccaacgaggcgtgcggccccatcgtcatcccggtctacggctccgtcggcttgctctggtccggcaaccggcacgcgtgccaggccgccgtcgaggccgtgctcaagggccaaccagtcgtggcaggtcgacgccgccgccgcaccgccgctgatgctcggcggccgcaggttcgacatccgccatgtcgccaaggatcctgacgccgccgccgcggcagacctcctccgcgtcgcgcgtggacgcaagcgcgccgcgtcgtcgtcttgcacctcctccaagcccagcggcaacaagcagcggcgcgcgtcgactggcgacaacgacgaacctctgacgcgaaggcctggacaagaggcggaggaggagccggagccggtcgttgagcacgaccacgggcacgacgaggagtccgccggcagccacgaccaccaccacctgcaggcgcagcagcaggggtcggaggaggacaccgacgtggaggcggngttgaactcccactcccactcccactcccaagtgagccaagccgagcccgagctgcagagacatgcgccgccagccagcagca

SEQ ID NO: 9415 - DNA, 777 bp, Sorghum bicolor
  Clone ID: SORBI-28MAY03-CLUS23101_1
agcacactcaccagcaaaatccgagcctgcctccccgcccgcgcctgcctccccgcgcacggctcttcccgcccagcgccgccgccgccatgccccttgccctctccttcctccacctcccgcccaacactgcccctttccattccttccaagtccatcgcacccaccactcgcaccttcacctctccctccgcactcggcccgcctcagcgacggaagcagcgaacgaagcagagaacccgtccgcatcggcggacgtcgagagggtccgcgggcgggacggcgtttggacggcgcggtccccaactgtggtggtgctgtgggacctcgacaacaagcccccgcgcgggccgccgatcccggccgccaccgccctcatcggcgctgcctccctcctctgccgcgttgcctcggcctcccccttcgccaaccgccaccccttctcccatctccctgcctggggaagcgcccagcgcgcccaccgccgcgccctccaccccgccgaccgcgcgctgttcgtgccctcctcctgcgccttctccggccccgctttccacacccggatccatctcacccgccacttccgccacctcctccgccgcctgcgcgaccgcgagcgctcccgcctccgctcccgcctccgctccctcaagggcaagaagcggcagaagttccgcgagcggttcatctccggcaacaccaagtacgaggacgccgcgcgggagctcctcacccccaaggtaggctatgggctcgcctccgagctccgacgcgcgg

SEQ ID NO: 9416 - DNA, 1009 bp, Sorghum bicolor
  Clone ID: SORBI-28MAY03-CLUS23562_1
aagacaagtgtccaaaaggcttcgtcttcggcctatatctccatcgtcattcagttgagcggcggcgcactgatcactcacactctgccagcatccatccaggcatccacggctaggcgtctcatcgtcgatccatccaccatggccgccgccaccaagaccaagatgatgaacggcggcgccaacaactccagcagggaggagtactcggagcagccgcagcacactgagtcggagtgggaggccgtgtcgtccctgcttgacgccgctcgtcccttcctccgtggcgagctgggttcggcggaggacccggagctgccatccctggtggcggtgctgcgcgcggcgggcgccggcgagtgctaccacaagcacggcacgttcctggcgcacctggaggacgtgtaccggatcctccgcctgtggggcgcgtccgacgccgtggcgcgctgcggcctcttccactcctcctactccaactcctacgtcgacctcgccatcttccagcccgacaccggccgcgcccaggtgaggggcatcatcggcgccgacgccgagcgcctcgtccacctcttctgcgtcgtccccaggcaccacctcgtgttccagcagctccagccacggtacacggaccaggagctgagggaccacctcgccgccgccgaggccgaggccgagatcgcccagcagccgggcggcttgctgacgacgatgtcgccgtggcggcagaagctccggtccgtggtgccggcccgagggcgtggtggtcagtcacatccggaccggggagcccgtgcggctgtcgcgccgggtggtggcggcgttcctgctcatgaccgtggccgacttcagcgaccagtacacggactaccaggacgatctgttcgacaacgatgacggccgcctcgagttccgcggcgacaactgggccgcgctgtggcccggcaccggcaagccggggctctgggtcagcgccatgtccaggctggcggcgctctacggcctcatc

SEQ ID NO: 9417 - DNA, 662 bp, Sorghum bicolor
  Clone ID: SORBI-28MAY03-CLUS237_1
agattggtgcagggatgatccttaaacaaaacttaggggccaggggatggcttttcttgttggcggtggatcagtcatgcagaaaatccttgcaccccgagaggttattactgttgatgctgcttgtattgtggctatgacaaccaccattaacttccagttgaagaaccctaaccagcttagaagagcagtctttgggggtgataaccagctaacaacatctctcacgggaccaggtgttgttttcattcagagtctgccattccatcgactctcacagcggatcgccagtagatcagtggcgggcccaagtttgagggacaacccgaagttcttcatccagattgtcatgttcttcttcctggcctatgtcatgattgtatcatccataattctgacagatgtttaggcggttcagcgagcttttgatgtattcctagacaagttatcaaagagttaaagctacctctccaatgttaatgtagatgtaagagaaggaatttcacaaactgttgttagaaaccttagccgaaagttcttcaatttttttttgtaacagtttggagggagagcgggtttcttcttggttagcgtgtaaagagtaagacagcaaaatcaagttgcacagcatatggtgaatatacagtaacttatcctcctct

SEQ ID NO: 9418 - DNA, 1052 bp, Sorghum bicolor
  Clone ID: SORBI-28MAY03-CLUS23784_1
cggccgctcgagccggccggccgggacacctgcgcactgcattcatcgaacacaataaacaaaagagaacttcccagcgggcagcgtcctcctcctcctccttcccctgccgcctccaggccccagatctcagatccgagtagctccggccctgctccaatggcggtcaagatctacgtcgtgttttactccacctacgggcatgttgccaagctagctgaggagatcaagaaaggtgctgcgtcagttgaaggcgtggaggtcaaaatatggcaggtcccagaaattctatccgaggaggtcctcggcaagatgggtgcgccacccaagaccgacgtaccgatcatcacgccgcaggagctcgctgaggccgatggcatcctcttcgggtttcccacacggttcggcatgatggcgtcacagatgaaggccttctttgacgccaccggcgggctgtggcgggagcagagcctggccggcaagcccgctggcctcttcttcagcactggcacccagggcggcggccaggagaccacaccgctgacggcggtgacgcagctgacgcaccacgggatggtgttcgtgccggtggggtacacgttcggcgccaaaatatttgacatggagagcgtgcacggcggcagtgcgtacggcgcgggcacgttcgccggggacgggtcgcggtggccgacggagttggagctggagcacgcctttcaccagggcaagtacttcgccggcatcgccaagaagctcaagggcggctccgcctgatccgccatggccttgccatactcgcacgtatacacctatacatacataattacacatacacgacgacgagtgatatcatacattcgacgttgtcgtagtggtgtcggttgtattgcttgtgtgaaatttggtactcggattgtgcatttgcccatgtactgtgttcctcttgcagtttcgcttgctacttttttttttttttgagtggaagtctcgcttgctactgaatggaaaaaatgtattcatcacttaggcccacttaggccttgtttagtccc

SEQ ID NO: 9419 - DNA, 1443 bp, Sorghum bicolor
  Clone ID: SORBI-28MAY03-CLUS1470_1
gcacgaggccaaaccctataccccgcctcctctcctctcctccccgattgccggctcagcttcctcttccctgtcgacggcgaggactacccttcgcgctccctcgctcaggcctcgctaggcgatcacaggcggcagggagacccgctcgcgccgacgagcccagcggcggcgcggtaattaagcaggagaggaaccggcggcccgagcggcggggtccaaaatgagcgacgacgtgatatggcactgcatccgccacaaccactgcagcttcatggccaagatcacgacagggatattctgccgcaacccctacaaccggacgcgtaagcggacccggagccatgctgagcttgctgcacgccgctatgttactatcgaggagcatgacggtgttttctatctgtacatgaaaactgctgaaagagctcatctgccaaacaaattatgggagagagtcaaactgccaaagaattacgagaaagcaatggatgtcataaacaagcatcttgaattttggcctaagttacttgtgcacaagatcaaacaacggctgacaaaaatgactcagtatcgtataagaatgaggaaacttcaactgaaagtgagggagaaggtcatgacaatgcccaggaaacaaacacagcgtgatctccggagattagacaaagctgaaagggctgctcaactagaaaagaatattgaaaatgaattgaaggaacgcctgactaaaggtgtttatggtgacatctacaattatcccttcaaagcgtttgatgttgttcttgatatggaaaaaggtgaagtggctcctgaagaagaggaggaagaagaaggcgagatagaatatgtcgaaggtgatgatatggaagagatggatgatatggaagatatggaagacttcgaaggcctcagtgacggaggcacagatgaagatgatgttttggatgatccagtatcaaagaaacccaagggatcatcttcttcgaagcaaaacgccgggaaaaggtctaggaaggttatgactgaggtggaacaagacgaagagataaatacgaggcagaggcgaagggcatgaatgtgaaatctgcaaatgtaactccagttctatggtgttagatgctggtagccacttttgttgtatgttagatcattctacttgccttcatcatactgtaacgtggagaattcatctgtggtccctgttgagaagttggcgaataatttgtcgtggtttacatcattatacattgctatatgttacgaggaaaaaaacggattctagcttagttgaggatgtgggagaccatctagttcccgaggcgaatttaggtatctattttgtaactcattcattggtcaagttttgtttttgttatgcggaaaaccaaagtcctgcgtttacgaacacatttacacattggtatcgaagcaacctgatgc

SEQ ID NO: 9420 - DNA, 821 bp, Sorghum bicolor
  Clone ID: SORBI-28MAY03-CLUS14810_1
gccggccgggccgggttttaggaggatgccgggcggggccggaatccacgagagttcctccacacccacttgtattgtcgcccatcaaggtttgctccctgcaggttcagccgtacctggtgaaacaagatcagaaagatggcagtgtctcgcggagcggtgctcttcttatttctccttctcctcgtcgcggcagagatgggagccatcgtcgtcgatgccaaaacgggagtggccaaggagaccttgttaaaggacgaagtgaaagaggaggaagatgacaaaagcaaggagaagaaagagagaatctgcttatcaaagagtgtcctattcgagggtttctgcttcgatagcgacaagtgcaacgaggtgtgcaagaaggagagctttggcggtggcgagtgcaagctagacacgatcaagcgcaagtgtttctgcaagaagccatgctagttcatcggtgtctttgctaattgttgatcgatgtgtgctccactcatttttgttggcctttatatctctccagaaacaatattacgacttttggtaaatcccgatcatcaaaactgattttgcagttctttttttatttagcgttatgtactggttttggggctccgattgcaagaagctatacaaattttttgcctattgtaaaatggacatttatattattatgatttggtaatactaaaaaactaaaaaaaaagatgcctcttttaaattttttgtgggtgagttattgtagtagctatggctaccttctttggaatggtgggctcctttctttgatgagattaaagccaaaggatattccatat

SEQ ID NO: 9421 - DNA, 766 bp, Sorghum bicolor
  unsure (1)..(766): unsure at all n locations
  Clone ID: SORBI-28MAY03-CLUS14698_1
gccggccggtccgggaaaacccacagcggcgcctcctctcccgtctcttccgttcggtcaagcccagcccactccgccgtcgccgcccgcgagaggagtccgcttcatccgattcgccgcctcaaggacgagatggacacatcaagccctgcagcacttgtcaatgcagagactctgaacatgtttgttgggcgaagagtgcgcacggttgttcaagtccaacgcaatgaaggtggagtggttgtcgggcagtccagcgatgggcatcagttgagtatcaaaagtgccatggacgtccctgtatcaaactttatggaggtttatggaattgctgaaaacaaccagaccatccgtgctgaagtttgcacagattttggtcccaactttgatcccaagccttttgatcagttgtgcaagttggcgagtgacaagttcaagcacatgttcctgtagaggtcatcatcgcatggaggacctttgcccaactgaagcttgtttgaaattgatatgattcgcctctaaatgttaccccagtactctgttacttgtcagtattggactcctattagtatgtattaacctaagcaacatactacggagacaagcataatatatcatgtagttgaagaactatgtttgtttctacttttaggcaatccaaacctaagcttggtatgttgctatcatttgtacttggaccctgagaagttgctacaatggccatgcagcttgatgagaggaaaaaaaaaaaanaaaaaggccccta

SEQ ID NO: 9422 - DNA, 510 bp, Sorghum bicolor
  Clone ID: LIB5052-008-A1-XP1-F11
gccggccgggctgcgagatgggcattcagttgagtatcaaaattgccatggacgtccctgtatcaaactttatggaagtttatggaattgctgaaaacaaccagaccatccgtgctgaagtttgcacagattttggtcccaactttgatcccaagccttttgatcagttgtgcaagttggcgagtgacaagttcaagcacatgttcctgtagggtcatcatcgcatggaggacctttgcccaactgaagcttgtttgaaattgatatgattcgcctctaaatgttaccccagtactctgttacttgtcagtattggactcctattagtatgtattaacctaagcaacatactacggagacaagcataatatatcatgtagttgaagaactatgtttgtttctacttttaggcaatccaaacctaagcttgttatgttgctaaaaaaaaaaaaaaaaaaaaaaaaaaaaaaaaaaaaaaaaaaccaaaaaaaaaaaaaaaaagggccccta

SEQ ID NO: 9423 - DNA, 1209 bp, Sorghum bicolor
  unsure (1)..(1209): unsure at all n locations
  Clone ID: SORBI-28MAY03-CLUS14736_1
gcacgagggtgcaaccaagtcatgtgtttgctaaccatggtgatgcattaaggaggatgcggctacaggttgagtgtagggaggtcataactaaatatgatagtgaagatgaagtatcatgtgttgtaactccagactgtcccacgcgtccggttgagtccactgcagtgaaggatgtggtttctgatggggatgaggctgagtcaacagggattgttattagaagccgtcaccctgctccaagttcaagcctagagagttcattcactcaacagggaactgctatgcgaaggctgcggctacagtcaggcctcaacaaaggcctgtgtcctagtagtgatgattcatcaagctgcatcatagacgaatcagaaagtcagcacaaaacagagaaagcagagattgaagaggatgcaagtacaaacctcactggaagtgttgatgatctacctggcaatagctatgatgatgagcaaaagaacatctctgaacatggtgctgaaacggctgttccagaagccaaatctgttctgaggctgcggaagacttctgaggaaagcaacaaggatgtcaagcagcaggagggttgtcttgagccacacgtgagagcaccaatgcagaggggaggattccaatcatacatcatctggctggttcttttggtggctctgctgctgctcctctgtgtcggggcgtatggatgggtataaaatctatcctggtgcggtgcaaggcatggtattttgcgcgcatggattcgtggcatcatcagtctggtgcgtggtcttttgtacataacctgggttacggcatgtgtccaacagccgtaagaaatcccagaatgccaaggcagctgaaaaatcaaaaaagagaggtagcaagtgagaagtgagaaaaagaaaaaaaaaaagagaggttatcgtaggttttagtacatcgtagtctttttttgctgttgctgcagatgtcttactaatgtcatagctgttgtgtagttgtaaatcatgccctcggtggccggttttttaatttcctgatgtaatgtagcaagagcaagacactgttagatgggtgccccgaacctcggtaatatctgatgtttcttcttgtagatagctgtttcagaattttcggttcctgaaccccgttactggtggcttgtttatntgttttnctgtgttgctatttgacgggattattgtggcgagt

SEQ ID NO: 9424 - DNA, 524 bp, Sorghum bicolor
  Clone ID: SORBI-28MAY03-CLUS14872_1
gctcgccgggaacgatgatggtgaaggcgggcgcggtgctggagcacccggtcgtcgtgtcggcggcggagaagctcgggaagacgccggcgcaggtggcgctgcgctggggcatccagatggggcacagcgtgctcccgaagagcaccgacgaggagaggatcagggcgaacttcgacgtctacgactggtccatcccggacgaattgttcgccaagttctcggagattgagcaggagaagctgattcgcgcgggcttttttgttgatcccgaaggcgtgttcaaatccatcgaagagttttgggatggcgagatctgaatgggaggagctggagtgaggaacttggccagacgtacggggaagaataaatttatgcgtatgaaactgtcaaagacagcgtagttttcgggtacttggtatttggtactacttggtacttggcatactttgtactcccaataattttcggtcgtctttaaataatactaatactaatattcaatttgaaaaaaaaaaaaaaaa

SEQ ID NO: 9425 - DNA, 921 bp, Sorghum bicolor
  unsure (1)..(921): unsure at all n locations
  Clone ID: SORBI-28MAY03-CLUS14959_1
gtggtgtttctgaaacacttgtgcttaacatgtcaactctaacatggtcagttgttagcactgtggaaggacgtgttcctcttgccagtgagggcatgactttagtgcatagcaattacagtggttatgactatctcatctcttttggaggatacaatggacgatacagcaacgaggtttacactcttaaactcagtctgaaatcagattcgcagtcaaccgtaaatgaagaaactgtctcagatactacatctagggtcatagaacctgaggctgaaatttctcaagatgggaagatacgggagattgccatggacagtgccgattctgacctgaataacagaaatgatgaagcaagtgaacagcttatagcagatcttaaagctcagaaagaggaactagaagcaacacttagcagggaacagctgcaaactgtgcaacttaaagaagacatcgcgcaagcagagaccagaaatgcagagctgacaaaggaacttcaagctgtccgtggccaacttgcttctgagcaatccagatgtttcaaacttgaggttgatgttgcggaacttcgacaaaagcttcagagtatggatgcgttggaaaaggaggtcgaactgcttcggcgacagaaagccgcttctgagcaagcagcgctggacgcaaagcagaggcaaagttctggtggcatgtggggttggcttgctggaagcccaccaccaacagtttagttcgtacaggccgtgattcatatattttacttgtaacattatatatcatttgacattctctacaattttttgtcacttatggcattcgtgttcattttgcccccccagaataaggtgctctggcgtgttcttataganaaatcgttatccctgatatgtacagcatattagcaaagttggttttttgagctgg

SEQ ID NO: 9426 - DNA, 575 bp, Sorghum bicolor
  Clone ID: SORBI-28MAY03-CLUS14221_1
agtcagctcaccaccaccacctataaaatcacctcctccagtgagatcaccaccgcccccgatgaaatcccctccaccgccaactccggcaagatctccacctccaccagtgaagtctccaccaccaccacctccggtaagctctccaccaccaccagtgacctcaccacctccaccaacacctgtgagctcaccacctcctccagtaaagtcccctcctccacctgcaccggtcagctctccaccaccacctgctctagtgagctcaccgcctccaccggcaccatcattaagtccaccaccggctcctatggaagtcatcttgccaccaatcatggcgcagaagtacgcgtcgccgccaccgcctcagttccaaggatactaagcggtgatcacagcacgctctactgacaatgagagtaatcgtgatgaggaggccaggagaagcagtgatcagttgatcgcaccatgcatgctctagcgacgtgaattgaaagctcagatgagtgcatggtacgtgcgtgcgtttgtgtataagagcataggtaacgtacgcatgtactagcgcatgcaca

SEQ ID NO: 9427 - DNA, 388 bp, Sorghum bicolor
  Clone ID: LIB3480-029-P1-K1-H8
ccacctgtaaaatcacctcctccaccggctcctgtgatttcaccaccacctccagtgaaaacccctccaccaccggcgccagttagctcaccaccaccacctgtaagatcacctcccccgccagttccagtgagctcaccacctccacctgtaacatctccacctccacctccaccagtaccggtcatatcacctccaccgccaactccggcaagatctccacctccaccagtgaagtctccaccaccaccacctccggtaagctctccaccaccaccagtgacctcaccacctccaccaacacctgtgagctcaccacctactccagtaaagttcccttctccacctgcaccggtcagctcttcaccaccacctgctatattgagct

SEQ ID NO: 9428 - DNA, 616 bp, Sorghum bicolor
  Clone ID: SORBI-28MAY03-CLUS14304_1
cttcctgcattgctacggcaagcgcgacgtctgcgacgacgacggcggcgccgttgccgccggcgatgccacagccaccaaggagctatgaattggatgatcaaatcaattcaatcaggcgatggccgacgacctccaaacaatccaaatccccctgctctgctgctattgctgctgtaatatttttgtaaatataggccccgtccggcccggcgacggaaggaggagaaattaaaccacaaccagccaaccaaaaaaaagaagaacaagataagggatggatgacggcgatcgattccatagatgtgatgatgatcctccgttcttgcaagtttgcattttttgcaggagggagggagatcatcggatcgaacgcaatgtactaatccctgcttgtttgcttagttttctttttttgatgattactactactagtcgtccgtcgattcttgtgttcattcaatcactgtacattggtacgggtaaacactgaagaacatgagaatgggagaagaggaagaaaaaaaatacgccacgaagttttgcaaaccgagaaggaactgctcctgttcctgagcctgttataaaaaaacggtcgcgtgggtcttgttcgcga

SEQ ID NO: 9429 - DNA, 881 bp, Sorghum bicolor
  unsure (1)..(881): unsure at all n locations
  Clone ID: SORBI-28MAY03-CLUS14287_1
gagcgctaagaaatcggtccctggtgagcctaacatatcgtacatttgctcgcggtattatagggctcctgaactaatatttggagctacggagtataccactgcaatcgatatctggtctgttggctgtgtantgnctgaacttctgattggtcagcctttgattgctggtgaaagtggtgttgatcaactggtggaaataataaacattttgggttctccaacaagagaggaaatcaggtgcatgaatccaaattattctgaattcaagttccctcagataaaagcccatccatggcacaagctttttggtaagcgcatgccacctgaagctgttgatcttgtgtcaaggctacttcagtactcaccaaatctgcgctgcactgcggttgatgcttgtgcccatccattctttgatgagctgcgggaccccaaggtctgcttgccaagtggacggccactgccaccgttgttcgacttcacagcagccgaactcgaagggctcccaattgagctggtccatcggattgttcctgaacacatgaggaagtgaatagggggacgcactggaaatcccagtttctctgttagttcttctgagacgcgcagggcatgctatggggccgctatggaggagtgctgtagctagcgaatgccttgctagatgtaaagagggctgaaagttccttgattgggcgtgtcaccaagactagagtgaccgtagaggcaaaccttatgtttgcttgttgcccatggtggaatcggcttgtacctttcgcatcgttatgttgctgtgtacccagacgtgtatcgataacttaggctgttgtattaccaggttcatgttgaacaagagaattcagagagtgcttgttccttca

SEQ ID NO: 9430 - DNA, 377 bp, Sorghum bicolor
  Clone ID: LIB3480-033-P1-K1-F9
aatcgatatctggtctgttggctgtgtagtggctgagcttctgattggtcagcctttgtttcctggtgaaagtggtgttgatcaactggtggaaataataaagattttgggtactccaacaagagaggaaatcaggtgcatgaatccaaattattctgaattcaagttccctcagataaaagcccatccattctttgatgagctgcgggaccccaaggtctgcttgccaagtggacggccactgccaccgttgttcgacttcacagcagccgaactcgaagggctcccaattgagctggtccatctgattgttcctgaacacatgaggaagtgaatagggggacgcactgaaaatcccagtttttctgtagtttttt

SEQ ID NO: 9431 - DNA, 837 bp, Sorghum bicolor
  unsure (1)..(837): unsure at all n locations
  Clone ID: SORBI-28MAY03-CLUS14349_1
gccgccgggacccccacctcttctttcccctctctctcccctcgccgtcgcggtcgtcgccgtccgtgcgagccatggatctaggcgctacccgccgagggcgcctaccgatccacctcttgttggcgtcgctcaccgtcctcgtggtcctcaccgtgcgctccagcgccgaagtcatcactctcaccgaagagaccttctccgacaagataaaggagaaggacacaatttggtttgtgaaattttgcgtcccctggtgtaaacactgcaagaaccttggaacactatgggaggacctgggaaaggttatggaaggtgaggatgaaattgagatagggcaagttgactgtggtgtcagcaaaccagtatgctcaaaggtggatatccattcctacccaacattcaaggtgttttatgaaggcgaagaagtagcaaaatataaaggacatagggatgtggaatcactgaagaacttcgtgttgagtgaagctgagaaagcaggtgaggcgaagctccaagctgattgaggcagggtactttcagcaagcatgtggcgcagacaaggaacaatgctttgcaacactgtcctgtatcctggcatttacaaagccattttacaggaaagaaatgaccttgtatctgagtattcgtcttcaaaagtacaagtccgaatcagttcatgaaagctatactccataccataggtttcatcacatttttgataaacttaagtaatgattagaatgcaacgatacaaaggtctgtttgtgtcaattgcgcatctcccaacagntaaactggtgggtgaatgtaaattttgcngcatggtggaactgc

SEQ ID NO: 9432 - DNA, 664 bp, Sorghum bicolor
  unsure (1)..(664): unsure at all n locations
  Clone ID: SORBI-28MAY03-CLUS15235_1
gctncaagtggttgctgaactggagaagatgaaaggcatgaccaaggaagaggcagctgcctttgctgccaaggcagttgcggaggcagaagtagcaatagcagaagctgaggaagcagcaagagttgcagaggctgcagaaaatgatgctgaagctgcaaaggcttttctcgatgctgtcactttatcaatgagaagcaggaatgctgcttccgtgatgcttcgagcttgctgatcctttacccatgccgtcatatggttttggccagcagaacactggtgttctgctgcaaagattttctggatagatgagtttcttgtatagccttatagatcgtgacgcatcaacgggaggggttttcaacatcttgctgctggtcctgtgctgtgcagccaatctacaatggacaatatgataacaagaatgatcgggaaagtagtcttcaattttttttgttttctccccattgtgttgctttgtaattaaactctagccttttcccttaattagttgatgaagtgaattgatgtcgtctaatagaacaactgtagtgaaaagaaaatgtcagaaagctgccatagttaatgcaaattgctgtgatactatgtttctagatatgtttatctgatgacagcgttcgagataaaaaaaaaaaaaaaggaa

SEQ ID NO: 9433 - DNA, 606 bp, Sorghum bicolor
  Clone ID: SORBI-28MAY03-CLUS15300_1
gtgcgggggcggcgctcgaggccggccgaaaagaagaggaagcaagagtcatttggagaaaaacaatcttttttttttgtaaattcctgaagcgtgcatatatttctgttgagacaaggtaatggagtcgtcacgtaagatccagccggtcgtcatcctgcttctcctgctcattgtggccaccggtatggcgccggcggcggtgcaggcgagggaatgcgagaaggacagtgagagatatgttgggatgtgcacgtccagagtgaactgcgccaacgtgtgccgtggtgaaggcttcatgtctggcaagtgcagcaccttccgcgaccgctgcatctgcaccaagccgtgctaattaaaccagagagcgatttgcatgatgcgcgtgcctgcgactgctgctactcgatcgtctcggcatttcatttttcgatgatgggcttgtgtattattaattaatttggtttatttatttgttccaacaatagaacatactgctcctggcaaggagatctatgcttgcttgctttattactcataattattaaagaattttaagtgtcgaaaaaaaaaaaaaaaaaagacccctaaaaaaaagggccccta

SEQ ID NO: 9434 - DNA, 1189 bp, Sorghum bicolor
  Clone ID: SORBI-28MAY03-CLUS15329_1
gcaaaagcgctctcccggtcccggctcgttctcgacctctcgtctcgctctcgcccgcccgcccgcccgaccgaccgaccccgcggaaccctagcctagcctcgcctagactttccccgaccgcgaatcccccccggccgccgcgacgatggactgcgccgtaggcggagaccccgtggaggacttcctcctcggcggcgccggcgacgacggggatctcgccatcttctgcgacggaggacttgggattgagggtgtcaatggagatgcttgtggatttgaccaatctaatttagggaaaaggggtagagatgagccatcttcatctggtccaaaatccaaagcttgtcgtgaaaaaatgaggagggacaagctgaatgacaggtttctggaattaagttcagttatgaatcctggtaaacaagcaaagttggacaaagcaaacatcttgagtgatgcagcccgtatggtggcacaacttagaggtgaggcagaaaagcttaaagaatcaaatgagaagctgcgggagaatatcaaggaccttaaggaggagaagaatgagctccgtgaagagaaagtgagactgaaggtagaaaaggataggctggagcagcaagtcaaagctatgagtgtagctcctacaggatatgttccccatctccctcatcctgcttcataccatcccgctgcttttactccatttgtgccgccacagcaagctccagccaacaaaagtgctccaatccctgcaccattccctgggatggcaatgtggcagtggttgcctccaaccatcgtggacacaactcaagatccaaagctctggccgccaaatgcttaggggcagggcagctaccttggaatgctgacgcgtcgtgccgtttcatgcattgggtggaaaatcagagtgtcagttaggtccctggagaggaatctagtgcgcaactcgcgtcatatttatgctgtaacagttgttcccagcagtcgttatcaacttactttgttctattgaagggtggcgcctgtaattaatatatggatcttaaccctctagttggcaaatatttccttgtcccatttgtgagcgtgagctgtggaggccgatcctgttcttggtttccaatccttagcttgtgaacacatgcatagcaggaaaagaacttgatgaattcaatctttaaatctctct

SEQ ID NO: 9435 - DNA, 1115 bp, Sorghum bicolor
  Clone ID: SORBI-28MAY03-CLUS1539_1
gcacgaggaaaagggttcaagattggtgttatttgtggcatgatcggtttaacagtatgaagccgtggccatcggaaggacgtttgctgccatgaaggactatcagatagatggaaacaaagagatggtagcacttgggacgatgaacatcgtaggctcaatgacgtcctgctatatcgccacaggttctttctctcgttcggcggtcaatttcatggctggatgccgaacgccggtatctaacgtgattatcccacgcgtccggcttcttaccttgctggtcatcacaccactgttcaagtacaccccaaatgcgatcctgggttccatcataatttctgctgtgatcggccttgtggactatgaagcagcaattctcatttggaaagttgacaaaatggatttcatcgcgtgcatgggagcattcttcggtgtggttttcaaatctgtcgagataggtctcctgattgctgtgtcaatctcgtttgccaaaatacttcttcaagtaacaagaccaaggactgtgctgctcggaaaccttgcaggcaccacaatttacaggaacaccgagcagtatccacatgcaaggcatgttcctggggtggtagtagtgagggttgattctgctatttatttctccaactccaactatgtccgagagagaattcttaggtggttgacagacgaagaagacaaagtcaaagcagatggactgcctaaaatcaatttcttggtagtagagatgtcacctgtcatagatattgatacgagtggtatccatgcccttgaagatctgtacaagaatcttcagaagagaggcattcagcttctcttatcaaaccctggctctgccgtgattgaaaagctccactcatccaaactcaccgagcacatcggaaacaaccatatcttcctcacggttgcagacgccgtgcgtttctgcacttccaagtcgatgcaagagccttgaactgaaacagatttacgtccggaatctgttctctagtgtatatgcgtcatgtatgatgtattcacgtaatgagtatatatgcaagattacgaatggtaggaatagttttgaaggcgatagtattcaatgaacttttttacagaca

SEQ ID NO: 9436 - DNA, 761 bp, Sorghum bicolor
  Clone ID: SORBI-28MAY03-CLUS15408_1
ctccgtgaaatgaatgagctccctattggtgattctggtgatagtgctgctgagaagtcttccaatggtgttgttgacacagcgagttgttctgatagagatgagatatctgatcttgatctagatgatgatgatgatttcactgaagaagaggctgctgttgccaagttggttattagtgtggcatccgattccctggttgtagtgaaagaggcaattcgtttcattactggtttgctcaagagctcaggtaacaaagatggggctaatgaggacaaagttgagccaatggaaaaattgctgagccattgcaaggagattgccgaccaggtcaatgatctaggggcttctgtatacccaccacaagactcatctgagatgaagctcgctataaaaagactgtacaatggcatcaatgggatgcgcaaggaagtagggaaccttggcggctcacctgagagcacctttgcagcccttgaaggatttgaaaagtgcattggatctctacaggcaaagttatctgatgatgtggcgaacgagatggaaaatcttaatattagctattagcacgtaatgttcagatttgttatagcaatgttatgccggtatatcttctgattttgcacaatggatggagcttttcttatttcagtaaatgagccattgattgtaaagtaagaaagtgggcttggtttgctgtaacttctccagttagtgatgtcactattacgggtcaatgattgagcggataagattgtttc

SEQ ID NO: 9437 - DNA, 752 bp, Sorghum bicolor
  Clone ID: SORBI-28MAY03-CLUS14599_1
cagcgccagcagcagaaaaaccgcgcgtcgccccaaagccttcaactccagcaaccacaagctatactgatcgcccatatgtctgcccctacgaaggttgcgacaaagcatacatccacggttacaaattgaaccttcatctaaaaactcagcaccctgaacacggccaagaggaaaatggtaaggtcggtgcttctgctggtcatcatgctgcgaatgaacagacctaccagtataactatgctgaggttggtgagattgcaccaaaccccaaaaggagcaagcataaggtccactcatccaaagcctacaatgccaaggtctcgagagcgatgccttctgacatcggtggtgtcaggaaccagtggccaggtaaagctacgtaccaagatgatagtgaagagaccgaagaagatgggggccacaacattgaagatggctggagatatggcaacaatgatgatgatgaggaaacaccagatgaagattgatctttatttaggtttggacatgtagatagatgatgtggtctgttaccctttagtttctgcaaactctgaatcaatgcagtcatggggaagttcaagctttaaccttaggtagtagttcatttagatagtgcatcgatatattctactcagttatctgctcctaaatgttcactcccctatgttccagagtgactaattgccacatctatgtgagagtttgaatatgttttcgttggaataaattttcattggaatgtactc

SEQ ID NO: 9438 - DNA, 943 bp, Sorghum bicolor
  unsure (1)..(943): unsure at all n locations
  Clone ID: SORBI-28MAY03-CLUS1461_1
gcacgaggctactcatacgacccatggaatcttgaaagtagtggcagcacgcataggggactgctgttatttttccgcccactaccggaggcaaggggcgtcgttccggtcaaaacaccctcaggttactggaaagtcacaggtctgcctgggtacatctactcggatgaaagacttgcagttgggatgaaaagaacgatggagttctaccatgaccacttgacatcaggtaccaaaaccaagtggaagataaaagagtttacagcatttcagcatgccacagctggtgaaatctgcacgcccatgatgccaagaagcgagatgagcctgtgtcaactgtacacggaattggcagcgaatcccgattgcagtccagcaggtgtccagtatgatgaaaaattgtccgtcaaacaaaataaaattccagcagaggaaccatcagtagaaagtgacattgttcaaacccgcaaacatgctgataagaggaaacgtagggtggacgagaccacaaaaactgtggtaactattgccagccctgatgtgaacgacggctacacctggaggaagtacggttcgaaacaaatcctgggctcaaactacccaagagactactacaagtgcacgcaacgaagaggctgcccggcgaggaagcacatgcagcgccgtgacggcgagccaatactctacgacgtgtgttactttggagagcacagctgcgatcttcagcaggggcactccagtgagcagggatcagaaacaaatacaatatcaggaggatgggaagcagcanggctaccattatcggtaccacacgcacatggaataagttctgtggaggccatgataagcagcggcagcctcaccgcgcgccccaatccagggtctcctccttgcggccgcgtccatggcacgagccaagtagtgtgagcaaccctgacgacat

SEQ ID NO: 9439 - DNA, 690 bp, Sorghum bicolor
  Clone ID: SORBI-28MAY03-CLUS14632_1
agctgatcaatcacctgatcgtatgatgtccccttcagaagttgaacttctgccaggacttgatggtatatgtactgaactattgcaagaggatggtataacagatgtacagtttgggcgccaagcatcggagaaacgtgttgtttcacaagatttggagctttggctttccaatgctccagctaaggataacaagttcacacttcttgcacgagctgggaggcaggtccaggaagtgtatttgaccacttcgctagaccaggagggcataaagaaagctgtgcaaagagtattagggcgtgttccttgatcctgacacgcagcatgtacaaaccgaggtgtgtttgtcctccccgattttctaactaaagcattacaaggaatcaacagtatgagcaaatagcccaaaacatttggcactgtcagtctgtcacaacatccggctaaatttttctctattggatactacaccaaccaaaatgtgtaaatattttcagtcctacacgagtaggttaggcaccttgggccatctctttaaacaaagatgtttgctaagcagtggttttgtgtatttgctggggtctgccttttgatgccctgtgcacttgtcatactgtgacagttcaatgcttgtacttgtctgaactcttgaggcaatttgtgtatatgagtatatgtaagttttgtgtc

SEQ ID NO: 9440 - DNA, 460 bp, Sorghum bicolor
  Clone ID: LIB3480-022-P1-K1-H7
gtcgaccaggcggcgctgaccggcgagtcgctgcccgtcaacaagcactcggggcagggtgtcttctcgggctccaccgtgaagcagggagagatcgaggccgtcgtcatcgccaccggcgtgcacacattcttcggcaaggcggcgcacctggtggacagcaccaacaacgtgggaggcaggtccaggaagtgtatttgaccacttcgctagaccaggagggcataaagaaagctgtgcaaagagtattagggcgtgttccttgatcctgacacgcagcatgtacaaaccgaggtgtgtttgtcctccccgattttctaactaaagcattacaaggaatcaacagtatgagcaaatagcccaaaacatttagcactgtcagtctgtcacaacatccggctaaatttttctctgttggatactacaccaaccaaaatgtgtaaatattttcagtcctaca

SEQ ID NO: 9441 - DNA, 1144 bp, Sorghum bicolor
  Clone ID: SORBI-28MAY03-CLUS14686_1
gcacgaggccaaaaccttctagattttttccccggccgccacggggctctgggagagggcccggtccttcgccggcgaggcggcgaagcggtcgcaggagctctccgcggaggcggccaagcgctcgtcggcgctagtctcggagacggcgaagaagtccaaggagatcttctccgagaccgcctccaagtcgcgggagatcgccgccgaggccaccaagcaggccgacctcctcgccggccagatcatgcacctcgcctccgacctccctgtgccctcgatcccgcccatccccgcgatcccgcctatcgccgccgccgcctcgtcggagtccgacaccgccgagcttgagcgctacggcatcaccgacgacctccgcgagttcgtcaagggcatgaccttaagcaccttccgcgacttcccactgcaagatgagccggagatgtctgatgtgccaacggtgtcgaatgtgcgtcaggatctgaacgagtggcaggccaggcatgccacacttgtcctctcggcagtcaaggaaatatcaaagttcagatatgagctatgcccaagatacatgaaagagcgcaaattctggcgggtatattttttgctagtaaacagctatatagccccgtttgagaagaaatacttcgaggagctgaaagtgaaagcagaggaagagaaaaaggattccccgaaggaagcatctcaagcatcaacaactgcagaaccgaaagacacaaaagcgccaagcaagtcctcttcaacaaatccagaacatgatctggatgtatttctgctgggggatctgggtagcgacgatgagggtcctgttgatggtgatgatgggctagatgatgactttgataggattgatgcgaccacgggtttggaaagtgatgatgatgacaaaataccagcaacagggaaggcagaagatgcaaagtagttgtctatggttttcacaattcgagagatgacgacaatgatagcgaactttagagttccaagatgatattgtatattagttgattgcatgccatctattcatttgttctctcccaatagaggaatgttacgcacttatggttattacagttttgattttttttactgaactcaagacatctatatcaatggtgtgact

SEQ ID NO: 9442 - DNA, 854 bp, Sorghum bicolor
  Clone ID: SORBI-28MAY03-CLUS15609_1
gcacgaggggaaaggcgaactatggaggcggcggtggagaagaaggaggccgagcaggaggagcagcagctaccgcacgcgcggaaggatgacgcgcccgccgccgccgaggaagacgaagcggatgcggaggagaccgagcgccgcaaccgcgacctcaaggctggcctccacccccttaggcgcaaactcgtgctctggtacacccgccggacgcctggagcgaggtcgcaggcgtacgaggacaacatcaagaagatcatcgatttcagcacagtcgaatcgttctgggtttgctactgccaccttgcgcgcccttcttcactgccgagccccactgaccttcatctctttaaggacggcatccgtcccctctgggaggatcctgcaaatcagaatggtggcaagtggataattagattcaaaaaggcagtttcaggtcgtttctgggaggatttggtgctggtgctagtaggcgaccaacttgaatatagtgatgatgtttgtggtgttgtgcttagtgtccgtttcaatgaagacattctgagcgtctggaatcggaacgcatcagaccatcaggctgtgatggcattgagggattctatcaagaggcacctcaagctgccacacagctatctgatggagtacaaaccacatgatgcttcgcggcgtgacaactcgtcctacaggaacacatggctgagaggataagccccatgattctcaccagcttcggaactatttcactgtgacagctctgaagcaaatagactcttttatgtaccaagaacgcagacaattatgcaatggactagtcaaaagccgctacattataatgctgaacaatcaatttt

SEQ ID NO: 9443 - DNA, 1188 bp, Sorghum bicolor
  Clone ID: SORBI-28MAY03-CLUS15618_1
caggcatgatgttcaatcacagatcaagcaaacacgccagaccaaaatgcatttccaaaaaatgaagaggagaattcaaaagctccacattgctgggctaaacaacgccattaactccaacactggtgttgcagtgcttattgccaccgctgcctttgccgccattttccaactccctgataattgtctggaggatataactcaagcaccttatccagacatgaccttggggcaagcattgatagccagtgatccagcctttataatcttcttggtttttgacgctttggctctctttatctcgcttgctgttgtagtagtacagacatctctaattgttgttgagcacaacgccaagaagaagatggtctttgtgataaacaagtcgatgtggcttgcatgcctctgcatctcggcagccttcatagcactaacctacgttgtcgtgggtcgagatgatgagtggctggcttggtgcacaatggcaatcggcactgttatcatggtggccactctcggttccatgtgctattgcattgttgctcacaggatggaagagaagagcatgaggaagatcaggaggacctccacaagccagtcattttccatatcaattgactcggaaacggagctgatgaacagtgagtacaagaagatgtatgccctttaggatatcggccatgcttgtcatctgagtcatgtatatattgatacccatttgcctgagaccagtccatggcattaagtgggattgactcaatcaaaactatatttagtcctagaacatggcacctgtatcagtatgtaactgcagtctgcagcctccagccaggaacataggggtgaagtctaggtgataggtgtagccactttttgttggcaaaatacaaatattgccaagcatgttgtccctatcttatgcttatttttgtggatggcagtgaaaaccatgagattgtatctgtatagtagaatagtatggaataagttgcccttatgtcaaaagttatctggtcgtggatgctcttatgatgcaacatgagactggagtagactggggcaaaaaaaaaaaattggactttgaactggaggaaactgagacagactttgttgaccgttgtcgttacgcggcatttgcagccgttctgtgaaatataaatgcctacgggctgttatgatctccgagtt

SEQ ID NO: 9444 - DNA, 895 bp, Sorghum bicolor
  Clone ID: SORBI-28MAY03-CLUS15777_1
gaatgcctagtgaaccaaacacggaatttggtattccttctcagtatagctatatgacggtttgtgctccctcatgtcatgattgctctacattacgtgcttggtgggaagaagatgaaggaagaagaagtcgtttctacaagactgtagttggcagtgatgaagagcccccatctcgttgcaccccggaagtagtgcacttcattgttcagcagcattttgacgctccatcaatgtgggcaatctttccacttcaggaccttcttgcactgaaagacaagtacaccacaagaccagcaccagaggaaacaatcaatgaccccactaacccaaaacactattggagattccgtgtccatgtgacgttggagtctctgttggatgacaaggacatccaagcaaccatcaaggaccttgtcacaagtagcgggaggtccttccctggaaagaaggcggaaggtgccgacgaaagcggagagaaactatctaaggtgcagttgaatggtaaagcttaggaacggattgcaagaacagctgaaagcgaccacgattacaagtaaatagaataaggcaacagactgcattaccatgtcggttcgggtggtgatgtttctgctaggaaattcttacccctgtgaagttctttcaactctggaaataagaagtatcatcaatcaagtcagcaagtgaaataattcatccaattttggttttcattcataaactttctttgaggacccagttatttcttgttggcgtatttctgcatcagcaagccattgaaatggcatcttctgcagtttgtgttgtcctaatcaagtgcgtctgtagtgcgtcgcatgtgaataaatgctactagttcttttagttgtctaattaaattatctgtctttgg

SEQ ID NO: 9445 - DNA, 792 bp, Sorghum bicolor
  Clone ID: SORBI-28MAY03-CLUS15824_1
caggaagcccgaggtcgctagcatcgccgccgagggcgtctccgacatggtggatcaagctgtcgccatggcgttcggacatagcaggacgaccaattacatccgcatccagggcacgggtgggcggtgcggcggcggcggcgggcgggcgccgagggcatgcggcggcgagacgaagcaggaagcggtgtggaaggcggaggcgatgctgctgcagaggagcgtggcacgagggctgttccagggccggaagctggccggcgagaccaacgccgacaaggtggagcggttcgcgcgcgagctcgccaaggagcacgcccggaggaagcagcagcagttggtgagcccggccggcggtggcggcgcgcccgtcgtcgccgtcgcttcggtcgcagcaccgaacaatggcaacgacgagcagccgacgacgacgacgaaggcgaccgcggcttcggccaccgcccccaccgccgtcgcaccgaggcggcggcggcggcaaataacaacggcggccacgaagcacgccccggcgacgtcgtcgcggccggcggtagccggcgggtgcacggcggccggcacgcggtagacacgagacgctgcatctgcatgcgtacgtcctgcgagcttgtacgtactagctagttttgcagatgaatctttccgatcgatcgacgggtacgtatacgtacaaacgccgaggcatcgacgtgcccgatggatctcgatcgtcgcggggtgtccgtcccgctgtgcaagctgccaaagctacgggatcatagcctgctgaaataa

SEQ ID NO: 9446 - DNA, 852 bp, Sorghum bicolor
  Clone ID: SORBI-28MAY03-CLUS1585_1
gcacgaggctttcccctgttcccacgctacctccgttcgctgccgctcggccgcgccggcgatggcgacgacggaggggcttgtgcccattacgcggacctacctcgcgcgctactacgacaactacccgctgcccccactgcccgacgccaccacggacctcgccgcgcggcttcgcgtcctctccgccgacctcgccgccgttgctcccatcacccctgatgaggaactcttagaacaagaagcggctggcatacctgcccacaaaatcgatgagaatttgtggaagaaccgagaacaaatggaagaaattctgttcttgattaacacatcccgtcgtcctgtggcactacaacagaagtccaccccagaagatgctcagatagtttgcacacttgatgatatagaagctaaattgaaggatatgttgaagaagttagaacaatttcaattggaaaatgctgacagtgttttcaatacagttatgacatacatgccccaagattttcgaggtactttaatcaggcaacagcgagaacgctcagagagaaataagcaagcagaggtagatgctctggttagtgctggtggaagcattcatgatcgatatgcattgttatggaaacagcaaatggaaaggagggtgcaattagcacagcttggttctgcaacaggtgtatacaagactcttgttaggtatttggttggtgttccacaggttttattggattttattcgacaaataaatgatgataatggacctatggaagacaaagagaacgttatggtccagccctttacacccttacaaaactggtgcttgcaattcggttgtatctgcatgtctctttg

SEQ ID NO: 9447 - DNA, 1301 bp, Sorghum bicolor
  Clone ID: SORBI-28MAY03-CLUS15853_1
tgcaacatcatgattccagatgcccagccttcctgtgcgtgtacggatcagtcaggcaggtacagtctgttgttgggttccaaaacagaatcatgtccatctccaagcaatgccataagtggaggcctggagggtacttgcagatgtgagccgtctaaatctgaggtagtatgctgctgctcacaacgaacagtgtgctctgttgttggctatctggagtaagcgacaagcaagcaggcatgagccgttgcttgtgccatcctgaaactgtggcgtgctgttgtatcagcaaggcaggcaaaaccggtttaagacaagacaagatgtcccgggaccgttgcctgccgcccatggtaatcgccaatctgggggcgggtgacgacgacgaggcgacctgttctgttctgttcatcggccattggcaacactgaacctggaagaagagaaagccgtccgttcatctcatgtagacgaagcctgacgctgtcgccggccacatcacgcttgccgttttgctggcgggatggattgattcaatggcacttgcagcagcatctgatagaggcagtaccggcttttgggtgagagagacttccttgatttgcatgcagctcgcactactcctgcatctagtattgctacatgttttgtttttggactgactggatccggggtctgtcggtagagcaacttgttgttatggaactatgtggatgttttgccgtcttgggcagagcatgagcaatgctgtgcccaggaggaggagatcacttccatccagagagcatgaacatcgtttggatgtatccgggaaaggttttaacctgtgaatctgaatgtgattgcgtgtgcaagctgccgtgaataagcggatctgaggtgaaatctagagtatgttgatggctttgcatcttgtactgacaagagaacagagagcttgctcaaactagtatgcttattattggctggcaccctggcagtagccacacgatactgtctgtatgtgcaattgcacgtctaagtgatgtgactaatctggtagagctatagatgtaggtgtggttaatgcgaagtaagcatgcactgcatctggagcaaaagacacgagtctgggactctgtagaaaatggcaacacgtatttttctagttgcaacttgatgcgtttggacattacaatcctaatagctgtcatcctcacaatgtgtcccgtccaaaataaatcttggtcttgtatttcaaaaagtcaatcaatctcaactttgattgatttataaaaaatagtatcaacatttaatttttt

SEQ ID NO: 9448 - DNA, 557 bp, Sorghum bicolor
  Clone ID: SORBI-28MAY03-CLUS14991_1
attcctcatatcgccgctcgttcctaaagtgatttgtgagaagttgcaagcagatcatcggcaatgtcgaacgttgaggtagaggcgcggcaagcggctcagtgcggcaaggacgccgccggcgccaccgcatgcgcggctggcgctgccgcctgcgccgtgggcgacaccgccggagccgcggccgacaccgccggagtcccggccgacagcgcgcagctgcagctgcaccgcgccgccggcgccgttcagcaggctgccgagcaggtggcgcagacggtccagggcgcggcggcggctgtcaaggacaaggtgtccggcggccactgatcgacccacgcgtgaaccggcatgggcgtggcgtaccaacatttccttatgctgcatcgcaagggctgaggattaatataaggccaaagacggctaaattttacccatttccttatgttttccttattattattttaacatgtttcattcacccatcttattgtgattgtgatcgactaagataaaaaaaaaaaggccgtcttacattaagcatttgtgtgtttctg

SEQ ID NO: 9449 - DNA, 870 bp, Sorghum bicolor
  Clone ID: SORBI-28MAY03-CLUS15044_1
ggctcgaaggctgatgcacaactctcaggagttgcgcagtgctgacttcttctctggggattcgagtggcatggtgtcatcccagtttcaatgggaacgtttttaggatatcaccaccgttgacccataggagcgaggatgccggtaagaccggctatctgctgatgcattcctcaaagttacttactaaccttacgtgatttttctgtcagcacgacgaactgccatgcagtgctcaaagtgctggagaggtggaagccataggagaatgcgtttggtgtagccggcagggctaaaggaacatgcatactcgcgtaaagagaagcatgaaatcattcctgatgttaggttgcgatttgtgcgacagcacagcggtgcctcttacagaacgtgaatgccatgtcatccgctgatccgtagtcatgcatgtcctgcgtgctatgaaagatatgggagtgctggttgggaagggtggtttctatgggaacgtttttagggtaccaccaccgttgtgcttcaccaaagaggattccgacttcttcattgaggtgatggacattgcgctctcgaagctgtgaggcagccagggcgaagatgatgtgcatactctggtccgttggcatgggaactttacccgtaaataatgttgcgatttgtgagacagcacctcgttgtctcttaatctaggacgatgccatgtcatccgctgatccgtaggcatggtattcttgcttcataaataagagacgagttgtgagacagcacctcgttgtctcgtaatctgtctcgcagacccatggacttgcaaccgcgcgtctgccacccagtcctctgcgttgcagctgctcctctgtgtcccgctctccgttg

SEQ ID NO: 9450 - DNA, 695 bp, Sorghum bicolor
  Clone ID: SORBI-28MAY03-CLUS15048_1
tgcatgtaagagaaaatatggaaagggtgaataccagataaaagcagcagagctagtcacaaattggcaggaggaactaaagaagccatcctggcatccttttaagatggttgaggttaacggagaaaataaggaaattctggttgacgatgatgcaaaactgaagcacctatggattgagtacggcgacgatgtgtgtaatgcggtgaagactgcactgatggagataaacgagtataacccaagtgggaggtatgtagtgcccgagctctggaacttcaggaaaggtagaaaggcaacgatgaaggaggtgctcaagtacctgttcagtcagatggacacgacgaccaagcgcaggaggggctgaggaggcgccccgaggccgagaagccaataagtagcgcctttacgctgctctgtcagtcgtgtgctgctcgatcttctagttagtggtagtctggcataataagtgttcgtaatcaaggcttaggtatgcatcatgttcatgctgttgccgggcaggcgtcctaaaaacctatgtgatcgttgaactgactactgagtaatctttcgtgctgctattattgttcgggtgtaaatagtttggtgcctgctccttcgtggctttcttcgtgtgtgtaatcatttgaccgttcatttgtaaatcattgaatcatcatgctgccttataacca

SEQ ID NO: 9451 - DNA, 753 bp, Sorghum bicolor
  Clone ID: SORBI-28MAY03-CLUS14994_1
caaaatattgtctttccatataggatttgcatttttctacttcaaatgttgacaaagaactgtacatgatataagaaacaagcctgacggcgaatgatataaaaacatgccatattgttccatcttcagaaatgtttctttgttctattctagtagtttgtgagagcaggatagtcattcctctgcgtctaaacaaagaaacagaccccaaataaagtgggtaaggactgaactgggaaaaaaaatacaggaaaaagaatagcattacagcaccaacaggtatttcagtgacacatttccaaagaactacaaggccgcatagcttttttgtctgtaaggggagcaaccaagcagctagaagtaggccaccaaaaatttcctaagtctcatgcgccttcatcataaccttgctggtttccggtggtggtcgcggtgccttggccatctacataatatgttggcatgagatagatctaccagatgagaacatattattagaaactcatgttttgatttgcatcaccataaaccgtcaacggctccttcctcaattcctgagcaacaattaaagttactgacaacacagccatcatcaatgcacatgcgacgatgaaatacgaatgcccccgactgtccctattaatcattactccgatcccgaaggccaacacaataggaccggaatcctatgatgttatcccatgctaatgtatccagagcgatggcttgctttgagcactctaatttcttcaa

SEQ ID NO: 9452 - DNA, 434 bp, Sorghum bicolor
  Clone ID: LIB3480-030-P1-K1-H10
gtttagatcgcgagcggcgcccttttttttttttttttaaaaacatgccatattgttccatcttcagaaatgtttctttgttctattctagtagtttgtgagagcaggatagtcattcctctgcgtctaaacaaagaaacagaccccaaataaagtgggtaaggactgaactgggaaaaaaaatacaggaaaaagaatagcattacagcaccaacaggtatttcagtgacacatttccaaagaactacaaggccgcatagcttttttgtctgtaaggggagcaaccaagcagctagaagtaggccaccaaaaatttcctaagtctcatgcgccttcatcataaccttgctggtttccggtggtgggcgcggtgccttggccatcataaaccgtcaacggctcctttcttaatttctgagccacaattaaaggta

SEQ ID NO: 9453 - DNA, 1055 bp, Sorghum bicolor
  Clone ID: SORBI-28MAY03-CLUS15165_1
gcacgaggcaggcattgcacactgatgaggaaatgggaatgatacagatgacaagtgcagtttcacagaatggtgacaatcatttacatcatgctaatggcaccgaccatagttgcgctgattcacaagcaaactcaaaacctcatagccaagtgggttcatctcagtgttgtgatcacagtaagaagactgataggacaccgttgggcctaggattgggccttgggcgaaacagtgcgtcccggcagtatgttcggtctcttatcccattgtgatccatcatttggagatcatgtgtttgttttgctgtagattggatttgttcactgctccggctccatcttctgttatacgtgcccttgacatggttcaccatgtagctttggttgggcagggttaacattgttgggccattagctcaggaatactctcaggtatatctagtgttgtagttttgcggtgaactcagagaagttgaaggtaagaataccagatgatctgcagtcaggaaacaccagagagcttgtgcagaaaaggtaacaagttatgggcttatggcagatgcactaccatgagatgtctttataattgttgtgtacatcagattcggtggtacccccatacgagtttggaaaaggtaactgtaaattgagaattgtaaattgatcagtaagctcagtgcagtgctagctgttttcctactttccattcatttttgggtcgggttattgttatgaaccacggaaagaattttcagtttttcggtatgggtaccccagttacagttagtctggttattggtactggtggtgcacgattgtgtgagtgcttcagagtttaggatattgttgtcacgaaacatgtttatactgacagaaagattgatggaagttgtatggtaaatagctgtactttgccatgttactgtggcatgactagtcacttctcgcgtgagttctattctaggctctagtttacatcaaaatttcttggtacaaaaggcaccctcattattgctgtaatttttcaaagctattgttattcacttactcttc

SEQ ID NO: 9454 - DNA, 900 bp, Sorghum bicolor
  Clone ID: SORBI-28MAY03-CLUS16089_1
aagtttttgaagaaagctgcagcattgaagtttgaggataacgagcagcagaagagatatgaaaagatctgatttagagaaatacaagatgaagttcaagaacttaaggatctcttggacactatgcatgcgcctgtggtttatgcacacaatgacttgctttcaggaaatctgatgctcaatgatttggaagggaagctatattttattgattttgagtatgggtcatacagctaccgtggctatgacattgcaaatcatttcaatgagtatgctggatttgattgtgactataatttgtacccagataaagatgcccagtataacttcttcaggaattatctacgccctgatagacctagtgaggcacaggcacaagatatggaagtactttatgtggaaacaaacactttcagactagcatcgcacatttactgggcattatgggcccttattcaggcaaaggtatccccaattgactttgactatcttggatacttcttcttacggtatggtgagtacaagaaacagagggagccctgcttctccttggcacaaagctttctctccaagccaagaaatgtctagagcctgagaatctgttcatgagtttatactgttgtgcgcatatactcggggcgggtacgccttgtgatcatctgctgctactcagaaactctattatagtgttggtagcagccccgcattgttgtatccgatgttaggttcgtcattgcctgataggaaagtcgcatgatccgtcctcgggagcacagggtggcaagatctgttatatttgtaataaacacaatcctggagggtcctgccctgtgcgatttgttgtgcacataagcattaccgtgtacattcctgtgacgaactgcataagttttttttact

SEQ ID NO: 9455 - DNA, 374 bp, Sorghum bicolor
  Clone ID: SORBI-28MAY03-CLUS16067_1
gcacgagggtccgacttctggtgctcctccagctccaccaactgctccacagcctgcgttctcctatgcgcagccatcagagggcaaccactgattctgttccttaggcatttacttgggaggcatatgatgtatgtgcagaaagactgctcctttggaagttgatgttgccatcatttactgaggccattgcggtcagcttgaattcaagggattgttgagagaatcttcctatgagtgtaatctcgtgtgggccctgtatgctagtcgatgtaggttaactatgtaatcgacgttagttttgtatattactttttaaaaaaggatgcttcaaagtcaaaactaaatttccattcaaaaaaaaaaaaaaaaaa

SEQ ID NO: 9456 - DNA, 203 bp, Sorghum bicolor
  unsure (1)..(203): unsure at all n locations
  Clone ID: LIB3480-053-P1-K1-B9
tttaactgaggccatttctgcncagcttagaattcaagggattgttgagaaaaactttctgagtgcttggggcactgtatgctagtcgatgtaggttaactatgtaatcgactttctatatcaatttcaaaaaaaaacgacgcttgaaggtggaaaaaaaaaaaaaaaaaaaaaaaaaaaaaaaaaaaaaggacgaccggtct

SEQ ID NO: 9457 - DNA, 723 bp, Sorghum bicolor
  Clone ID: SORBI-28MAY03-CLUS16132_1
gtttatcaaacacttttgggttcaagattcaggacaagcaagggaggatgcacagatttaactgtgaaacgagcagcttgacagacctgataactagcattcttcagagggtcggtgatgacattgacagaaaacacctgccacaaattttgtatgaagatgaggaccatgataaggtcatcctttcgtcggacagtgaccttatagctgctgtagaccatgcaagacagattggttggaagagcttaaggttgcacttggattatgccggtgttggccgccgaaagagagggggtggttcttcagacttcgagtacgctggcaaggacgcatgggcttctgcttacagtgcagtcgcagcaggggcggctctggttgctgggcttggtgtgatggcctacttgaaacggtcagggtaagctgggaggcaagcacggcatggaagtggaacacgcttttgatcgtctttgtgatacaaatgctactccaccggaatgagcagaatggctgtgtaagtaattcttgtgagaaacagagagaagaggaagattttaataatactgtcaaggcagtggatggccgcctgcaaacatgtacacggaattggtcgagttttttttggtgggttcagagtcaacgtcgtcacgatgtatttgtatcataaatcacatgatcattatacaagagtcctgatgaaccttcctcaggcatcgtctcctgtgc

SEQ ID NO: 9458 - DNA, 1081 bp, Sorghum bicolor
  Clone ID: SORBI-28MAY03-CLUS16233_1
gcacgaggcggaagcggtggatgaggctcccaagaatgccatgcgacgagtgcttctcctgtgcagataaggaatcacttgccgtcggaacacagctgcttgtctttggccgtgaatatactggccttgctatttggatgtacaacttactgactcgcagttggtccccatgcactccaatgaatctgccccgctgcctttttgcctcgggaagctcaggtgagattgctattgttgctggtgggtgtgataaggatggacaggtgctgagatctgttgagttgtacaactcagagattggccactgggagactatcccagacatgaacctgcccaggcggctctcttcaggtttcttcatggatggcaagttttacgttattgggggtgtatcgagtcagagggattcattgacttgtggagaggaatataaccttgaaacaaggacctggagaagaatacttgatatgtaccctggtggaaccagtgcatctcaatcgcctccccttgttgctgttgtgaataaccagctctatgctgctgatcagtcaacaaatgtggtcaagaagtatgacaaggtaaataacgcctggaacatagtgaagccattgcctgttagagctgactcatccaatggttggggtctagctttcaaggcttgtggcgatagattgctagtaattggagggcatagaggacctcgtggcgaggtaatactgctgcattcctggtgccccgaaggtggggaagatggtgctgactgggaggttctatcggtgaaggaacgtgcaggcgtcttcgtttacaactgtgcaataatggggtgctgagttacctttgcttcagtacatgccgctggtttagaaagccaaccatttcttgctgccatttagctaccctttataatgacttgtaattcagaaatgacacaccccccatttcgccgagctctcagttgatgaatgttttgtagagagcatagagcattgagttcagtttacctggaactactctttttctgttaaactcgttcagaattctttgttcttgtccagtatgaattttatgcagtattctttat

SEQ ID NO: 9459 - DNA, 996 bp, Sorghum bicolor
  Clone ID: SORBI-28MAY03-CLUS16282_1
gcacgagggagaaaagcaacgtcatctttaggcagctactcagaacaagaaggccatttgttgcagaaataacagatgctacgcgtaacgagatatttaaggttcgcaggccattttggtggattaacagctcaatttatgcagaagtggatggtaaggagataggtgtagttcacaggcgttggcacctttggcggagaatttatgacctgtacttagggaataggcaatttgcagttgttgagaatccaggattctggaactggacctttagcctggtgaatgaagatgataaactgttggctcagattgatcgtaactggaggggcattggctttgagctcttcacggatgctggccagtatgctatccggtttggtgatgagggacagagccacaagtttgctcttgctgcagatgttgatgaactgcatgtggttcgccagctgactttgcctgaaagggcagtggctcttgctctcgcgatttccctggacagtgattacttctctagaagaggtggctggggacttccgtttctgattgccacagagtagacacacgtaccaccatcgcccatatacaaggatttttttttcattcctgaagaaggctagcagttacactcagtactgttatcaggtggttgccatcatcaccagaggcaggaactgctgcgtgcttctgcttcatcgaaacctgaaagcggaagttgcctaaggagagatttccgaagcctttattttccctttgtttctgtatgcatagtggaagcaattcatccctctgttatggagatgcacactgaagttcttattgtggaactcgtcattttcgttttctggttttttttcggaagattcttataattatgtatgtggtagtttgattttagtatctagatcttggatttgacgccaccaccgatggcgccaagggtgcatagctgtgcacgtggtttataggcttttgtggcagggccaagtccccccgctt

SEQ ID NO: 9460 - DNA, 493 bp, Sorghum bicolor
  Clone ID: SORBI-28MAY03-CLUS15464_1
gccgggccgggattgaggcgtccgtccgtccgtccccttccgctgcaacccgcaagcctgctgcatccctcgcaaggatcgacatggccgcctctggtggtggtgctgctgctgctctccgcggcctcgtcgtcgtcctcgccgtcctctccgtctccgtgtggggtgcggaggccaagctcaacgtcaaggagacgtgctcgttcacggcgcacccggagctgtgccagagtgccatgaccaagctggtgggcccggacgacgcgccggcgccggcgccggcgaagtcggactgagatcgattagctcatgcctgcacgcattcacgatatataatattgtgctgtaactttggtgtcgtccttgtgattgatcgtccaggacgccgccgccaatgtcctcaagaaatagctcttgagtgattaatcaacacgttcatgtttcgtcgtgcgaaaaaaaaaacaaaaacagcccctaaaataaaacaaagaac

SEQ ID NO: 9461 - DNA, 448 bp, Sorghum bicolor
  Clone ID: SORBI-28MAY03-CLUS15422_1
gattgattagcatcctttccctacaaatatgctagacgctaagggaaagaccaaagtcttgacattggaagcagctgagaagagcgcatcggtagatccccaggttcaggaatggcctccctaggatgatgggtgcccactcatcagtaccagcctctatcaccatgaagtctgctagagcatacaaggtaccaactctgttgatttcaaccttgattttgttgaggacgggtgtagtagtagttgttgttgttgatgttgaaaggatctagacgcccaagagggggggtgaattgggcttctctaaaaatttaagcaacctataagctccaattcaaccccttgtgcctagtgtgactagagagctaccggataaaagttttgcaacctagttccaatcctattctagcatggcaattctaagcctcgtgcaacacaaggtgaatgc

SEQ ID NO: 9462 - DNA, 754 bp, Sorghum bicolor
  Clone ID: SORBI-28MAY03-CLUS15496_1
cggacgcgtgggttgaaagctgtcatgcagaccgatgggtttgattatttgcagcaaagctgcccatccctcctgactgagcttctcgagtatgtggccaaggtaggagatcactccgtgagcccctgcttgtattcaactgaagttcttgatggtggcgatgccaatggacgacgtgtgaaaccgaggatctaacggctgcccagatgagcctagaagaggagttccttgtgtcctttttcgttgtaaagtgattccaatgacgggtgcttctgtggcgccataatcatgcatgttgtagcgtgggtttgtgtgtgtgtgtgtggtgacttccatccctctccccagccatattgctgctactgtggagggagctgtggctaatatatatcctactgactagtgtattgcattgctgctgcaaagcagcttgtcatcataagtgcacacaggtggcatatggcaaggatggtctggtacaaaggtttgatcaaggagaaataatggcgcagaatttgtttttgcagaagttttaccttttgctaggccagatttgtcgattcatggtcgtctgtatttgactgtattcaattgaaatggtgaaatgcaatgaaatgtatcctggacattcacttccatactgatccgttcatctttcctacgctgaaattctgaagtaccttttacctttgggaaatacccgtttcatcatataataatttcctgtcacgaatcaaacgggtatttcgcaaag

SEQ ID NO: 9463 - DNA, 1813 bp, Sorghum bicolor
  Clone ID: SORBI-28MAY03-CLUS15510_1
actattagctcacgcgcgccgtgcgggagagagagagagagaggagccgatccaacccctcccgtcgcgtcccctcgccgccgtcctcgtccctctcccctcccctccctctaaaaccctagctagcggggagccaggggatgaagatccagtgcaacgcgtgcggggccgcggaggcgcgggtgctgtgctgcgcggacgaggccgcgctctgcgtcgcctgcgacgaggaggtgcacgccgccaacaaactcgccgggaagcaccagcgggcgccgctcctgacggacgccgacgccgctgggaccgccgccgcggcgccggccgtgcccaagtgcgacatctgtcaggaggcttctggatacttcttctgcctagaggaccgtgcactactttgtagagactgtgatgttgctatacacacagtaaattcctttgtttcagtacaccagagattcctgctaactggagttcaggtgggtcttgatcctgctgatccagttccacctattgctgaaaagcatgttaatgccgctggtggatcagtaaatcaaccagtgaaacatctgccaaggagaagcccgacagttcaattttcagttgaaggcagtgcttctgttccaagcaaaaatgtaacaaatggagattattcaaggcagaattctgttccaacagccagggcagaagtggttgattggactatgaacaatagtacaattcgttcagtagaatccccgcctaagtacatgtcagaggaaagtccaacacttctgcaatctagccagaccacaacagccttcaaccaaattaacggcaatagtgatgggccctaccacttgtcattctcaggtggtaatgtgacagacagtctaccagattggcctgtggaagagttcttcagtaactcagaatatggtccaaactttggcttctccgagcatggttcttctaagggtgataatgctaagctggggaatgctggtggttctccacaatgccgtttagctgaaggctccgttgctgaggaactattagggcaggtgcctggattgatcacagatgaatatatgagccgagtacctgagaattcatggacagtacctgaggttccctcgccaccaacagcctcggggctcaattggcatgggaatttgtgtttccctgcatatgacagcaccatgtttgttcctgaaattacctccctccagacctcccaaaatcagttcgccgtaccttccagtttcaagcgccggagaagagagtattgaggtgacaacaagatcactagacaccactgtccagtttaggccatctcgagaaaggtttcttggtgggacaaatgactggaaaaaagatatcccagactgtttcttggtgatcattcaaacttcaactgaactatcccctgggtttgaagtgtgttgtaatgcctctgttgttcatttcccaaagatctgagcttcgctagtgaattgtttcgagctgtgcagtgtcgaatttgtgtacataccaaaataaagaggagtacccagtaagatcattcgcgagtacatcgcacactggtggtggcacatgaagttacttctgcaatatcatccttgtccgttgcgagaatggctccagttttgccgtctgatgcctgggtaccttgactgctgcggttcggcgaggcgagggcagctccaatagtctacctgctagctctaaagcatgtgtcatatttaccttagcaagagctaagtttaaaagactacttgtctaataatctactctttacacattgtctaaagctaatataatctcatatcgagaa

SEQ ID NO: 9464 - DNA, 973 bp, Sorghum bicolor
  Clone ID: SORBI-28MAY03-CLUS15546_1
gctcttcacctccctcaacgagcgcctcctggtgccgctcgccgcgcgcctcacgggccgcccgcaggggctcacctcgctgcagcgggtcgggacggggctcgcgctctccgtcgccgccatggccgtctcggcgctcgtcgagaagaagcggcgcgacgcgtccaatggccccggccacgtcgccatcagcgccttctggctcgtcccgcagttcttcctcgtcggcgccggcgaggcgttcgcgtacgtggggcagctggagttcttcatccgggaggcgcccgagcggatgaagtccatgagcaccggcctgttcctcgtcacgctctccatgggcttcttcctcagcagcttcctcgtcttcgccgtcgacgccgtcaccggcggcgcgtggatccggaacaacctcgaccgcggaaggcttgacctcttctactggatgctcgccgtgctcggggtcgcaaacttcgccgtcttcatcgtcttcgccaggcggcaccagtacaaggccagcaacctgccggcggcggtggcgcccgacggcgccgccaggaagaaggagacggacgacttcgtcgccgtggcggaggcagtcgaaggaatggacgtgtagggcgatcacaattgatcggtgcgtgcgtgtcggtactagtgctgctctgtagtgtggcttaatttttgcctttgggtttctttcgcttgccagttttcagtttgctgctgcttcggcttcggcctgctctcctgtaaataacacaggaggcatacgactatacgagttgtggcgaagttttatccagttattagatgaacaagatatagaaatgggcttttagcgagcggacgctagaccgggtggctagcgcttgaccgtgtcgcaccattgcgacctaggttggagccccatgggatggaggtgaaaaaaaagatatctcctcaagcacaggtttaccttaaaaaaggaacatgg

SEQ ID NO: 9465 - DNA, 1017 bp, Sorghum bicolor
  unsure (1)..(1017): unsure at all n locations
  Clone ID: SORBI-28MAY03-CLUS16525_1
gccctactggaacccaccacacaatccccggggagcgtcccttgccgccgccggcgccgccggcttgtttcctccgccacgaatccgcatccgaatcaccaaatcgagcccactcccaccccctcggcgcctccaattcggaaccaccaagatctggacctctggctcgcgggcatgcctggccgcggcctccgcatccacaccgtcggcgccgggaggcggcctttactcggcggcgacgtacgagctgaccccagaaaacgtcgaccgcgtcctggacgacgtccggccatacctcatctctgacggcggcaacgtcaccgtcgttgccgtcgaggacggtgtcatctccctcaagcttgaaggagcatgcggcagctgccccagctcgacgacgacgatgaatatgggcatcgagcgtgtgctcaaggagaagttcggcgacgcttttaaggaaatccgtcaggtgttcgacgaggatcagccgccggcggagacgacgcccgaggcggtgaaccggcacctggacatacttcggccagcgatcgcgaactacggcgggagcgtggatgtgttggccgtcgacggcgaggactgcctggtgaggtacgacggcccggaatccatcggcagcggtatcaaggcggccatcaaggagaaattcccggacatcaccaatgtggtgtttaccctgtagaacactgtctagctatgctatgcatattattacgcagtcgacagcaaatgagaagatgaaatgaccagacatattgatccaatttcatacatgtaattgcganaaacgtagtaatgcaaggatgagacgcattacatccttgaatttgctctggtgcggtcatccttgcatttggcagaaagtggatggacggttttgcgtctcatccttgcatttgctctggtgcggtcattgcagctttcaggagcacatctcctgctgcgagtgccgatgtttcccttccgtcacctgaaattgagatgattcggaattttcatttc

SEQ ID NO: 9466 - DNA, 1124 bp, Sorghum bicolor
  Clone ID: SORBI-28MAY03-CLUS16652_1
ctgcgatctttatggtcctcagctttgagagggccgggcttcaatttgtgggcaaagatgaacttggaaatggcatgggtgtactcgttcctccctctcacgggttctggggagtccagggcatccatcttgccgcaaagtcggcacgtgaaaacaatgttccttatctcggcatttgcttgggaatgcaaattgcagtgattgagtttgcccgttcggttatgaaactacgaggtgccaatagcacggaattcgatccagctacaacatcaccctgtgtcattttcatgccagagggctcaaaaacccaaatgggagcgacaatgaggcttggatcgaggagaacctatttccatgtcaatggatgcaaatctgcaaagctgtatggcaatgccagctctgtagatgaaagacaccgccacagatacgaggtgaaccctgatatggtcccggactttgagagggccgggcttcaatttgtgggcaaagatgaaagtggaaaacgcatggggataattgagcttccctctcacaagttcttcatcggtgcacaattccatcctgaattcaagtcgagaccaggaaagccatctccgcttttcttagggctgatagccgcggcatctggacagctagaacctttgcttcaacgcagcaatctgacaacaaaagcatgtcctatcagtaaaatcccgaaactgaaattatacccaactggacctgtgaatccattgaacagctcggtaaatgggtactacccaaatggcactggcattcacacctagaagcataatgcttagcagcggcttgattgatatttgatttgctcatatggttttgcttgtaccccctttttatgtttctttttcagtttgtactctgatcaactgagaaggctaagattcagcaagccctagctccagcgacacatggttccgacattttaacgaggaacgtcctccagtccgttgcagcaaactagctatagggtggtgaggtctagtgtgatgttgcttttttgttttgaggcctggaattaaaggcgggaagtgttttggtagcgttagtagagcctggaatctcaactatttgtacattaggtaagaacttatctaaggatctga

SEQ ID NO: 9467 - DNA, 1482 bp, Sorghum bicolor
  Clone ID: SORBI-28MAY03-CLUS16725_1
acgctgcatccacagaatccacctccacatgtcggcctccggcgaccccctggatgccctcccggcggcggtcctcgccgacgtcctgggccgcgtcgccgacgccggcgacatcgcggcttgccgcctcgcctcgcgggcgctcctcgccgcgtcctacctctgcccccgcgtccgcctctgcgccgccgactgcgcccgccgccggtgcgagggcgggggcggtttccccgcgttctgcgcgacgactgcgaacctcgcctcgcttctcgggcctcacctccggtccctgcacctcaccagcggcgaggccgcgccggcgtgggcggctacctccacggcagcggttctccgggagcttgagatcgctgactactggccgcaggcgtgctggcggaaggcggaggcgctcccactcatctcacactactgtcaaaatctcgtcaagttgggacttaaaaatgcatggctttctgttgaggggctcaagaaaatgccaaatctgactcatctgacgcttgagttcattaggttggatgatgaagatctcaaccaattgaatgagtgcttcccttgccttcacactcttaatcttataggagtcggagggctcaaggaccctaagattgaccttcttcatctaaaggcttgccgctgggaggtatcaaatgtcccacggtctttggttgtccgtgcgccagacttggtttttctggagttgaaatgtatccgaccagatacactcattttggatactccgtccttgtctactctgaaactgaccattgataaacttggtgcaaatgtccgagttgatggtcttctgcgtttgacaaatcttcacatagaatcactggattttagttccctttttctagtattcatagacaatcgaggtatcaggacattggagcttgagctacctgagtttgcaagtcaatatgaacttcttgaagcagtgaacccagattatcttctgaaaatgcttgccagcattagtgaagtcaagctggctccgagattctcatgtgaactgaaactatgtctcgccctatgcaaaggtagtcagtttggaagttgcctgaagaagctcctaattcatgtgccgcaaccagggagctgttctcatctcttgcccttgtttgagatttgtgcacctttgtgtgaggtgactgtccttttccacactgaatcagctgatgctgtccgtcaaggtgcaatctcaatttgtatgcaaaactttccagatatcagatggcagtggggtacctggcagtagtaatcctgtctatatatgcttataggcaagtttgagttacataactaactatctgcgtgactgataatttgtacttttgttaacatagcagccccttctacacaattgggagctggcttgtttgctgacatacactgtgcactaacattgtaaggagcaaattacctggttgtgtctctgtttcatctatactatattactat

SEQ ID NO: 9468 - DNA, 996 bp, Sorghum bicolor
  Clone ID: SORBI-28MAY03-CLUS16787_1
gcacgaggcccactcggctactccccaccccacctctctctctctctgctcgccacgcgccacatggctcccgcgttcactagcctcctccccgccgcgacctccgccgccgccgcgaccgcctcgcggctcccctctgcccccgccggagcggcatccaccttcgcgcgtctcccgcatcacccgacgggctgggctggggcctccgtcgcggcgccgcgtacggcggcggcgcgcaggcgggcgcccggcgtcgcctacgccaccgccgccaccgacaagagcatctacgactacaccgttaaggacattgatggaaaagatgttcctcttaaaaagttcaagaataaggtgttgctgattgttaacgttgcttctcaatgtgggttgacaacagcaaattacactgaactatcccatatctatgagaagtacaagactcaagggtttgagattctggcatttccttgcaatcaatttggtgcacaagaacctggatcaaatactcagattaagcagtttgcatgtacaagattcaaagctgaatttcctatttttgacaaggttgatgtcaatggacctaatacagcccccatctataaatttctgaagtccagtgctggaggatttttaggtgatctagtcaagtggaattttgagaagttcttagtggacaagaatggcaaagttattgagagatatccaccaacaacttcaccattccagattgagaaggacatccagaaactccttgcggcataagtacttccaagtctttcagttgagtatctgtatgactgtatataggcctcgtctagaagctagagtattacgtaattatatatattttctgtattgtaattctttcttgtaaaataattcactcattatctatacgtggttatagatgtaacatgacactatattattagattttttttttttttttagggttggccggccttggattaataagatagaaggagtttacaacct

SEQ ID NO: 9469 - DNA, 755 bp, Sorghum bicolor
  Clone ID: SORBI-28MAY03-CLUS1682_1
tcaaatattggatgatggtagggttactgactctcaaggccgaaaagtgagcttcaccaacccccataattatcatgacgtccaacgttgggtcacagtatatactaaacatggatgaagaagttggatcatctgattcagcctatgagaacataaagaagagggtgatggatgctgcaagatctgtattccgtccagagttcatgaatcgtgtagatgagtatattgttttcaagcctctcgagagagaacagatcaacagcattgtcaaattacagcttgcaagagtacagaagaggatcgcagaccgcaaaatcaagctcgaagtctcacctggcgccattgaattcttgggaagcctggggtatgacccgaactatggtgcgaggccggtgaagagagtgattcaacagtacgtggagaacgaactcgcaaagggcatccttagaggtgatttcaaggacgaggacagcatctttgtggacacccaggttacggtgccctccaatggtcagcttccgcagcaaaagctagttttccggaaagtgggtgagcaatcgaaggccgctgctgaagacgagaagttcttgccggctgtgtgatggagtacggttgcagttttacagatcttgagcaataaaatgtacatataacggtgacaataaactggtagagttattccttttggcttagaggagcataacagccagactttgttctatgatacacatagctcaagttcacagcgagcagcg

SEQ ID NO: 9470 - DNA, 1015 bp, Sorghum bicolor
  Clone ID: SORBI-28MAY03-CLUS15938_1
gcacgaggcatcattgttcgtaatacacttgtgacctatgaccgtcacaatgaaaagattggcttttggaaaactaactgttcagagttgtgggagaggctacatatcagtgacgctccatcaccagccccttcaagtgatacaaattcagaaactgatatgtcacctgctcctgcccctagtagcttgccagagtttgatgttggtctcattaccgttgatatgtccataaatgttacttacccaaatctgaaacctcatctgcatgagttggccgagctgatagctaaagaactggagattgactctagtcaggttcgagttatgaatatcacgagccaaggaaattctactctgattagatggggtattttcccagcagaatctgataatgctatgtccaacgcaacagcaatgggtatcatctatcggttaactcagcatcatgttcagttgcctgaaaatcttggcagttatcaattgctcgagtggaatgtgcagcctttaccgagaaggtcatggtttcaagaacatgtagtctctatactgcttgggattttactagttgttttggtcactttgtcagcccttttagtagtacttgtttggagaaagaaatttagtggtcaaactgcctacagacctgttgattcagtggctcccgagcaagaactacagccactataattcaaagctgtttggcggacatatagatgattctttggtagagataccttgtacggggttacatatcacagcggctcgcgtctactgctggagtaagcccctctttgtatgtaacacaagctacaagcttacagaagaggcacagtatgattacatgacttctccattcaaaacttagaagcgctgttcataaactgtctagttattcagatacaagagctcccctcttgtgcttactgtagaaggttttgttcatgtaatgtagattaagtaggggtagagaaggggctatgcacacccgcagaacgaaatgatgtaatttctattt

SEQ ID NO: 9471 - DNA, 1106 bp, Sorghum bicolor
  unsure (1)..(1106): unsure at all n locations
  Clone ID: SORBI-28MAY03-CLUS15976_1
gcacgaggctcttggtgagctatcacgtgctcttgataaaaaggaagctttgctggtggagttgaggcacatgaatgaagaagtgtctggaaaccagagggatggggaaattattagagacttggagcatttcaggaagcaatacgctatggtgcttgtgcagctaagagattcgaatgatcaagtggctgcagctttgctttcgcttcgccaacgcaatacatatcatgggaacccagggtctaaatccatggaaaatggcatagcctttgctggagcatcagatccgtataaccttttcagttatattaatccagagtctgattctcaagtgattgaagttatcgagacttcgaagtgcagggcaagaatgatggttgatgttgctatccaggctatgtgcaaagtgagtgaaggagagaatgcttttgcaaaaataggggaagcactagatcacttgaatagccgcggtactggctctggttcaagtatacttggcataagacggatacctcctgattcaggacagtcaaatgcatcttatcatgataattgcacaactgcccctgcagcaaacagcagttcaaaggtgccaaacggctgtgattcggaaactcaatttcccaaagagttgatatcatcctgcgtagctacgatgcttatgataaagaactgcacggagaagcagtatcaccctgctgaagtcgcacacatcctcgattcagcactgtcaagcgtacaaccgtgcagctcccagaacgtcccgatcttcagagacatcgaaatgtgcatgggcatcatcaagaaccaaatgctggcgcgggtatcatcctagattcctaggctcggcattccttagtctattagctaatgtatgtatgtattttggaactggatacctgtatgtggtgtgcaatattcctatttttttcattttttttgttttctgtatgtacatttcatgtattattatttattatttcctgttattaaatattcaaccggggggtataaaanaaaaaaaaaaaaaanaaanggggcggccgctcgcgatctagaactaggagacatccaccagcgggtgcaacaacgacgccaccgacgca

SEQ ID NO: 9472 - DNA, 1112 bp, Sorghum bicolor
  unsure (1)..(1112): unsure at all n locations
  Clone ID: SORBI-28MAY03-CLUS15963_1
gcacgagggcgagaaacaagagaaaatgaaagatgagaaaaagaaggaaggtgacaaagatgtaggggaggaggagaaacacaagaagagagaaaacaaagataaagataagaaggataaaaagcacgaggaaaaggatggatctgaaccaaagggttcaagtgatgaaaaacaagagaaaggtaaagataagaaaaagaaagacaagaagagcgaagagatggaacagaaggaggaccatctagagaataagaatgataaggccgcacagaaggatgtccacatgaacaaagagttggcgggagctgcggactcgggcacccgcgaaatcaagctaactgacactgaaccacaggagaaagaaattgatagtgaagattcagaaggcaagaagaagaacatagagaaggacaaggacgaaacgaagaagaggaagaaggatgatggtgaggacgatgaaggcgagaagaaagacaaagaaaagaaagagaagaagaaggacaagggtgacaagaagggagatggtaagaagaaagagggtgatggcgatggcgatgaaggcaaagaaggtaagaagaaagacaaggagaagaaagagaagacgaaagacaagggtgcgaaggagaagacgaccgatccggtgaagctgaaagcgaaactggagaaggtggatgccaaattgcaagacctacaagctaagagagaagatatcctgaggcagctgaaagagctggaaggcggcggcaagggaaagacgaatggagagaagcctcctgcacaggtacaggaggacaaagggaaggactctggagaggtgcctgcacagatactggaacagggtggagagagcaaggtcaaggaacagaatcctgttgccgcagcctgatcttgtggagctcctgtggcggttgatgtaacaataactctgatctggttctgtacacatgcattatacactgtgtataggaatgtacattttgagctgagttgtaaaatggtacacatggcatgcactatcangatctatgtctctcttactatccagtgaacggaacatatatagccgagtggaatgcgtccttttcctgatacataacactgtaatactttgc

SEQ ID NO: 9473 - DNA, 834 bp, Sorghum bicolor
  Clone ID: SORBI-28MAY03-CLUS16009_1
caacttgcctcactaaagtccttggtctttaccagatcactgccaagaatttgagagatggaaaggagctgaagatggatgtaatggtcatggaaaacctatttttcaagaggaaggtatcaagaatatatgacctaaagggctctttgcgttcgcgctacaaccctgatacttcagggaacaacaaggctctcttggatcttaatctgttagagacacttcacacaaagcccatttttcttggaagcaaagcaaaaagaaggctggaacgagctgtctggaatgatacttcttttctggcatcggtggatgtgatggactactctctcctagtcggcattgatgaggaaagaaaagagcttgtgatggggattatcgactatcttcggcaatacacttgggacaaacaactagagacttgggtgaaggcgacaggatttctagggggctccaaggatgttctgccaaccatcatatctccggatcagtacaagaagaggttcaggaaggccatgtcgaagtacttcttggctctccctgaccaatggtcaccgtaatgcctcctccaatgcatccaggccattcaagcgcgacggggaagacactttggttttcctttttcttttttccctcctgtatcttttagaacaatcgatccatctatgcctcttgtatgctgtttttgttcacaacaggcaggatgaactctgtggaggattgtggcgattgttgtccatccaggcagaggttaggcgtcaatacgtgtacataccctacactataaaatgaaatgcaaaggaaatgaaaatacgggaaccgagttccttaccagtg

SEQ ID NO: 9474 - DNA, 1032 bp, Sorghum bicolor
  Clone ID: SORBI-28MAY03-CLUS16062_1
gcacgaggatagaacagctagacagatcaggcaaggataccccaggtgatgatcttgagaaatctcttgaaaaacttgcccaagaaatgttgctggagatgctatccatgattccaaaaatgccgctttgaagattatctctgctggtgcactgtttgcactatttgcagtaataggtctgaagtgcttgcctcgtaagaagtcacttcctgctcttaagagcgaatatgggtctgtggcagttgctgactctgttgatggtctgggagcagatgaagagccactagaaattcctagaatggatgcaaagttggctgaagatattgttcgcaagtggcaaagtatcaagtccaaggctttggggccagaacacactgtcacggcattgcaagagatcctcgatggcaacatgctgaaggtatggatggaccgagccacagagattgagcgtcacggttggttctgggaatacacactctccgacgtgacgatcgacagtatcaccgtctccatggacggtcgacgggcaactgtggaggcgacgattgaggagatgggccaacttaccgacgtagcagacccaaagaacaacgacgcctacgacacaaagtacaccgctcggtacgagatgagctactccaagtccggagggtggaggatcaccgaaggagcagtcctcaagtcgtagaacggtcgtgcagcaggagtaggcgagtaggggttgctcaactcccattcttttttcttttgcaccagtgtatgtaaataaacagtgtgagcacaggttcttttctctcctggagagagtttggttaggttgattagtgatgagttcctgaggccgagagaatttgtcatctagtttgtattgatagagataatttggtgttactattactaggtcagatttttcttctgaaacaaacaatagatcctaacgaaggctgcagtgcatcattgcttaccacatcactgcatcagacaaaggtcactgcttaccacatcgaaaaaaaaaaaaaaaaaaggccccta

SEQ ID NO: 9475 - DNA, 850 bp, Sorghum bicolor
  Clone ID: SORBI-28MAY03-CLUS16981_1
gcacgagggttttgactatatgttaatcaaattagtaaaaaatgaccgggggtgggacttgggagtccacgagagatcgatcccctgtcctgttcagttggccagttgccgacgaagcacacggaaaaaccgcaacagaaaagccttggaagggtcgaggcggaagcagaacaagccgaggaggggagaagattcggatgggggcgaagaagcagggaggaggcggcggaggagaccagaagggcctcctgtggaggctgccgaaggtcacctctaaggagctcggcaagataggccccgccctcggaatcggcatcggctgcggcgccggcgcaggcgtcggattctttggcggtgcaggattaggctatggatttcctggactcacattaggctttggagttggagctggatgtggtgtaggaattggttttggttatgggttgggcaaaggaattgcatacgatgaaaacaaaagatactccaatgttggcaaaatgttccaggaagctccacatctgcctacggacactgttgttggtttatttgacgagctggttataaacaccaagaagtttgtgtcagcaacatcaaaaggaatcgaaaaatggcgttgagctgcaccactgcattgtcgtctctattagtcagtggagattgcgagcagcattcatcttgaacaggcagtaggacttggtgctagaatgcagcctgttgcatctcatcactttatattgctcatcagctagtagctttgtatttaggtaggatcctgggacaatacatatgatttgtggtcgatatttattagttaaattgcactgtattgtgggttgactcaccactactg

SEQ ID NO: 9476 - DNA, 899 bp, Sorghum bicolor
  Clone ID: SORBI-28MAY03-CLUS17122_1
gccggccgggccgggctcctgactacccgaccgcggtgcgcccgcacgccgccgcgccgcccctcacccggccgtgcctcgacattctactaccgcacttcctgccctgttccccaaactaccgccctctgctgttatttgttctttccccggcgttcgctcgattgctgcgtgaaattgagagatgaggaagctcaagttccacgagcagaagctcctcaagaaaaccaatttcttggagtacaagagggagcgcggccatcgcgaggcgctcgtcacacagcgctacggcctcgtcgagagggacgactacaagaagtacaacgggatatgcttaatggtgcagaagctcgttaacatcataaagcagatggacccgagagaccctttcagaatcgagatgacagatatgcttctcgataagctgtataatatgggtgtaatttcaacaaaagagagcttgataaagtgtgagaaactttcagtgagcgccttctgcaggcggagacttgcaacagttatggtgaagctcaagtttgcagagcaccttaaggaggctgtgacatacatcgaacaggggcatgtgcgtgtcggtccagagacagtcacggatccagcctttcttgtgaccagaaacatggaggacttcatcacctgggtggattcctcaaagatcaagaggaaggtcatggagtacaatgatgcattggatgattttgatgccatgttctgagaaaaatcattctgcagaaatctctgtgcccatcagtgtaatcttaggccagtcacatgtggctttttctgaacaaaatactgtggcagttgttttctgcagggctacatgcatttgcgttacagatgtgatgcaattttgtggtttggttgaaggcaccttttaa

SEQ ID NO: 9477 - DNA, 584 bp, Sorghum bicolor
  Clone ID: SORBI-28MAY03-CLUS17113_1
gccccgcgggccgggtggtttttgccctatcttccattcttcctgcttcgaacatttggaggagaggggagagagagagagagagagagcggcggaggcgatggcgagcggagggaagggactcaacgcgactggggagtttttccggcggagggacgagtggaggaggcacccgatggtggggaatcagctgcgccacgccacaccggggctcggcatcgctatcgtcgccttcgggatctacctcgtcggcgaggccgcctacaaccgcctctcccgcccctccggcgaccaccactagatcgccggccgggatccgtgactccaaggtcaagtagctggagccaactctaccaagcactggtgttgatctttttacagtttgagctcataaggtcagccatgaccatgttgtaatctgtgaccaggtagacttgcccatttggtccaactattgtcttgaaaccctatgctgatacttggtatctggatctgacgatgctcgtgtaattcaagaatcctgggtatcttttatgattttatttgattttgcaaaaaaaaaaaaaaaaaaggcccctagggcc

SEQ ID NO: 9478 - DNA, 1060 bp, Sorghum bicolor
  unsure (1)..(1060): unsure at all n locations
  Clone ID: SORBI-28MAY03-CLUS17237_1
aaaaactcttcgtcgtcgccggcgaccccgcaccggccgcgcagctgtcggggatgccggtcagggtggtcgacaccgccacgccttcctcgcagccctccccagggcaagaaacaaatactggacacccatctcctcctagctgttcactcttaagtgctggaagatcttttgctggaactcagaatgtttcaagtctgcagaaggacgaagcatggaaagtgaatgttcgcatccatggttgcgatcttgaacagggttatctatgtggaacgatggaagcacttaatgttccattagcagatacacctgtagtgacattctgggagggggagatagtggatgctaaaaattacactcttttcactggcaagtgggaggcatcaccagaggacgatataagacattggtccaagttcccatcatttacgcctcttctgagtcagattgagactgatggtggcaagtctctggactttagcaactatccttatatatttatgagatggaaagagcaatactttgtcaatgttggagctgactgtgggttaaccattgctggtttctactacgtctgcttttcttgtagcgatggctccatcagtggattttattatgatccaaatagcagtccatttcagaagctcgaactgaagtgtaccaatgagaaaaattctggattcaccttttcatcctatgagctgcagtgacaggcccgatgccctcggcagacaactttctgttagcatatactagtgtatactgagctcgtagtccctaatgctgttgtattaaaagaaatgagaggttgtttatgtaacagtttgttttctagcaactaagcaaactgtcactttgtaatctgcagaagcatattgtcttttctaaaatccaccttttgtattatgtttgtgttaatcatggtatgatgtgtccaaattcagttgaatagggaatgtgagggctaaatgttgattcagagaaatgttctctgcagttggngatttctatttcaacatgtctatgatataaacaaaaaaaaaaaaaaaaaaggccccta

SEQ ID NO: 9479 - DNA, 937 bp, Sorghum bicolor
  Clone ID: SORBI-28MAY03-CLUS17246_1
gcacgaggattcttcaaggcgtcgcaacagccaacccaataatcaatcaatcacccagcgacatcgattccttcccgtcgacgaaccaccccgcccgctcccaccaccaccagttccaatcccatgggcaaggtccgctccttcttctcccgctcccgcagcggcggcagcaagcgcggcgccgccggggcaccaggcgcgtcctcgcccttctcctccgcgccgccctcccctctgcctcgtaggtcgccgtcggcggcgcgggccgcggacgagacggagggccgggccggcaagttcgacgcgaacggcgacggccagatctcgcggtgcgagctggcggcgctgttcgcgagcgtggggcacgcggccaccgacgacgaggtgtcgcggatgatggaggaggccgacgcggacggcggcgggtgcatcagcctgaccgagttcgcggcgctcatggacgcggccagcgccgacgccgccgccgtcgaggaggacctcaggcacgccttcatggtcttcgacgccgacggcaacggcctcatcacccccgccgagctcgcccgcgtcatgcgcgggctcggcgagtccgccaccgtcgcgcagtgccgccgcatgatccagggcgtcgaccgcaacggggatggcctcgtctccttcgatgagttcaagctcatgatggccgccggcggcggcgggttcggcaggatcggtgctgcctagggagaaaggatcctgctgctgtcctgctccctcctctgctccgctccaacaacattgaattcgtttcatttcattttatgtacatataaacactggaatcacggagattagtaggttcagattacacggccagcagcgctccacataaaaagcgcgatttatttttgtgtataaattgcaaaatctgcatccattgtactgctgtgggatgtta

SEQ ID NO: 9480 - DNA, 812 bp, Sorghum bicolor
  Clone ID: SORBI-28MAY03-CLUS17273_1
cctagtccctcgcccgcctctctcccgtagtctcgcagcagccgcctctctcggtctctccctcaaccctatcgcgtgcgccgccgtctctcccgccctcgactctccagcagcctgtgtagccattcgcgagcaaggtgtaggtaacctggcgcgcctccccctgctgccgccctctgcttcgtacctccttgtggcgactgccaagctcgagctcctcggtggcctcctgctccacatgcttccccagaaacggggggttgacgctggcgacgtctacgactaacaccgcgccgccaacccagcccaggacaaggacaagaggaggttgcggatatggctggcagggcgcccgagatcgatgaggaactccacatccggcagattaccatctatggcgcaagaccatgaggcgcctcttccgctgcagcgtcctttgtgctccgtgggttgaggatttgatatgtagttactgcctcgattagttatgtgatccgtgggttgttgcaatcggtagctatgtgagccatatttgtgcttcatttttatcctcctgtacatgccattgttacagtatttgtgctgctacatgctaataggatcccatctaaccatggtgattaattgggcttgcagttctgtttctcatttgttagttttcgtcttttattttgtgagccataagtttatttctcctacatatttcccgtctgtgcagatcagagagtttatatttatgtggatggatcctttatgtttctactgatttcttaactttgttgattatttagtctagctcttgctgttcagag

SEQ ID NO: 9481 - DNA, 784 bp, Sorghum bicolor
  Clone ID: SORBI-28MAY03-CLUS16311_1
tccgggtccggccgccggctcttcttcccgaccccgcgcctggggatggtcggctaggtcctccccacccgggagatccgcttgttcccctccgttgcgcaggtccacctcgacttgttgctctcctccagcctgcctcttgtgatgctgcccgtggtcaatctcctgccctgggggcccttctcgcgccctggcggcgacctcttccgcgagctcgagtctgcgatgcatcttgttctggtccgcgcacccttcgccttgctcgaaggttgccggggtgacacgtatttcgtgcggcggtgcaaaggatgctttgatgacatgaacttggagcggctgaggctgacgatggcaatgaagacccctgaagatcaaatgttcaatttcgaccctaagaccgtcgactggaatgattacttcaccaaaatccacatccctggtgttctcaagcatctcgcgcgccttcatctcgtttcacagtttacacttgtactgtcacaccgaaatgaaatagcacaatccgttcgttcgctagacaaacgcgtatcagtgattatgaaggaaataaatcatactataagtcaactatatattgtcagctaggtatatatatattggtagatgtccttattactcttcatagtgatcatcagacgtgtgttcgtgtgtatgtgttaggtggcaccgtggcaaccatatatatatcttgattgcgaacttctgtaatctgtgtcatctgtacgtgtcagtgacaatgaaaaggacccctgtaatatctatatgt

SEQ ID NO: 9482 - DNA, 1336 bp, Sorghum bicolor
  Clone ID: SORBI-28MAY03-CLUS16361_1
gcacgaggcagcaaggctgaatgggagatggttctgaataatgattcttggttcgtgagcccggtccttccagaagtaccacaagctgtgtatgtgagttatgttgacctgccatctcacctgaaggagtgtttcctccattgctctctgtatccagaagaataccccattcagcgctttgatcttgtgcggcgttggattgctgaaggaattgtaaatcccagagacaacgaactgctcgaagaatcagctgaagagtactatgtagaattgataagcagaaacctactacagcctgatcctgaaagtgttgagcgatgctggataacacaccatcttctccgttcactagcccgccttttgattgcagatgagagtatcttaatttatggtcagcagaaattgaacacctcattgtcaaagccccggcatctcacattgtgtaacatggaaagcagcttggacattccgatttcactgaagcagcagatgagcttaaggtcattggcactcttcaaaagcccaactgtcagagcaattgatcttctcaccgagtcagcttcatgcttgcgtgtattagatttgagcaatacagcagtggaggccctcccgaaatccattggcaacttggtacatttaaggtacctcaatcttgatggaactcaggtccgagacataccttcttccattggatttctcataaacttgcagaccttgagccttcaaggttgccaaagcttacagagacttccttggtccatcagagcattgctagagcttagatgcctttgtcttgagggaacttccctaagctatgtaccaaagggtgttggtgaattgaagcatctcaatcatctagatggtctaatcatcggtcatgacaacaatgtgcctgagggttgtgacctagatgaccttaaagctttgtcagaactaaggcaccttcatgtagagagtttggatagggctacttctggtgctgctgcactcgcaaacaagccattcctaaaggatctgtacctctctgagcaagccccagtaatagaaaaccaggagagtcctgaggacaaggatgaaacagaaaaagaagaggaggaggagcaggaaggaagcaatgaccaatgcaggggagatgaatcagccaaagctagtgaaaagatatggaatgagctcacgccaccccatagcattgagaagctggtaatcaagaactacaaaggtataaaatttccgaattggataagaggtcccaagctaggagcctccttccccagccttgtgtttttggatcttgaaaactgcatgtcatgcactaaactgccttcacttggcctcc

SEQ ID NO: 9483 - DNA, 1016 bp, Sorghum bicolor
  Clone ID: SORBI-28MAY03-CLUS16433_1
gcgcggggattctgtcgggccgccaaacagtccatatagatctcattcagctatactcgcagatgatattgtttcaccttcagctggacgtgaacacatatccctcgatgttcctagaggaaggtacaagatgactagtttgcctgttcctggtcttggttcaagcagaggttctcagctgttgggtggctcatataatggaaatcatgatatgatctcaaccaataccctacaaaacatggctggaattccaccaggaccagcttggcttgaaagtgatgctgcggcaaacgcttatttggaatcaaaggatgaagttcatgattttgcaagcctgcgacatgcagttcttgaacaggatagacaggcttttctgatgggcaacaaccctttaacaaaggatctaacattgaaggagctatacagtatacaaaccaggatggttcaggagaaggctagagaatcaacatatcgacaaagattccaaatgccagagttgcaaggcctcatccaggaacaaaatcccccaatcgatctctgtggtcttcacgtcagtgaggcgatacatgtcctgaactacgagctcaacaaccgaagaaagattgtgagatccactggtcgccgactccaggctgtgataatatcaagcgcccgcaccccagcaaggctgaccgctgccgtcgagcagtacctcatggagcatggccttcagtacacacaggcgcaaccgggcctcttccgcgtcctgctgtactaatggaactggcctagctgttgttcagaactggatcagatgaaaagagaagggaaaaaaagttgacttgtacttttgtatatggcagagatggctagctggatagaagcgttaagataggtcatgtaacattcgtatatcaggctttttgtcagcaaatgtatacatgttaacatttgcggagttagggaatattctcgttcagtctttggtgctggtggatgcataaggggatagcatcttcacaatcataatctcgttc

SEQ ID NO: 9484 - DNA, 1366 bp, Sorghum bicolor
  Clone ID: SORBI-28MAY03-CLUS16478_1
ggcaatggggccgccgggccgcgtcgcgtcgcgtctcgcgacggcgacgacgacggcttaacagctgcgccaaacttccgctggaggagggagctcgctgtccctgttcccctacgacggctggcggtctgtttgggcgagcgctcgatgcagcgctgtcgagcggctcgatctgggaggctccaatttcggcgtctgatcctagaagccactaatttggtggagggagcctccgctgccgccgcggagcagggcggtggcggtttcgtctgtttcagcaagctcaggggacgccacacagacgaaaagggagatgtttaacaatttggctccactgatgtggcactctttgggatcaattattatcctgatccaggaaattttgtcagtctaccctgcactttcacccccaacactaacggcatgtgcatcgagccgagtctgcaatgcagttgcacttcttcagtctgttgcatcacaccctgagactaggactccctttctaaaagcttacattcccatatacctatacccactcttgaacactgtcagcagcgctagatctttcgagtccctgcgactcacgtgtctaggcgtgattggtgctcttgttaaggcagatgatactgaagccataggtttcctgctgcaaagtgaaatcattcctctgtgcttgcgaatcatggaaacaggcgaagagccttcaaaaacagtggccacttacattgtcgaaaggattgtgctggatgaagctgggttacagtacatctgtttcaacatgggacgtttctttgcgctagcctctgttttacaaaccatggtgatttctctagctgagcaaccctccgctaggttgctgaagcacatcatctgttgctaccacaggctgactgatcatccccgggcccttgaggcactgcgaattagattacctgaggctctcaagaacgggacattcgtccactgcctcaaggatgatcccgttgcaaggaactacctccgacaactgctgagtactctggctgctccacgcgtcgaagcacctcaaccaccaggtcccacagagggtggagcacctcacgctggcccaggctcctctcaggctgggccaagtcgcgtacgccgttgatgtgaaccaatctggtcgctgcaattcagagttcactacaaggatgcaaaaatcatttggcgaattgcagctagagctagactagtggagaaccctggcgtgtctggaagccatggtctgtcctgatttcagtaaagcaagaaccagtgttttgtaataataatatgcgctgcaaacgttcgcagtgccctgcacaagtgacccgtttatgtgttttggtgttttggacgcactaag

SEQ ID NO: 9485 - DNA, 676 bp, Sorghum bicolor
  Clone ID: SORBI-28MAY03-CLUS16593_1
gcacgagggcaagacgcactgttcttcgccacaatgtcacggcgcttcagctccttccccctctcgatcggcggtcgttcgagcactacatggctctgctgcccctccctgggtgcttggatcgcctcccttctgtctacgcgttttatatcgggggagctcaaagaagcgcagaggtctcaggggcgcacgtggcccacccattttgactcatcggcatgaaggatggccgtcctgcccggaatgagggcgcccaccgtctagcaggaacaaggcgaagtgaatgtataatggccttcattgctcgagcgggaagttgattctatgcttctgcattgctttctagcactctactcatcagtgtccatcgatctgcagactgaatttacgatctataatttgagctcctgacatctctccaaagcctaatctttgaagactacagggctctgcaggccctcccttctctccaggaattacatatcaatatatcattgcaactcaaaatatcatatggctgctcatatctctattatgacgaatgccaaaactcaacaagaacaaggcctctaagcatacaggtgccttcatgcctgacgcgctctcctggaattctgcttttcctgattatcgcgcactccaatatcatatggctgaccatatcgcttttatgacg

SEQ ID NO: 9486 - DNA, 712 bp, Sorghum bicolor
  Clone ID: SORBI-28MAY03-CLUS17522_1
gcacgaggaaatcgagaggtagaagacgacggccaggagcagcaggccgggccgggcgagatgacgatccggttcgtgctgttcgtgaacaagcagggccagacgcggctggcgcagtactacgagcacctctccctcgacgagcggcgcgccctcgagggcgagatcgtccgcaagtgcctcgcccgcaccgaccagcagtgttcgttcgtggagcaccggaactacaaggtcgtgtacaggcgctacgcctcccttttcttcctcgtcggcgtcgacaatgatgagaatgagttagctatccttgaattcatacatcttttggtggaaactatggatcgtcactttggcaatgtgtgcgagcttgatatcatgttccatctagagaaagtgcacttcatgttggaagagatggtgatgaacggttgcattgtagagacaagtaaacagaacatcttggcaccaatacaacttatggagaaaacttcctaaaatagtaatatccatttgtctagttttgcatccacttttacattttcctgtctgtccccttccataaattttccatctgtatgttaaagtgcaaacaatctctgtaagcatggagtattgaattgattctgtgctttcggataaaaaaaaaaaatcctcttttcatgtatgccttcgctttgaccacatatgtataggtgtatttttcttaagaaaaagc

SEQ ID NO: 9487 - DNA, 979 bp, Sorghum bicolor
  Clone ID: SORBI-28MAY03-CLUS17599_1
gccggccgggccggggttgtaaataggatatgatggatgtccaaatatggttggctatccgacgtatttgccacaaaactatgctacttacctatcttcaggcaccttccagcaagcatacccgagtaatggaccattccatcagtctgctgctgctttgctcggatctggtatgaagtactcgaccccagagtataagaacaacctgtctgccacaggcttacaacagcaacatcagccgcaaccacaaccaccttcatcagtcatctctggttatggaggcttcggaagctcaggcaacatacaaggaaattttacccttaatcagagtactggctctgcatcaactcttggttttgacgaagcattgagcagacagtacaaagacaccagtcaatacatggctctccagcagggtgacaactccggaatgtggcttcatggctcgggttctagagcgacctcgactcttccacctaaccacttttatggttaccagggacagagtcagctgggtggcttccgtcaggcgcagcagccacagccttcccaatttggaggccatgggtatccaacattctaccagtctcagggtggcctgacgcaggagcacccccagaaccttgctgagggcagcctgaatggcttccaggtcgcaccgtctcagccatctcatccgaactggcagcatcagcacacttactgagccctgtacttccttgttatggtggctctttcgccgtcacaagccaagtttctcgtgcttgtgccctcactcgatgcagagtaagctgctcggtttagctgagcttgtaccttgagcgctgagagggtcccaggcatacaacagttagagcgtgttaacatgttgcgtgtgttgccagactgatgcattgtgatttcttttcgatagtatgcggaggtgcagtcctgtataactgagatatgataacctaacaagcagtcgtttctgatttcc

SEQ ID NO: 9488 - DNA, 895 bp, Sorghum bicolor
  unsure (1)..(895): unsure at all n locations
  Clone ID: SORBI-28MAY03-CLUS17643_1
actcggacgcggagactagagcctctcccctcctcgggaagcaggtcaggcaacgagagccagccatggactgctgcttcccctgcctccgaggggccaagaagaaggagaagcagccgccggagaagccccagatccgccccgcctcagttgttgatgcagagaaacccaaacagcgtccgtcgtctagtgtgacgaagcaggattcattcgatttcaacatggaatctgcaaacaagggcattgtcctgagcaatggatctggccacaaccaaatcgctgcgcaaaccttcagtttcagggacctcgcagcagccacgagcaacttcagagctgattgccttcttggtgagggtggctttggacgggtgtacagaggctatctggacagtgtcagccaggttgttgctataaagcagcttgaccgtaacggattacaaggcaacagggagtttcttgttgaagttctgatgttgagcttgctgcatcacccaaatcttgtcagtcttattggctactgtgctgatggggatcagaggcttttggtttatgagtatatgcctctaggttctcttgaggatcaccttcatgatccttccccagataaggcacggcttgactggaatacaaggatgaagatagctgctggtgcagcgaaagggctagagtatttgcatgatgccagtcctcctgtcatataccgggacttgaaatgttcaaacatcttgcttggagagaggtatcacccaaagttgtctgattttggattggcaaagcttggtccaatcggtgacaaaactcatgtttccacaagagtgatggggacatatgggtattgtgctcctgagtatgctatgaccggacagntgacccctaagtcggacatttatagctt

SEQ ID NO: 9489 - DNA, 705 bp, Sorghum bicolor
  Clone ID: SORBI-28MAY03-CLUS17571_1
atttctgcgtctcaagtgcctggccgggccggaaagctcgtcatctaccatttaccgagagaaccattgcggcggctcgccgaaatcccgtccgcggttcctcgcgctcgtggcgagaggctgcccgcttcgtctgaatctggcctccggtggtaatgcagcgtattgcatctcttcgtcgcccactccctcttggcctctcccatctccccctcctggcggcctctccgctcctagtccggcggatccagtccgacggatccggcctgggtggcacagctgcaaggatgggtcagagtggatatttacaaatagaagagttgatgaagcccatcaattcacaatgcatgtgaattttgggaaatcaaagctagaaagaagccatcatagcagggattctagaaggatatggagagattcagcaacttcagttatttgctcctggcaccaagaataattagctgctagcactgtctgttaggactattagtttggtgacaaaggtcacttgtgagacagggatgtgaaatatccatctgtttattttatctaagatacctttgtgactaaggtcaattcttgaacaattactttggtgtttgcgatgaatgtaacaaagatgttgatgtgtgacttgtgaacttgtgtatttggtcgtgaatggaatatattgttgggcaaaaaaaaaattcaaaaaggccccta

SEQ ID NO: 9490 - DNA, 622 bp, Sorghum bicolor
  Clone ID: LIB5052-001-A1-XP1-H1
ctgtgcggcgctcaggcggcgggttcgacctcatcctcgcaaatcgccggtcgtcgttcgttcctcaccgccgagtgtcggcaccttccgccgtcgatggcttaatcccagccacgagcgtcccccattccctactccttggacggccgccgccgccgccgtgaaaatcgcgtctctcgcttctcgatgcaccaggaccgtggcgccgtcgctggtactcacagcagtagattccatcaagagagcagatgatttgaatgatcggcccaatatttttatttgttcttattggctggctacctcgattcctattggctgcacattgctagatctatccagaagagcatgctccttgtaagcaggacatggagagattcaacaacttcagttattttctcctggcaccaagaataattagctgctagcactgtctgttaggactattagtttggtgacaaaggtcacttatgagacagggatgtgaaatatccatctgtttattttatctaagatacctttgtaactaaggtcatttcttgaacaattactttggtgtttgcaatgaatgtaacaaagatgttgatgtgtgacttgtgaaaaaaaaaaaaaaaaaaggccccta

SEQ ID NO: 9491 - DNA, 713 bp, Sorghum bicolor
  Clone ID: SORBI-28MAY03-CLUS17713_1
acgcgacccaccccacctcgaccgtctctttctcgcatcgccgcgccgctccgctccgctcggctccctcccgtccgttcgtcgccgtcgcctcgcggtcgcgccaccgccgacgcgctccgtcctcctcgccaccctcggttgctgcccgggccggccaggcgggaggagcagatgggggtgtatctcagcacgcccaagacggacaagctctccgccgatggagagaacagccgcgtccgcttcggcctctcgtccatgcaggggtggcggaccaccatggaggacgcgcatgctgcgtttccagaccttgatgactgcacatccttttttggtgtttatgatggccatggtggaaaaggcgtatcaaaattctgtgcgaggcatttgcataaacaagtgcttataaatgatgcaaattcatccggtgatttgccggcttctgtccataaagctttcttaaggatggatgagatgatgaaagggcagaggggttggagagaactaactgagttgggagataagggaaacaagatctcaggtatgctagagggcataatatggcctcccaagggtggtgattcagataagatagaggaagattgggataatgaggagggtccaaattcgaattttcctggaccaacatctggaagcacagcttgtgtggctgtcataagaatgatcagctaattgttgcaaatgctggggat

SEQ ID NO: 9492 - DNA, 820 bp, Sorghum bicolor
  Clone ID: SORBI-28MAY03-CLUS17910_1
gccggccgggccgggatcgccccctgcccctgcctgctctctctctctctcatctcatttctccctgccagctctgtgctcatcactgcgtgtttcccatctgatcctcgagcctcccagcagtgtggtacaggttgcagaaagaggaagcagatcgagatggctggaggcggcgaccacaactccgcccagacgaacggcggaggtcacgaccagagggccatggaggagggcaggaaggaggcggagtacgctgaccaccagggctgcgccgccatggtcgtctccgtcccattcatccagaagatcatcgcggagatcttcgggacctacttcctgatgttcgcggggtgcggcgcggtgacgatcaacgcgagcaagaacgggcagatcacgttcccgggcgtggccatcgtgtggggcctggccgtgatggtgatggtgtacgccgtcggccacatctccggcgcgcacttcaacccggccgtcaccttcgccttcgccaccagcgggcggttcccgtggcggcagctccccgcgtacgtgctggcgcagatgctgggcgccgtgctcgcctccggcacgctgcgcctcatgttcggcggccgccacgagcacttccccggcacgctccccacgggctccgacgtccagtcgctcgtcatcgagatcatcaccacgttttacctcatgttcgtcatctccggcgtcgcaacagacaacagagcgatcggggagctggcagggctggccgtgggcgcaaccatcctgcttaacgtgctcattgccgggcccgtctctggcgcgtcgatgaacccgg

SEQ ID NO: 9493 - DNA, 870 bp, Sorghum bicolor
  Clone ID: SORBI-28MAY03-CLUS16870_1
ggccggctcgagggccggccggggtctgggagtctaacccaaaccaaacagacagccaccgagtcctgccgctctgctataaacgcacactcttctgtctccacgagatcgttgaattcatctcttccctagcagcaccagccatggcgaagccgcagcttcttctctgcttcctagtcgccgccgccgcgacgctgctcgtcgccacggccaagaaatccggggacgtgacggaactccagatcggcgtcaagtacaagccggaatcttgcagcattcaagctcacaaaggtgacaaggttaaagttcactaccgtggaaaacttactgatggaacagtttttgattcaagctatgaaagaggtgaccctattgaatttgatttgggcactggacaagtgatcaaaggatgggatcagggtctcctaggaatgtgcgttggtgaaaagcggaagttgaagattccatcaaagcttggctatgggcctcaaggctcgccacctactattcctggtggagcaaccctaatatttgacacggagcttgtcgctgtcaatggagaaccagccaaccaatctgacaacgagctttagatatatcaaatagatgaatgcataaccttattactcagaactcggcaaatgtaatacattccaagaaatgagccttcattccctgtgactttctttcgatattccacaagaacatctaggatttctggagcaaactctggtctgttttgactagtttacgcatctgtgtctggaatccggagaattgctctgaaatcataaactaaaaaataaaagccctctgcttagttttctgggcccttttttttttccaaaaaaaaaaaaaaaaaaggcccct

SEQ ID NO: 9494 - DNA, 671 bp, Sorghum bicolor
  Clone ID: SORBI-28MAY03-CLUS1693_1
tggcgtacgtgactaacgtgtttcggtggtctgccgtgttgaagctccaattattgctgctacttctctgctgacagaagcatggatatcggatcaggttgtcacaaaacgcctgcccggaccgacaaaaacaccgcaatcgtctggtgcagcccctctagtacaaacacattctgctgagaaacgtgagaaacgtgtttcggtggaaaggtgtgttgaacttacaattattgctgctactcatggactgaaagaagcatggatatcatatcagcctgtgttgactgttatgtacttggtgcaatacatgccaacagttggttactggctcatggacaaggttggtgcaaaacggctggatgcggctgcaaagaaagggaacacgtatagttggaatctcattttcggcagcaagaaatcagcatgaccaagttactcgtagctcctagtaccagggtatttctggattcggatggtcacgtgactttatgcttgtaagcaaaaagtttagactgaaaaggaacagagcatctatagaagctatacagtttagtgaaaaactggactcttaactatggcagggtctaggtaatcgtcatttgtcctaggttgctttttaaggatattctagtctctctagatgaaatgctatttgtgtgagccaatggtca

SEQ ID NO: 9495 - DNA, 538 bp, Sorghum bicolor
  Clone ID: SORBI-28MAY03-CLUS16873_1
gccggccgggccgggagcctctacgcgagcggccgcttcacccatccagccccgcaccgccgcacgacgtcgccggaaccggagaagggaggggggaacgcaagatggacaaggccaataagctcagcgccggagccggggagaagacggccaagaacaggagccacggatccacggcgctgttcgtcgcggtggactacgccttcctgctcgccttcgccggcttcctcgcctacctcgtcgggtcgcggatccttccctccgccgccggctccgcctagaccggtccgcgttcgtggatctctctcttctttcttccacctttttggttttttttttcttggagccgatggcggtgagagcaccgagatcttgccgggcggccgggtggctctcgtctcgatctgacgccgctcccgcgatgtaatccggacacattttgatgagacgagaactagcggtgtttcttggcaatttgcctggtaatgtgacaaatctttgctttgttcttgaaaaaaaaaaaaaaaaaaggccccta

SEQ ID NO: 9496 - DNA, 728 bp, Sorghum bicolor
  Clone ID: SORBI-28MAY03-CLUS16965_1
ggatgctgaggcaatccttggggacatacgcggggaatgccgggatccaattcagtatactctaatgaaagatcctgtgacactgccatcatcgaaggtcacagtagatcggcccgtaatcatcaggcatctgctgagtgattctacagatccatttaaccgctcccacctcactcaagacatgctgataccaaacacggagctcaagctgcagatcgaggaatttgtccggtcccaacagtcgagaaagcgatctgctgcggtgtcagagattggcgaagcggacggtgctgatgatatggccgaatgaattgtgccaggagcagcctagcaggggatggacattttttattttgcgggaaaagagggatggttaacttacacgaaatttatgggtccatcggtccgtagcttgtgtccccattgtctcgattctttgtaaatgttgtaagtgcacacttgaaatctctaagttcatcgatacaaatctaattatagaggaagcctggtctccaaaatcttacaccgttagcccgtaacataaacagtttgtgttacgtattcccactacaacccttcgccttggctttctagggcatggcacgatgagagtttccatgtccagtcccagcgtgtcagcttcaaccccaggaacgcgtgtgtaattttaaataaatatattttttttggaaaaaagtaatcgcagaactgggagatggagaaattgc

SEQ ID NO: 9497 - DNA, 654 bp, Sorghum bicolor
  Clone ID: SORBI-28MAY03-CLUS16968_1
gtgtgcggcggtcgaagcaatgggggggaggaagacaggcgaacacgaacacgaagcactaatcgacggcatccaggcggacgactccccggcagtggcggacgacgacgtctgcccggcgaacttcgccgttattgtggcctctcttccaagcgggttctggtgctccaccgtcttcttcctgcacctcccccgcgggttctgcgtcctcagcggcgtgctgctgcgcctccagactccccacgcgctgttcctggagcgccgccccgccgacatcctcctggcgagcttccccaagagcggcaccacctggctcaaggccctcgccttcgccacggcgcgcaggtccgtccactcgccgctcaacggcgccgccggacacccgctcctctccagcagctcccacaactgcgtcgcgttgctcgacatcctagggttattagaaagcaacgacgatgacggcaacgacgacacgatggcgccaccgccgcgtctccttagcacgcacttgccctactccctgctcccgagacgcgccacggcggacggcggcggcggcaacagctccgggtgctggtatgtgagcatccggagggagcccgcggccgtgctacgctccgagcgcccgacagcggcggcggcaggagccacctt

SEQ ID NO: 9498 - DNA, 859 bp, Sorghum bicolor
  Clone ID: SORBI-28MAY03-CLUS18233_1
ctcgaggccggccccggccgggcaagggcattcctgcacgtcttggattggaggcggttggagttgtactcttgccggctttgattgccttctgcttcccgcaaccgcaactctgcttcccaacaaaaccgaacaagccccctcatcctcttcttgcgtcttccttctccaatctctccgtttccacttcgcggtgctaatcctactcccagctcgcgcgctgagatggacggtagcagcctgaaatccgcgcagctcctggagctgatgcgtcagcacctggccaccgacgccggcaaggagctcaccaagaaggtcggcctcgtctaccagctcaacatcgcacccaagaagatcggcgttgatgaggagatcttcgtggtcgacctcaagaagggcgaggtcaccaaagggccgtaccagggaaaaccggatgctactttctccttcacggataacgatttcattggaatcgccaccggcaagacgaacccgcagattgcgttcatccgaggggcgattaaaatcaaggggagcataaacgcggcacagaagttcacccctgacatcttccccaagcctgctaagctgtagaaggttagattgtgttatttggtcacggctggataataaggtttgcaagcttcaatgactgtgtaccagatagaatgagtgggacatgaaaagcacacgaccttatgatgttatctgtggaatttggatatggttaaagttccaattccaattaaatgaagctcaatgtttgtgtcttgtgtttagctttcttcttcattagaataaactggtatgatgcttgctgatgccccacgagtagttataattggctactggcaaggtt

SEQ ID NO: 9499 - DNA, 552 bp, Sorghum bicolor
  Clone ID: SORBI-28MAY03-CLUS18248_1
tgtgcgccgactcgcccggccgccccctaacacagccgagaggaagccggcggcggcgagccgaatccaatagaacgcgagcaggcggcggcgatggcatggcgggcgagcctgtctcggagcgtgaaggagatccgcgtcctcttctgccagtcctccccggccagcgccgctgcccgggagttcgtgaagaagaactatggtgacatcaaggcccgcaaccccgccctccccttccttgtccgcgagtgctccggtgtccagccccagctctgggctcgctacgatatgggcgtggagagatgtgtgaacttggatggcctgacagaagcacagattgataagaagctggaggagcttgccaaggccggcgagtctcttaaaaccaaatagttttggaacttgtatcatgtcttgtgtttaatgttcccaaataaaagataccatatcggtggacaattgttactcttcattattcctgtagtccgtggaatgaagtcttcaattggctcaaattaatgtgaaggaaaaaaaaaaaaaaaaaggccccta

SEQ ID NO: 9500 - DNA, 1064 bp, Sorghum bicolor
  Clone ID: SORBI-28MAY03-CLUS18262_1
gccggccgggccttggactgaaaccagaccagaccaaccctgtcaaagcccacagcagagagggaaacagcagagagttgcaacaaaaagttcgttcagctcctagcctcctaccttctgtgcgttgctctgcgaggaggaggaggaggaggaggaggaggaggaggaggaggaaggagaggttgatttgatcgagcagcatggcgccgcggccacagccgtggggccaccaggtgctcacgcttcttctgctcgtcgtcgccgcggcgacggcggcggcggtcgtggtgagagccgacgacgagaagtgcagcaacccgtgcgggaacccgtgcggcgagccgtgcgtgtacgcgagccctccaccacccgcgcttcccccgccggtgtactacccgccgccggcgcccgtgtactcgcccccgccgccggagtactacccgccgccgaccccgacgaccccgaccccgaccacgccctactgcccgccgccgccgtcgggcggcggcggcgggtacgagccgtcgccagggtacacgccggcgacgccatacacgcccggcgggtacaacccgacgacgccgtcctgcgggggcggcgggtgcttctcgccgccctacacgccggggatgctctacccgcaggaccccgggttccggcccaacgccgcgcccgcccgcgccgaggcgtggcgcgccgtgctcctcgtctccgcggcagcgacggcggcggcctgcgcctgcttcggcttgtgatcgatcgatcgatcggacgccgcccatggtgatcatcgtcgtccaccgcgcgcagactgcatggcggttttagttccgcgcgctccgtgttaataataagattagaggaaggattaagttgggtaagattatttttttttcctcgtcacttcatcatgtcgtttgttgttgttggtaaattcatcgttcttgtcatgtacttaaatcgttggttcatctgttttcgtcataggaacacaagttcatcatccatcatatcggactatatgtgaaacatatataactgtctctcgtcaaactgaaataaca

SEQ ID NO: 9501 - DNA, 929 bp, Sorghum bicolor
  Clone ID: SORBI-28MAY03-CLUS1834_1
gcacgaggcagcggcgaaggtgccgagcgtccgcaagatgaaaaggaccgccaagagggcagtgaagacgaagaccaacaacgtggaggcggtggtggcagtctctttctgatggagaagattctccgaccggtaactggtgatttagaggtcttgttctatggcaatggcagaagaacctcgcactgcaaactcttgccacctccgccctatatccatgagccctccaagatcgggtcttacgctgtggttggcaatggcgctcatgtttgcatatcggtcaatggcagaggcacctatttcctggacacagccgggcacacatggaacaaagctggtgactggactcttcccttccatggcaaggtcgaatatgtacctgagcttgaactctggtttggcctctccgccaatgcccaacaattgattgctgctgacctctccaccacggactcccagccacagccagtttacagttggaagctgtttcagcctctagaagaatggatcgaacacaaagacgctcaacttgtgaacctgggctcaggcagattttgcattgcaaggttcttcaaacatgactttgattttgttgaacaagatgactctccccgtgattgtattgtcttgaccggtttggaggtggtcccgcgtgtcctcaatggtaaagtgaaactcgaaatgttccatcacaaatcgatgcgtcacacgactttgcctatctatggaaattccgtcgatttagtgttctgatgaataaatttggggatttgctttcaaactctcttttatcatcatatgcggtctggatgtctctgggcctgctaatttcctctgcgtgattgtgtatacttttaaaattttaaggattataagtacttgggtatgaagtctcagcgttgactgtagtcgcatgtattctgtatata

SEQ ID NO: 9502 - DNA, 652 bp, Sorghum bicolor
  Clone ID: SORBI-28MAY03-CLUS18417_1
gcacgaggcgccggccgggccgcgagttctttgcgggaggacgagacacgttgtggggctagtaggcggcgcctgaggcttcggcggccctagtctcttctctcggcagggcacagatggcgtccggcggtccggcgctcgagccgctcgtcgaccaggtcatctccgtcatcaccaacgatggccgcaacattgtgggtacgctcaggggattcgatcaggccaccaacattatcctcgacgagtcccacgagagggtctattctagaaaggagggagtccaacaacttgttcttggtctgtacattatcaggggtgacaacataagcgttgtgggcgaggttgacgaagatctggattcaagattggatatgtcgaagctaagggcacatccactgaagcctgttatccactgaggtccgtccgagtgtgtgttttgggtaccctgtggactggatgagtcattgttgcatgcgggatgtagcatcgtcatcatcatgaagagacagggggactgatgagtaatatgaacatgtatcttgcgtattgtgaatcaatgaatatgtgttggctgtttgggctgcttgcctacgcattcgatctgtaagatatatactaagattgcagttgcctctttttttttttcccccta

SEQ ID NO: 9503 - DNA, 1122 bp, Sorghum bicolor
  Clone ID: SORBI-28MAY03-CLUS28740_1
gggctcgcttcccttccctctgcttggcgatgtattcgctgattattgcctcgcctaaggatgcccggttcggtgggggcgcagctcgaatatgatctagaaattttatacagcctttgctaaattgtgttctctgctccaaggacaaaaatattaataaactttttaggaaggctcctctgtgtttgtgtgaaaaaaaggtcacgaggcttgcccatttttttatgcgttaggatttcattcccttggctttggtgctctggtttctcgagcgcctttacccagatcatattgttgttgttcctgtcctccctttgctccctcttctgcgtttctctcctttgaccttcgatctgtgtcttgggcttacagggaatactcatatctgtttaacaagagttatgttcggatcgtacttctctgtctttcgagcacacccgcgctcgttgttccaagctccttcaaaccagccactctccggccttgatacttattatcatgtcagcttgagcaccgtgtagggtgtgaaagatgtttccacactcggtccgaactgcatgctgcgtgcctctaattcatttcctatgcggatcagtttggtttcatgctgtgatgacaattcctagctatctattgaggatatgggcattggaaattttgcaaattactgaatgttacaggtcagacaccaaaaaaggaaggctctgctagcatcatatgtttgactatgtacttttacattttcaaccagacgtgatttggtgttggcccctgctgggtttttcttgggcctatgcccccttcgtactgtgggtacctcgtcttgcgggtcctggtgccacgcattacttcctgaccacaatagcctcatggaagtacttagaggttacagctcaggcaccaaaaaaggaaggctctgctagcatcatatgtttgactatgtacttttacatttttatacagatgttaaaagatttttaacacagataaggttttcatggtgtaaaacctccattgtacagatgataccttgcctagctatagtaggtaccacacaattagttgttaaacattataccaatgtaatttatcatcctgtaataaatgtgtgtgtcgctaatc

SEQ ID NO: 9504 - DNA, 753 bp, Sorghum bicolor
  Clone ID: SORBI-28MAY03-CLUS28772_1
cggtggtcttggtggtggttctggtggaggaggtgttcttggtggcggaggaggagccggggccggtggtggttacggcggaggagcaggtgcaggcggtggcactggcggcgggtatggcggaggtgctggtgcaggaggcggcgctggaggcggctatggcggaggtgccggtgcaggaggcggttatggtggaggagctggtgggggcactggtggtggatacggtggaggtgcaggcgcaggaggtggctctggaggcggttacggtggaggagctggaggtggcgccggtggtggctacggcggaggtgctggcggaggctacggtggtggtgctggcgctgggggtggccttggctccggcggcggcggtggttatggtggtggcgccggaggtggaggtggcataggtggcggtgtctgattcaacctcttacatgcatgcatgcatatgcgtgcatagcgagtgcatgcaaggtctcgacgcagactcccttgacaggcatgcgtggagtcaacctaccatgtgtgtgctatacggctataccgatcgatcctgatcatactctctgcataacgatcttaatacacagaataagaatgttgcatatgcgtctagtctgtgataattgtatgatatatagtagtttatacggagtatatatatacactgcgttagtagcaatctgaaaggttgctttgtattgtactatcttcattattgtatttgtcgaaataaagaaactgtta

SEQ ID NO: 9505 - DNA, 675 bp, Sorghum bicolor
  Clone ID: SORBI-28MAY03-CLUS28801_1
gttgggcccccatgggtcaaagggcgtgaggagagagagaggaaggaagcgtaagagacgccaccgtgacacagaggacgcaagctctgagagggaggccaccgggggttcgagggagtctcggaggcagggcagggtccgccagggagcgaggaagcgggccctgggggcgctcttttggacacccatggttcaaaagataagaaaagagataaagaaaagaaacataagagacgccaccatgacacagatgatgtaagctctgaaagggatgataaagatgattctaagaagtctcggaggcatagcagtgatcgcaagaaatctaggaagcatgcacatggttcagactcggatagtgaaaaccggcacaaaagacataaaaaggaccgagatagtagcagaagaaatggtggacatgagctggaagatggtgaacttggagaagatggagaggtcattgactctttccgttggcccccctgattgccggtcaggcctgcccctcgtctccttcgccgtcgctcctattcttcttacttttgacatagtgcttcgggcttaacaatcattagtgttatagttatttagtcccatatattctgaaatattttctttaatatctacatttctgccgtttcacttgtggttcttgtcgctaatgtcatgttgaca

SEQ ID NO: 9506 - DNA, 801 bp, Sorghum bicolor
  Clone ID: SORBI-28MAY03-CLUS2897_1
cgtccgggaccttggaatcaataagctagaagtgtcaaagggagctgtagagcctcatgaggcgtggagcaagaacgtacttgagaggctcacttctgatgctcagaggctgttgagcatccaagcgagcattgaggagttgaagcacaaaatggaggggccgtcaaagggcaaatccccaatgaattctgagtacagcagtgtgagcacgcagctgcatgagacagagggttttgtcttggaacagatcaatttcaacaacaaattgaccaggaaggctgagaactatcctgcgttgtcagataatatgaacaccgagcgagaagggtattccagcaggaggaagatctccgagcaggtgcagaaagggtcagaaaatgtggcaaggttggaactggaacttcagaagatacagtatgtcttgctcaagcttgaggaagagcacgagtacagaaggctcaaggtctctgataagcgcacccgtgtgcttttgagagactatctgtatggaaggaaggaccgtggtggcgggcagaagaaaaagaagaagagggtcccgttctgtggttgtgttcgtccgaaatcaagaacagagccgtaaacttttttgttgtcgcgggccgaagaaatcgagatgctggcacctgcacctccaagaggttggttagtgtcacctgtgcattggaagaggaggtggtgttcctaggatctcctttgtaattgagctagcattttcttagtatcctaagaagcttatgtactaaaatttttggttccatgtctaaatgaggccttctagct

SEQ ID NO: 9507 - DNA, 700 bp, Sorghum bicolor
  Clone ID: SORBI-28MAY03-CLUS28921_1
aagcctgaaggttaggcttagatgtgggctgagcaatggcccttttcatgtcgaggcgcctgccggatgcgtcctggccgctgcctgaaggttaggcttagatgtgggctgagcaatgaacttaatgatgtcgatgagcctagcagatgcgagtatgtggctgtattgtcgactcctgcagtttgcgttgaggataagctgaaggagctgcaaaacaaattggacgccatgtcttcaaagcagcccgggcatgatgaactttaaattgttctggcatgaacataaagaaaatgtcaccatgaagcatagctctgacagttacatccataaccataagagtggaagtcaatgaggagatatatggaagggccaagtgggagaaatgggaatgtagagttcaggccacctaccaggcaatgttagctcgcatagaaccttttttagctgaatttgataggatgttgcaattttccagcctcatcctgagttgtttggtggaggcgactgcaaccgtgcttttctttgtgatttaacattgctctatttagggaaagacgctagacgtctccagcttcattgccgagccattacacatttgatggaatatatagtaagaaacagtataccctgaaccagtataatttaaagatgtcggttgccccgggttgttacatgatacaactctgttcagcacgggcca

SEQ ID NO: 9508 - DNA, 1203 bp, Sorghum bicolor
  Clone ID: SORBI-28MAY03-CLUS18996_1
cggccgggctgggtgacaattgccacctgaatggcggggaaaaggccaatggtgccagggataccagaattgggaaggtccgcatccgcctctcgacgcttgaaactgatcgggtgtatacccactcataccctcttattgttctgacacctggtggcgttaagaagatgggtgaggtgcagcttgctgtccgtttcacatgctcatcactgctcaacatgatgcatctgtactcacagcccttgctgcccaagatgcactatgtgcacccattgtccgtgatacaggtggacaacctgaggcgccaagccacaaacattgtctcgacaaggctgggccgtgcagagccaccactgcgaaaggaaatcgtggagtacatgcttgacgttgactcgcacatgtggagcatgagaaagagcaaggctaacttcttccgtatcatgggtgtcctgagccctctgattgcagtggccaagtggttcgatcagatctgtctctggaggaacccgctgaccaccattctgatccatgtcctcttcgtgatactggttctgtacccagagctgatactgcccacaatcttcctttacctgttcctgatcggggtgtggtactacaggtggcggccaaggcagccgccgcacatggacacccgcctctcccacgcggagactgcccaccccgatgagctcgatgaggagtttgacaccttccccacctcccgcccgccggacatcgtgcggatgcggtatgacaggctgcgcagcgttgcggggaggatccagacagtggtcggcgaccttgcgacgcagggcgagcggctgcagtcgctgctgagctggagggacccaagggccactgcgctgttcgtggtcttctgcttcatcgccgccatcgtcctgtatgtcaccccgttccgcgtcgtggtcttcctcgcaggcctgtacgtgctgaggcaccccaggttccgccacaggatgccatccgtcccgctcaacttcttcaggcgtctgccggcaaggaccgacagcatgctgtaggtgctgcaggtgcctggttccattgctggcttggtggtttcacctgtcgattgcagctcgcagatggtttctctctctcactctctgtcttgagtgtatctgaaaacgatgaactgctaggtaccttcggtacttttgtagctctctctgttgcatggttggc

SEQ ID NO: 9509 - DNA, 789 bp, Sorghum bicolor
  unsure (1)..(789): unsure at all n locations
  Clone ID: SORBI-28MAY03-CLUS19100_1
gtggcggccgcntcgagnngccggccgggctgcagaaagggtactttgcaggcggtgtagggcactctccaacacaatcaatcaacacataagcaacacccaaatgcccccttgagcacacacactctctcttcttcaaccctcctctccctcccctctctctctctctctcccctgcattcttaggcttacatggctcagcagctcgtcgggcgaatcacaatggaggtggcgccatccaagctgccgtcgatgaagaccaggcgtgccaggctcctgacgagcctcgacacgatcgcggaggacgacaaggaggcagccatggagtcacagtcaccaagggcgccgccgccgcctctgcgcaatgcgagctgcggcggcgtggaggtcatcgtcgacacccctatgcactgcgccgacaagctggccttcctcgcccccatggcgaagaccgagtgcctcaagatcaaagcctaagtttggtaggagagagagatgagggtgagggaatcatggagctggagagtcttgctctcttgttttagttctgagcataaggcaatccctttttcgttttacgtacgctatagtagctgtcactgttttgcattgctatgttcatggtggggcactagtaagaactattactaataacgtggttttttgcttctacccttcaatgtgaagatagaagatcaagaacactactgaatcaaagtctgtaacttttttcagccttgataaaaaaaaaatttaatgccacaaaaaaaaaaaaaaaaagggccccta

SEQ ID NO: 9510 - DNA, 701 bp, Sorghum bicolor
  Clone ID: SORBI-28MAY03-CLUS19151_1
gccggccgccgggatttttcccgtctgctgtcggcatcgtcacccctttcggtcgcgtccacctgctcgcttcagttcgtccagcttccaagagcagctcaagcctcgccggaaagggcacgatgagtgatcccaagtacgcctatccctaccctgcacaaggttactaccaggggccgtaccagggaccgccggtgatggcgccgccgcagtacgccgcgccgccgcccaggagggagccgagcttccttgaaggctgccttgccgcgctttgctgctgctgcttgatcgacgagtgctgctgcgacccatccatcatcttcgtcagctagactacacaaggctagaagggaggggatccgatcggcccggccttgctacctcttgctcttgcgttgtgtacactgtacagacaggagcggcttcagctccatccggatcgaggaagaacctattgacaacgatatatatatgtatgtatatatgtatctagtgctactttattccagcaaacctccagcttgagctcatgtatctcggtcgagtttatacttgatagcgagagtgcgtgcgtgtgtgatctagctcttatcatcatctattcatggccctgcttgcttgtgtgtccccccaaaaaaaaaaaaaaaatattcgtccgggccgccggccctaaactataaataatcaaccccccccccccc

SEQ ID NO: 9511 - DNA, 745 bp, Sorghum bicolor
  Clone ID: SORBI-28MAY03-CLUS1903_1
gccggccgggtcgggggcgaccaaggaattgaagaaaccggccgcgtcgtcctgcgctgatcaggtcgtcgtcggtgaatcgaagaaggagcgctagctgccgtccggcggcaggggagagcgatcgagcagatcatgtctacgctgccaggaggcttcctgtccgtgcgcgtcctgcgagggatcaaccttgtcagctgcgacgccaagggcagtgacccctacgtcgtgatcagcctggatggccagaaactgaagacgagtgtgatgaagaagacggtgaacccagtgtggaacgaggatctaaccttggcagtcatggacgcgtcagcacccatcaagctagaggttttcgacaaggacacgttcagcaaggacgacatgatgggggacgcggagttcgacatcgaggcgctggtgcagatgatacagatggacctggaggacatccgcagcggcaccgtcgtccgcaccgtgcgccccggcggcaaggacagctgcctcgccgacgagagccacatcatctgggacaacggacaggtcgtccaggacatcctcctcaagctcaggaacgtccacaccggcgtcgtccacctgcagctcaaatgggtcaccatcccagactgaagaaagtgatcatcagctgctccgatccccgggcatgacgaactcttcggtgataattacagtgtagtactatgcataattacaatgttgaagaatgcattggatttgagtagagcca

SEQ ID NO: 9512 - DNA, 706 bp, Sorghum bicolor
  Clone ID: LIB3480-046-P1-K1-G7
cgcgtcgtcctgctctgattagaacacagcaggtctcgtcgtcgtcgtcgtcgtcggtgaatcgaagaaggagcgctagctgccgtccggcggcaggggagagcgatcgagcagatcatgtctacgctgccaggaggcttcctgtccgtgcgcgtcctgcgagggatcaaccttgtcagctgcgacgccaagggcagtgacccctacgtcgtgatcagcctggatggccagaaactgaagacgagtgtgatgaagaagacggtgaacccagtgtggaacgaggatctaaccttggcagtcatggacgcgtcagcacccatcaagctagaggttttcgacaaggacacgttcagcaaggacgacatgatgggggacgcggagttcgacatcgaggcgctggtgcagatgatacagatggacctggaggacatccgcagcggcaccgtcgtccgcaccgtgcgccccggcggcaaggacagctgcctcgccgacgagagccacatcatctgggacaacggacaggtcgtccaggacatcctcctcaagctcaggaacgtccacaccggcgtcgtccacctgcagctcaaatgggtcaccatcccagattaaacacgtaccagttctaacgaattccccttccgcgccgtcttcgacgatctgcagactgaagaaagtgatcatcagctgctccgatccccggccatga

SEQ ID NO: 9513 - DNA, 594 bp, Sorghum bicolor
  Clone ID: SORBI-28MAY03-CLUS1917_1
ggacgagcttatggatcattggacggctatccaggaattgctacggcatttttggtcatcgtatccaataacaagtgcagtcctttataacaaggttcaaagagttaaagaagctatgacacagatatatcaaaagttgcagcttataaaggaatcggcgcagcctgatgtaagacatgaaatatctcggctcgtaaagcccatgactcaggccttggatgccgccttcaaccacgatctggaacagcagcagaagtcatccaagaccgggaacaggcacaacgggttttgactgagcccaggagattggtttgaccaacacatcgaagcgagacgggcgtgctgtgccctgatatacaagagctgccgtagaattcttgaggcttctacgattttgatctctctctttttttccccctctcttattaatagctgcaggaggagcctggtatttgcagccccaggatattgatctaatgccatcaattgtttgtaattgaatgaatagtgagactggcaaacgcatgacgctgccaacgcgttgtacttgtacatgacggtcatggctattcgagatagaatcaaagctgtacc

SEQ ID NO: 9514 - DNA, 1443 bp, Sorghum bicolor
  Clone ID: SORBI-28MAY03-CLUS1946_1
cgtccgtggcaacattatttggggacagtaaagacgtggtgaagatggcgaagaataacctgactgactgggatgaatcaagtggacctgatctgaatctatcagagagggcgagcgtgtacttgtgacagctccaagcaatgcggcagtcgataaaatggttgaaagtttgtcgagaaccggattgaacattgtgcgagttgggaaccctgttcgactatcaccctttgttgcctcaaagtccttgggagagattgtgaattgcagacttcgacagttcaggaaggagcttgagagaaagagaacagatttaagaaaggacctgaggcagtgcatagaagacgattctttagctgctggcattcgccaactactgaagcaactcggaaaggatctagaaaataaagaaaaggaaacaatcagagaagtgctctctgatgcacaggttgtgctatcgactaatacaggggcagctgatccactcgtcaggagaactggttcctttgatttagtaattatagatgaagctgggcaagcgattgaaccagcctgctggatacctatattgcaggggaaacgctgtattcttgccggtgaccactgccagcttgcacccgttgtactatcgaggaaggccttggacggtgggcttggcaaatctttattggaaacagcctcgtcattgcatgatggattacttactacaagacttactgtccagtacagaatgcacgattcaatagccatgtgggcatctaaggagatgtaccatggattgctcaaatcctctgatttggttgcttcacatcttcttgctgactctccagttgtcaaggctacttggataacacggtgcccactgctcttacttgacacccggatgccaaatggagccctaaacattggttgcaaggagcacttagatcctgctggcacaggctcgttttataatgaaggagaagcagatatagtcacacagcaagttcttaatcttgtacactgtggtgtgtccccacgccctttcgtcgttccgtcaccctacattgctcaagtgcaattgttaagagagaagctacaagaatatcctgggctttgtcctgttgaggtttcaaccatagatagctttcagggtagggaggcagatgcagtgatcatatcaatggttcgctcgaatccactaggagctgtagggtttctgggcgacagcaggcgcatcaatgtggctattacgagagcacggaagcacgttactgtggtttgtgatacctccacaatttgtcacagcaccttccttgccaggcttcttcgccatatcaggcggtatggccaagtaaaacacgttgcccctggttccttggatggggcttctggcctcggcttcagtcaacctactctcccctctatcagttaacactcaggacaaattacaagcactcttccttc

SEQ ID NO: 9515 - DNA, 682 bp, Sorghum bicolor
  Clone ID: SORBI-28MAY03-CLUS17924_1
gccggccgggcgtgggtgtaaactaaaagtgccgcatcaggaaatcgatcgatatcgaagcaactagtagcttgcaagaatatggtgtccggccatctcctcctctccgccggcgtccttctctccgtcctcgccgcctgcgcggccaccgtcgacgtgacggcgtgcgctccagggctggccatcccggcgccgccagtgccgacctgccgtatctacacggtaagccggacctgcggactcggcgggccctacggtcccgtcgacccttcgccggtgctgaagcagaggtgctgccgggagctcgccgccgtgccgtcacggtgccggtgcgccgcgctggggttcatgatggacggcgtggacgcccccctgcaggatttccgcggctgcacgagggagatgcagaggaccttcgctcgcaggctgacgagggcggccgagtgcaacctgccgaccatcgatggcggcatgtgccactcactcaatagccctaggcccgtcctagaatcagtttccacatactgatgaagttctgtcatctcatgtagtagtttcatataaatatatacagagaataagctagcgttgcatgcgaatgcatcgtcgaatgatctgtatctttatgtatgtactgcgtgagaactatgcactgaatggacaataaatataagcttgatcg

SEQ ID NO: 9516 - DNA, 791 bp, Sorghum bicolor
  Clone ID: SORBI-28MAY03-CLUS1795_1
gccggccggtctcggggaatctcgcccctcgttgcagctgctcacatccctctttctctcctcctcgccggccgaaccgctgattgtttctcaaccagaggaaggaagagatcggaagcatcagccatgtcgaactcggcgtctggaatggccgtttgtgacgaatgcaaactcaagttcctggaactcaaggcgaagaggagcttccgtttcatcgtgttcaagatcaacgagaacgtgcagcaggtggtggtggacaggcttggggaaccaggtgaaagctacgatgccttcaccgcctgcttgcccgccgacgagtgccgctacgcggtgtttgattttgacttcgtcactgatgagaactgccagaagagcaagatcttcttcatctcttgggccccagatacatcgagggtgagaagcaagatgctgtacgcaagctccaaggaccggttcaagagggagctcgacggcattcaggtggagctacaagcaactgacccgagtgaaatgagcatggacatcgtcaagtcgcgagccctctgaaacagcccagccactgcatgctgcaggggcgcatcagctcctgcatgcccgtcgattccttcggtgttggatccgttttcgtgtccttgttttcctggaagcaaaagccttgcattctgtatgagactgtatgccattttcccacttttttcctctatctctgccgtagttctgctactgctgtaaactagaccttatttgtgtttttatctcctggccgaaaaaaaaaaaaaaaaaaggcccct

SEQ ID NO: 9517 - DNA, 1180 bp, Sorghum bicolor
  Clone ID: SORBI-28MAY03-CLUS17926_1
gccggccgggccgggccggaagacgagttctctgtgctttcccgtaggtctgcaagggatggcgcagtaccacagaacaatctgccttctgctacaagaaatgaaaggccatacccaagcccacttcttcctcctccaccagcatcgaagaggcctgtttacactgaggcaagcagtattgactatcttagtggtgactcctacaagtcagaaaaggttccagatgatttcatcaacccaactgctccatctaatatatctacatcatcccattcaaagccagaagtatatccgccaccaagttatggtagcaggccagacagtgtgtctgatgactttataaacccaactgcacctagcttctctgcgccttctcgtcctacaaatgaggagccaacccattcatctgttaagcggcaggaaagtctacctgacgatgacttcataaacccaactgctcttcctggtttctcgtcatcttcagctagtaaggagtccagtgaagatcttccaaaggctccatgggaatcacaagctgctgctgcaggttccctgccgccacctccagcgaggtatggccagagacagcagtactttgagcaaaatgtgtattccggtgggagcaatggaggtggttacgatggactgatgacacagactgaaaacctctccctgaacccacggagcagtgagagtgcatcacggccaacagcatcccgccaggctaaacccgaggactcccttttcaaggacctggtcgacttcgcaaagaccaagccttcgtctccatcgaaaccagccaacagccgcaggacccgctaaacgatatatgtacattgagttgtccagctattcatttcacaggttagcagcggctttagattatacccaatgaaataagggcgcttgaagacaggttttcattgcgttgcgttgcatggggaattattttggttgcgtttagaatcacagctgtcagatacagacagtacttggtcataatcatgggtgtgtgatgtctagttagctgctcttaaatctctgtgttgtcggctttactttttttttcctttttacttagctgtgtatatatatgttacccgattggacagcagtattcatagttgagtttgcagacaagacttggctgattattttcagttaggataaatttggtccc

SEQ ID NO: 9518 - DNA, 646 bp, Sorghum bicolor
  Clone ID: SORBI-28MAY03-CLUS179_1
aaggcaaatttttactccgcacggagaaatttcctatgtgaagattcctgtaggcaagcattgtggatttgttcaatttaccagcaggtcatgtgctgaggaagccatccaaatgctgaatgggagtcagattggtgggcagaaagttcggctttcatggggccgtactcaaaacagacaggcttctcagcaagatgccaacagccagtataatgggaacagctattatggataccgacagcagggttatgaaggttatggctatgctgcacccaatacacaagacccaagcatgcaaaactactatggataccctggttatggtaactatgagcagcagcagcagcagcagtcaacacaggaacagcagcagcagcctccaccagcacaggagcagcagcaacagcagcctccacagcagtgatgatcatgcacttctggagatctatcagatcagagggatggtagagtcacaggccactgcctaatgagacagatatggaggtcatgtagttgcatgggtgcggttggacttgttcttggggaccagtgttaattgatgatggcactccacactccagatgtttcttttgtttgtcgttgagatcttgaccgttaaagtatgctctgttgagattggtgtctt

SEQ ID NO: 9519 - DNA, 631 bp, Sorghum bicolor
  unsure (1)..(631): unsure at all n locations
  Clone ID: LIB3481-049-Q6-K1-G9
gctttcgcanaagttcggctttcaggggccggactcaaaacanacaggcttctcagcaagatgccaacagccagtataatgggaacagctattatggataccgacagcagggttatgaaggttatggctatgctgcacccaatacacaagacccaagcatgcaaaactactatggataccctggttatggtaactatgagcagcagcagcagcagcagtcaacacaggaacagcagcagcagcctccaccagcacaggagcagcagcaacagcagcctccacagcaggtaggacaccgacaatccctattgtttaaatcttactatcctttcatagttggaattaggaaatcgactgttaaaaatattactatcctgaaccagccaactgctggtttgctggtcatacagtgttatgttacgagtcttctatgttgggatgttgacaaggctgatgagtaactttgtggtctttcatttgcagtgatgatcatgcacttctggagatctatcagatcagagggatggtagagtcacaggccactgcctaatgagacagatatggaggtcatgtagttgcatgggtgcggttggacttgttcttggggaccagtgttaattgatgatggcac

SEQ ID NO: 9520 - DNA, 666 bp, Sorghum bicolor
  Clone ID: SORBI-28MAY03-CLUS18109_1
gccggcgggctctggcgctcgagtctgccgggatccccagtctgcctctctcggcgcatcggcgttcacagtgaaagctaaaaccctagttcggacctctactagcaggcgacgggggcggtagagcgtggaatacccggagatgtcagcgcagtctgcggttgcgtcggccgtggagaggctgcaggcagcggcgcaggacgccgccaagtcctcgtcgcgctcggccggcgccttctccgagcaggcacagcaggccctcgtgcccagggccgccggccgggttgtttctctgtcaacatgtacaaaggtcagcgccattagctttgcagttggaattgtggtggggttcacgctcaagaaaaggctacgcagatgggctgctagactgctgaagagaattaaggacgatgactagtgcaatcttttcctcattgtctttggagtttgttcagaagtatgcctactatgtacctcagcatcttctgtagccaactccttatgtgattccacagatttgctatgaatgctggtttatgaatcatcggttcatcatattacagcaccctgaaatgatataacgtcagaaagtatgtggcacactatttttatattattaatggagaaagtattagcgagcaaaaaaaaaaaaaaaaaagggcccta

SEQ ID NO: 9521 - DNA, 1066 bp, Sorghum bicolor
  Clone ID: SORBI-28MAY03-CLUS1970_1
cgtccgccttatatgttttgatccctggacccatgttgacatgtgtatagttgcactagcctactgtcacagtgctaatgctttaaaatatagtggtcaagagaatcgtagattctctaaggtagtataaaaaatgttaagatttaaattatatggagttttagaagacaggcatgttctaacagtttcttcatatgctctcatccttttttatgtaaatttctttcccatagttatatatgtggtgctatctctgttgtggtgctatctttgttccaaatatttctttaaattatatggagttttaaagacagacatgttctaactcttacttatagcttgataaaataatatagttgtggtgctatctttgttccaaatatttccaataccgtaaaaatattatattctgtctttggtttgggacagagaaaaattgagagccttgaggttctacgcttaccactatacatgaatctttatttaacctgcctgctgatgtgtgctctcaccagttacatatttttttctaattttattagttagccttcttcgaccagtaggtgatgttggcctcatcggtactcatcagcaactagtgtgcagctagcacgattttatgatttatctatcttgatttatgtatgcactagctgacattaaaggaacaaatttattatgactactacaaacgtgagcatttgtatcgcttttaccatgtacaacttccccttacttgctctgccactatactgaattttgatctgtactaccatttacttttgtaagtttgacctcctctaatgcacacatgttctgctatagtcaacctggggcaaatgcaccattcggagtcggcaccattcctaccaatcgcatcaaccagttgtacatgtactaataagaactgtacgaccactatgcaacacagcctgcttggagtcatgctttgcccccgttcttttttattttttcaaccatcttcctttcctagtcaatgtatcatgatctattagtacatgtattatttcccaatttgacgttattcgtttttaatcacagaata

SEQ ID NO: 9522 - DNA, 903 bp, Sorghum bicolor
  Clone ID: SORBI-28MAY03-CLUS1972_1
agaaaatgtcataactaaatcagtggagaaggtcaaagagactacaacgactgtgttgcaggggacacaactcttagcaattgatacaggagctgctatgggtttgctaaaaagagctcttattggggatgaactaactcagaaggaaaagcaggctcttcaaagaacgttgacagatttggcatctgttgttcctataggaatactcatgcttttgccactcaccgccgttggtcatgctgctattttggctttcatccaaagatatgtgccatcgatgatcccgtccacatatgctcccgataggttggatctccttagacagcttgagaaagtgaaggaaatggaagttgctgaaggcagcagtgaagatatattggaggccgttggttcgagaactgagcaagtgaaataagctggccatgtacagatggacgattatactgcttagcttacgatctttcctgtaaagttgttttggaacacgacatgaggggtttattttgtttaaagattctttgaatgacacataccgctggaaacagaactgcaaggccatacgaataaccaatcatcgggtcgataaggcgaagaaagatccttccaaatgctccacgtctgtaggctgtatccatacttcacagtatacatgggcgcatggtgcccttcaacatagtagagggtgaatgtccaagctcctcttgggcagtctgtgtagggtagtggttttggtagaggattgtatatatagttaatatgttgtgttgatgatcatttttttctcatgcagcctccacctggaggcggagtaaaaccttgtaaccttgttttttgggaaccaagggaatgcttcattccctgtatccaaattgccaagttcagtgaactagttaatggccaagt

SEQ ID NO: 9523 - DNA, 734 bp, Sorghum bicolor
  Clone ID: SORBI-28MAY03-CLUS19677_2
gccggcctggctgggatccccactgcccgcgactgttcttactcctcccatccaccaacacatacaatcacaatgtcttcctccgagcaaaccttcattgccatcaagcccgacggcgtccagcgcggtctggtcggccccatcatctcccgcttcgagaaccgcggcttcaagcttgtcgccatcaagctcgtcaccgcctccaaggagcacctcgagacccactacgccgacctcgccggcaagcccttcttccccggtctcgttgcctacatgggctccggccccatctgcgccatggtctgggagggccgtgacgccgtcaagaccggccgtgtcatcctcggtgccaccaaccccctcgcttcccagcccggcaccatccgtggtgacttcgccattgacgtcggccgcaacgtctgccacggctccgacgccgtcgagtccgcccagaaggagattgctctctggttcaagcctgaggagctccagagctggaagcaggcctcccacgactgggtctacgagaagtaaatgcattgctaaaagcatgctttttactatccgttcgtagcttcagctgaaaaaggccacgatgcagctgagaacacctcatgttctcgagctgttcacgactgaaatgggaaaacatagtggatacttaagaatagctcagtttgagatacaatgagagcaattgttggttcgaaaaaaaaaaaaaaaaaaggccccta

SEQ ID NO: 9524 - DNA, 809 bp, Sorghum bicolor
  Clone ID: SORBI-28MAY03-CLUS19677_1
gtgcggcgctcgaggcggcccgggccgggaagtcgtatagacaaatcacttttaccaagaaaaactcaaaagtcacttcatcgccaaaatgactaccgagcagaccttcatcgctgtcaagcctgatggtgttcagcgtggcctcatcggtcccatcatcacccgcttcgagaaccgtggcttcaagcttgcgggtatcaagatggtcactccctccaaggagcacctcgagaagcactacgccgacttgagcgacaagcccttcttccccggtctaattgcctacatgggctctggccccgtctgcgccatggtctgggagggccgtgacgccgtcaagaccggccgctccatcctcggtgccaccaaccccctcgcctccgcccccggcaccatccgtggcgactacgccctcgacgttggccgcaacgtctgccacggctccgactccgttgagaacggcaagaaggagattgctctctggttcaaggacggcgaggtccagagctggaagtccgctcagcacgactgggtttacgagaagtagacgtctcatacaattgaaccatgagagtgtggagtgtgcttagtagctggacgtctttgtaacggaaagcaggtctaccgacccgtctagtagttacgaatgcgtctggcggaaggctgtctccggcttgaaggtttaggtgtgggctatgaagatacgatcacatgaaaaggaatatggtagaaaccaatgagacacatgaatgatctcttaaaaaaaaacaaaaaaaaaaaaaaaaggcccctaaggccgcggccgctct

SEQ ID NO: 9525 - DNA, 728 bp, Sorghum bicolor
  Clone ID: SORBI-28MAY03-CLUS19762_1
gcacgaggatagattaagggacaaatttccagctgtatccttcacgggaggcttgaccttgtcagaggctgggtttgacctgctaaataggttgctgacgtatgaccctgagaagcgcatatctgctgatgatgccttggaccatgattggttccgtgaagttcctctgcccaagacgaaggaattcatgccaacgtttcctgctctgaatgaacaggacaggagggtcaagaaatacatgaagagtcctgaccccctggtggagcaacagatgaaagaacaagggagcataggagatcgtggcctttttggctgatctgaaaccagaccagccttactgcaaatgacagtttttgagtgagtaaacatgttccaaggtgaggtgtacaactggacagagaagtatcccgtctacttggtgtgcggtgacagcttattgtgttctataacaggcaaggaatcaaagtggaacagaaatgtactttaagtcccatgcagctagtgttccaatggcggggttagctctctaccagaactataatactctaacctaccatcattataaggtgcagatctaatgcactttcagttcatctaaaaggtctggccttgcgtacaccaagtttcacctctgacatgtgtaaagtattataaattgtcgacttgtaatcagtaatcaaatagatattagtgacatttcagaaaaaaaaaaaaaaaaaaggccccta

SEQ ID NO: 9526 - DNA, 1429 bp, Sorghum bicolor
  unsure (1)..(1429): unsure at all n locations
  Clone ID: SORBI-28MAY03-CLUS19867_1
catgtcaaagattgggaagaagacagagagcaataaaaagaggagaaaggagagaaataatgttggtgttgacctaagacgaaatgcaccagctggagagggcaagaatggtaagggtatcaaagagagaaaaatgtgtgaggatgagaatgatgacggtgaaagagaaaaagaaaacatggcaaagcgaaaggacaagggtagacgagtgagcttcactgatgatgtggaggtgtttaatataggtggcagtgatgatgtagagggtgatgggagtggtgaaattgaacttgtgcatggacgacggtttacctctgaggaagatgcgaagctaatggaagccatggtgaaatatgcagagatgaggcaattaggagagaaagggttagagatgattggggattgtaaaaaatatccagagctcaagggttgttggcctgaagcaccaggatcattacctcatagacccacagatgccgtatacaaacgtgcaaggatcttacttcaaaggagtgctgagcgtaaatggactgaagaggagcgtgagatagttcgacggtttgttgaagagaatggcagaaattggagggtattagcaaaagaacttggaaagaatgaaatccatgtaaaagatctttggagacgaatgaagcccaaaaatttgagaagagggcattggactcaggatgagtaccaaaacttatttgacttggtaaatttggacttgcgtatgaaagcccaccaatacttcgaccctggtcaccgtcagataagagataacatttcttgggaggctatcagtgataaattaaccactcgtaataaccatgagtgctgccagaagtggtacctgcaattagcatcaccactggttaaagaaggaatctgggcagataaagatgattatctgctagtggaagcgcttcaaaatgttgatgctgtttgtgttgaagaagttgactgggagaaccttgttgagcataggtctggggagctttgccgtcaaagatggaaccagatggtccgcctgctcggtggccacagagataagcctttcattgagcaagtggaagtgcttgcaaggcggtactgcccagaaatgcttccgtacagggaatcaaaagcaggtgacttatcggccggcgaacttgctggaggctctgacctgtaatggctagcataacccctcagcgtgtgtgctgttgtaaaattgtttagcttttgtaatacgtatgctataatatgggatctgtagaaatgttagcatcatatggttctaaagcttcagaccttcagtgcacactacagtgtgacttcaacaaactctgttattaattgttgagggcttatgtatctggatttgaaatgttgttcctccactgaatttagttgttttgtcgccaaaaaaaaaaaaaaaaaaggcccctan

SEQ ID NO: 9527 - DNA, 717 bp, Sorghum bicolor
  unsure (1)..(717): unsure at all n locations
  Clone ID: SORBI-28MAY03-CLUS18498_1
gccggccgggtcgcggctgatgatgatttgcctaatgtgtgaggtgtagacagctccaagtccctgcgtgccagggagaacctacttggagtcctacattcaaatgaaaatttatgggcattttctgaagagtatcgccgccgtaagccaggtgccaccacgtcttcgtcgagccgtcgccggcgacgaacagccaacagggaaggggaggaggaggaggaagaggaggatgggcgagttcgacgactactgggcgcgggcgtacaggggcgacgccgccgtcccgcactccgacccgcagcggctcatctccacctggacaggagccttcgccctcggcgcgaccgcctgcgtctgccaccacgcctccgcgcttgcctcccacctcaagtccttaccggcgacttggcaagacatgacactggtgcttgatcaaaagcgatggaagaaagctcttgagaagaaggaacgacaagcttaagctcattattcttcccaactccttgggccatttggatgagcatgtgtcttgtcatcaattgtggcgcatgaaatttcagagttctctatatatataatatattgactgaggttctgcttgattgtgttaaattatccctatttttgagtttgctccatctcagatgacattcacaataatttgtcaatcttataatctccatgatcttttcaaaaaaaaaaaaaaaaggcccctan

SEQ ID NO: 9528 - DNA, 827 bp, Sorghum bicolor
  Clone ID: SORBI-28MAY03-CLUS18644_1
gccggccgggacttggtcatttcccctacgccaaggcacctatgatccctctctctttccctgcttgccaagaactgccagtcgccacaaacgcacccagcctcgctcctctcaccacgatctgagcttgtcgaaggcatgaggccggcaacaagtgtttccaggcccacatcgacgtcgactacatcgccagcagcgataccggcagcggcagcggcagcggcagcggcactgccggcctcgccgtggcactcaccggtgccgtacctgttcggcgggctggccgccatgctgggcctcatcacgctggcgctcctcatcctcgcctgctcctactggaagctcaacaactacctcggcaccggcgacgccaccgcctccgcctcctccggacccggacgacccggagccacggatggcgacggctccaagtcgccggccgcctcccccgcgacgttcgccgacctcgtcgccgtggtcatggccggggagaagatgcccacgttcttggccgcgccgatcgtccgccgagcgcacagtaacggcgccaccgccatagtcaccggagaagggtcgtcgccggaaacggaggaggagcaggagagccgcggcaaggcaggggagggggagagcggtgtggtcgccgacgccgaacgtgaacggcagctagcagatcaggtgtgaagtgaacagggaatggagaaaactgaaatctgctcgatcgatcttcctccaaattttgtttggttatcaggatctgtaaaaattttgtgagaaggatgaaattacatgattcgtgacgtgaagaaaaaaaaaaaaagccccta

SEQ ID NO: 9529 - DNA, 662 bp, Sorghum bicolor
  Clone ID: SORBI-28MAY03-CLUS1847_1
acaataccaagccatctattattagtcagctactaggaagagcaaatcctggcctcatgtcacagggaaagctctgagcgccacaagagactcattccaggcctccttttgtcctccccgttggaggaggatcctgagcactcacatcagtcgtgtgtgtgttagtttcctcctctcacagcgcccgctctgtcgcccttcacctctccttcctctcctccctgtcctgccagggagagaggaagtcagaggcgcgaagtggcgcagagcagacgctcgtgaaccattattgtagctgtcgtcgctgctgctgtcgtcgtcgtcaacaaatccacaaggatggagaagaagccgaccatcctcatgaacaggtacgagctcgggcgcatgctcgggcagggcaccttcgccaaggtgtaccatggccggaacctcgcgtccagccagagcgtggccatcaaggtcattgacaaggagaaggtgctgcgcgtcggcatgatcgaccagatcaagcgggagatctccgtgatgcgcctcgtccgccaccccaacgtcgtgcagctgcacgaggtgatggccagcaagagcaagatatacttcgccatggagtacgtccggggcggcgagctcttcgcccgtgtcgcccgggggcggctcaagga

SEQ ID NO: 9530 - DNA, 1082 bp, Sorghum bicolor
  unsure (1)..(1082): unsure at all n locations
  Clone ID: SORBI-28MAY03-CLUS18870_1
gccggccgggtccggagtagcagctaatccattccaggcagcctgcttatcacaagctatctagctagcacatcggccggaaccacgcacgcacattccttcacgcggccgtgagccatggccaccaccgcgcccatcctccccctcatcctcctcctcctcctcctcctctccacgtcgtccgccgtcctgacgacgacgctggcggcggacagcaacggcaccacccacctgagcttgttcatgcacgacatcacgtcgggcagcaacccaacggcggtgaaggtgatcaagggtccgggcaccaccctgacggcgccaacactcggcatgacgttcggcgacacgatggtgatcgacgacccggtgacggcgacctcgtcgccgacgtccgcggagctgggccggatgcagggcatctacatgctggcgtcgcagtcgggcgcggcgctgatggtgtgcgccaacctgctgctcacgtcgggcgcccacaacgggagcacgctcgcgctgatgggacgcgacgacaccggcgaggatgtccgcgagatccccgtcgtcggcggcaccggcacgttccggatggccaccgggtacgtgctgtggaagacgccggaagggatcaacggcaccgacgccaccgtccagctcgatgtgtatgtcaccacggacggcaacgccgtcgacgcgctcgcgcctgcgtctggtggtggtgactcgtcgtccggaggcggagggtcgccggggtcaggagggtcgtccaagtccagctccgggtctgcggccacggcgaggacgatgaccgccgggtgggtcgtcgccgcagtggttggatcctcatgggtttggtggtgagcatgactggtggtggtgggggagagtagtggggagcaggagaatcttggacagcgatgataatctggttggattggtccgaaagttaggtgagatgagattgtcggtgtattggtggggtttggtgttgtgtgtatggatggttgttgcattgcgctgctcatcatttactactagcagtagctttttccttctgctacttgcaatatactcctatatgtnttttt

SEQ ID NO: 9531 - DNA, 1182 bp, Sorghum bicolor
  Clone ID: SORBI-28MAY03-CLUS1897_1
cgcgtcacctcgagctcggggagccatcctcagggaagggcggccacggcaaatccaagcgcagcgcagcggccgacgaggtcgtccaggccaacaccatcgtgcagtccctgaacgccttctcgtcggtggcgcacatctcagggatgggcctcaaggtgatgccgatgatcgcgcccttctcaaccctccgggcagttaacctctccagcaacttcatcgttcatatctcccctggatcgctgcccaagggcctgcactctcttgatctgtctaggaacaagattgccaacgtcgagggcctccgggagctaaccaagctacgtgtgctcaacctcagctacaaccggatttcgcggattgggcatggtctgtccaactgcacggcgatccgggagctgtacctggcgggcaacaagatcagcgacgtggagggcctgcaccggctgctcaagctggcggtgctggacctcagcttcaacaagatcacgactgccaaggcgctggggcagctggtggccaactaccactccctcctggcgctcaacctcgtgggcaacccggtgcaggccaacgtcggcgacgacgcgctgcgccgggcggtcacggggctcctcccgagccttgcctacctcaacaagcagcccgtgaagccgcagcgcagcgcacgggaggtggccacggacagcattgcgcgcgccgcgctcggcggctcgtgcagtcggagcagccggaagaagacgtcgcggcggctcacgcagagcccacgctcgtcgtccttgaccaggggccgtggtggcggcggcgcctcacccacaccaagaaacccatctcgtcgtcgttgaccaggggatcggaaccaactgcatgcgtgctggccgtggcttgagaggatttgtcaggcactacgattgggcacggtgatgaggtcaaactgaatcggtgggacaaacctaagtatgatgtgagaaaattaccatggaccacataatgtacatacttgttagggagagattgcttagattgatgttgtgctcgatgtatctttgtagcggcgaaacaacaattggtgcttggttgaagatgagatccaatgtcacactgattgttctctacttgtgtgctttatatctatccaactatatttatctgtatctgcactataaagaagcgaataaaaaa

SEQ ID NO: 9532 - DNA, 930 bp, Sorghum bicolor
  Clone ID: SORBI-28MAY03-CLUS20402_1
aacggccggaacctgaaatgcagaaacctgaaatctaccgccgctcccccgtgaaggcgacgccgggctcgggcgggcgcatccccgaccacaccggcggcaacgacccctacgtccctggccccaacttttctcagatctagatcggcggcgaccgcctcttccggccacacccgcgccgccggagacgcatcggtggtgccagagacgaaccagtctgcacaccttctctctgcaggagacgatccttcccggtcgcatctgctatttgcccgagataatcccgtcccagccatgtgaatctgtccagcgataggcggctttgtgtggaggcaaaggatcgatgtatattcagtaaatgcgaaagttgggcatttttaggccagattgacgactagtgctccagtaacgggattttccagtttccacaaagtcacatcctctggccgccggcggactcattgtttggccaaaagtaaatcagccggacacctgatctgcgcacaaaggagcacctccagattctgcatgtgggctcaactatccatttttcttgctcctactgtcttaagcaaactttgctttcttattttgccgatgctggagaaagggccccatttatgtgttttgctgcacttctacatgcttttgccatccactgaaggactaaagaactactagccggacctgagactcttatggcatgatcttgattggttaggagcccttcaaatgagtagagaccaagtattatactgatggaaaaattgttcgacttactctttctattttttacaagttttttcatgcctatctgatcccccacctcaccatcttcgtcatccccactttccaataatcttgtccgttaggcggctgttatagtaattcaatatatttgctgtacatgactctctaatttattgtttc

SEQ ID NO: 9533 - DNA, 970 bp, Sorghum bicolor
  Clone ID: SORBI-28MAY03-CLUS20428_1
gccggccgggcctgcgtcgaggtgtccccccctccctctcggcacctctctctatctctctcctcccccgaagaggagcgaggaggagcagcgcagccgcgatggaccgcgttcagctcgtgctcctgggcctccccatcctcctcttctgctccgacgtcgttaccctcttcgcgcctcttccgccggcggcgcccgagcccgacaaggccgcccacgcttttcaccccggcgacccctccgccgccgccgacgcttccgcacttgtggagccacaggtggatggacctggctccggcaccaccgtcgacttgaagttttgcgcctcctgctcgtacagggggactgcaatgaccatgaaacggatgctggaaacctcatttcctgggattcatgttgtcttggaaaattatcctccaccgttccccaaacgtgcactcagtaaagctgtaccccttcttcagtttggagcgatggcaacattaatggctggtgatcagatattccctagatttggaatggttccgcctccttggtactactcacttcgtgctaatagattcgggaccatggcatcaatttggctgtttggcaatttcgcccattcatttctacagagttttggtgcctttgaagtttattgcaacgggcaactggttttttccaaactgtctgagcagaggtttcctagtgacgcttgagctacaagagctcattggcagtaggataccggatcctccgattttagaaaatttggaaaaagatctggtcttagatgatgctgatgctgatgctgatgatgccatgagagactagcttgcctgtttgttactaaatagacagaacttcagagtttcacaacttaattgtcaaaaacacattgtcttataatttaaacttcattttccccacttatgtacaaacagtactagttataccatagctatgtaataacaaagtttttctgttt

SEQ ID NO: 9534 - DNA, 541 bp, Sorghum bicolor
  Clone ID: SORBI-28MAY03-CLUS2044_1
actgcagaaccgccccagataccaaactgttctcgtccgttgctctctctctcgctcggcgacgactgggataccaccgccaccggcgccctacagcaggtgtccaggtcttcgtcggtcccttctccggcatcgagcacccaccaggatataccatggaggtcagaccgatggtagctctgcgtgctgccctagttggtggggtagcagcatttgcaaagattggtggggcgatgaaagctgctggaggtgtcaaaattggtgcagctgctgcagctgtgacagctgcagcgtctgctgctgtatctggaaaagacgcaaaagaagacgcttcaaaggcagaaacaaaatgatatgacccatggattggtcgagaagtatgaaattgcctctccagaggttcaaaagagaaaggacgccatagtcattaagttacaggagcaatttttcactccatgtgtttttatcttaggaataagaatgacaatcgagttttccctaagtatgattttgtgccgtgcaacaaaaaaaaaaaaaaaaa

SEQ ID NO: 9535 - DNA, 654 bp, Sorghum bicolor
  Clone ID: SORBI-28MAY03-CLUS2049_1
actactctctctctctccacagtgcacacgtacgcaggtagctgccgagaccctccgccgccgccgccgccgccgtgccgctacttctcagctggtagttccttccacgatccaggatgaagtttgttgctgcctatctgctggctgtcctcgctggcaacaatgacccctctgtggaggatctaaaaacaattctggagtcagttggtgctgagattgacactgagaagatggaacacctgctgtcccaagtgagtggcaaggacatcactgagctcattgctgccggtagggagaagtttgcttctgtcccttgcggtggtggtggtgttgctgttgcagcagctgcccctgctgctgctggtggtgctgctcctgcagctgagaagaaggaagagaaggtggaagagaaggaagagagtgatgatgacatgggcttcagcctgttcgactaagtggtgtgacattgttatcatcagggcagaggaaaccagtcatgatgtcagaatgttaatgttaaccttgtaggagactgatacttagtgtcagtgttggatgttatgctggttggtttgcagctgaaccaaagttttgctaccctatctcaatgttttattatgaattgagtaccttgcctaagcaatgagcaaaaaa

SEQ ID NO: 9536 - DNA, 1075 bp, Sorghum bicolor
  Clone ID: SORBI-28MAY03-CLUS2050_1
gcacgaggctccgcctcccgccgaccgggcgatcacctgagaacacgcggagcagcggaaggagcgcagggggttgttcgcgaagatggaggacgtggacgtgtcgcggcagctgaagcagatgacggacttcatccaaaaggaggccgtcgagaaggcgttctagatcgcgagcggccgccgccgaggaattccaaattgaaaaattgcaactggtggaagctgaaaagaagaagatcaggcaggagtatgatcggaaagagaagcaagttggcatcaagaagaaaattgactactcgatgcagctcaatgcttcaagaattaaagttcttcaagctcaggatgacttggtaacagatatgttggagtcagcaaggaaagatctactgtgcataagccgagatcaccaaacttacaagaaacttcttaagatacttattgttcagagtttgctgcgcctgaaagaaccagctgtgcttctccgctgcaggaaggaggatcttgaacttgttgattcagttttggagtctgcaagcaatgagtatgcagataaagcaaatgtatatcctcctgagatagtggtagaccgtcacatctttctgccatctgctcccagtcattatcaggcacctggtccctcctgctccggtggagtcgtgctagcttcccgagatggaaagattgtctgtgaaaacacactggatgctaggttacaagtggttttcagaaagaagctgccagagatccgtcaaagtctttttgttcaggtagctgcgtaaccaattcttgaaagcggaacgtggctcagtactctttcgggtaccctgattatgtccagaagcggaacgcagctcaagagtgatttatcacactgttttggatctcgattattatgtgtgtatactttttttctggttatggatgctctgtcattagattccagacctctgaatcctgcactgaagcaaataagagcaaataatctgtcttcatatgtgggacgaccttttgtaaaataaagcatcaagatgtgttgcgatgccacttctgttaatagcatcatgtttttaattgc

SEQ ID NO: 9537 - DNA, 1381 bp, Sorghum bicolor
  Clone ID: SORBI-28MAY03-CLUS20621_1
cttaggaggctccttcccccacggcgtcctctgcttcgcgacctgagcccccccgagcccgtcctcgtgtggatccgcatgccccaacctgctctgctcggtcggggtctcattcatcgcagcctgctcgcctccaaggctctacgtcaattgccatccgcactctcagagtctatgtttctgatcaacaggctcatcagggatgttttatgattgagaagagaggaaccagcctcattgttgcttcatccgtgaggataatggatattagtccaccagaagtaatatttataagcagctaccttcatgtatgatgttggcacatgcagcgtattcatatttgttgtcgagcacattgatgggagatactaccagggaggcccttctgcttcctggcttctacttctgatggttatctggggttgaggtgttagcataaaaatggcactgtcgtgggtcgggatgctcagttttcggtctttgggtccgtctgccctgtgcgggtccttcgggccaaattcgggggatgctcggcgtggcggcttacaacttccggtggctgctctgctccggtgcgcgctgccccgggggcgctgcagggggctgctccgcagcatgctctgccgtaggtctctggtcctgcgcgccggtggcctcgggaaatcatttactatcgcaggcgtaagaaaggtccaatatctactgagaattatgctaagcgacttgagcagaacaaagaatttggtattgtggatcagtatgtcagaagcagcagtggttggtgggagtgtcattaaaggccggctagttgcttccaaggctttacatgaatagccatttgcatcctgagagtccattttgaggataacaaggtttgtgtgctcctgttaggtttcatttctgtcttgcattagggcatctttggatgtgattaggccaaatctcttcagattggaagggaaaatgaacaaattttccctgccaacctgggtgagctgagtgtaaaacctacctatccaaacaaacaacattttattttcattcccagtattagtgttatatgaaaaaaaaaaaaaaaagaaaaaaaaaaaaaaaaaaaaaaaaaaaaaaaaaaaaaaaaaaaaaaaaaaaaaaaaaaaaaaaaaaaaaaaaacaccccaaaacccaacaaaccaaaaaaaaaacacagaaaaaaaaaaaaaaggggccccgggggcccgcggcctcaaaaaaataggggccccccgggggccgggaaacccatttccccctttccaaacccccacccctcggggggggggcccgcccccctaagcccctaaaagggggaaaattccggggggcccaggggccctgttttaaacaccgatcccgggaaaaa

SEQ ID NO: 9538 - DNA, 765 bp, Sorghum bicolor
  Clone ID: SORBI-28MAY03-CLUS1929_1
cgtccggcgccgccgtggcagaggacgccttcgtcgtggaggagttcgacgaggccttcgcgtcggggcccaagaccagggatttcgtggccgctttgcagcggtgggggctcgaccccaagcagaaagccatgttctttgccacggagttcgacgacaatgtgcggctcagcggcaggaacatcggttccctcaagatgctcacacccaggacgctcaacctgtacgacatactcgacgcccgcaagctcttctttactcctgctgctgtagactacctcaactccaggtatggagccagcgcttctgatgactactatactgatgatgaggatgatggcgaagaggaactggtcgagcaagaagccgaagaaggcaccacagcagaagctgcttaagatgcaactgaagagggcgaggcagacaacagttcctaggtgggaagtgtagatttgttgtttcttatttgctatgttacccttgggtgagagtgatgttggtaattcttccctaacgggccttttgtctgctttattataagttgataatgttctcttaccaaagcgtatgtttacaaatacattatcaggtgtcaaccactgcatataaagcgttttcccatctatgctgcaactgcggacagcagtggacaattatcccggcaactgacagttatgtagctgatggttgaaactgctgacttgtgctgtgacagttttttgcaagttctgtataggctatctggataaattactgcattgtttt

SEQ ID NO: 9539 - DNA, 453 bp, Sorghum bicolor
  unsure (1)..(453): unsure at all n locations
  Clone ID: LIB3481-013-P1-K1-A12
cgtccgaaaggtgcagtttgattaaaaatttagatctgagtccaggaaagaggagagttaaggaatacgctgggttcagtaaaacaatagctttcttctttaacactagtaatatggctataatggtgaaatcttcacaataagtgtgtgcacttctttcaatagtgctaacattacctaatcaattatttcatttgtttggaaagatgcaattctcctgctactctgctatagatttatgatattttgcaaacttctcagaaccttgttttatgtgattcgcagatgcaactgaagagggcgaggcagacaacagttcctaggtgggaagtggtagatttgtgtttcttatttgctatgttnaccctgggtgagagtgtgttggaattcttcctaacggcctttgctgcttattatagtngatatgtctctaccaagcgttgttacaaatca

SEQ ID NO: 9540 - DNA, 742 bp, Sorghum bicolor
  Clone ID: SORBI-28MAY03-CLUS19461_1
aagcaaggagttccatcattgaataagccatctatacgtggtgatcatttgttcactgttaaagttgcaatacccaagcgcataagtgggcgtgaaagggaattacttgaggaacttgcatctttgagtaatggtggctttgctcgaacagacgccaagccaaaacctgcccagccaaaacgcgtacatcaagagaaagaagtaggtgctagtcaagaagatacagacaaatctaaagaagcagagggtgactggttgaagaaacttacagattttgctgggtccattgttaatggtgctgcaaagtggctgaatgacaacctgtaggcgtgtaaatatttactgcaggattctagattgtcttcaactaccatgttgctgtagcccaatctgcaattcttagattcattggggtccccacgagcttgtacattcgttgtgttgagagcttcaagattttcgggctgtgagtggcaaccgcgggagtgagaattgtgaactaatattgtcggcgcattgatccctttatcattcttgcaaagcaattatttttatgtagagttatttcgtttggcaagtgcatgcagcagtcggaagttgtgggatgctgatctcaaaccccgagactagacaacactgtaaatatgttccattcctgattctgtacttgaggttttggattaatcatttttttttgaaagtcagattaagcaaaaaaaaaaaaaaaaaggcccctatttcg

SEQ ID NO: 9541 - DNA, 1196 bp, Sorghum bicolor
  Clone ID: SORBI-28MAY03-CLUS19418_1
gcccgcggccactcaccaccgcgcttccgctctccaaaaccccgcgcggcaccccctcctcgcaccattcccctccgcccctcctccgccgcctccaaaccctaacccgcgcgctcgcctcctcatcctcgcaggccatggcgtcgtcgtctcctgcccccaagaaggtgctggtcccgatcgcgaatgggacggagccgatggaggcggtcatcaccatcgacgtgctccggcgcgcgggggcccatgtcgccgtcgcctccgtcgagcccggggccgccaccgtcgccgcctcgtggggcgtcaagctcgccgccgacgcgctcctcgccgaccgctataggggagctcggaagttgctgggccaatggttatgcgtcctcagcatggtgtggaattctctatgaaagagctgaattcaactagttggaatgttggtgaaacgcctaatattcttgtaccaattgctaatgggacagaggagatggaagcaactatgataattgacattttgcgaagggcgaaagcgaatgttgtggttgcctccttggaagacaagctggagattgttgcatcccggaaagtgaagatgattgctgatgtgctgttggataatgttcttaaggagcaatatgatctcattctgttacctggaggtctgggtggtgcggaagcatatgcaaaatctgataaactaatggatctgatcaagaagcaagccgaggcaaatagattgtacggagctatatgtgcctcccctgcgattgcttttgaaccacatggcctgctaaagggaaagaaagctacatcctatcctgctatgtggaacaaacttgcagaccaaagcgaatgcgtcaacagagttgttgttgatggtaacctaatcacgagccaaggtcctgggacttctatggaattctcgcttgccatagtggagaaactctttggacgggagagagcccttgagcttgccaaaaccatggtttttgtatgagttcaaatggtatgtgctaggttcctggagtttgtaccttttttgtgaatatgaggcatgctatgttctttccctgtgcaatgtactccgattcccttttctaatagaaataagagtaatacttgtaatgtgtttcatatgcaataaaaagtttgaggcgaacattaagcgaggactgagtctgattgaaaacacttaattc

SEQ ID NO: 9542 - DNA, 753 bp, Sorghum bicolor
  Clone ID: SORBI-28MAY03-CLUS19612_1
gccggccgcgagggtcctcgggaccggaggtctcgctaccggcaaccggcgagactggcggccgcgtcctccgttcctctccggcgactggctcgagtcctcttcccggcggaatcatgatcgtctgcgtcgccgtcgtcggccaccagaacaatccgctgtacctgcagagcttcacggaggcggacgacgccctcaagctccaccacatcgtccactgctccctcgacgtcatcgacgagcgagtgaacaatcctaaaaggagtgcgcctacgttgaatgagacatttttgggtcttctgtacccaactgagaactacaaagtgtacggctatttgacaaacacaaaggtcaaatttatcatggtcacgactgatcttgatgtcaaagatgcagatgcccgaaattttttcaggaagttccatgctgcatatgtagatgccgtctcaaacccgttccatgtcccagggaaaaagattgcttcaagaagctttggtgcaagagtaagcaccatcgtgaaatccttcggttcagggataaccagttgatcgaatgccacttttgccagacttcctgtaatcaaacatatgtgttctacctgtttgacaaaatcactccccactgtgtactgcttgtatgttgaacgtgatgctagtttggtactgattgctgaacaaagaaagatagtggttcattcattcaaagattaaaaaaattgctgttcagtgaaaaaaaaaaaaaaaaaggccccta

SEQ ID NO: 9543 - DNA, 659 bp, Sorghum bicolor
  Clone ID: SORBI-28MAY03-CLUS1962_1
gaaacggtactcgtccggatgaaaaacctgtcaatcaacctaactagcccaaactttgaggaacataggaggttgctctcttcacatgcctcaagcatggatcaagaaatgggctcttctcacattcatcttccattcatgataacaagcaagtgagagaagctgccctcaagccaacggcgttggagtcactctggagcatggcgatgtccctaggggtgcttgctagcctcctgttgtagtgcggcatttgtacatagctcttagtaatgcccctaaccaccttaggctaggtttgctcgacatgttgtaggttatgcgccttttgattctttgcccctccagttttgcccattgtaacttataatatgcgtgccttatgcctctttaccccttttcccccctcataaggatgaatgggtggcatgtagttttggccgtgtgtgtatatagcatgcggatgtatgtgtacagcaggcggctatagcaaactgttgttgtaaggcataataagctgatagtgtgtggtcctattctacagcaggtcatgccagatacacctccgaacttactgtcgttttgtattgtatgataagggcaccatgtaacataaataaaattttagttgcccttctggttgcaaaaaaaaaaaaaaaaaa

SEQ ID NO: 9544 - DNA, 862 bp, Sorghum bicolor
  Clone ID: SORBI-28MAY03-CLUS2143_1
ccgggcagacgaacccgcctcgcttctcgtctcccgtcccctccgccgccgccgctcaccttgccgtgcccgggcccttgcccagcatgtggggtagcaccgacggcggaacgccggaggtcaccctcgagacctccatgggcgccgtcactgttgagatgtactacaagcacgctcccaagacttgccggaacttcgtcgagctcgcgcgtcgcggctactacgacaacgtcatcttccaccgcatcatcaaggatttcattgtgcaaggtggggatcctactggaaccggcagaggtggcgagtccatatatggagcaaagtttgaggatgagataaagtcagagttgaagcacactggagctggaattctgtccatggcaaacgctggcccaaatacaaatggaagccagttcttcataactcttgcgccttgtcagtcacttgatgggaaacatacaatttttgggagggtatgcagaggaatggaaattgttaagcgccttggtagtgtgcagactgacaaaaatgacaggcctatccatgaagtgaaaatcttgcgagccatcgtcaaagattgaagcattgcccagatgtaactcgaatgttggtttaggcttagtaatggccccgttcatgtaagttgcgccatgttagttgcgcggacctttgggaaaagatgaaagatacagctagttccggcctgtatgactctcagtccctccatccgcctgacctgaaaacctacctgatgagtagattgtaccttttgagcaaggtgtttgaaacaacttatacgtatgcgtctgtggttgagtttttctgcatggagtatgctgcggaaacattattattgtgaaga

SEQ ID NO: 9545 - DNA, 674 bp, Sorghum bicolor
  Clone ID: SORBI-28MAY03-CLUS21610_1
aatatccagtactactaccatatcatgtgatgtgcatgaggtaggggagtgctttgctcctccacaccagcccagccatggccaaggtagctcctcctctcctcgccgctgggagctgcaccgccatcacagcccagccttcgtcgaggaaaggcgctgccggtttgttcgccagtcacatcgtcagcaagcgtgcaaggataatagcgaagcttggaggagatggtgagctgaagcctccaggcaagaagaagttcatcaccagggaagaggagccaggacagtactggcagactgcaggggagagggagggcgagaaccccatgatgacacccctgccctacatcatcatctttggcatgtccacccccttcgtcatcctcgccatcgccttcgccaatggctggatcaaggtccctgtgcgatgagcacttgtccatgaccatgacgcggttgcgcaatcaaccaatcagatcttggatgttgattgccctgcatcttatccagcgagagtcctgcgagtttgtaccttcatatatagagacaagagttcttgtttgtgtaagcataattgcatgatcatatggtgtatgtttagtatgtaactcaaaacttttggagctcctaagtgtttacccttttgcaatataacttcagtcttcaggcattcttcc

SEQ ID NO: 9546 - DNA, 687 bp, Sorghum bicolor
  Clone ID: SORBI-28MAY03-CLUS21061_1
gccggccgggctgggcaatgtggtgacacgtcatgatatcaaggacaggaagacaatgggcaaaatgtcagaagcttacccccatttaatactggacaacttctcaactcactagggagagtagcttgtttttttgtttctgcagaggttagccatccttgtattctatctttgttcatgacagtttggtaacttgctatttgtattctaggttggtgaaaggactgccactattctcaagcacctctttcctgtgccaaagccagattcaaagcgaataattacttttgctaacagagatgagtacatatctttcaggcatcatgtatacgaaaaatctggcggccccaaatcgatggagttgaaggaggttggtcctcgttttgagttgcggttgtaccagatcaaactaggaactgtggaacaaaatgaagcgcaaagcgagtttgtgctgcggccctacatcaatactgccaagaagcagaagactcttggggcttgaactccactgcagtacagcattttttaatttcttttctttactttatgctgtagtagtaacattaattcacaggttgattagctccatgtttgtcttatatgcatacttctcaaatctgagttattcttgggggaggaaatcattaatttaattaacttaaaaaaaaaaaaaaaaaaaggccccta

SEQ ID NO: 9547 - DNA, 634 bp, Sorghum bicolor
  Clone ID: SORBI-28MAY03-CLUS21558_1
ctcccggcgcgcccggctgtggtgccgcggccctgccgcactccggggccagccccatggcgccgcctggcctccgcggcctgtctccctccgctgcgtgtgtgtggttcccccgcccttctagtttctgctgttggtctatttttcagcctgtaaagttccaattactaaaccatagataaatagtcggggttgtcatgaatggtatatttgcatattcatcgccgataggtttacatactagtgaagtatatttgccattggagatcattcactatgtatgctatgcacctcgacctgctattttatagaaaataatttagcaaaatgacatttcttaaatttatctctttaattaactatctgttgttttgttgtagcctaggatcagttggcctacattgagctgagaggaaaggaagtagctaggaggtatatgtatagccatttattctataaagcaaccattactttgtagttctggaggatactctatgcaatcacttacagttcaacaactgttgtgtattttgatcatgagaactttctgtgaactctgtgcggtgtgggctctggtgtaacctatagggaatcttgcgtttcggaaatgtacaccgtggatttagattttttt

SEQ ID NO: 9548 - DNA, 366 bp, Sorghum bicolor
  Clone ID: LIB5048-011-R1-XP1-F4
ccgggttttctagagactgcaacctgacagatctgccacggtattggaatcctttggttgtctccatccatttctgcaagatatgcacacatcggaccatgcagatttgcaatggacctacataattggcctaggatcaggcctacattgagctgagaggaatggaagtagctaggaggtatatgtatagacatttattctataaagcaaccattactttgtagttctggaggatactctatgcaatcacttacagttcaacactgttgtgtattttgatcatgagaactttctgtatatactgtgaagtgtgaactatgtgtgtactggtgtgaaatatatcatattgtgaaacatgggattcgg

SEQ ID NO: 9549 - DNA, 772 bp, Sorghum bicolor
  Clone ID: SORBI-28MAY03-CLUS2165_1
cgtccggttggagtaggtcggggaggagaaggtggaggggtggatgcgggagtcgatcgccgagatcgtgcggcacatcggggaggccccgttcctggtgcacctgttcagcaacgacgacggcgagggcgaacgcgtgaccgtgcggcgggagcccgcggcgcccgagagctgggctgacggggggcgccggtgggggcctggcgggcagcggaagcccgacgggatcatcctcgtcgagcaggtggccgcggacggcggcgcctccgcctcggaggcggcgcggcaggtgtggggcctggtggtgcaggcgcgcggcatggagtgcgcgtcgtgctacgtgctcgacacctgccgtgtccgctcgccggccgggttctgcacgcacttctgcctcgcgcgggtgcagtgcttcggcgaccccgtcgagctccagctccgcaatgcctggctcaaccgcctcgccggccgccgatagccgcccgttggtcgctgctgctactactgattctactactaatagtattcgattcgatgcgtcaaggaccaaatgcaacgatgatgcctcctcttcgctggcaagaacgaggaagagaagcatgcagattggaagcagggaaggcgaacagaatccatcaaatcttttcgttcagttcggtttctccctgaattggatatcaaatattttcgttcagttcggcttctccctgaattggatgtcaattgtacagattattggttgtaattcttgcttattcaatcaagaagcgat

SEQ ID NO: 9550 - DNA, 1201 bp, Sorghum bicolor
  Clone ID: SORBI-28MAY03-CLUS19898_1
ctgtgcggcgctcgaggcggcaccgctgcataaccctatctcttcccgccccggcggcgcggcctcccgcctccccatcccggtgttctccgatttggggggcgttccttgcctgctccggtctgttcgtccgggttccggtccagcagagcgcgctacggcacagatcggccgccgtccgtcccttccctagacctccagaccatccaccgccgcgtcgactgatttctagataactgggtaaggccgagctcatgcaaaatggttctgtgccagggcgtatctgttggaaatgctcagctgctagcttttcctggtagatcatcaagtcttaagagaacccagtttcatgttaaggcgaatcattttcctgcaagagctctacgtgttgtcactgattccattcatcatggcatgcctacatcattcctgagggaaaattctgtcaggggcatcccatcactctcaagacagcacaacctacatccaaggtccgttagttgtcaggcatcctcactggcatctttcagttaccctgagctgacatccaaacccagatggtggtggagaactctagcttgtgtgccgtacttactgccactgcacaacatgtggtcttatgccgatgtgatctaccagcttcacacttacttgcaggggttttcgctgttgtataccttcattgataccatgactctgtgtcctgggtggctctttctggtgatatttatgacagtgtacttcttcgttgtgaggcggaagtggtcgccgcactttctgaggttccatgtgatcctagcgatccttctggacactggctcccaagcagtggccaccatgtgtacctggatgccaagcatcgtttatcaggggaaggcaatgcagtacttctggatgtctatcgcatttatacagatcttcacagtgctcgagtgtttgcggtgtgctctttgtggaatgtatcctgatgtcccattcatatcccacaccgctttcattcactctgatctgaatctgttcagataggtgcttactacataaattccaggattcagaaagggtggtttttttgaaatggctacttacagttgtagagggtgtgttttttgttttgttcatatagaagtcctgtgtaattcttatcataggaccagctgttataatagcattcgaacaacactgcaattgattttcgttcctc

SEQ ID NO: 9551 - DNA, 701 bp, Sorghum bicolor
  Clone ID: SORBI-28MAY03-CLUS2000_1
cgtccgccagagactaaaaagccacgggtgaagatctatactgataaggaaaccggcaggaagaagggtgatgcgttggtgacatatttcaaggagccttctgtagctttagcggttcaattgttggatgggacatcattccgtcctggtgttaagattcctatgtctgtaagtccagccaaatttgagcagaaaggtgatgttttcatttcaaagaaaactgacaagcaaaagaaaaggaagatcaaaaaggtcgaagacaaaatgcttggatggggtgggcatgatgataagaagctgatgattcctactacagtaattttacggcacatgttcactcctgcagtggtgagagctgatgaagagcttctttctgagcttgagactgatgttagcgtatcctggattatgatgcagaggtgtcatgactggatcggtttggagaggagttagaagagtccacgtagagggtaactaacatagctagcatgagagcggaagtttttgcatttgggccctcgtatgctcgctcagcttggcctttcatttgcctgattaacctcagaatagaatgatagttgggtatcaggcatcagctggtatatactcctatgtttttttgttactgcgacagaggattttatgcacgattttgcatatgttaacatgaagcacttggtaaagtatcatcatttttcctg

SEQ ID NO: 9552 - DNA, 872 bp, Sorghum bicolor
  Clone ID: SORBI-28MAY03-CLUS20063_1
gccggccgggttttgactagctcacccccagcagtacccaccagcccagatcagctgcgagctactgtgtcacaccgcgctcgctccgcttgcaatggcgtccatcatcgtgcaggcggtggtgatcctcctggacgtcatcgccttcggcctgggcgtggccgccgagcagcgccggagccgggccaccgtcaccccggacgccgccaaggagtacgacttctgcgtctacgactccgacatcgccacgggctacggcgtcggcgcgctgctcctcctcgccgccgggcaggtcgtgctcatggtcgccagccgctgcttctgctgcggccgcgggctcaagccgggaggctcccgcgcctgcgcgctcatcctcttcctcttcacatgggtgaccttcctcatcgcggaggcgtgcctgctggcaggatcagtacgcaacgcgtaccacacccggtacaggggcatattctatggcgactccctctcatgtgagacggtgcgaaagggcgtctttgctgctggtgcggccttcaccttcttcacggccatcctgggtgaggtgtactacctcagctactcaaagtcccgagatgccgctggcggtgccccctatggcggctccagcattggcatgggcccatacaactaaaggagcttgctcaaggcaggccccagtcttttcaactcgcttcatggtggaggaatgcagtgttctctttaacattaccttagtagggacggtgtaattggttattggatccgctgttttttctttaggttcttgtatgaggttacttggttgtgggctgtatactgtttggattattgggttggattctggacatggaataaaaaaaaaaaagaaaaaa

SEQ ID NO: 9553 - DNA, 645 bp, Sorghum bicolor
  unsure (1)..(645): unsure at all n locations
  Clone ID: SORBI-28MAY03-CLUS2024_1
gccnnggccgggcccgggaaaaaaaagaaggcagccattgtttcatttcatcccgaactcccgatcgctcgcaaagaagctagcttttagcatggcgtcagtggcgttcggcagcaccgtggcggcggccgtggcgccgacctcggggaggacgcggccagcgcggcggtccgtgctggccgtgccgccagccgccaccaggggcggcccggcgccggccaaggaggagaaggggctcggcgagatcatcttcggcttcatcttcaagaaggaccagctggtggagactgacccgctcctcaacaaggtcgccggcgcgtcagccgccgcatcctcccgcgccaagccgccgccgcggggcgccgctaccacctccggcaagaaggctgccgctgccgacgacggcggcagcggcggcgggttcaacctccccggcctcggcgggttcttcgccaagaaaagcagctgaacgtgtccagtgtgcgtggtttacggattgtcgaactcaaagctggatttggctttgagggggaaaaaaattggctgcgcatatatacgtgtggtggtgtgaggttactctcgctcccccaaaaactcaagtcatctttgatgtcatataatgtgatatatttttacttcccgctg

SEQ ID NO: 9554 - DNA, 715 bp, Sorghum bicolor
  Clone ID: SORBI-28MAY03-CLUS20282_1
gccggccgggcctacgcactgagccgaggagggacctatcccgtaggccaacaacgctcgcatccagctcctcctcgcgaccccaaatctgccgtctccgccgccgccgccgccgccgcagccagcatcaccggagggatccgcggcgcgccctgctccacgcgatgaatacggacatcactgcgtcgacgaagccggagtacccggtggtggatcggaacccggccttcaccaaggtggtcggcaacttctccgcgctcgactacatgcgcctctccaccatctccgccgtctccgtcaccgttggctacctctccgggatcaagccggggatccggggcccgtcgatggtcacgggcgggctcatcggggtcatgggagggttcatgtacgcctaccagaactccgccggccgcctaatggggttcttccccaacgacgccgaggtcgcgcgctacaagtacaagctgtagtgaggatccagctccactccgtctctcttttcgcaaccgttgcgccttttcctttcctgacctccgtgttagcttctgtacttgatctgggcactctatggccttggttgaataaacgctgtatgctgttgcacagttatgaggattcgatgatacaattcacctcctcctcttgatgttaaatggtgagaatttcgtcgccatttcggtgaatttatgaaatattaaagtgatttctgccc

SEQ ID NO: 9555 - DNA, 1272 bp, Sorghum bicolor
  Clone ID: SORBI-28MAY03-CLUS2215_1
cttctattgggaatatagctggctcactgcttgctgcgttcctcctgaagtttgggtggggctggtcatttgccgtccccagccttatcatggctcttgttggtttgatggtgtatattttcttgccggttaatcctgaggtaatggagatagacattgacagtggtgagtttaattgtgagaaggacgctgtgaaggagccccttttggaaccaggccaagaagtgaaacatcaggcagtgggtttcttagaggcatggaggattcctggagttgcgccatttgctctttgcctcttcttctccaaattggttgcatataccttcctgtattggctaccgttctacatcagccatacacgtattggtggtcagtacctctctgatgctatggctggcagcttatcaacaatctttgatgttggtggtgtgttgggaggagtccttgccggtcacatctctgatcgcttaaatgcgcgagcaatcactgcttccagcttcatgtactgtgcgatacctgccctcttcctgtaccgcacatatggaagcatgtcgataatgtggaacatctccctcatgttcatcactggaatgtttgtgaatgggccttatgccctgatcacaactgcagtgtcagctgatcttggcacccacagctctttgaatggcaactcccgagcactggccactgtgacagcaattattgatgggacggggtctgtcggagctgccatcggaccgttgctaacaggatacatctcatcgaagagctggagtgctgtgttcacaatgttgatggcagcagctctccttgctgggctcctcttgacaaagcttgtatgtgccgaactaaaaggaaaaacaccttccaacgcgagcaaggatgtcgccgatgcagaaggtacctactcagatgaagtgtaaatccaaagctgattgcgccatggaagcagttccagtgaatgcctactaagaagttgaccggtgctgcttcccactgcctttcatggtggctagcagtgtgaagactgaaaagggaaagagatttggctgctgagtgacttgctcaaatgccacttcagatgattttttgtgtctgttcaggtatagaggcgatagaaggcaaaagtgtgcgctttagattagttttcaggtttactagatagaggtgagaacccctcaaagctctagagcccaaatataggcacattttaggcaccttgtattgtaaatatgttgggcaataaggtcgggcttgtactggttgcactgc

SEQ ID NO: 9556 - DNA, 543 bp, Sorghum bicolor
  Clone ID: SORBI-28MAY03-CLUS2207_2
cgtccgagcaacttcaccaccggagctggaggagctgcaccaaatggccaggataggagaagcacttctgcacctgtgggagaggaactggatccattgcacgtacggaggcgaagctggtttctggggctccagctctctggcagcagagcgctcatagaggagctgcaccaaatgtgcccttagtttgctttacggactgtgctatcagttcttgggaagcggcaaaaaatgatgatgcaaaagatggctgtagaatacaatgaaaggatagaaaatgtcaatcgtgagaggaagttccaccagcaaaatactggaggacagctgcatgccctgacaatggaatggcaggagctgtgtcaaaaaaatatagctattcaagctgcctgtgttgacctgcagaatcagattgatcagcttaaaattgaagcaaaagaactgggaatgcccatcgacgacaacaatggaaccaactcacaagcatcatgaggatttgagttaccattcggtaacgtcatctagttaagttaagacgccacgaga

SEQ ID NO: 9557 - DNA, 739 bp, Sorghum bicolor
  Clone ID: SORBI-28MAY03-CLUS2207_1
tttggaagctccagaacaaacaaatggaatcagttctgtctaggatgcaaaagatggctgtagaatacaatgaaaggatagaaaatgtcaatcgtgagaggaagttccaccagcaaaatactggaggacagctgcatgccctgacaatggaatggcaggagctgtgtcaaaaaaatatagctattcaagctgcctgtgttgacctgcagaatcagattgatcagcttaaacttgaagcaaaagaactgggaatgcccatggacgacaacaatggaaccaactcacaagcatcatgaggatttgagatacagaggtggcaaggaagaagctacggtgcttcaatgaggttgggagctggacgttccattagccattgtgcttacctgacttgcagttgtcatatgggccagtttgtttgacattgaaaacatgtggactgtgcctagcaatcgtatgggttgaaggtgaccctgacctgtgcagccgaaaacacgtcggagaggaagagtctaaaattcgtgtattgttgtccgttggaatgtcctaacctgtggcaagagacacaacagatgtttatccactttccagcgctttatagcgtaacattgagttttgaagctttcttctgtttagttttctgattgtttctgaaaataccttgtgggtgcaactcttgtccttttcagaatgtgctcaaatgtttgtaaacagtggacaccttactctgctttgagttgac

SEQ ID NO: 9558 - DNA, 794 bp, Sorghum bicolor
  Clone ID: SORBI-28MAY03-CLUS22218_1
gcacgaggcccaaggtcactggtgttgactggaggaagaagcttgagacccagcggggtgctgtgcttgccactgagctcaagaacaatgccaacaagcttgcacgctggactgcccaggcgctgctcgctggtgcagacatgatgaagttgggttatgtgtcacggctgcacccccgtgatcactacaaccattccattctcagtgtgattgggtacaagccaagggattttgctgcacagatcaatctcaacactgcaaatatgtgggggattgtgaagtctattgtggatgtctgcatgaagcttggtgagggaaagtatgtgcttgtgaaggatccagtgaagccgcaggtccggctttatgaagtgccaaatgacgcgtttgagaatgactatgttgaggaaccacttcctgaggaagagcaagtacgtcccttttccgaggacgtcgacgccaccgcgcaggaaatggatgctgctgcagaagcggaggctactggaacaactgcaggtgcagagggagacgctgagaagagcaatgacgttgctgctgtgtgaaggcagtggttacaacctacagaggtctcttcaggccttgaataaggttaacttggctagctatctacagtcaatgggcatcttgacaaggtttgatgtttctactatcaaaggttatgctattgtcgtttggtgaaccttgagttgagttgtttctctttattaacacatgcgcctgtatcgacttaatgcaatccccaaattatattgcacttcagggctcacatgttacag

SEQ ID NO: 9559 - DNA, 695 bp, Sorghum bicolor
  Clone ID: SORBI-28MAY03-CLUS22261_1
agaacaacttctgtggtagggtccaacaggagcatggtctgaggcctcgtccaacaaatggtttcatgagtccaaacatggggagagctgttggcgacattgagatgggtagaaaaccagtggcatgggatgagcctaggatggcagctgagattggtgatttaggagcaggtctgagcaacttgttggaggacaaggatggcaggtttcgtagcgcatctccagatctcagccgtgacgcccttgcagttggaggaggcttagaagagcaaggctcctcggcgatgaaccctgggcgttcaagctggggagttgaagcaggtcgatgatggcattgaccatgtaagcgactgtagtgagatgctcagggtggttagtgccagttcgtcgctaatttgttgttttgtttgggatttgtggtcactaatgttattagactcatgacctgtatggcggttgtttctggactttcttttcttctttctcttaatttgcgatgtctttcatgtctattttttgaagcagttggtttgtgatgtctccagtttggcactgtcaggtttcgtctgtatataatcggagcagtaagcctaaaataggtttcagttgcttggatttggatggtattcgttgtgaacaatgttgaatctttgcattgcagtaaatgaacatcgcatgatctgagtgcccatgtt

SEQ ID NO: 9560 - DNA, 800 bp, Sorghum bicolor
  Clone ID: SORBI-28MAY03-CLUS22282_1
ccggggtggagtggagtggatgcgaacctgaatgtggacgcagcaagaaaggaaccgattgggatggcgggtatggaggagctgctgacgctgctgttcaacgcgctgctgctggtgttcgtggtgaagctcttgctggccttgttcaacaccaagatcctcgtcatcctcctctacatcctcgtcctcctcttcgccacgctcctccccggtacttctccccgctgatatcccctctccaggttgagtagggaacccaagcttcgtcccaacatacggaaactctccatttttctgtggactctagtctaactgttgcgccattgattcaggttggcgaaggggaggagtagcttgtagatgcaacctcggaggaagtatgggaatcaatctgaggtgagcgtggctgcaatgccgcttggctgtcagttaacaggcatatggtcagcaggtaggagtatatactacatgggttaaccaaaaacaaatcagccgaatctgccagtcattcttcagcagtgtttttctccatggcttatcagccaaaagaacaagagggtttgatcactttggcagtgactgtcgccaagcatttcagttcttttcagtcagcgctgcatgcaattccagttcatctgctatctcccagatggctggattgagagacggacggcccccttcttggatttttttttttttttggggggtttgttggtggaaagagcattggactggtggcgaaatcaggatcgggatagctactgtacgtattaaactgctgatcacttcggtagtgctga

SEQ ID NO: 9561 - DNA, 475 bp, Sorghum bicolor
  Clone ID: SORBI-28MAY03-CLUS2233_1
cctcgggcgccggcggcacatccgacaccaacgacgccacggacgccgcctccaagttctggctccccgtccgcgtcggcggcagggacgacggggtcggcttctacgtggacgccggggcctacggggtcgtgccaagcttctagaacgttctttcctccagacaaactcacaagttgaagaaagccttgaagattaggtcgtgtgccaagcttctggcaatggcgttcgcccagcttgaaacaagctaagaaatgggcgcgcggcaatgtcgccatcgttcttgtttgtgtcgtgtgtcatcgtcattcatgtgggcagcattcgtggtgaaattccgccatcgctatttttaaatgatggcgcggaatttccatgggacatcatcaatttggtgaaggaacaactaggggaatttattgtgtgttgtaagatagcttatgtagacgacgttcactgttagttttcttcatga

SEQ ID NO: 9562 - DNA, 1076 bp, Sorghum bicolor
  unsure (1)..(1076): unsure at all n locations
  Clone ID: SORBI-28MAY03-CLUS20682_1
tctttttccttttatatattnagcgcgtagtatgcgtntgatccacgggtnttggcacccgnttccttccttgcccccggcgcaatctttgcttccgcgacctcgccccggcgattttcctttgcggttgtttattgcaaaattttgggcgcaagatagttgctgattcgttcggcttgaagccgtcgaggtgattgtttggagtctggttctggaacctgggctgctcttcttgttcttggtccggccggtcggtcacgaagcaatatctaaataaacgttgccgcaccgccgctggagactgtgaagcgaaagaggaggaagaattcgagtccaagtcttggagctgccccccgcttggatggagtggatctggccttctactctaggggaaagagcaaagcacattatcttgtaaaaattagcattttcctacatttatctcaaatcaaatcatctctgcttctgggaacagcaacctgtaatttcccatgcaacctcttggttgatggatgctcttcctgttgaatcagaaagagaaagtcaaacagatagtcaccctttactcatggagcatgtgattggcatcccaagggatgatgttgcttctacatcaacacctcgtcgagacaacaatgatggcatggatcacttgcctcgtgattcagaaagttcttccggaacaactgctgcatataactctccgaatactcctatagcaagaagagatgataatcgccgtcgccgtcaacagagtctgaattctggcttctggatatcaattgaactagctgtaaatcttagccagattatagctgctatctgcgttctgtctgtgtcaaggaatgaacatcctcatgctccattgtttgagtgggtcattggttatacaataggttgtattgcaactcttcctcatctttactggcgctatctccagcgcaaccagctgcccactgtgcaaggatcaaatcagaactacgttcccagacacagctttgaaagtaattcttttactgggatttcgccccctcatgtgtctgaagctggtgtcgtaactgtaacaaatggagtct

SEQ ID NO: 9563 - DNA, 869 bp, Sorghum bicolor
  unsure (1)..(869): unsure at all n locations
  Clone ID: SORBI-28MAY03-CLUS20951_1
gccggccggttccggagaagaaacccttttttcgagccgccgttcgtagcgccgcagatccatcgccgaagttttggatctcgtttccggcgaacttttccggcgaaccttcggcgagagtttccggccgcctccgtcatcccctgcgaaaaccgccgccaccgtgaggttcgtgtcgatcttctctataccggcacgccattcttttcacgaatccgccacccgttaactgttttccttgtcttctcttttatctccggcgaactgcaccacagccatggccgctgccacctccctggccgaatgggtcacggtcgtggccaccgtggagccccgtgcctggccccacgagcaggcccgcatcacgccgagtgccatgccccgccgcccaatgccccaagccggcgcccctctgcttccctgcgcaagcaccagatggtgcgtacgtgatccagatgaccaaagaagaagcgtggttcgtcaacggtgaagaccaggagctgaggaccgacagttgcagtagaagataaagatcacaagaaagaagtcaaagaattctgagcagatatacactgggaattaagtgtgtagtaaagtgctgctcagaagaaggacatagatgctatggagttttctagaagcttatcagaagtgcttggcgtacggagcccccagtcaaccgtccctgagaagaatggagcctaagaagtttagctactgtttccgcgtactctgatgtttgtaagtgttaatattcttccgttttgtggtcggcatcgcctccgtcgaggtagtaactccatgggtccatgttcgatctcttgggtggtcatgcactttggtaaaattactaaagcttctgcatntag

SEQ ID NO: 9564 - DNA, 778 bp, Sorghum bicolor
  Clone ID: SORBI-28MAY03-CLUS209_1
cgcgtccgccccgcgtccgccgccttcccctccctcaactcaggcaggagccagacccaaccaagacacagccgatacgtgtcgaaggactatctgatctctcactggttgacattgctgctggaggctggcattcaactgcactaactatagagggagaggtgtatgcttgggggagaggagagcatgggaggcttggatttggagatgataagagtagtcgcatggtgcccctaaaggttgagctcctcgctggagaaaatattgttcaggtgtcatgtggaggaacacattcagttgcgctaactcaagatggccggatgttttcttatgggaggggcgaccatggccgtctgggctacggcaggaaggtgacgacggggcaccccatggaagtgcccatcgacctgccgccgcccaagagcagcagcaaccccgacgggcagtggcaggccaagtacgtggcttgtggcgggcggcacaccctggctatcgcggagcggacagagcccaccgactgatcacggagtgcttgacttcctgaatgaatactgatatgcgtgcaaatctgaggctgagaagcctactatacaattattatatatagtgttcgtggaataagcataagttgtgcaacattaggcatcataaaattttctgtatgagcttatttaatttggcaaggaacaaattaaaatagtcgggaagagaactttgtgcagagatagtagatgagagacgttcagtatttcagcaatattttcccatggacaaattg

SEQ ID NO: 9565 - DNA, 841 bp, Sorghum bicolor
  Clone ID: SORBI-28MAY03-CLUS20990_1
tactggaaaaaaaaaaaaagccggccgctgttcggttctctccgtctcgcctgcgcctcgcgtcctgccctgttcccgtccgccacgtctctcctctcatcctctcctcggctcctcgcctgcgcgctgatcctcatccatcgaccgcgagtcaaaagggcgacgacgagcacaagcacagcatgacgggtaccggcgacagcggcggcgagcactactcgcactactcgcggcaggtccgcgagctctgcgctttgctgctcaccatcgtctaccccacggcaccggggcggggggcgtcgtcggtgtcgatgtcgatgtcgccggccgcggcggcgtccatgcttgggcgcgtcggtggcgctcatgctctgcggctccgtcaccttcgccatcggcttcttcctcatgccatgggtcgccggcctcgcgctcctcttcggcttcgccggcgccgtcaacaccctctcctcggggctcttcctctgcaccaacaccaagcagcccccggccgctgccgccgccgcggtcccttgcaagcacccgcggggacggatcatcgggcccccgaccacaaccccagtgatgcgctccgacgcgctcgtcgcctagcttcctttcctccgggccggcgtccctagattttttgctttgatttctcttcgtggatcgctactaggattccctgtaaaaaacgcaccctttttctgtactacgctgagcagtatgatccagaggaggcgttgttgcttggctggttaatgggaggaaccgaacctcgaaagaaattaattaagtgattgtttagcctaaaaaaaaaaaaatcgttctgattcgccct

SEQ ID NO: 9566 - DNA, 817 bp, Sorghum bicolor
  Clone ID: SORBI-28MAY03-CLUS21248_1
ccggggtcgagagcgcgagcaacccacacccacgccgccccgctgtctccgccggtccgccccctctgcctctgcctctgcctctgcgcctcccccgtccccgaatcgcgtcggcccgtctcctcgtgtcgcgaaaccctcggccatggcggaggcgcccgagaccgccgctcccaccccgcccccgtcgccgccagcgccggtgacttcgtccccgcctcccaagtcggggatcccgccgcggtacgacctggacgccaagtgggacgcgtgcctcgacctctccatccgccgcgtcgcctactcctccctcgctggcgccttcgcgggtctcctcctcttccgtagccctactactcgctgggcatcagttgcccttggagctggtgtggggataggagctgcatacactgaatgctcatacttattcaatggtgctcctccaaagtggtcacccaaagtctcaactattccttctgctcactctgaaggaggagacaagtaaacccttaccgaaggattggtccatctcggtggagttttggagtgtgtgaagtacttggtggtttcctgctggatattacgctacctgtggccatagtatgtcattaaagttagatttgcctcacttgagagttttgttgcaaacctattccaattgtggtctgaatgtctgatgacccacccttggcaaagagcttttgcaagctgacgttgaaacggtggcttggtgaccggtaataaatttttcatcatgtgaacttgtttgcagaatgctttgtgccttacatgagtatatacatttacacattgcccg

SEQ ID NO: 9567 - DNA, 929 bp, Sorghum bicolor
  Clone ID: SORBI-28MAY03-CLUS22877_1
ctgggctcgagctgaccgttcaatggaccaccctgttgatccctccgaccactcttctcctgctgaacttcatcggggtcgtggctggaatctcgaacgcgatcaacaacgggtacgagtcatggggtcctctcttcgggaagctcttcttcgcgttctgggtgatcatccatctgtacccgttcctcaagggtctggtgggacggcagaaccggacgccgacgatcgtgatcgtctggtccatcctgctggcctccatcttctcgctcctgtgggtccgcatcgacccgttccttgccaagagcgatggacctcttctggaggagtgtggtctggactgcaactaaagatgaagaggccgtcactcaaaagttctgtcacaggcaggcgaattatgcctgattttttttggaattctttcctgtagatagaaaacaccacagatgatcccaggcatttcttctgtgtccgtgcatggtgaggctgtgacatctctgagagtttttttcaaccgaagacacaagtccatggctgctgctggtggttcttgaacattctttgaggcagctgcagggattgatctgccagccaccgcggggcaggagaaaggcgcctactgtttgttgattgagtaaattaaagttttaagttatacagtcaagtgatgcacattccagagtatgtcctgcccattgtattccccatttacagttgtatattagcaacaagaacagattggttaggagttgattcttttttagcaatgtgcccttcccctgtgttgtaaaatccgccgcccattcgcccaaaaccgtggtgggcggcgctgtttgctgcttctgtgatggtatagaaacgagaccacttgttgttctttgacatattgaggaaggaacgaaggtccaggttggaatggaacaccggtccgg

SEQ ID NO: 9568 - DNA, 1317 bp, Sorghum bicolor
  Clone ID: SORBI-28MAY03-CLUS22921_1
ccggggaaaaagatgactgaaagtactattaactaatatgttgtgagagaaaaatactgctaaatgactactagattcggcacataaacttaagcgaactatcagattgcccttgcttgtttagttgtgtgagtaggcacgatgttcagcagagccttgcaggtgattctcagggagaagaagagcaggacgattggtccagccttggtccatgccttcaactcggcttccagctctcaaactcagaggctggctggaaaggtcgccgtcatcaccgggggcgcgagcggcatcggcaaggcgaccgcagccgagttcgtgagaaacggggcgagggtcgtcatcgccgacatccaggacgacctcggccgtgccgttgccgccgagctcggacccgacaacgcgtgctgctacacccactgcgacgtcgccgacgaggcgcaggtcgccgccgccgtggacctcgcagtggcccgccacggccagctcgacgtcatgttcaacaacgccggcatcacgggctcccccgggtgcgggtggccaccgctcggcgccgtggacctcgccgacttcgaccgcgtcatggccgtcaacgcccgcggagtgctggcggggctcaagcacgccgcgcgcgtcatggtgccgcgccgccgcggcagcatcatctgcaccgccagcgtcgccggcctgtgcggcggcatggttgccgtcgcgtacagcgcctccaaggcgacggtgatcggcctggtgcgcgctgtggcggcggagatggcgtccgccggggtgcgcgtcaacgccatctctccctacgccgtcccgacgcctctggcgctggcagcggtcgcctcgaggcaatcgatgaggggattgagcgccgaggagattaagcggagggtggagatagactcgaacgtgatgtacgggacgaagttggaggaggacgacatcgcgagggcggcactctacctggcgtccgacgacgctaagtatgtcaacggccacaacctcgtcgtcgacggcggcttcacggtgagcagagaagtaccaaaaatcctggcacaagcacgcccaaggagtgatgaacggtccgcatggattttacttcgtgggcgctgctgacttgctgtacaccagaatccgtgatggtctctcacgaccagcaaataaagcccggacgccactaggttattgccaacatgggatgggcgacggggccacggtcgtcttagcagcggcagttagcctttcagttggataaatctccatttcttcctaagctcaatatgttttatcatgtactagttgaaaaatttgaga

SEQ ID NO: 9569 - DNA, 929 bp, Sorghum bicolor
  Clone ID: SORBI-28MAY03-CLUS22972_1
gcacgaggcttgccttctgctgctcctctactccgcgtttccgggacaaaccctaacccgagcacccagcccctacccgcgtccgctcgcgccggcctttggggctctcactctgagcggcagggatcggcagggctccggttgggtcccggaagcatcccagttgttggcgggaaaaccgggaaatggcggagaaggagggggcgaaggttggggcggaagagatggaagagcgggagcaggaaggggaggcggaggaggtggaggtgaagtttcgtctctttgacggctccgacatcggccccatccgctgcaacgccgccgccaccaccgtcgccgctctcaaggatcgcgtcgtcgccgactggcccaaagataaatcaattatcccaaagactgctagtgatgtgaaactaataagtggaggcaaaattctagaaaatgacaagaatgttgcacagtgcagagctccttttggtgatcttcccagtagtgctatcacgatgcacgttgtcgttcaaccatcatcagccaaatcaaaaccagataagaaggcgaacaagttgcccaaaaccacacgttgctcatgtaccatactatgaactatgaaggtcaagtccctacgagaccaacaataatttgtacgtccaccaaagattctgcagagaatttgagaacgcagatccaagatgtccatgtcattctctgccaacgagtggcaatggcgaaacacgtccatatgttgtaagctatgtaattgtaacttaggtacaaagagtcggtccctctgccgtgcggatagggaaaatagtatgctggttgccctgttttaccctacaagatgttctatatgtacaagatacagacacgctattttgggtctagtgaccttgttcccaattcaccttttaaaatttgttcacgagttg

SEQ ID NO: 9570 - DNA, 1263 bp, Sorghum bicolor
  Clone ID: SORBI-28MAY03-CLUS23010_1
ccggggacccgctagatctttcccctctcgcacttcggcacccgcttcccccctcagcacccatgggctctcgccgccgctgagactggggcccaacgctctccaccgcgtccgcgcccgcctccgcctcctccccctccccctcctcctcctcctattgcctccactgaccctacccgaccgcccccgcccgccgacaccggaagccctagctgctgtcggaaccgccctgccggcccgccgctcctccgcccgaagcgtcccggagttcttggatgcgccggctgctccgatggctgcctctccgcccgccgccgagggccccgacgccgtggagatccgcgaagtctgggcggggaacctggaggaggagttcgcggtgatccgcgccgtcgtcgacgcgtacccgtacgtcgccatggacacggagttccccggcttcgtggtcaagcccagcgccgagtaccggttcacctgcgaccgcaactacgccgccctcgagggcaacgtcaacgtgctcaagctcatccagcttggcctcaccctctccaacggggcgggtgcgctcccgccgtgcggcacgggggggcggggctgcatctggcagttcaacttccggggcttcgacccgcacaccgacccttccagcaacgactccatcgacctgctccgccgcagtggcatcgacttcgaccgctttgcggccgagggggtcgattccacccgcttcgccgagctgatgatgtcgtctggtatcgtgctgaacgacgatgtccagtgggtcaccttccatagtggccacgacttcggctacctcctcaggctgctcaccggacgggaaatgcccaacaccttggatgagttcctgaagctcaccaagaccttcttcccggtgctgtacgacatcaagcatctcatgaagttctgtggcggtggcctgtatggtgggctgagcaaacttggggagctgctcaaggtcgagcgtgttgggatcggccaccaggctggttctgattcgctgctgaccctgcagtgcttcatgaagctcaagcagttgtacttaaatgagtctgtcaagttgtatgatggtgtgttgtttgggcttattcctggggaagtggagatcaaacctgctgctccgcccattgaatgagtaatggtagttattaaataacaagattctgaatgagaaaaatggagaacaaaacctatcatcagtgaatatatggctgatctgatgatttcctgtgcttgttatgatat

SEQ ID NO: 9571 - DNA, 1119 bp, Sorghum bicolor
  Clone ID: SORBI-28MAY03-CLUS2306_1
gcacgaggcacgaggcactgcttcagccaagccggagacgtcagagacaccggagatggcggggaacctgcacctccccgtggtggacctggcgtcgccggacctccgcgccgccgccgaatccgtccgacaggcgtgcgtggagcacgggttcttctacgtgaccaaccacggagtggaccgcggcctgctccaggcggtgttcgcgcagagcaagggcttcttcgacctgcccatggaggagaagatggcgctgctgaggagcgccaaccaccgcgggtacacgccgccctacgccgagaagctcgacgcctcttcccagttcgtaggagacctcaaggagagtttctacattgggcctattgatgatggcgatatgcataatgatgtaaaccaatggccttctgaagagcgcttgccatcttggaaggagacaatgaagctatacattgcagctattctggatactggcacaaggatactctctctaattgctttgggtttggatttggatgctgagttctttcataaaattggtgcattgaactgcccgtcaacatttcttcggttattgcattacccaggtgaagtaaatgagtctgatagtggaaactatggtgcatcagctcactcggactatggtgtgataacccttttagtgacagatggcactcctggcctgcagatatgcagggagaaggataggaatccccagctatgggaagatgttcatcacattgatggggcccttattattaatattggtgatttgctagagaggtggacaaattgtgttttcagatctacgttgcatcgtgttgttgcagtcggtaaagaacggtattcggtggctttctttcttgacccaaatcctgacacactagtgcagtgtttggaaagttgttgcagtgaagcatgtccaccaaggtttccacctatcaagagtagcgactacatattcgggcgaataaattcaacatacaaataatcatccgtcacatttgtaatactgtatatgctcctttataacagcttgatataccatagtaatgtttgaacccaggatttaaagttatttttcaataaggcgcaacgaataaaaagggtgctatgtatgtg

SEQ ID NO: 9572 - DNA, 1138 bp, Sorghum bicolor
  Clone ID: SORBI-28MAY03-CLUS21673_1
ccgggatccccaccaccaactccggcgctccctccccttccaggcctatatacgcgcggtccggctgcagtgttcgccgtgtcctcatcatttcccaaaatcccaactactagcgtttatactagtttattacggggagacacgagcggcgcgcgtcgaccggcggcctccctccgcagccgcccgagatcgatctcagtcttccggcaccggcagggtacgtacagagtagtagaggcagcagcggaagatgagccacccggagaacggaggagccagcaacgggcacgccgccgaggagcatcaggacgtgatgatggaggtggagccgaagcagcgccgggcgccgcggctcaacgagcggatcctctcgtcgctgtcgcggaggtccgtcgccgcgcacccctggcacgacctcgagatcggtcctgaagctccggccgtcttcaacgtcgtcgtggagatcaccaaggggagcaaggtgaagtacgagctggacaagaagacggggctcatcaaggtggaccgcgtcctctactcctccgtcgtctaccctcacaactacggcttcatcccccggacgctctgcgaggacaacgaccccatggacgtcctcgtcctcatgcaggaaccggtccttcccggcgccttcctccgcgccagggccatcggcctcatgcctatgatagatcagggggagaaggacgacaagatcatcgccgtctgcgccgacgatcccgagtaccgccactacaacgacatcagcgagctctctccgcaccgcctccaggagatccgccgcttcttcgaagactacaagaagaacgagaacaaggaggtggccgtcaacgacttcctgcccgccgcagctgcccgtgaagccatccagtactccatggacctgtacggtcagtacattatgcagaccctgcggcggtagagcgagcgtgccccatcttttctctccctactaccagatcccatctcatgcgagctgaagcaaaagcccagatcatcagaacatctgggatcaagacacatgagttgtcaagcttgtcgaccatctctttccagcgatattttagcctgtatcttcccttattagtcttttggaatatgtccacagtgtggtttgata

SEQ ID NO: 9573 - DNA, 878 bp, Sorghum bicolor
  Clone ID: SORBI-28MAY03-CLUS2175_1
cgtccgcaacagtaacgattctttaattcagctagctagcatgtactaaaccgtgagtagctagtttactacacgccagccctgacctggttcgtaccataactaaatttgacccggccagtcccgaacgatcgtcaggatcagcacacgccacgctgacatatatagtgacatagtagtagagctatagatgaactggtgggcatgcactgagacgcgagggaaacctaccgagtggtgattgcagggcagtgtctggcggatcgatgaacccggcgaggacgctggggccggcgctggcgagcaacctctacaccggactctggatctacttcttgggccccgtcctcggcacgctctcgggggcctggacctacacctacatccgcttcgaggaagcgcccagcacccacaaggacatgtcgcagaagctctcctccttcaagctccgccgcctgcagagccagtccgtcgccgcggaagacgacgagctcgaccacatccaagtgtgatatgctttgcatgcagagcagagcgcacactgcttgttactcctcactcaaatgtatcggtgatactcctagagtagtggtccgtagttatgcatgtctggtctgtgtgtgtcggtgctcatgatcatgatccatgcacgtacgcacgcacttgttgcattgtgtgatgtccggtccgtggcgcggtgtggatggctcgctctctcaatgtgccaatgagctggagctttatttttgggacgaacactgtcccgtgtgcgtgtgtgtgcagccagtcgtacacacgtgccaaatgtaccctctcctgctgtcacttgttccaaaacctgttggtgcttatataaagatcactgtgccttccatgcc

SEQ ID NO: 9574 - DNA, 992 bp, Sorghum bicolor
  unsure (1)..(992): unsure at all n locations
  Clone ID: SORBI-28MAY03-CLUS21958_1
ngtcggacttctctccttcgttcctgtcggcggcgatgactgatgagatgaggatggccgccgtcttcggcgaggccaagccggagaaatccgacaaccaagccgatgctctgccgcgccgacccgtgctcttccgcgcccactcccactcccagggcagcctccgcgtcgtcgccaccgacctcaactccctcgcctggcacacctccctcgacctcgacggcctccgcgacctccaagatgacgttggtatcgctggctcctggtccgacttcctcgactacctcaattcttccttgtcttccggccatgtcaggctcctcttccccgacgccgcccgaggtcctgataccgttgagcttgtggctaccaaggcgaaggggctacctcgcatcactatctctctcgatagagttgctgcatctgagctcaaagatgtcattgctgatttctcccttgcgctgtatgaatcttacaagaccaagcaggaacatgcatccagagaacaccagcaagtgtcacagctcatgcaaagtctagcctctgaaagagaaaaaaacgaagtaatgcaaaagcaacttgaagccctttcattcctcgacaaaagaaaggctacaaagccaaagctggtgactgatcaggttccaagtgtatcgagtgtacctccaagctctgatcaaattattgttcctgcgcagcagcaaacaccagtggctttgcctagcaaagttcctcctgctaaagctacgaagcgattggcccctgtgtctcggagggcaagagtccggggagctttgttgcaagatactgaagaaaatgatgatgatgatagttagatattgctgatttatcagcgttgattgactctttggcatgtaaacctattacatttagatgacacttagttttgtggctgcttgacttatgtcaaacttgtggaattaaagtatgcagctcatgttgtagaaacaggtatgagactaagtttctaa

SEQ ID NO: 9575 - DNA, 576 bp, Sorghum bicolor
  Clone ID: SORBI-28MAY03-CLUS220_1
gggttaaagcgcgatggcgttctccagcagcaaaaccactcgtctcctcgtgctcctgcagatcgctctgttcgtcatgtccgcgctgatcatgccgcgctccgtctgccatggagcccgaagcgttgggctaggttccattggttacgagccttttgatccaaaccatcctgtgtgccttgctgggcggtgcccagttcctggcaaaccctacggccgtggtggtggtggcgatccctacgagaaccgccctggtcatggtggtggcgggcctcgtagctactatcctgacaaacccgctataccttcttacggagaaacctcaaatccttgattgcacgtaatactcgtatggcacggtaaagaaaatgttggcaactcaactactagtacatctgacgagacggatatatgatagtacaatcttggatccatgaacaactatatatgtcagctacaatataagcggaataacaccgtgtatcgtctcatgtacttggctttaatactgcacacgaataaaactgagtccgatggtcggcagtggcatgaatacgaatggcatgcagcacttat

SEQ ID NO: 9576 - DNA, 551 bp, Sorghum bicolor
  Clone ID: LIB3481-050-Q6-K1-E11
gcgttcggcgcgaggcgttctccacagcgggaccgcctggtcctcgtgctcctgcagatcgctgtgttcgtcatgtccgcgctgatcatgccgcgctccgtctgccatggagcccgaggcgttgggccaggttccattggtcacctgcctttggagccaaaccgtcctgtgtgccttgctggggggggcccagttcgtggccaatcctacgtccgtggtggtggtggcgatccctacgagaaccgccctggtggtgggggtggtagcgggcctggtacctatcctgacaaacccgctacatatccttgattgatcgctgcctcctcctcaatcacgtaatactcgtatgggacggtaaagaaaatgttggcaactattagtacatctgacgagacggatatatgatagtacaatcttggatccatgaacaactatatatgtcagctacaatataagcgggataacaccgtgtatcgtctcacatgtacttgtgtttaataccgtacacgaataaaactggagtccgatggtcggcagtggcatgaataaaa

SEQ ID NO: 9577 - DNA, 704 bp, Sorghum bicolor
  Clone ID: SORBI-28MAY03-CLUS22139_1
ccggaggaggttccggcgtgttgtccgtcagtcagcttccagttcatatggagggctccctgcctgcggatatacgagatagggtattctacttggaaggagatcatatgcattcaagcattcagaaggttcctgctcttgtcctggactgcgaacatgacattgattttaacaaggacattgaagccaaacagcaatatgctcggcaagttgcggagttctttgaatttgtgaagaaaaagaaggaatctcctacagcagagatgactgatggcaataacaagagtatcaacaaacagattgtgctgccgcacagaggtggtttgtgggtgcccggaggcagcccattaccagaatcagctctaaagtcgtttgatttcaggagaacaatgtcttccttcctctcaacttaagggggctaggcgctatcaatttgtgcccacaccctgaattggtgcgctccagcaatgtatctcgattgcaaaatgtatagacctttaactgtcgaccctgtaaatgtgtaaagattacatataaatttaggctttttagatggtgttggcgtacaatgtattatactagtggtatccaactcttgcctgtaattgttgatcgtgctgctttctgtttgcctgtaaatgttgatcgagtgctttctgtttgcctgtaaatgttgatcgagctgctttcgaggcagtacttct

SEQ ID NO: 9578 - DNA, 767 bp, Sorghum bicolor
  Clone ID: SORBI-28MAY03-CLUS2398_1
ctgtgcggccgctcaccggccgggccggggcacccagcgacaggccaagagccaacctttttcgcggagagagagagagaggtggaggtgaagggaacgcgcgagagagagagaggagagaaacgaagagaggatcgggatggcggcgctgcgatctaggatggcgatgttgggccgccgtagctgcggtccctccgtcgcatccatgggcggaaaagggatggagatccaccaggttttccgtcctgctccgccaccgctccgccccgcggccgtccgtaacctcgagagctggcggtgtttctccactgggggtggtgagccgaaaggcaaagcagatagtttcatgcgtctttggcaatgggccaaatatcgtgtggaaaatgcaggtccagttgccaagaccagggccgtcagtctgtatgtattggtggctatagggacacctacattatatatgatgaacacagtaaggaactggagaccgtccccttgaagacaagaatggatcaccaaacgacctggctttatttcagtggtgctatttatcctagttgtatcctgaagtattattagttcgattagctagcaaacttctgaatctgaacttatatgtagtgtaggagagttatccctggccgggtgtaccgaggcatttagtcccgtacaagtggtgctatttatcctagtggtattctaaagcactctaagtttgattagctggtcacttctgaatctgaacttatatatagtgtgagagtaatcct

SEQ ID NO: 9579 - DNA, 983 bp, Sorghum bicolor
  Clone ID: SORBI-28MAY03-CLUS2404_1
aagagaatcctggattttaatcaacgtatagtgattgcccttgatgttgctattgcattgacttacctccatttgtgttctggggaagctttaatctgttacaatttgaggacgtcaaacatcctactgacagagaactaccgagccaaagtatgctgttctgaactgtcagaaagtggtaatgtcgtgctatcgacgggaacagggggctacattgatccagagtacttcgagacatctgagctcactgccaaatctgatgtctactcttttggaataatactcttagaaatcatatcttctcatgggccacaagactgggatgtattgatgaaccaccggcagagcagcgttgtacaatgggctcttgagaaattctatgacgacctcatgaatgagatattggattaccgtatggaggatcgcgtggatggagatgtgctcagggactggctcagcttagcattgagttgtgtggtttcgcatggcattgatcgcccaagcatagaagttgttggtgagcgactgtggaaaatatggaaagatcatcgaagaaacatgggggaacagcacgagtacgaaggaagctgggcagcctttgccgttcaagagggaattctgaggcatcaaaagtctgtgctcaagagaaattggggcccttcagctacggaggaggattggtctgggtatcttaggcagattgaattgattcaagaaggtcactctgttacagaggaagagcactctgttacagagggacagcacatttctcgttcgcggtctttttcattggacgatatcacagtatctcctcggtagaaagcttcaattcgattatattcctcgttctattttctccatggtattacatgtgtagattggaagacaataacctatttgttctatttctgtttgtgtgcatgcaacatacataaataccttacatagaacacacatcactctatacacaaataccttattac

SEQ ID NO: 9580 - DNA, 744 bp, Sorghum bicolor
  Clone ID: SORBI-28MAY03-CLUS2439_1
gcacgagggacagatgggaatttgcaaatgagggttttcttgcacgacgaaaacatctgctgaagactatcaacagaaggaaaccatccttgcaggggaacagccaaccacagcaacctcagttgcagaatgctcctgtgccttcctgtgtagaggtgggcaagtttgggttggaggaagagatagaacggctgaaaagggataagaatgttcttatgcaagagcttgtcaggctgagacagcaacagcaaacaactgaccatcagcttcagactttgggcaagcgtcttcaagggatggagtcacggcagcaacagatgatgtctttcctggctaaggcaatgcaaagtcctggtttcctagcacagtttgtacagcaaaacgagaatagtagaagaagaatagtagctgcgaacaagaaaaggcggctacccaagcaagatggtggcctagactctgaaagtgctgctgcttcgttagacggtcaaattatcaagtatcaacctttgatcaacgaagcagccaaagcaatgctaaggaagatcctaaagctagattcttcgcataggtttgaatctatgggcaattcagataataataattttctgctggagaattatatgccagctgctcaagcttttgagagctcttcgtcaacaagaaattctggggtcacccttgcagaggttccagctaactcgggcttgccctatgtcagcgcaagctctggactgtcagctatct

SEQ ID NO: 9581 - DNA, 952 bp, Sorghum bicolor
  Clone ID: SORBI-28MAY03-CLUS24371_1
gcacgaggctaagattgaagaaggtattaccagcaaaaagaaaggactccctccacctgcttctaaaccagcccggagaacaagggctgccagaggaaatcagcatacaaagatagacgatggcggatctgaagaaagcgggccttgtgaaacagggcaagatgatcagaagttggacacagattacatctctaatatggaagttgataacagtgataaagactgtggaccaccgcctggtgctcagcttttcacattgggggagcaagaggccaaaggtgtcaaattgaacaccgtggaagagaaaccagacagtcctttccaaagaacaactgctgctgaagcgatgagtagtgcgcctggtgacaagatagaacaaatggctgatccattgcacgccatgcttctggatatgttgccactcctgggcaagaaagggacagaagatgcaagtagggcacccttgccgaaagctgagaaggatccacctgcaggaggaagttccacatccaattctgagattctggcgccagatgctggtacatccggggttccagccccagacccgaatgcagctcctcccccgaagaagaaaaaagtgagttacaaagatgtcgctagtgaacttctgaaagattggtgagagagcttggtcagtgaacttctgaaaaaagtgagttacacttttactcccgtagtcgttatcatgtaaatacaacgccatgtaagtaaccatgtttgtagcgtcaccttgactgtttgtcttgttctcagaagttcactagctttgcctggtgacttgttgagaatgactcttaagcctagcaacactgatgttgagttggaccaatatgcatgcggaatccaaggattttacacgcattttgtattatattgcattgaagtggaagtggaagccctgtggtctgctctgcaaaaaaaaaaaaaaaaa

SEQ ID NO: 9582 - DNA, 1435 bp, Sorghum bicolor
  Clone ID: SORBI-28MAY03-CLUS24409_1
gcacgaggccttcttgtccggcccttttgttggcggcgtcggcggcggcgatggcgacgtcggcgagcacgtccggcgagtggctgaagggcgccttgcaggaactgcgggagcgtaagggcagctcgctggagttcgactcagatctcatctcgggcctcgtctccttctgcgagctcgcgcctccctccgacgccaccagctatctcgagaattttattggaaaagaagctgctcaggacatcattcaagagtacttgcggaggaggggtcacattggttcttcaaatggaaccgagagctttcaatcatctaaccttcagccttatgttaagccatcagctgatgcagcagctacacaaacaaagaaacaaacacgcacacaaaaagattcagcatcttcttctagtcagagttccaagagtcaatcagctgcagaatcacaacttccttccaggagaggttcaaaaaagaaaggagcaaaggtcatttccctcgctgaggcagcaaaaggttctattgtcttcaagcaggggaaaccttgttcatgccaagcacggcaacataaccttgttagcaactgcttatcatgtggtaaaattgtgtgtgaacaagagggcgagggaccctgtagtttctgtggtgcacttgtcttgaaggaaggtagcacttatgctggtttaagtgatgtcgggctacctctttcagaagcagaagctgcagctgaagcttatgcaaagaggctggttgactatgatagaaatgctgcagcaaggactaaagtttatgatgatcaaagtgactattatgaaatggaaggaaacagttggctttcttcaaaggagaggtcagtcctaaagcagcagcaagaggaagctgaggaagcagctcaaagccaaaaggggaaagtgattgttacatttgatttggtgggccgtaaggtgattttgaacaaggatggaactactgagctggaaacggagcatccgatcatgcgaccgcccgaagagaaggatcagagccaccgcatacaaccgaaccccacaatcagagagcaaccggtgtttgtcgaaacaggtccagttaagccaaaacccgcccgagcaaaacagagcaagagacttgccaagaatggtctgtgcctggaggtaaccggacggctgcagcatgatgacaaggacattgagagcattctgagtggcaaggtgaagaagggtgatcacctggcttacagttccttcggtcaggcacgtgaaggggatgacgttgaatgctccccggattttgactgagcctttacttgagaaaaatcatggtgaggtaaagaaaaaaccatgaaacaggtagagttgctatgttccccatccaactacgtatgcaatggtaccttaacggacctaatttcctgcaaaatgcaaatgtgagaatggcactc

SEQ ID NO: 9583 - DNA, 838 bp, Sorghum bicolor
  Clone ID: SORBI-28MAY03-CLUS24562_1
gcacgaggggacctcctggggggggggtattctggcccggctgcgttccccgcgcgcccagggttcttcctctgcatctccagccggaggcggacaccggtggccgaggaatacttgcgaggtttcaatccacgggcaccgaattttcttcctctggaattggatccagatgcagagaaggttgaccttaagcatcaaatgatggatgagcggaaaaatgctgaagaatggatgattgattatgcacttagaagggcagtaacaaacttagctcctgccccgcagggcctggtcgaccctcttgcccaggccttcggggccgtggttcctcttgtcgtggatgtgttgttcctcgcctcacgcccgtcgcccgttcaaccccgtttctgctctcactcctctttgtggtttctctatcgtcggccgtgacgcgctaccctcttgctcggcgggtcccgcaatattagcgccagtagcctgctccaagtttgaatgagagagctatttactagtttgctagagggagctagtgactagtgtgctcgagctgagttgtgacagaggaggagctcactcctgctccccaaggaaggataactactcattactgatcaaggtattgctatccagttgctgagttgcaaagagaatgctcccggcttgagttatgtaatttaagtgtgtgtatacatgtgtctcgtgtgctagtgttgtctgatattgtgctggtggatgtatgaggcttggaaaatgtcaatggcgatgaggtccgtgaatgtcaatggcgatgaggtccattctcctctggcaaagatcaataaaactctcttgagtgcgc

SEQ ID NO: 9584 - DNA, 874 bp, Sorghum bicolor
  Clone ID: SORBI-28MAY03-CLUS22464_1
gcacgaggctctgctctcgctgcgacgactgggcgatcgccgccgctctccgcccccgcccccgctccccgtccccgtacgccaggtgcccaggtcgtcgtcgggcccttcgccggcgatgagcacccaacaggaggttactgagaactatgcaaatcctaagacatgcttcttccacgtgctcttcaaggcatcggcattggcgttctacatactgtccacactgttcgtgaacaacttcgtcatcatctttgtcatcactgtgctcctcgcagcacttgacttctgggtcgtcaagaatgtcagcggaaggatactggttgggttacggtggtggaatgagattaatgacgagggagagagtgtttggaagtttgagtgccttgatggagagtcactggctaggatgaacaagaaggactcatggctgttctggtggactctatatttgactgctgctgcatggattatacttgggatattctcgctcatcagacttcaagctgattaccttcttgttgttggagtttgcttgagcctcagcatcgcaaatattattgggttcaccaaatgcaacaaagatgccaagaagaacatccaggattggacaaggaatgcccttctatcagggagcgtcaggtcgcatctgcagtcagcattcggtgtctgaacaacctactcctacgacctagttatacgtatagtgctgtacaatttacagataacatgatcgttcactagaatgcatttgttttggtgttttttgttggctatgtgcatcttgctaggcagagaactgaagaactttttcaaagctgtgtatcaactcaatgtatactgctattaaaattttaataaaatttaactttatccc

SEQ ID NO: 9585 - DNA, 691 bp, Sorghum bicolor
  Clone ID: SORBI-28MAY03-CLUS2255_1
cggtcgaccccgcgtccgtgaggatatctatggcttttttgatcctgagtaccattctgaatccaaaataaaaccagagggtggctcagcttcacttgaccggaggcccaacggaaggccaccatcgaacggcaggagcaactccaggaacccacagtccaggacacagaaggcgcagcaggctcaggctgcatccgagaggtcatcctcttcaagccacagcagcgcaagcagcaaccatgactggcgcgaagggtcctcggtccttgatctcaagggcgagaactacttctcctgcgccgttggaaggaaacggtccaacgcccgctacctgctgagttcgtcagaggaggttgtctccttcctcaaggagctggcaacagcaacagctggcttccaatccagctgtgctgattacatgttcctggataggcagtaagtagattggtggagagcctccgggctttaccagagaagcaccttggcaagaaaaaaaaatatattcattcctcatttgcgcgtacagagttacacccgtagctagccagcgtgctgtacaatcctgtacaaaatttatgctacctgatgataaaactgcgagaggggagcaaaggggaaaaggataaaggagtttagagagttcggttgcttctggtatgatatacaatcgttctccggcttttgatttctc

SEQ ID NO: 9586 - DNA, 877 bp, Sorghum bicolor
  unsure (1)..(877): unsure at all n locations
  Clone ID: SORBI-28MAY03-CLUS2259_1
cgtccgcgaagacataaaactctgctggtgcagaactagatgaaagtgaaggtgcttctatttctctggataaagtgctcaattgtgcaacatcatgcatcagtgtcgcttttccacaggatattatcaaccaaaagaagaacgttttagaattaatattgaattctctctcacctgaggagagttggcaagttaaactatcatccttcttgtgtatcaaagagttgtgcctgaaatttcatagttctggtgatagtaacacatggcctcaagacacagcttgcttggttcaggagttatttcatttggtatcaccaaaattagtagactccataagattagtaaagattgctcaggttcacattgctgcatcggagtgccttcttgatttgagcaaactgtacagagacttcccattgttggaaagaacagaggccaagttcgaggatgaacttacagagctctgcgagtctgaaaaaagtgagcaagcaaaggcgattctgaaggaatgcctagccattcttaaaactcttcctggagtaaccatgacgacggattaaaaaccagcacagggaacatgtaaagttcacgtggtgattgtaaatttcattccgatatacgcatatagtacagaaatatggcaaagttctccctccattttatgtcagagggcagggcaagaaaagttacatgcttcgattagtttgctcatttgttgcctagatccttaaccgtgatattccgatacatgtgcgtgtaagaaacaagagattgtcaggcagcaagaaactgttgctgcagcattttgcagttgtgccgcccatccaatatagaatatcggtaagctaccaaagatcgaatttttagtttnccgtcg

SEQ ID NO: 9587 - DNA, 733 bp, Sorghum bicolor
  unsure (1)..(733): unsure at all n locations
  Clone ID: SORBI-28MAY03-CLUS22456_1
cacccccacaaacatccatcaacaacagcccgcggtccgcctctctctcttcacccgcccatcctccctcccatctgtcgccatggctcgcaccaagcagaccgcccgcaagtccactggtggcaaggccccccgcaagcagctcgcctccaaggccgcccgcaagtccgccccctctaccggtggtgtcaagaagcctcaccgctacaagcccggtaccgtcgctctccgtgagattcgacgataccagaagtccaccgagctcctcatccgcaagctccccttccagcgtctggtccgtgaaatcgctcaggacttcaagtccgacctccgcttccagtcctccgccatcggtgcgctccaggagtccgtcgagtcctacctcgtctccctcttcgaggacaccaacctctgcgccatccacgccaagcgtgtcaccatccagagcaaggacatccagctcgcccgccgtctccgcggtgagcgcaactaagcgtctcgctctaccgtcaacaacttcaacatgatctccacctcgacctccctggcctggcatggcggtgatgggcggtgttgaatcatgggcatgtcttttcattgggagtttggttctaccacaggcagagggtcatctgcacaggagttttcattggttttgagatatcacaaaggatcgagaggtgcaccacggtggcacgaganagggttgtatcataatgaccatggtgcaatg

SEQ ID NO: 9588 - DNA, 614 bp, Sorghum bicolor
  Clone ID: SORBI-28MAY03-CLUS22631_1
gctgcacgagcgaagaaaaggagatccggactagggttttagacggcgatgggtgcggcgggcgacgagaaggcggctgcggctgcggggaccggtgccaccgccgccgagggcgagggagcggtggactccaaggatcttcagcagcagagcaaggcgctcgacaagctcaccgatcatgtcgaggaccggcagctcgattcatcccgtgtccaatccgccatggcagcacttgcttcatccaaagaggctgactggaacgcgatgaggctgagggagaaagaactagctgctgtcaagatcaaccctactgatgttgaaattattgctaatgagcttgagctggacaagaagattgcagagagaaccctccgagagcacaaaggtgatgctgtagctgcggttcgattcttgctgcactagtttggagatttagttgccagcattatatgttttccttaaatcaacacgacatgtgatgatgtgaagcagtagtgcttttctgtgcctgtgctggaaatttgctctgtcacaatgaaacgatcatacttggcattgaccgagagcctttgttgccaagttgccatggtgtttgcgaattattttaatctgcg

SEQ ID NO: 9589 - DNA, 1448 bp, Sorghum bicolor
  Clone ID: SORBI-28MAY03-CLUS24794_1
gcacgagggaaattcttagagtcttaactcactataataggccaatattcaaagttgagcgccaacatagtgaagctgaatgtagcagcacttctgatcaggcaacatctagtgattcgaccgataagaaatctaataattctccaggaaatgaatctgaccggaaaccattgaggccactaaccccgtggatcactgacatattgctagctgcacctttgggcattcgaagcgactattttcgatggtgtgggggtgtaatgggaaaatatgctgctggtggagaattgaagcctccaactactgcttgcagccgaggatctgggaagcacccacagcttatgccttccacccctagatgggctgttgctaatggagctggagttatattaagtgtctgtgatgaggaggtagctcgttatgagacagcaaatttaacagcagcagctgttcctgcacttctgctacctccaccaacaacacccttggacgagcatttggtggctggcctgccccctcttgaaccatatgctcgcttgttccatagatactatgcaattgctacaccaagtgctacacaaaggttgctttttggtcttctcgaagcaccaccatcatgggctccggacgcacttgatgcagcagtacagctagttgagctacttagagcagccgaagattatgcttctggcatgcggcttccaaagaactggatgcatctgcatttcttgcgtgcgattggaactgcaatgtcaatgagagctggtattgctgctgatacagcagctgctttgcttttccgaatactttcccaaccaacgctgctttttccaccactgagacatgccgaaggagttgaagtacaccatgaaccactgggtggctatgtatcatcatataagaagcagttggaagttcctgcatctgaggccactatcgatgccactgcacaaggcattgcttctttgttgtgtgctcatggccctgatgttgagtggagaatatgtaccatctgggaagctgcctatggtttgctaccgctaagttcatcagcagttgatttacctgaaattgttgtagctgctccgcttcagccacctacactgtcatggagcctgtacttaccatttattaaaagtattcgagtatctacctcgtggaagtccatctgaagcatgcctgatgaggatatttgtggcaacagttgaggctatacttaggagagcttttccttctgaaacatcagagcaatctagaaagccaagaagtcaatctaagaaccttgctgttgctgaacttcacacaatgatacattcactctttgttgaatcttgtgcctcaatggaccttgcctcccgattgctatttgtggtgttaaccgtttgtgtcagccatcaagctttgtcagggggcagcaaaagaccaactggtagtgataaccattccca

SEQ ID NO: 9590 - DNA, 1141 bp, Sorghum bicolor
  Clone ID: SORBI-28MAY03-CLUS24876_1
aaaataacatattttactgaatcatacatcaatatatataaatatggtataagctgcatacagaaatacttctcttcacttttctaatagcttaagggggttgttgcaacttcacgttaggcagacaaatttccgtagatttttaaagtggggaaaaattaaattaaattggtgaaaggccttgcttcacagttgagacttctgctttatcttcatgagaggttgaacagcttctattatttccctgcacgccctgcattcttctgctcccagtcctcgttgcacgcttcccctttcctgctggggagttctctgagtcaggcagttgcactttggcagaaacttggctggtccagatggatgtggagccaggactcgtattgaagcctctgcttgatggacgactgaagcttgtgttgggccttaacattattgaattctcaggcctctttacaagtagagtctgtatctttttattctcccgtaaacaaatgtttatgaaatcaacgtcatcctgactgataatggggtccttcagcattgccagaagcgggagctcatcatagtagaagatcttgtttctctcctgttcccagaattgtgtcttggccattaactgctctaccaagcctggaattttgttaactataattcgagcacgctctgcccttcttccgggcgtgtgtgctcctctcccccgtggcctccttcgttcatccctgctgtattcttctagccaccgctcttcatcacatgaagccatccatttttcaaccttatccattatgtctttccggcttgtggcctcctcttttgctttgtatatatattcatccattgtctttaatagatcatcatggaccacatctcctgacattatcagattcattattttgtccatttctgtttgataaggcatgtccatgtgtgatttcttgcaaatttcatcgacttctgctctcttttttaggaatagctctttcattttgcttgccttcaactgatttagacgctgaacttcagattcaacctgttgaattgtctcaagtgtgaggcttccaggacctaacattccatttactgaagtcattgcgagtaccttaatttgcccatatggttggcgctcctccatagtagtatc

SEQ ID NO: 9591 - DNA, 825 bp, Sorghum bicolor
  Clone ID: SORBI-28MAY03-CLUS25050_1
gcgcgaggggaacagctgctctctctagctacatatacatatatataacaacacgtactactgcgcgttgcaacacccatggcggcggctcggggaagaggcagtgccgcaggcggcagtagggcgccgccgcttgtcgccggtgccgcgttcctgtgcttggcggtgctcctgctggcggtggccaccccggcggccgaggcggggacgacgtacctcgtcggcgacgccgccgggtggacgctccggcccaaagttgactacggccagtgggtggccggcaagaccttccacgccggcgacatcctcgtgttcaagtacaacaccacgtatcacgacgtggcgtgggtgagcaagggaggctacaggaactgcatcgtgtcgcccaagggcggacgcgcgccggtgtaccacacgggccacgacgccgtcacgctgcccaggggcacgcactacttcatctgcggcacgccgggacactgcagcgccggcatgaagctcgccgtcacggtctactgatcagatccatagtacgtcgtactacgtacgtctccggccagcagcttcatatcttctcgatcgcgtgtgggtagcagagcaggtagctagcgtagtgtgcgcggacggttgaatgagcgtgcgtgtacgtgtgacgtcgcgctctcgcgcgctgatgtattcttcatcatgcatcgtcgcatgcaggtacggttgagttaataattggcgtatgtaatttgcgtgtcgttgcgacttgtgtgagtttggcgtgtatgtgtggcatcattcaaaatgtgcaatgagagtaaccctgatgtttcctct

SEQ ID NO: 9592 - DNA, 665 bp, Sorghum bicolor
  Clone ID: SORBI-28MAY03-CLUS24977_1
cccaagactgcagacagctcctcgctaggatctttgtcgcaaatcctgcaaagagaataacaattagggagattaggaatcacccctggttcctgaagaatttgcccagagagcttacagaagctgcacaagcgaagtactacaagaaggacaacagtgctcccaccttctctgatcaaaccgtcgaagagatcatgaagattgtagaggaggcccgcatgccgcccgaatcatctactccggtggctggttttggttgggctgaggaagaagagcaggaagatggcaagaaacctgaggatgacgagcaggatggggaggatgaggaatacgatggcgaggacgagtatgacaaacaggtgaagcaagtacatgccagcggggattttcaacacctgataaaatgaagctcctggcaaggccaagttcccaactgatgaaatactgtctggatttgttttagtttgtggtgctgagatgctgcaccctcggtgcttacttgtagtttcctcctgcttgcatccaccttttttcgcatattgtgttatattctgtaaattatcaaactggcttcctcaatgcctgtgtaattgcaacgaatcgttgagtgattaagctagaaggcgaaatataatttctgtggaatacacttgcaactttgagtt

SEQ ID NO: 9593 - DNA, 1051 bp, Sorghum bicolor
  Clone ID: SORBI-28MAY03-CLUS2511_1
gcacgaggtcatttgcagtcaggttcgatcagttatcacagtcaggtcgctgatgaggagttccttgaaatcaatgatttctttgatctggatgatgtaggtcagaatgcaattgtacgacaactgagtacttgatctctgcaacaaatgggatgttgacaatttggaatactgtgatgctccttcatttctgcctgggccatttgacacagttggattggtagctgaaaatcaattttttgatattggtaacagtggaattcagaaccagagatatcaatatacaacagaagtaaggacacataatcaggctgctcttaatgtgcggagccatatgaagcatgatcatgtagtcttatcctcgcatgcatcaggcactatgaatattcatgcagcaaatgaggtaaataaccagagctccacagcttcacaatcatggttcaatgcggctctatcagccttgttggactctgtacctagtagtccagcattagctgctgaaatcgaaaatactgttatcaacagaacactccagtgcatctctagcttccgatcacagcaaactgcaggtgaagaaaacacttttatcaacagaacacttcagcacatctctagcttcaagtcacagcaagcaacaagggaagaaccaggcaccccaagtattcaggttaccagaggcagcaggctgatgctcatctctctactggttatacttgcttctatcatatggacttttacttctggctctgccctcaatttttgcaaaggtttttggaaatcctcttctacgtgacacagatgaagtggcaacctgacgaccttgtcctcggtatcagttctggtttgaatatcccttccctttcaaaagggtgaagaggtagaaacattttgagggtggtactatgaatataggtcttagagcttatttaagatggtaaaatgcaaggaaaaaaagccatatctgatggtaatatttgaaactaatgaattactgtcctcatttgtattttgacagatatatgtactgaatgtaattaaactattattatag

SEQ ID NO: 9594 - DNA, 620 bp, Sorghum bicolor
  Clone ID: SORBI-28MAY03-CLUS33488_1
acacccccgacctccccctctccctccccctctgcgccgccgcctatctccctcgccagcccgcgggtctgcgcctccctcaccatcggctagaggatccacgccgccggctcccctcctccggctatttccctggatctggccgagcaggagccacggtgccttcccctgccggcgccatccctcaccccagtctctgctcccaagtattggaaagatggtggccaataaaaggagtggtggtgctatctcaagaagcttaaatgagaataaaagaacctgctctgcacgagaggcaaccaagtcatcgctttcagatggattatgggactctaaggatggcgtctggagcaagctgagtgaacaagttgctttaaatttgtctaaaagcgttgtctcacttgttttatcagatggagacacagtgctatttgcgtcctctggcattgctatagagtgccatggacatgtttcgaggtttctgacttccgcaggtttggttagagctttaaacaatgaagaaaacggacatgataacgtgaagattgaagtgcatcataaaggaagggctgtcacagggtttcttgaagaatatgatttggattatgacattgcggttg

SEQ ID NO: 9595 - DNA, 963 bp, Sorghum bicolor
  Clone ID: SORBI-28MAY03-CLUS33465_1
gcgcggggatcccgggcccccggggcaccgcctgcgtcgtcgtcgtctcgccgggggtcgtccccggcccgcaccgcgccggctttctccccgttgtttcccctcccccccgtcttgggatcaaatttgttcttgttcctggaacacatgtccagattgataagctcttggctgagagagggaagaaggctaagtatgctggtcgctaccgtattactgattcagattcattagatgctgcaatggaggcagctggccgaataaggctaactttgcgggcggagccgtcgcccgctccgcccgtgttctttctccggcggcgtgctgttgctcctcgtcggctcggatgctctgtctgtggggcgtctgctgtgttccttggtgctaagcggcgaggggttgttgctggcattgtctgtggattcactggtgatgttaaaacaatagacgtgtcacggataagacaaaggcttcgttcagttagtatgctactagtgggccatagggggtccgccactacagtacttgatgtgtatggcatgttcaatgagcttacttctgcgtgtgctacgtgcaagaaggctataatggaattgtatgctggtcgctaccgtattaccgattcagattcattagacgctataatggaggcagctggccgaataaagctaactatagaagaaaagctgattcagcctgttcgtttgagcttatcatctgaatctgtcagccattcagcagtgtttttctctcacaacattcagcggtgtttttctctcacaacaaatcagccaatagtactttctgccatggctttttgtcggtatggtgttaatggccgttggcacgaaatctctgataatgttgcaagtggaaattttcttggtgctagagttagtacaatcatgctggttctttactgtatatcatcgttcatttatatgtaaatttaaattgcacgtc

SEQ ID NO: 9596 - DNA, 664 bp, Sorghum bicolor
  Clone ID: SORBI-28MAY03-CLUS33597_1
gcgctggtccgcacggcagcagccacccatcacccgccccgtcggccacgcaggcggcgggggggccgtgctccggcacacccggcaagtggagccgaggaccgcaggaagcggccatggcaggcctcttggtcagctcaagcggcgtgtggaccgtgctcgggcaggcctcgaacgtggcgcagctggtcggcgtcgacgcgctcgggctggtgtccatggtcgtgcaggccgcgctggcggcgcgccgccaccgcgacgcctgccgtcgcctggcgcagcacgtggaggtcgtcggcggcctgctgcgggagctggagctcgccgagctgatgcggcgggaggctacgcggcggccgctcgagcagctccagggcgccctgcggcggtgctacgcgctcgtcacggcgtgccaggactgcgggtacctccgcagcctgttcctcggcgcccggatggccgacgagctccacgctgtggagaaggagatcgacatgttcatccgcttcgtcccactcatcgccctcgtcgacagtacgcatgatcgccatgccaaggaaaccgcgggtggagtgcctgttgtaatcatgactagggtaagccggctgctcgatccatgattgccatcaaaaggatggatgaaaatgctacagtgtttgatttc

SEQ ID NO: 9597 - DNA, 705 bp, Sorghum bicolor
  unsure (1)..(705): unsure at all n locations
  Clone ID: SORBI-28MAY03-CLUS33602_1
gcacgaggccgggtttctctcaacaacaaaaatcccccccgcaaccgccgccccaggccccagcgcacggcacgcccgccccgtcccaggcggccgctgagatggcgcaggacctggagatggcggcgcgcaacggctccggctccggcgccggcgccgacggagcgcactactaccctcagcagccgcgggacggcggcgccggcggccaggagctcgacgacgacggcaggaagaagcgcaccggaacggtatggacggcgagcgcgcacatcatcacagccgtcatcggctccggtgtgctctccctcgcctggtcaactgcacagctgggctgggtcgtggggccgctcaccctgatgatctttgccctcatcacgtactacacctctagccttctcagtgactgctaccgcagcggcgatcagctcactggcaagaggaactacacctacatggacgctgtcgccgcatacctgggtcgatggcaagtcttgtcctgtggtgttttccagtatgttaacttggttggaactgccgttgggtatacaattacagcgtccatcagtgcagcggccgtgcacaaggctaactgcttccacaaaaagggacacgacgccgattgcagcacctatgacaccatgtacatggttgtatttgggatcgttcagatcttcttctctcagctccctaacttnagtgacc

SEQ ID NO: 9598 - DNA, 974 bp, Sorghum bicolor
  Clone ID: SORBI-28MAY03-CLUS25443_1
gcacgaggggtgtggctacccgacagctccagcaatttgtggttctcaggaagataatcgatgggaagagggctgatttcgatgggttcctttccaacctgggctttgcaaaggttggggcaccgccgccgccagcaaggatcatgggtggtgcgtcccctgtcccagcaccagcgccagtaagcgaccaggaggatggtgctggaattggggacagtgacaaggaggatggtgctggaattggaattggggacggcgaggtggtggacaatgctagtggtacacagcagccagcacagagattgcctgcccggctgcttaacatccctttgtcgaatgtggagcgtctgcggtctacgctgtcggcagtttcactgacggagctcattgaattagtcccccagctggtgagcagatcgtcaatatcggcagatgcacatcctgacaagaagaagcttttctcagtgcaagacttcttcagatatgcggaaattgaaggaaagcgattctttgaagagttggacagagacagtgatggtcaagtcactctagaagatcttgaaattgcaatgaggaagaggcggttaccaaggaggtatgctcgagaattgtttcgccatacaagaagcaacttcttttcgaaatcaattgggtggaagcaatttttatccttgatggaacagaaggaggcaaccattctccgagcatataccacgttgtgtttgagcaagtctggaacacttcacaagaatcaaattttgacttccttgaaaggtgctggacttccggccaatgaagataatgccactgccatgctacggtatctaaattctgattcagaaggatcaatctcatatggccatttccggaacttcatgcttctacttccttcagaacgccttgaggatgatcctcggaacatctggtttgaagctgctactgttgttgctgttcccccacctatagaaatatcc

SEQ ID NO: 9599 - DNA, 1163 bp, Sorghum bicolor
  Clone ID: SORBI-28MAY03-CLUS255_1
ggcaattgctctgtctggtcaaccgctgcttggacaagcagtgatggttaagccatctgaggctgaaaagaacttggttcagtcaaatgcgacttcaggtggtgcggcttcaggtggagcaagaaaattgtatgttggcaatcttcactcaaatattactgaagaccaattgagacaggtatttgaaccatttgggcaagtggagcttgtacagcgtcctctagatccaatgactggattgtgcaaaggttatggttttattcagtttgcacggcttgaagatgcaaaagctgcacagagcttgaatgggcagcttgatattgccggcagagttattaaggtttcagctgttactgatcatgtgggagtgcaggctagtggagcaactactggagatttagatgatgatgaaggtggaggcttggcactaaatgcaagctccagagctgcccttatgctcaaattggacaggagtggtactgcaaccagcttaactggtggtattggtgctgctggagtgtctttaccagctacttcagttattggggctccaggagctgcttctcttctatcaccaacagttgctgctgttggatcagttcctggggcacctgtgcttcctgttaccactcagaatgtgatcatgtctacacctacagaattcttgttgcttaaaaacatgtttgacccagcattggagacggatcctgattttgacttggatattagagatgatgtccaagatgaatgttccaagtttggtgcagtgaagcatatttttgttgacaaaaatactgcaggctttgtgtatctgcagttcgatagtgtggctgcagcagggaaggcccaacaagcacttcatggaagatggtttgcgggaaagatgattacagcaacatttatgtcggctcaggagtacagtacaaagtttccaaacttgtgagcatacacggggaagagttggccagttggctactgtgctcgtagtgttcgcaagtgctgtattgttggatggtagactagacgaacaccttattgattgtatgacaggatagttacagcactgggcgtcaatacaatgttttatgtactttatttacggcgtcacatagtgaccaaccattatttgtccaccgaatgaaatgccaaatgatatcaaggct

SEQ ID NO: 9600 - DNA, 617 bp, Sorghum bicolor
  Clone ID: SORBI-28MAY03-CLUS25531_1
tactgctccgcacccgcacgcggcacgcttgcacgagggcgcccacccgtcgccgtgatcgccagagcgttcccctgccgcgctgttcggcccgttccactccagcgaagcttccagcagaggcggccgccggatcgagtctctgccgccgaggagtcgaagaccatggaagtggtggcgtcggcgccggggaaggtgctcatcgcgggaggatacctcgtgctggagcgccccaacgccggcctggtcctcagcaccaccgcccgcttctacgccgtcgtccgccccatccgcgacagcctccccgccgactcctgggcctgggcgtggacggatgtgaaagtgacttcccctcagctctcccgggaggccacatacaagttgtctctaacgaaatcgacactgcaattgacgtctgcaagggaatctacaaacccttttgttgagcaggccatacagttctccgtagcagctgctaaatcgatcatcactgataaggacaagaaggatgctatagataagctgctgttgcaaggtctgaacattacaattcttggttgcaatgatttctattcttatagaaagcagatcgaagcacgtggtcttcctcttactac

SEQ ID NO: 9601 - DNA, 623 bp, Sorghum bicolor
  Clone ID: SORBI-28MAY03-CLUS25587_1
accttatccgaagttggctttcaagtactatggtccatatcgtattctggagaagattggagcggttgcgtacaaactggaacttccaagtcacagtgacattcatccagttttccacatatcccagttgaagccattcactccaaatttctcacctgtttactcgacactacccactgtgtcactgatctgcaggctactgatgctgaaccggcgacaatcttgcagcgtcgtctggtgcgcaaggggagtactgctgtcccacaagttcaagtcacatggactggtttaccagacacggtggtgacatgggaagactacaatgttctcagggacaggtttccatcggcgcctgcctggggaccagcaggatcttcggcggggggagatgtcacaacccgtggctgaaggcgtattcgcaggatacgtttctattattcgttaagcgtaatatgtaatggtgtcggtttatttcagtatgacatgtgggaccaagatgtcaggtctttaggcatataagatgctagttgctgtaagactaaaacagatgagaattgaatcagaaaacgcagtcgcgtgcagaggtgttcctctgttcgtcctcgtgctcacttctcgacccc

SEQ ID NO: 9602 - DNA, 833 bp, Sorghum bicolor
  Clone ID: SORBI-28MAY03-CLUS25596_1
ttgcaaggctgcttgtagacaatgctgcccatgttaccactgtcgtggcgggcacctttggatacctagcaccagagtacttgcaaaatgggcatgctactgaaaaatcagacgtgtatagctttggagtgcttttgctggagctggtgaccggaaagaggccaaccgactcatgcttcatcaagaagggactgaacattgttggctggctgaacaccctaactggggagcaccggttggaggatatcatcgatgagcaatgcggtgacgtggaggtggaagccgtggaagccatcctggacatcgcggcgatgtgcaccgacgcagacccagggcagcggccatcgatgagtgccgtgctgaagatgctggaggaggagatcctgtccccctgcatgagcgagctgtgctacgagcagcacctggagctctgagctgagaggaggaagcctgactatgatgctagtagctgctgctcaagcgcgtgcatgcatgaatgatggatgagatgagactgagtaggaagcaaaagttttgtagatacaatggtgatgctgaaccgtgtagtgtaggtgtttatgtgctggctggacaagtgcagattctctcatcttcctttttttgtgctcagcctcagctcaagcaaagtcaaagtggttcttggcacagaaccaacaatctaatcggccatgttctgttgtacatagatcttctctccttttttttttggttcttttttgccttttattttcctcagttttcttttgtggcgcctttatctttgtaccggtaattttctgactagattgtctgcactgttgtggctgcgatgc

SEQ ID NO: 9603 - DNA, 678 bp, Sorghum bicolor
  Clone ID: SORBI-28MAY03-CLUS25624_1
accatgcatacaaaatgatactgcagctaatcactttggtgaatccagaacacgaggtttcaagggaaggaggcctatacagcaatctgttcactgcacatccacctttccaaattgatgcaaatttcgggttcccagctgcagtgtcggaaatgctggtgcagagcactgggaccgatttgtaccttctcccagctttaccccgcaacaagtggccccaaggctatgttaaaggtctgaaggcccgaggtggtgtgactgtaaacatcagctggaaggaagggagcctccatgaagctctgctatggtctagtggcgggcagaattcccttgcaagggtgcactatggggaccagacaaccactgtcaacctatcgttgggtcaagtttacaggcttggcagggatttgaagtgcttggagactttgccactgtgattgcacacatttgctgaaatggaaggtacaattgacactggaaaaaatcatgaaaaatgttcttcgtggccagaaaataatcgatttcatacatcatcacacgaatcagacatttgatttgctgtgtatgttttttcacgtagtgtgtgtttgtttacatttgtttgctgaaatggaaggtacaattgacactggaaaaattcatgaaaatgttcttcgtggccagaaaataatcgatttc

SEQ ID NO: 9604 - DNA, 704 bp, Sorghum bicolor
  Clone ID: SORBI-28MAY03-CLUS24575_1
gcctgctttcgccctcttggtgcgaattctgctcataagcttcatttgtcagacaagctatgctttcctatcattatagagaagcattggtttgtctttattgttgacttgaagaataaactttttgtgtttttggattcttacttttctgataatcacaacttccaagttcgagcaaggaccaagcttattaatgcattcaaggattcttggcatcagtatgctgagggcaacgtagatgttgacacattctctgtgttctatcctccagtttcaaaacaaaataatgtcgttgattgcagtgtttttgccctaaaattcatggagctatgggacaggaacgttgatctcagggatttgcttgaccattctgatattcccgatatacgtgtgaagcttggaattgacttattcttcagcaaaggaaattgcatcgacaaatctctcgtaatgaacttgtataagcagggtgtcgatcctcgtgtttgcaattagtttttttcataactagaatctcaaagtattgatgtaattagtaaaatacttttggatagagattgtggagattgttaatactgtcttttccagaaatagtaaatattcattgttgcacacaatagaacgaattcaactattacagtttattcttatattacatatatgtaatatcacttctctgtgtgtgtctcctcaaaaaaaaaaaa

SEQ ID NO: 9605 - DNA, 1085 bp, Sorghum bicolor
  Clone ID: SORBI-28MAY03-CLUS24603_1
ctactggagaaaccctagtaggccttcacacgccgccagcgcagccgccgccgcctccttcgccatggccctcttcgccgccgcccgccgcgccgcggcctcctccgtccccatcctcctccgcgcctccgcctcctcggggtcccaccgcagcgccgccctgctccggcccctcgctgccgccgtggcgcggccaaagccccgcgcgatgccgttcccctcggcccccgcgacgaggcccagctccgacgccgagctactcagcgtcatcgactccgagatcaagtacgccgaggattgcgacgaccacgacagggttgaggagattccagataacttccctttcaaaatcagcgacgagaaggggacgaatgtagttacccttaaaagaacatatcagggtgagcagattgaggttgtggctcacatgcccagccttgtcactggagatgagcctgatcatgaccgtgatggtgaggacgagggtgaggacaaggagggagatgacgatgcggaagacgaaggccagaagcccgagcagtccagcgttcctctcacagtcactatcactaagggtgatggcccggtccttgaattcgcctgcaccgcctatcctgatgaggtcctcatcgacgccctgtccgtgacgcagccctcaggggatgatgaacatgacatgattgtgtatgagggtcctgatttcaatgaccttgatgagaacctgcagagggcattccacaagtacctggagctgcgtggcatttcacccatgaccacaaacttcttgcacgagtacatgatcaacaaggacagccgtgagtacctgctctggctgaggaagctgaaggattatttcaagcagtagagatctacaccatcgctatcaattcccccaggcataaaatgttctttgcacaatgagattagagccctgaacttctcgttttagataaatatgaaagatgattgtgcacttacatgaacttccgaagttcgtttttttggctatggttttagtggtgtgataacgaccggttcatctgcaagttggaaccagtatgtttggaaaggttaagtaggatgga

SEQ ID NO: 9606 - DNA, 795 bp, Sorghum bicolor
  unsure (1)..(795): unsure at all n locations
  Clone ID: SORBI-28MAY03-CLUS24635_1
acccntggctcgccaagcacggcgacgcctcccgcctgttcctcgccggcgacagcgccggcggcaacatcgcgcacaacctcgcaatgcgcgcgggccagcagcagggcggcgccgccgcgaggatcaagggcgtggcgctgctggacccgtacttcctgggccggtacgtgagcggtggctcgcagcgctcgtgggacttcatctgcgcggggcggtacgggatggaccacccgtacgtggacccgatggcggcgctgccggcggaggtgtggcggcggctcccgtcggcgagggtgctgatgacggtgtcggaccaggaccggctcggcccgttccagcgcgagtacgtggacgcgctccgggctagcgggtggcgcgggcaggcgcgcctgtacgtgacgcccggggaaggccactgctacttcctcaacaacctcgcctcgcccaaggccgccatgcatatggccacgctcgccgcgttcatcaacggaagctaatagtagcttcctcacaccagggctctctgctttgtcggcagccaagccagcgtggtagtgctacacgtacgatcgatcagccctgtacgtagctatagtcgtcactggtgagtggtgacatctgtaacgaccaccataccgtatactgtattttgtcagtgaccagagagatgtttggcatgtaggagtactgcgtctacgtgcacgtcctttttttttcttttgcttgtttgtaaccgcatcacatgtaacttgcactcgtttattactgcggccgggtaatgtatactactcc

SEQ ID NO: 9607 - DNA, 858 bp, Sorghum bicolor
  Clone ID: SORBI-28MAY03-CLUS24749_1
gcacgaggccggcgcaggccaggacaccccccccggggggcgcacgcaagaacgaaccaacccgcagccacgcacggcaccaccccgcccgaaccgaagctgattgatgctgagcgcagccaaatccagccgctagccatagatagccagcccataggaatatcgccaagaattctccccgtctccccgtcttcctctctctcgtctcctccctcgttccggatccaccgccgcagccttagcgggccccgtcgctgtcgctccgcctcccgcccgctcgcggctcgcttgccggggggcctctgattccccggacggcgcctgtgcagggcggccgtgacttgaggagtgctctgctgtggtccgcccggcgatggaccggggccagcgcctcggccgcgcgctggacgccttcgggggcgacatgtgggcgctggttgacgccgcgctggacgcggccgcgcgggaccgccccgacgacctgcgcgcgcgccgcgacggcatcgtcgagcgcctctacgccgccgccaccgccggctgtagcaactgcgccgggcgtccgccgcctcttgctgctttagcggcggcggggctggatgaggaggacggcgaggaggcggctccggcttcttcagcggtggctttggaggcggaggctgacgcgcaagccggtggcgcagaggagcgagcagaggagctcggcgccggcgcgcccgggctcgagagcaagatcgtggccataagggacttcttggatgaccccaatcagcccgaggacgagctggtgcgcttgctgcagagcctggcagacatggacgtcacctacagcgccctccaggagactgacatcgggcggca

SEQ ID NO: 9608 - DNA, 749 bp, Sorghum bicolor
  Clone ID: SORBI-28MAY03-CLUS24792_1
aagacagtgctgctggtgaaggcggcagctgtggcgctcacccagccccctgtagtaaatgctagctgcagaggggggttgccctgcccctgctgctgctgtggccgcctgcgggggcccgctccccgcgcccctggccttcttgctccagtattggaggatgctgataagctggatatatatctgcttgcgcaaaagtggagagtgctgctcaagaaggcacgcatgaagcagctgcaaccaaatgaatacaactctgggacatttacactatccaatttgggtatgtttggggtggataaattcgatgcaatccttccagctggtcagggggctatcatggctgttggagcatcaagaccaactgtagtggctgacaaggatggtttctttagtatcaagagtgaaatgctggtgaatgttactgctgatcacaggattatctatggtgctgatttggcagcattcctgcaaacatttgcaaagattgttgaggatcctgaaagcctcacattgtaaggaaagtttcatacagctgttctcaattttctgtattcacaattggaagagaatgccaatatagataataaagagataccttttgatgttttctccaattagagaaatttgtgtacagtttatacagaactcaaaacctggatgctcattttcaattcgcatttatcgtttcaagaaaccattaatagtataaacacttgggtagcattaataatgatagaggatgcttc

SEQ ID NO: 9609 - DNA, 887 bp, Sorghum bicolor
  Clone ID: SORBI-28MAY03-CLUS25885_1
gagccagcgggaaggcacctctacggcgactggcgtcaagaaaggggaacggacgcctcgccccaacgcacgaccccacgttcttcctaaattcctcggttcctccgcgtccttccccccacgccgcggcacgatgatacagctcctcttctcgctgctagcggcggagggcgccgtggcggcgacactactcttcaagacgccgctgcggaggctgtccgtggtcgcgctcgaccgcctcaagcagggccgtgggcccgtcatggtgcgcaccatcgcggccaccgtgcttgtcgtgctcgcatccagcctccacagcatgaccaagatccgcagccgcgccgatggggagctcgacggcgccgggatcgtggggctcactcccaccgaccaggtccttcttgcgcgacacgtcctcgaggcctcgctcatgggatactccttattccttgctttagtcattgaccggctccacaactatgtcaaagaaaatcgaaggctcaggaagaaattggaagaggtgtcaaaacagaatgagacaatgctggaagcaacacatgggccaaaagagagcaagctggaccagaaagatattttcgatgccaaggataattaagtatgacatgcgctcaagaggctcctgccatcactgcttatgtctgaataggatgccggtcactgataatctcccatctgagaattagcatttgtacatgaatgctcggttacaacgtgctgaatctcttacagcaggcatctggctggcctagcgctgggtgatgcccatctgtaaatacatgatgctactgctttaaactaaatataatgttagtcgtgtcctcgtgtggccaaatttcataatgctaccatgtcggtattgttctcag

SEQ ID NO: 9610 - DNA, 576 bp, Sorghum bicolor
  Clone ID: SORBI-28MAY03-CLUS25910_1
ccccggccccggcgcccccgcctccgcctccgccgccgccccctccccctccgcgggctccgcgcgcgcgtccgacatgccgccgggcccgcagcccgggtgggtgaccgcgcacgcgcgtggcgccgccggcagccccggcgggctggtgttcaagggcggcgccgtgcaggcggcgggcggcgggggccagacctacctcggccgcgcgtggaacgccttcgccgccgtcgtgttctaccgcacgcgcatggacggcgtcgtcgtgccgcagggctggcaggcctggaacgccgccggcaacgtgtcgagcgtcacgtttgcagaggttgagtgcacggggccagggtcggagatgggcagaagagtggactgggagaagcgtttgagcgaggacgaggtgcaaagattcgtggacatcaaattcatcgacgatggctggctgtcaaaccagccatagattaatataattagccagggactggaattaatgaatcatcttcggtatgcctatcgggcaagaaggctgttgtgtgcaccgggatggacatcatcgatcgaattaatttcatcgga

SEQ ID NO: 9611 - DNA, 723 bp, Sorghum bicolor
  Clone ID: SORBI-28MAY03-CLUS25961_1
gatatcagtgaggtgcgagtagaaggtttggaaactctggattacctagataacttacaagatagagcccgtttcactgaacaaggcgatgcaattgtttttgaatccgaactggacagaatatatctgggcactccgtcaaaaattgcgattattgaccatgagaagaaaagaacatttgttgtgaggaaaggaggccttcctgatgctgttgtttggaacccctgggataaaaaagcgaaggctatgtcagattttggggatgatgaatataaacgaatggtatgcgtggaggcggcggctatagagaagcctgtcactctgaagcctggtgaggagtggactggaaagttggaactttctgctgtgccatctagttattacagtggtcagctagatcctgaccgtgtgattcaggattctactgtcccggaggactcaatcagctagtccttaagtctattttgcgcaggtagagcattacatcatatgcataagagatgctggcaacaaggattgtccacatgtttcttccattctattcaaatctttggtgttttctattcggagtacatatccgaaccaaggaatgtgaaattggttttcattttttaggatctatgccgcataatattggcatagtggacaagtcggtgttcataccctgtatagggatgtttaaaggatgtttccatgtgttgtaaaataaaagaaaatcccctt

SEQ ID NO: 9612 - DNA, 663 bp, Sorghum bicolor
  Clone ID: SORBI-28MAY03-CLUS25971_1
agactctcatcggtggcaactatggactgcttgacacagaaacttttctgccaaatcctgattactacagtgctctactatggcatcggcttatgggcaatggagttctttcagttgatataaatgcaccacgtcaaatacgtgcttatgctcattgtaggagacaacagcaaggcatcacgcttctgttgatcaacctaagcaacactactggatacaacgtcactctacagaatgacatcaacgtcagcctcggtaaaagacctgaccttgagaagcgcagttctttcacacacaggctcaagaaagcagtctcatggctgggaaggaaaccaacaagcgacaccaagaggagggaggagtaccatctgaccgccaaggacggtgatctccagagcaagacgatgctgctcaatggggtcccgctagaacttggagatgctggcagcattccagctatggatcctgtgctcgttgccgttgattcgccggtgcacctagcaccaacatccatcgccttcgtagttctacccaagtttgaggccaaggcttgttcttgacacatgaggtcttgaaataaatatttttgctgcagtatgccttgaaatattccatcggctattttgtgaaagaattttgtgacggggacaaaaacgggaaagc

SEQ ID NO: 9613 - DNA, 878 bp, Sorghum bicolor
  Clone ID: SORBI-28MAY03-CLUS26000_1
gcacgagcgccgcgggcaccgcagccgcagccgcagccgtcgtccgccagcacccagcagcgaactgttccccgcggcggcgaagcacaggagagaagcggcgagcgagatcgatggcgccgccgatggacccgcccgacgtcgagatggagatggaccccgcgccccagcctccggctccggcggtcgctccggcgccggcagcggttggggaggggtggagcatgctgtcccgcgcccgcgggctgctcgaggagggcaagccgtccctcgctctgcaggcggttctcctggccataagatctcaaggtggtgaacaagcgctcatgcagacaatgaaccgtgcgcgtgaactctatgcgcagagattgcaggccactcctagtgttgatgagcttgcctctttgcttgcccaatgtgccatagcagaggctcagtcaacaaatactaacccttcacaaggacctgggtcagaccctgtcgatatgctgaattctgatgaggcctgcattcttgctgagagtggaaggaagcagatcatcctggatgcgtttgctgatgggagcagcttcatctgcctgaaatgtggtgggctctttagcacatctcgcaaggacgagcacttagcctactggtgcgggactgcatgatcctggttacatcttgctgtggtttatctatggtcacacctggcaatgaactgatgatcatgatacccgtgagattttgtaaaacctttcttctgttcctattactgcttctttactgcagggatgccagagatgcatctgttaagtggtagtaaatacattgccgataccaaactttatgaacgaaagtttccatctatatccgttgtatgttgtacttgtacttcg

SEQ ID NO: 9614 - DNA, 571 bp, Sorghum bicolor
  Clone ID: SORBI-28MAY03-CLUS2603_1
cgtccgcggcaatcttggagccactagaagagagcgtgcctgaagaaaatggactcgcatcagctgaagatgacgaagatgattcttctgatactgaaaataatgatgaacttgtgcctgccgattctacgccgaagctggacctgcaaagtgacaagaagaaaggaattcaagtccagcttgacctgaagagcaatgggaatggctctagtgggaagaaggcgcctgccgccagatcaagagcgactgggtccagtgggaaggccgctgcgggaggctcggctgggaagaggaagaggtaactgagacattggccaccgcccacagttggccagcgactagtttggacagatcccttggtaaatagggagcagggcgaggttcagagttttgcttgtacatacgctcatccaatggcacctgtaggcactaggctattttacctgctcccacgttttctctaagggccgtccatgtctcgttaccaaaattttttgcacttaggaagttaggatagttctaggctgacaagcgagaatttgatggggggggtttcatttgggaggaattt

SEQ ID NO: 9615 - DNA, 1096 bp, Sorghum bicolor
  Clone ID: SORBI-28MAY03-CLUS25272_1
gcacgaggcttcggtacatctacaatcatcagaatgaagatggagggtggggattgcacatcgagggccacagcaccatgctcagctcagccttgaactatgttgctttgagattgcttggggagtgcccaaatggcggagatggagccatggagaaaggccgaaactggatactggatcatggaggagccatatttatggcagcatggggaaagttttggctctcagtactcggagtatatgattggtccggaaataacccggtaccaccagaattgtggctactaccacattacctgccgtttcacccaggtcgagtggtttgctattgccgaatggtgtatatgcccatgtcttacatttatggaaggaggttcgttggccccataacaccactagtactggaattaagaaaagagctgtacacagacgcctacgatgagattgactggaacaaagctcgtactgaatgtgctaaggaagatatgtacaaaccacattcattggttctggatatctcaatgaccattctccacaagtttgaacaaattatgttccattggccttggagaaaactgaggaacaaggctctggcatttaccatgaggcacgttcactatgaggatgagagcactcactacatcaaccttggtggtgtacccaaggtattaaatatgcttgctcgctggattgaagatcctaactcagaagcattcaaatgccatattgcacgagtatatgatttcttgtggattgccgaagatggcatgaagatgcagcttcaccaacaactttacgtatggttgaaagagagatatatggatgagagatgtgaaaagctacttcttttcagcttcacatctctccgttcatttgtgggagcacaaaaaaaggagcttgacaccatgagctattttggaaaagggtgtttggcaaaatacatgtcacaataactcatgaagctgttagtgaagttatgacaaataggccctaaatattgattttatgccccacttctttctacattgctcacataccattcaagaaactactatgttaacaaacatactagcatatgcactttagacccctcttc

SEQ ID NO: 9616 - DNA, 1077 bp, Sorghum bicolor
  Clone ID: SORBI-28MAY03-CLUS2528_1
tctggagcacctgcccaaagccttctcatcccctctccacctcccgaccctccgccgtctcacccccacttcctccctccgcgtcgccgccgccaccatgtcgtcctcctccgcagtcgccaccccgatcgagcacttcgtgctcttcaaggcccgcccggaggcggtgacctcgggcgccacggcggcgatggtctcctcgctgcaggcgctcgccacggtcgtcccgggcctggcctacatccacgcggggccggtgctccgcctccggtccccggccgcggaggcgctgggccccacgcacctcctccactcccgctacgccaccaaggaggacctggcgtcctacgcgacgcacccggcgcacgtggccgccgtgcagagccacgtcctccccaacgcgctcgacatcaccgccgtcgactgggtcaacgccgcgccgctcccgtcccccgcgggccccggcagcgccgtgcgcctcacgctggccaaggtgaaggaaggcgtggaggtcgcgcagctcgtggagaaagtggccgccgtgaccaaggccgccggggacgccaagggcgccaaggtgagcttcggggagaacttctcccccgcgcgggccaagggttaccagttcgggatggtggcggtgttcgacagcgtggaggagctggacgccgtggagggggacggcaaggtcgaggaggccaaggccgcggtcaggccgctgctggacgaggtgatggtgctggacttcgtcgttggagatgcttcaacgcctgcgagcctctgattacaggcggaggaggcgagggcgaacagagtgggcgatgctgacggggtcctcgatgcgaaggcagccaaccagaagcggagcaaaacgcagacgcgatacgaggcagtttacaaaccgcggcaacacgtcgattgctgttgtcagtaattcgaagttgcatctagaagcgacacaagtgcataacatgttcacttgtctttcgtaagcggtactttttatatgctagtactagtagtgtttttctttcacaataaggttttgttagttccattttttttaaatagacgtgt

SEQ ID NO: 9617 - DNA, 694 bp, Sorghum bicolor
  Clone ID: SORBI-28MAY03-CLUS25309_1
gaacggcacgagggtcccctcccccctcttctctctcctcgctccccacgccacgccacgcagcgcatcgtctcgtctcgtctcctctgaaggcggcagcgctcgctgcgagcaacgaagggagggagcggggatgaggatgctgtcgaaggcgtgctcgatcgtggcctcctccctcccgcgctgctcctcctccgccgcccccacgatgagggggcagccgtccttgctgccaagcgtgcggaagcaatggcccgggaagccactgctgtatggaatcggcaccctcttggtcatgccactgaggacactgtatggagtgggtcgtgtttttggcgcagggcggttcctctgcaacatgaccagcgtctcttcgtcgctgcaaattgagcttgtaccatgccttcgagacaactatgcatatatcctgcatgatgttgatactggaacagttggagttgtggatccttctgaggctatgcctattatcaatgcattggaaaagaggaaccagaacttgacttatatactgaacacccatcatcactatgatcatactggtggaaacttggaattgaaggcaaaatatggtgcaaaggtattgcgttcggcgaccgtgtttgttctatcttttcctatattgttcagtgactctgatacatacaatatgtgaaagtgacaatcaaaatgtgta

SEQ ID NO: 9618 - DNA, 803 bp, Sorghum bicolor
  Clone ID: SORBI-28MAY03-CLUS25366_1
gccggagagagatccaagagcaagccattgctttagatggcttcagtgaagaagcctggattgagagagagcttgagactgggattgttacaaaacaagaagccaattgtgctgccatctcagatgaactaagtgatgaagcctggattgagagagagctcgagtcagggattgtggtaggaccaagcaatgagcaggcaatcacttttgatggtttgagtgaaaatgattggattgagagggagcttgagtctgggatcatcgttgagccagcacctgctatcaagaagcggaggctggagtcgaggtgttagctcttaagcccctgcattcagaggccagattccaagcaggttgaataatggcagatatagtaccttgcgactaggacacattgaagccaaagatagatgtcgcaccgatgagaccatcaaatattttccttttttatttctttaaccaaaacacctcggaatagttcgacacaaggggtgtgtgcacagtggaaccttaccagtttcttgaatgcagaatcgtatccattgtatttgttccttgttgtgagtgtatatctagcatgcctgaaattcggctttagattgtaggtgtaactgtagcagggtttttctggtgttaagcccgacgagaaaacgattcagtgtaactgttactgataaccaaagaaaagtagtagttattttcggtgtaaatttattgttaacaaaagaaaaggtagttagtgctgtatatgatatgatgtttataaattgatgatgaatgttccgttgaacggcatcgtaaaa

SEQ ID NO: 9619 - DNA, 682 bp, Sorghum bicolor
  Clone ID: SORBI-28MAY03-CLUS25386_1
tcacatatgggaagtggacagaggtggctactaaccaagatcaagaattaattgttagatcattgttggctgcaagggatgcttcccttgagataaggcttcacatgcgagagatgggtatagcagccggtgttccaattgagccagattcacaaacacagctactagatgccactatgaatatggagggtgttttactggctggagttcctggagctggtggtttcgatgcagtattctcagtgactttgggggatgcaaataatgctgtagcaaatgcttggagctcagctggcgttctgccacttcttgtacgagaagactgccgtggtgtttcattggaagatgctgacccaagaacaagggaggtctcagcagctgtatcgtccattcagattaattgattctactgttaatagttctatttatgtatgtatggtgtaccattatttattatctcgttcttttagaagtaccaaattgtgccgaatgctaggaggtacgtggttaaaataagtgctgcacttgcagcaggatagcacgttatttacaacgactgttcatgagtgtagaaaataaggaattctagggatttccatggaattagtgcttgtagctatggaatatacgtgaggaaatgtcaagctattcaatcaacaaactcatactgtaaaccttgtat

SEQ ID NO: 9620 - DNA, 615 bp, Sorghum bicolor
  Clone ID: SORBI-28MAY03-CLUS26434_1
acaactgggaaaccattcttatttatcaaacgataacaaatcatcatccaaacagggccgtgcagcctgctctgctccaccagtggtttgtgtggaggaaacgagaagcttttccggctttgcttgccgaaagctgttggactcgcaattaactactgcaaattgtctacttgaaaacgacatgtgcccaacttatccttccattccctaggaagagaaatcctccacagcacacagccgctaaacgcactagacaagtaacctcgccgacgaaggatctcatcttatacaagctgttcgagacatgtatcgggtacttttgcagctaaaatttacagatgatcgagattaaaacatcaggaacaaaaaaaaaaaacaacaacaactcagtttgtgcaaccgaagcaagatcgaagttgactggctgactagcagtaggctccctcttattgtcttcacacaggggagctgctctgctcgccagttcgatcgaggccacgcatcgacgacgacgacgacgacgacgacgacgtgtagatgctacaaacatggtcgcgctcgcgctcacgctcacacaaacttactagtagcagagcaggcgcgcgcgaacggaac

SEQ ID NO: 9621 - DNA, 862 bp, Sorghum bicolor
  Clone ID: SORBI-28MAY03-CLUS26519_1
cccctgttttctatccttgcccgtccgctgagcggtccccccgccctcccagcccaccccagacaccgcgccaccttcgctctccgtcaccccgctgcagtgcgcccctctaagcttcttgaaggacagcgctgtcagaagcgaatcagtccctgcctggtgccagattccaacccttgcgccctccagcagctcagccagcctcttccgccctccatggaggctattccggaacctcatccagtgctgccagcagtcgcgagtggcaaacgacaagcaaacatcactgtcggcaccaaacaataatgcacgcctccctacacggacaccaacaggcaacagcgatggatgggcaaggacaataatggtggcaggaacgacagcgacgacatcaagcggctcccggagtgtcctcgccggaggcccagacgacgtccttgagcgccggccggagctcctcgctacagaacgactggtactccatcgtgtcgccaccgtccttcttcacgtccaccaggagcaccgccggccgcgcccccctgaagtgctccgccgcccccgccggccgcccgccccccccgcccccccgcggcccgccctgctcggcgccgcggccgggcccgacctgcgtctcctgccgcgtgtccacgctccccgcggccgcgcccgtcgcgaacccggccccccccgcgctgctcctccctacgccgcggccatggtcgaagagcggggacaggtcgaagccctccgagagagagatgaggtggaacgcgttcagcacctcgggctcttccttgtcgtcggcgctggcacggcgagcgtccggggttgccccggccccgggtgcgggctccttgacgtt

SEQ ID NO: 9622 - DNA, 824 bp, Sorghum bicolor
  Clone ID: SORBI-28MAY03-CLUS26465_1
taattttttttttttttgtgttggggggagtacactttatatcttcgaagtaacggggaagacagtgcaaactccttccttgcaacaatggcctactcctacaattttagcacattaccctattccattccaaatgacctagctaaagcccatgggaaaggtaggtacgtagtattatgccacaacactagcactgaggcttatagctccatgcacagcaaagatgtaatttgggtaccagaattctcagtaccagagatgctggtacaaattgctcattgaggtgacatccgaacttcagtatcggttctttttggcttcaccttactcttgtacgcgagactcaaatccacaagtgccaaggtgtttagcaagcttctctccatactgcttctgccagccttgtgtccccttggcctcatctgttgtccatacaactgcacttgcttccttataatcaacggtagcagaagtaacctccggttggctctccaggatccgcttcacgctcgcggcgcacccgtcgcacatcatcccctggacactgagcaggatggactcggatccggcgtccgccgtatccccggaagccgcggccgcggagaccaagggaccaacgccggcataatcgcggctccggcgcgagagcaagacgaagccgccgctgccggagcagaaggggacggaggcgagaaggcgagccaccctagtgaaggaggcaggggagaggggtttggaacgggagccagaggtcggaagtggtaacctcgcggtcattagcgcggtagactccattgctgggtcggatgatccctcccgcgtgc

SEQ ID NO: 9623 - DNA, 666 bp, Sorghum bicolor
  Clone ID: SORBI-28MAY03-CLUS26605_1
cccagggaagaactcctctgaatacggatgctgatgctcaaccagttcgagtttgtgacagatgcatggctgaagtaacgcaaagacttaacaatgcaagggaagtgacaaatcgacctattgttcagagccatgaggatcttgccaaaaagcttcaggaagccatggatataaataaaaggtcatcttcagggacgaggtcttcggatgcttctggcaagcgaatgcgggaggtcgcgtgcccaatctgcacagtccatcttcaggttgaagttccaacttctggttcggagacaatagagtgcggcgtatgtcagcaccctttccttgtcagcgcccgttgaattgagttcagcttcagccgccatgcaatggtggagtcttctcagactgacaagcgagaagtcagtcctgttcaatggagcttgatgctgaatccggctatccctgtctgtaccctaactctgcacggagtctgtcgctgcactctgtatatggttgagtttgagtcgtttgcgaattattagtacagttgtaagttgtttttttttatttcagttgtaagttgttttgagaagcaagcaggggtcatcacatgtactactgccaccatcaactttgctactgttacatgagaaaaagttgtgtagcccccttttttttagg

SEQ ID NO: 9624 - DNA, 822 bp, Sorghum bicolor
  Clone ID: SORBI-28MAY03-CLUS26640_1
ccccaaggcgtacggcttcgagaccgccaccgaggcgtgctgcggccagggaaggttcaatggcatggggctgtgcaccatggtgtccagcctctgcgccgaccgcgacagctacgtgttctgggacgccttccaccccacggagcgcgccaaccgcctcatcgtgcagcagttcatgtcgggctctgtggaatacatcgcgccaatgaacctcagcaccgtcctcgccatcgacgaagaactcgagaggcagcagcaaagcacattgccgtgatgtcatgcatgtcatccgccggcctgatgatggatgcaggcctccggccatctgcagcagctaattcagcttcatcgccatttgttgcatatatgcatgcaattcgatcgcgttcgttccgtggatatcatctcgagtttttgagggtgtgtgtgtgtgtagagagagtactccctagctagtcctggctgctagtagtagtagtagctagtgcaagccatcatcagtttcttcgatcggtttcagtcgtcgtcaagtgcagagaatccagatgtggttttctgcatgcagggtttcaaatttatgtcggtgtggttgcatgtaccgtgtaagtgtgtgacagtgacgaccatatcttgtcaattgtcatataggacagcttcttataatttatataaatttttcaggggattcataattttttgcttctttttaataaatgaattttcagctgctagctagctaccaaaagtggtgtcattttcgttcctagcttgattcgcaaaagtgaccctgaattcctgcctggatgggcgggcgtcctgccg

SEQ ID NO: 9625 - DNA, 333 bp, Sorghum bicolor
  Clone ID: SORBI-28MAY03-CLUS25684_1
gcacgaggggagaaactccccctcgcgtcccctctgccccccatcgcgtcccctctcgctcgctacctcgccgcgcggcggaaacgccacgccaggggtgagatccgcgccgtcctccgccgtcctcgtcaccgccccgtcgcctccgatctccacagggcgtgcggaggaggaggaggagggggcagagggagatggcggcggaggagggggcgatgtcgccgacgaggatgcttgcggaggggcacctgcgggtggccaccggcgggggcgcgccggcggacggcgagatcgccgtcagacacctcccgcaccatcaccccactaagaaag

SEQ ID NO: 9626 - DNA, 1038 bp, Sorghum bicolor
  Clone ID: SORBI-28MAY03-CLUS25717_1
aaaaagaagaaaactccagccgccgagctcagccgccgcgaccgggaccggggaagatggccgacggcagcgcctccgcgtcgccgccctccgtttctccgcaccaccagtaccaccgcgacgccatcaagtcctcagtgcgcaatacagctgctaaccggaggagggagcaggctcttgcaatagggaaggaaagaagggaagctttgatgcgtgcaaagcgtgtgtgtcgagctcctctttctggcagtgatgaggctgcagcagaagatggtgacatggttactgatgaggggaaagcagatcttgaggctagaacgactcaggctgttgaggaactgaaatctgctttgtcaagccagggaaaaggggcacagaagaggaagacagaggtgcttcgtgctttaaggcgtttgttgtctcaatctgaagtacctccagttgatgctgcaattaaagctggagcagtccctctgttagtgcagtatctgtcatttggatcatcagatgaacaattgctagaggcagcttggtgccttacaaacatagcggcaggggaacctgaagaaactaaatccttacttcctgctctaccattgctcattgctcaccttggtgagaagagctccacacttgtcgcggaacaatgtgcatgggccattggtaatgttgctggtgaaggagcagaactgagaagtacattacttgctcaaggtgctttgtggcctcttgcccgtttaatgctgtcaaataagggttctacagcaagaactgctgcttgggcattgtcaaatctcataaaggggcctgattccaaggctgcgaatgagcttattggcattgacggcgtactgaatgcaatcacacggaacttggaaaaagcggatgaagaacttgctactgaggtggcatgggtagtggtctatctttcagcactttcagaaaaagctaccagccaaatagtaagaagtgctgtgccactgttgctgatcgggcgccttctagcatctgaaaacttgcagctcctcattccggtac

SEQ ID NO: 9627 - DNA, 580 bp, Sorghum bicolor
  Clone ID: SORBI-28MAY03-CLUS25752_1
tatacgggctgcttccatccgattcattccactccaccggtccaccctcccttccccacacgaaaccaccacccccactcttccatgtcagccgccgtccgctcccgcgccgcggcggccgcgctctccgccgcgcgccgcatccacgcaggcctcgccgcggagcagaagcagcagggcggcaacagccctggcgcccttcgccgaccttggaccctcttccggcgccagcagcagcagcaacagcaggagcagagccacgttcctcgcgccgccgctcctgtcctggacgccgttgccgaccatagggccggcggctcggacggtggggagcccccagagatctggcgccagcccggagaagcccctgtcgcttccgcgggtgcggacgccatcgggaggatcgacgtggttagggttgcggcccccggcggggaaggctttgatgggaaggacggggccgaggaaagcgggggttggggcggctctaacctgggacgacggtttcccacgcccaaggagatttgccgtgggctcgacaaatttgtcatcggccagcagcgagccaagaaggtgttgt

SEQ ID NO: 9628 - DNA, 884 bp, Sorghum bicolor
  Clone ID: SORBI-28MAY03-CLUS25865_1
gcacgaggggcactccaagaatgaggacaccggctcctacctctccatggggcggccgaggcggtacaagtacacgcagaagtggcacgagcagctgcagcgcgctcccgttgggtccagcctcgagtcctgcttctgggcggtggtcgaggagctccaggccgagatggccgacggcagggcgttcgaggacctgagagaccgggtggttaaacttgagaacgatgcacatggcgggttcgcctccccgccctccggctccgccgccgtccgggggggcgccgccggcggccccgcgccgtgcgggctccccgaggtggacccggccctgttcccgtcactccgcgctgtcgggagcggcatccccgcgcgaaccaacgccgccttcctcggggccttccgccggctgctcgacggatcgacgctccagtccgaggtaacaagagctgtggcagaggagaaacgtgtagtattcacaggccattcatcaggaggctcaatagccacccttgctgctatatggtttcttgagaagtgcaccagacgaggaagtgttaatcaagcacacccattttgtgtgacctttggggctcctcttgttggagacaatatcttcaaccatgctgttaaaagagagggctggtcacagtgtattttgcatttccttcttccactagacattgtcccacgcataccactgactccacttgcgtccttcagagaagaaattcaagctgttctggattggtgtatctcctcagacgccaaacaactcccctgctgggaggtcccttgtcatacctgaatattatgaaactttattgtatggcttatgagctctttgtataaatacgctgctctgtattacttcccacaataagatt

SEQ ID NO: 9629 - DNA, 521 bp, Sorghum bicolor
  Clone ID: SORBI-28MAY03-CLUS26980_1
agctaagcacgtgcaaacaagcgagttacttacaaccaaccaaaggagtagaaaccacctgaagccatgtgcattgctgcatggatttggcaggctcaccctgtgcaccaactcctcctgcttctcaacagagatgagttccacagcaggcctacaaaagcagtaggatggtggggagaaggctcaaagaagattcttggtggcagggatgtgcttggtggaggaacatggatggggtgcaccaaggatggaaggcttgccttcctgaccaatgtgcttgaaccagatgccatgcccggtgcacggactaggggagatctgcctctcaggttcctgcagagcaacaagagcccactcgaagttgcaactgaagtggcagaagaagctcatgaatacaatggcttcaacctcatactagctgatctaacaacaaatatcatggtctatgtgtcaaaccggcctaaggggcagcctgcaacaattcaactcgtctcaccaggactccatgtgctgtccaatgc

SEQ ID NO: 9630 - DNA, 921 bp, Sorghum bicolor
  Clone ID: SORBI-28MAY03-CLUS27029_1
gccgttctttttgttcatagagcgcacgagggttctctgcttcctcaccctctactaccgccacttgcaatcgaagaaaacgagtcctttggagccgaccgaatggccaatagtcgggcatctccccggcttggtcgccaacatccatcacttccacgactgggccaccggcgtcctcaccggcgcgggctgcaacttcgaagcacgcggaggccgcaccggcctgcgctacttcatcacctgcgacccctccaacgtgcgccacatcttcacgtccaacttcgccaactaccctaaaggcgaagagtacgccgtgatcttcgacgtccttggcggcggcatcttcaacgccgacggggagtcgtggcggcggcagcgggtgatggcccagatgctcatgaccggccctcggttccgagccttcacggcgcggtgcagtcgcgacaaggtggagcggagcctcctgcctttcctcgcccaccacgccgccgacgagggaagcagcaggccgccgtgcgacctgcacgacgtgttcctgaggctgacgttcgacatgacatgcagtctcgtcttcggcgtcgaccctgggtgcctggcggtcggcttgcccgtcgtccccttcgcgcgcgcgatggacgacgcgctggagacgcttttcctccggcacatcacccccgtggcgtactggaagctgatgaacgtgctggaggtagggcaggagaagaagatggccgcggctcggaggacgatcgacagcttcgtcgccgccaccgtcgcaaaacgcagggccgacaagctcaaagaatgcgaaggcgtcagcaattcgtttgacctgctgtcatccttcatctgtcacgaggactcgagtagtggtgcaaatgacgatgtgttcttacgtgacacgacggtgaacctcctgct

SEQ ID NO: 9631 - DNA, 2149 bp, Sorghum bicolor
  Clone ID: SORBI-28MAY03-CLUS27_1
ctccctccctctcgcgctctctcggcttcctcgcttgcctgtctccctccctccggactccttgctcgctggttcgctccgggtctccgtccgtctccctcacctgtcaccacacccacttccaccttcccgtcgttcctgtcctcggtccgctccaacggctcctcgttgcgtggtcacaagggaagccgcccatccagaggtcgggagagcttaaccccggtgaagactggaatctgagccacccgcgctccgatctgtcttccgaaggacgcggagggaggaaggctccggatcgaggatttgcgtctccttccggtccggcacgccttgatgtataaatcggcctttgcttctttgtaggcacactcaaaagcagcgtttcccctgtagggtggcgtgatctccactgttctataagtggagcagccacgaaggctgtcggaacctccttcgctgttatatattggcaggctagagccccaagtttcctgaaggctttgctgccctgttctagttggcgaagatgtcgttccgcagcatcgttcgtgacgttcgggacagttttggtagcctgtcaaggcgcagctttgaggtgactatcgctggcctttctggactcaccgtgcatcatagggggaaatctcagagcacggtgcatgaggtctgtgatacggatctcataatccaggagagccgttgggctaatctccctcctgagctcctccgcgatgtgatccggaggctggaggccagtgagagcacctggccaaatcgcaagcatgttgtgtcctgcgctgctgtttgtcgagcatggagggagatgtgccgggagattgtgctgagcccggagttttgtgggaagcttacattcccagtttctctaaagcagcccgggcctcgagatggaatgattcaatgtttcataaagcgagataaatcaaagtccacatatcatctctacttgtgcctcagcactgctgtacttatggagaatggcaagttcctcttatcagctaaaaggaaccgcaaaacaacctgcacggagtatgttatctcaatggatgctgagaacatatcgagatctagcagcacatatattggaaagctaaggtcaaacttcctcggcaccaaatttatgatctctgacacgcagcccccttataatggggctgtagtccctcatgctggccggacaagccgaagattcaactccaagaaggtctcccctaaggtgccaactggtagctacaacatagctcaggtgacatatgagctaaatgttcttggcacgagaggccctaggcggatgcactgcgtcatgcactctatacccgcctccgcagttgagcctggtggcatagtccctggacagcctgagcagattctgccccgggcattagaggagtccttccgcagcaccacctccttctccaagtcatccatcatggaccggtccatggatttcagcagctcccgtgacttcagcagcgcccgcttttctgacattgccggaggcgccgccatagctggcgatgaagagggacagaacaaggagaggccgcttgtgctccgcaacaaggccccaagatggcacgagcagctgcagtgctggtgcctcaacttccgtggccgtgtaaccattgcctcggtgaagaatttccagctgatcgctgcgccaagcccggcccctgcccctgctgccagggctccaaccccatcgtcacaacctgttccgcaggaccaagataagatcattctccagtttggtaaggtggccaaggatatgttcactatggactaccgctacccgctctcagccttccaggctttcgccatctgtttgagtagcttcgacactaaactggcctgtgagtaaatatagaccccgtggaagcaatggaacagcccggagctggcaatgcacaaggggagagatgcatttagccctaggattttagtttgatgcttttgcaatttgttgttttctctctgatggttgtattctgcttcctgttaacctggaaccggacctctaggctctaagcatgtatgttttcacctgctgcaccatggtaggtgccatttcgtgtaatgtgcatgagattcagcccttaacgtgaatgaattgttacggtgttgatttctc

SEQ ID NO: 9632 - DNA, 912 bp, Sorghum bicolor
  Clone ID: SORBI-28MAY03-CLUS27040_1
gcacgagggccgcctctctccggcgcgccgcacctgccccccctcccggtctctctctcctccgcgccacacgcatctcctgctgattgaatcaacttggcctcgcgactccggctgatccgtggcgcctcgctgccgagcggaaccatcacctgatttggcgagactagcagataaaatcatggctcaggatgaagctgtggctacccagaagactggaaatacagcatccccttctaaggattatccaactccttctccatatcctgattggtcgaccatgcaggcatattatggccctggtgtcttgccaccaacatattttgctccagcaatagctccaggccatccaccgccatacatgtggggtcctcagcctataatgccacccccttttgggacaccatatgctgcagtatacccacatggtggagcttacccacacccccttgtgcccatgatgtcaactccattgagcatggagcccgccaaatctgcaaacagcaaggagaaaaattccaataagaaacttaaggaaatagatcggactgcagtgtctgctggcagtggtaacagtaaaagaacaatgtcatccagtgaagattacagtgcagagggctccagcgatgtaaacgaccagaaggtgaacaaaacgtccaggaagcagaactcagatgatggacctggtgcagaaaccaccacaggtgcaaacacggaatgtgttttagctcctaaccatacgatggggaatggtgctattttgccacatcactggtttccagctccagtaattaagcccagcgctacaaatgtcgccaactcgagggtgataggcacagcgatatctccatcacctagtgtgatggtcccagctcatactgcattaccagctgacttatcagtcaaggatga

SEQ ID NO: 9633 - DNA, 705 bp, Sorghum bicolor
  Clone ID: SORBI-28MAY03-CLUS27138_1
ctcctcccctcctcctgtctctctctcgctaccctcgccccacgaggagactgttgggccaccgccgcgctaggccaggtgctgaggctttccttggtttcttcgccggcgacgagcacccaccaggtgtacacccatgtccctttactggatccgcccctgtaggtgctgatatactgaaatcaacatatgatggtgcgcaagagattggtttatagatcccgtggccgtcgaattccaactatgccacgtgttccaaactcagctcggggaaaacgctctaccagaagaaacaaagatgagaatgatatgtgtgcatttgatttgctcgcaactgtagcaggaaacttattagcagatcaggacaattcatcgaatgttcctaataccaatgcagcaaaagctaaaaaaaggaaatcatttaaggaagaacacttcgacgaaattctgcctctaaaagatgtggctatggagaaagatgtgggttctgggagtgtcagtgcctttcctaggcaagctaacaactgcttggcagaaaactcgtcgacaagaaatgaagctgaatcaatattagagtcactaacaatgaaatcagatatgttagcaaaaattcctgagtgtggatctcatggaatacaccatccaggaccctccagttcagtagagcctgaacaagtgcagaaagctgaacctaaagtgatcaga

SEQ ID NO: 9634 - DNA, 751 bp, Sorghum bicolor
  Clone ID: SORBI-28MAY03-CLUS27177_1
gcacgaggaacgcatggagattatcgaactaccaactcataggtttttcgttggtgtacaatttcaccctgaattcaagtcaaggcctggcaacccatctccgcttttcttaggattggtagcagcatcatcaggtcagcttgatcaacgtggcgttatcagtaagacaagcagatgcatcagcaataccggaggagcatcaaagctaaaagcttgccagaatgggcacctcatgaagccactgaagggcctggtgaacgggcactattcaacaaccagcaatggcgccattcccatctagcagcacagagctgcgaggcactgcatgcttgtttgagatttctcttctaccgttttcgcttgttcttttcctttacttggagcgtgttcttccattctaccaagcaaactaagaagaagagaagggccgtttgctctagcgacacagcagccgtttccgatgttttaacgtggaagcatttggcatgcaagctgtcgcatgcattaagaggcaaatttagcaggttagctagagtttgattagtagtagtaatccgatatgctggtttatttgttcgtttgtttgctaagattacaaaggctggtgatgtgcagctagctgtagtgtagcctgccgtctcgcctcatttgtacattgtaaaataactgctactctccattgactgactgaatggatgagtataaacgtatcggaccaacatgctcagcgtgggtttagtttatcaccggt

SEQ ID NO: 9635 - DNA, 718 bp, Sorghum bicolor
  Clone ID: SORBI-28MAY03-CLUS26067_1
cgcggctgatgggggcgaggggcccgtggcgaagggaggaggaggaccggtcccgtggtggaagctgtcgctggacgcgctgcgggtgtgggcgctacgcgcggcgaggagcgcctggtcggtgccgttcgccgtcgcgctgcgcgcgtgcgccgtgctcgggcgacggctgtaccggatgcgccgccagagcaaggccgtcgcgcgcgtccgcctcgtcctcgacgaaaagaaggtctcccaattcaagggccaatcatcacgtctgaatgaatccatgacgatggtgcggcgaactcctatcataaaacctatgcttcctgccaatggagtgactccatggcctgtgctggggcacctgtgagatgtgtgatcagtgacgtgatagaggcatagagctaataatacaactgcgccagccatgcagagacgcttacaggccggcatattatgcaatgcccagcagcagatgtactggctgcttgtaatttggaactatacacttgtggaagaccttgtaagtttccgttcacgcggaatgatatttaggcctgatctagtttgtgtttcttttgtgtatacccatgtttataattttattttctgaatccttatgtcatggatcttatgtgctggagatgtaaatgattgagtactgagtacccatggtactatggtaatgtgctgtatatgactattacccataaatcaatgtaca

SEQ ID NO: 9636 - DNA, 623 bp, Sorghum bicolor
  Clone ID: SORBI-28MAY03-CLUS26177_1
agctcgtgcgccacgcacacacggacacgaatcctcccccacctcggatgcagtgcctaccctgcggaccgtccaccaacgcgcccgctgcgcatgccgcgggcaggagcgtcagccgccggagggttgtcgtcgacggcgtcgcctcggcaacccacgacagtgacgaagcgccttcaaggtcaatgagggcaacatgtgatcttggtgcaatgtcaagcaaagccttattgcttgtgtcaaagaggaagcttattgctttgtcagccttctgtcttagcttgcattcttcaaggtactttccagcacttgccttgggtgatacgtccgtcaaaatcgaggatgtgactcccaagatttttccatctgggccattatttccaactgagaaacggatcgcagagctattcgaaacaaatacttactcagtcgtcaacatatttgatgcaacactacggccacagcttaatgttactggtgttgtggagatccctgaaggaaatggttctggtgtagtgtgggatgattctggacatattgttacaaattatcatgttgttggcagtgctctctcaaaaaatccgaagcctggtgatgttgttgcacgtgtcaacattcttgct

SEQ ID NO: 9637 - DNA, 740 bp, Sorghum bicolor
  unsure (1)..(740): unsure at all n locations
  Clone ID: SORBI-28MAY03-CLUS26376_1
nagcgccatatagttgcctactctgtgcggcgtgtgacagacttcaatgaaataccccatcactttctgcactgcattcaggtgcatctggatcacaccaggccaaaggcccaaataaatgccagtacggcaacccttggtcatactaaccaagttcggccctttaataatcaggctgcaacgttttctgcatcaggaaatgctgctggaaacaacgtgtctgacttggtcatgagtgtttttaatgacccagcagccatagaccgggagcatggactgcacatcaaagatgtcgcaaatcgtcttaaactatcagaagatgtagtcagggcggtcatccaacatcatgttgaccagggcgacatttacaacacgattgatgacaaccatttcaagtctgccgcgaatggatgatcatgttgcaagtccagccttcaggctctgtgtaggtatggagccgtttcaagcaagaaatgtaaaccctctgcaggatcgcctctatcttccatatggtcatcagggtgtcaacagcttaacttctaggtttcggtgtgtatctaagtactgctctcttatgcagttatatgtaatggacatatgatgtgattggactaggtctacctgctggacatcagttgtgtttgctactcaagtaacgtacaagtaacaccgtgtgcaggatggatctagcaaaatcagtttcaaagttccccggcgctagatctgccttttgtgatttc

SEQ ID NO: 9638 - DNA, 1074 bp, Sorghum bicolor
  Clone ID: SORBI-28MAY03-CLUS2641_1
cgtccggaaatatacggctgaagatccaacaaagtccagactatgctgatcagccagattatgaagctggactggaggacttcaaggaacgtgtgatcaattatgaaaaggtctacgagccagtaggggaaggttcttacatcaaaatgattgacatggtaaaggggcaagatggtcagttacaggtaaataatatcagcggttatctccctgggaggattgtcttcttcttggtgaactctcatcttacaccacgacctattttgcttaccaggcatggtgagagtttacataatgttagaggaagagtcggtggtgatacagttctaagtgaaactggagaactttatgcaaagaaactagccaactttatagaaaagcggctcaaatatgagaaaacagcaactatatggaccagtacccttcagagaacaattttgacagcaagtccaattgttggatttcctaagatacaatggcgtgctcttgatgagatcaattctggagtttgtgatgggatgacttatgaagagataaagaaaaatatgcccgaggaatttgagtcacgcaagaaggacaagctaagatatcgctacccccgtggagaatcttaccttgacgttatacagaggttggaacccgtcatcattgagctagaacgccagcgtgcaccagtggttgtcatatctcaccaggctgtactgcgagcactgtatgcatatttcgcggacaggcctttgagagaagttccagatatagagatgccactacacaccataatcgagatacaaatgggcgttctcggtgttgaagagaagaggtacaaactcatggactgaatgaatgaatacataaaagcagcaggtcgttggctgtttcatatcatacagaaagtacagataacacagaagcttttttttatctctccacacggtgtgaaacctacttcagtgtatttttttctctgaaaaaaaacatattgatcattgtaaagaaaaaaacatgtactactaataatgaactgtaaaaatggcagcttatactgcaaggaataaggaatacagactgtggctc

SEQ ID NO: 9639 - DNA, 589 bp, Sorghum bicolor
  unsure (1)..(589): unsure at all n locations
  Clone ID: SORBI-28MAY03-CLUS26416_1
taaagctgatggctctccaaactctcattcaaggttaggcaacccaaatccagtaccagatctccacgcacataatcaaggtaggagtacatttgttcgctttccaactacctaatgatatcatgactctgaccgagccaagccgaataagacctttctagtaagtaaaaaggcaacgcagctttacacaactcttaaaactggaattctgggcacccgagcttaacccacgagacaagcattcagggaccaacgtaaggtattcacagcttgcgtagataggacaggatgggagcagagcgcctagtcggctgccctgaagagggtcatcagggacaggaagaggttgatgacgtccaggtagagggagacggcggcccagacgtactggtcgtacgtgaagcgcctgatgatgttgttcgtgtcgtagacgatgtacccactgaagatgagtgatgccagcccaccgtagatcatctgggagagcttgcccagtgggaacagtatntggatgagtgcgaacacaagcagcactatgagggaggcgaacaggaaaggacccaggaagctgaagtctttgcccctattc

SEQ ID NO: 9640 - DNA, 1288 bp, Sorghum bicolor
  Clone ID: SORBI-28MAY03-CLUS27629_1
gcacgagggcagctcgctcgctgtggttcactctgaccctgccatcctccctgctcccgcgcagcagattcctcctgctacgcaagatgtcaaggctcttgctgatcagcatgttccagcgattccagaggttaagcaagcagattcggagacgacgccggcgcgggagtggaagccgctgtgcgacctcacctcgaaccgccgcatcgactggtgcgagctcgacggcgacgtgcgcgtgctgggcgccaacgccagcgtcacgctggtggcgccgccgggcgcggacgaccgcaccttccgcgcggagtcgtggcgcatcaagccgtacccacgcaaggcggacccgaacgcgatgcacgtcgtccgcgtggtgaccgtgcagtcggtgtccggcggcggggcgccggcgtgcacggacaggtacgacgtgccggcgctggtgttctcggaccgcgggtacacgggcaactacttccggggaccttccagggacatggggctgcgctacctcgagtaccggatcacgccggaggagagcacgctgatcgaccagtacccgcgcgaccaccccatcttcacggaccccaacgggatcaagagcaagggatgggagtctctcaaggacgcatacctcgacaagcaggacgtgcggctggacatgaagaggttccggccgacgctcaagaaggccatcgcgcacctcaggaaggccaaggccaaggcgaccaacggcggcggcaactaagagtcggcgtcgccgtgcgtgcatgtgttcattcatcctcctcttactctactcttctgtttttttttcttccttcctttttcgggttatgtcggtgtatgtagcaagcagaaatcgaccaaatgtatgatatggcagggaaagaagctagagcaaatcatatattctctctctctctctctctctctctctctctctctctctctctctctctctcgctcgctctcgccctctctcccgctctctttttttttcgtttttttggatgggatggattatgccaagtgaccaggagtgagggacaatgttggagcggggagtatgatcatgaagcatgacagcaagcagcgtacaaggtttagatgtttgttgggttttttttatgtagcatttgttccttgtgtttcttggggctttgggtggtaataagcttgtttaggcgattattagttagtacaaatgatgtacacttcaatacatacacggctacatatatgagcagtaaaaaggatggtcatttttctcatcttccataggacc

SEQ ID NO: 9641 - DNA, 1329 bp, Sorghum bicolor
  Clone ID: SORBI-28MAY03-CLUS27812_1
gcacgaggcctcgcccttcatcgtctggatctatccgccaatgctgcgccgcaaccctacccgcatcgagctctgctccgacgaccgcgacgagctcgaagagcaccgccgcgccgccgcggggagcaccccagccgccaccatcaaggatccgcccggctacaccactccgtccccggtccttggcccgcagacctccaaccccctactccgcctcctccgccccccccccgacggcgcgccgtccaaggcgcaacgcatcggcatcggcatcggcctctccaccccgccagccccgggccctgcccctcgaccacacaatcctccccatggaggttgagatcaagctccgcctccccgacgccgccgcgcaccgccgcctgtccgcgttcctcgcgccccgcctccgccgcacccacgcccagcggaacctcttcttcgacgccgccgcgcgcacgctcgccgccgccaccgccgcgctccgcgtccgcctctacgacgggcccgacgaccgcaaccccttgcgcgccgtcctcgcgctcaagcgccgcccgcggatcgacgccggcgtcagccgcgtcgaggagatcgaggagacgctcgaccccgcgctcgccctcgcctgcgccgacgaccccgcccgcctcggcggcctcgactcccccatcatccgcctcgtcgccgccgagtacggcgtcggaggggacgacgcgcccttcatctgcctcggcggcttcaggaacacgcgcgccgtctacgactacgagctcgaggacggcggcggcggcctagtgctggagctcgacgagacgaggttcgacttcggcaccagctacgagctcgagtgcgagacggcggagcctgaccgggtcaaggaggtgctggagcgcctgctcacggtggccggcgtgccctacgagtactcccagagtaacaagttcgcctgcttcatggcagggaagctgcttccttgactaggcatacctagtccgtgcttgggagtaccatggagcggaatgaaaaaggtgtttgctatggtggtaaggttgcttgagaagttggttgccgatgtacaaactggagattgtggtttgtctggtggagaacgaagcaagcttagcaccgcggatcaagtggaatgtggattcatcaggattggatcaatcaattgctcagcctttggtggttcaagagatgcttcaattttgcaatgtaatagggattagatcgttagttgtggcgtttctggtttggtggccttgtttggcttgccttgcgttctttgaaccggtgtcctggcgtttggaaacgtttctgagctgttgaagc

SEQ ID NO: 9642 - DNA, 781 bp, Sorghum bicolor
  Clone ID: SORBI-28MAY03-CLUS27852_1
cgccctcaagtacatccccgacaggatcgccggcgcggcaatgatggcgccggtggtgaactactggtggccagggttccctccggagctggcggcggaggtgtacgcgaagcaggaggtgggggaccagtgggcgctgcgggtgtcgcaccacgcgccggggatcctccactggtggatggaccagagctggctgcccacgtcgacggtggtggccggcacgacgccgctgccgaacgcgcgcgacgccgagatccggcgcaacatgcaggcggacggcacgttccagcagaagcgggagcaggcgacgcagcaggggatccacgagtcctactaccgcgacatgaccgtcatgttcggcaagtgggagttcgaccccatggcgttgccggagccgccgtgccccgtgcacctgtggcagggagacgaggacggcctcgtccccgtcgtcctgcagaggtacctcgccggcaagctcgcctgggtcaactaccacgagctccccggcaccggacacttcctgtcggcggtgcctgggctcggagacaccgtcctcaggacccttttcggtcagaagcagtagcaacaaacagttcattacgacgacgtatggacggtgctaagcttaaagtatactagtagtgtcagtcgtggcgcattagttcatttgttattgtaaggccgatggttgtcgctgattagcgatgataatggtgatgtagatgcaggatctttaaagtcaaatactatcagatatatacaaatactagtcatacgggaa

SEQ ID NO: 9643 - DNA, 673 bp, Sorghum bicolor
  Clone ID: SORBI-28MAY03-CLUS27890_1
ttggtgggcggcgcgcgcggcgaccggctccgccacggggagcgcgagtactccatcgacgagacgccggcgttccggttccgcaccccgtccgcgcgcgtgctccgcctcatcccctgcatcgcgccggccgtgccggacaccccgggcctctacggcgacgacgaccaccgctacttcttcgccgccgccgccgcacgggagatggatgacgaggagggcgcacgaggtgggtactgctgctacggcggcgacgacccacggagcgcgcgcgacgtcgtcgaggaggaggaggaggagctgatgagccgctgcggcgatgacgagcagctgctggagcgcgtggtggcggaggcctgccgcgcgagcacgggcgcggccgggtcggtggtgccaggggacggcgccggcgaggacgccggggtggacgtcaaggcggaggagttcatcgccaggttctacgcgcagatgaagctgcagcgccagatctcgtggctgcagtacagcgagatgatggagaggagcatcagctagatttcattcattccttcgttcatccttgattacgactagtagtagcagttcaccttgaggagctctggttcgtcgatagatatatacgcatacatgtacattttggctctatatacaatttcgtttgttgctatccaat

SEQ ID NO: 9644 - DNA, 777 bp, Sorghum bicolor
  Clone ID: SORBI-28MAY03-CLUS2792_1
cgtccgggagaagatgctgaatgtgctgcagattgtgcagaagaggaacagtgatccagcattgacgggggaggaggtggagcttgattttgatgagctggatatcgagaccctgtgggagcttgatcgatttgtggtcaattggaggaaggcgctaaagaagagccagcggaattctatgatgaatggtgatgctgctgccatgaatggagacgccattgatgtgacaattgttccggatgatgatgacatggtcgaggttgctgtcaatccgtctgtggtggttgaaattggagagtcggagactgacattccaaagaagagggaaatggaagcggaggacgagtatgttgatataggtgacgagatgccaacggtgaattaccagtcggtggagattgagccagattccccggcagctagcagctcaagcggatcaggaagtggctcatcttcatccagtgattctgactcggactctgaatctgatggggatgatgcaagcgccccgcactaggtggttgctcttttatctgactgtaggattagtgatgagtaggtgactgaggttccattgggtgaggcattttgaagaatggtatagcaaattggaggggctcttgttgatgcaagtcgttgtcaggtgtgttcgtttgtgtatgtgggtgcagcttaggttgtcggtacttggtagtgaataggtagatgcttgggtagattgggagactactgtaaagaagggaatataatctggaatggaactaagaggaaaagtag

SEQ ID NO: 9645 - DNA, 691 bp, Sorghum bicolor
  Clone ID: SORBI-28MAY03-CLUS27972_1
ctggatgaaataattgattatgtgaaatttcttcagcttcaggtcaaggtcttgagcatgagtaggctaggagctccaggagcagttcttccccttctcacagaatctcagactgagggttaccatggtcaacctctgtcggctccaaccaacacacaaggattactggatgcactagactcggaagacgccttcgtctttgaggaagaggttgtgaagctaatggaaaccagcatcaccagcgcaatgcagtaccttcagaacaaggggctctgcttgatgccagttgcccttgcttccgccatatccacccagaaaggtgtgtccgctgctgcaatccctcctgaacggcgaaataaagacatgctcctcccatgagcatgaggacacaactgaagaagacagagctcagacggctgaagaatgcagagcccgtagagtacaggataggaagttagtctgaccagagtgcatggccccgtctactaatttgcttctcagaatcagttttttcgtacctattgcgcatcagttggttttgccttttttttcccccttttttgccgtattgcatcaggttgctcagcgatagttgcgtttcagtaacttgaactgtatctggattatctatctggtttctccttttgtgcatagaaaaaaaagtaaaatctactgtttctggtgtcctgct

SEQ ID NO: 9646 - DNA, 1330 bp, Sorghum bicolor
  Clone ID: SORBI-28MAY03-CLUS26731_1
actgtgcgcacagggaaaagaaaaatcccaggcccccccgccctgccccacgcgacgcggccgccgccgcttccatactttccagaaccaccgcctccgccgccgccggcagagctcccccctggtagggtcaacccccttctccatcctctgacgactgcggactgcgggaagcgccagccgcggccgccgccgagaaggaggagcccgctccccaagcagaggggtggggatcagtgcgtgcgctccacgaggaggacgtggaagagctgggcagccgacgagaaggggttggggaggatggtttcgctgtcgactttgttccgctatgccgcgcacaagttcgagtactccatctccctctcgcggaagaaatataatgtgggccagatcaacagtacggagctaactgatgcgatatggaaaaactacatccatggcaagctcacctacacgcattggaccaaagggggagaagccatggctcccatcgtatctccaactggaggaaccctccttgtcagaaagctcgcaaatttgagccccacacaagtgtttgttggggacgttgtcttgttaaaagacccagagaaatctgatgatttaattattcgacgactggctgccctggaaggctatgagatggtctctaatgatgagaaggatgagccgtttgtacttgagaaagaccaatgctgggtcctggcagacaacctagccctcaagccaaaggaagctagagatagccgcttgtttggacctgccccaatgactgacatccttggcagagtgatatactctttaagaacggctgttgatcacggtccagtcgagaacagcggcatggccatgaaacaggatggcccagtactcgcagtggagcttgatgtggaagagatggcaaagaataataaggcgtagtagatacttgatgttttcgacatgccgtgctgtaactcaccgccacaatggattttgttatttatgatctgttgcttcaagtagaactgcattggaatgtttttttttttcacggtttgcctgtggagcagtcaataatggtcttgacaaaataatccagaggctgctggatcgtgatcattaacagttgcgttggtatccagtgctatccattgtgtgattgtaatggctgtgtttagggtttcttatttgtctattaagttgccgtgaattttgtatttgcgtgtgttcatggagccacggctcacgggtaagccgttgcgtcttgtagcatagttacttgataaactgtcatgatttgtttagtcctgaaaggaatgagaacgctaataccatcgatttatttgcg

SEQ ID NO: 9647 - DNA, 581 bp, Sorghum bicolor
  Clone ID: SORBI-28MAY03-CLUS26827_1
ttcagtgtcctgttgagatggcttcacaagacacatcagcaagctcccaagccatcatccccgtttcacctgcaccttcagacataggtgctctagccattgtgcccctttgtaagtccaagcgatctgaaattgggcaaaggcgcataaggaggcccttcactgttggtgaggttgaggcgctggtgggagcggttgaacagcttgggactggaaggtggagagctgttaaaacgcttgcctttgacaatatagagcacaggacctatgtcgaccttaaggacaagtggaagaccctggttcacactgcaagtatatccccgcaacagcgaagaggtcagccagttccacaagaactcctggaccgtgtcctcgcagcgcaggcctactggtcccagcacctccaggacaagccccggggcaaggctcgtcttctccctgagatttgctttccctagaaagggtagcgtgtccttgtgtaaatgttgtgcctaatagaaacaatgtagaagggatgtccaaagaaaccagagtaatttgtgtgttattgcatacttacaacatttattgttcttttcctg

SEQ ID NO: 9648 - DNA, 704 bp, Sorghum bicolor
  Clone ID: SORBI-28MAY03-CLUS26778_1
cacctctccgtgccatgccagattttgcccgagtatacagcttcctaggaagtatatttgatcctgatacaagcgggcatttgcagaggttaaaagcgatggatccaattgatgttgaaacggtactactactaatgagaaatctttccacaaaccttaggagtcctgactttgagcaacatcggaggttgctatcatcatatagctatggtggtggggaccatgttaaatccgaaggcatggaaaatcatggatcagctcagagtggccatcttccattcctggtaacaagtgaatgagagcacactgccaatttgcggtcaaagctttggttgtttccacgagacattcttgtgtgctctcagcaatggagttgtggacgtctggtctggcagtttatgaatgctagagacgtatcgtggcagtgacatctgtatagcttccaataatggtctgaccctaggctagttttgcttttcatgttcatgtagatagccagttttgtgtgctcatgcaattcttttcatgggtggggcctagatcgataagtttttgttatatacacacttgtgctcgcgtgtatgtaaatatgtggaatcttgtaatgtttgaggtacttggagtctttggtcaagacaaagcacatatacgcaataaggagttcaccatcgtcgactgaataataaaaagttttttagttgggg

SEQ ID NO: 9649 - DNA, 968 bp, Sorghum bicolor
  Clone ID: SORBI-28MAY03-CLUS26925_1
gcacgaggaggaactgaacccggtccctcggcggtgcagcggcacgcccaaggtcctgatcccggtggccaacgggagcgacgagatggaggtgctcgtgaccgtcgacgtgctgcgccgggccaatgcggacgtcgtggtggcgtcggccgagggcggcgacgccgaggtcgtcgtcgtcgcgcgccacggcacgaggatcgtcgccgacgcgctgctggtcgacgccgtcgccgccggccagcagttcgacttcgtcgtcgtgccgggcggcatggccggcgccaagacgctggccggcacggaggcgctcgtggcgctgctgaaggagcatgcggcggcgggcagggcgtacggcgccatcggcgccgccacggcggaggtgctggagccgcacggcctcctcgagctcgagggcaagaaggcgacgacgacgtgcgcgtccatggcggactcccgcgagtgcgggagcagggtggtggtggacgggaacctggccacgagcagcggccccgggacggccatggagttcgcgctggccgtcgtggagaagctgctcggcgccgaggcggcaagggaggtggcggaagccctgctgttcgtctgacgacggaccacgggcggagatgagctgtgcctgtgctatttgatcctttgcagtagagatcatggaacgtggccggaccttccttgtcataacatcatctgagaatttggtatctcgatcgtgtagtgtagtaaaaattctatacaagtatcgttacttatatagagaggtgggacttgggttaagccataccgcctcaggatggtcctcttgtgatttttgccgctctttggaccatgatatctaggcacgtaagacgtgtcaaggtgtcgttgtggtgctacgtttttttcaatagcccaagcacagctcatggtacccaaaaaaaagtctttatatcgtatcattaattttttagttt

SEQ ID NO: 9650 - DNA, 486 bp, Sorghum bicolor
  Clone ID: SORBI-28MAY03-CLUS26950_1
ttttggagctccgatctgtagctgaatctaggaatgaagaaattgagagtcaactgcatgaagttcttgaaaaggtagcacaaaaagaagctgaagttacagacttgacagagaagctggctttgctcgaagctgagaatgaaaagttgactggtgtgaacggggcattaaaagaggaagtggatgctaagctggccatgtttgatgagctacaggaacggtttagctctactcatgcggagaaggaagaagctgcagagaagctagctgttcatgagaggacaatctcacaactgacagaggtacacacaagaaccttggagctccattctgtagctgaatcaaaaaatgaagaaattgaagctcagttccgtgaggctcttgagacaatagcacagaaagaaggtgaagttaaagaattgtgtaagaagctggatgcccttgaaattgagttgggatattatgagcagcagcttcacctcgtgc

SEQ ID NO: 9651 - DNA, 1223 bp, Sorghum bicolor
  Clone ID: SORBI-28MAY03-CLUS28315_1
atagtagattgattttgaccaattgggtgatgcctcaaccgactgtgtccacttatatttatagggtgaagatcaaggtcttgcccgcgtagagtcgtaatccatagaatccgcccttaaattgacttaaaactctatctgaacttgaaccggatgttgcagttctgacccagatcttctggcttatgttggaatctcggccctaggttggacactagctttgaggatgttctattccagatcttaggtttaagacggaagttttgagtgatagggactggagtttggttctattccagaaccaagacaactgtcatggtacacggcaaattcattccttcccattcttaatctgaaagttccagtacctatcaggtttaatcatcaatacctagccacatgacaatcaaagaaaggaggtggtgctgtctccttatgattgtgtgtgatttcagcatcggcgcccgcgctttttactgccgctcttcttctctggtcgtgactgcctcggggttacctcccatgctggtgcatcatttgccccccctcaggggatctttcccgtctgcacctagaatatcactgtggtggcaagcagtccaaattcaaggcacacggatccaaaggctttggtttcaaagaattaccaggggacatgttttgctgggccttgtattgaaaatggcaagaagctttcttggtggatggtagacatcggacaggactaccagctgatgtgcaactactacacggtgaggcaggatggctccacaacattcatgagatcttgggctcttcagggatccatggacggccggaactggacaagcctccgtgtccatgacgacgaccctaccatttgccacccgggccagttcgcctcttggcccatcgttggcccggcggcccttctgcccttccgattcttcagggtcgccctgacaggcccggccgccggatgtgcttggaacctctgcatttgcttcctagagctctacggctacttccgttagatgtcctgtccacaagctttcttttcctaaagaagagtaaatgaacagctttgttagtaactagagcagttctaagatggtccaagttctgttgattttctttttctttttaaaaaataatatagataacagggtttttattgcaaacacaagtaatctttccatgggtggaaggcattccggaataggttctgcagatggtacaaattg

SEQ ID NO: 9652 - DNA, 745 bp, Sorghum bicolor
  Clone ID: SORBI-28MAY03-CLUS28414_1
ggctgcgcacgcgggtgccgctgaggtcttggcggccccgccgccggtgcgcgtccgtttgcatccccagctggcgagagggcgaccaactccctctggcactgcaggcccgagcgctcctaatgataaaggcaagggtccaagtacaggtaggccgttccgccttatggattggaacccaacagcacgcacctttcagtgggaggaatcacctggtcctgagagttcagaaccgtcattacgcagaccacacttgcctagcccaaggagagcaccagtttctcctttgccaccgggagaaaacaaaaataggcgtagaagggcaaggaagtggtgcttcttagaagaagaagcactaagacagggtgttgaacagtatggtagtggcaattggaaggacattttaaataacaaccctgacgtttttatcggcagaacaccggtggacttgaaggataagtggaggaatatgatcaaccgttagtgtaacggagagacatgttggacaagatactggagccccagcttccttcggacaggactaacttcacgctctagagcaccttctaatggttcactagggtgaagtagctagcctgttaccacttaccactgtagtcgtgatgtacttagcgacgtcactaagtgcgcaccgcggcccttctttgatccccggttgcgcttcgcgcggccggtcctccgcgccggtgtgttttgcgcgcggcgtgttctccgcacaggtgta

SEQ ID NO: 9653 - DNA, 698 bp, Sorghum bicolor
  Clone ID: SORBI-28MAY03-CLUS2842_1
gtcgacccacgcgtccgccctctccacccctcctcctccggcaactaaggagagagcgcgcggctgctgctacccggcggcccggcggcggtgaaagccgcgacgacccaacgcagaacaggcgccatggctgctcccgaggcgccctcatgctacgtcgggatcgcgcggcagtccgccgccttccgccttatgaagcaaatgggatgggaagaaggtgaaggccttggcaaagacaagcaaggcataaagggtcatgttagagtgaaaaacaagcaggacacactaggtgttggtgtagatagccctcataacaaatgggtatatgataccacccaatttgacaacatactgaagaaacttaaagtgcaatcagctaatcctattcaagaagaggttgcagctgtaaaaagtgattcgcctgacgtcactccaaaggaggacaaatcagcaaaagctgaagttactaaagttactcgacctcaaggaagatacaagaaaagagagagggggaaaagtgtgagctcttattcagcaacggatcttcaaggcatactcgtacgcaaaaacgaagataattctcaagtggatcagaaacttgaaccgacatgcttggatgaacctgatcccatcatctgtccggatgcagtatcccaagctgatgatgtgaactggtgggggcacaaatttggattcgt

SEQ ID NO: 9654 - DNA, 771 bp, Sorghum bicolor
  Clone ID: SORBI-28MAY03-CLUS28498_1
gcacgaggccgcccccggcatgatgcagccccagatctcgcggccgccgatgcccaacctgtcggcccagccggtgtcgtacccgcaggtcgtgcgcccgccgcagggaatgcctccgccaatgcgtcctggaatgcagccgcagatgccgatgccgttccgcccgcctggtgtgccgcctgctccgttccctggtgcaccacaacagtttatgaggggtccgcccccgatggggccgccacaggtgaggcccgggatgccggggccaccacctcctggaatgaggcctgggatggctccgccgccctgcgcgcggccgaggccagggatgcagcccccgccacctggtccacagcagcctggacagaacccgccgcagtagcttcttcttacccggataagcttctttcagatacacttatggaagatttttgtatcgcgagaaaggatcaatcgcacctctggaaggcttgtgaattgcaccaatgcttcaccattctgtcttatatatcagggtactagtagtttcctttgggtattgtgagagaagtgtgtaccactcatcctttgatgtgagaggggacttttgtacgtaaagaggcgagggcttatttttaactgttggtgttggttaagttaggaaatatggataacttgtatcatctttgtctgaagtctggacccttaccagatgtgtgtgcactgcagtcctgttattcggtgttcattcgtgcttcttaagcccttggtatctcaaagtaaaagtacttt

SEQ ID NO: 9655 - DNA, 730 bp, Sorghum bicolor
  Clone ID: SORBI-28MAY03-CLUS2850_1
acgatggaattcagagaggatcaatcgcaaatcagagtcaatttagtccttacaatatcatgttgcatcaatgaatcatgaaaatcctctttgtaagaacaaaaagtcgaccacggcgggtaggaacacaaattttgtcgcaataccaacaccaacaccccatgtcagcagcagggaagaacagcacatctggggacctaactctaccttgaacggattggtactatcctattacctgcttggcacgctccagaaaagcatcaaaatttctggacctgttcttgttgattcacagattaagctccatccacctattctgcatcgccatcaacaccgtcgtcttcaacatcttcaattttttgaggtgccacactgtcttccacaactgtagggtcatcatctctagacacttcagggcctggtcctgcagacacttcagggcctggtcctgcagataccttaaccattgctgggcggagtaatctttccccgagtttgaaaccttttcgaaattcctggagaatgatcccctcttcgtactccgatgaatcttctctcataatagcctcatgaagcataggatcaaatggtttgccaacagtttcgacatcttcaacgcccagtgaattcagaatctcaataaattgcttataaatgctctggtagctattatttattttctcctctccctctgtttccacctttatttgcatttttgctctttcaaagt

SEQ ID NO: 9656 - DNA, 667 bp, Sorghum bicolor
  Clone ID: SORBI-28MAY03-CLUS28598_1
ccaggagaaactagaagctgaaatccagtgtctggtgatgctgaaagcaaggcagaactggcaggtccgggcagaggaccggatggccttggaggagcacagggcgctgtctgccggggacaagagcagaatgctgctcaagctacgggagacagagagtaagattgtgatgctgaaagagcaggtggacaagctagaggtccgggagaaggagctctaccggacgaccgaggtgctgaagatgcagagcaggaccttcaaagtgtccctctttggcctcctccagctggtaatgatgtgcctgtccctaaagatgttcttcgcgagggtctcggccccatttgacgaggttgtgccgacatgatgctgtctaagtcttgtttggattggatgcagtcgcatccacctccatccacatggattcaggtggataatagtgtagccaaacaagccctcagttggtgttctcttcagtctgtaacttggctcgccttgtttgcgatgccttaacgtgtgccttactttagctggtagtctgtagcccagtaggtagtattagtttcgtaatcgtacactgaagtgtaggttgtgatgatgtaagtgcgaaactacgcgtgttctgtaaaaaaaatgataatgtaggccttgtgcatcaaattgggtttgc

SEQ ID NO: 9657 - DNA, 782 bp, Sorghum bicolor
  Clone ID: SORBI-28MAY03-CLUS27293_1
aacgcagcaaagcgcgcaccaaattgcacctacccatttcgctaatctccctccacgaccccccgcggaccaaatcgaatcgaatcgaatcgaatcgcggggccgcgcgcaccgcgcagcagcgattgccggcgatggcgagcctcaccctgccgccggcgcccccgaacccacgccaggacgccatcgacctccacaaggccttcaaagggtttggctgtgatagtacagcagtgataaacatacttactcatcgcgattcagttcagcgtggacttattcaacaggaatacagggctatgtatcatgaggaactcttccatcgtatttcatctgaactcagtggaaaccacaagaaagctatgtcgctgtggattcttgatcctgctggacgtgatgcaactgttttgagagaagctctaagcggtgacactatggatctgagagcagccactgagattatatgttccaggacaccatcacagttgcaaataatgaaacagacttattatgctagattcggtacttatcttgagcatgacattggtcaccacacatctggcgatcaccagaagcttttacttgcctatgtggggattccacgctatgaaggtcctgaggttgatcctaccattgtgacacatgatgcaaaggatttgtacaaagctggtgagaaaaggctgggtacggatgagaagacctttatccgtgttttcactgaacgcagttgggcacacttggcatctgtttcttctgcttacatcatatgtatgaccggaaat

SEQ ID NO: 9658 - DNA, 1224 bp, Sorghum bicolor
  Clone ID: SORBI-28MAY03-CLUS27427_1
gatctgggtaatgcgatgacagaggatgagggcattgggcttgatgacttacaaatcttgaagcttgttggccaaggggcattcggtaaagtatttcaggtgagaaagaaaaacacctcagagatatatgcaatgaaagttatgaggaaggacaggatactagaaaaaaaccattctgaatatatgaaggccgagagagagatattgacaaaagtcgaccaccctttcatagtgcagctgaggtacgcatttcagacgaaatatcgactttaccttgtcctggacttcataaacggggggcatcttttctttcagctctacaagcaaggattatttagggagcttgcaagaatctatacagctgaaattgtatctgctgtagcgcatcttcatgctaatggaattatgcatagggatctcaagcccgaaaacatccttctggatgctgatggccatgccatgctcacagactttggccttgcgaaggaattctgtgaaaataccagatcaaactcgatgtgtggcactctcgagtacatggccccggaaattgttcttggccgggggcatgataaggctgctgactggtggagcgtgggaatcctgctctttgaaatgcttacaggcaagcccccatttgttgggaacagggacaaagttcagcagaagattataaaagacaacctgaagcttccttcatttttgtctagtgaagctcattccctcctgaaaggcctcctgcacaaggaacccaacaagcggctgggcagcggccctggaggcagcaatgagataaagaaccacaagtggttcaagccaatcaattggaggaagctggaggcccggcagatccagccaagctttcggccgaacgtcggtgggcttacctgcattgccaacttcgacgagtgctggacgaagactcccgtgctggactctccggtgaccacccccgctggcggcgggcacagccacttcgcaggcttcacctacgtcaggcctgcgccgatccttgaggaggtgaacgcatccagctccaaggtgaaggactaaggatgtttagcgcattgaaaatgtgcttaaaattttgatcgagtgacatgttatggaacgcgagttatgtgcagaagagacgctggttctgtatcgtctattaaaacatgtagcgttagcgtggaaataccggatatggaaatataacttacctccttcatccattcctcc

SEQ ID NO: 9659 - DNA, 895 bp, Sorghum bicolor
  unsure (1)..(895): unsure at all n locations
  Clone ID: SORBI-28MAY03-CLUS2749_1
cctgtcaaaatactgcaagttcaagacagttggtcaggttttcacaaaaagtggatggagatttgccttcccaagagattcccctcttgctgaggacttgtcaacagcaatcctggcactatcagagaatggcaatctccaaaggatccatgatgaatggttaagtgcgacagagtgcagtgcagacaacaatggtgctgcgtcgaactccttgagcctatcaagcttctggggcctcttcctcatctgtggccttgcatgtctcgttgctcttgtaattttcttccttcgcatattctgtcagtacagcagatacagtaaccaggtcgaggctcagtttcctgagccccaacagattctgaacagaccagcaaggttaactaccatcaagtcattgatctcttttgttgataagaaagaggaggaggtgaagaatgctctcaagaagagaccaaatgcgtccgagcatccaagcattggcagtacagaagaacaatccacattaccacctacatccattgcataactaatgataccaaaataatgtgcaatcctgctttgaagtggaagttctcctagcacagaggtcgagttgacgctgaaggggttttcctgcatgtgccttgctatgacttatgactgtgaaaacatatcatcggaatcagcttcagacttcagagcattgtcttcagagaaaatacatcagctttaggttttattttttgccaacagcaacaattctggatctcctcgctagcaatatctgggagaagtagcattcagttgcaggttcaacttctgtcaagttggccttcttcattttgaagtaactcctaccaaagttattgtagctaccatcttgagcatcttccaaaaaaaaaaaagtnggcaagtt

SEQ ID NO: 9660 - DNA, 862 bp, Sorghum bicolor
  Clone ID: SORBI-28MAY03-CLUS27615_1
gataagacgtttttcattgctgcactactagcgatgcaatatcaaagagcactggttttacttgggtcaatggctgctctctccctgatgactattgtgagtgttataattggacggattttccagtctgtgccagcacagtttcaaacaacactacccataggagagtatgctgcgattgctctgctggcattctttggtttcaagtcaataaaagatgcattagcacttcctgataatgccaacggaaaccttcaggggaactcagaaagtggggaactggctgaggccgaggagcttgtcaaggaaaaggtttctaaaaagctcaccagtcctcttgatgtcctttggaagtccttcagtcttgttttctttgctgagtggggagatcgctctatgcttgctacaattgctttgggtgctgctcagtctcctttgggcgttactagtggagccatagctggacacttgattgcaacagcccttgctattcttgggggagcattcctggctaactacttgtctgagaagctggttggcttgttaggaggagtattatttttgctctttgctgcagcgacgctttttggtgtattctaatctgtctgaagaatctgtggttagggaaagacttcgcagttccgagtgtggtcttagattttgatgaagatgaggggcaaacccaagtaggctttgcacatgttgtatgtagatagacgttatcttttgagttccatgagatgatttcaatgtgccaaaaaatctctcagactggaaacctgcatcatatggacaatttacagatgttaccattcaaataatttaattagattggtttaaggagaaaaaaaaaaaaaaaaaa

SEQ ID NO: 9661 - DNA, 900 bp, Sorghum bicolor
  Clone ID: SORBI-28MAY03-CLUS27752_1
gcgcgaggctctctctcctcgcacgaggcccatctccgctcctcctccccgcccccagcgcccaaaccctacccggcgatggcctccccggcgccggcgtcccccgcggccgccgcggcccacgctcctgcaccgcgcatcgggctcgcgggcctcgccaccatgggccagaacctggctctcaacatcgccgagaaggggttcccgatctccgtctacaaccgcaccgccgccaaggtggactccacgctctcccgcgcgcgggacgagggcgcgctgccggtgctgggccaccgcgacccgcgcggcttcgtgctctccctcgcccgcccgcgcaccgtcgtgctcctcgtccaggcgggccccgccgtcgacgccaccatccaggccctcaccccctacctcgagcccggcgacgccatcgtcgacggcggcaacgagtggtaccagaacacggagcggcgcatcgaggaggccgcggcgcgcgggatcctgtacctcgggatgggcgtgtccggcggcgaggagggcgcgcggaacgggccctcgctcatgcccggcggccacgtcgatgcctacaacaacatcagggacatcctcgagaaggccgccgcgcagacggaggatggggcgtgcgtcaccttcgttgggcccggtggtgctggcaacttcgttaagatggtgcacaacgggatcgagtatggcgatatgcaactcatcgctgaggcatacgacgtgctccgcagagttgggggcctgtccaactcggagattgccgatgtctttgcggaatggaacaagggggagctcgagagcttcttggttgagatcaccgcggatatattcactgtggctgacccattggaagggagcggcggagcgttggttgacaagattcta

SEQ ID NO: 9662 - DNA, 683 bp, Sorghum bicolor
  Clone ID: SORBI-28MAY03-CLUS29116_1
atgaagccgccgcagttcgccaccatgaagaacgtcaactacctgcccaacgtgctgtccatcatggacgccgaggaccgcggcgcgttcgcctccgtctgggtcgacgacgaaggctacgtcgccgaggggcccatggtgaacgtggcgttcgtcacgccggacaaccacctcgtgctcccggccttcgacaagatcctcggcgggtgcaccgccaagaggatgctcgcgctggcgcccaggctcgtcgagtccggactgctcgcaggcgtcagcaccaggaacatcaccgtggaggacgccaagggcagcgtggagatggccttcgtcggcagcggcctccccgtgctgccagtcgtccactgggacgacaaacccatcggagacggcaaggttgggccgctgatgcaggcgctgtctgatctgctgtgggaggacatgaagtccggtcccgacaggatccccgttccatacaagcactagtcagtgggtgaagactcaacactgaagagaagccatgtgtgtgtgtgtgtttgcagtcgatcctgcgattgtgtctgtctgtgtgtatttccttgtttgaattgggattggtcaaccaagtcactcgattgggatccagtttgccgctgtaatgaaatgaatggcggctgacttactgaataatacagtacacttgggag

SEQ ID NO: 9663 - DNA, 1010 bp, Sorghum bicolor
  Clone ID: SORBI-28MAY03-CLUS2914_1
gcacgaggcacgcgcgccatctgctcgagcttgtgcctctgcacgcgtcattgctgggaacattgatcaactcgttggtaggaacattggggtgttgtctgaatcctacaccgtctacgcgatcgatttactggggttcggtgcatcggacaagcctgctggattttcttacacgatggagacatgggctgagttgatattggatttcttggaggaggtggtcaggaggcccacggttctcgtcggcaactctgttggaagccttgcatgtgtcattgctgcctcagagtccaaccgagaagccgttcgtgggcttgttctgctgaactgcgccggcggcatgaacaacaaggcgatcgtcgacgactggaggatcaagctgctcctgcctctgctcctgctgattgacttcctgctgaaacaacggccgatagcatcagcgctctttaaccgcgtcaaaaacagggacaatctgaaggacatcttgctctctgtttacgggaacaaagatgccgtggacgacgaattggttgacatcataagcggaccagctgacactgagggcgccctggacgcgttcgtgtcgacggtgaccggcccgccggggccgagcccgataccgctgatgccgcggctggccgacctgcccgtgctggtgctgtggggggaccgggaccccttcaccccgatcgacgggcccgtggggaagttcttctccaagctgccgtcggagctccccaacgtgacgctctacatgctggagggcgtggggcactgcccgcacgacgaccggccggacctcgtccacgccaggctgctcccgtggctggaagcgctcccgccgcctgcggctggcacagtgaccacgacggtgtagtcgtcgggacgggatcgacgaatgggccatggccgatggatggatgtgtactggaaatttgtaaatgaatgcatgcaactgtaggaggatttgcctatttggttctgaggcatatagtgaaattaatttctgt

SEQ ID NO: 9664 - DNA, 665 bp, Sorghum bicolor
  Clone ID: SORBI-28MAY03-CLUS29160_1
gcaccacgcggcaaccaaggcaaaccagcacgatgcgtcgcgagggccggcagcacgggtgggtgttcaccgtcgaccccagcctggtcgacgcggagggcaagcagtgccgttcccgcgcggtgcaggtcgacggcgcggcggcggccaacggcgggttcgtcagggcgccgcggaagcccaccaaccacaccaagcccgccgtcggccgcgcctacaaggcgctgatcggcaagggagaggctgggtccggcaggggcaggcacaagttcaagcacgacgaggccaagatgtaccacctctacctcgagggcgccgacgacgcctacgcggatgcgatgctggagttcgactggtagtcctactgacatgggtgtgtgaatgcggtgctggatcggagttcgacgggcctcattgccaggaagtgcagagatcgatgttaggcttctgtgtctcaatccaaatgtgttttgtgatgtgagtcgttgttgcgtcagcagtgaataaaaaaaggcagggatctggaatgtatcccaaattgggaatcaatcttgatctccaaagttgaaatttgtaaaagttttagccgtacgagtttccgtttttgggtccctgttgttttcaaagtgtaatagcgttcatgcagttaaagactgtttactgtt

SEQ ID NO: 9665 - DNA, 806 bp, Sorghum bicolor
  Clone ID: SORBI-28MAY03-CLUS2919_1
ctccctcctcctccccctccccctcccctggccttcgtctccgcctcccgtcttcctccagaattcgattcccttcccacaagaacccagcccgcaccatgacgagctcgtcctctccttcccgaaaggcgctgagcaagatcgcttgcaatcggctgcagaaggagctcgcggagtggcagctcaacccccccgccgggttcaagcacaaggtctccgataatcttcaaaggtgggtaattgaggttaccggagcggcgggcactctttacgccggcgagacctaccagttgcaggttgactttcctgagcattaccctatggaggcacctcaggtcatttttctcaatccagcgccaatgcatccacacatttacagcaatgggcacatctgcttagatattttgtatgactcgtggtcaccagcgatgactgtgagctctgtctgcatcagtatcctgtctatgttgtccagttcgccagcaaagcaacgcccagcggacaatgaccgctatgttaggaactgccgcaacgggaggtctccgaaggagactagatggtggttccatgacgacacagtgtaatgagctccgtggcatcgcctgtcagccttccttaccgtgatatatctcttcaaggggagatgagatgatttaggcctatttacaagcacccctctattggatttgcgaagcttaccttgttgtggtggtatgtaaatgagttgcacacatgtgtcgagtctgagaattatattatcaccatccatgatataatatagaataagcaagaatgtaccctgcctg

SEQ ID NO: 9666 - DNA, 673 bp, Sorghum bicolor
  Clone ID: SORBI-28MAY03-CLUS29214_1
gaggatgggcggcactgttcgtacttccgaaagtctctaatgaatcaaccacctgttgttttgcctgctgagatagatagctcacaagtaatttggttggaggaattggaggaccatcagcccccagaaggctttgttgttgcgagaggtctgtataaaggccctgtaattaggagatgatttgccttggagcacagaatccaccaaactgcaaatcagctgaaagacgatgcaggcttgtagtgtcaattgcaagcttcatcaggtcatgtgcagcctacggtttactttgtacatgtcaaagtgatctgtgataatttaacagcagttttacagaacaatggatgttttttttgttttgctgccattttaattgtgtcccactgctggagtattctctgaccttagttatggagctcttatcagatcaagaccgtggagcacatacttttgagcatagtctagcatagctattgtcatggtgtactagggagatcaatggacaaggttttccatttggtgatttcagaaagaatttggtgtgggggaaccattttgtctgtgtgtaatagcagcactactatttttgggcaagactgtaaattacgggggacgaaccgtaaacaaacctgtgcgcatcatctccatgtttcatttacgtccgttgccagca

SEQ ID NO: 9667 - DNA, 708 bp, Sorghum bicolor
  Clone ID: SORBI-28MAY03-CLUS28149_1
cacaggtgagagtttctgttagtgatgatgcaaacaaggcgacaatagtcctcaaagttgcagaaaactcctgtaacattagcattcacaatgcaatcacaagggagactggcagagttattcggatgccacttacatcaacatacacgctgctgcctatctttcttctccttgctgtggtgggagtgtgcatcatgcttcggaggacacgcaagcaagatggcgaacctgcatatcagaagctagacatgtcagacttaccagtttcagttggaggcaagaaagagaccgatgatcagtctgataagtgggacgacaattggggagatgactgggacgatgaggaagctccgatgacaccatccaaacctctgcccaacccttcgtccaaaggtctcgcttcgaggcgttcgacaaaagatggatggaaagattagttagccaaatgacgccagttaaaggagcattgcagaaatagttccaatgcatgtaccatatttttgccttccgctttgttgttaaagtgttctggaggaggatgctatgtcagagagtgcaatgcattgataccaagcagaaaattttgtaagctcccactgccaatttgagttactggcaactactgaatataatagttttctcagcggcccttatgttcttgtgaggttctatttgtattgatctttctccgtatataagacttacgaa

SEQ ID NO: 9668 - DNA, 1242 bp, Sorghum bicolor
  Clone ID: SORBI-28MAY03-CLUS28221_1
gtagctcgagaagcgaggcacccgcccggcccgcctgcgccagtgctccgcagggcgtgggagaggtggtgcccgcgcgggaggcgacggagggaggcgcgagcgcggcgaaagggccggtggtggtcaccggggcgtcgggcttcgtcggctcctggctcgtcatgaagctcctccacgccggctacaccgtccgggcgaccgtgcgcgatcccgcgaacgttgcgaagacgaagccattgctggaccttcccggagcaacggagcgcctgtccctatggaaagccgacctggcggaggaaggcagcttcgacgacgccatcaggggctgcaccggcgtcttccacgtcgccacgcccatggacttcgagtccaaagaccccgagaacgaggtgatcaagccggcggtcgaaggggtgatcagcatcttgcgagcctgcaaggaggccgccgacgccggcggcggcaccgtgcgccgcgtcgtcttcacttcctccgccgggacgtgtcagcgtcgaggagcggcggaggcccgtctacggcgacgacggctggaccgacgtcgatttctgccgtcgcgtcaagatgaccggatggatgtacttcgtgtctaaaaccctagcggagaaggcggccatggcgtacgcggcggagcacggcgtggacctcatcaccgtcatcccgacgctcgtggtcggccctttcctcagcgccggcatgccgcccagcctcgtcaccgcgctggcgctcgtcaccgggaacgaggcccactactcgatcctgaagcaggtgcagttcgtccacctcgacgacctctgcgacgcccacctcttcctcttcgagcacccggccgccgccgggcgctacgtctgctccgcgcccgacgccaccatccacggcctcgccgccatgctcagggagaggtaccccgagtacgacatcccgcggaggttccccgggatcgacgacgacctccagcccgtgcgcttctcgtccaagaagctcctagaccatggcttcactttcaggtacacgacgatggaggacatgttcgacgccgccatccggacgtgccgggagaagggcctcatccccctcgccacggccggaggggggggtggctctgcctccgcgcgcgcgcccgcccccccgggcactgctccgccaagtagcgcctagtccctggctgcacttcccgccatcctgcggttctcgtgttgttttataccgttatatatatac

SEQ ID NO: 9669 - DNA, 729 bp, Sorghum bicolor
  Clone ID: SORBI-28MAY03-CLUS28260_1
cgatggcactagcctaaccgttgtcagcgtggacgacgagggcgggtggtttgacttcatgctcgtcaggtacacgcaggacaacatcgtgctgcccaccaagaaggtcggagacaaggtgaatctggaggcggatatactggggaagtacgtcgagaagctcctcgccgggagggttgaggccatggctaaggttgattcgtgatcgaccattgctgagatgctggattgctcatcattctataggggttaagaaaggcttggattcaatgcctatacccggctcagctagggtccctatgatggagatgtcacttaatgaattttatgcatgagctttttgttatgatgtttggaagtgctcaattgcttgctgcagcctgcagctgcgatatggattcttgaagaatttttgttatgatatttgtagatgttcatttggttgctgcagcctgcaaattcaaaatgctattctggtgcacttaccccctctactgtatgagacctgagatttgtgattggaacaataggaatataaggcttagcaccatggtaacactcctttgttgtagttggctgtgtaaaaccttttccttgattacacagaataaagtcgatgttgatagtagtcacaactccttttggggataagatggaacttactggcactggattggagatcgctgggtaacatcttgtgtttgggttacttcaaatcttacagtatat

SEQ ID NO: 9670 - DNA, 749 bp, Sorghum bicolor
  Clone ID: SORBI-28MAY03-CLUS28325_1
ctgcgacgccaggaccaattccattcgctccagaacgcacgagggcgaccgcgagtcccctccctctcccttcccttcccgccgcctccgcggaatcgtgagggggttgcctcccaaatcgccggagttggttgatcctgccgtgcacgcgcgcggtggttagggctaggcgatctccggaaatggacgtccccgattccggcggtggcgcgccggatgccggcgagcccatctgggactggggcaatctcctcgacttcgtcgtccaggatgacgactccctggtcctcccgtgggacgacgccgccgccggtatagcagcagcagccgaccccaccgaggctgccacggcaccactgctccccgcctcgcccccgctaccgcagccggtggaggtagagccggagccggagccggagccggaaccggaaccggggccagtgcttccgccgccgcctcttcgggttcaggggatcgggcgccgcgtcaggaagcgggacccgcggctggtgtgcccgaactacctcgcggggagggtcccgtgcgcgtgccccgaggtggacgagatggtcgccgctgccgaggtggaggacgtggccaccgagttcctggctggcgcgcggaagaagactaagactgcagctgctgctgctcgccgtagcaaggcggcagctgcaggcgctgcccccggagctgcaggaggaggagctgcccgcgcggcggcggcggagatgaagtgccaagtgcat

SEQ ID NO: 9671 - DNA, 911 bp, Sorghum bicolor
  Clone ID: SORBI-28MAY03-CLUS29496_1
gcacgagggtcatatgcttgtctcaaagattaagccatgcatgtgcaagtatgaactaattcgaactgtgaaactgcgaatggctcattaaatcagttatagtttgtttgatggtacgtgctactcggataaccgtagtaattctagagctaatacgtgcaacaaaccccgacttccgggaggggcgcatttattagataaaaggctgacgcgggctctgctcgctgatccgatgattcatgataacttgacggatcgcacggccctcgtgccggcgacacatcattcaaatttctgcccttccttgcagaggaatgcttctgtgccacctgatcagagcagcccatcaccaccgccgcatgctcaggctccctatgcctctacacctggggtagactcaaggcctggatattctcaaccggagccaagaccttcatactcacagccatacccctcatcctatggcgcgccaccgcaacagcctccatacagtgcaccacaccctggtcagtaccagccaccagcgcatcagccgcctcctggtcatgactatggtcagccggcatatcctggatggcgtggtccatattacaatgcccatcagccgcagcaatctgcgccatatccacagccaccgtacaatgcccctggggcttaccctccgcaccagagcaactattacaggcctcaataagtcatcttgtggttgctgcaactatttgtttgtttcttttccattggatcttaccattgaggagtacattatctggcgtactgcatacgagagtttgggtggtgtaatatcaggttgattagaaggtatagcttgtatgatttgtacgtataataatgtgctggatgtgttgtaatacgcggctacattctcatatgcatattgcaacacctacgtc

SEQ ID NO: 9672 - DNA, 857 bp, Sorghum bicolor
  Clone ID: SORBI-28MAY03-CLUS29537_1
caaacccaaggagctactacaaatgcacttatgctggctgctcagtgcgcaaacatgtggagagggcctcaaatgatctcaagtccgtgatcacaacatatgaggggagacacaaccatgaagttccagctgccaggaacagcaatgggcatccgagctatggctccagtgctgcaccacagggtagcagtcttcaccggaggccagagcctccacaattcagcatgcctcacgctgctgccgccgctgcctacggttcactttgtctcccaccacaactcaatgcagcttcagggggtttctccttcggaatgctcccccctgcaatggcaatggcaattccagtaccatctctgggtaacttcatgccagcgcagatgcctggccatggatcaccaatgcagggttgttcaggccttatgctgccgagaggtgaggagaaggtgaacccagagcagcagtccagattgccggtagcgaatgggaatgcggcagcaacttaccagcagctcatgggaaggtggcctcagggtcatcagatgtaaatactccagcaggcacaaagatgaaacgatagggtttgttttttgcttgtgtacatacacaatgaaattaggtttcttctaccgtagctcctttgtttgctttcaggctttagtaagatgattctgataatagtgagggagagggaaaggggaagggatgaacttgggtgatcaggctttgctgttgtgttcattgaattattcagactaaggtcctggagtagtaactagcttcagcgggtgtttagttccccataaaatacaaaatatcaactattttggaattatggaatgcaaaatgtcaaaattttc

SEQ ID NO: 9673 - DNA, 907 bp, Sorghum bicolor
  Clone ID: SORBI-28MAY03-CLUS29634_1
gcacgagggacctgagctcgagcgccggcgggtagtaaagtagattagcttgaagagtttgctgtgtgcgcgccagcgagcgagcgtccggccggccggctagccgccgccggtggtggtggggatagcaatggcggcgtcgcagcaggcggagaaggcggcggagctgcaggaccccgagatccgggcggcgctggaccgccgcgtccgcgaggaaggcgagaccgtcatcaagagcggcaccggcgggaccaacctcgaggctcaggagcgcctcgccgaaggacgcaagaagggagggcgcagccgcacgacggagtccggcaaggagcgcgccgagaaggagggcggcgtggtcatcgagcccgacgagaagcagcttcaggaggccatgaaggacatcggccgcaactgatccgtcatcatgcatgcatatatatcgtcgctccagtcgtccgtatacgtcgttgatcatcaccgtacgtagtagtataccaccaggccgccggtacaagttgttgaccacgccgtgggcctagtagtggagtatatatatagtatgtaataatacacgtacgtccgtacctcgtccgtgtatgtgaccttagttattattaggtcgatgtagttgttgctacaagcatatatacatgctgtatgctgtgctacaagcatgctcaagcttgtgtgcaacagtactacgagtgcaggctacaaagttttggtctttgcattgtagccccttagccgtacgtatgtgtgtgtatattgtaattgccacaaggaagcatccgcgtcgtgctgcaaaattttggtgcctgcgcatgcatgtccatgcatgccagcaaggtttgcagcacagtttgttcagcccaatatataaaataaaacaacttcgtcctatctc

SEQ ID NO: 9674 - DNA, 742 bp, Sorghum bicolor
  Clone ID: SORBI-28MAY03-CLUS2971_1
cgtccgatttgacggaagaagaagaggaagagtattggatggttgtatctgccatattcgagggcaaagaaacttgcagtctaccatctgaatcgagttatgctgataaatcatcatctgaacctccaagttctactccattaagtgatcccatcaacaataaggtgcatttgctcagaaccatgcttcagtgggaggagcaagttcgccgtggtgcatctttggcagagaaaagtcttggtgtaaacacctgcacaaaaccaatcctgcgagaggtggccataatattctggcctaatggcaagattatgagaatgagcactggtagcacagctgctgacgctgctagaagaatgggcgttgaagggaagctgctttgggttaatggccaagtagttctgccccaaacagagctcaaggatggggatatagttgaagtgagggtatagatgcaagtaccagtttccagtacacctttctcaggggttattgatcatattggttcctcagttcttgccagatcttggcaatgcaacagactgaaggattgtagacataggaacccaaatctcaactgtacagtccatttgtcgaaatgaatcgaagaaagaaggattaggtgcagtaagtgttgtgtcatcatacaagagtttactgtgtacataagcaactgcaagtataagctgtctgtccagctgtgcttctctttatccatagttacagtggtaatgtaaatttctgt

SEQ ID NO: 9675 - DNA, 692 bp, Sorghum bicolor
  Clone ID: SORBI-28MAY03-CLUS37372_1
aggccatcgccggcgtcaccgccgtgtacgtctgcttcggcgcctgcggctacctcgcctatggcgacgccaccaaggatatcatcacgctcaacctccccagcacttggtccgccgccgccgtcaaggttgtgctgtgcatcgcgctggcactgacgttcccggtgatgatgcacccgatccacgagattgtggaggcgcggctgctggcgccgggcgggtggctgcggaagcgcggcggccccgtggagcgggcggccctgcacgcgagccgcgtagcggtgctggtggcgctgtcggcgatcgcgtgcttcgtgccggcgttcgggtcgttcgcgtccttcgtggggagcacggtgtgcgcgctgctctccttcgtgctgcccgcgctgttccacctccgcgtcgtgggccacgccgcgggcgccgcgcagcgcgccgccgactgggccatcctcctcttcggcctcgccttcgcggcgcacggcctgtacgccgccgtcctgtcgcggaactgacggcaggcggcgggcggcggcggcagcctagtgcacgttcccattccgacgcacgattttctcttccacgcgcgtttgtgttgataagataagataaaaaatgcagcagtttcgttattataaaattgattgattgatacgtttcggataggcctggataggaggactggagaa

SEQ ID NO: 9676 - DNA, 683 bp, Sorghum bicolor
  Clone ID: SORBI-28MAY03-CLUS37508_1
gcacgaggacccagagtccagggggcgttgccgcgttgcgttccgctctcccttttctgctgcgacggctggtcgagcgccggcgccgccacccttcgccagctcttcgcaggcgacgagcaccgaccagacatgggggaaggtggagaagagaagtcattcaatttccttcaagttttgctcgagggcagcatagccggaggaactgctggtgttgtggtggaaacagcactttacccaattgatactataaaaaccaggcttcaggctgctcgaggtggaagccggattgaatggaaaggcttgtattctggattagctggaaatcttgctggtgtccttccggcctctgcaatatttgtcggagtgtatgagccaactaaaagaaaattactggagacacttcctgaaaatctgagtgccggggccccttgctcggctccggccggccgcggcattgctcctccccgtgtccgagccaactaaaagaaaactactggagacacttcctgaaaatttgagtgcagttgcccattttactgcaggggccattggtggtattgctgcttcccttgtccgtgtccctacagaggtggtcaaacaaagaatgcaaaccgggcaattcaagtctgcgcctgatgctgttcgtctcattgtcgggaaagaagggtttaaaggactgt

SEQ ID NO: 9677 - DNA, 665 bp, Sorghum bicolor
  Clone ID: SORBI-28MAY03-CLUS37519_1
ctactgggaaacaaacgcacggcacgctggtttggttgcagcgcccccggccaagacgctgccgagagcaggaggcgtcgtcgcgaggcagcaaaggcaaaagagcggcagggaagacttgtgagccggccggccgcgcgccgagcgaaagatagcagccgagaacagcagcagcagcagcagcagcaggcgggcaacaacaacaacatgccgacgggcggcgtgttctccgggtcggtgaacctcaagtacgtgaagctcgggtaccagtacctggtgaaccacttcctgacgctgctgctggtgccggtgatggccgccacggcgctggagctggcgcgcctgggccccggcgagctgctctcgctgtggcggtcgctggagctggacctggtccacatcctctgctccgtgttcctcgtcgtcttcatcggcaccgtgtacgtgatgtcgcgccccaggcccgtgtacctggtggactacgcctgctacaagccccccgccagctgccgcgtgcccttcgccaccttcatggagcacacgcgcctcatcagcgacgacgacgagagcgtgcgcttccagacgaggatcctcgagcgctcggggctcggcgaggacacgtgcctcccgccagccaaccactacatcccgcccaaaccgagcat

SEQ ID NO: 9678 - DNA, 1366 bp, Sorghum bicolor
  Clone ID: SORBI-28MAY03-CLUS37682_1
gcacgaggctcaagggagctgcaaaaagcgccactccagtgaatgaggaagttcctcctttgcttgaaggcggtgggaagcttgaggtatggtgcattgatggcaatgctaagactgccctgccaaaagaggatattggaaagttttacagtggagactgttatatcattctctatacgtatcattcaggcgacaagaaagaagaatactatctcagctactggattgggaaggatagcttggtggacgatcaagtatcggcatctcaaataactaatacagtgtggaattcattgaaaggacggccagttctgggccgtatataccaagggaaggagccaccacaatttgttgctcttttccagcccatggttatcttgaagggtggaattggatctggatacaagaagctcatagaagaaaagggtgcgacggctgagacttattctactgaaggcatagctctaattcgagtatctgggacatctatccacaacaacaagactcttcaagttgatgcggtggcaacgtctttaagctcaacggagtgttttgtactgcaatctggaaatgctatgtttacatggtttggcaattctagcacatatgagcaacagcagtgggcagcaaaagttgctgaatttttgaagcctggcattgcagtgaagcactgcaaggaggggaccgcgaggtctgctttctggtttgcacttggaggaaaacagagttatacaaataaaaatgctcctcaggatattattactagagagcctcacttatatgcattctcattcaagaacgggagactggaggttactgagatcttcaacttttcccaagatgatttgttaactgaagacatgatgatacttgacacacatggtgaggttttcatttggattggtcagtgcgtagaatcaaaagagaaacagaaagcctttgatattggccagaaatacgtggagcatgcaaattctattgaagatctttctccatatgtaccactatataaagtcatggaagggaatgagccatgcttcttcaagacgtacttctcttgggataacacaaaatctttggttcatggaaattctttccagaagaaactctcactactttttggattgcggtctgagggtgcatctaggagctctggtaatggtggaccaactcagagggcatctgcattagcagctctatcatccgcattcaatccatcatctcaacaaaggctgtctaatgagaggcctaaaagcacaggcgatggacccactcagcgtgcctcagcactggctgccttatctaatgcattcaaaacatccttaaaacccaacaaaacaccacctccatctcgctcaggtcaagg

SEQ ID NO: 9679 - DNA, 637 bp, Sorghum bicolor
  Clone ID: SORBI-28MAY03-CLUS29901_1
tttgtctgcctccctgctcgcacagcagattcgccgagtttgcatcattaatacttattagggttgtaccctctctaccatctattacacccatcatagcatcgtctcttcatatacaacacaaacatttgcatgtcaagtgttacaagaacattattattcttcgggtccccggctgctgtgggccgctcctggctctgctcttcttgcgctgtccccccctcccccatgcattcaggttcaggcagggctgtcgagcctggtatctcatgtagcgtagcttgctgctctcatgtagtgtaagcctgctgcaacgccgcggcaaatctaactgtgtatttggctcgcgtgccccctgtgcggtgttgatccagtaattgggcttctgccactaaagaattttgtagtggttaattaaaatcctctaattctttgcaataagccgttggcatcgccacccaccagcctccctggttccgtatgctccttaatccaaccctccgtgcgggtgcccccgccgccccggcccctcccgttttggcgttccggcgcaaggggccagcggggacgggttcgctcctggtttggacagggttttcagtatcttaaaacaatgtctgagctgaatttgaacttt

SEQ ID NO: 9680 - DNA, 635 bp, Sorghum bicolor
  Clone ID: SORBI-28MAY03-CLUS29924_1
gtgcaccatgtaatgcaaagaactgcacctttaatggcgtctggaatggaggcggtggagctggccaggacaatctctacgttgcatccttcttctttgacaaggcttcacaggttggcttcattgacagtgaggcacccagcgtgaagtccaccccatcggcattcaaagctgctgcagagaaagtttgtttgctgagcgccgatgaagccaaagcagggtaccctgatctctatgatgtgccatacatatgcatggatctcatctaccagtacacattgcttgtagatggcttcggtttggctccaacgaaggagattactttggtgtccagagtgaagtatggagagtttgacgttgaggcagcatggcctctgggcactgccattgaagctgttgcacccaagaagatgaaccaggatgcataagctagctagtcctttgtaataatctctgatgagaaatcactctgtcatgccgatgttctgaaataatttcagtctagttcatgaggataaactttatcggatctaagactgatgatgagaagctcttctaagagagaataatgtagatcatttagtgtcctgcaaaacaagtcaacaagtccccattcatcttgagtttcatgattc

SEQ ID NO: 9681 - DNA, 699 bp, Sorghum bicolor
  Clone ID: SORBI-28MAY03-CLUS29928_1
catcgtgtgttgctgcggtaccttgttgagcgtgctattcatatcgaggataaagccggtctatcagatgctctacgcaagtggatcgttcagacatcctcggagccaacagcagctccactgatgttgcatatacaccatacagtcatgccaacaaatattgagttttgggaatgaaatcataatgttctggagaaaaaatatctgctggatgccacggtgttgtatattgcattaagggcgcttgattcgcccccctgtttgtatgagagagttgttttgatttcatttttccctgttctgtaaaggtcgccagcctagtagatagaatacagtgggtcatcaatatataaaccaggtgcctacttatatggcaggtcgtgtgcatcagcaagtctgaggatgtcataaagcgaatgtatcttctttataccatgactttcctggcgtcagatgttgctgctgctgcttaaaaaaaatggatggtgaattgccttataacttatgttttggtgtttgtcatgctaccactgccagtgccaggaaactgagttgtggacgtagtcgtctagtggaacaactgtaacaagatagcccctttattttccgcttggtcactctgctttaaattgttattgtatgtcgaaacactgaaaattctggtttaatcaatgaaactggaagcactatttcatttgt

SEQ ID NO: 9682 - DNA, 1402 bp, Sorghum bicolor
  Clone ID: SORBI-28MAY03-CLUS30017_1
gtctcgatgctggcggcggtgcgtcgccatacgcggggcggaggtggagccgcatgcgagcgtgtgcccgcccgcgtggcgtccactccccctccacgtttcggcgtcctcttcgccttcccgggaatctcctccagctactactgcccctccccttcgcttcgctccctggacttcccccgagcactgctactagtagtgccagcatcccttcaggtctctccgcccggcgcagacccgcagcagcagcacgaactggtgatctccgccgcgtccagcctcctcctccggtgatcggcggacgggcggggttggaaccagccgagcgcagcccacctccttccgctgctgcagattctcgatggacatggatggggttctgcaagccgcggatgccaaggactgggtatacagaggggagggcgccgcgaatctcatcctcagctacaccggctcgtccccttccatgcttggcaaggtactgcgggtcaagaagattttaaacgacaagtcgcagcaggcaccaagttgtatggtcttctcaagtcatgagcaactcctgtggggccatatcccagaattgatcgagtctgtcaaacaagattgcttggctcaagcctatgcagtgcatgttatgagccaacatctgggtgcccgtctgggcgttggtggccttccggttcgtgcttcccgggacttgctggggcttgttggcgaggatgctctgtgccgccgtcctgcttggggtgttattgcacgtgctttcggcttcgctgctgatgccgctcttctaataccagaccactctttattttctggtaatcctaagggtagcagctgcatagctgtagagataaaggccaaatgtgggtttctgccatcatcagaatatatatcagaagataattctatcaagaaacaagtaacgagatataagatgcatcagcacctcaaatttcatcagggtgagatatcgaagaccagtgaatacaatcctctagatctatttgctgagtcaaaagaaagaatacgcatggccatcaagtcatttttctcaactcctcagaacaacttcaggatttttgtgaatggatctttagcttttggtggcatgggaggtggtgcagataacgttcatcctgctgacacccagaagtgtattgaagatctcagcaaggttagtggcctagacctccctgacttcactgagctcctgtcagagacaattttcaaatctggggtattaggcaaactgttgaccactcaaaagctggacgatcatgacattgaaggggcaattcatctgtactacaacataatttctcagccttgtttggtctgcaaaaacctaactgatgtagagctactgcggaagtacactctcttgcattctcttccattg

SEQ ID NO: 9683 - DNA, 708 bp, Sorghum bicolor
  Clone ID: SORBI-28MAY03-CLUS30021_1
aaaaaaaaaaaaaaaaaaaaaccagcacgacgatttatcttaccttcgccccgcatgatgtcgccaacgaaagacgagatcggcgccacgtcaagctcaagcacggacgccgatggcgtcgccagcagaagcaaggcagcaagagacgtggcccgtggagcagtcgtcgagcttcctctccaccttaccgagaagatcctttgctgcatcaacccgctcgcgtcggctcgcctcgccaccgtctgcaagtcctgggcggccaccatctccgaccggctcgcacggcctgttccccacctgttcgtgtacctgccggctgacaacaagtcagatcgtcgcggccgcgtcgtttccgtcccgataggttacgacggggacgacgccggcgccggagccggagcggcgctcccggtgccggcggtgatcccgaaccgcgtgctcttggcagatacgaatggcctggcgtgcatcggcgccatgcccagtggtcatctggccttcgcgagttggtggagcaagatcttgttgcttatcaacccgatcacgggcgaccggcagagcgtccaagtggaggaaccacgccggagtctagttctggcggccggcggcggtgatgactccttcatctccgtcggcaccgatgaacacatactctggcggcggcgagctggcggcggcggggaggagtggtccaggtggacggaaccg

SEQ ID NO: 9684 - DNA, 732 bp, Sorghum bicolor
  Clone ID: SORBI-28MAY03-CLUS29274_1
ccacgccgctcgcctcccggccacatcctacttggtagtagggttgcggcctgtccgttccgagccgcccaccttgtgcggttcctcttgcagcgagggggatggactccaagccgaaggacgccaaggggaagctcgccaaggggaagggctagcacgcggccggcgcctccggcggtgacgccggcggcggcaagggaggcaagggcaagggcggcaagtccgctgacggactcggcacctgcacctacgtcaaagctaggcacgtattgtgtcagatgctgggcaacgtcaatgaagcttataagaacttccacgatggatggctggacaatggggacaaagtccctcctgctgagtttgctaaggtagcacaagagtattctgaatgcccatcagggaagaaaggtggagatcttggttggtttccgcgtggcaagatggctggccctttccaggaggttgctttcaacacacctgtgggagcttgtagcgcaccattcaagtccacgcatgggtatcactttatcctctgcgaaggaaggaagaactgatccagaagtgtgattcaggttggggagactgcatcatcatgctgtattatgcaaactactcgtcttctctaataagcgctggacatgtgtactttgtgttgggctattcgcatcccggccctaaggacttgccaaaacaaaagaatgtgtgttttgctgtaattaacatatgatactg

SEQ ID NO: 9685 - DNA, 936 bp, Sorghum bicolor
  Clone ID: SORBI-28MAY03-CLUS29255_1
cctctcccgcatgagcatacttcaagggttggaactgagattgagtacaagcaccagattaaaggcctgcctgtacagcttcacttctcctggtggccctacttacccaacacgagcggtgcggcatgcagcctggaatacattggatttgctgttccctatcggtcggtacccaaggcatgtgatcagcctgttcttccggctgctgtatccgtggtactggccttcctcttgctggaacttcgtgatgacctgtgccatgactgtctactactacatcctaaacctgctggtgtcaagttgggagaaactgaggcggcccagtcaccagagaaggcatggtgaatgaagacgtggcagcccaacaagtagcaccttgtgttgttgttgttgttgttgttgttgttcattttctttcgtttgcgcaagcagtgttgtagtaagttggccagcttatgcgtttgtccaaacagcatctcctgtataaactgctgtgtttgttcagttgttgatataggaagaggaacggatggtaaatgaagagagagcatgtgcgtttctggagtcgtttcttatcaggatctgcagtgtcctgcacccattcatctccaaaatctttggacggactatggacagactccagaaggattgcctagtggtactacttgctttgcgtagatggaagttgagttgcctcctgctgctttttgtttactgggttgctggataccagtcacactaatggctaattggtccaggcctttgatttatatttgttttggactgcgttgagcataacctgaatgactgtaaagatctggaggtacaaatcttctgtcatccgtttggaggacatggtctctgttgggattaagttgcttgctgccagtttttgtacctgctaccaagggaaagggtagtgatttattatattat

SEQ ID NO: 9686 - DNA, 660 bp, Sorghum bicolor
  Clone ID: SORBI-28MAY03-CLUS29306_1
ggatcatctgcctgggtacgatggatacttcatcatctccaacttgtggaaatttcagcatggtaaagattgcaacttcatcatacagaagcttatctcctttaagagatcctgatatcatgataagaaacttgccaggaccaacatcccccattccttcgacatcaaatcgcaggatcacagcattgaacccatccactgttcggatgaacatgtcgctgcctgtctctccctgctctagcccgctacggcagtacaggcagtccaaccgaagttgcttgccatcccctcctcacccagcctattcagctggagcagccaactacagtcctatcaacaatgcactctacccgatgcgaccaagcagcggtctcacagatccatggctcgaaatctctcggccgaaaacacaaacttttgattctccaagaagattgtagagattccaaaaagaatactttgtaggcagggaaaaagtgttccataatttatgttgttagaggaacaaaggaactctttttttttttttcgccctttctgtatgtatcttccacccaagatgcagttgcgtcgcctttgtacaaattcagagaagagctaggaaaaagagtcgcattcagagaagagctagtgaaaaagagtagctttcagatcgcaaaa

SEQ ID NO: 9687 - DNA, 957 bp, Sorghum bicolor
  Clone ID: SORBI-28MAY03-CLUS29420_1
gcacgcgcctctctctccagcgcactcttcctcctcactacccacctcagcagcctcagcgaagaaggccggccggagaagcgcatcgatccatggagttctacgtggacgagaagtggaagttctccaagaagagccggaacaacgggagccggcgcgtgccgggagccggaggagccggcggcggggactctctgctcaagagatcgtcaagcatgagggacgtcccggcgatcggccggcgcgggagcggtgccgccggcgccgcggcggcggcggcggcggcgggcgggtgcgcgccgcagccgtcgttctcgagccggtgcgcggggctggtgaaggagcagcgcgcgcgcttctacatcatgcgccgctgcgtcaccatgctcgtctgctggaaagactgctcgtagccgcggtagttccagggccggccgccggcgaagaagctccacccctcgcagtttctccgcctgccaggatcagagagtcagtcatggtgctggttgctgaagcaagccgagggacacgggggaaggaagaaggcagattaggtgatgtgtgtatagatcagtcttgattaggagtcctctttctctccttttttacctcccatttctgggacgttttcttggttattactagtactcgattaggtaagtagtagtagtaattagcacagtacttagtagctctgcgaggtagatgtggaatcgtggacagttttgggatccccttcttcaaggggaatggggatctgggttcttttacagctgcagtgctgcaaaggagctagcaccgcagggcgcaggcaggcagctcgcagctgaatgaaatctagtggatcttcttctgttgtaccacgaccacgaccacgaccacggtgaaaacaaggttgtcactgcccatgtatagctaaagaaatcagacgcaacagcatgttaagatgtcaccgcg

SEQ ID NO: 9688 - DNA, 619 bp, Sorghum bicolor
  Clone ID: SORBI-28MAY03-CLUS29422_1
cagatcatcaagtaagcaacctaaggttatggagggcgagatagagattgaggatgatgccccgatacgtaagccatctttggaggaaattgatgctttggaggaggctcgccttgcaatcgagtacattgttattccaggcggggagccagttgagctcctcccaagatgttcagaaatagttgctcgccagctggagcttgtagagagctatcagctacttgctgaaacctttggaagtgactccaatccgaggttacagattctccccgtgaaaataaccaagaagggctctagtaaagacaatggagtatcaaagcccactaagcaaaccggatcagatttgatcgtcagtgagaatggcggcggctcaagtttttctcggctgccctttctgccaaagtgacccgtctagattcagattgaccttccgatcaccactctcggaaatgtgcatcgttcctgcccctcattgttgctcttattgtacagcattgtgcagtgttgtaaatagtgttgaatgttgaagaagcgaaagagcaaagctaactggcattgccttccattcttttgctggaataaaacccgttcatttttggggttttagccaggtcagctc

SEQ ID NO: 9689 - DNA, 1417 bp, Sorghum bicolor
  Clone ID: SORBI-28MAY03-CLUS29307_1
agagctcggcggcagcagcatgcctgcaactgcaactgcaactcctcccctctctccctcctcctccccagtgtgctgatttgctcctgtcacctgtgtgcttgtgtgtgctagctaccatcgctggccgccaatggcgaggcgtgagctgttcctcgcgctgctgtggctcgcggccttggcgctggccaccggccccgctgacgcgacgaggaagatggtcggggtgtacgagctcaggaagggggatttctccgtcaggctcaccaactggggcgccagagtcatgtccgtcgtcctcccagactgcaaagggaatttggctgatgtcgtccttggcagagacaccatcgctgaatacgtcaacgatgacgtgtacttcgggccgataacgggccgcatagcgcagagagtagcccgcggccggttcgtcctcgatggcaaggtctaccacatgcacaggaacgatggcaggaacacgattcacggtggtgacagaggattcagcagaagcatttggacggtgaaggagtacgtagccggcggcgagtcaccctacatcaccttctactaccgtagctccggcggagagcaaggtttgccggggaacgtggacgcgtacgtgacgtaccgtatgtcggggccctacacgctgggcgtgcacatgaacgcgacggcgctggacaaggcgacgccggtaaacttcctgctgcacgtgtactggaacctgcgcggcgaggggaacggcgacgtgctgggccacacgctccggctgcacgcgtcgcggtacgccgtgctggatgatgagctcctcccgtcgtcggggcgcatcgagcccgtggccggcacgccgctggacttccggacgccgacgccgatcggctcgcgcatccgccaggtcgtcgtcatgggcggccgcgccgtcgggtacgacaccaactacatcgtcgacggcggggaagggatgatgcggcccgtggcgcaggtccgggaccccgcgtccggcagggcgttggagctgtgggcaaaccagccgaccatgcagctctacacggggaactttctcaaccacaccaagggaaagcgcggcaaggtgtacgacaggtacgctgggttctgcctggagacgatggggtacgtggacgccgtgaaccaccctgagtttccgtctcagacactcaggcccggccaggtgtacaagcacgatatggtctacaagttctcgttctaggtgatgcacgatgtaaaacacagttcaccattgttgtgcgcgcgcactcggggatatctgtgcgttattggtgtttgacggaggcgaataagagggtttgacgagtcgttgtttcattacaccctcataaaccacgcacaagcgcatgcggacatagtatatgcagtaaggtcactcagggcactc

SEQ ID NO: 9690 - DNA, 721 bp, Sorghum bicolor
  Clone ID: SORBI-28MAY03-CLUS37684_1
gcacgaggcacgaataggaaagagaggaatcgcggaaagagacgcatcgacgtcgacgtcgacggcgacgctggtttaagccctccttcgttgctcgaggtaggcttccttctcccctcctagagacggcattggttggtttgccgggggccgatggcggcggaggcgaaggcgccgctgctagaggaggcgcggaggggcgccacgccggcgcagaccatcggcaacatcgtcgtctccatcgtcggcaccggcgtgctcggcctgcccttcgccttccgcaccgccggctggctcgccggcgctctcggcgtcgctggcgccggtgccgccaccttctactgcatgctcctgctgctggaatgcagagacaagctgcgagagcaagagaccgaggaggacggcgagcagcaccagcgttgctgcaactacacctacggcgacctgggcgagaggtgcttcggccggatcggcaggcacttcaccgaggccaccatcatcctgtcgcagacgggcggcaccgtggcgtacctagtgttcatcggccagaacgtgtcgtccgtgttcgccgccgaggacgggcacggcccgctgacgccggccaccgtggtcctcgcgctgctgctgcccgtccaggcggcgctgtcgctggtccgctcgctgtcgtcgctcgggcagttcagcatcctcgccgacgcgtgcaccgtgcttgccgtggcca

SEQ ID NO: 9691 - DNA, 799 bp, Sorghum bicolor
  Clone ID: SORBI-28MAY03-CLUS30464_1
gcacgagggatcgctcgaagctgctctcgtctcggtggggagtggcgagccgcgaccgcgagtccaagtggcggctagggttttacgacctctctctctctctgacttctttccactccgcctcgtcttccttccacctccgtctcaaagtctaaaccctagactagactacctctcgcgtcgattacgattcacccatccatggcggtcacttcgccggcgtggttgctctaggttgctgattgaagggttggattggtgtttccggtgatttgtgagtggagtttgaggccaggaggggagagggggggcgccatgggcacgaagaaccagttcgatctcctcgtcgacgtcgacaacgacgacccctcccacctcatcgcggccgccgagaagaaggcggccgcgtcgcccaagccggcgcccgccgccccggccaagctgcccaccaagccgacaccgcccgcgcaggctgtgaaggagtcgaggaactatggcgctccagctcgtgatgggccaggacgtggtagaggtggcttccgcggaggcaggacgggcccaaggcgtgaatttggtgagggcaatgccaatggtgttgagggaggttacggcggtggtggttttggagatagtggcttccagcggagagaggaaggtgatggaaaggctatggaaagaggccgtggaccacgtcagccttatcgtggtggtggtcgccgtggtggctatgctgatggtgaggctggtgatgagtctgctcggccccctcgccgggcctatgagcgccacagtggcacag

SEQ ID NO: 9692 - DNA, 821 bp, Sorghum bicolor
  Clone ID: SORBI-28MAY03-CLUS30474_1
gcacgaggccctcggctcccccgacgcccggctaggggctcgccgccttcccgccgcctccgtccagcgagcgagaccgagggctagaggacgagcggtgcttcgccagccatgtcgctgcgcccgagcgagcgggtcgaggtgcggcggaaccgctacaaggtggcggttgacgcggaggaggggcgccggcggcgcgaggacaatatggtggagatccgcaagaaccgccgcgaggagagcctgctcaagaggcgccgcgaggggctccaggcccagttccctgcccctccctccggggtcgagaagaagcttgaaagcctcccagctatggttagtggggtttactcggatgacaataaccttcagcttgatgccaccacacagttccgcaagttgctctctatagagaggagcccccccattgaagaagttataaaatctggtgtagttccaagatttgtgcagttcctcaccagagaggatttcccccagctgcagttcgaagcagcatgggctctcacaaatattgcttctggcacttcagaaaatacaaaggttgttattgatcatggggctgttcctatatttgtgaagcttcttgggtctgctagtgatgatgttcgtgagcaggctgtgtgggctctggggaatgttgctggtgactctccgaagtgccgcgaccttgttcttgccaatggtgcgttgatgcctctgctagcccagttgaacgagcatgctaagctctccatgttgaggaatgccacttggactttatctaacttctgcaggggaaagccacagccatcatttgatcagac

SEQ ID NO: 9693 - DNA, 563 bp, Sorghum bicolor
  Clone ID: SORBI-28MAY03-CLUS30524_1
gagacagacagcgaggcttccagcacgaggccgaacccacgagctccgtccattccgctcgcggctacctccggcctccgacctccgcccaaaacccaatccagagccaggccaaccaaaccctaggcaccccgcgccacgcctcgcgcgcgcgtggcatccatgggctgaccgcgtcgcggtgggggagccccggatccggagctagggttccgccggtcctcggcggcaccgccatggagtgggacagcgagtccgacggcgccggcagcgtcggcgccggcgaggaggagcaggagcaggaggaggaggaggaggagcggcgaagcgagggtggaggtggcgacgccgggggtgccggtgggatgttcacgttcgcgattgaaggcatgctgcgcgcgtccgggccgtgcgggctcgtcgtcaccgacgcgctcgagcctgactgccccatcatctacgtcaaccgcggcttcgaggaggccacgggctaccgcgctgaggaggtcctcggcaggaactgccgattcctgcagtgcagaggaccatttgctcgaaggagg

SEQ ID NO: 9694 - DNA, 740 bp, Sorghum bicolor
  Clone ID: SORBI-28MAY03-CLUS30575_1
gcatgcgcgccaagatcgccaacttcggcctcgccaagacgggccacaacgccgtcaccacacacatcgtgggcacacaggggtacatcgcgcccgagtacctcgccgacggcctcgtcaccaccaagatggacgtgttcgcctacggggtcgtcctgctggagctggtgtccgggcgcgaggccgcggacgagagcggcgagccgctgtgggcggacgccgaggacagggtgttccggggccgcgacgagaggctggaggcccgcgtcgcggcgtggatggacccggcgctcgcggagcagacgtgcccgccggggagcgtggccagcgtggtcagcgtggccagggcgtgcctgcacaaggacccgtccaagcgccccagcatggtggacgtagcctacacgctgtccaaggcggacgagcacttcgccgactactccggtgagagcgtgtcggttgacggcagcggcgacatcgctgctcggtgaaccatccttcgtttggctagcactcctactcactagtaataggtttcttagtcatcagttcgcgttgtacagtaaatgttaaaggtctagcgtctagcgagcgggggacgagtcagcagtgagtatattgaataataacgccggcattctgcgagcctgcgaggttcgtgaaatctatcgacttgatgtgtatatatactcttatatagtactattatgtaaatgaggattaatccgtgtcttttttttgcg

SEQ ID NO: 9695 - DNA, 666 bp, Sorghum bicolor
  Clone ID: SORBI-28MAY03-CLUS30598_1
gtaaaataggttacaacagcaagcttagcacactttggtttgctgttggcattattgtttactcattggaggccacaatcagtgtgcgagttagtggtgggtcatggcaagatggttttcatgcccagattgcagcccatacagtcagtataggttgcgaggaacttatcttacttgattctggggatgataatgtgcctgttgctggtgacggtgctatcacgctctcacgttgtgtagcatctgttgaagtgaatggggagcttgtggtttctgtcagggcatggcaaggtgatgaagttgtgcacagagagaggggtttcaaacctaagaaggctggaagaagttgtgggactcttgacattggcttctgccaaatggatgtctccgtggcctggtcgcttgtttcctcatatcggggggagtggtgatgagagcagcattttccttttgtttcagacagtaagtcgtatgctaaaagaaactcgtcaagagtcggtaactgtggccgttgcttcagatgcggaattatgtatcatgtaaactctcggatatgctttcttggtttcgaccatgatatgcttgcacttcgatgccatgtcttataagctgtactttggtcgcatgtcttataagctgtattttttttgccagttaatagtgttc

SEQ ID NO: 9696 - DNA, 736 bp, Sorghum bicolor
  Clone ID: SORBI-28MAY03-CLUS29629_1
aggatcttgattatatagataagctgctgcggttgattgaaaaggaagagatacccgcacctggacctattgagcagcgttggactgcccgcagcaagagcccaatgagcccagcatcaagctctgaagaagaagacatattttcatgggttggtattataatgtacctgccaacatcagatgctcgccaaaggaaggaaattacagaggagttcttcaactacaggagcctggctcaaagtctctgggatgattattctgcctatgaacactgggccaaaattgaggttccaaaagacaaggatgaacttgctgaagtccaggcccggttgaggaagcgtttccctgtggatgcatataacaaggcacgtttggagctggacccccacaaggttctctcaaatgcgaagctagagaagctgttcccagtgttggagccggttcaccaaacaaagtagcatagagcaaagggcacataaacttcgttgcagaggcttaatacatccacatttgtaacactgctcctatcatgattctgtgatcctgtcaaatgagatggtgattaggatttgtcactcgaaataaagtagaggaaacaattgatgattcaatctgtggcagcagctagcactggaagcaaatcatgttgctcctggtgaatttcgtcctctgactgagaacacctaaaaatgggttcatccaatcaattaatcatcaaatcagtaaattctcggtt

SEQ ID NO: 9697 - DNA, 603 bp, Sorghum bicolor
  Clone ID: SORBI-28MAY03-CLUS29735_1
ctgccctggattcccagacaatgtgaggacgaatgagaagggcgagttttgggtggcgatccactgcaggcgaagcctgtatgcgcggctcatgagccgctatgtcaagatgaggaagttttttctcagcctcccgatcccggccaagtaccactacctgatgcagatcggtggcaagctgcacgcggtgatcataaagtacagccccgagggccaggtgcttgacatcttggaggacaccaagggagaggtggtgagagctgtcagcgaagtggaggagaaggacggcaagctctggatagggtccgtcctgatgccgttcatcgctgtctttgacctggcgaaggcgtcttagccgcctcagtttgattggaaatattgttgaatatggagtccatggttactcgctgtacgcttctctgagatgatcagcgatcccaataatttggtcctgaagcaacctggagctgtataatgctccagcttcttttaattgcaaatgtaagttgttgacatgttctctagattgtgactagaactatgtacgaacccctcctgcttctgaatccagaattccccgatgtgcttctggagttttgtttt

SEQ ID NO: 9698 - DNA, 728 bp, Sorghum bicolor
  Clone ID: SORBI-28MAY03-CLUS29770_1
gcctttgcatgggcatttgacagtcctcccaagggccagaagcttcatatctcctgcaaaaacaacagcaaatttggaaagaaatcatttggtaaagtgacgatccagattgacagggttgttatgctggggtcggtcgcgggagagtacaccctgctacccgagagcaaaagcggccccaataggaacctcgaaatcgagttccagtggtcaaacaaataactgtatacctacataatttaggtgttctctgtaagttaaagatctataagaggttgagtggtttcttgttttgcactctgctaaaggtataccctgtttgtgcatcattgtaaatagcaggcagagaaagttgtcgtttgctgtacctcctgtgagatataaacagatgagttttcagatgttttgtactgattgtaacaggcttcattcgtttattttttttaccctggaattttgtctttgtaaaggggtgtaaacagaacaagtatatgctgttattaggttctctcatccggaatggactttgcggtctataaccagagcatgtttatttgccatgtttgttcattttcggatgtgtgagaaacatagaatgctgattaagattactgaattacatcgaatactattatattttttttacaacagaacactcttatagttgattcggtttgtgtatgttatatatcggcattggatgcacattcttttgagtggcaagattc

SEQ ID NO: 9699 - DNA, 1254 bp, Sorghum bicolor
  Clone ID: SORBI-28MAY03-CLUS29835_1
gcacgaggcagagaaattgtattgatacaatcagaatgtggcgaatgtatgctgtgtacaattctctccatactcctcccgcatgctagcttttggttcagctgattacaagatatactgttatgatctgaggaacacaaggataccttggtgtactatttcgggacatggaaaagctgtcagttatgtaaggttcttggatccagaaacacttatctctgcatcaaccgacaacacattgaagatatgggatcttaaccggactaattgcagcggattatctaccgattcttgcagcctgactctgaatggtcataccaacgagaagaattttgtagggctatctgttcatgatggatacataacttgtggctctgaaaccaatgaagtgttttcttactacaaaactttccccatgccaataacttctcataggtttggttctattgacccgataactggacaagtaacaaatgaagacaaccaacaatttgtgtccagtgtttgctggagagggaagtcaaacatggtagtggctgccaactccagtggtagcatcaaagtgcttgagcttgtgtgaatgatccaatgagagtcatattggagaagaaggttctagggttgccatgcgggcttgtgatgctttcgtgcccttggtgatgctctgatggccctccttatccagtgtctgcatcctcaaaggaagcactaagcactggttacctttgctaggtctgcgtttcactgttttgccggggcactaaaagatgcgactgcactatgcaagcaaactacaacaccaatcattggttattggaagctttgcttgaaactcccaagcaaaccaaagaaattttcaggagtatgaaggcctcacctctatttgttgtgtttgtaaatctctgtggcattttgacacagtacctattcaacctttttaaggagggccccaggtctgtacagaattaggggccctggggctgatgaaatataccatgcaaacttcttttcggctagagaggctgccgtggtgccttactcaatgggaatttaacccagttttgatgtgcgctggacttgctatgactgttgagaggaaacaatggaaagagagaaaaaaaatgatcctgtagctcgaagaagttaatcgtgagaatgtgtctaataattttatattcccctttattattgtacatatatctagggctgcctaatggaaggctttgtaagttgtaactatagtagaatgctcaa

SEQ ID NO: 9700 - DNA, 1019 bp, Sorghum bicolor
  Clone ID: SORBI-28MAY03-CLUS2988_1
gtcgcctgatatctccaagctcgggttgttctggcacttcctccccattccctgaccctgagatgctggcttcctcacgcagcgctttacactcgttcccagttcgtgagccacctaagatattggatggtgagggcgttgcaacacagaagttgatacctcgccatatgcgcaatggtgggtccctcttggatggccacatcacagcagctgtaccagttgttgacttctctgcccgacttcaacccaatgagcatgctatggatcatcgggtatcgtttgagctgactgtcgaagatgtcgcacgctgcctagagaagaagactgcaatttctggggattccggcacggcatctttccaccttgcgcctaccagcaatggtgatcaccacagagaatctaatgaggcaagggcagggctatacgttgacgaaacataccatgacttgcctgagaaagcaaggcggtccctatccctgcgcctggccaaagacttcaacttcaacaacgtcgacgttgctaatgtggagccaagcgtgggatctgactggtgggcgaatgagaaagttgctgggatgacatctgagccaaaaaagaactggtccttccacccggtggctcagcctggggtgagctaacctttgcactgaccataataatcttttacaggatgaatcaattagcttcttttacttctgcttgagtgctcgattcagcaggtatgactgtgggggggatgccaacttgtgctaaacatgcagttagtggtaattctaaatttagatagtataagtaatcggatgtccgtctaatatcgtcatgggatactaaaggtttattctggggggtgtttggatgtaacaaaccgcaaactctttggtttagggtcggtcggaactgtctgtgtgtctcttgtatcctgtgtatgtactgacttgtcgtcctgataccggtgctgtgttgtgtatgtacataataaagtggttttaagttaaaagggtacaactctttcctttgat

SEQ ID NO: 9701 - DNA, 753 bp, Sorghum bicolor
  Clone ID: SORBI-28MAY03-CLUS2976_1
gccggccggttcgggaggaatcaagctagcgagcgggttgcagtccgccatggccatggtcgcgtccacctcgttcacgtaccacaagccgcgtctcgcggtggtgtgcaggaagaacaaggacggccgggacagggagcgggagcgggacggcaaggagcacaagcaccccttcaaggtcgtcgagatcacgccgccgccgcggtgcctcggcgtccgttgcttccccaccgttggttgtacatgggcggacggggcgcgactagccaagcaaacatccactgcggcgagagcgtgacgatcgaagggcaggcgtacacggtgtcggcggtgacgcaccggtaccagctgcgcaaggggcggtacgagccgagcgagaagcgcctcgacgtcctctccaccggcagatacatcctcaacctctacctccaaaacctgctcgaccagtcctagctaggcagctagtagtagtgccttagctactgcctgtctgtctgtatctgtgtacatcagcatcgcttcatcactctataattctaccacgctactgtatatatagctatctagctgtaaataacaatcaattggttcggctagcaaaaaaaaaaaaaaaaacctcctgctatgtccatcgaacacttgtcccagtgggtggtggacgatcatggccgatcatgcgtgaaggggatagtgtttccctgcgtgcggctctgtgtaactgaaaaggctagattgaggcataaagttcagtat

SEQ ID NO: 9702 - DNA, 454 bp, Sorghum bicolor
  Clone ID: LIB3480-030-P1-K1-A4
cggacgcgtggggccgggggcatggatggcgacggacggacggacggacggacacgggctacgccaagcagaacatccactgcggcgagagcgtgacgatcgaagggcaggcgtacacggtgtcggcggtgacgcaccggtaccagctgcgcaaggggcggtacgagccgagcgagaagcgcctcgacgtcctctccaccggcagatacatcctcaacctctacctccaaaacctgctcgaccagtcctagctaggcagctagtagtagtgccttagctactgcctgtctgtctgtatctgtgtacatcagcatcgcttcatcactctataattctaccacgctactgtatatatagctatctagctgtaaataacaatcaattggttcggctcctcctgctatgtccatcgaacacttgttccaagtgggtggtggcgatcatgggcgatcat

SEQ ID NO: 9703 - DNA, 750 bp, Sorghum bicolor
  Clone ID: SORBI-28MAY03-CLUS3090_1
cgtccgatcaagtggaactaagttatgatggaacccttcttgatgctgcaagcatggcagcaggagtctcttctcccaacttttcagcgccagccaagtggcaacaagatatattgtcacagctaaatctgcatggagagggtgccattttaaaggtaagcttaggaggcccagacattgttgatggacgcttgttagctgctctaagggtgcttcttgcggatgatccagaggctttgcacaagcatgacctgaaaacactgatgtcccttgatgtgcaagctcctttaggccccgctattgaagcatcagcactccgaacagttcttgccctttgtgcgattgctctccaacacttccacacaaagataatggacgacgaggccattctaagaggggggccacctcttaccacagagctggccgtccagtttagattgcagaagaagttcatgatcgttgacgttatgcagaatgtcagcaggagaatcaagatgctatcgccgcagaaatccaccgcgtagttctttaatttgtcatcagacaatcagtaccactctgtactggctactgcagataacacaagccccagttttgattatgtagcatattcttgtcatcctacttccaatgcctgacattgaaaagatacatctgcatgaatctaagggtgtgcagtgttttcatcgaacaatcaatactttcctctactgattactgcgtataataataagccccaatttgacgcct

SEQ ID NO: 9704 - DNA, 735 bp, Sorghum bicolor
  Clone ID: SORBI-28MAY03-CLUS30905_1
gcacgagggcgcggtccaacccgggcgcctggctcatcgtgcgcgccgacaccacggggtcctcggacagctggcagccgtggggtcggctggaggcgtggcgcgacgcggcggcggcgagcggcggcaaggacacggtgcgcctgcggctgcacctgctcccggaccgccacgacgactgcgtgctggtgtcggaggcgccactgagcagcgacaagggcggggagttcttcatcgacatggacaggcaggcgccctccgccacggcggcggagcactgcgcggcgagccttggcgccgcgtgcgccggcggagggttcgtcatgagctgcagggtggaaggggaggcgaggagcagcaggccgttcgtgcagctcgccatgcgccacgtcacgtgcatggaggacgccgccatgttcgtcgcgctcgccgccgcagtcgacctcagcgtcaaggcgtgccgcccgttccggaggaagccgaacaagaaggctggctcgccgtcgcccgaccttctcgagctcgacacgtaggaacacaacagcacagggacacaggagacgcccgcccgccgactagcatccatggccgggggccggccatgcatccatctaactcgatctgtaaattcacttaatttcaaagagctggaccggaccttttgcatttgcagcaatgcaaaactctctgttgtttgattgacgccttgtttagatgcacccaaaaagccaaaac

SEQ ID NO: 9705 - DNA, 810 bp, Sorghum bicolor
  Clone ID: SORBI-28MAY03-CLUS30938_1
cctcccccggcgccgttcgccgcgggcgccaccttccccctctacgcccccgccccgccgcggctggcgcgggcggcgcacaggccgcgccccggcggcggccccgagccccccccccccgcggcgccgggcgcccggcgcggcgcggcccccctcgacgccgcctccgcggcgggcctcgcgggcgcgagggtccgcgcgcccccccgccccgagcagaatggcggcggctgcgcgggagcgggagcgcggcggggcgtggccgacatcgaggtggccttggcggagagccacgcgaacgtgaaggtgctcgcgccgcggcggccgaggcagctgctgaggatggtggtggcgctgcagtgcctcggcctcacccgtgctccacctcaacgtgaccaccaccgccgatcacctggccttttactctctcagcctcaagatggaggatgagtgccggctgtcgtcggtcgacgacatcgccgccgcggtgaacgagatactcgccaagatctccgacgagtgcgccgccagtcacttattagctgcctagctggaacactacattatcttagcaagtgtcatgtatgattgtaacatcaatgtgatcctagtacatggataacactggcaacaagtggcaattcgcgccactgtcaggcaggctaggcggtactaccactcctccatatgtttgcgtgcaagtaaacatgtaccgattggaccagcttacgtatgtagtctttcgcagcgcagagtactgtacgtatttgtgtgtatccagaattcagattcacatctcgcatcagcgcc

SEQ ID NO: 9706 - DNA, 939 bp, Sorghum bicolor
  Clone ID: SORBI-28MAY03-CLUS30942_1
gcacgaggcaaaggaggattttcatgaggctggaagcaaagccttaagcttgtttgcatatggacagaaagtggccttagagaatggattaattctggttgacacaaagtatgagtttggaaaaacagctgatgggacaatcgtgttgattgatgaggttcatactcctgactccagcagatattggattgctaattcatatgaagatagattcaaatctggcctcgaacctgaaaatgttgataaggagtttttaaggctttggttcaagaacaactgcaatccatatgaagatgcggttctgccagaagctccagaagagttggtttgtgagctagcctggcggtacattttcctgtttgaaaccatcacaaagacaaaattcgagatcctggaaacacaggaaccaattcatgaaaggatatcaaggaatgtcgctcaagccttactggacctatgattgctgataggggatcctggggcagagtttgctgtgaggcgcatttctggtaccaatattcccgtgagaatattagtatgcgcacatgccatatatccgtcatgtgaaggttgccattgcggcttgatgaagcagaactatccacatttcttcatgatctgtgattgatgaagcagaactatccacatttcttcatgatctgtgatgtaatgtggtaataaactccaactagagctggttgtgtttatgtgagcaaccgccatgctctgttggtgagatttgccgtgtttggagcatgaggggagataaatagagaaattcagacagacagatgcggtatgcatacggatcttcctctaatttcctggtgtcagtgtaacgtttggcaagtggttgagctgagcagccatcacgctctagaaacatatctttctgaaatgaaaagaataaattgcaaataaccattcgaacagttcatt

SEQ ID NO: 9707 - DNA, 1002 bp, Sorghum bicolor
  Clone ID: SORBI-28MAY03-CLUS31038_1
gcacgagggtcggccttcccgacggagttcttcgatagggttgaggccatcaagcctgtctgggctccttactacacaatccacaagattatgcaaggccttcttgatcagtacacagtggctgggaattccaaggctcttgacatggtggtaaacatggctaattatttcagtgaccgtgtgaagaatgtcatacagaaatatagcattgagaggcactgggaatctctcaatgaggagactggtgggatgaatgatgtgctctatcagctctacacgataacgaatgatctgaagcatttgacactagctcatctcttcgataagccatgctttcttgggctgcttgcagttcaggctgacagtatttccggcttccattccaacacacacattccagttgtcatcggtgcgcaaatgaggtatgaagttactggagatcctctttacaagcaaattgcatcattctttatggatacaataaattcttcccatagctatgcaactggtggcacatctgctggtgaattctggaccgatccaaagcatttagctgggactctgagtactgagaatgaggaatcttgcaccacctacaacatgcttaagatttctcgcaacctattcagatggacaaaggaaatagcatatgcagattactacgaaagggcattgataaatggtgttttgagcattcaaagggggacagatcctggtgtgatgatttacatgctaccacaggcccctggacactctaaggctgtgagttatcatagttggggaacaaagtacgattcattctggtgttgatatgggacaggtatagaatccttttcaaaacttggtgattctatgtactttgaggagaaagaagatttgcctgcactcaatatcattcagtacataccaagtacatacgactggaaagcagcagggcttattgttactcagaaagtcaacaccctcagctcttctgaccagtatcttcaaatttcactctcc

SEQ ID NO: 9708 - DNA, 734 bp, Sorghum bicolor
  unsure (1)..(734): unsure at all n locations
  Clone ID: SORBI-28MAY03-CLUS30213_1
gcacgagggccatattgaaagctgcagagcttgctgcagaggctgtgttcaccagcaggaaccattattggaatgggggaaccacttccttttaccctaagagagcttttggaagctgggccgaatggctattgcacgtcggcgagtgtgaggaataaatctggaagtggtaacgataatccagtaacagaaacattggaggtagatgcaactgctaactttaacaaatctggcagaaagcgtggtcggaaacctaaatgtgatcaagcactaccaagttcggagccatcttcaagctgcaaagaattacagccatctggagtacatccaggacatggggttgttgaagatgttcctgtcactgtgtcactggatggtaacaatgttacagcaccaataagcattatctggaatggcattgaaaagggatctgcagttgaggttttatctgacaagtgtgggtttggagtagcttggttttctgctaaggttattgatataaatgcaaataatgcttttgtcaactatggtgaccacaatggaactggtcctggtgaagaatgggtgccattgagacaagaaggggataagccgcctcggatacgtctcgcgcaccctgctaccctctctaaattcaaaactaggaaacgacgcanggaaacagcaggcagttgtttatgggttattggagatcatgtagacgcttgggtcataatagctgttggcgagaggga

SEQ ID NO: 9709 - DNA, 961 bp, Sorghum bicolor
  Clone ID: SORBI-28MAY03-CLUS30251_1
gcaccggcatttgctcgcgttggtacggtatctctggccatcccgagctcccttcccgtgacagcgacagcaacatcaacggcttccgctaccccacaaaacacctcgccgccctgaaattcaccgcccgatcgagctcctcatcagtcatcacgaatcaccctcgtgaactcctgcccataacctccggaatctaactcctcagttcacgattcgacctcttcgccctcgcccctcggatcgagcttttccctccaccgaatcgagctcttccaccatccgaatcgagctcattgccgccggatcgaggtgtctgcgggacgagctcgagctttggagaaggaagaggaaacgggggagcaaggcgaccaaacgggtggagggaaacacgccaaacaggcttccgcattcggtgtcccctccttgacaggtgcccgagtccgagcccgcgcccgcgccgagctccagcctcatttccacggtccacgccgcccactcttccctctcccaatcgtcggcctcctccttgtccgccccctccttccttcttcccactccactggcttcggattggagtgcccgacgtggagcggagacctacccgaacaggggatcgattcttctagtggtgttacagcatggtgtttttgacatagcaatggaatttctcatgtatcacttctgaagttaccttggaaagcctctgcacctctgacgggtcgtgttgcataagccattgttgagaggagatttggcctaagaatgggggctccaaaacaaaggtggacttctgaggaagaggctgctcttagagctggaatagcaaggcatggagttggaaaatggcgcacaatattgaaagatccagaatttagttccactttgtgctaccgctcaaatgttgacctcaaggacaaatggcgaaacatgaatgtaattgtcagtacatcgagttctcgtg

SEQ ID NO: 9710 - DNA, 1049 bp, Sorghum bicolor
  Clone ID: SORBI-28MAY03-CLUS30356_1
gcacgaggcaattcagtcgtctcggaacaaattcttcttcgtgggggggcaagaacctgatttccactgcccctgacaaggtttttgccgccgtggacggtaggttcttgctgtggtcatttggtgagacaattgcggggtgaaaaggagccggaaaaagccgtagaaagacggcaatttttgtccatagtcagaggcctgattgttctgttcttatccccgcgggcgagcgatttgaccagcttgccgtctccgcagcaggccatccatccaccgccattcgcacatccgccgcctcgccgcccccgccggtcccgtcgctttgctttgtcaaggaacagccgtatcgttgccgtcgaccgctccaggcctccagccacctcaggtttaagtctgagttgcttcccttattgctgggacagtcaaccgcagcgcattcatggaggattggatgcttccctcacccagcccaagaacactgatgccaagcttcttcaacgaagaattcagctctgctcccttctccaacatcttcagtgatgatagaagcaacaaacccctggatgaaatcgagaagagtaaaactttcattggctcgagtgctcaagaaacctctcaagatacgaaagaccatccacagactgaatcaaaccttttcagcgcaaatcagaaatcaacctctccaggaggtcttgcagagaggatggccgcaagagcgggttttggtgtcctgaaaattgacacgtcccgtgtcagttcatctggtgcaccaatccggtctccggtgacaattccacctggtgtgagcccaagggaacttcttgagtcaccggttttccttccaaatgccacttcgcaaccttctcctaccactggtaaattgccattcctgatgcctaataattttaaatcaacaatgccgtccgtccccgagaagtctgaagatcactcacatgaagattctgcgttttccttccagcccattttgaggtctaaaccatcaaccttatggactgcaaagaagggatcaagtgttggtcaccaaaccc

SEQ ID NO: 9711 - DNA, 607 bp, Sorghum bicolor
  Clone ID: SORBI-28MAY03-CLUS30408_1
agcgcacgagggtggactcctccccccacaaaactaaaccctcgcttcggaggcgcggaggcgcgtgagcgcgagaccgagaggcggacaaagcgaggagggccctgaatcccctgctgcaacgaccgacgctgccggcgatggcgtccatctccggcgcggcggcgccgccatcttccgcggcgtgccggctgcggctgctgccccggcacctcctgctccggccctcccacctccgcctcctccgcgcgccccactccatcgccgacctctcccgctccagctcctccaattccgccccgaccccggcccagccgctgccggagaacggcagcggcgtccgcgcggtggagaaggacccgatcaagctctgggagcgctacgtcgagtggctgtaccagcacaaggagctcggcctcttcgtcgacgtcagccggatggggttcacggacgacttcctgcagcagatggagccccggatgcagcaggccttcgccgccatgcgggagctcgagaagggcgccatcgccaacccggacgagggccgcatggtcggccactactggctccgcgacccggccctcgcgcccaactccttcctccgcaa

SEQ ID NO: 9712 - DNA, 854 bp, Sorghum bicolor
  unsure (1)..(854): unsure at all n locations
  Clone ID: SORBI-28MAY03-CLUS30462_1
gcacgaggctcgaggcttcggaaccgagaccaccgcgccacgcaccgaaccaaaccctaccggtcgcggcttcccataccatcccgcggctaaaccctagccgtactcctcgccgccggcgaccgccgccatgagccgctacgacggccgcgctgcggacgcgggctcttaccgcgaccgccgcagcgagggggcgttcggaggcgggtcgagggcgttcgcggcgccgagcaaagcggacgcgtccgcggcggcctcggagctcgatgggctgccgcgcttcgagaagaacttctacgtggagtcgccctcggtggccggcatgacggaggaagaggtggaggcgtatcgtcgccgccgggagatcaccgttgagggccgtgacgtgcccaagccggtgcttgagttccgtgatgttggcttcccagaatatgtgttgcaagaaattacaaaagctggttttgtggaacctacacctatccagtcgcaaggttggccaatggcactgaggggccgtgaccttattggcattgcagagacaggatcagggaaaactcttgcttaccttttacctgccattgttcatgtgaatgctcagcctattcttgcccctggcgatggtccaatcgtcttggtgttagctcctacacgtgaacttgctgttcagatacagcaagaagcaaccaagtttggtgcatcatcaaagataaaaagtacttgcatatacggtggtgtgccaaaaggtccacaagttcgtgatcttcanaaaggtgttgaaattgttatagccacaccaggacgactaattgatatgatagaatcacatcatacaaacttgcgaagggtcacatatc

SEQ ID NO: 9713 - DNA, 761 bp, Sorghum bicolor
  Clone ID: SORBI-28MAY03-CLUS3128_1
ccggggacggacatcctttccttgctcggcttggtttcgtgctttcctcaaccatcccctcttccgtggcgcgcagtttgcccgctgcttcacggaaattcctacgggacttgttatatatccgctgcgcaggcccggccgttgttgttgtctccgctcaccccgccagccgccagcctcctcccgccgtcccaatcccaggaactttcgtcgcgtcaggtgatgctttcagtaaccacaggcatagaacaatgtcgatgaactatgatggggatagaagtgaggaccggcaaagtgaggaggttcagtcagcatacaaaagggacagtgacattggtgaggaaatgataataagtagcgaagagcaaaatgatgaaaacgaatggagctgggtgaaccaagatagaaatggtgatcctcttgctgaatctgtttcttcacttcatacgacacagcaagtccttgaaaatgagatacaaaaattatcagaacttggcaaagaacttgaggcggaggaatccacttctggtaacaaagaccaagatgtgatcgttttgccgtatgcagtggtcgatatgttggaactgaatgagaagatggaacatcttgaacagaaagtgaaagaagcatcaaacaccatcagagagaaagacttgaagctttccaagcttcaagtactcatcggtactacagatagggcggcgctggaggaggcaacagctagcatcgaccagttggagacagagctggagcaccatctc

SEQ ID NO: 9714 - DNA, 516 bp, Sorghum bicolor
  Clone ID: LIB3481-018-P1-K1-E10
cgtccgcccacgcgtccgcccagtttttagtgaattattctttccataaataccacttgattaccatgattattttttaacttatttagtctttgagctcaagtttatgtttgtacttaccacctctgttttttgtgtgtactgcttagagatacaaaaattatcagaacttggcaaagaacttgaggcggaggaatccacttctggtaacaaagaccaagatgtgatcgttttgccgtatgcagaggtcgatatgttggaactgaatgagaagatggaacatcttgaacagaaagtgaaagaagcatcaaacaccatcagagagaaagacttgaagctttccaagcttcaagtactcatcggtactacagatagggcggcgctggaggaggcaacagctagcatcgaccagttggagacagagctggagcaccatctccaggagaaactagaagctgaaatctcaggtctggtgatgctgaaagcgaggcaaaactggcaggttcgggcagagga

SEQ ID NO: 9715 - DNA, 752 bp, Sorghum bicolor
  Clone ID: SORBI-28MAY03-CLUS31948_1
accgacgaggaagcaaagaaaaccccacgcaaaagcaaccaactccaagcccaacatccactcatccgagatcccccccaaccgcaaccatggccggcggcgacttggagacggcggcggcgccgctgctgcccccgccggcatcttccctagcggacgagccctcctccgcgagcccgccccccgaggaccggctcggcttcgcttacctcatcttcttcaccctgggcgcgggcttcctgctcccctggaacgccttcatcaccgccgtcgactacttcgccttcctctacccgggcgctcccgtcgaccgcgtcttctccatatcctacatggtctccgccttccttcccctcgtcgtcatcgtgctcttcttcccaaagtccagcgcccccttccgcatcaacaccgggctcacgctcttcacgctcgcgctcctcatcgtgcccgccatggacgccgtctacgtcaaggggaagcccgggttgtacggcgcgtttgatgtcactgtcgctgccaccgccctgtgcgggatcgccgacgccctcgtgcagggaggcgtcatcggcttcgccggggagctgcccgagcgctacatgcaggccgtcgtcgccggaaccgccgcctcaggagtacttgtctcggcaatgagagtctttaccaaggcgctctacccgcaagatgcccatgggctaaggcaaagcgcgatcatctacttcatcgccggcatagtgctcatgatcatctgcatt

SEQ ID NO: 9716 - DNA, 719 bp, Sorghum bicolor
  Clone ID: SORBI-28MAY03-CLUS31957_1
gcacgaggaggaagtccatgactacctgaaaagcctttgccctgatctccacattaccagaggtgaatatgatgaggatgctcgatacccagagactaagacactgacaattggtcagtttaagcttgggctgtgccatggtcatcaggttgttccgtggggcgacctggactccctggcgatgctccagcggcagctggatgtggacatcctggtgactgggcacacccaccagttcaaggcatataagcacgagggaggtgtggtgatcaaccctggctctgctacgggcgcctacagcagcatcacgtacgacgtgaacccaagcttcgtgctgatggacatcgacgggctccgcgtggtggtgtacgtctacgagctgattgacggcgaggtgaaggtggacaagatcgacttcaagaagacagcgacgatgcacgcctagccctgtttttgcacggcgtgattgagttcaacacatatctagcttctgtttcttctctcctcttcttgattcagagctccctggacactgtctttctaccaattgtgctcacctgttcatgtgcaaagaactctttagtgtgtgtttttttacacattagctgatcaaattatgagggtgtgatgttaaatgtcaagtaattttacatgtgcaaagaactcgttagtatttggtcgtgctttaagcaagaacgggtgaccctaaatttacgttt

SEQ ID NO: 9717 - DNA, 641 bp, Sorghum bicolor
  Clone ID: SORBI-28MAY03-CLUS3209_1
gcacgagggccatgtcgcgcgcgttcggcgactactgcgtcaaggactacggcgtcatctcggtgccagaggtgacgcagaggaggatcgccgccggtcccctcgtcgcctccccgtccgccgacggggtacctttcgtggcctcttctttacttttctacggtggtcgtccgtgcctgatgactgacgatgacacgcgggacgtccgccggcggggtgtgggacgtgctctccaacgacgaggccgtgcggatcgtggcggggacgccggaccgggagaaggcggccaagcggctggtggagtgcgccgtccacgcctggaggcgcaggcggcgcgggttcgccgtcgacgactgctcggcgatctgcctcttcttccactcgccgtcgtcgtagacacgaaacttgaacgtgcctcgggccacgtcaagcggcagaggcgacaaaatgcacatctcaagactacgattattgtgcccgtcgcattcgtagtagagactagagagtgcattggcgccgtccaccattcagaacgtgcagtttgtcgcatgatcgtgacactccacgattagaactgcagctggtgaatggccaaacaaaaaaaaaatcttcgctttcacactctggcactcaaaatgtac

SEQ ID NO: 9718 - DNA, 1425 bp, Sorghum bicolor
  Clone ID: SORBI-28MAY03-CLUS32117_1
aagcaaaagacgcacgccacaccgcacacggctcttcccccaggatcgctagctgcagcggacgacaccccacgacgacgtcatcgtcatcatgtccgtcgccgccgccgccgtggatcgcaccgacgagctccgcgcgctggatgccaccctcgccggcgtccgcggccttgtcgcgtccggcgcgaagcaggttcctcgaatcttccgcgtcccttacccagaggagcaaccgccagcggcggcggcggcgaccgtgccggtgatcgatctcagcggcggcggcgaccgcgcagccgtggtggacgccgtccgcggggccgccgcggagtgggggttcttccaagtcacgggccacggggtgcccgagcaggtgatgtcagcagcggtggcggcgatgcgggcgttccacgaagccggcggcggggagggcagcgacaaggcccggctctactcgcgggagcccgggaaggcggtcaagtaccactgcaacttcgacctgtaccaggcgcccgtggccaactggcgcgacacgctctacctgcgcatcgcacccgaccctcccgccgccgccgacctgccggagatctgcagggatgcactatttgaatacgccaagcaagtgaaggatttgggggacaggttgtttgagctgctctctgagtcccttgggctcaaaccgagctacttgacagatatagagtgcaaccagggacaaatcatacttgggcactactaccctccatgcccccagcctgaactcgccattgggacaagccggcattcagactctggcttcctaactatactactgcaggatggtgttggcggcctccagatcctccatgatgaccagtgggtcgacattacaccgacgcctggagcgttcatcgtcaacatagccgatctcctgcagttgatctctaacgacaagttcatcagcgtcgagcatagagtggtcgcgaagaatgctgaaccgagagtttcgatcgcgtgctttttcagcactcattttcatcccgcttcgacgagaatgtatggcccaatcaaggagctgctgtctgaggagaaccctcctttgtatagggaaacactcgtcagagaatatgttgcccgttactactctgtcggcttggatggtaagcagaagactgctctagctgatttccggttgtgaattctgaacgagaaaatcgtgttttattaccagcaagatgcaagtgtttgggtgggacaacctataccgtgtaataatatattagaccaaaggttcccaccctgcttatactgaaagtaaaagataggtggctgatgttgcatgttctttgagtgatgggaaaacatcttaaatgagtttgttgactgccacttccgtgtctgtatatccaatcacaatgtcatcaaggagttgaacataatcagtcc

SEQ ID NO: 9719 - DNA, 755 bp, Sorghum bicolor
  Clone ID: SORBI-28MAY03-CLUS30729_1
gcacgaggctcagctggtgccacgcactggtgggcgtgaaatgaacgctggcctgagcgtcattggccgcctaaacgaagaattcgaacaacggagccaggtatttgctgatgacgccaagttcctggttgaggtcaagtctgggcaggcggatgccagcctaaacccagacatggagctccggaggttgaagcagaattttgactcgtggaagaaggatttcagtggccgcataagggagacaaaggtgatcctgaacaagctcgggaatggcaacgagtcatcgcccaactctgtgaagcggaaatggtggggcagactgaacacctccaagttttcgtgagtttattatgattgattggcaatttgtaggtgtaccggtattttacacgccggtgtggttctagcttcctagagtatctattctacgggtgttgtgaaagtccagtgtgttggactggatttgtgttccgtggagggcgagttgtatagttcttccacaagggcttcctttgaggggtcaaggaccactgaatcgtgatgtaattacttgctgatgaagtagttgtcggaggcggaagattgtgagattgctcactattccactatcctcatgctttactttcagcctgttgtagattaatagatttaaatgtggcatggtgtaacatatgtaatcttctcatcatctgatgcctgtgtaaattagatacttgttgcatttcgaaatgtaaggtcgcggtaacttttttttt

SEQ ID NO: 9720 - DNA, 894 bp, Sorghum bicolor
  Clone ID: SORBI-28MAY03-CLUS3076_1
gcacgaggcatctttctcgatcggatttgtgttgttcgtgcgtccgcttttcttccgtggaagccttgcctacatatttactgaaagtcaagcggtagctaaagcagtcgccgacctttcgcctctgctagccttctccatattgctaaacagtgttcaaccagtgctatcaggtgtcgctgttggtgcgggctggcaaagtgtagtcgcctatgttaatgttacgtcatactacctgattggcattcctcttggagcagtcctgggatatgtggtgggatttgaagtaaagggcatttggattggcatgctgctcggaacactagtccaaactattgtgcttctcttcataacattaaagaccgactgggaaaaacaggtggcggttgctcaagagagactgaagagatggtacatgcaagagaacagaagacttcaggggttgagtggaaactcttgaaccgccctccctcaggcctcagctccatctctatctctgcaggctgttataagtatctactcggcatccgagacccttggggcagacacacacgtatgactaattttccattcaccgtctcacaagaacgaaatgagggagctgttagttagtctacccaggattttaattgctcctcaagccgaggccaagcagcggaagtggttgtcagcagcagagaaaaagacactctattgtttggcagtggcatggcatggaggatgtgtgtgcacccttgttgggtttgtgcgagtttggctcaggtttggtttgggcagtatggtaatgccctcttcatcagagcagcgattgtggtgtgttggggatgttggaatctgtaacagatttgtttcaatacgtttgcattacaaataatgatctgaggggtgtgttgc

SEQ ID NO: 9721 - DNA, 720 bp, Sorghum bicolor
  Clone ID: SORBI-28MAY03-CLUS30772_1
ttgaggttatgaagaccatgtctcaagatgaatttgtggcctacataaggaggtcagtggtacagtcgaaaaaattatattgtagtagttatgtgataattatttattgtctttgtggcctacttttggaggcaaagcagttgtttctcaagaggtacttcatcataccgtggtgtaaccagacgcaaggatggtaaatggcaagcaagaattggtaggattggtgagagtagagacaccaaagacatttatcttgggacctttgaaactgaagaagaggcggcagaagcttatgacctagcagcaatcgagctccgtggtgttcatgctgttaccaattttgacattagtaactactgtgaagttggtttgagaaaactagaaggtccgtcagaggtggtgaatctggaaggtccatcggaggttatgaagcacgctgggcaatagatctagaatagcaacatgtaaattagtttttatttcatttctttcgtcatcatatttttctctccttttggtattcctggtaccttttcttccccctttggtgagttatctccttgccgtcttgtcaagccagtatttatccggctcgaaaggacaatgtgatgttgtaaaggcctcacagaaaggtcttattactaacctttgatgtcagttgtcactgcagaagtcacattgtcgtgcctggttggggcggtggttcttaccgtgcttttc

SEQ ID NO: 9722 - DNA, 693 bp, Sorghum bicolor
  Clone ID: SORBI-28MAY03-CLUS30786_1
tggtcatgcctggactacagactatgggtgttcagataaggaagaagagttccagtggctcattaaatattctccccttcataatgtacggagaccttgggagcaaagctctggtaaccactgccagtatccagcaaccatgttgttgacagctgatcatgatgatcgcgttgtgccgttgcattcactgaagttattagcaacgttgcagcatgtcctgtgtaccagcactgaggacagcctgcagacaaatccaataattggtcgcattgaccggaagtcagggcatggagctggcaggccaactcaaaaactgattgatgaagctgcagacagatatagctttatggcaaagatgttaggggcatcgtggactgaatagtttattttgtccagcttattgtggagatggtgagcaagattacgctatgcagtcaaagtaaagtggcagggaaagttacattgcttatgttttgctcttagcttggattatcaccaaccagatagttgtaggggtttatgcttcgggttgagataagggttcaggaacattgtcatggctgatattggcgtgctttttatatattttttgattttttgcaccctatatattactactacatcccaaattataatatctagaaatgttaaaacgtcttataattgggaaaggagggacgtatttgtgactgg

SEQ ID NO: 9723 - DNA, 684 bp, Sorghum bicolor
  Clone ID: SORBI-28MAY03-CLUS30859_1
cgtcaggaggcgatcgagagcctcggcgcggacgagttcttgatcagccgggacccggaggagatgaaggcggcgacgggcaccatggacggcatcatcgacacggtatcggcgtggcacccgatcacgccactgcttgcgctgctgaagccgttggggcagatggtggtcgtgggagggccgagcaagccgctagagctgccggcgtacgccatcgtgccgggcgggaagggcgtggctgggaacagcgtcggcagcgtcggggactgccaggccatgcttgagttcgcggggaagcacggcatcggcgccgaggtggaagtcatcaagatggactacgtcaacacggcgatcgagcggctcgagaagaacgacgttcgctaccgcttcgtcatcgacgtcgccggcagcctcggctctgctgcttaggcatggctgaaaagtttgaatcggagcccaataattaattaggtacggaatgatgtttcgacgcttgttgatgagttggaacttggtcgtggcttttgtggctctaattgtttggtgtacaagtaaggaaaataagagggagacagagtgctgttgccttcgctggcttgtatggaaagtgaatatccattaattaggtctttgtttggatgttatcatattcaccttaactcaatgtgttggtcgattggggtg

SEQ ID NO: 9724 - DNA, 806 bp, Sorghum bicolor
  unsure (1)..(806): unsure at all n locations
  Clone ID: SORBI-28MAY03-CLUS32807_1
gcacgagggccaactccatactctggtggatctatgatgggagcaggtggaatgtatggaatgcccatggacaggtatgggccaatacctgttggtcctggtccaatgggcacaagggctggctcatattctgatgaaggttctcagaagaagcctgcaggagctggccgtgataatgattgggagtgtccaaattgccacaacatcaactttggctttcgcacagtctgtaatatgagaaagtgcaacacacctagacctgaaaaccagggatctaagcccgatggtttaagaggctcaaaaccaaagatgccagagggcagttggaagtgtgagcagtgcaataatataaactatcctttccgaacaaagtgcaatcgtccccaatgtggagcagaaaagccatcacagacaaacaatgtaaatgattcagcgacagatcaggacaatcagtgagtcctagaacagtaatgagggtcaaggaggtccagcgtcgtcgtcaaggttcagtcaatgtggggtacatctgtgtcagtagtcgctgctgtcgttacaagtttcttccccttgagaccttagttgagtcggggccttggagttggcaatggagtcttgccttccctaatcactatggataatggtcaagaacatcaatttgtcatttggtttggtcaagaacatccatcgtgcctttcctggctgaacttggttacttgtctttgttactagtactctgggtatattaccatctgttatatgaatgtcttttagggagctctggcatagaatatcactcatctgttatn

SEQ ID NO: 9725 - DNA, 881 bp, Sorghum bicolor
  Clone ID: SORBI-28MAY03-CLUS32910_1
gcagaggcacgtctcgcgcgggatctaattcgaaacagcactgccctttcttctacggttccccaagggcacgctctctccctcgcggcgactactgggcgaccgctgccgctgcccaggtgcccatcggtccgttcgccaggtcttcttcgggctcttcgccgccgacgcgcgcggccaggttgctgtgttaagtccaaacttgtcacatggattcaacacaagatttccaacccaggacattctctataaagttgtggccaccaagtgagagcacacggctcatgcttgttgagaagatgacaaagaatctgtccacagagtccattttctctcgcaagtatggtcttttgggcaagcaagaggctcatgagaatgcaaaaaggattgaagaactttgctttgcctcggctgatgagcatttcaaaagggagccagatggtgatgggagttctgctgtccagctatatgcaaaggaaacgagcaagctgatgttggaagttctgaaaaaaggcccaagcactactgcagaactggagacacctgtagctgatacacctcttgtgcctgctgatactgtactggatatatctggtggcaagcgtgcttttattgaggcacttgatatatctggtggcaagcgtgcttttattgaggcagatgaagcaaaggaactgctgagtccacttacaaaaccaggaaattcatatcaaagaatatgctttagcaacaggagctttggtattggcgctgctaatgttgctgggccaattcttgagtcagttaagaatcagctcacagaggtagatatctcagattttgtggcaggaaggcctgaggatgaagctcttgatgtgatgcgcatattctccaaagcatta

SEQ ID NO: 9726 - DNA, 1138 bp, Sorghum bicolor
  Clone ID: SORBI-28MAY03-CLUS32969_1
ctactggaactgcagagctgcctttagccgcctatccgtcgtccgtcgtcctgccgactcgccatctccctcatcagtccctgcttccacgctgcctcctcttgactgactccacccgccgcgggtttccctctcctcgccatggctcctcctcggactcagcgcatctaggaacagtgagtgtgtgtgtgtgcgcgcgcgcgtgtggtgcgaagagacgagaggatggaaatcgaggaagccgccggcggcggcgagattggggaaatggaggcccccgcggtcagcacggtggcggtggcggtcagcgggggcaggagcagcaagcacgcgcttaagtgggccccccgcgggttcgttcccgaagggagggtcctcttccggatcttgcacgtccacccggcgatcaccatggtgcccactccgatgggaaattttataccaatctcacaagtacgcgaagatgtggcatctgcctacagaaaagaagcagaatggcaagcgagtaatatgctagttcctttccagaagatgtgtgctcagagaaaggtagaagctgaagctgttttacttgaatcagatgatgttgcttctgctataagtgaagagataggaaaattcaatatttgcaagttagttttaggttcttcatcaaagaatatatttcgaaggaaactcaaaggaagtaagactgcaaccaaaatatctgagtgcattccaagcttctgtacagcatatgttatttcaaaaggcaaactatcatttgtgcgctcagctacatctgacatcgctgaaacgcctcgatccatatcctcttcaactgtttcttcacctagcactagaagtctttcctcctgtggaccttcagaatggggagacacatatggaacagcaaatgtaccattgcatcaaccttctttgccattgcagcgtgaccaagcattggcaatcataaacaagctgtcaaacaggagagctagctcttcgagcagtgttgtgagcgaggtctcttacaatgatgagccggccctgacaaggtcacactccatcatatcagagatgcagttcagtagtggtagcagtggaaattctgtttacaagagcttccaaagagataatttgcctgacaattctgatc

SEQ ID NO: 9727 - DNA, 901 bp, Sorghum bicolor
  unsure (1)..(901): unsure at all n locations
  Clone ID: SORBI-28MAY03-CLUS3292_1
acgcgtccgggaaaatgcaggtatgttgtcaattcttccttttaaggatcgtatcttccaaaggtcataactttgtgtccaactgaaagcaacaaactgtcttatatatgataaatgctcaaattggatacagagcagcagtgtagtagacatttatgagaactgtataatatccagttggaattcacaaaaatctaaaccacgtccggagagatcacagctacagaacaaagagcgggcatttcaattgttgagagcaaacccttatgaaaaaaaattaagggagcaacaagagtcaataagaaaccagaggaaaatgcaggttggtactggtgctcgatctgagaagataaggacatacaattacaaggataacagagtgacagaccatcgattaaagatgaactatgaactgaccggcttccttttaggagacatcgaatcggctgttcagtcttgtgctacactggagcagcaggagctcttggaggaaatggccagttccgtgggcgcagtgaacgtatgattcaggcaattcggcgttgagatcaggtcatcaaatagaatcaagaaactcatgatgtgttcaaaaccgatgaagatgattgatagttgtacaagaaactgacaaaatgaactccacataggaaatttttctgtagtccacatggtcatgagttcatgactaataccatagaacacacccatgcatttcagcttccttaacgacagcagatttttgagtattagaaaatatacacggtatgtacaattcaactgctccagtattcacagtttaatgcattttaggtttgttgttctgggaaattcttttgttccncaatgtgtaattcttcaagaaaaaaaattgcaaatacccatttataaagacgctatagcc

SEQ ID NO: 9728 - DNA, 439 bp, Sorghum bicolor
  Clone ID: LIB3478-032-P1-K1-B2
cttccttttaaggatcgtatcttccaaaggtcataactttgtgtccaactgaaagcaacaaactgtcttatatatgataaatgctcagattggatacagagcagcagtgtagtagacatttatgagaactgtataatatccagttggaattcacaaaaatctaaaccatgagaagacagcaaaagctagtgtcttcagtttgtgtaggaaataggaaatagagttggcccttatgaaaaattttgccatcctctctggtcagtgttactacctgtgcaactgaaggttggtactggtgctcgatctgagaagataaggacatacaattacaaggataacagagtgacagaccatcgattaaagatgaactatgaactgaccggcttccttttaggagacatcgaatcggctgttcagtcttgtgctacactggagcagc

SEQ ID NO: 9729 - DNA, 1257 bp, Sorghum bicolor
  Clone ID: SORBI-28MAY03-CLUS32971_1
accacctcccttgcgcccctgcccgtcctcgccgccgcccgccccgcccccctccgcggccgaaaccgcgcgacgcagatgcggctgttcgacttcttccgggcgcgcccggacctgcagacgcccgtcgagctgaccacggccgcgcaccgcgagctctgctaccgccagctgcgcgcgctcgtgcgcgaggccggggtgcgcccgctcacgctcatggccaacgaccccgccgagtacttcgccgtcatggaggccgctggtggcgccgacatctctctcggcgtcaagctcggcgtccagtacagcctctggggtggttctgtcataaacctaggaaccaaaaagcacagggataagtactttgatgcaattgacaatttggattatccaggctgttttgcaatgacagaactacatcatggatcgaatgtacaagccctacagactaccgctacatttgatcctgtcactgatgaattcattattaataccccaaatgatggagctattaagtggtggattggcaatgccgcggttcatggaaaatttgctactgtctttgcaaggttaattttaccccttcaaggaaaaggaggggaacctgctgatatgggcatccacgcatttatcgtccccatacgggaccttgaaactcacgctgttcttcctggaatcgagatcaatgattgtgggcacaagattggcctgaatggtgtagacaatggcgcactgagattctgctcagttaggatacccagagataatcttctgaatcggtttggcgatgtgtcacgggatggaaaatacacaagcagtctgcccacaattaacaaaagatttgcagcaacccttggggagcttgtcggaggacgagttggcattgcatattggtctgtgggtgttctcaaagttgcagtaacaattgctgtgaggtatgctcttctgcgccaccaattcggtccacctaaacagcctgagatcagtgtgttggattatcagtctcaccagaacaaattaatgcccatgttggcatcatcatatgcatttcacttcgccacagtaatgttagtggataagtactcggaaatgaagaaaaccaatgatgaggatcttattgctgacgtacatgttctttcatctgggttgaaagcctacataacttcatatacagcgaagtctattagcatctgcagagaagcatgcggtggccatggctatgctgctgcaaatcgttttggagctctgcgcaatgac

SEQ ID NO: 9730 - DNA, 861 bp, Sorghum bicolor
  Clone ID: SORBI-28MAY03-CLUS3104_1
cgtccgtacatgcttccttgacattgagaaggcttgccaaggattggaccaatccattgggtcagatggagtgcttaacatgacaatattccgtcagggaaaagaaatcgaccttattgttggaactgatgtaagagatggcaatggtacaacccgaatggttaattggtgtggatgcattatccaggatcctcattcagcagtgcgtgcacttggctttttaccagaagaaggtcatggtgtttatgttgctagatggtgtcatggaagtccggtacatagatatggcctctatgctctccagtggatcatcgaagttaatgggcaaccaacaacggatctggaaacctttatacaggtggtgaagggtctcgaagatggtgaatttgttagggtgaggactgtccatttgaatggaaagcctcgtgtacttactctaaaacaggaccttcactactggccgacatgggagctcagctttgaacccgaaactgctacatggcggaggagaataataaaagcattgcaatcaactaaggcgtgatatttttatgttttcctgcgacattttcatgctcagaggagaatataggtaaggaaattataggttcatgccttggtttggtaagctaaattctgcattatgcaggattaagctaccctgcactttgtagggtcagttgtgggcattagcttaggggggggcttgaaagatatatagtaagtacatcattgatagtaatatggattcatcggctgtggtctctggacaatttgaccacaggatttgccttctgtatatcgtccattcctatattttggtagaaaatgaaataaatcgttagtgtttccagcggttta

SEQ ID NO: 9731 - DNA, 776 bp, Sorghum bicolor
  Clone ID: SORBI-28MAY03-CLUS3116_1
cgtccggtggtatactgcctcgtcaggcttgcccccgctttttgacgagcacaagataagaactgctctgcagaaaatatttgaattcaatgtgatgaaggttaaaggaggacggatgggagctgtaaatggtatgactccaaagggaaaggtggacgagacatgcatgcaatctcgtgaaatctggactggtgttacatatgctgttgctgcaaatatgctgctccatggaatggagcatcaaggctttacaaccgcagaaggaatttttattgccggatggtcagaagaaggatatgggtattggttccaaacaccagaaggatggaccacagatgggcattatagatccctcgtatacatgcggcctcttgccatttgggcaatccaatatgcagtttctcctccaaaggctattcttgaggccccaaaagttaacctgatggaccgaatacatatatctcctcacatggcccgagcaattagcgagataagcattagaaagatagcacctgacaacagatgtttccctagctctgcctttcattgtgaatgctgatccaaaggtaacatgcagctgctgagcaacttaccaatctattcggcttttcggtttctccctgccctttacaaggtccagtgtgattcaggagttcttttcttgaaccagagggcatacccaaaccaccacaaaacgggactcaaaagagttcatgttgtataattgtacagcaaactgttaatcacatatactttggttctttttccttcactct

SEQ ID NO: 9732 - DNA, 657 bp, Sorghum bicolor
  Clone ID: SORBI-28MAY03-CLUS31108_1
gcacgagggttccccacggctcttccttccttcctccgccggcgagctataaatccttcccgccgacgccatccccatggcatcccgcttccgcggctccccttctttctcctcctcctcccccccgtcgtcgaaggctaacccttggcccgccccctccgccccgccgctgtacccgacgctctccatggccgatctcgcgccagtcgagatagggcccgtagcctcgtcgccgacggcgccggcctcgccctcggagtacgacaacgcgccgccgccgtccgaggacgtcctcctccgtgtccccggcgcgcagctccacctcatcgaccgcagccgcagtcacccgctggccgccggagacctctccctcctccgcatccggtccggcgacacctccctcgccgccatcgcgctgctcgaaccggtccagtggccgctcgcgcgcgacgtggccgccgtcaagctcgacccttgccactacgccttctccctcaccgtgccggcctctgccgacgaccccagcccggacccgctccactatgggctcacgctggcccaccccgacgcgcgcctcgacggcatcctcgccgcctacaccagcttctccgtccacgccgtggtgggaaccaaggagctggagggcagggtgcgcga

SEQ ID NO: 9733 - DNA, 797 bp, Sorghum bicolor
  Clone ID: SORBI-28MAY03-CLUS31093_1
gaggccaccagagcaaaatccaccgctccccccctggctcccgtcgaaccagccgagcaagccaacgcaacgcaacgcaaacccagcgagccgcggcgcctcgtcgcgcgcgccttgcctgtctgtccgcttcttcgtccgatcgcccgcgtcgtccgccggtccgagagcccctccccacccgaaggatggcggagcccgcggcgacgccgacgacggcggcggggaggaagacgcgggtgggcccgtacgaggtcggcaagaccatcggggagggcagcttcgcaaaggtgaagcacgcccgcgactcccgcaccggcgccgtccgcgccatcaaggtgctcgaccgcaaccacgtcctccgacacaagatggtcgagcagatcaaacgggagatttcgactatgaagctaatcaaacatcccaatgtggtccagctgcatgaggttatggcgagtagaacaaagatatatatggttcttgaatttgtggatggaggcgagttattcgataagatcgtcaattctggaaggctaggagaggatgaagctaggatatactttcatcaacttataaatgcggttgattattgccatagccgaggagtgtaccatagagatctgaagccagagaatctgcttctggactcacatggaactcttaaagtttcagacttcggcctaagtgcatttgcaccacaaacaaaagaggatggacttctgcatactgcctgtggaactccaaactatgtagcacctgaggttcttgctgataaaggttatgatggtatggctgca

SEQ ID NO: 9734 - DNA, 822 bp, Sorghum bicolor
  unsure (1)..(822): unsure at all n locations
  Clone ID: SORBI-28MAY03-CLUS31423_1
tngtcgataaggtagcaatcaactccactgcagaaattattgggattaggcgtggggatgtgattgtttcagttaacggggtgtgctctcagactatgccagagttggaggagtatttgctttctcttggctggaagtttctggagaggaaaaataaatcatccaagattgttctgaagttaaaggtttatgaccccatcaagtgcctggagcacactctaagcctgcctctaggattttattgccttaccgcagtaaaggagagggtgaaggtgcaagtaactgagaagatatcacctgacatcaagcgcaagaaaactactactgtaccgattccatctggaagggtcttacgccctcgtaagaagtgagaaaaagtggagtcctgggcaaggtggaagctaggccgtggcgcacagaaatatagttctggttactggtagttaggtactagtactagtatagtagccgtagattttttgtattcagatgtcctttttctccgtcgttgtggcggcgcatcgcacaagaaaagttctcacctgtctcgtctttgatcgcacgcctatttggcctctggtagttgccatctttaccgaggacaaaatatactgtgcacttttgtacgttcctgttataacgcgttaggatctaacctgtacgggcagcttctgtgccggccaccggggatatttaacctgtacaattgttgtcggttctcctctcttgaaggttttgagctgctaatgcggtgctttacagcaaaaatactacagtaacagggtggctttgccgcgtcttgtatagaatttgggaccagat

SEQ ID NO: 9735 - DNA, 563 bp, Sorghum bicolor
  unsure (1)..(563): unsure at all n locations
  Clone ID: SORBI-28MAY03-CLUS31781_1
ccgaattgaaccccacccgcggcccccgccgcggcgccgccacccccccgcggagccggccgtcaggtcgggccgtcgggggacgcgggacgccagacgcctcctcatcggcgctcttctaaatacccgcccccatctccctacccagcagggaggaaatcgcggtgcgggttgcggacacgcccacgggaacgcggcggcgcatggaccgcatcgtcggcggcaagttcaagctcggacggaagatcggctgcggcgcccgcggccagcacgacctcgcctcccccgtggtcccccgcggcaaagatctacaacaccctccaaggaggaagtggcattgccaatgtcaagtggtgcggcgtggatggggaagagaatgttctcgtcattgacttgctgggaccgagtttggaggacctgttttgttattgcggacggaaattcacgctgaagactgtcctgatgttggctgaacagatgattacnagaatagagtttatgcattccaaaggctacttacacagagacattaaacctgacaactttctgatgggtcttggtcg

SEQ ID NO: 9736 - DNA, 682 bp, Sorghum bicolor
  Clone ID: SORBI-28MAY03-CLUS33246_1
ctctctcgccaggccaactacccctctcaaaacgccttctcgctccggtttttattttcccatcgtttctcttctccttcctcctcttcactccaccaccctcctcccctccctcttttgtagtatcactgtcaccaacaccaccaacaacaaggctaacgcacaccaacccaagaacaagaaaagaaaacaattgattctgttttgatctctcttcgatcgaggtaagtgcggtaggaggcaataatggtggcggtgcaggctgcggcgacggcggaggcgccgatccgggccgaggccaaggtcgcggtggcgccggagacggatgcggaggccgaggtggaggaggtgaagaagggcgatgccgccgttgccgccgccgccccgggagagacggaggaggagccggtgtacagcagcgacttgaggaagctggaggagctcatgtccaagctcaacccttgcgcgcaggagttcgtgccgtcgtcgcgccgcacggctccagtcgccgtgccggcagcggcagcaaagccggcggcgggaggaaggaggggtgctctccgccgacgcgcctgtgttcgtgtccgccgccgagtactacggcgctgccggcgggcgcctggagataagcggcggcggcgccggcgggggcagggactctagcagcgacggatccagcaac

SEQ ID NO: 9737 - DNA, 661 bp, Sorghum bicolor
  Clone ID: SORBI-28MAY03-CLUS33333_1
gaagtatactcacgcacggggggaggtggccgccgctattcggaagtcaccacagcgattcggaagcctaaaaatcattccccaaatttcacgagagagaggaggccggtgctagggttcctcattcagattcgcgatgacctgaggcggacgcacgggctcgcctgctcgccaacaaggaggtcctccaccacatccaatcgttgaatccttacccaaattcgtgtgagacagaggtggccggcataaggaggctgcgagggctcgcgagctcgctgacgaagaggtccgctgctacatcccggcctaaagcgtctggtacagctcgtgattcagaatcacgccggcctgaggcgaccgcgagggctcgagagctcactggcgaggaggtcctcatcgacgaggaggtcgagatcctgaagggctcctccataagcatcgtgagttcgtacacaaacatcattgtcccctgctcaactactaatccaggtatatccccatagccaccaatcatttgaagcctctattgagatgttgattgctgttgaatctggtcccagggttggctttgtggttgggcctctgttgcatgagcggtgctagttatctataccaagctagaagttcactgtgcttaactttattactattgctatgatcc

SEQ ID NO: 9738 - DNA, 964 bp, Sorghum bicolor
  Clone ID: SORBI-28MAY03-CLUS3335_1
gcacgaggaaccagtgcaagaacaagatcgagtccatgaagaagcggtaccgggccgagtccgccgccgtggcgcgcgcgggccccgccgctgccggtccgtcgtggaggttctttggccgcatggacggcctgctcaaagggccgcccgtctgctctgcccaggtgcagccgccggagctggttaacagcatagacttgcgagctccggcgaaaccagaggcggctgaggttgaagctgatttccccacgcagttgcgggatgcagttccaggtgcattatctgatctgatgaacattgacgcgaatggcgctgctgttccggaaaaagcggagaaggttgacaacagcatgcacaaggagtgcaggcctgctgatagcgatgccaacgtgagctctccgaggagtaaggtggccaacgaggacgtggaagaggtgaacaatgtctgggaccggaccaagaagagaaagagcacagactttgacatagccaagagcatcgagctgctggctagctcgttcttgaagattgagcacgccaggttggagatgtacagggagacagaaaggatgagggttgaagctgagattaagaagggggagatggagctcaagagaacagagatcatggcgaaaacgcacctgcagatcgctaggctttttgcaaagaaattgaaacagagcagtggaaagaatggtggcagttcgtcagtaacagctgaagtggacacccttaccaagaaaggcgagaatggttccgggtgatgtggcatgcccagcagctgtcctcagcgtacatggtgtacatgacatctcactttccctgtgcagcaagtgtagtagtctgattgatgcaacttcgtgagtggagaaatggtcagctgtaaacttacagatgcaataatgagagcgatgatttgactgtttcgcccattgcgggattattattatagaagcgatttttg

SEQ ID NO: 9739 - DNA, 1092 bp, Sorghum bicolor
  Clone ID: SORBI-28MAY03-CLUS33367_1
tctgtgcccacgcgcttcaattcgattcgaggcgccgcggccggaaggaatttctcgagcccgccggtgcgggccgccccccgctctccgccggccgccacccccccgccctcccccaccgccggcgcccccggcgactggccgccgcccggtccgccgccggggcgccgcgccgcggccctggcgcggccggcctcccacccctccccgccgcccgccctctccccctccccccccgccccccccgccccgccgtccgccccgccccccccccgcccccgcccccgcggccgctcccgccggcccccctgccccccccggtccgcccccccgccccgccccccccccgcgccccccggcccgcggcccccccgcccccccccctccggcccctcccccgccccctcgggctcccccccgggcccccccgcccccgcccccggccccggcagcgccgcctccgccccggggacgccgtcgtgctgctccacgtgcgccccgcccccgtgctcgccggcgccggcgggggccccctccccgtccccctcgccgccgggcctggcgcggccgcgcgcccccccgccgcccccctcgagggcccgcccccccaagggccgcggcaggaggggccgcctctgcctcgcggccccgcccccccccctgtccgccatgatcatgggcagccggggattcggtgcctcgcgcagggccgggaaagggaggctcgggagcgtcagtgactactgcgtgcaccactgcgtctgccccgttgtggttgttcgctacccagatgatgccttcggggatgagctgcgaacagtgcctgaaaatgagcctgtgtatcatgaggcgccggaggcgcagaaagaaaaatgaggcaagtgcaggggcggctaggcggcgagagggagcaagcagaggccttctttacgttatgtcagccagccctagtgtaacacgagtgccctcttccgtggccactcggctctgcaactctgcgttgcgtttgtaccagaatctgtagatcatggacgagtccccgctgttttgcttcatgacgtgtcatgtggtggtaaaacgaagacaaatgtt

SEQ ID NO: 9740 - DNA, 690 bp, Sorghum bicolor
  Clone ID: SORBI-28MAY03-CLUS33407_1
cctgctgcaccggaccccgccgcttcactgccactaggctttgttttatgcctcgtctccattgagcggatcggacgagatcgctccgacgacctgcgtgtgctaccggcgacgagatgcagccggacaacgcgggcaagccgatccggtgcaaagcggcggtgagcaaggcggcggggcagccgctggagatggaggaggtggaggtggcgccgccgcgggcgcacgaggtccgcgtcaggatcatctgcacctcgctctgccacacggacatcaccttctggcgcatgaaggattttccggccatgtttccatccatcctgggccatgaagcaatcggtgtggtggagagcgtgggggaccatgtgcacgaagtgggcgtgggcgacgcggtggtgccggtgttcctgccgcagtgcggggagtgcgccgactgcgtcgcgtggtggagagcgtgggggagcatgtccaggaggtggccgtgggggacacggtggtgccggtgttcctgccgcagtgcggcgagtgcgacgactgcctgtccgcccgcagcaacatctgctccgtgctggcgcaccgcccgggccgccggcccccgccccgccccgcgcgccgcccgcgcccccccccccgcgcgcccgcccgcgccggcctgcccgccccccgccgccgtcaccaccggagttggtg

SEQ ID NO: 9741 - DNA, 935 bp, Sorghum bicolor
  Clone ID: SORBI-28MAY03-CLUS33414_1
aaaaaaagcaaaaccctggctgccgtcgcggcaccccgaagccgccgcgatcccattgtcacacgcacacccacccgccgccgccgccatcccctcgtcgccgtcgtctcctggcacgacctcgtcgaatcctttgctcctctgcccccgccgctgctgctgccatggactccacgccggcacccgaggcggctcccggcgcctcctcttcctctgcagctgccgccgaggatctggcgggggccgtggcggcgatgagcctggacgagcggttcgatctgctgcgggggattggggaggagtgcatccaggaggacgagctcaggaacctgcttcagaagaagcccgtccccatctgctacgacggcttcgagccctctggacgcatgcacatcgctcagggcattgtgaaaaccatcaacgtgaacaagatgatcagggccgggtgcagggtgaaaatttggatcgccgactggtttgcgcagctcaacaacaagatgggaggtgacctgaagaaaatccagacggtggggcgctacatgatcgagatatggaaagcggctgggatgaacctcgacggggtcgagttcctgtggtcctccgaggagatcaacagccgcgcgcatgagtactggccaattgtgatggacattgcccggaaaaataacgtcaagaggataacgagatgctgccaaattatgggcagaagtgagtcagacgacttgactgctgcccagattttctacccttgcatgcaatgtgcagatatatttttcttgaaggctgacatatgccagttggggatggaccaacggaaggtcaatatgctagctagggagtactgcgatgacatcaaaaggaagaacaaaccgattattctttcacatcgtatcctgattagtgattttgattgtgttatcttttttttttccttt

SEQ ID NO: 9742 - DNA, 682 bp, Sorghum bicolor
  Clone ID: SORBI-28MAY03-CLUS32185_1
ccccgagcgctagtggccgcgacctgctagatttcggccctcctgggctccccctgctactgttgggtttcgcaccgccgagctctccgcaccgcggcctgccgtccgaccccctccgcgccgtcttcatctgccccccgtgctcgtttttaatgttttattttgtttcgcttcttttgacaggtgaagcaattagcagccattagagatgcgagagaatcaagggatgtattagtttttttttgtctttcattaaaagtaatttaatttgtctgagttgctgaacccttaatatttatgatcccaatgaaggtgatttagcatattgtatatgatttagtggactaataactcaagacagagccaactatgtttattcaaactacaaagtgtattgaaattttctttgacgatttatttgcctgaaaatttatgttactagcaaaaaaaatgaggtgtattgtaatcttcattgtatgattcatttgccactaaaatctatgttttatgatcagcatcatcataaaaaagggaaaaaatgccgcaaaatcaaggtgatttagcatattgtatatgatttagtacagagccacaaaactatgtttattcaacaaagtgtccacgagttgctgtgacgaggtatttacccagccttaaaaaaatcgaccatgacattgtcatg

SEQ ID NO: 9743 - DNA, 642 bp, Sorghum bicolor
  Clone ID: SORBI-28MAY03-CLUS32317_1
cttcatcgacctcttcttcattctttctagtatttggctaggaaggttctattatgtgttcggcttcctccttgtcgtgctccttttgctgattgtggtgtgtgctgaggtatcagttgttcttacctacatgcatctctgtgcggaggactggaggtggtggtggaaagctttctttgcctctggaacagtggccctttatgtgttcctttactccatcaactacttggtgtttgatctcagaagcttgagtgggccggtttctgctatgctctacattggatactctttcattgtatctgttgccattatgctagctactggtactgttgggttcctgacatcgttctcttttgtccactaccttttctcatcagtcaagattgattgaagatctaaggatgtctttggctctttgcgcaaaatgccaaaatcccctgtgagctcaaatgatatgatccattgcatcttgaaggcctttcacagtgcagcgctgtttgtaatgtagcttattactgagagtctgagactactgtacctcgtaatgaatagtatatatcagcagatgtgctttgaaatttgtcacactttgctacaacattttgttgatgctgccactactgtgggaaggtcttgagttta

SEQ ID NO: 9744 - DNA, 763 bp, Sorghum bicolor
  Clone ID: SORBI-28MAY03-CLUS32338_1
acagcaaaactggtggtgtgaagccaccagagatatggaggttgttctttcggtgaatgtcacaggcagctcctcgactgaggccgtcacacacaggatcactgtccggcattgctgcccggtgccttcagctcccccgcccgttaacccacactctattagcgactcaccaagtgatgctgagtcaggttccaagaataaccagttgaatcacttactacgttctgattttgcaaaatttggcagctcagaggtgcatgacttgtgcggtgtgcgaaagcgaagcttgtaaaagctgagcttaatttcttttgcttggtgttgtagttcttctgagtgtttagccggtagagccttagatttcttgcctaagctgggaggaaaagtggctctgctcttcatcctgttctgtacatatgcctcaccgctttgcgtatcaaatcaaaaaggggaaaaaggaggaaagaaatgtgcagttgttgcaattacccttaaaaatttaagttaacctttttgttttaccttctttagtagatttggcagcgaaattatgttgttagaaggtgtagtatataattgtatatatataatatgtaatagaggttgtgagtttgaagtaccgactgatcaatagtctgtataatttacttcattgattgaatcactgtagagtggtttgtacacaaaggcaatacatgtgacttacaggacattctccttgattaatgagactgtaatcttttgttgtatttttttcctttcc

SEQ ID NO: 9745 - DNA, 1007 bp, Sorghum bicolor
  Clone ID: SORBI-28MAY03-CLUS32500_1
gcacgaggctaaatcgctttgcagaactactgattcacaaacctggtgaaggctttctcctttggctcttggccaccctgttggctccattgagatggctattttcgaagtttgctgagagctactactccatcccaatgaaaaagtatgacatggtgcctgaccacagcctgtttcaagcactagctacatgtttggttgctatagagcccaagggattttataagaggctggaagaaggcagcatagttctgaagaaatcaaagacgtttaccttctgcaaggatggtgttgttgtggaaggtgaagaattatcgccgctcgagggcgatatagtgatctacggaaccgggttcagaggtgatctgaagatcaaggacatgttcacctcagaatacttccgcagcattgcagttggatcaacatgcacaactgtgcctctctacagggagtgcatacacccaaagataccgcagcttgcggttctaggctattcagagagcattgcaaacttgtacacctcagagctcagagccaagtggctggcccatttcatggatggtggcttcaggttaccaaatgttactgcaatgcagaaggatatccttgaatgggagaagtgcatgaaaagatatgctggtaggtactttcgcaggtcctgtatcggactccttcacatctggtacaatgatcagctgtgccgcgatatgggatgtgatccaagaaggaagaagggctttctccaggaattattcggaatctatggccctggtgattatgctgatcttcaccccaagaaagactagacgtttggcggcttgatttcctgaggcagtcgttatctagaagttcttcactgatttgagtattatacatgctgaataaagttggtactgtgcctatattggataatcctacaacgttcacagctcctgttttaatttgcttctggatcgagagtttctgtattacattttctttagaggaatctgtatcattttttgctg

SEQ ID NO: 9746 - DNA, 819 bp, Sorghum bicolor
  unsure (1)..(819): unsure at all n locations
  Clone ID: SORBI-28MAY03-CLUS32681_1
tgaaataaatgccaaagcagccctagatttggcagaatgcctaacagcaatgcaatcactgaagaagctgaccttggctgaaaatgaactgaaggatgacggtgctgtgattattgcanaatcattggaagatggccacacagatctcaaggaacttgatgtgagcacgaacatgctgcagagggttggagctcggtgctttgcgcgggcagtcgcagataaaccagcttttgtgcaactgaacatcaatggaaatttcatctccgatgaagggattgatgaggtgaaggaaattctgaaggctggtaagaaatccctggatgttctgggctcactagatgagaatgaacctgacggggagcctgatgatgaggaagaggacgaggatgctgaggacaatgaggacgagctggatttgaagctacagagcgtgaaggttgagcaggatgattgaccaagttggttttaaggttccaccagttacctgaatttgaccaagggaaatgtcctgggctcactagatgagaatgaacctgacggggagcctgatgatgaggacgaggacgctgaggacaatgaggatgagtttgattcgaagctgcagagtgtgaaggttgagcaggatgattgaccattcttaggttaaatatctttagcgctaactgttttttgttgcaatgtgctgtagaacttatgtggtggatgcactcaacccacgctgcaataaagtagtctttggcctcaaaacatatgttatgaatatcaaccagccagatcctgagatccatgaagattaactcattatatgggcggggatgc

SEQ ID NO: 9747 - DNA, 592 bp, Sorghum bicolor
  Clone ID: SORBI-28MAY03-CLUS33645_1
cttttctagttctagctaacttccccggcccgacatcttcgccgccgctcggtgcccacccagttgccgaggttgcaacgctgcagccggcgaggatcggatgaaccaacccctcctataaatcctaaccgagtcctctgctcccattcatctgtagagtgcaacagcactgccagaatcatgcagtgccccatggacactgctgctagtggaacctcaccagtgctgcagttccatagcaatgctgatgagtcgacctcccattcatctccattgccaacattaatagaacgttcacagcgccattgctgtggggatggaatcccaggtgaatttccccttgctgtgagcccctccattgtcctccatgtgctctcagcttgtgatctagacccgaaagatctcgccaatctggaggctacatgcacatttttcagtaaacctgcaaattttgcaccaaactttgcattgtcacttccagagcttgcggcatttgatatgtgccagaaaaggaccatgtttaagctgatgaagcaagaagatcaggagtgtctgaaacagcggtgtggaggatcttggaagcatgttctta

SEQ ID NO: 9748 - DNA, 855 bp, Sorghum bicolor
  unsure (1)..(855): unsure at all n locations
  Clone ID: SORBI-28MAY03-CLUS33650_1
gcacgagggtccccccctctccgcggcaccgcacgccatccccaaccagcctacggcggcggtacggccgacttctagcagttgcttccaatccattcattcgtccgcagatttctccattagccgtagagacagttgatttctaggttagtttgttgcctttgtggctttgttagtttattaggtctatcaaaaccaattcgccgacatcacttaagcaagggggaaagcaggggcagtaaaagaagaagaagagacaggaatggcaggacaaagctcagactcaaatcccaccgatgtgctcgaggagtacatgctgcttgagaaggatcctgatctctaccggatggttttctctggcccgagccagataagcccatggattgacccgagcgtgttaaatctgaagcaccggatagggagaggtccatttggggatgtctggatagcaactcatcatcagaggactgaggattatgatcggtaccacgaggtcgcggtgaagatgctacatccaattaaagaggaccagctgcagttcttctcagcgaggttcgatgagatcttcagcaaatgtcagggtcttggcaatgtttgtttcttgcatggcatctcaacacagaatgggaggatttgtatagctatgaagttctatgaaggatccgttggagacaagatggctcagcttaaaggtggaaagctccctttgtcagaagttttaagatacggagctgatttggcacgtggtgtactagacctacacaccagggggatattgatcctaaatctgaaaccttgcaattttctcacagacgaaaatgatcatgctgtgctgggggattttgggattncatc

SEQ ID NO: 9749 - DNA, 1151 bp, Sorghum bicolor
  Clone ID: SORBI-28MAY03-CLUS33658_1
tcccgtcttccgccgacccgccctcctgttccgcaggcgtctcccctctctgtccccctcccctcctgcaccccgcgctctcttcggcgccctgctgctggggccttgcggcggcgctcggcgccggccgcccctcgccgccgcagctcgcatcctcggccgctcccgtctcccttctgctggggcgtcgccccgcctgggcgccggtgccccccaccgcgcacgccgcccctcgcccccacccagctccggcctcacctcgcctcgccaccttcgccctctctgttcccggctgggtcgtgtgtcgtggtgcggactgcggctcccgctatgtgcgggcctcctgctgcggctccgccgggctctttgcccagcggcctggctcccgtcgtcggagtactctcccatgttgggcacgggcaggcggtctcgcgctttgccctggtgcctctcgctgtgctttttctttgtggggccgccctgaactgctagtggatttggttttggtcatgatttgacatatcttttagtgaatttgttatggcaggctagatctggagtgttgcctatctgcatggctacagttctgtgcacagttaagctggttaggctgatctgatctgataaattatcgtaatatttgtatcaggcgtcctttatctgggcctaaaacatgaagtccagttaagctggttaggctgatctgatctgatttatcaacatgcagaggattgacaggatgccctcctgtggtgaaattgttatgagtgttctcagttataatttatttgttctcttttttatattgcgaggtggattatgatacctgccattccttggtggattaaagcgttcaggtgcttcatcttgctggatgtctgtgacatccatcaggcatgccttccttggtttccagatagcagtagcaacacttcgacaagggagacaagtgcatagaccaagaacctgatgcaatggattttttttgaaggagtgccgctatactgcaaaaaaaattaagccttgtcatagatgtgaagattgaaagaggacttacttttttagttttcctaggttttatggtgatcagacatgttgtgttaatgtactggaattttttttataaagaatgtactagaaattgagttacc

SEQ ID NO: 9750 - DNA, 577 bp, Sorghum bicolor
  Clone ID: SORBI-28MAY03-CLUS33680_1
gctcgcggcccccggccacacttctctcatttcgccctcccccccctcgagccctccgccggctagggttacggccaccgccttccacgcctcccccacttcccgtccagtaggcggcgggaggaggctggtcggcgcgccacgcgaccgcgggcggcggagatggacccggacttctcgcccgggggcggggggcccagcttcgagttcgccttcaacgaggtcaacttctccgaccgggaattgcggatcgaggtcgtcgccggggatgacgacgcgccgggctcaagcggcggcggcgccggaggaggtggcctcgccgactgggcgcgccaccgcaagcgccgccccgaggagctcctcaaggagaatcaagcggcacctctcgcgtcggtgcaagcatctccccccggtgtcggcccagatgggggtgatgcgcatggtgttgatccagcggggcctgtggcggggacgccagtttcacgagtcaagacaatttatatcagttcggcgattcttgctgcgaagagtcctttctttttcaagcttttctcaaacggcatgaaagaatcggatc

SEQ ID NO: 9751 - DNA, 665 bp, Sorghum bicolor
  Clone ID: SORBI-28MAY03-CLUS33695_1
gcacgaggccgcgcttccgggggttatctcgcgcgggcgccggccatgtcggacctcgcttccacctgcaaggataaacttgcgtattttcagaataaaggagctcaaggatatcttaaatcagctggggttaccgaagcaaggaaagaagcaggaccttgttgacagggtattggcaatattatcagacgagcaaggtcaacgccatcatggatggggaaggagaaatgctgttacaagggagacagtggcaaaagttgttgatgaaacatacaggaaaatgcaagtatgtcctcctgaccttccctccaggagccacagtggatcagatttcaatcatttcaggcccaaagaggaatccactgacttctaccatgtagagactaaggtccgctgcctttgcaatagcacaatgctaaatgacaatatgatcaagtgcgaagatggcaaatgccaggtgtggcagcatattacctgcgtactcatgccggtttcgcccccggtgggcggtggccctgatctcccgcccctgttgtctggggattggcgccgtctgcacccggccgaccccttcgccgtcacggcaggaaatccattactacctgtgaaatttatgtcatctggtgttggaaatgatggagcaagtgtacctcaaattgtggaga

SEQ ID NO: 9752 - DNA, 676 bp, Sorghum bicolor
  Clone ID: SORBI-28MAY03-CLUS33720_1
aatccactccatactcggcgctcctccccagccgccgccgccgccgccgccggaaatccggaagagcagagcacactccgacactcgccatcccctctcggccccgtcgcccgcagctgccttggcataaaatcgccgaattctgcttcctcttctcggtctcggtctcggtctcgctctcgcagctctctggggtgcgctcatcgccggcggcagcggtgaggcatcttcgcctccggcttccttattacgatcaacccatcgatcgatcatggcgtcgtcgagcgcggctgctgctaccagtgatgacagccagggcctcaaggctcgagatgtctgcatcgtcggcgtcgcccgcacgcccatcggcgccctcctcggctcgctctcgtccctcccggccaccaaactcggctccatcgccatccagggtgctcttaagagtgcgaaggtcgacccggcgctcgtgcaggaggtgttcatgggcaacgtcctcagcgccaacctcggccaggccccggcaaggcaggcggcccttggcgccggcttgcccaactccgtcccctgcaccaccgtcaacaaagtttgctcctcaggaatgaaggctgtcatgtttgcggcgcagagtattcacctggggatcaatgatgtcgtggtcgccggcggcatggagagc

SEQ ID NO: 9753 - DNA, 679 bp, Sorghum bicolor
  Clone ID: SORBI-28MAY03-CLUS33001_1
ccgccccgccctctcccgccctcgtctccctaagcctacgcggtcgctcactttttctctctctctctcgcctcgcgttccccccgtgtgcgctctcccttcctctcttgtgaggagtgaggacggctggggcgaccgacgccgccgccgccgccctacgccaggtgccgaggtcgttgttgtgcccttcgccagctcttctccgggcccttcgccggcgacgagcacccaccaggatcagtgatatgatcaagtttctcttgttttcatctttcagttgctgatgcaaggctttcaaaagtttgaaagtctcacttgacgcaaaagcaacacaatcactctaaaggtttagacagtcatttcagagaatgggttcacggtttccatctcaccagctaagcaatggcttgtatgtctcgggccgccctgagcaacctaaagagaaggccccagtcatttgctcctcggctatgccttacattggtggggacataaagaaatcaggagagcttggaaagatgtttgatctccacagaaagtctggtctggtgcgttttcgtccgccgtgcctggctcccgtgggtcgtcctggccacaactctggaccagtttctaatgctgttggtcgctccaactactctggttctatttcgtctgcagttcctggtactggaggatc

SEQ ID NO: 9754 - DNA, 774 bp, Sorghum bicolor
  Clone ID: SORBI-28MAY03-CLUS3300_1
cgtccgattaacattatacttggagctgcaaaaggcttgtcttatttgcatcatgactgttcgcctcgaataatacatcgtgatattaagtcaagcaacatcttgcttgatggcaattttgaggcccgtgtgtcggactttggacttgcaaagcttttagaggatgaagaatcacatattactacaatagttgcaggaacatttggttatcttgcaccagagtatatgcaatttggcagagccaccgagaagactgatgtctacagttttggggttttggtacttgaaatacttagtggaaagcggcctactgatgcatccttcattgagaagggattaaacattgttggatggttaaattttctggctggtgagaaccgggagagggaaattgtcgatctgaactgtgaaggagtgcagactgagaccttagatgccctgctttctcttgccaagcaatgtgttagctctttgccagaggagcggccgacaatgcacagggtggtacagatgctcgagtcggatgtaattacaccgtgccctagcgacttctacgattcagagtagtctcctggacaaagccacactgctgctaatttcccgtggaggcgcattcctttattctttgcagatattgtgtaaatgcattgccgcggtgtttggtctccaaatcggctggttcaacgggtgacatttttgcgtctgtatacctatgtatgtatctgtcatgctacaagttggctatatcctgatttaataagagagaacttacca

SEQ ID NO: 9755 - DNA, 786 bp, Sorghum bicolor
  Clone ID: SORBI-28MAY03-CLUS3312_1
accaggctctgacaagatatttaactgatgctatgagagaatcaagggttcttgagtttttgcatgcgctggaaccacttgcgtacagaaagatggactttgaagaattctgtgctgcagcaatcagcccataccagctcgaggcttcggaaaggtgggaagaaattgctggaacagcttttcagcacttcgaacaagagggcaaccgagttatatcggttgaagagttggcacaggaactaaatctcgcgccaactcattactccatcgtgcaagattggatcagaaagtcggacggcaagcttaactttcttgggtttaccaaatttttgcatggtgtcacaatacggggctcaaatacaagacgacactaaacggttgcaaattgtattcgcttctaatttaaagcctctcatcaattatatggccctgattgctgttacccctacctcctgcttgccctgccccttcgtctggtcaatgaccattcttgtttgtgatgtcgccggttgttgtcgtcatagcttttgtagagtacatgtaaagatccttgtaatggcgaaatcatatggtttgctcaagaaatatagtgtcatttgttctttttggctcaccagttttgaaccattattatccgtggatagtcttttgtcgacttggtgcttaagttgttagcgttgctcagctaaataacatttcaggcacctgtaaggctgtaactccccgctgtacttgttttgtatgcacatacattattggcgtaaattagttgtacattatcagctt

SEQ ID NO: 9756 - DNA, 952 bp, Sorghum bicolor
  Clone ID: SORBI-28MAY03-CLUS33045_1
gcacgagggacaccttcgcgttcgaggacttcgatccagattctcagatagtttacatagatggtgcttttgatctgttccatgctggacatgttgagatattacggcttgctcgagaacttggagatttcttgcttgtggggattcacacagatcagaccataagttcaactcgaggacggcaccgcccaatcatgaatctccatgagcgaagtttgagtgttttggcttgcacgagggttgatgaggtgatcattggtgctccatgggacgtttcaaaagacatgattaccacattcaatatttcgttagttgttcatggaactattgctgaaaacatggactttgcagaggatgattcaaacccatatgctgttccaaaggctatgggcatttaccgccggctggagagtcccttggatatcacaacaagtactatcatcaggaggattgttgctaaccacgaagcttaccagaagcggaatgagaagaaggaagccagtgagaagaagtactatgagagtaaaagtttcgtcaatggggagtgaagttatgagtagcaggacttgcatgaagaatgttgcctagatcattttagatctcagccttttagcaacggcaacagttggttgatctacagttgtacctttttcttcagtatctttgatgttctctgctgacatagcttaggaagcatcaggcgcgacattgaagaatgactagcagagtcgatcgctagtttggcgagtctaggagcatttccatcatttccccagtgtctccagccaattttccctcgctgctgtattgtatatgcgccttccagctgttgtttccagctgagttgcatttgagatctataggctttccgaacccctcgaaattgtgcactacagtattgaaaacccctgaatgttagcgtgattaactattggctgctgagtttctttcc

SEQ ID NO: 9757 - DNA, 622 bp, Sorghum bicolor
  Clone ID: SORBI-28MAY03-CLUS33170_1
ccgcgaggcgcgtctcctctcgctgcctgcgctgcacgaggctttcttgcttcctcctctcttctccacagaccaagaatctcttcaccggttattcgcgggtcatttcatttcagtcggtgccttttttaggccaattggagggaacagaagggtggtctgtgtctcttttctttacttgctgcaagcgctttcgtggggagttgaatttgggcgcctcttgctccaggcagtattttatcgagcaggattctggtatccggtgattcttgcttgttgcaggcgccaaggcgaggaattgggcctagctccaggtcaaatccgtgccttgttgcgttaaatagaaggattcctggatgggtaacgcgctcaaggcaccatagctaaagatgtgagatttggtggtgtcagcagagattcttggtgtgtcagactgtcatccctggaaccggagtctgctgctgatttggtgaggacagtgcaggagaaacatgtctttcaggagcctgattcaggacatgagggacgagttcgggagcatctcgcggcacagcctgcggtcccggtctcaccggtccgccgggaacgcgtcgcgggcggcggccgcggggccgtcggaggc

SEQ ID NO: 9758 - DNA, 1501 bp, Sorghum bicolor
  Clone ID: SORBI-28MAY03-CLUS34099_1
gcacgagggatcccggagagcagagcgaggaggcgtgcgggcgagtgcggctgcctgctttgcttccgacgcgcgtgccctcggaatcggttggattccccacccaattcccgtcgccatggccgcgccgccttctccttcgtccccctcctcgtctggcgaggtcgccgcccacagattcggcggcaccatggatgcatcatcatcgccctcaaggacagagctcgtggccatggtgaagaagcactcacatttgattgggtggacaattgttgatgctgaggatgatgcatcagatgtaggaatggatgataaattctggcatgaaatgctcgatctattctttgtgcgtggcaggcaaccaaaaagaagtgaagatgacgacctcgtcttctttgttaataacatgaaattgcatggttatggttttaatgataacatggaagatccgcctcccttttttgtacggagatgggctcccacgcttgagaagatcagtattaatacagtggaggttgattgggaacgttcattctatttgaatttaattgctcacacgtcgtacactgtcactgttgcaatatttggcattggagatcttcgcaaccgtgcagcgaaaagcaaacagctgtctccagtttataaggttacaaaaactgtatacgcgtcccctagccgtgtaaattttcatcttgaccgaaggaaggctgtagaaacagtaccagcatatcccaacatctttttctcagtagacgactttgatgatacttttgatgctgtggttttgtcagatcctgaacactgctattgtgtgattctcaatgcacatgatggggcagcatttcctgaagaaactgagtccaagaatcctgtttcaaatatacagcctggagtgagctgtgggagtgcccaagaaaaaccaccaaagagaactctcttctcaggttacgtgagctaccaaaacgtccgtgaggcttatgatgctggcagatcaaaatttgggagcttcctctcacttgggcatgaccacaataagcttgacagacttttcatgaggggcccagaaggacgtggagaggtggaagtagctgtctgtggcattgcagatcagagccgtgagaagtcaaagaaagatccaggagatagctttcgagtccttgttcacagagcagcttctgctgcatcaaagctagcgaagcatgcttatgattctgcatctgctaacaaacggatggatgatgagcttgtgcctctgaagtgctgcttgatgtctgtgtctcttccttgggactacattgcccatgatcttttgcacaaggacacacctccattggatctatgaaggcagatctttactaccagtcataggacgaatccaggcataatgaaattaagacagaatcaaaatggaagcgagatgtacatgtgtacttttagatcaaatatatgtaaagtgagttttgcaacgtgcttgtgcacagatgatcatactatgtaaata

SEQ ID NO: 9759 - DNA, 663 bp, Sorghum bicolor
  Clone ID: SORBI-28MAY03-CLUS34178_1
ggctccttatatcacggaatcaaaaaggaattacgtatttggtgggatttccagtgttgctgctaatgcatcaataaaggcacttgctcaaatgaagtcaatcaacttgttaggagtccagcaaatatgcaggaattcgatagctctagaacaggctcttgcagccataccttcaatagatagtgaagcagtccaacagagattggatcgcgttcgaacgttctacgagttattaaatttgccttttgagtctttgcttggattcatcgcagaacatgaatatttgttttctgctaaagaatacctgagtgttctaaaggtcaatgtgccgggtagagagatacctgtggatgctgaacgacgcatctcacagattttgggtcactagatctaactaaaacacaatggtgctatttttgattggtcatgccttatgtgggctttggctaccaaacggcggtcttctgtagctttagctagtttttgctactttagttattttgttcatttgtatttctagtgtgggatgatatattcttttgtatgtcttaccagttatcattgattgtaaatgtgtagtgttctgaataaaatttccattattgattattgtaaatgtgttacctatctggatgcaatattaataacatcatcaaattcagt

SEQ ID NO: 9760 - DNA, 638 bp, Sorghum bicolor
  Clone ID: SORBI-28MAY03-CLUS34190_1
ctccccctgcaacccagcctcctccgcagatctcgctgcaactcagccacctctgaagaagatggcaacagacgcaacagccaactccatggcctcagcttccatgggaggaaacatgcaaggtgccatggatggcttttccaaccagttagccaaccctggcatgatgcaggcctcgtcctctgggcagatggtggagagcatcccatcagctgcaatccggagagatcagggaagtgatctcgcacagagagtttctgcagtgcttaggcaagcttggaaggaggatcaggacactggtcatctcttggggtctctgtatgaggtcttcggtgaagccatcttctcctttgtccaaccaccagagatatccttgtttgtgtagagaggaaatgcataggctctgggttttattattctacgctgttgtacaactagggatgttttgcagagttcacgaatgtaatgcaggttgtagtttagtcagttactgcatgtattcgtaacatattccaagttatgtatgctgtgctgcttaatgttatgtcacatagtattttttttcctgcagcagctgtggcgttaggcgttaagcagaagcgaacagtttcaagtatgtctatctacatgcatttgtg

SEQ ID NO: 9761 - DNA, 625 bp, Sorghum bicolor
  Clone ID: SORBI-28MAY03-CLUS34206_1
tgttgtggaaccaccagaatctattgaatcagttcctgatgctccatcaattgaagaagtagatgacactattattttgtgcttgggccaaatggcagtcactgcacggtcagatgttctttggaagcctcttaaccatgaggttctgatgcagaccagaagtgataaagttcgccccaaaatgctgggcctgaaggttatcaggtacatggtccaacatctgaaggaggagtatgtcgttctcttaccagagaccatcccgttcctcggcgaattgctcgaggatgtggagcttcctgtcaagacactgtcgcaggagatcttgaaagagatggaaactctcagcggtgaaagcctcaggcaatacctgtgactctgtgagagaagcctggttactcatcgggatcagcatgagagaagctactgcgatatgatgttttattgagaattttgatagaacaaaagtgtaatatatggaggattagctaaaagttgtcgggtaggtggaccccaataagatactgtagatccacccctgcttgagaggaggatttatggccttgtttggttcatgccggtaaactttagcacatatcatatcgaatatttagacacatgaaatatt

SEQ ID NO: 9762 - DNA, 551 bp, Sorghum bicolor
  Clone ID: SORBI-28MAY03-CLUS41701_1
gcacgaggaaatgcagaggcacgaggtttttgtagcgcgtctttggtgcagggactatgttatatgagatgccatggtaatgttgatgtatcattgtcttccataagctgccttcaaagattggtgcagctatcctggtctgttgacagagtgatccagggagccaaaaaaagttgttctgagtgtttcaatgagtctggaacaggtgtagctggcaagctactaggagaaggtatctccagtttatggcataatgatttgctacatttgttgacttcgctattgccaatgatttcatcacaatggtcaatatcacagaacatagagatgtttggtagaggaggaccagctcctggtgttgggtttggttggggggcatgtggtggaagggttttggtctcttaaatgcctacttgcacaattggattcacaattggttgtagaattgatgaaatgtttctcttcagttcaaggaagtcctgtcatccttgatgaaggtgtgaagtcagataatgtgactaacacagttgtgacagcttcaaattggatca

SEQ ID NO: 9763 - DNA, 1186 bp, Sorghum bicolor
  unsure (1)..(1186): unsure at all n locations
  Clone ID: SORBI-28MAY03-CLUS41789_1
gcacgaggcagcaatcacatcagtagcagaggagtcattagccaaagtgaagctcagccaagtaactaatgctagagcaggcagctacagtggaggaatgaagcgccggctaagtgtcgcgatcgcactgattggtgacccaaaattggtttttcttgatgaaccgactactggcatggatccaataacaaggaggcatggctcgggcatcatagaggaggccaagaaaggaagagctattgtcttgaccactcattccatggaggaggctgatattcttggtgaccggatagctataatggcaaaggggaaactgcggtgcattgggacatcaataaggctgaagtcaaaatttggaacaggatacattgctaacgttaatttctctggaaatggccacatgcagagccccaacatcaacagcatcactgaggctctggctaatccgaacatagaagctgtcaaatggtttttcaaggaacggcttgatattaatccaaaagaggagagcaagacattcttgacatttgtcatccctcatcacaaagaatcgcttctgacgagattctttggagagctgcaagacagggaaggggagtttggaatatcagacattcaacttggtctgacgacacttgaagaggtgttcctgaacattgcaaagcaggcagagctggagagctctactgctgaaggtaccttggtgactctcaacctgacatcaggagcaacaattcagattcccaagggggctcgttttgttggtattcctggaactgagacagaagagcatccaagaggcctcatggttgaggtttactgggatcaggatgaaaatggatcgctctgcatttctgggcactctgacgagatgcctgtgccagtccatgctgagccgaggaggcctccgtcactttctcgtagggcctcaatgggccgtggaggtccagttgggtatgtgattgacctgaaccaggccccatgaaaaaaagatgagtccaggcgcaacgtttagattggtttacatgtagagtatctagtacatataggaatcatctattcatgtctttgtttgtattagaagggtaactctatatgcagtagtaattggtaaagacngtgctttgcgtaagatcctatagtgtaacccttagtttttctgttatttggcaaacaaaggcttgtt

SEQ ID NO: 9764 - DNA, 737 bp, Sorghum bicolor
  unsure (1)..(737): unsure at all n locations
  Clone ID: SORBI-28MAY03-CLUS419_1
ggtcgacccagcgtgcgggaggagaagaagcagcaggaaagcacgagcagcatatgtcacagaggccagcgtcccacactcctcctgcatagccttcgcgctccattcccatctcctggtctccagtgagatgtgccccagctcctcttggcagcaatagcttagctattctctcccttccttttctctcttcttcccccaaattggtttcaagcctcgagctaataagcttcgagcttccgtttttagatttcttcctttgctctcctccgatccaatcgtctatccctgactcctcctgacaaaaaaaaagagaggaaaccgaggcgacaagcaagcaatgggtgtcaagggattcgtcgagggcggcatcgcctccatcgtggccggctgctccacccacccgctggacctcatcaaggtccgcatgcagctgcagggtgaagccgccgcggcgccgcagccagcgctgcgcccggcgctcgccttccacgccggtggccacgccgtcacgctcccgcaccacgacatcccggtgccgccgccgaggaagcccgggccgctgaccgtgggcgcgcagatcctgcggtcggagggcgcgcggggcctcttctccggtgtctccgccaccatgctgcgccagacgctctactccaccacgcggatgggtctgtacnacattcttatgaccaagtggacacccccggcggacaacaacgggaacggcggggtccttc

SEQ ID NO: 9765 - DNA, 1020 bp, Sorghum bicolor
  Clone ID: SORBI-28MAY03-CLUS41902_1
gcacgaggacttcttgacacgtatgttatgggcataggtgaagcagatgcgttctctgagagattgaagcaggagcttgtggcattggaggccgcaaatgtatatcaattactggaaagtgagcctttaatagaagaggtcttgcagggtctggatgctgctagtgcaactgtagatgatatggatgagtggttacggattttcaacctgaagctgaggcatatgagagaagatattgcatcgattgaatcacgtaacaacggcttggagatgcagtccgtaaataacaaaggacttatggaagagctagataaattgcttgagcgtctgcggattccacaggagtttgcagcatcattaactggaggctcatttgaagagtcacggatgctgaaaaatgtcgaggcatgcgcacgggggacaggggccattcgtactcttgaagttcctaatttggacccatgctatgtcaacatgcgcgctgttagagaaaaaaaggcagaactggagaaactgaaaacaacttttgttcgacgagcatcagagtttttgcggaactacttctccagcttggtagacttcatgattagtgacaaaagctacttttcacagccacgacgattgaagcggcctgatcatgcagaccttaggtataaatgcaggacatatgcccgacttctgcagcacttaaagagtctggacaagagctgcttaggtcccttaaggaaggcatactgccattcccttaatttgctactacgacgagaggcacgtgaatttgccaatgaacttcgtgcaagtacaaaagcacccaagaatcctgctgtttggcttgaaggttctggcggctctggtcataatggaagcagtgctgatacttcaacagtctcagatgcatactcaaagatgcttacgatatttatcccacttcttgtggatgagagttccttttttgcacattttatgtgctttgaagtacctgcacttgttccagctggttctcctaatgctaataagagc

SEQ ID NO: 9766 - DNA, 936 bp, Sorghum bicolor
  Clone ID: SORBI-28MAY03-CLUS41908_1
gcacgaggcttctaaggcccagcaggtgtctgttccctttccccacgtccccgagtcgagcgagtcgcggcgccgccaccaacgcgccacgttgctcagagcgctctcgctcccgccttgctatcccttaaccctagccgccgccgccgccgccgcctaaaccctcgccgcgcgaaccgcagcaacctcccgccggcgatggcgaaggagaagaagcggaagcagcctcccgccgacgcggcgccgcccccgggcgacgatggcgaggggaggagcgggcggaagggcaagaaggccaggaaggagaaggcggaggcgatactgccgtcgcagatcaagaacaaggacaagcgccgcgaggtgcatgccaagctcaagcgagagaagaaggcccagaagcgcgcgcttgcccgtgaacgcggccaggccgcccgccgcgccgaagagctcggggagcagccgccggagaggcaggtgccgcggacgatcgagaataccaggggccccggggagactgtgtgccggcccgacgaccaggagctgtttgcaggaaatgatgcggatgaattcaatgcagttctaaagcagcacataaccccgaaaatattgattacaacatgccgcttcaattcagggaggggacctgcatttattgacgagttaatgcaagtgataccgaattcccattatgtaaaaaggggaacgtacgaactcaagaaaattgtggactatgcaaaaaatagggatttcacctcacttattgttgtccacacaaatcgaagggaacctgatgctctacttatcattgggttacctgatggccctactgcacatttcaaactatccaaacttgttcttcggaaggacataaagaaccatggcaaccctacaagtcataagccagagctagtattgaacaatttcactacacgcctt

SEQ ID NO: 9767 - DNA, 674 bp, Sorghum bicolor
  Clone ID: SORBI-28MAY03-CLUS34562_1
aggaattgctgagctgaagaaaaggacctgcaagccaaagcgaccaaccatcaaatcattatttgagactgctgattgtgacgaccagccttctgatggcggttttctgaacctattacccacacaattggagctgccagagagcctggagccctcccctcactccagtatctcttctgaggattcccaagcacggaataggtagcaggtgtgtgttttctggcacctgcgagcttagcccaacaaaagcaagccacagaggcctttcgcatagtgatggatggctatctgcaggtttctgttcagaggacaagctccatgaagtttgcttttgaagagctgtttgaggtgctcagaagccatctaatatgtctgcactgcacatcatcctgtacatttttactggtttccaaagttcctttggcaacagcccgaggaggttggttgtcatagagagggaggtatttgttctctcctgtaaattcttggattctttgagttcctgagatttattctttcgttggagcatgccaagggggtatgctgcctgtttcttttttacttgcagaaatctgcatttctacatcgttgttgtaatatttgagacaatgtaaagaaattgcaagcgatgaacaagcgactggaaatgataatgaaaatactatttatcttct

SEQ ID NO: 9768 - DNA, 755 bp, Sorghum bicolor
  Clone ID: SORBI-28MAY03-CLUS34606_1
tagagaagtacttccatccagatcatatgtcatctgaagagaagatgaaattggagctccaaagggtgagggatgagttcaagatgtctgagaatgactgtgggtctgcacgagttcaaattgcccaactgactctgaaaatcaagcatctgtcagctgttctccacaagaaggataaacattctagaaaagggcttcaggagatggtccaaaagaggaagaaatacctgaaatacttgcgaagaactgactgggactcgtactgtcttgttctgtcaaagctggggctccgcgacgtgcctgagtacaaagctcctgactacaagagcaaagcaaccaccaaggctaaatctaagaagagcaagagcaagagcaagggcaagaagagaaaggtgaaggcataggagtggtgaacaaatacaccctttttggccttgaatttcatggtcagaaaatgaatcgagaagacacgcagcccccagatggctcgaaccaatcttgcaacgttgtattttttatttgaagctgtttgtaataaccatttctctggatgacagggtttttccttgttctgctaggagctgtaacctttttgtaacaattgatttcttatttcttttgagttctcccgctcaatttgctgagaagggaatggaggaacagatacgacagtacgataccatcacgttgtcaccagtatgtaactttaccataattctttgttcgcgtttcatgtaacttttccaggattattt

SEQ ID NO: 9769 - DNA, 811 bp, Sorghum bicolor
  Clone ID: SORBI-28MAY03-CLUS34633_1
gcacgaggccccctcgaggtttcgacgactcacgctcctgctcggtgctgctcctagcgtaccacgaagggggtaagagcttccttccagcctcgtgcaagatcgaccacccagttagaggatgagccgcagcctcgggatcccggtcaagctgctgcacgaggcggcgggccatgtcgtcacggtcgagctcaagaccggcgaggtctaccgcggctccatggtcgagtgcgaggacaactggaactgccagctcgaaaacatcaccttcacggcaaaggacggcaaggtgtcgcagctggagcacgtcttcatcagggggagcagggtcaggttcatgatcatacccgacatgctcaagaacgccccaatgttcaagcgcctcgaggccaggattaggggtaaaggctcagctgttggtgttggccgaggccgcgcagtcgccatgcgtgctagggctgctgctggtcgtggcggtggtcctgttgggcgaggtggtgcaccccctgtgaggaggtagatttgtctaaaggattgcgcacgcttttatctggcaaatcaagcttttgcccaagttgcaaaaactttgcttgggcagccatgcttgcaaggtagcttatctgcagcagtttgtgtttacagaatggatgcaggatttctgtaactttgccctgcagtgtattgctcgagtgtggtgtgagctttaagcgcgagaagactaaatagttttgacaacgctatatcgctattgagggtttgatttggaatatgtagattagtgactgctgcttgtactggtcagaaaatgcat

SEQ ID NO: 9770 - DNA, 710 bp, Sorghum bicolor
  Clone ID: SORBI-28MAY03-CLUS34676_1
gcacgccgctggttgccgcgctcaatttgtttatgagcgcaacggtgtgccgatcggtccaagggcaaattcagattggctttacatagtgccttggggactatacaaagctgtcacttacgtcaaggagaagtatggcacccccacaatgtttctatctgaaaacggcatggatgacccgggcaacgtcaccgtcgcccagggcgtgcacgacgcgacgagggttgcctactaccggagctacatcaccaagctgaaggaggcgatcgacggcggcgccaactgcgtgggctacttcgcctggtccctgctcgacaactctactcctatgattggcatgctgaatttgtttatgagcgcaacggtgtgccgatcggtccaaggctccactgcaggcaaattcagattggctttacatagtgccttggggactatacaaagctgtcacttacgtcaaggagaagtatggcaaccccacaatgtttctatctgaaaacggcatggatgacccgggcaacgtcaccgtcgcccagggcgtgcacgacgcgacgagggttgcctactaccggaactacatcaccaagctgaaggaggcgatcgacggcggcgccaactgcgtgggctacttcgcctggtccctgctcgacaacttcgagtggaagctgggttacacggccaggttcggcctggtctacgtcgatttcaagaca

SEQ ID NO: 9771 - DNA, 1125 bp, Sorghum bicolor
  Clone ID: SORBI-28MAY03-CLUS34760_1
gcacgaggtcccgctcaaggccaccagctgctgccacggcggcgccgatgacgacgacacgtcctacgccgaggccgagcccgtcgggctcaccgaggtcgccgtcggcgagcactacgaggttgtcgtcaccaccttcgcagggctgtaccggtaccgtctaggggacgtggtgaaggtagccgggttctacaactcgacgccgaagctcaagttcgtgtgccggcggaacctgatgctgagcatcaacatcgacaagaacagcgagcaggacctgcagctggccgtggacagcgcggccaagatcctggcggcggagaagctggaggtggtggactacagcagccacgcggaggtgtcgcgcgacccgggccactacgtcgtgttctgggagctcaacgccgacggcaacgacgacgtgctgcagagctgctgcgacgagctggaccgcgccttcacggaccccgggtacgtcgggtcacggaaggccagcggcatcgggcccctggagctcagggtgctgcagcgcgggacgttccagaaggtgctccgccactacctctccctcggcgccccggtgagtcagttcaagtcgccgcggtgcgtcggacggtcgaacaactccggcgtcctccagatcctctccgccaacgtcgtcaaggtcttcttcagcgccgcctacgactgacgacgacgcttgatcgatcgctcccggcctggacggcgacgcgagaggatggaggaaggagctgaggagaggtagaagacgagcgtgcatgcatgctctacagcgacgccacaccgctggcgcgtgcatgcatgcatgcatgcagtgcagtgatagatcaggtagtttgcagacttgcaggtatgcaggatacaatgttgatgcagaagattcaggtggttgttgtgatcatgtagcctgtctgcaagtagtagtgtcgtcgttaattcgagtgaaataaacctgttaatatctcttatatggtttcttctccaagatggatatcctttgaccctctgagcctgaggctctgagctctgaatgtttatccatcgatcggggggcagttgcgtgaccaacatgtacatcgtcgttttacaagcaagcaacaagcaggc

SEQ ID NO: 9772 - DNA, 1341 bp, Sorghum bicolor
  Clone ID: SORBI-28MAY03-CLUS33785_1
gcacgagggcctgccatttggattacagctgcaaagctagaggaggctaatgggaatgcacaatcagttaacaaggtgattgagagaggtatcagatctctacagagagaaggaatggatattgatagagcaccagggctgaaggaagctgaagccgcggagcgtgctggatctgttttgacttgccaggctattgtgaagaacactataggcattgctgttgatgatgaggatcggaagcgtacatgggttgctgatgctgaggaatgcaagaagcgcggttcaattgaaacagcacgtgccatctatgcacatgcacttactgtgttccttactaagaagagtatttggctgaaagcagctcagcttgagaagagccacgggactaaggagtcacttgatgcgctcctcaaaaaggctgttaattacaatccacgagctgaagtattatggcttatggctctccctagctggcctagaggagaaggttagtggcttgagtaaatcacgtgctgtcctcacaatggctagaaagaagaaccctgctacacctgaactctggcttgcggcaattcgagctgaatcgaggaatgggaacaaaaaggaagctgatgctctactggccaaggcattacaagagtgtccaacgagtggtattttgtgggctgaagctattgagatggcgccccgcccacagcgtaaaggaaagagtacagatgctattaagcgaagtgatcatgatccacatgtcattgcaactgtggccaaacttttctggcttgacaggaaggttgataaagctaggagttggttgaacagggctgttactcttgctcctgatattggtgacttttgggcattgtactacaaatttgaacttcagcatggaactgtggacacacaaaaggatgttctgaaaagatgtgttgcagcagaaccaaagcatggtgaaaaatggcaagaagtatccaaggctgttgaaaactcacacctgcctgttgaggctcttctaaagaaagctgttgtggggcttcatgtagaagaaaatctcaatccggcaggcgcctagactcactctttttataaggtgtttggtgaacatgttttgtactactatccttaaatttctgtttgcttcaatatgaggtactttaccttttaatattaatatttcatctttattgttgagttaatatttgatcatcagtacttgaacttgcatggcagccatgatttgttctactcttttctgtgtttattcttctcaatgggtaataagaaaattgtaatttaggctagcttttctccctttttttaaaaagaaaaatttttcctgtgcac

SEQ ID NO: 9773 - DNA, 1017 bp, Sorghum bicolor
  Clone ID: SORBI-28MAY03-CLUS33847_1
tccaagttatggattgtccatagggatttgaaacccaagaacatcctattagatcatgacatgaacccaaagattgctgattttggatcagctagaactctgagttcagatttcgctgaagagtgtacaagcagggttgtggggactagtggctacaaagctcctgagtacacgtctcgaggtgtatattcactaaagacagatgtgtttagctttggggtgatggttttagtgaccatcagtgggcgaaagaataccatactggagaaccaaggagattctgttggcacccttgtacgagatgcatggcaactatggaatgatggaaggctacaggagcttgtggatccaatgttgggtgatgaatttgaacttgctgaggtgatgcagtatgctcaagtagcactactctgcgctcaggaggaatcaacagatcgcccaaccatgtcggatgttgtgtcactcttgaactttcaaagcataagtttattaccagatcctaagcagccatcagagttgtgcaagggaggtgctactggtgacaagttatcgacatatgttagccagtcaagcaggaccatagacataacaatcacaagctcagctcctatatcaactagagtccgcatcactgtagacccagagacctcaaagtagacacaaattaatatgtaacagagcatggagaacttaaaatgtgataggtttgggccggttcatatggcactggccagcatttggggcttccagggggggtcggggcgtcggttttccctgggggtggtggtccccgtcttgttcccctgcggcatcagtatctttccatgtcctctgcacggtggcagagtgtttgtgtcttcggtgttgggaatcggggatgtgtgatgtctagttttgaagtttgaggaggaattttgatactttgacacaagttcgaagaagatggactttactccgaaagagatgtgtaaccggacactatagccatcttttcatggatttgaaacgtttcttttc

SEQ ID NO: 9774 - DNA, 758 bp, Sorghum bicolor
  Clone ID: SORBI-28MAY03-CLUS33894_1
tggcatgccgcagcctttggtgctgacgggcgtgtgtgcacctggggttggggtcacactggttgtctggggcatggtgatgaggaatacaaggctgttcccacattggttgaaggattacgcgacgtgaaggccgttcatctctccactggtgaatacacaacatttgtcgtcgctgagaatggggatgtatactcctttggatccggtgaatccttagttttccaggaggacgatgaagcagaggagggtccggatttctcgacaccgagcatagtcagctcgctcaaggctctgaacaagaaggtcgtgcagatcagccccacaaacgcctcgtactggctgaactcggaaatgggtcacccgcacacatttgcggtgatggactccggtgacttgtgtgcctttggaggagggatcagaggccagctcggcgtgaagctccttgagggcgtagaaaaagtgagcgtgccgatgcatgttccgattgttctcaactgatcccatcccaccagcatttgcctgaacattcgcgatggcactctggtctcggaaacaaccagtttgtgccttcgcaccagtgtggtaagcttagacatggtaggatgtaaatattagggagaatttgttttctctgaacttttcgaatgtgatatgaatcgtctggataaagtttacctaattaatgctgtgaccaactctgtttacccaacttggtgaccatcactaaaatcagtgattatatctggatattattg

SEQ ID NO: 9775 - DNA, 687 bp, Sorghum bicolor
  Clone ID: SORBI-28MAY03-CLUS33896_1
ccgtgtgcctttgctgtcccctcatcctgatacaggagcaatacaaaccatgagcatgatcagccacctcatctgcgcttgagggatcctacaataccggaacaagtaaatgttccactgtatgcggggccagaatcacgctattgcccagcccgggtttacgaatatgtctctgacgaaaaaggtgacccaaagcttcaaataaatgcacagaattgtcttcattgcaaggcttgcgacatcaaagatccaaagcagaacatcgagtggactgttccagaaggtggaggcggccctggttacacagtaatgtagaatacttgaaaggaaaaaaaaaacatgatgccttcaaaataataacagctcattcaccacgggtggcacactggaccaaatccccacccaaacctgggtaattgggttggaggttgcatcaagtatctagcaataagcaacttccctaagcagtagacaggatgtcaggatgttcctagagctatgtaccgatcaggatcaaagcgtgcttaacatggatggcacaagcaattggtcgagtgggggtccgggctgtacatggatggcacgagccattgggccggtcggtgtcgtgggcgtaaaattattggaggatgcaatttgtcgatcaataacatgagctgtagtgatacagatcggccgaaaaaaagg

SEQ ID NO: 9776 - DNA, 649 bp, Sorghum bicolor
  Clone ID: SORBI-28MAY03-CLUS33932_1
tcgcggagccgctgctgcggcagcggttctcgccggagccgtcgctgctgctcaaggggctggtggcgtgcacgggcaaccagttctgcgggcaggccatcatcgagaccaaggcgcgggcgctgcaggtgacgcgggaggtggagaagcgcgtgtccgtgccgcggcccgtgcggatgcactggaccggctgccccaacagctgcggccaggtgcaggtggcggacatcggcttcatgggctgcctcaccaaggacagcgacggcaagatcgtcgaggccgcggacatcttcgtgggcggccgcgtcggcagcgactcgcacctggcggacgtgtacaagaagtccgtgccgtgcaaggacctggtgcccatcgtggccgacctcctggtggagcggttcggggccgtgcccagggagagggaggaggatgaggagtaggagcaccgagcgccggctctggtttgtcctggtgatcatcgaccgaccttcctcttgccccccagagatgaggtgctgtttgttgtaaagtagacgcgctgccttcttccatatggcacacgatttgttttggtattgtcgtagcaaaaaagaatatgtccccttattcacgttacagagaatgccgataaataaagtaacacgctgcc

SEQ ID NO: 9777 - DNA, 721 bp, Sorghum bicolor
  Clone ID: SORBI-28MAY03-CLUS3399_1
cgtccgcccacgcgtccggcgttttattggcgatgaaaatggcaaggtgaaggcccttgaggtagtgcgtgtgaagtgggagaaggtggatggaagatttcaactcaaggagatcgaaggatcagaagagattattgaggctgatctcgtcctcctggctatgggattcttgggtcctgaagcgactatcgctgagaaactgggtttggagaaggacaacagatcaaacttcaaagcgcagtttggagactttgcgaccagtgttgatggtgtgtttgcagccggggactgtagacgtggacaatcactggtggtttgggccatcacggaggggcggcaggctgctgcagcggtagacaagtacttatcaaggtatgatcagaatgctgcaggcgacatcactccctccggggcagggctcgttcagcctgttgcggcataaaagcataaacggaagcatgttttaggttgtcgtcagtatatcctgtgaattgctcacagcaaatactcttcttgtagttgtctaagaaacagatacaaccgggcttatcaaggaaagaaagcccttctatattttgacgatagataaacagttgaaagttttggcggctattgtttctttttcttctccagttattatgttttgcatgtctgcatgtggttttgtagtccgaataatgtacagttttccctttattaaatagatgtaaatttgttgggc

SEQ ID NO: 9778 - DNA, 741 bp, Sorghum bicolor
  Clone ID: SORBI-28MAY03-CLUS34840_1
gcacgaggcggagacacatcgacctcatctactcggatctgatgaaaagttgcaagtacgaagctgcatttccgaagaacgtgatcgagatggggcgtgttagcctggcagtcaattctgctctggcatcatgtcggcccgatctgccccgccgagccgatcaaaaccatgcccacgctctggattctggagactggagcttgtgccttctgctgcccagcggtgtcaacggcgccgaggccaaggacaagtggggcggcagcaccgtccgctccgagctagaccacgtccacgcatcctactgtgcacggcgtgagcttccccgctgtgcgcttgtgcctgcagttctacttctgcatcgccgacgcgtatcgtacttgggggctaatgaaggtcgggccggatggtggtgaggccgaggtgctggcgatgcttgcagctgttccaaacaggctttaacagggagatatgatctagaagtcagacgcgacggggtggctccaaagtcagatgcgaggagaaagcaagtcacctgccgtacccgaatggcgttgcagtgagctctgcagactgagtgcaaccatatccgtatgtataacaaaataaagagtgtttagtaagggcaaggttagcaaatacacaaaaaaagagagaggaagttttggttacttgcacgagcaaatgcaacatgtatgtgacctgtgagattgacgcatggatgccccactctatccctaccgt

SEQ ID NO: 9779 - DNA, 627 bp, Sorghum bicolor
  Clone ID: SORBI-28MAY03-CLUS34931_1
caatatccttatttgcactgatgtagcaagtcgtggccttgacattcaaggagttgatatggtcatcaattatgatattccaatgaattctaaggattatgttcatcgggtgggtaggaccgcacgtgcagggcggtcaggatatgctgtatctttggtgaatcaatatgaagcccagtggtttgtgctgatcgagaagctccttggcaagcaaattgaccagcgtaaggtggacagagatgaagtcatgatacttaaagggcccatatctgatgcaaagagaattgcacttacgaaattgaaggattccggtggccacaagaagcgtagaaaggcgggagatgatgatgaagaggtggaggattattctcattctaaaagaccgaaatccttcaagaaatcaaacagacgatgaaggctctggagctctcctgatgaattagaatccgtgtgtacagctgcttcatttatccaaaagtcctctggttcagcgcagaccctgtgggtttgcagtgatggtgatgcatgttttagctatatactagggccagttaagacttctccaattttgtcatcccgatcaaaaccatgttacataagcaaatcatttttattgaagtctgagct

SEQ ID NO: 9780 - DNA, 691 bp, Sorghum bicolor
  Clone ID: SORBI-28MAY03-CLUS34944_1
atagtggagaaagtcatattgcgttggaggcgaaaaggggctgggttgcgcggatttcggtctacagaaggtgcaatggagggcaacagcagcagtagtagtaatttgatccaaaataaacctgctgaggatgattatgatttcttacaacaaggacggaaacaaaccgaggaaaggctgcagaaagctcttgccagagtgaagtcgatggctcagtacccagacgctcgggatcagtatcaaaggattctgactgttgtgacaaaaattcaagaatcgcaggccatgcaagaaaagatgctcgatgagtcgaccgagatggatgaaggcttctttatgagcgagttcaaagagctttgggatgatgacgtgccaatgccttcttggtcataacaactggtgtatatatgcttgtaaattatttgttagtgttaccaaattgataacccttagttgtgttactaagttaaccatatctagtgtgtgtatattttattttggttctggtcatagttatttagctatagtgttttgtacagtatatgttgtacagaaggataaacaaaggtttatgtatattaaacatgtcgaattatccttgactctgtaaagtttgttcagtgttaggggctttggttcaagccactgtttgtaaagtctaccgattgcttctatgatgtttttttgcagt

SEQ ID NO: 9781 - DNA, 679 bp, Sorghum bicolor
  Clone ID: SORBI-28MAY03-CLUS34956_1
gtttctaattgagatggaaggttttgacactggaaatgagcaaatcttacttataggagcaacaaacagaccccaggaactggatgaagcagcgcgtaggcgactcacaaaacgtctatacatccctcttccttcatcagaagcacgggcttggataattcgcaatctattggagaaagatggtcttttcatgctctcggaagaagaaacaagtgctatctgtaaattaactgaaggctactcaggatctgacatgaaaaacttagtgaaagatgcctcaatgggacccctaagagaggctcttcaaaggggcgttgaaatcacaaagctcagcaaggaggatatgcgaccagtgatgctgaaggatttcgagaatgctatgcaggaggtaagaccttctgtttcctcaagcgagctgggaacttatgaagaatggaacatgcaatttgggagcctatcgatctagtttatggggaggcatagaaaaaaaaggagttcaatggttttagtcggaatgtgacatctataacacctcgctgaactttagaagttcagcagtagaacaccaatgttttaaagcatcaaaatttgaacagtctatttggagtactgagtaatttcctggagcctacgatatcaaatcaattcaaatggctttgaatatcttttctggaaattt

SEQ ID NO: 9782 - DNA, 1106 bp, Sorghum bicolor
  unsure (1)..(1106): unsure at all n locations
  Clone ID: SORBI-28MAY03-CLUS34961_1
aaaaggtccacttgcacctgcccaacagnagcaagtcatagtagaactgacaaaggatcctaaactggtttattactgtgggatgaccccacagaagcttcctgatcttgttgaacacaacccgctcattgctgttgaggttctttcgaagctaattcactctcctgacattcctggttactttgatgttcttgtgcacatggaaatgagcttgcattctatggaagttgtgaacagacttactactgctgttgaccttccaacagagtttgtccatgagtacatcacaaattgtatccaatcatgtcaaaacataaaggataaatacatgcaaaacagacttgtgagactagtttgtgttttcctgcagagtcttatccgaaacaagattataaacgttcaagatcttttcatcgaggtacaagcgttctgtattgaattttcacggataagggaagcagctggtttattccggctactgaaatcgttggagtgaaagaatttgtatgtttttacttaccttctctgtaccatactgcatcttttttcctaattatgtatgtacatcttcattgtcatggttcagtcaaatgcctcaagggcattggatgcgatcatgtgctgtattgaaattttccatggaaccatttttggaacttgatgggctgtggtaatacgatgtgatagaaacgtcctgattgtttaaaattcctattgtcagatagactgattgtatcagacaccgaaagtttgaagtttgcctgttctgggtagttctctggccactgggtgttcaagatcggtctggtatgttacgcgcaccatctcaattgcagaatccgtggcaccctttgtaatgacagtgcatacccttgaaagagtggtggctaaaacagagtataccaagagcagtcggccagtcatcagataaccatgtgttaattgttggtgcatgtttagatcagctttgtactttgtaggctcatcatttgtatggaaacgaataatacatgcatgctttgatctagtcatatttgccgtgtaacctaaacaacgcttcaatctgttttattgtcagcctgttctcgcctggtgcgcggccctgg

SEQ ID NO: 9783 - DNA, 918 bp, Sorghum bicolor
  Clone ID: SORBI-28MAY03-CLUS34223_1
tgggatggggacggcagagtggagggcctccaagagcccggcttactacaagcgcggggactatgtgcctgggttaaaggtagatggaatggatgttcttgctgtgaagcaagcttgcaaatttgccaaagaacatgtacttgaaaatggaccaatcatccttgagatggacacctatagataccatggtcactctatgtcagatccaggtagcacctaccgcactaggaatgagattgctgggataagacaggagcgtgatccaatcgaaagggttaggaagctcatattggcccatgaatttgcaacggcccaagagctaaaggacatggaaaaggagataaggaagcaagttgacgctgccattgctaaagcgaaggagagtccaatgcctgacccatctgagcttttcacaaatgtttatgtcaatgactgcggtttggagtcctttggtgtagacaggaaggtggtgaggaccgttcttccgtaggctggcaaacaagagcagcagtacagtagtatggtctgtattgtgtacacgtaccgaggagcttgcactactgatacaggacaggcgaagggatcctctgttgccgtacgcattcctttctctggtaggaatagtacgaaataagtttgttcgtatgtatattgatgatgcatcaagtgctggattcggttttccgcatcacaatcacgggttatactttcctctgcttgtttgagctatgatgatgtgcagccgaaattttatcaggtgacccatgccatgcagatttttcttcaggtgagctattgcaatacttgcacagattccgtttccctgcacagtcccaccatgtaaacagtagttcgctgcattgttctaggcggcagctaatagctttttatttggtgagaaaaaaaaaaaaaaaaaaa

SEQ ID NO: 9784 - DNA, 718 bp, Sorghum bicolor
  Clone ID: SORBI-28MAY03-CLUS34260_1
aatggtccaagcgatatacgcatcagttgcccagaagtttccaggaatttcctggagaggtcattggcctatcatttcctccgcaaagctcatcatcagttgttgtatacagtaccagggctatgtgctacattgattttggattgccagtcgttgaggatgttgacttgccaaatcgatcagctggaccagtagagaagtcagatgccaaaaagacaacaaaatcaaggcagaagcgtaaggctcatgatgaagagtctaaacaagagaaaaggaataacttcaacttctttgcgttcaaagaaccggtgctctttgttgggcacctactggacagttcaattttaatagtagagaagcgatggatggatgttgttgaaggtttcagcgcaccggttcatagacacatatacggcacatgattcttgctaacattgacctttggcgctcgtgacaagcagaccattgttttgtttttgcccaagtaatgccaagcatcggtcctcaagcatgttaccagttgaaagggctccaagattttgcagcacaaagtggcagctgcacctaagctttagaatcggggattgtggcaatagtgtattgttcttttgttctctagtaatgtagtggactccctgcgccagtttgtcataccttgtcactgcgcaaaattttgtcatatgtaaactgtattatcacctctgttattgtcgagttg

SEQ ID NO: 9785 - DNA, 628 bp, Sorghum bicolor
  Clone ID: SORBI-28MAY03-CLUS34323_1
tactggactgggctcgaatccccgccgcggcgtgtctccgcacgaagcgcccccaaaatgccgcgggtgacgccgctcggcgcgagcctcatcctggagcacgtcctggccgacccctcggtccccgccgccgtggtcaccaagctcctcgtcgcgctccccttcccctcccacccgaccccgcgcctccgccgcgcggtcctcctccaccacctcgccgccgacccggtctccgaatcctccctcgacacgctccagctcctggccgcgctccccgcccccgcctccccaatcgccgccgcccacatcgccgtcgcggcctacctcgcggtctccgcgtccgacttcgacgtcgccgtgggggcgctcttcgcgcgccccaacggccgcgcgcgcctcgcggtcgacgagggagggtcctccgcgctcgcctccgatgaggtcatgaccacagtggaccagttcgaggccgccgtcgggaactccttctctcaggccgtcctcaggggcctgtggggcgaccggtccgccacggaggagcgggtcagggacctcctcgccgccgagtgggctgccattgggccgtcgctgctcgtgcaggcggctgagcggatcgtcggggatgggg

SEQ ID NO: 9786 - DNA, 1523 bp, Sorghum bicolor
  Clone ID: SORBI-28MAY03-CLUS34446_1
gcccccggcgctcctccggccccggccacggttcggcccccccccggccggcctccggccccccctcgtcctcctcgccgccgccgccgcgtcccggcggctggcgggtcctcgcccgcccgttcgcggcgcctgcccccccggccgccgccggcgcccccggccgcctggccccggcccccgcccgccctcgaggccgcgggctcctccccgcggtccgcccccccggggtggccgccgtcggccgccgcggcgacggcggcggcggcgtggccgccgcggtcgccccgctgccgccgcccctccctcccgacgatgaggccgcctccgccggcggcgtcgccgctgtggcggcgctgcatggtggcgtcgtcgtcttcttcctgctgctggttgggggggacgccgcctccacacgaggggaaagtaacaaatgcccttctgttgctctcatgttccaagttggagagaaagccacattttacaatatgggaggatgcaaagatatgccaggttcatgcacaagtaaaagttgtagacgtcaggtggtcgtcatgctcctctcctctggtggtgctgctcctcctcgacgtcttggtggcggccacctcgtcgacgctgctgcggggggtggcgacggctgtggtcgtcaccttgttgatgtctatgcatggaatccacattgccgataccttgatggactgggccctaaagagaacaatttagatgctcaaaatgattggcatggggcttggtggcacagttcactgaccgtccattcaggctttgttgatgatgataatccttatggaaaacaggatgagaagggcacatattattttgagttttcaagacccttaagaacaatggatcaatttcagcaggatgcacagttcacaataggacatcccagcaatatggctgtagccttttggtacccaactgatggcaaagcatggagcaagtccgatcattactcagccagttgcaactggttggttttggatatacaacgttcatctgaagctgcatattaccgtccagctcctaatcgctcttgggatgctgcaactgcctttgctttacttctttcagtggtagccatttgcctgtccatctttgtgggctaccgattttctaggaacaggagcactgcccagtttacaccacttgaacagatccagtttgctgaagaacgccattgattggaattgatattaggcgaagcagcaagaaacagtgtttcatctgtttcaccattgtacctccaaagttgacagattgctgcattgcagttttgaaccgcgatgttgtgagctagcataggacatattgaaagcatacacaatacagaattatagactgccgatttttattctaggaaacaatttcggtaaatgttgtacattaactctgggttattggcttactgcgccacttgatatcattctagattctacctgtaacacgtgtggtggttgtttcattggttgtataatatttgaatatatctaaattggttc

SEQ ID NO: 9787 - DNA, 681 bp, Sorghum bicolor
  Clone ID: SORBI-28MAY03-CLUS34466_1
cggcctataaacaacctccgtcgcctcctcctcgaatcccctcctcccctcgacccctagcagccactagggtttctccgctcccaccccgcctcctctccctctcctccgatgggcaagtcaagcaagaaggcggcggccgttgccgcggcgcccgcggcggtgcccaaggggaagaagcgggaggcggaggacgagatcgagaaggcggtgagcgcgaagaagcagaaggcggcgccaccgccgaaggccgtggtgccgtccaagaaggacgccaagaaggccaagaagcagccgccccccaagaaggttgagagcagcagcagtggctccgaagaggactccgagtctgaagaggaggttaaggtaccaaagaaggcgcctgctgctaagatcgctaaacaagagtccagtgatgatgacagcagtgacgcgacctctgaatctgatgaggaacccgcaaagaagcctgctgttgtgaaaaatggttcgaagacagccaagaaagagagcagcagtgatgaggacagttctgatgatgagtcagatgacgttgaacctgcaaagaaggctgctgctaaacccatgggtgctgttgccaaaaatggtttgaagaaaggcaagcaagaaagcagcagcgatgaggacacttctgatgagtcagatgatgatgataaacct

SEQ ID NO: 9788 - DNA, 1187 bp, Sorghum bicolor
  unsure (1)..(1187): unsure at all n locations
  Clone ID: SORBI-28MAY03-CLUS34573_1
actagttctcatggagttgaattcaacttcccaactgcattccatgggtactgtatgcgtcatgttagtgaaaccttcaaaaaggagttcaacaatccagtgcttgtcaaccttctctgggaagctgctcatgcactgactgtgatagagtttgaaactaagctgctggagatagaggacacatcatcagaagctgttgtctggataaggcacctacctcctcgtctttgggccaccgcttactttgaggggacgcgcgacggtcatctaacagcaaacatcacggagtcgctaaattcctggatactggatgcctctggccttcctataattcagatgatggaatgcatccgtcgccagctgatgacttggttcaacgagcgtcgcgaagcaagcatgcagtggaacacaatcctcgtgcctgcagccgagcgccgtgtgcaagaggccattgagcgtgcacggggctaccaggtggcccgagccaatgaggcagaattcgaggtcatctcagctcacgagggaacaaacattgtggacatccgcaacaggtgctgtttgtgccgggggtggcagctctatggtgtgccgtgtgctcatggtgtggcggcactcctctcctgtaggcagaacgtccaccgctacaccgagagctgtttcacggtggcaacataccgcaagacttactcgcaaaccatacacccaatcccagacaagaccctctggaatgaaacagcagatcatgaagtagcagatcaaggacaggctgaagagaccaagatggagatggtcatcaacccaccaaagtcgctgaggcctccaggacgtccgaggaagaagaggatacgagcagaggaccgagggcgagtcaagcgggtcgttcactgcagccgctgcaaccagactggacacttcagaaccacatgtgctgctccaatatgaacaatggcataatgatggtgtaaaatacgctgcaaccacttcagaacttcttttttattaattatagctgcagtatttctgtgacaagttagtgtctacttgtgcaagcttcttgcttgcagatggtctttggttattatacttggacactgctcttgttctagcattagtagttaaataatgtcaatttcaagntttgtatcatagcaccataatttctggaaatcttcaagtgtttttttctt

SEQ ID NO: 9789 - DNA, 728 bp, Sorghum bicolor
  Clone ID: SORBI-28MAY03-CLUS3533_1
ctgcggggtgtttggtctagtggtatgattcctcctccacccgctcgccctttcccctatccacgagcgagccaccgcagagcggagcgaggcgaaccgcagcggcagcgccagcggcagcaggatgccgacgctgaacctgcgcaccaacgtgccggtggacgcggtggtagccgccgacatcctcaaggactgctccaaggccgtcgccaggatcatcggcaagcccgaatcctacgtcatggtgtcgatcaacgggtcggtgccgatgtcgttcgcgggcagcgaagagccggcggcgtacggcgagctcgtgtccatcggtggcatcggccccggcgtcaatgggaagctgagcgccgccgtcgccgaggtcctcgagaccaagctctccgtcagcaggtccagattctacatcaaattcgatgacgtgcagagatccaactttggcttcaacggatccacattctgagacaactccagcaggactggagacgattggttgctgcgtccaaacgaccagctcggtccgccaatacataccatcagtacatcaataaacgttgatcatgtgtatcacctgcaccaccgccgtcgcccatggaaattccgcttgagtacgagacaccactagtttatgagttttaatatttcaatgtttcaactgaaagcagcgatagcatgtacctgatttcaaatgtcattgaacttcattttcagtacaatca

SEQ ID NO: 9790 - DNA, 612 bp, Sorghum bicolor
  Clone ID: SORBI-28MAY03-CLUS35503_1
ctgttggcctctggaatccacggtggtcgtgctcaccgattttcctttttcccgagtggattagcgcgtagattacagatcttcttcgtcggcggtgtggcctgtgagagagaccaaaaatctcagattccggcgagggatctggcattctcttctcgcgccgcaaacaaaggtcgcggctttcgtgttgttgcccatccggtggcccggttgctgaccgagcgtggaggttggtggtgcccgctagctgttcgacgacggtgacgacgaggccggggtcgaccatggtggcggcggcggcggagcgggtggtggcggagctccgcgaggcgtgcgcggcgccggcggcgcggctgaacgaggtggcggcggccatggaggcggagatgcgcgcggggctgcgcgaggagggcggcagcaagatcaagatgatcatctcctacgtcgacaatctccccaccgggaacgaagagggtgtcttctatgccttggatctgggcggaacaaacttccgcgtcctgcgcgtgcacctggcggggaaagacaagcgtgtcgccaagcgagagtccaaggaggtgtccatccctcctcacctcatgtcaggcaacgctt

SEQ ID NO: 9791 - DNA, 1127 bp, Sorghum bicolor
  unsure (1)..(1127): unsure at all n locations
  Clone ID: SORBI-28MAY03-CLUS3558_1
gcacgaggcttgtatcagtgctcgagcgtttactccaaccacaaggaatgcccagtctgcaaaggtgaggtgactgaggcaaatatcactcctatatatggtagagggaattcaagtgcagagaagactctggaggatgnnggaagccaccaggtcctacaatcccgccgaggccacatggaaatcgccatgaaagtttcaggcagcaattccacaatatgcgacctatctcaaggattctggcatcatgggggcgtcatctggatcagcagatcatgagcagcgtgagtaggtttgaagggctgtctgaatcggcctggatagaagtaaatgaaaatcgtcaacgtgctcgcctaagaggattggcattggccacgaggatgagagtaaggcagttgcaaatagaagctgcgtcccgtcctggtggttcttcggctggccctgataatggtctgacaggaaacaatgcatcagaatctctgacaggaatgcggtgcatcagaggtcaccatagacgtgcgctcaacaacacgcgtatcagatggacttgatttgttggaacgtcttgcttttggcacagaaagactactagctagtgccgtgactgaccttagaagaattgcttcaccaagccaatatggaggatctgcttcctcatcgaatcctcaaaataatgagccagcagttgatggagctcgcattgctggagcaccttctgcagatcaagcatctaattcgagcactgttgcagtgatacaaggggatgctggtatctctgagagtgcaggggagcctagcaatgcaggctcttcgagatccttgaggaggagagggaggagcaatatcttaggttcattggatgtggatggtggaggcctccaacagaacaagagacgcagaatgaactgaaccctcttgacatctgtgtttgtcccaaaccacacttggcctccttcgctgatttcagtcgttgtatttcatgacttccggtgatatcagctgcattgtagcatgttgtagtttcgttttttatctgttcaggtttcactgaaacagttccttgatcagtttgctctgtagtctgtgcccctaccagttatcagaatcgagttcttgctatccagcag

SEQ ID NO: 9792 - DNA, 702 bp, Sorghum bicolor
  Clone ID: SORBI-28MAY03-CLUS35480_1
gcacgagggacagggagggagacagagagggttgggggaggagagtagagagttagaggcacggggagacaacgggtgctcggtgggaagaggaagaggctcgtggggagggggagggatccagaagaagatgaggcggtgggtcttggccatcgccattctttccgctgcttcggcggcggcgctcttccttggggctgaggcccaggcggtccagcagcagggccaccagacagagaggatctcagggagtgctggtgacgtgttagaagataaccctgttgggaggctcaaggtttacgtctatgatctccccagtaaatacaacaagaagctgctgaagaaggatcctaggtgcctgaaccacatgtttgccgcagagatcttcatgcaccggttcctgttgtcaagcgctgtccgaacttttaatcctgaagaagcagattggttctacacgcctgtgtacaccacatgtgacctgactccttcgggtcttccccttcccttcaaatctcctcgcatgatgcgcagcgcaattgagctgattgccacgaactggccttactggaacagatcagagggtgcagatcatttctttgtcacaccacatgactttggtgcttgcttccattatcacgaagagaaagcaatcggacggggaatccttcccttgcttcagcgtgctacactggttcagacctt

SEQ ID NO: 9793 - DNA, 706 bp, Sorghum bicolor
  Clone ID: SORBI-28MAY03-CLUS35580_1
atcttcacggcgacgccgctggcgaacgccggcacggtgacggccggggtggcggagggcgcgcccgtgatccaggcggcgctggaccggatggacgacgggtactgccggtcgccgctggactacctggagctgcagccggacctgtcggcgctggtccgcggggcgcacacgttccggtgccccaacctggggctcaccagctgggtgcgcctgcccatccacgacgcggacttcgggtggggccggcccgtgttcatgggccccggcggcatcgcgtacgaggggctcgcgttcgtgctccccagcgccaaccgcgacggcagcctgtccgtggccatctcgctgcaggcggagcacatggagaagttccggaagctcatctacgacttctgatctccgagctcctcccaagaagtcgtcagtaccataccaaccagtacgcgcagcacagagaagcagaagaagcggtagcaagaggtgcagggagggtgatttttcagctatgaagtctggagggagtactccgtaggttgcagcaagattctttgatttcacacatagttcctgcacactttcccgttcttgcctgccccctttgggcagggtgtatacttttttgtgccgtttggtttacgagccccagcaattgtatgatgaatgaacaatttaatacgttctgaatgatacagatcaataagactaa

SEQ ID NO: 9794 - DNA, 1200 bp, Sorghum bicolor
  Clone ID: SORBI-28MAY03-CLUS36300_1
gctcgacgccccctgcggtcctccagggcttcgccgtcccggccgacacggccctcttcgtcaacgtgtgggccatcgggcgggaccctgctgtgtgggacacagcggacgtgttccgcccggagcggttcatggccggcagcccctccgtggactttagagggaccgactaccagctcatcccgttcggcgccggtcggaggatctgcccgggcatcagcttcgcgctgccggtcttggagctcgcgctcgtcagcctcctgcatcacttcgaatgggagctccccgccggcatgcgtccggcggacctcgacatgggcgaggcaccggggctgaccacgccccggcacgtaccccttgtcctagtccccctgtgcaagacgctcgctcaggcgcttcggctccacgcaccagcgccgctcctcgtcccgcacgaatcaacaacgcccgctgttgtgcagggctaccagatcccggccaagacggcgctcttcgtcaacgtatgggccatcggacgggaccccgctgtgggacgcaccggacgagttccgcccggagcggttcatgggcggcagtcgctcggtggacttcagagggaccgactaccagctcatcccgttcggcgccgggcggaggatctgccccggcatcagcttcgcggtgccggtcttggagctcgcgctcgtcagcctcctgcgtcatttcgagtgggagctccccgccggcatgcgcccggtggacctcgacatgggcgaggcaccggggcttacgacgccgcggcgggttcccctcgtcctagtccccaagtgccggacgctcgttcaggcagcgctgcagtagctgaggcctcagggaatttgttgtggctccatgggtaccgaggtttgtctatttgagaagttgtgcttcaaagcaaaattcaagaacactggttaccgaaaaacaacacacacgtaagaacacgtttgagtgctcccgaattgcagaaagaaatcggtttcttgttgactgcagtacatggcatggttctccctggactagactggacagtgtggtatttcacgtttatatagtcttggcctcttgggccagaataatgagatggccataagtgacaattgggctacaccatcatctcaatgtatatatgtaatatatatcctatattttcacgattgttaatagataacgtgtatattt

SEQ ID NO: 9795 - DNA, 700 bp, Sorghum bicolor
  Clone ID: SORBI-28MAY03-CLUS34771_1
gtccccatctttccacagcctgagaggtccatgtaccgtggcggtgagtttggatacacaaggcttgtagcaacaagggagaagctaacattaacctatgtggggaaccatgatgggcaagtccatgatatggtggagatattttctggcctggtatccagtaacagtagtgttgctgtggcagtgcatgacaccaaacttggcacagaagtcagcaccgtgcgaaaaatatctccattgtacttggaaatcggaggcagtgtattgtttgcactgctcctgggattttcctttggatttcttatcaggagaaagaaagaagctgcacagtggactccagtaaagaacgaggaatcataatagttgccaataccacgagcctggtgcagtggtgttaaatccaaacttggacttaattgctggaatagaccctaacacagtgaagtcatttgttcttggggggctctgtgtccttggtacacgagtgtatagttgtgtaagattgtgcctttgtatatggtagtcttgggaaatgaagtaatctgttgctgtaatagtccaatgtataagcatgtaataagtgatatcatcttcacattgcattggttgacacaagtgtttaacctgtaccataatttgacatggtttgttgagtcgttaaagtggacgttctttgtagttgaaccatttttggttaaaa

SEQ ID NO: 9796 - DNA, 818 bp, Sorghum bicolor
  Clone ID: SORBI-28MAY03-CLUS34791_1
aatggaatatctccatgggaagaatatagtccatttcgacttgaagagtgacaatctgcttgtcaacctaagggatcctcaacggcctatatgcaaggttggtgatttgggattatcaaaggtcaaatgccagacactaatctctggtggagtaagaggaacacttccttggatggctcctgagttgttgaatggcagcagcagccttgtctctgaaagggttgacgttttctcgtttggcattgtgatgtgggagctacttacgggtgaagaaccttacgccgagctgcactatggcgccattataggtggaatcgtgaataacacgctgcgacctccggtgcctgagccctgtgatccccagtggaggtcactgatggagcagtgctggtcagccgaaccctcagagaggccgagcttcactgaggtcggcaagagcctgcgcgccatggcagccgctgctcctaccaaggcacaacaacaatcgaaatagatgctttagccttcttctacctctcgcgcccttctgtttagcagactgtttcagtcttcaaactgaggaggtgccaccatggctagcctggtatttgtacatgaatgaataagttgaagaaagataggagaatatggcatgcttatagaatcggtggatggttgatgcttcatgtcttgcttttggcatggatacgtgggaaatatacatatggagcgagcggtgagcatgtagatgaatcagaagatgaggtgttataggatctgctggcgactgatgctcgtgcgctcttgtccattgcgatttctttttcgtccgtgctaat

SEQ ID NO: 9797 - DNA, 1066 bp, Sorghum bicolor
  Clone ID: SORBI-28MAY03-CLUS34804_1
gcacgaggcgcctccctacggctcgtcgcccgcgccctcggccccgccctacggcgagacgaagccgcccaaggaaggcaagacctcctcctcctcctcctccggcggctccgcgcccccctactacggcggcgcgccacccccttcccatccctcctacggcggcgggggcggctacggcgcgccacccccccaggacggcgcgccaccgccccagcagtacggggcgccgccgccccagtcctacgggggcggcccgcctgcgccgtacgggggcggagggtacggaggcagcccgttcgcgtcgctggtgccctcggcgttcccgccggggaccgaccccaacgtggtcgcctgcttccaggccgccgaccgcgacggcagcggcatgatcgatgacaaggagctgcagtctgcgctgtccgggtataaccagagcttcagcctccgcactgttcatctactcatgtacctcttcaccaacaccaacgtccgcaagatcggacccaaggaattcacttctgtgttttacagtcttcagaactggagagcaatatttgagaggtttgatcgtgatcgaagtggcaggattgacacatcagaactgcgtgatgctcttctcagtctgggatattctgtctctccaaccgtcctagatctgcttgtgtctaaatttgacaagactgggggcaagagcaaagcaattgaatatgataacttcatcgaatgctgcctcactgttaagggactgactgagaagttcaaggagaaggacactgcatactctgggtcagcgacttttacctacgaggccttcatgctgaccgtgctccctttcctcatcgcgtagtggcagtttactccacagctcaaaacaagctttataagcctttttaagtactatatgtaatactatgcctgctgtacaaagatggttatgttcgcagagttgtttttcgatgagtttcagttctggatttaacttctgttgcgagtcataaagttattctgaaatggagaaggtacttgttggttgaacagatgccttatggttgtggcctgaggg

SEQ ID NO: 9798 - DNA, 630 bp, Sorghum bicolor
  Clone ID: SORBI-28MAY03-CLUS3483_1
ccggtcccgggaagcatcagtattggaacagtacacacgccgtcatggcgctccagctcctccgccatgcgctggtgtcgctgctggtggtggccgttcacgcggccggcgcgacgcgcgcgggcggcgacatgcaccacctgcagatggtgacctccaccgccggcacggcgcgcgcggtggcgtcgtgcgcgagctggcggctcggtgtggagaccaacaacatccgggactggtacagcatccccgccgagtgccggagctacgtccgcgactacatgtacggcgacctgttcaggcaggactgcgcggtggtggcaggcgaggccgccgcctacgccgaggggctcgagctcgccggcgacggggaagaggtgtgggtgttcgatgtcgacgacaccaccctcaccaacctcccctactacgccgacaccggcttcggggctgagccgtacaacgccacctacttcgacgagtacgtggcgaacgcgacggcgccggcgctgccggaggtgctggagctgtacgagaagctgctgtcgctgggcatcaaggtggtgttcatcaccggcaggcacgacgacgaggaggcggccaccgtcaagaacctccgcagcgccggctaccaca

SEQ ID NO: 9799 - DNA, 804 bp, Sorghum bicolor
  Clone ID: SORBI-28MAY03-CLUS34836_1
agattgtggcaaaaaaactggaagaaaacctagagattacaggcgcatccttagaggctcgaaaattggtggttgaaatttgtgacattgtggcaacaagagctgcccggctggccgctgcagggcttgcagggatcctcatgaagctcgggagagattgcagtgtcgaggatcaacgatcagtcatcgccatcgatggaggattgttcgagcactacaccaaattccgccaatgcttggagaccacactgggcgagctgctaggagatgaggcgtctaaggcggtggccgtcaagcatgcagatgatggttcaggaataggtgctgccctgattgcagcttcacaatctctgtacaaaaatgacttagtggccgtcaagcatgcagatgacaagcatgcagatgacaagcatgaagatgcagatgacaagcatgaagatgacggtaaaggagtcaagcatgcagatgacggttcagaaataggtgctgccctgattgcagcctcgcaatctcagtagagaaatgtcctcgaaatctcagtagagaaatttcgagtgatatagtagtatcagccatgggtgcttaccatagatgtaggaaagactagctagcaagtagctataatgtctttccaacatcttaacagtccggcatctgcagttagcatgctggacctggatgtaatctataaccaaaacgaggcttggcagctggatgcaatctgtaaccaaaacgaggcttgggaagtgctgttcatagttccaaacttccaataaaagcggagttgcagatgtctctaattcg

SEQ ID NO: 9800 - DNA, 714 bp, Sorghum bicolor
  Clone ID: SORBI-28MAY03-CLUS36235_1
cattgatcggtcatcctgttgaaaatttaagaattgtactgactgatggggcttcacatcaggtggattccagtgaacttgcttttaagctagctgctatctatgcttttcgacagtgttacacttctgccaaacctgtaatattagaacctgtgatgaaggtggaactcaaatttccaacagagttccagggcaccgtaactggtgatatgaacaagagaaaagggatcattgttggaaatgagcaggaaggtgacgacaccattgtagtttgccatgttccgctaaacaatatgtttggatatgcaacagctattcgatcagtgactcaggggaaaggtgaatttacgatggagtacctggagcataatgttgtctcgcaggatgtacagatgcaattagtgaactcatacaaggcggccaagggcacagagtgattcttctttttgcagaagaataaattttgtttacaaactttcagtagcatcgaattcccggtcctcgggacatcacaaatagtaggcgataattcaaactatatggtttctcagtgaaaatacaagggagctatgctgcaataattggcattcccacagtagaattgtacaatatctagcaaatgtcggaagtttagtttgtaatgattaccatgtcttggcatgggaacatcttgtgcaatttctcccaaaaaaatatgggacactttcaatccct

SEQ ID NO: 9801 - DNA, 696 bp, Sorghum bicolor
  Clone ID: SORBI-28MAY03-CLUS36245_1
ctcccgctggcttgggcccaccttccggccagtgatgtttgccccgtacccggcgctactcgagcgggggaccgcaaccgcagcgtgggggcgttgcccgccatctcgactcccgttggcttggccgcacctgcggcgtatcctgctgcgccccatgcctggcgcgaccgttatcctcaactgccccccgcctgggggggctctgtctccccgccattgtcttcttggaaatctgagtagccaatctggtattttcaactctgtcaccgtcacatatctccaaattgtcggtctgcagaagatgctcaggtgcactttgcaaaagcgtccatatgatgtgcttgcctttttgcaagctatgatgtttggtacttgtttgtattgcatgcctcattttgtatcaagagcttttaccatgaatagcttgaagatttaaaccactggttcaatgaataaccatgtgcatttgtatcaagagtacaagtagcaaactgaattttgcctcgtttcgcatcagggggattgtccatgggtctagggtatggggtacacgcactggttcgatgaatgaccatgtgcatttgtatcaagagtatttagcatgactagcaaactgaattttgtaatagttgtaaaaaaaaatgtgattgtaaaatgtactagatgtggtacgctcatgcaaacataactataggc

SEQ ID NO: 9802 - DNA, 792 bp, Sorghum bicolor
  unsure (1)..(792): unsure at all n locations
  Clone ID: SORBI-28MAY03-CLUS36248_1
atttttgggtgctaaagactggaactcagatatccctggtgatgctgacaatgaccaaacattggacacaaataagaagggtaaagactccaggtcaatgaaactttttaagagtgcctgtgccggtctgggtatcggagttcttaagccatcatggaggcaaggtaacatgagcacagaggctttcaaaactattgtcaggaaaacagttgataaggtttctaattcagtccctagcagtcatattccgaaaacacctgccaggattaaacattatgtacaatcctctcaaaagaaggtgaccaaattagtaatggggtatgtcgacaagtatgtgaagccgtagactaatggggcattgtgctgagccaatcagaactgttaaggttcagagtctgtgctgcattctactaaagaggctgcaaattgggcaaatctttctgcattctactgagagattcattgaggctgctgatagaaatcctcatgtgccggagtccaggacccatcaaaactcgagggctttagtgtctgcttttgtaagaactcataaactgaaacagaacttaaggactcctcagtttacctgcaccaagccttgtttgtgcatttggtttgttcccaagacgctgcagcctgacgagcacctctgtaaaaaccttggcttggctcctccggtaaagaggaaaaggctgaaatttaagatgacgtaatgtttgtgacttataccaactagtacttcatgttctagtccaaaggaaaatactagtacttncagtttgaaaatactag

SEQ ID NO: 9803 - DNA, 749 bp, Sorghum bicolor
  Clone ID: SORBI-28MAY03-CLUS36275_1
cctatatgatatgctgcaaaaagaggtaatttctttgagaaagacatgccatgaaaaggatcagattctaaaagataaagatgatgctattgagatgttagcaaagaaagtagacaccttaaccaaagcaatggaagtggaggctaaaaaggtcagacgagaggttgcagccatggagaaagaagttgcagcaatgcgtgccagtaaagaacaagaaatcagagccaagcggcttggtacaaaaggctctggtagttcacagctgcttcctggaagaaacgcaccacgaagtgggtcgatgcgcaacttccagtgatggcagcactaacaccaagcagcattcttggatagatccttttctgttccaccatttgttccattcctatcctattaattttgtggctaaaatcatagcacagtgagatgacccaacaatacctagatcagggtaagagtaggctcggatcttatgagaccattgtgagagtgaaactgagcctatgtgtctaaccttgtggcgcgccctcgtttctttttattagtccaggcagtgcacctgatgcttgtataggctggggatcttcgcatgcccaatctgtaatgtagcttgagtgctcagttacacaggacacccgttgcccaggttgtgaatattgtatcctctcacatgcttgtttgcgctgctctgtttgccctgtgtttgggttggaattttttaacatggcttctggcttgtctaagttctgttg

SEQ ID NO: 9804 - DNA, 740 bp, Sorghum bicolor
  Clone ID: SORBI-28MAY03-CLUS35019_1
atattgggctggtccagcaagagccggcgctgttcgcgacgacgatctacgacaacatcctgtacggcaaggacggggccacggaggccgaggtcgtcgaggcggccaagctggcgaacgcgcactcgttcatcagctcgctgccggaggggtacaagaccaaggtcggggagcgcggcgtgcagctgtcgggcgggcagaagcagcggatcgcgatcgcgcgcgccatcgtgaaggacccggctatcctgctgctggacgaggcgacgagcgcgctggacgtggagtcggagcgcgtcgtgcagcaggcgctggaccgggtgatgaagaaccggaccaccgtgatggtggcgcaccggctgtccacgatcaagaacgccgacgtcatctcggtgctgcaggacggcaagatcatcgagcagggggcgcaccagcacctgatcgagaacaagaacggcgcctaccacaagctcgtcaacttgcaacagcagcaacagatgcagacgcagcagagctcatgagacatgttgaataaaaagcgtgtgtttctatcttgctgtggcgttgtctttcttgggcttttgtaaaagatctgtgctggtaatcttttcaatgaaatgtttcaaaaaaaaaacttttcagtgaaagggagtgttcagaattacaggataaagcgttattggattgttatttctttgtatgtactagattattacagctgaattttagtagtgtgatac

SEQ ID NO: 9805 - DNA, 706 bp, Sorghum bicolor
  Clone ID: SORBI-28MAY03-CLUS35082_1
acaagctcgcggggcaggcggcggcgcgtcacggcagcggcggcggcaaccgcgcgtccgagcccgacgagaagccggcgaatcgagggcggggagaggaagacgcggcggcggcggcggcggccgcaaagcgtgccgagccggcgtcggtgctggcgctgacgacgacggaggcggcctcgccggtgtcgtcgagcgcggccctggcgacggcggtggcgcggcggcggagcctgttcagcctgggcatgtcgctggcggtgggcgcggtggcgtggtcggccgacgcgccgtgcctgccgctcctggcggggctgttcgctgtcgtggccgtgtccatgtgcagcgtgtcgcggctgcgtcggcgtcgcgccggcgcgggcgacgccgtcgcgctgctcagcctcaactggttcctcctcggcctgctcacctcacccatgctgccgggcgtcgcgcacgccgtcgtcccacgcgccggccgaaccctcggccccgcgctcacgtggctcgcagccgccacgcccctgcccccgtcactgtgacccgaccgcaggcaaactggcaaagcgtgtaccgcgttcgtcggatacgcatttctttacgctatatatgcatgtaacttcacacgtactggaactgtactataaaaacatctggctcatacggtcaccttgacgttttttaggcttttgtgataaacata

SEQ ID NO: 9806 - DNA, 1107 bp, Sorghum bicolor
  Clone ID: SORBI-28MAY03-CLUS35129_1
gcacgagggagaatgacagcgtagagggactcaggccaaatgcacggggccctggtcttgttacctttgggcctgatagagttatggagttctgcaacaacaatgacctgcagttgattgtgcgagcacatgagtgtgtgatggatggctttgagcgtttcgctcaaggtcacttgatcactcttttctcggctacaaattactgtgcaccggcaaacaacgcaggtgcaatcttagttctcggaagggatctggtggttgttccaaaactcatccatcctttgccgcctgccattacatcacctgagacatctccggagcatcatattgaggacacatggatgcaggagttgaatgccaacagaccgccaacaccaaccaggggccgccctcaagcacccaacaatgaccgaggctcccttgcctggatatagcagcctggccgtactatgaaacaattgatttcttgcctcccaccagtggcttgaggctatactatccatccatcctgggcacatgcaggcggtctgtgctggaagcacatgctagcccaaaacaacgtcgaaagggaactgttcagggagcgagactaagcggtgctctgaagacgaaggccagaagagattcaccaatcaccgcagacagcgctcctcaaatccttttcccaaacatgagaagtagaagaacagaatgaagtgtcggtaaaccacagggtcttgcctgagatcgcgcctgtacatactcagatgccagcagataggcggggggttgtgtatgtgttaatttttgttgagcgtcaaaggggatagcagcgtccattgtactaggtattcatttgctgtagattttttgtttgtctctcgtgttgcaaagtatggagtgggaaaatgggtttacttatgtcgggtcttgtataatagtgttgtcgcctgtttatgttagcagtgagttagctgtcagcacaccttacacctccctcctgttgtaattctcgtcaccagtgctgagaatgtgtacaatatattgttgtctgttgcccaaagttttgggttatggacgggtttggtgatttgatttgatttattacagaagccaatatgttgttcg

SEQ ID NO: 9807 - DNA, 1185 bp, Sorghum bicolor
  Clone ID: SORBI-28MAY03-CLUS35155_1
gcacgaggctgataatcaatgtagttgctgccgtcagttctggaaacgtgccgttgaatgctgtccagttgctgtgggttaacctaattatggacactttgggtgcccttgcattggcgacagaaccaccgacaaaccatcttatggagagaccccccgtagggagaagggagccattgataacaaatatcatgtggagaaacctgattatcatggctttgtttcaagtttcagtccttcttactctcaacttcaagggaataagcctcttgcagttgaaaaatgatgataaagcacatgcagataaagtgaaaaataccttcatattcaacacatttgttctctgccaggtgttcaacgaattcaattcacgtaaaccagatgagctcaatatattcaagggcatttcagggaaccacctctttattggcatcatagcaataacagttatactccaggcgcttatcgttgagttccttggcaagtttgcctcaacagtaaagttaagctggcagctgtggttggtatccataggccttgctttcttcagctggccgctggcattcgtgggaaagcttattcctgttcctagacgtccacttggagaattcttcacctgctgctgtagggggagcaaacaagcccctgatgacgcaacctctaatgacaaggaagacaacaaacccgagccttgagatgtcctaagatctgacggttggcaacggtggccttttgcagtttcttgcggggatttgacgtgttggatttgtaattaccactgattgcgattgtatttacatacacgggtagttctcggcctttggaagtttgcagcatcatctaaccatccatgcgtcttgatacgtgaccctagctttcgtgtggcatttcaaacaggaatggctggaaatgcaactcggcttctcttgagactgtcatttgtcttagttcgttcgcaactgtatattgtagctaggaagaccgtatttcagaaatgtcaaacaggagtgagctgccataacaatggatggtgcagcatcatgcgcagtgttgcctaggcagcatccagtggttcgtggatgctttcgggtgtcgagttgcctgtgttcgtgccgtaacgtttgacaagtgggcttgtaacttgaagcctcccgatgcagagaaaatggagtgtgttggactgcg

SEQ ID NO: 9808 - DNA, 750 bp, Sorghum bicolor
  Clone ID: SORBI-28MAY03-CLUS35166_1
ttcaggactggtgggatgcatgcccatgccgcacaaaactctggtggctcaactgtcaggatgcttattcagctgttgccagtcctactgctgctgttgctcaacttcctgccatcatctgaacctgtctactcgttgtcccgttcctacccttatgaacataagttccaaaccccacgtggagttgcatactatgtcaagatgtctaattttgaggagcagtatccacaccaaagcactgagcgagcgacgctggagcggcatgttgagagggattattactccataatcacgcagaattgcagggtcgagctacagcgtcgccaatggggtctgtcataccagacaccacattgtgatatgcttaaaaagtttgaggctacagcagagtaataattctccaatgatggaaggttgacagggagaagagaatgctggcctcatgtaaaggtgctgccttaactgccagcttcaaatttgagaggacatttaatttggtctagtagtaaattttgtggaataagtgcctttgacgactatacaccacccactgtcgagatgctctcttagtagtgttaaggagcgttacctagctacttctaaaagatatgtaagcttcataggggttgatcacatgcaaaccagtgtatgtatatgaagtatatctatctcattctttaacttttttgaagtgaagagtttagtggaaacagaaatgcaactataacacaaaaatgggttgttcatttt

SEQ ID NO: 9809 - DNA, 738 bp, Sorghum bicolor
  Clone ID: SORBI-28MAY03-CLUS36676_1
gcacgagggtttcgcctcccgtcgccggccccggcgagccccgccgccttgatctcccccgaccagaccagcagcttccccactccccagcctcgcacgccgtccccttcgccggcgccgtcatggcgttcggcagacggagccccgggtcctcgcggcaccgtcccgcgctcaccatcgtctcggcgctactcctcgccttcctctcctccgccgccgccgccgcggcggcgtcgtcgtccaccgacgcgatgcacaacaacaactgggccgtgctcgtgtgcacctcccgcttctggtttaattatcgacacatggcaaatacattgtccctttacaggactgttaagagattaggaatacctgatgagcgaatcatacttatgttggcggacgatatggcctgtaaccctaggaacagctatcctgcccaagttttcaataatgagaaccaccagctaaatctctatggtgacaatgttgaggtcgattatcgagggtatgaggtgacagttgaaaatttcttgagagttttgacaggccgacacgaaagtgctgtaccaagatcgaagcgtctccttagtgatgaaggaagtcatatacttttgtacatgactggacatggtggtgatgaatttttgaagttccaagattctgaagagcttcagagccatgacttagcagatgctgtgaagcaaatgaaagagaaacatagatttaaagagctgctgataatgg

SEQ ID NO: 9810 - DNA, 1647 bp, Sorghum bicolor
  unsure (1)..(1647): unsure at all n locations
  Clone ID: SORBI-28MAY03-CLUS36716_1
gcacgaggcgcgctccctgtcgtctcccccgctcgtccgccccgcgcggccgtttcacctttctccccaccgcttcccatctctccagcggcgacgactcctgcggagatacacagagatgaggacgaggagcgggtcccggtattctaacggcggcgaggtcgttgccttggtggggcagaagaggaagaggtcggcgttggccgtcgccggtgagtgcgcctgcggcgggcgcaggaagcggcttgccggtgggccggactacctggacgcgctccccgatgaccttgtcctctccatcctgaccaagctcgccgcctcctcctcggcgccgtccgacctgctgcccgtccatctcacgtgcaagaggctcaacgagctcggcggccatgacatggtgttcgccaaggcctcgccggcgtcgctggccgtcaaggcggcggcgtggtccgagccggcgcagaggttcctcaagcgctgcgccgacgccggcaacctcgaggcctgctacattctcggcatgattcggttctactgccagggcagccgcagcggcggcgcggcgctgctggcgagagcggccgttggcgggcacgccgcggcgctctactcgctggcggtgatccagttcaacggcagcggcggcgctaagtcggaccgcgacctgcgcgcgggggcggcgctgtgcgcgcgcgcggccgcgctgggtcacgtcgacgcgcttcgcgagctgggccactgcctccaggacggctacggcgtgcggcgggaccccgctgaaggccgccgcctcctggtcgccgcgaacgcccgcgagctcaccctcgcactctccgcggcgaccgcctcgcgccacgccgtcaccgcgctacccttcgccgcggctgctgctgctgccgccgccgcgggcggcgtcggtggcggcgggtgcccgctcctgtcggactttgggtggagcctccccgaggcggagccccacgcggcgaaccagttcatggtggactggtgggcctcccgctgcgccgcccaggccggcgggaagaagcccgacggcgacagcagcggcgtggacggcagcgacggcgcggagctccgtctgtgctcccacgtacggtgcgggcggcgcgagacgcggcggcacgagttccggcggtgctccgtgtgcggcgcggccaactactgctcccgcgcgtgccaggcgctggactggaagcgcgcgcacaaggcgcagtgcgtggccatggaccggtggctcctcgccggcgttggcggcggcggcgaggtcccgcaaccgcagcagtgaggaaacgccgtttctcccaacggctgacatgacgtaccagcactcccctaaaccggggccggaccacggctccgccgcagcggccgtgccggtcggcccaccgtagaccgggcgtagcgaaaaggcgcgcaggaggaggaaggcgtttcacggctgtttttttctctctttccaccgcaccagctgatgaattgaatgaggtttactcgctgccgtttgggcccgggtgtcgtctttgtacagatgtacgtattctactaggaaaaagcagtagagatcctcttttgtttttgtaatcttctggtatttctaaaagctagaagcggagtactagtagaattncc

SEQ ID NO: 9811 - DNA, 885 bp, Sorghum bicolor
  Clone ID: SORBI-28MAY03-CLUS36727_1
gcacgaggcttcgactcttcttcaccctccgcacgaggctcactcgcgaactcacgagattaccaaatagacgagggagaaggagatggcgaagaagaaggagaaggcggtgaacgtgtcgggcaagccgcggcactcgaacgacgtcaaccgccccaatgacaagaagggcgcgggcggcggcgccggcggcgggagccggtccgcggccaccgtgcggcggctcaagatgtacaagacgcggcccaagagggaccgcgccgggaaggtgctcaggaacgacttccagtctaaagagctccccaacacccgcatcgtgcccgaccgccggtggttcggcaatacccgcgttgtgggccagcaacagcttgctttttttcgggaggaactcacgagtcagctttccgacaacttcagtgtcatcctgaaagaacggaagctgccactatcgctcctgcaagatcatcaaaagcaagcaagggcacatcttcttgatgttgaaccttttgagcatgcttttgggccaaagggcaagaggaaacgcccgaaactaactgctcttgactatgaatctttgctgaagaaggctgatgattcccaagatgcatttgagcaaaagtatgcttcatcaaagttgccaagggaggaagaagaagatggcttacgggatctagtgaggcatacgatgtttgagaagggacagagcaaaagaatctggggtgaactatacaaagttattgactcttcggacgttgttgtgcaggtgttggatgccagggatccaatgggcactcgatgctaccatctagagaaacatctaagagagaattgcaaacataaacacttggttttcttactaaataagtgtgatctaattcctgcttg

SEQ ID NO: 9812 - DNA, 592 bp, Sorghum bicolor
  unsure (1)..(592): unsure at all n locations
  Clone ID: SORBI-28MAY03-CLUS36782_1
gagcaagcagagaaagaggaggagatggtganggtgagggtcgacaaagccgagaagcagcggcacctccatgaggaggatgagactcaggtgaggacctcatcgcagtaccgggaggagactcacttcaggagcacgcacgagacgcattaccaccacgaggagagccatgtcagcaggagcacgcagtatcatgaggggatccacgtgaggagcgacacggattcgccgtcgccgccacacttcgtctaccactacgacatccagccctgatgacgctgaacagcagccgtctctaacctttgttttcctgggtgtcttgtgaatgcttctcttggctaacctgtcccccagaggttgctaaaattgctgatgattgatgaattgttgggtgtacatgcaggtgtagtgaggtagtgactgtaaaaattctggtgtgccatgggacctgaacattgattccatgcagaaaaaaaaatgtggaggaatcaagtttgaagtattgtgcgtggtatatatgagaatgtctcgcgccgaatcttcacaatttgtttgaaaccacggaaaacggaaagcataatagtgttcggag

SEQ ID NO: 9813 - DNA, 881 bp, Sorghum bicolor
  Clone ID: SORBI-28MAY03-CLUS375_1
gcgttcgcccagcgtccgcccacgcgtccggtggggcgacagcttgggaggtttcacgacgctgttcacggcaaccgaggtgccggagctggtccggggcgtcgtgctgctcaactctgccggccagttcggcgaccccaacaagccggccgccgcaccggccgaggaggaggagggcagcccgctgtccaggttcatcgtgaagccgctcaaggaggccttccagcgggtggtgctggggttcctcttctggcagtccaagcagcccgccagggtcgagaaagtcttgaaaagcgtgtacatagactccagcaacgtcgacgactacctggtcggttccatcacggcgccggcggcggaccccaacgccggcgaggtgtactacaggctgatgtcgcggttcatgtcgaaccagagccggtacacgctggaccggctgctggggaagctgtcgtgcccgctgctgctgctgtggggggacctggacccgtgggtcggcccggccaaggccgcgcggatccaggagttctacgccgacaccgccgtcgtgcacctgcaggccggccactgcccgcacgacgaggcgccggagcaggccaaccgggcgctgctcgagtggctcgcggatctcgacgcccgcgccaagccggccgagcccagcctccagaccgtctgatcgatcaggcgtcaggggcttagcgtacatacatacactagtcaaagcatacaatttggtggccatgtgccaatgtagcataacactagttaaagcatacaatacggtgattcccatggtgcgagtaattgaggagttgggttctcggacgaatgacaagtgattgatcaaaattaatttcagagaaatggatttcacataaaac

SEQ ID NO: 9814 - DNA, 748 bp, Sorghum bicolor
  Clone ID: SORBI-28MAY03-CLUS35721_1
cctggggcacaaggggtccccatgaaccaagttactccatcacagggcagcgacgaggcaaagccatcagatgctacagtggcagatgcagctgccgcgacttcagaaggcactgcagctcccccagctgcagaaggtacagcagctcccagcagtgaggaacctaacgcagcagcacctggcaatgaggaaggcacagcacatccagtcaacgaggaagccacagcagctggagttccagatgcagcaggcagccctgatgtgcctgctccggctgctcctgctcctgctcctgctactgtagctgtagctgataccagtagctcggatgcacctgctgttactcccagtgaagttaccgtctccgccccctcaaccgaggcacctgagttgacggataagccatcttcaacagaggcatcgttgccacctccacccactgtttctggtgtataaaatatttctgattcttttagcgtgtgccaatttttttgtatgctggtgcgtccgttccactgtaattttccccgaatactgttataggtatttgttgtccatggcattcagatttcgtagacgccaggcagtatgtgagtagccttgtacatctgctgccttcgtctcgcgagaacgtgctaccattgtgtcacattgtgtgggcatagcttatgttggtttgtgaccaatcaataggaccacagttcaatctttgcttgatgagttaattgaggtgcatcgtcgatatcct

SEQ ID NO: 9815 - DNA, 1154 bp, Sorghum bicolor
  Clone ID: SORBI-28MAY03-CLUS35853_1
gcacgaggcgccttcccaacccgcatcgacagcgcgcacttggattcggcgacgccggagcgcggaggaggcaagcgccgatccagagacgatggccgccgcgggctcctcgccgtcatcctcctcaagcaagcggttggaagggaaggtggccctcgtcaccggtggcgccaccggcatcggcgaagccatcgttcgcctcttcacggagcacggcgccaaggtctgcatcgcggacatccaggacgaggccgggcagcagctgcgcgacgccctgggaggcgacgcgcagggcgtcatgttcgtccactgcgacgtgacgtcggaggaggacgtgagccgcgccgtggacgcggcggcggagcggttcggcgcgctggacgtgatggtgaacaacgcgggcgtgacgggtgccaaggtgacggacatccgtgccgtggacttcgccgaggtgcgccgggtgctcgacatcaacgtgcacggcgtgttcctggggatgaagcacgcggcgcgcgtcatgatcccgcagaagcggggctccatcgtgtcgctggccagcgtggccagcgccatcggcgggctgggcccgcacgcgtacacggcgtccaagcacgccgtggtcgggctcaccaagagcgtcgccgcggagctcggccgccacggggtgcgcgtcaactgcgtgtccccctacgccgtgcccacggcgctgtccatgccgcacctgccccagggcgcgcgcgccgacgacgcgctcacggacttcctggccttcgtcggcggcgaggccaacctcaagggcgtcgacgccatgcccaaggacgtcgcccaggcggtgctatacctggccagcgacgaggcgaggtacgtcagcgcgctcaacctcatggtggacggcggcttcacagccgtcaaccataacctcaggccattcgatgattagctcagcttgtttagcagcattattatcactcttgttctgctgctacttttgagactttttctttttgaactgtaacaagtgtctgtaagactaataaaccgcgtcttacatgattggacattttaagcgacaatgccgaattcgcgtatggtatatggttgctgaatgtgctaacaaatgagtttcagcagtgcctaaacaggcaggcagtttc

SEQ ID NO: 9816 - DNA, 1211 bp, Sorghum bicolor
  Clone ID: SORBI-28MAY03-CLUS36016_1
gcacgagggctttacttggcgtcacataccgcacatctcgtagaatcagtcctttgacagcaacagctatatcaactgttcaatcgatgcccttatcaggttttggtggaagtggatcatcttttgcatctgatgatccattttcctctaaggaagggcctccacaaaatttccaactgtacagctgggagacctatcagcctgtaagcggcctgcttgcacaacctgagtggaccgtgtgggaccaaactgttgagtattgcgcatttgcttatcagcagtatatagtaatttcttccttgcggccccaatttaggtaccttggcgatgtctcaattccctttgcaactggtgccgtttggcatagaaggcagttatttgtggctacaccaacaacaattgagtgtgtctttgttgatgctggagtagcagctattgacatggaaacaaaaaggagaaaagaagagatgaaagcaagagaagctcagagtcgggcagttgaagagcatggagatttggctcttattactgttgaagctccccaggttactgtgagtgaaaaagtatcattgaggccaccaatgttgcaggttgttcgtttagcctcctttcagcactctccatcgataccaccatttatagtgccgaagccacccgggttcgatggagatgattcagtgtttcacaaagaactagatgacagaagatatgctgaagttgctgttgctggaggaggggtgtctgttgcagtaactcgcttccctcctgaacagaagagacctattggacctcttgttgtggttggtgtaagagatggagttctctggcttgttgacaggtatatgtgtgcacatgccttgtcactcagccatcctggtataagatgtcgttgccttgcagcatatggggaccctgttagtgctgtgaagtgggcaacgagacttggccgagagcatcacgatgacctggctcagtttatgctgggtatgggctatgccactgaagctcttcatttgcctggaatatctaagagactggagtttgaccttgcaatgcagagcaatgacctgaaaagagcacttgcttgtctattgacaatgagcaatagccgagatgtgggacaagaaacagctgctgctgatgccactgacgttacacagattcttaatttggcggtagctaagcaagctaagcaggaaagtcttgcagat

SEQ ID NO: 9817 - DNA, 1125 bp, Sorghum bicolor
  Clone ID: SORBI-28MAY03-CLUS35648_1
gcacgaggcccacgcccggctcttcttcactcgagccgcacccccctcaactctcaaccgctgaacgcagagttctcgacctagcacgcgcggccgccgccgcagccctcaatggcgtcccttttcaaggacccgagcaagctttcggcgtacagggaccgtcgattcaaggggacgcaggaggagtatgaggcgacgctgcttgcgtcgactacgctgtacattgggaacatgtccttctacaccacggaggagcaagcctacgagctcttctcccgcgccggcgagatcaagaagatcatcatgggcctcgacaagaactccaagaccccatgcggtttctgcttcgtgctgtactactctagagaggatgctgaagatgctgtcaaatacattagtggaacgatgcttgatgatcgtccaatccgtgttgatttcgattggggctttgaagaaggcaggcaatggggccgtggacgaagtggtggacaagtcagagatgagtaccgtacagattatgatcctggaagaggtggttatggtaagatggttcagagggaactagaagcacaaagagaattagttgactatggtggatcttttcaaccgaatgcaccacctccctatgagagaggtgagcggaagagaggatacggagattctcataggaatgacagaggagattaccagcggaaacgctatcggaacgacgaccggtcggcaccagaggagtccaagagagcaccagactctgatccagcggagaagaatcccagattccgtgagaaaggtgactctgatgaagaagaggatgactacgacaagagacgtcgtcgctagcgatgtgtggatcagttgttgctacatgcaacagttctggtatccagtcgctgcagaagagtccacagctagcagcagtatccggatttcgccctgttgtacaacagtctttgttcgtcggtcggccgttcctccttttctagtactcctatcatctgttagcctgaatgtgcgttggttttacatgtggctttacagtgagcctaatctgtatgtttgctgctgatgaagactatactgagaccgatgcatatatgaattctaaattattattacctaatccta

SEQ ID NO: 9818 - DNA, 1073 bp, Sorghum bicolor
  Clone ID: SORBI-28MAY03-CLUS36142_1
gcacgaggccgaagggaactaattagggtgtatctatcaaatgtggaacaaatttgccggcgctttattgatgaaagaagaagcaagcttagcaggttgattgaggataaactggggtggtccagtttctgtggattctggctagcaatggatccaagtgtgcgtcggcacatgacaagggaaaagactgaaactatattgaaagttctagtgaaacaattctttatacagaaagaagttacatcaaccttggtaattgactcaccacgtggcggacttaaggcacttgaataccagagcaagaacaaaaaggcgatacctaaactaacagagacagatgctcggagcactccaatggtacttattgatcaggacatgtttgttttggctgatgatgtgatacttctgcttgaaagagctgcattggacacactgccacaccaaccattgcctacaaaggatgataaaagttcacaaaaccgcacgaaggatggcaactcaggtgaggagttcagcaaagattctattgagcgtgatgatagacggcttatagagctaggctggaagacattggagctttttgccttggctcatatattcagccgaatagaagtggcacatcaagaggctgtggctttgaagcgccaagaggaactcattcgtgaagaggaagcagctggactagctgaaattgaacttaaggcaaagcgtaatgctgctgaaaaggaaaaacgtgccaagaaaaaacaggcgaaacagaagaaaaatagtcgaaaaagtaataaggggaaaagtggcaagtccgacatcaataaggaaatacttatggacagcagtccttcagatgatagaatcctggatgatttttctggacaaacggaagaaatgtcctcaaatgctgacaaccctgaagaagtttctgatatatctgacagcagagacgataattcagatgtgcttcatgttgatattgaagaccgcgaatctagtcctgttaattgggagacagatgcagaaacacaagctactgttcctggaagtagtgaggtgcaaaatgaccatgcagggaagag

SEQ ID NO: 9819 - DNA, 713 bp, Sorghum bicolor
  Clone ID: SORBI-28MAY03-CLUS3622_1
cgcttgtccatggaaacctctcgcgctcgctcgctgtgattcctgctgcgagtgcgagctcctcccaaccacgctctgaatagccgttcccttctcctgcctttgctctgcacgccgcaccgcacgtcctctccgaagcagagacgttcccgtccgtccgttccccgtggccatggccgccgcgccctcgtcttgctgcgccgcgaccgcgtccaccagcgctccgcttcgccccgcgcgcgtccagtgcagcgcgccttgggtacccggtgccacccggagcatcttcaggcgcaggcagcttcagcggcggcagagagagctgtccgtccgcgccacggcctccgtgccgccgcccccccccctccgcgccgccgccgccgccccctcccgccccggcgctcgccgcctccccccccgccgctgcctgcgccgcctcgctcatgagccagctcccgagcgcggcgtccgggctgctccgccgccgcgcggcgagccaggtggccccgcaccgcgcggtcgccgcgccgcgccgccgcctggcggcgggcccggcggcccgcggccccgccgacgcggcggcgcgggagctggaggcggcgggcacggcggcgggcgggcccgtcgacctcaacggcggggacctcgacaagctgcagggccggtggcgtctcctctacagcagcgcgttctcgtcgcggacgctgggcggc

SEQ ID NO: 9820 - DNA, 917 bp, Sorghum bicolor
  Clone ID: SORBI-28MAY03-CLUS37055_1
gcacgaggcagcaaggtacccgggagtttttagctgaggttgagatgcttagccgattgcatcataggaacttggttaagctgataggtatatgcacagaggggcatagccgatgtttggtatatgagcttgttccaaatggcagtgtggaatctcacttgcatggatcagataagggagctgctcggtttgattgggacgctaggctcaaaattgcacttggtgcagcacgtgcacttgcatatttgcatgaagattcaagtccacgtgtcatacaccgtgatttcaagtccagtaacatcttattggaacatgacttcaccccaaaggtgtcagactttggcttagcaaggacagctttgggtgagggaaacgagcatatttctactcgtgttatgggaacttttgggtatgttgctcctgaatatgcaatgactggccatcttctagtaaagagtgatgtttacagctacggtgttgttcttcttgagctccttactgggaggaaaccggtagatatgttaagacctgctggacaggaaaacttagtcgcatgggctggttctcttctgacaagcagggatggtctggaatcaatcatagatccttcacttgggagcagcattccatttgacagcatcgcaaaagtagcagccattgcttcaatgtgtgttcagcctgaggtggatcagcgcccattcatgggtgaagttgttcaagctctaaagttggtatgcaacgaaggcagcgagttcaatgaaaccacaagctttagccaagatttgcatatccaagatgttgaggctatgagtagagcaagtatggacatagacgttgacccaacactatcagcggagctgttcacttcatcagcgcgttatgatgctatggatgcctctggttctttccgaagatac

SEQ ID NO: 9821 - DNA, 1083 bp, Sorghum bicolor
  Clone ID: SORBI-28MAY03-CLUS37178_1
gcacgagggttctgcaatgcctgagcaagagcttgcagctacccaagcaaactcccatggagataaaccactacctaagcaagagcttgcagccacccaagcaaactccaacgcagagaaaccattgcctgagcaagagcttgcagctacccaatcaaactccaatggagataaacctgtgcctaagcaagagcttgcagctacccaagcaaacttcaatggagataaacctgtgcctgagcaagagtttgcagctacccaagcaaactccaatggagataaacccgtgtctgagcaagagcttgcagctacccaagcaaactccaatggagataaacctgcgtctgagcaagagcttgcagctactgaagcaaactccaatggagataaaccagtgcctgagcaagagcttgcagctaccgaagcaaactccactggagataaaccagtgcctaagcaagagcttgcagctacccaatcaaattccaatggagataaacctgtgcctgagcaagagcttgcagctactcaagccaacttcaatggagataataaacaaacagaagcaaataaccaatccgaggttagtatgactgatgaggacttcaatggagataataaacaaacagaagcaagtaagcaatccgaggttagtatgactgatgagaaccctctagtggaggatgacaagcgaacaattctagggaagcatcccagggattttagtatggctgatgaagcctcagcttttgtggaggatgacaagcgaaagcgtcccagggatgacaatgatgctgaacagaaatgcaacggggaagtaggtgtagatgttagcaagacatgatgtttggaaagtgtcccagggatgacgacgatgcttgcaatccatgagtacatagctatagatatggtaactggaacccccaatggcagggttttactacgctgctgatatctgagcgtattgtcgcctctttgccatacacaaacctctcctagttttattattttgctggtagttttgtttatgttaagagacacagggattgcaagctgaatggtacccttttcaggcgcgttgat

SEQ ID NO: 9822 - DNA, 673 bp, Sorghum bicolor
  Clone ID: SORBI-28MAY03-CLUS37201_1
cttgaccaacggtgacacttcttccaatggagctgacgcttcaggttccaccaaggacactgagtagctgaactgcagcttgctgcctcgctaaccacaaaggcccaagctataactttttgcaaacccattttcagttctagttttcccccctttcccattttggttttgtttggtaagtctcccgatctgtatttattaacatccatgatgtgggtcactgaagacttaggttgctgcaaaaattttgtctctggcgggaagctatatgcaaagagggtgctacctattccccagaatctatgtgcttgttaacctgaaggccgagaaaggtgaaaggcgcagggagagcctccagattttggtcgctgtaagaattaaccccatgttgtacagcaggtcccagtaacttgtgctgaggggagagtgaaggagtcattttaatcagtttagtggtggtgtgtgtgtgtggagaagaagagtcttgcctgcattttcttttggaaccttctcttgtgccttcacctgtgttgcattttgagtcgagggctcctcttaaattgtgtgcagaggggctcgattttgttaaccggaacatggcgcatttgcgtctggatcaaccccggtcttgtcttcagggcactgtcgccgtatttatcaaccttcttatgta

SEQ ID NO: 9823 - DNA, 923 bp, Sorghum bicolor
  Clone ID: SORBI-28MAY03-CLUS3726_1
tgagggtatgagtatagcgtgctacggatcacgtgatacaagctcaccaaaaggaaccatgtggaagactgtacctcacaggttgctttttggtagatcgtctaccccttgttggggaactggtggtgttgcttttctcaaccctgagataaactacaatgagaagtcgtatgtctgcatgtacaaaataacgttggagcagttcaatgacatcttgtttcaggagaatcgtcgtccgctgaaggatggcaaagacgggaacgttgtgtatcctgactctcctttgattggttcatctgaaatcaagtttatatctacaaacaaagctattcatcttgaacctattaaggatagctggtactccaatgtactttatcttgggaatgagggtgaacttccaattctaactatgacgtgccccgcatcagatattgagaggttcaaatctggtgagctgcctttagcacctccatcagagacatatgcggccactctgataaggggactagttgaaggaaagcaactggatgcggacggagctgccaactacatcaatgcttgtgctgcaaaaggcctgtgaagcctgcttcagcgtgtgctttgtacagccagtaggtagtagtaaggatacactattcgctagcgtgaggaccgggagtgttggacaagcttcgttctttgcgagtggagaacttggatccaatttgaattgggcaggatgattcgatcttgcccgcttggtcattggtgaatggtgggtctcccctgttaggttgattctgggagaaacactagctatgtcggggtggagcaacactagttgcagattgcagcaggtgctctcactgcactagcatcgttcttgtctgacataccgtagtatttggatggcatgccgggtggtgttatttggtattgttact

SEQ ID NO: 9824 - DNA, 930 bp, Sorghum bicolor
  Clone ID: SORBI-28MAY03-CLUS36320_1
gcacgagggctgaaagtagcgtcactaagcaattggaggttgcagagatttataagccaagttctcatgttaaacccatatttgtggctgtagaagctgacatggagaagtattacagtgcaccagaggcttcagatatagtcttcaggtatgtcgaaaaggaaaatttggttaaacctacagacaagaccaaggtgattcttgatgttacattatgtgatgcattgtacaaaggggctatcaaaaagggctcggcatacccaactgaaatccacaagaaagacttgggttcaacatttttaaaccgcatgcaagttcaccacaaagtatcaagagggactcaggaggtcatacgcaagggtgccataagaactattcagatcatgacagaaagaagacagggtaacaagaagatgactcggctttccgggctcgagtgttttctgatggatcctgattcattggcttctgaactccagaaaaaatttgcctgcagcaccaccacagcagagcttccaggtaagaaagggcagtgcgaggtcttggtacaaggtggagtgattgatgaccttgcgaaacaccttgtcgaccactacggtgttccgaaaagatacatcgaggtttatgacaaaacaaagaggtaggaagggggagctgatcaactggagtgcctttcaggtgttgccgtgttggtgcgctttgatggtcgctggtccgaggatcatcagctttgtgcaaaatacgaaatggtcccaggattgtttcatgatacttcttttttgtcatgagatgtctaggcattattacgacagtgttgaattatgtgagttatatatttgttttcgttcctgccctttattggtggaaaatgctattgtgcttcctgaagaaacgatggttacaggacaatgaggtttcctcatgtacctc

SEQ ID NO: 9825 - DNA, 960 bp, Sorghum bicolor
  Clone ID: SORBI-28MAY03-CLUS36341_1
gggcccccctcgagactagttctctctctcaatcgttgtacattaagcaagcatcctctgcaatatcaattgtggacgaggaggattctgaacctgaatggatggagtacaaaatcaaagagacgaacatgttcactgtggacaaatatcagcagatagggttctttcctgaaaaaaaggcatttgctctgaggtaccagactgctggaatgctggagactgtccttcgggttggtgtgcttggagaagatgatactggtgaagaatcccccaaaaacttgaagataccttctcgtaagccctctattgtatgtgaaaattgtctttactcccttgaaggcaatggtcgaatgagggctttccacataatggatccaaagggaatgcttgacacacttcttgtttttcatgagaagaggcagggatctgaagtgccacagtctattaaacaccattcagttggtaccactagtgccagcagtgataggataaatacactacttggaaaatgggaggggcattctgttactaagaggagtggggtgtatggagcaacacttgctgaagccgatacagctgttgttctcaaaatgggcagtaatggccaattgattcaggatactttatcaactaaagtcggaactggcacaacaacaactgtcaactggacaggatcacctaatgttctctcgcttctgttggctggagggtccgaatcaactttgcctcctgccgggtgggcctgggcatgtccatcacacattagcaaatctgtttcccagttagattcttttcatttagagttttgttggatggaatcacctggaaagaggcagcggcttgtccgaacatacgattcagctggtttggctgtttcatcgacctatttttctgaaaccaaagtatgagtcgcagcttcatacaaaatgtattgcaacaattttgtaagtcatgccagta

SEQ ID NO: 9826 - DNA, 1326 bp, Sorghum bicolor
  Clone ID: SORBI-28MAY03-CLUS3646_1
gcacgaggcagcttccctccctctcttcatcgtccgccgctgctcgagatccgcggccagcccatctcctgccggtgaccggcggctctcctttctcccggtttgcaagcggcggatgagcacgctggcgcagcccaggttcgcccctctccctacggagcgaattgaatcccaaacagatgctggtgctgctgggtaccagttccggctggtctcttacaacatcttggcccaggtttatattaagagtacgttttttcctcactctccatctgcatgcctcaagtggaaatctcgatcgaaagctattcttacagaactgaagagctttgatgctgacctcatgtgcatacaggagttggatgagtatgataccttctacaagaacaatatggaaaactctggatattcaagtatttacattcagcgatctggagacaaaagagatggctgtggtatattctataaacctaaaagtgcagaactggtgcagaaagaaggaatacattacaatgatttagtggaaaaatacgttcctagtgatcatgtaaatagtgcccaggaaaataattctttaacagaagaagacaggaatgcaaaaccagataatagcaagcgtggagatccaaatgatccacgtgtaagattgaagcgtgactgtgttggtctgctcgcagctttcaagcttagtgatccttgtgatcacattttaattgtggcaaacacacatatttattgggacccagaatggatcgatgtaaagttggctcaggcaaaatatcttctttcgagagtatctcagtttgagcaactcatctcaaataaatataattgtaaaccttcagtgatcattgctggtgacttcaattcgacccctggtgacaaggtatacaattaccttgtatctgccggcggtgaaactccgatcaagttaagcagcctttatgctgcgaatggaggggagccagagtacacaaactacactcctggctttactggaacactggactacatattcttgtccgatggtagttcaataaaacctactagcctactttgtttgccgcgaggggattctgaggatgtgaaaggaggcttgcccaactttcaacatcctagcgatcatctaccaattggtgctgattttctggtagttaacagctaatgcaggtgttgatagcattttcaatagaaatagtaaatgccattgaataatttgtgttgttagttcaagtttcagagtttaaatgtaatatctcaaggaacaagcttttcttttcttgtagagccaatagcaattaacaatgcgaattgtattcatcaatt

SEQ ID NO: 9827 - DNA, 856 bp, Sorghum bicolor
  unsure (1)..(856): unsure at all n locations
  Clone ID: SORBI-28MAY03-CLUS3658_1
ctgtcgtgatcaagaatcttgacattacaacaaatttcactgatctgggtgagcaagagattctgctcatggctgcagagttcaagttaagcatcaatgcgtatttgtcggacctactgtactccncagtccgctcccttgcacagatcatagccttcaacaaagcacatcctgtagaggagagactcaaagattttgggcagccagacctgattgccgcggagcaaaccaacggcattggcaccagggagagagctgccatccagcggctcaaggagatatccaccaacgggttggagaagctgatgaaggaacaccagctggatgcgatcgtggcggccaacagcgacgcctcctctgttctcgccgtcgggggctatccgggcatcgccgtgccggcagggtacgacaagcagggagtcccctttgcaatatgctttggtgggctcaggggctacgaaccaaggttgattgagatcggttatgcgttcgagcaggctaccaaagtcagaaggccaccaacttacaagagctagcaaacaagattgtaactagcatgatggcacgccataaggaatttaattgaaataattcagtggaaacaagcaccttgaaaaagcttttgggttgtttttgctttgacctgtcgcgggattttcgttagtgttgtgcgtggggaaaagtcataaaaactgggtctaagttagaaaccatgtctacaaaaaatccaagacatgaagtgatatgattgactaagaatggagagagaatgaatgtgattggatataaaaatattctatagaaactatccattgagtccatagtttctatatatagtgtctaaaatttaatggat

SEQ ID NO: 9828 - DNA, 1425 bp, Sorghum bicolor
  Clone ID: SORBI-28MAY03-CLUS36584_1
gcacgagggcggcggagatggcgcggcggcagcaacaacagctgccacctccgccgcagcacccgccgccccaggctggcggcggcggtggggacttctaccgcggcccgccgatgcggcagctgtccgcggcgtcttccaccaatctcccgcctgactacgccgcacacccgggccccccgccacagcagcagcatcagcctccttacgacgcttatggtgacagttttggtgctaaaaggatgcggaagcctgtccagcgacgaacagtggactacacaagcagtattgtccgtcatgttcaggctcgcatgtggcagcgggacgctagggatagattcacattgcagccaactccagctgctgtcctggatatgttaccgtctgttgcatatccagacaatccctccacaagttttgctgccaaatttgtacattcatcaatcaataagaaccggtgctctattaatcgtgttttgtggaccactacaggccgtcgacttatcactggatcacaaagtggtgaatttacgctatggaatgggcaatcttttaactttgaaatgatccttcaggctcatgatctacctgtgagatcaatggtttggagtcacaatgaaaactggatggtgacaggcgatgatggtggtgcaatcaagtattggcaaagtaacatgaacaatgtcaaagtgaataaaacagctcatggagaatcggttcgtggtttaagtttctccagaaccgacttgaagttctgctcctgctccgatgacagaaccgtgaaggtttgggacttcgcaagatgccaagaggaaaaatcattaactggccacggttgggatgttaaaactgttgattggcatcctacaaagtctttactggtttcaggtggcaaagactatcgcgcgaggctttgggatgcaaaaagtggcagagagctgagctcattccatggtcataaaaatattgtgcattgtgtgaagtggaatcagaatgggaactgggtactgactgcctcaaaggatcagattattaagctgtatgatattagatccatgaaagagctgcaatccttccgtgggcacactaaggacgtcactgcattggcgtggcatccatttcatgaagagtattttgttagtgggagctttgatggagctatatttcattggttggtcggccatgaagctccacaggttgaaataagtaacgcacatgacagtagtgtctgggatctttcgtggcatcctgttggctatctactttgcagtgggggcaatgatcatgctacaaagttctggtgtagaaacaggccgggtgatcttacccgcgatagatacaacagtggccagatgcaaggttatggtgaccaacaaccttttggtgctcgtggaatgggtggattccagatgcctgaactccaat

SEQ ID NO: 9829 - DNA, 700 bp, Sorghum bicolor
  Clone ID: SORBI-28MAY03-CLUS36626_1
ctccgggagcaatagactggtcatcagagcagaaaaaatgtctccttacctgctgcttgccgccgccgcgcttttcgccccccccgccagcttctcgtccccctggagcacctcgcgccccccgtccccgccgtcgcgccccctccgccgccaccgtcacctccgcggccccctcgcccacccctcctcgcccgccccgcgcccccgccctggcgccggcggcggcctccccttcccgcaactcgggccctccccgacctgcgtcgcggccgctgccgcgccggcagcgggcccgctccggcaccgccaccgcgcctgcgccgcgcccgcgccctccccggcgccgcccgcccgcacggcgggccgcggcaacgtgtcgttcgcgccgtacggcgagaactggcgcctgggcaagaagatcgcggtggtccacctcctctccccgcggcgcgtggagtcgttcgcgcccgtgcgggccgccgaggtagccgcgctcgtcgcgtggacacgctgcgccgcggaggcacgggaggccgtggagatgagggagctcctgtacgggtgcaccaacgcggtggtcacccccgcgcccacccgggccgcccccgcgccgccacccgtgccgccgcggcggctgcggaacgccgaggcgctgatggcgggcttccaacctgaggacgtgctgccggacgcgccggcg

SEQ ID NO: 9830 - DNA, 657 bp, Sorghum bicolor
  Clone ID: SORBI-28MAY03-CLUS37750_1
gctcaccgtgcttggcgaactcggttcccgacatctaaaatcgatgactgtgctgttgtctgcctgttcctgaacacaaatgaagcaagcgaatcttcgagttccttggccaacaatttggcagatgctgtagaagttagcagtgctcagcgctccacaactatccaggtgagcactggtgcatctatagatgttactgccctggtaacagatggaaacgaggagtctgttgttgaaacggtcacaaggccggtcacactcatggatttgcccaaggatggttgaggcgcaaaatagggcatgataagtgaggttgcatgctgcctgtgactggtatctgctgaacgatcaagtagttcaggcacagagcggaggcaccatgaacaaacatgctgtgcctgtgattggcatctgttggagcgaagatatagcacgtcggtgggtttctgcttgctattttttctggacgcaagtgtgactagaatttgcagttttgctttgtgtaaagtaccgcgtcaatttagcgtgatttgctccagttttttgtaataattttattcatgttattatcggtgcgggcaagcgtcgaggtcatagtatcatgtaggaaggagcctactgagtttttatgcttcctgcctcgtgcttcatcattct

SEQ ID NO: 9831 - DNA, 679 bp, Sorghum bicolor
  Clone ID: SORBI-28MAY03-CLUS38001_1
gtcggcggggccgccgctttttggttgcgctctccccctcctctccccgcacgaggctaccctctctgcctttccattggagcgcacaaagccgacggcaccaccatttaaagaaggccaagcgagcacacggcggaggagaagagaagagaccaccacctcacactccattcacaccaggatcgatcgatcaacaatcgcgccgcgcgttatacccgcttcacgcttgttgcgtcgtcgtcgtctgctgctgctgcgctgcggctccggcgcaggaagtctaacgtggaagtctctaagaactgagtacttttgctagaagaaatatttgttcagtcaagctttgcaaattatcatcatagtttggatgacatacatggttactttgacgagtttatggagccctggttgccgggctcatctgggttctctgacaatggaactgtaatatttgcagcaaaactttatttcctcatcttggaagaaagtttcaagaggggctgacaacttgtaagtgttcctgtgaagcttgatgtgagggcgaagtggggagaaaaacttcttctcgcatgcagatgtcaacagatcctaacaactatggggtatttccacattcattctgcaaccaacatgtggtttcatttcagacgagttcaattaccagtggatcaggagtcat

SEQ ID NO: 9832 - DNA, 748 bp, Sorghum bicolor
  Clone ID: SORBI-28MAY03-CLUS37774_1
catcaccaacaaggtctttgtggttcatggagggctatttagtgttgatggggtgaaactttcacacatcaggtccattgatcgtttctgtgaaccacccgaagaaggtctaatgtgtgaactactatggagtgaccctcagcctcagcttggaagaggtccaagcaaacgtggtgttgctctttcctttggcgcagatgtgactaagaagtttctacaggaaaataacctggatcttattgtccggtcccatgaagtaaaggatgaaggccatgaaattgaacatgatgggaagcttataacagtcttctctgcgcctaattactgtgaccagatgggcaacaagggtgcatttattcgcttcacagctccagaaatgaaaccagatattgttactttctcagctgtgccacaccctgatgtgaggccgatggcgtatgcaaataacttcctcaggatgtttcaatgacagaatatagcaaccttgtctagcaatttttatcagatgagtctgttgtttgtcagctcccaacacatttcttgctaggttcaagtgtatgctctgtacaacaaatcaagtgatgtaagggattcaattgtcgatttactgggacgttgcatcaatttttgtgctccagttgtcattcttgtaaccatcagtaaacagccttagatcattagattctagtttacttgtaaaattgctaaatcgtcatttcctttatttatttatcagctaagttatccc

SEQ ID NO: 9833 - DNA, 674 bp, Sorghum bicolor
  Clone ID: SORBI-28MAY03-CLUS38057_1
agcgtgcgcttaacaccccgccttcgacgactgcgccgcccgtcgctgccgcagccgtcctacttcggccccttacttcgcccccttcgtcggcgacgagcaacaccagtttgtggataaagggtctttaagtcttcatatgaaattatccttttggtaggcagctgaaggataataactatcatggatgctactgcaacagatctgcaaagggctgaggaatttaaacttaaggcgaatgatgccttcaaggcaaacaagttctctcaggctatagagctttacagtcaagccattgagctgaatagttcgaatgcagtttactgggcaaaccgtgcatttgcacacacaaaattagaggaatacggaagtgctgtgcaggatgctacgaaagccatcgaaattgatcctagatattcaaaaggttattatagacgtggcgcagcgtatcttgccatgggaaagttcaaggaagccctaaaggattttcagcaggttaaaaaaatctgtccgaatgatccagacgctacaagaaagttgaaagagtgtgagaaagctgtccaaaaaatccgttttgaagaagcaatttctgttggagatgctgagaggggctccgtggcagactccatcgactaccatatcatagaagtagagccacactacgcgggaccaag

SEQ ID NO: 9834 - DNA, 839 bp, Sorghum bicolor
  Clone ID: SORBI-28MAY03-CLUS38058_1
gcctacttgtttccgcttcacactctccatcaatcacgcgcccctccgccgccgctccgctcccatcccacaacgaagaaactgagagagagagagagagagagagagagcaagttgcagcagaccttcaagaagacctaccaagcaagcaagcaatggcggcctcgctagcgccgctcctcgccgtcgccttcctggccgccgccgcgcaggctgccgaccccttcgcattcttcgactgggacgtctcctacatcaccgcctcccctctcggcgtcccgcagcaggtaatcgcaatcaacaagcagttacctggacctatcatgaatgtcaccaccaactacaatgtggtcgtcaatgtcctcaacagcttggacgagcccctgctcatcacctgggatgggatccagcagcgcaagaattgctggcaggatggggttctcggcaccacctgccccataccgccaggttggaactggacttataacttccaggtcaaggaccagattggcagcttcttctactttccacccctcggcatgcagcgtgccgctgggggttttggaggtatcactgtcaacaatcgcgcggtgatctcggtcccattcgacacgccagatggggacatcacgttgttcatcggggactggtacaagatgaaccacacacacctgaggaagatgcttgatgatgggaaggagctagggatgccagacggtgttttgatgaatggcaaggggccatataggtataatgactcgctcgtgccagatggaattgaacatgagactatcaaagttgagccaggaaaaacataccgtttccgtgtccataatggt

SEQ ID NO: 9835 - DNA, 791 bp, Sorghum bicolor
  Clone ID: SORBI-28MAY03-CLUS36880_1
ttggacatgttctcagaaccgagagctggtatgaacatgaggcctgatgaagatgagcgtctgaattctgttccaagaaatggtagttacaggaatttggatgattttggccgacctggtgatcgccccagggataatctgcagtttggagttcccaggaggccaaattcttctaatggtaggagagaagtttaaggagtgtgttgctatctacaactctggtacagcatggaacaatgatgaagagctctgggacagtccagattcagcaaggtgcagatgcatgttcagaagatcagttagattccttgcaccatgtggtgtggtggtcacaagaaagcattgatatcagcagaggatgtgtgaatctaccatgatgtcagtcagtggatcgagatgctttcatggtgggtgattaaaggctcctgatgtcaggttgaagaaaggctgctagccttcagtgttatggagttcttaggaatttctttcttagaacaaggctgtctgctgtgttttgacattgtggtccttgctttagccagctccatctttccgtagatatatacatgcatgggcatttccattttgaaacatgccaggagaaagctcactggctctagagcagggtaggtatcaagcattgttgcctgattgctgctgcgatcgttgcatgcttgatatgtctggtaggatcagtatgctaacataggcagggcttctgtaccatatgacataagttccttctgtatacagggtcagatctagagaaaaaaaagttcattatttcattc

SEQ ID NO: 9836 - DNA, 780 bp, Sorghum bicolor
  Clone ID: SORBI-28MAY03-CLUS36907_1
tcaatataccaaaagatctatctagtgatgaagcaaatcgttacttgatagaagcatgtgcgaagtatgatgtgaaatgtccacctccccaaacgacatcacggttgcttgacaagttagttggccatttcttggaggagatgtgtgtgaatccaacatctatcatcaatcatccagagataatgagtccattggcaaagtggcataggtcccgacctggattgactgagaggttcgagctatttgttaacaagcatgaggtgtgcaatgcatacacagagttaaacgatcctgttgtgcagaggcaacggtttgaggaacaactaaaggatcgtcaatctggtgatgatgaagctatggccttggatgaatcattctgtactgcccttgagtatggtctaccaccaacaggcggttggggcttgggaattgatcgcctaacgatgttgctaacagattctcagaacattaaggaagttcttctattcccggctatgaagcctcaagagtagctatccacagagccaaaggttcaaagcaaacatgatgctacatagcctggaggatagcgaagtccttgcatctgttgtgacttatacatctttttgcccgtgtgtgtgcaaggtttccatttttcattatttttctaaaccatcgtgtattggccggtcgcacagttattaaccagaaaaatgtaagaaagttccagtttaacttcaacacatgaaattttgcaaatactctggttctgtgcaatgtgtgcgctcaaattagattggg

SEQ ID NO: 9837 - DNA, 775 bp, Sorghum bicolor
  Clone ID: SORBI-28MAY03-CLUS36921_1
cccgcgcctggacggccgagccctccccgccgccgccgtcccgcccggagcgcccccccgactccggccccgcgacgcagaacgtgcatcagcagccgctggcgccgcagctcagtctgcctagcggcaacaacggcggcggcaagccggcggcggcctcggcggagatggcggcgatcgagaagttcctgcagttccaggacgccgtcccctgcaaaatccgcgccaagcgcgggtgcgccacccacccgcgcagcatcgccgagcgggtgaggaggacgaagatcagcgagcggatacggaagctgcaggaactcgtgcccaacatggaaaagcaaaccaacactgccgacatgctggatctggctgtggactacatcaaggatcttcagaagcaggtcaaggtgctgaacgacggccgcgccaactgcacctgctccgccggcaagctgctgcaggaccagttcaccagttagccgccgccttttctcggtgcgatgcgatgcgatgcaatgcgtggccatggccgcaaggcctgactgacgcctcgcctccgcgccggcagctcgctttctcctcctcgttgaagttgaaatagtaccagtgtacttgcttacatagttttacatgaggaggtaaggaacgtaaacaaggatggatataatatggaattgaaatgagagtagtctgtacatgcaagttcattagcaggcagagcaggacccgcaatgttatagtgatagctgcaagctcaattagagttggttcttggtac

SEQ ID NO: 9838 - DNA, 653 bp, Sorghum bicolor
  Clone ID: SORBI-28MAY03-CLUS37010_1
aaacaccaaagcctccgactccgatccccgatcaccaccaccacttccgaattccgatcctcgaccccacttgcagcgatggcggcggtggatctgaccccgaagcagcccaggaaggcgtacggcggagagggcggttcctactacgagtggagccccgccgacctgcccatgctcggcgtcgcctccatcggcgccgctaagctctcgctcgccgccggtggcctcgcgctccccagctactccgactccgccaaggtcgcctacgtcctccaaggcactggcacctgcgggatcgtcttgccggaggcgaccaaggagaaggtggtggccgtgaaggaaggcgacgcgctggctctccccttcggcgtcctgacatggtggcacaacgcccccaccgcgtcgaccgacctgacggtcctcttcctcggcgacacctccaagggccacaagccaggccagttcaccaacttccagctcacgggctccaccggcatcttcaccggcctgaccaccgagttcgtctcccgcgcgtgggaccttcccgaagccgacgccgcgaagctggtgtcaagccagcccgcctctggcatcgtcaagacctccatcgcgctgccgacgggctcgcccaaggaccgcgagggcatggcgct

SEQ ID NO: 9839 - DNA, 666 bp, Sorghum bicolor
  Clone ID: SORBI-28MAY03-CLUS37037_1
ggcctgctggaaactgctacgcccacacgcctccccagtcaacacacctcagctcgcgagctctcctcatctacacacagtccccgacgcccgcccgcccgcaccgctgcgactgcgacgccccgaccaccccccaccttccctgcctgccgtcttcctcctcccgtccgatcggtttcactttcaccattcaccgtacgcgcgctccacccgccgcaatcgtactggcgcgttggacagggagctaggcggccggggttgattgcaattgggggaggcgggggtgggtgatgtacggcgcaccggtgcccaaggacctgaacctgccagcagcagccctgccgcagccgaccaccagggccggtgcgagaacgccaccgcaccagcagcagcagatgagctccccgggactgctgcggtacaggtcggcgccgagcacgctgctcggcgaggtcatgtgcggggatcaggacttccccgcggctgcggctgcggctgcggccgcggctggcggcgcaggggcagggcacggtccaccaccggaccacgccgccgccgcggacaacgtcctcgcgcgctttctcgccgggcaccaccactgctccgaggcccgggactgcaagcctccccgccccgccgcgtccgctcaccacttcatggacgaag

SEQ ID NO: 9840 - DNA, 851 bp, Sorghum bicolor
  Clone ID: SORBI-28MAY03-CLUS3706_1
gcacgagggcgggctctgctcgctgatccgatgattcatgataacttgacggatcgcacggccctcgtgcgtccgccacaaccccggcggcgcacggctccccgtctcccctccactctctccacccactccttccctttggcgccaagtccacccgcccctccgattccggccgtcgtccaggtgccgacagttgagcaggatgggactgaagcgcctgatgacatgctgctgctgcattgcaaagcagcacgctgatgacgaggacaagattgattttggaggtggcaatgttcatgttgttacaagcaaagaggactgggaccaaaaaattgccgaggcaaacaaggatgggaaaattgtggttgcaaacttcagtgcttcctggtgcggcccatgccgtgtcatttcacctgtttatgctgaaatgtcacagacataccctcagctcatgttcttgacgattgatgttgatgagttaatggagttcagctcgtcgtgggacatccgtgcgaccccgacgttcttcttcctcaagaacgggcagcaggtggacaagctggtcggcgccaacaagcctgagctggagaagaaagtcgccgccatcgctggggcgtcgtcacaggctgacgctgccagcagcaagacagtgtagtgtagtgtagtgtagtgtaggcaaggacccgccctgttgaccttgccccctgtatatggctgttccgatcctgtgtgtttcttgacagttgtcaccgcgcgcattgcgtctgccggcggcggttctgtctgtctctgtgtgatgtctcttcgtgccatgtgctgactgctgattgtacagttctccggtaatggta

SEQ ID NO: 9841 - DNA, 693 bp, Sorghum bicolor
  Clone ID: SORBI-28MAY03-CLUS38379_1
gttttgtccccatgatgaactcccatttgccgtctcccgatccctagatatatacaagggaggaccaattgggaaatggtaccggccatttgcctgacgaaccgttggtagaggaaaaggagtcagagcttctcgcattgtgagttctaaggagctgctgccctttgcatctacagttgtgatgacatcacatcggtctgaacaaagggagactagatccagaataacagccatattttgggagtttgctcattcagatctccgtctgagtactatggcacacgtccatacgcatttttgcagagtgtggctggcttcagttatacatggtcctcgtggaaaggtgagttcagttatccacggtggatgctactgcagattcacatcttgcctgaaacttgtgagctgctagttactgcaggtttgacagacaatgctgaacgtcagttgcatttcaggattttagctcgctgtagggagaatgagcttatggatgttgttagctgctcacttgctgtgtatgtcatccttgtaccacgtccagctcaactctgtaaaacatgataacctcgttagcctgataagtgactgttagtgaaacatgtcaactgtaatacgttctgaatcctgatgagggaaatagtgcctgtagtgtgatttcttttcttatatacagggtctataccccgtgcc

SEQ ID NO: 9842 - DNA, 742 bp, Sorghum bicolor
  Clone ID: SORBI-28MAY03-CLUS38391_1
ctgggtaaatgctatagcaggcgtagtactagggatgttcattgtcaacgagtccatcacgattggtgctgagacgggtgagcgcttacggagtttgatcctgaaatacatcagggagaagagtctgataggtcacaaatatggttgggagcactggagggtggataccaggactaagcagtttgtgcttttgtcagtgatgataattttgatgtcttccttttgggttttgagcattgtgttgactgtagtaaagatgcatagtcttgctgatggtgctgtcctatggatgggctgctcggtagcacctccaggagtttggctacgctggtacctggcaaggctcaatggccagggaattggcaagcagagatccttgaaatggctgcccattgggaccctggtagccaatgttcttgctgcaggcataatggcggttcttgctgtaacatccaaagcggtacatacaaagcgatcgacaactattcttagtggaatacagcttggcttccttggttgcttgagtacagtgtctacttttgctgctgaagtgtatacaatgagaagaagcgggcagattgcgagggcctttgtttatgccgcatccactttcctgctttcttttgtgctgggaactctagtgtattccgtgccagtttgggaaaaacattataaatgacctcttgcaacttccaggtcaacatattagcagatggctcaaatgtgcaatggattttttttc

SEQ ID NO: 9843 - DNA, 743 bp, Sorghum bicolor
  Clone ID: SORBI-28MAY03-CLUS38400_1
atccagtgcccagttgtgctggacaacaagttgtctaaccaagtgcccaacatgagtgctgtgcctcctgtttcaaaccctataacagcaggctcaagtgacatcagcattccggaattctcagatctggcggacttggtaaacgaagactctgtcaatattcctggaggggcctttgagatgcctggtcctgagtttcccctgccagaaggtgatgacagtgtccccatcgagactgatgagaccatgtacaacaatgacgagactcagagccttccaggcatcatcgactccttctgggagcagttcctggtaggcagccctctatccgccgataatgatgaagttgattcaggcggactagatgcaaggggttcaccacaggagaatgggtggagcaaagtggggaacatctccaatcttacagaacagatgggccttctatcatcaacaaatcaccgggactcagggaatgggctgtaatatcttaatatggtagactgggattctggtaataagtgtcgcctgccattttgttattttccttttcgccaaaatgatatgcccggtatatcaacaacccaacctatatgtggggggattcaatcttccagccatgaatgatcttggtacacacgccacagccaggaattcacctgcttgtttctagtgttggcaggcttgagaacacgagggttacttgttaaatctgtatgattacttgtactgtagttgctgttgtt

SEQ ID NO: 9844 - DNA, 609 bp, Sorghum bicolor
  Clone ID: SORBI-28MAY03-CLUS38470_1
gcacgaggctcgcctcccaccgctagactctagtagcgcgacacgccggaggcgatggctgcgcggtggtgcctcgtgctgctcgtgttggtgctggccgcggcagcggccggcgcggagaagggagagtgggacccggtcattcggatgcctggggaggaggagcctgcagcgtcgtcgcactcgcacagcggcgagggatttgagggagaggaggatgtcgccgtcgggacgaggtgggcagtgctcgttgccgggtcctcaggctacggcaactacaggcaccaggctgatatatgccatgcgtaccagatactgcggaaaggagggataaaagaggagaacattgtggtgttcatgtatgatgacgttgccactagtgcacttaacccaaggcagggggttattatcaatcacccacagggcgaagatgtttatgctggtgttccgaaggactacactggcgaccaggtcactgctaaaaacttctttgcagttctcttgggcaacaaaacagcagtcactggaggcagcaggaaggtcatcaatagcaaaccagatgaccatatttttatctgttactcagatcacggggggcctggtgttctt

SEQ ID NO: 9845 - DNA, 665 bp, Sorghum bicolor
  Clone ID: SORBI-28MAY03-CLUS47578_1
gcgtggtgatcaatgacagacatcgtgtggcggctgcttccgctggtggcacgaaggatccaatggtaactgaggctgctgttccaagaagcaatctgaaaaggccacgagcaactgagcaagaagttgatacaagaaaaatacagataattggggagcatgttcaaaggaggaagaggaagcctaatactccaatttccactgctactctgagaagaagcccaagactggccgaagctctagatggccataagcctgaagtgatttcagcctcaaaaaagcctatctccaaaaacaagtcaagggctagaaaaatcacattgcagactgatctgttggataatcgcaactgagaagtgctgcatcgctccgtcagaggtgacagctgaactactgcttcaagaccagatgaagcaagctcgagcagtagtagttgaatggagctccaattagtttccagtgattcgttgcacttttagcctttattttaccaagggtatgccctgcgtggaactgctgtattatggggattggttttgaaccctgccagactaccttttgaaaacttatgtccttcgcacttttctgggaaggcttccttgatgtttggttggacaaagattaatctcttatgttaaggctgtttgggccctttcttcggcggg

SEQ ID NO: 9846 - DNA, 769 bp, Sorghum bicolor
  unsure (1)..(769): unsure at all n locations
  Clone ID: SORBI-28MAY03-CLUS47674_1
actgtgggatgagtgaagctatcggtcntgtgcatgtgaaagcgcgtccacgtgtgctgtcgctgtcatgggggggtgccgtgctgctgcacctcctaagtgaagcttatgggcgggtcaagcgattgcttaagaagcatgagaagcaattacatgctttggcaaatgcgctgctggagcgtgaaacacttacagcagatgagatcaacaaagtagttcacccctaccaagaagaaccccagttttccttccaagacgaggagtttgctctcacttaaaagattcttttgttgcatcaagacagcatttgccaactgtgaattgtaaatccgtgtacagtaagtggtgcctagatgagccatggaagttccttcagatgcccccttctgtaaaatagggcgcaacacctatggtgcatttttcatcttggcaccatttccttttgacgagctgccaatacatcagaaaatgagaagattggtgttgcaaaagatgatgcctgctcattgataattcttgggatggaagactgccatggtgcccggcaaggctctgggttgcaaaaccctccatactctggtttagttaggatagatataggtgtagcattgcatgttctgaatgctaggtttctggctagtcttttcgctttttttatcgacatttgttgtaaggaaatcgtacatataacccttttttttgttaaacaagccactgtttgttattgtcaaacgactatacgttcaatgtattcgtattgctaacatct

SEQ ID NO: 9847 - DNA, 1320 bp, Sorghum bicolor
  Clone ID: SORBI-28MAY03-CLUS47608_1
gtcagggactgtgatcgtctgggtgcaagaaaacattggctcgggggtcggatttgccgtgccgatggtgttcatggtgtttggcctggcggcgtttgtcgccggtcggaaggtgtataggtacaagaaactgagtgggagtcctttgacaagggtagcccaggtggtggttgcagctgtgaggaactgtcatctccagttgcctgaggatacgtcagccctgcaccatgatacgttttttccagccgagcccaatttcaagactgaggctgccagacagttcagattctttgacaaggctgccataatattgccctggactggcgagaagggcacagcagcaccgtcgagcccatggagactgtgcacggtgtcccaggtggaggagctgaagatgctgctccggatgttgccggtctgggcaaccatggtgctcttcttcgccgtcacatcgcagatgtcatcgacattcatcgagcagggggcggccatggacgaccgcgttggcccattcacctttcctccggcgtccctggcaactttcgaagtaatcagcgtcatggtctgcatccccgtctacgacgccgtgctggtgccgctggcccggcgtgtcaccggcaacgaccgcggcctgtcacagctgcagcggctcggcgtcggcctcgcactgtccgtgatcgccagcgggcgcgcggcgctccctgtcccgacgcggcggggccgcgcccaggccgacctgcccccggcgcgcttctggcggctggctccggtgtgcgccgtcctcggcccggcgcgagggtccgccgccggccgcgtccgcggcctcctctacgaccagtcgccggacgggatgaagagcctcggcaacgcgttcgcgcagctctccatggcggccgggagctacttcaactcggctgtgctcagcgctgtcgcggcgacgacgacggcgcgcggcgtggagcccgggtggatccccgacgacttgaacgagggtcacctggactatttcttctggatgatggctgctctgagcatggtaaacctgttgcacttcgtgcactactccatccgatacagaggcaacaacaggacagcttcttgagacttcaacacgcacgggacaactacattcctggaagcccaaccgagtagagtagagtaaactgtgtatagtttgctgctgctcatgttggggtcttttcaacctttaactctgaaatcaagtagaatcaagaaaaaactgccatacaattcgaaaaatctgaagtttttaactgtaaaatattgtaatccccctgccatttgaaatatatattcttt

SEQ ID NO: 9848 - DNA, 932 bp, Sorghum bicolor
  Clone ID: SORBI-28MAY03-CLUS47856_1
gcccgagggacgtcccgtcccgcgcgccgccccctccccccgcggcgcctcgcctccgcccccgccgccgcacgcccgcgcccgcggcctctcgcgccgccccgctagtctccccccggcaccagcccgcgcgcgcgcgcgctccggggggggcgctcccgccacccgctccgcttcggggcgggggccctcccgccgccatggcgagccgggtcggggaggcccagcggcacgaggtgctcatccgccgcctgcgccagcggcccgccagcatgcgctgcgtcaactgcggcgatctggtgggtctggccgcgcgtcttctcgtccgccctctggctgtttctcggcgcgtcggtggggggcggcaccgagcgagcgcgcagggtccacattttccctgcgcgaccgtcggccccgctgtgtccaccatgtccagtggagcactccgcgcgcccgcgcatcgagtaaaatcagtttccatggccaaatttaccgcacaagaagttactgcccttcaagaagggggaaatgagcgtgctagagaaggctcgtgcaaggaatgggatcctcaacgaaatggataccctgacagcagtaatgctgacaaattgagaaatttcatcaagcatgtgtatgtggaacggagatacacaggagaaagaagtactgataggccaccaagggcaaaggatgacaaggatgagtatagtgaaaataggagatctgatgggaattggggtggttcaagaagtccgccaaatggaagttactctgatcgtcggagttatagtggacggagtgatgacagaaattccagatattcctatggggaccgtagtcctggctatgaccaaaatgactataagaaaagtcctcgctactttgaggttgtcgatgatagatctggaaaaataactccagttcagaggttt

SEQ ID NO: 9849 - DNA, 1079 bp, Sorghum bicolor
  Clone ID: SORBI-28MAY03-CLUS4770_1
gcacgagggacatatatgacttcattgtctcttctcatatgacattggtgaattaagcttggaactgataaagtgagaatgctgcatatggcattgactacttggtcatatttaagtgatgaggatgcaacagttgtttgcaaatttgtcgaatgcttgttgattgctgatgagatttctggctatctaacttgaattggctgctcattttagaaggatgctgatacaggagcagaaggctctaaaattactgatggtgatacagaggctattgaactagataacagtgagaagattcccctgaaggaagctgctaattctattgcaagaaaacgggatttgaagataagagatcgcctgttgagtctcacccatgcaaaacccgtgggcacaggaccaaaggaaatggaagtccagaaaaggagtagtgtgccaaaacacaaggaggtttcgacaccaggcagcaaatttaatgaaggcagtgacaaagccaaacgaaaggcatcagctttgtcgtatcaaggccaatcatgcgcatctggtgttgtgaagaaggtgaaagtgaaccagcaacccagcaacaaagggaagcagagcaaaactagtgaaatcggagcaagtgctcggaaagctaagcgacccgctgtggctgcaagaaaggcgaagttactagccaagaagcaactagccaagaaacacagccatgaaacgcaaggtggatgtctcaattcctgagaatacagacaggagcagaagtccaaggaagtagttatccatttcgttggttgtttgcccctgtcaaattgtaacatgggtttcagtggatgaccctggtcagatgatcatgttactgcagagaagcaatgcgccccctccaacaggttctcgaattagatgtcaagtgttatcatcctctattccagttgtgtcgctagtcagtgatatagatatagagtgatattatttaaacggctctctaaatgtttagagatagagtctaagaaagactctcgaagatcctcagctaacgactaagaaggtgtttggcaaagctcctcttgaggaactggagacgtcaa

SEQ ID NO: 9850 - DNA, 975 bp, Sorghum bicolor
  Clone ID: SORBI-28MAY03-CLUS38751_1
ctggcttcttcctcctcgtccgcagtcagccagtccccctgaccctgagcagagccggagcgccaccttcctcctcctttcttctagaaagaacgaactagaaccctccatccagagccttcaagcccagaccttcccacccttgaagctctctccagtctccgctgccgccgccgcgccggccccggccttggcgacatgaagcaccagccgccgccgccgccgcgccgctggggcgtcgtggcggcggtcgtcgcgctcgtcctcctcgcctgcctccagatccagtaccagcacctcaaggtggatctcggcaaggccggctttgcctctgccacgcaagagaataacgcgatccccagtcgcaatcgcattcgctgggggaccgccaggaccaggaaggcagccaccggcgctgactccttgccgcgcgggattgtccagcgccactccgacatgtccctccgcccgctctgggaggacgacgctgcttccacccacaaggtgggcacctgggcgttttttgcatcctgatgtcatggctatctatgatttcatctttctatgggatgaagaccttggagtggagagcttcaacccaagaagatatcttgatataatggtttcagaaggcttggaaataacacaacctgctctggaccctgatctatcaaccgatatccaccatcggatcacaatccgcaataagatgacaaaagttcacaggagaatatatgacaatcggcctagtatgaattgttctgatgagagcaaaggacctccttgtacagggtgggtagagggcatggcaccagttttttctcgtgctgcttggaaatgtgtatggcatctgattcagaacgatctgattcatggatggggccttgacatgaagcttggctattgtgctcagggtgatcgaactgagaaagttggtgtaattgacagtgagtatgttgttcatcaagggatacc

SEQ ID NO: 9851 - DNA, 673 bp, Sorghum bicolor
  Clone ID: SORBI-28MAY03-CLUS38837_1
cggccgcctccccgcgggccccgggccggggcacgcccccggccggctccgcgcccccgccgcccccgtccggcgcctccgcgcgggccgccgccggctcccgccccgccccgccgacttctccgagctggccgtcgtcggcttccgcgccgacccggtgctccgcgtcgcgcaccgccacggcgcccgccaggccgacctcctcggcctcatgacggccgactacgccgtcatgacgccgcagaagcgcgcggccatgcgcgccttcagggcgcggcagatgacgtacacggtgtgctacgacgccgtgcggtacgcggacgggccgttcccggagtgcgacaactcggacgaggagagggagtccttctccgcctggggggaatccaagaccgtcgtcatgaggccccgcgcccgaggccgccgccggggacgcaaggccggcgccggtgccagggtaccgccggctgacgtgtcaagcagctgaggttttacaacaacaacaaaaggaccagggtctgttgcgaaagctattggcacaatggttagagatgatgatcggttgatccggtattgtagtagttcgattcgtttttattttttggcccatccatatgcaggttgtaaagctaggtgtagggaactagtatggactattggattaatgcgttat

SEQ ID NO: 9852 - DNA, 734 bp, Sorghum bicolor
  Clone ID: SORBI-28MAY03-CLUS3881_1
cgtccgggaccgtcaacaaactcccccaagcttacctcttgctcgtccctgagcaaggatagactgagctatggatcataagttgttgcaatatttaaaaaattgacggtacacatgcttttaaataagacctcatctctgagttagagtaaactgtcaagacttaaaacttacttactttaccttcaccatgggacttgtaaccgtcacttctgtcttgagtggttaaaagatagaacagtctagccaagtgccatgtctcttattcttgatcagctttagctctggggtttttgcagattttcaaataaaactcagagattccttgtatgattctctcaggtctctcttttgtggtatttttggatccttaccaaggcagtgatggtatatgccttctctcaaaatatgtggtatttgtggtatgaggcatagtgacattgccttctctctcatcctactctaataaggcttttgatatctggagctcataggtgggaaacaactaatacatacttacaagacatttattgcatagtcaaaccatggatccagaagaacaagtcaataagtcaaatcaagatgtgcatgtgtggcgaatgaatggtgtatggtgatgatggtgaatgaacaatggtgaaagtctaattctacttatgctcttttgaggggatacatacctttcttgctcttttgaaactttttgaggagaatgagatgctctatattttatt

SEQ ID NO: 9853 - DNA, 645 bp, Sorghum bicolor
  Clone ID: SORBI-28MAY03-CLUS38977_1
cacaggcctgcagcacaaggcagaagcacgaggagacgagcagcggcagaaggtgggcagccatggagatgctgagcatgctgaaggcagggtacaccatcctgcgcagcgagacgccggcgaccgacctcgtcaacaccttcatggactgggcggcgcgaaggtcccttgtgctcctggccatcttcctcccgccgtactacatctacaagctcaccacgtcggcgttcgctgctgccgtgccagaggatgttgcagggaaggtcgtgctcatcaccggcgcctcctccggcatcggcgagcaaatagcttaccagtacgcaaagaaaggagcaagactggcgctagtggcgagaagggtgggcagcctgcatgatgtcgcaacgagagcgaaggatgttggctcaccagacgttctggttgttgccggggacgttgcaaatctggaggattgccagaggtttgtgcaggccacagtcgaacatttcggccgattggatcatcttgtgaacaatgctggtgtggcatatgtctgctggtttgaggaagtaccagatgttgctgatttgaaacaagtcctggccgtgaacttctggggcgcagtttatccaacccactgtgctcttccccatctgaagaagagtg

SEQ ID NO: 9854 - DNA, 653 bp, Sorghum bicolor
  Clone ID: SORBI-28MAY03-CLUS3876_1
ccgggatcgcgcagcggccagcgccgtggaaaccgtagacggaggacaagggaaagaaagcctgccgccccaatctcgtgtcccgccggcggccaccaccatcaccgccatgatcagcatcctcgcgcaggagcgcctccttgggttcgccctgggctccgtctccatgggcggcttcgtcctccaccagcgccgcgccatctaccgctcaatcgctgaagccgacgggtcgccctacttctaccagcctggtgaaattgccagtcgaagaagctcaactgaactggctcatgtatggaacaaggcagtggacgagacccttggtcgacttgttgtgtaccttagctctcgtggatggtgattcaagcaccatgttgaccatggcaactgaggaagcacagactcttttttcaagccactgatgtgctgaaacgtcctgatgtgctcatatttctctgtacccggattgaacatgttttgttttttttaaagaaaagagacccgcaatgaccgatttatctcgaactgagctgattctaccgcacgcttcgctgaacagttggatgttacttcaagcccaatgttctagctctgtgaaaggcaggattctcctaactattttagatatatgtattggtaataaagactgtatg

SEQ ID NO: 9855 - DNA, 721 bp, Sorghum bicolor
  Clone ID: SORBI-28MAY03-CLUS3808_1
cgtccgccttcgaggccgtctgcgaagggctgggcgccgccgtcgccaaggaggacaccccggtccccgccgccatccccgtccgccagcgggtcgccgtctgcatctggcgcctcgccaccggtgagccgctccgcctcgtgtccaagcgcttcggcctcggcatctctgcctgccacaagctcgtcctcgaggtctgcgccgccatcaaggccgtgctcatgcccaaggcccgccatcggcatctggcgccccgccccgccgcgggcgtgtccgcgaccttcgaggccgcgtcggggatcccgggcgtcgtcggcgccatgtacaccacccacatccccatcatcgcgccccatgctaatgccgccctttactacaaccgccgacacacggagaggaatcagaagacctcgtactccatcacgaagctcggcgtggtcaagcgtgatcggcgccatgtacaccacccacatccccatcatcgcgcccaagatctcggtggcggcctgctccgccccgcgctccacgcgccgcgccccgccgccggcctgctgcagcgcccggcggggcggggcggcgcccggcgccccctcgtcggccggctgctgcggcccgccgcgctccacgcccggccgccggcgcagcacgtgttcaacgagcgggtggacggcgtgcgcgccgtcgccagggacgcgttccagcgcctcaagtcccgctgggg

SEQ ID NO: 9856 - DNA, 611 bp, Sorghum bicolor
  Clone ID: SORBI-28MAY03-CLUS38193_1
ccaaacccctcctcgacctcgcccgctcctcttcgtcctccgctcccaatcctagggttttgctcgccgcggcgccgcatcgcaccgcagcgcgatggagcccacctcgtcggcgtcgatcgcgcggcagacgtgggagctggagaataacatccccgcggcggccaccgacccggacgcgatggacgcgatctaccgctacgacgactcggtgcaggcgagagcgcagcaggagaagccctgggccaacgacccgcaccacttccgccgcaccaagatctccgcgctcgcgctgctcaagatggtcgtccacgcccgcgccgggggcaccatcgaggtcatggggctcatgcagggcaagtgcgagggcgacgccatcatcgtcatggacgccttcgcgctccccgtcgagggcaccgagaccagggtcaatgcccaggccgatgcctacgagtacatggttgagtactcaaccatcaacaagcaggctgggaggttggagaatgtggttggctggtatcactcacaccctggttatggatgctggctgtcaggaatcgacgtgtcaactcaaatgcttaaccaacaattcacagaaccattcttggctg

SEQ ID NO: 9857 - DNA, 710 bp, Sorghum bicolor
  Clone ID: SORBI-28MAY03-CLUS38200_1
ctccttcgtctccttccctcccggagaagttcacagtccccactccacctcctcctacaaatacacctcacaacttcaccacgcctctgctcccctgccttccgcttccctccctatcccccccacccccccgcatcgtacggaacctgccaacgccgccggcgccatgggggccttcgcgaaggaggagcaccagttcctcgccgagctcggcctcgcgcagcgcaacccgggcgcgttcgtatgcggcgcgtggggcggctcgggccccgccgtcacctccaccagcccgaccaacaaccaggtcatcgcggaggtcgtggaggcgtccgtgcaggactatgaggagggcatgcgcgcctgcttcgatgccgccaagacatggatggcgtttcctgctccgaagcgaggagagattgttaggcaaatcggtgacgcactgagagcaaagctccatcaccttggcaggcttgtgtcacttgagatggggaaaattcttcctgaagggatcggtgaggttcaggaaatcatcgacatgtgtgattatgctgtggggctaagtcgccaactaaatggatccattataccatctgaacgaccaaaccatatgatgatggaggtgtggaatccccttggagttgtgggtgttataacggcatttaattttccttgtgctgtgcttggttggaatgcttgcattgctttggtct

SEQ ID NO: 9858 - DNA, 1529 bp, Sorghum bicolor
  unsure (1)..(1529): unsure at all n locations
  Clone ID: SORBI-28MAY03-CLUS38304_1
caacaccgtgctcgccgcctgcgcccgcgccaccgacccacccgtccccttcgacatgctcctcggcctcttcgctgagatgcggcacgacgcgtccccctccgtgcgccccgacctcaccacctacaacaccctcctcgccgccgccgccgtgcgctctctggctgaccagtctgaaatgctgctgcgcactatgcttgaggctggcgtctccccggacactgtatcttatcgttacattgtggatgcctttgccagcgccggcaacctctcccgtgtagccgagctgttctccgaaatggctgtcatggggaacacggcggatgcctctgcgtatctaggactcatggaggcacacacgcgtgttggcgccacagctgaggcggtggctgtgctgcggcagatgcaggctgatggatgtgcgccaacagctgccacttaccgtgtcctgctcgatctttatggaaggcaggggcggtttgatggagtgcgcgaactcttccgtgagatgagaactgctgtaccgccagacacggccacatataatgtgcttttccgtgtatacggggacggtggcttcttcaaggaggtggtggagctcttccatgatatgcttgaaactggggtagagcctgatatggtgacctgcgaaaatgtcatggctgcctgtggtcgtggtggcctccatgaggatgcaagagaagttcttgaatatatgaccagagaaggaatggtgccgactgcagacgcctacactggcctggttgaggctcttggccacgcggctatgtatgaggaagcctatgttgctttcaacagcacgacggaaattggtagcttgccaactcttgagacctacaatactcttgcgtttgcatatgctaggggtgggctcttccaggaggctgaggccatcttttctcggatgagtaacaatgctggcattcagaaaaacaaagattcatttgatgccctcatcgaagcatattgccaggccccacgattggatgatgcagtgaaggcgtacatggagatgcgcaaatccaggtttaatccagatgaacggtcccttgagggggtacttaatgcctactgcatagcaggggtcatagatgagagtaaagaacagtttgaagaacttcaatctagcgtgacactgcccagcattattgcctattgcatgatgttgtcactgtatgctaggaacgacaggtgggctgatgcgtatgatatgctggaagaaatgaaaacaaatcgtgctagtagtacacatcaagtaattgcttccctaatcaaaggggaatacgatgatagctccaactggcaaatggttgaatatgcccttgaaaacagtaccatggaaggctgtgactatagtttacggttctttaatgctctcctggatgtgctttggtggtttggtcagaagggccgagctgcaagagttctggatcaagcagtacaatttgggctcttccctgagttatatcgtgacaccaagctggtctggtcactagatgtacatanga

SEQ ID NO: 9859 - DNA, 795 bp, Sorghum bicolor
  Clone ID: SORBI-28MAY03-CLUS38318_1
attttcccatgcccgaccctaccggagcacctggacagacgcgagcgattgcgaggggaccggagaagacaccgcactgccgtctgctgtgctcccggctcccccgccccgcaccacaagcgcgtgcgcgccgtcaagtctcctctacagcaacttccaccgcgtactccctccctcgtcccgtctccaagtttcgcggggggcgaaggttgctagccagagcagtcgcggtctgcgctgcggcaccggcacggcgacgaggtggggatggagtaccgcgacaagctggtgctcgcgcccatggtccgcgtgggcaccttgccatttaggctactggctgctgaatatggtgctgatattacttatggagaagagattattgatcacaaattgttgaagtgtgagcgtgttacaaatgaatctcttgggactactgattttgtggagaaagggactgacagtgtagttttccgtacatgcccagaagaaaggggtagggttgtattccaaatgggcacatcaaatgctgtgagggcacttaaagctgctcagcttgtgtgtcaggatgttactgctatagatatcaacatgggctgtccaaagtctttttcgcttagtggagggatgggtgctgcattactctccaagcctgagcttatacatgatattttgacaacattgcggaggaacttggacacaacagtgacatgtaaaatccgtcttctgaacacaccttaagacactgtggagttggcgcgccggattgagaaaactggtgttccagctcttgctgtc

SEQ ID NO: 9860 - DNA, 716 bp, Sorghum bicolor
  Clone ID: SORBI-28MAY03-CLUS38371_1
cggcaggactatgttaaaaagaacccgaagttgataaatccaagtgatgaagcaagtacaattacttctaagtcttttcaaccagaagaagtgaaccccatagcctgggcagttcctacagcacatgagggtgatgccagtgaagaagcttctctcgctgacgagacacttccatcagaagtagtgctaacccggaagagaaaagcagaaagctcttcgtcagtagagccaaaccatctctctgatgaacttgaaccaaagttggcggatgctcagaacggggagacgtctaactgaaaagtaaaagtgggcagcatcatgatgccaactgcccccctatcatggttttattggtctgcttgtttctcatttcccttgggagtcagcttctctgttttatgaggccacacaagcctcatttgtagtattacaccacagaagctggctgacccaaaatccgccactttggggggcagcaacttaacaaaatgtttgtacgagagtttagagccctatggaacttgtttggataagtatgtttattaccttgtacttagctaggaacctgcttatgtaagatgaagaactgtcatagcggcatagttctgccgcacgtcggatttaatctcctgttctttgttagacggaccagtcgcaaatgttgtgaaatgtcttgagttataaaccagtactactgcggtattgttccctcgtgc

SEQ ID NO: 9861 - DNA, 778 bp, Sorghum bicolor
  unsure (1)..(778): unsure at all n locations
  Clone ID: SORBI-28MAY03-CLUS39404_1
gcacgagggttcaccccctgcccctggccccgcacgaggctctcccgttcaccccgtgtgcccgcgcgcgctttctctcgtggcgacaaccgggcgaccgccgccgccgccgccgccaccgcctacgctaggagcctaggtcttcgtccgccctttcgccggcgacgagcacccagcaggggaactgcaagattgattttgatggattatggcaagtctagaagaagtaactccaaaaagaggacatattccaattctgaggacagaaagaggaaacggctaaactcaaggcatgatgacacatctatgtcctcagagccagttgaaaccatctacaggatattgtgcccagtaaaaaagataggcagtgtcttgggaagaggtggtgatgttgttaaggccctcagagaagaaactaaagccaagataagggttgccgatcccattcctggtgcagatgagagagtaattatcatcttcaattaccaaaatcaacctgaactgactgatgaagcagctgaaactaaatttagtgatggcttagggaacatgaaaccccattgctttgcccaagatgccttattgaagatacatgataagattgtggctgatgaaattcatgatggagtcgcccatgaggagaagtctgaaagtgctgatgatgtgactgctcgaattttggttcaaggcaatcaagttggctgccttctaggaaaaggtggctccattatacaacaactacnaagtgatactggtgctgggatccgtgtcttgccat

SEQ ID NO: 9862 - DNA, 944 bp, Sorghum bicolor
  Clone ID: SORBI-28MAY03-CLUS39410_1
gtcaccttttcttctcccgttcacggttcagcttgctctccccagcagcgacgactgggcgacccccgccgccgcactaaaccctaccccaggtctgcgtcgggctcttgccggcggcgagcaccagccagcttccaagatggctcgtcgtggattgatggaacaggacttaagcaaactggatgtgacgaagcttcacccactgtcacctgaagttatctcacgccaagcaacaatcaatattggtaccattggccatgtggctcatggaaagtctactgttgtgaaagctatatctggagttcagactgttcggttcaagaatgagctggaacgtaacattactataaagctgggttacgctaatgcaaaaatctacaaatgtgaggatgacagatgtccacgaccaatgtgctacaaggcatatggaagcggaaaagaagatagccctctatgtgatgtgcctggatttgaaaacactagaatgaagctcctgagacatgtttcttttgtcgattgcccgggacacgacattctcatggctacaatgcttaatggagcagctatcatggatggagctcttcttttgatcgcagcaaatgaaagttgtccacagccccagacgtctgaacatcttgctgctgttgaaatcatgcgtcttcaacatatcatcattctgcagaacaagattgatcttatccaggaaagtgccgcgatgaatcagcatgaagcaatccagaaattcatccaggggacaatagctgaaggtgcacctgtggtgcctatatctgcccagctgaaatacaacattgatgttatctgtgaatacattgtgaagaaaatccctatccctgaaaggaactttacctcgcctcccaacatgattgttattcgctcctttgatgttaacaagcctggttcagaggttgatgaaattaggggtg

SEQ ID NO: 9863 - DNA, 809 bp, Sorghum bicolor
  Clone ID: SORBI-28MAY03-CLUS39569_1
atgctttccttcgcgcgagcaaagaggggcacggcgaacaggcactggacagacccaaatccccgtagctccaaacatccagaagcttctagaccaaaccttcaaacccatcgcctcgggttccggccatgtcgctctcgtcggcgcgccagcgtcgtgccacggcggcgtctccaccgaccgacgatgggtacgctaaggacgccaaggacaggaggcggcggcccggcggcgacggggacggtgaggacgagggtatcaagtggttcctcccgttcctggcgctcgggctcctccgccacatgagcgcgtcctccaacctgatccatgactgcgacgaggttttcaactactgggagcccctccacttcctcctctaccgctccggctttcagacctgggagtacagttctgattttgctcttcggtcatatttgtaccttttttttcacgctcttgtagctgggcctgcttcactgatctttggtgagaataaggttcgtgtgttctactcattgagaatctttcttggtctcatttcaactattaccgaaactgttctggtggttgctctttcaagaagatatgggaagcgacttgcttgttatgttcttgcaatgctatgcttatccagcggttgcttctttgccagtaccagtttcttgccaagttcattctccatgtatgcagtaacactttcatctgcactcttccttcttgagaaatatgctggtgcagtctcagttgcagctgctggagtgatccttggttggcctttctcaattttggttttcctccctgttacctgt

SEQ ID NO: 9864 - DNA, 1213 bp, Sorghum bicolor
  Clone ID: SORBI-28MAY03-CLUS3938_1
gccggccgggccgggagcctcgatttctttcccttccccagccagccgcgagcctcataccggcgcagccatggcggaggtgcccgccgtcgtcgccgccgcttccagctgcgaggtcgacctcggcaacctcatggcgtacgacccgtcacaccacgtcgtctccgccgccgccgccgcctccagggaggaactgaggcaggagtgtctacggaaggggacggagctggcgcaggcggtggccgacgctctcttcgcgctgcctcccagcgaggaccgcgacggccccatcgtccacctcccgccgcccaccgtccgactcccgcgcgagaagcatctacccaagcccaagccaccgaccaagtgggagctgtttgcaaaggcgaaaggaataaccaagcgcaagaagaacaagcgcgagtgggatgagcaaactcaatcctggaagcggacttatggctatgaccgtgttaatgatgacaaagacattccaatcgttgaagccaaattgactgatgagcctggtgttgatccctttgcgcaaagaagggatgagaagaagaagagggttgaaaagcaagaaaaaaacagactagagaacttaaagaaagctgcaaagattggcgctttgccaagtcatatacagcttgctgcaaaggccttgcccatcacaggaactaaagctgaccttccaaaaaaatctagaaaagaggatcttgagagtgttgttggcatggcttcatcagcaacagcaagcggtgggaagtttgatgagaagttgcctggcgagaaacctccaaagcactctggcaaacacagaaagttcctcccagttgccgaagggaagggaatgggcagcctggagaaacagcagaatgacaaaatcctgaactctctacttgccagaaactctgatgaaccgcttgatgttggcaaggcaatcacaatgtacaaggtgaaaaaggaaaagcagagaaggaaagagaaagatatgtcatcgaaatctgataagcttaagccccagaagaaaccccacaagaagtcatcgaagaaaaaggcttaggtccacatctttcaggtgaccacagttttgaaagctcaaacaaggaggcctgtcacaaattcgattgtatttgtgcgcttgaatctatgcgagaaattgttatcccgtttactggttatgacacaaaaacctgaatgctgttataatata

SEQ ID NO: 9865 - DNA, 578 bp, Sorghum bicolor
  unsure (1)..(578): unsure at all n locations
  Clone ID: LIB3481-031-P1-K1-H7
cgtccgcttatttctcttccacagccgcgagccgcttaccggcgcagccatggcgaaggagcgcggcgccgccaccatcgcggcgtccagctacgaggtcgacctcggcaatctcatggcgtacgatccgtcgcaccaccgccgccgcctccagggaggagctgaggcaggagtgcctgcggaaggggacggagctggcgcaggcggtggccgacgccctcttcgcgctgccgcccaacgaggaccgtgacggccccatcgtccacctcccgccgcccaccgtcggactcccgcgcgagaagcatcttcccaagccaaagccaccgaccaagtgggagctgtttgcaaaggcgaaaggcattaccaagcgcaagaagaacaagcgcgagtgggatgagcaaactcaatcctggaagtggacttacggttacaaccgtgttagatgccgatcattgaagccaaatcgactgacgagcctggtgttgatcctttcgcacaaagaaggggatgaaaagaagaagagggttgaaaagcangaaaagaacaaactagagaacttaaagaaagctgcaaagatt

SEQ ID NO: 9866 - DNA, 1051 bp, Sorghum bicolor
  Clone ID: SORBI-28MAY03-CLUS3960_1
cgttcgcagcaactgaacttggtgagctccgctctgttcttaagaagtcgttagtggattcctgtggcaaggatttgtttcagtctttatatgcttcgtggcgccactctccgatggctacgataagtttgtgtttacttgctcaacatacagtcacgcaagctgtgttattcagtcactgggagaagaagacataaatgtgaaatttttggttcagttagataaattgatccgtctcttagagactccagtatttgcttacttgcgtttacagcttctcgagcctggaaaacacacgtggcttctgaaaactctttatggtctcctgatgctgttgcctcagcaaagtgcggccttcaagatcttgaggactcgactgaagactgtgccattcagtgaaaatcttaagcgcacatcttcagcaaatccatactctcagattctgcaagtgacagaagatggcaatagaaaccaagacacacagaactatagtgcaatcaatttcccattccttctccagcaatttgagaacatgcagctgcagcaccgtaaccatttgaaggatcagctgcaatcccgcaaatctgcttcagctctaacattatctcaggagatacaaagatacgaagaagcacattcctcttcgctatcagagattaacaggcccccttcaagaacatccaaaggcattttatgatgcatttggttcttgcgatgtatgatatatttgccggaagcatcatcacaaatatgttggggctttggttagtctccttgattttttcaaaggaggttgcatagggtacatagagtgtaatcttttttgtttcgttcctagattttgtcaagagatggcaattatttgttggagaaagctcgtttccgccctctagccattcttttcttagccgtttcactgctcatctggtttctgtaatttttcaattgaaggccaaatgagcaaagtagtacttggagatatgctactactgttactgcttatcgatctcccaataaattagcgtcgcaatgtaaattcctgtgttggctc

SEQ ID NO: 9867 - DNA, 792 bp, Sorghum bicolor
  Clone ID: SORBI-28MAY03-CLUS38552_1
cagttttctgctgggccctgatccaggcctggaagtgcttcacaccagcaaggagtttgtcgatccagctctccagaccagataacctttcgtccaggttcttctgcggtcgcggtgccctgcattccagggtttccggccaggtcacagcagcgcactccaccccctcccaagacccatgcatgtggtcgtgggtaaacctattgaagtcaataagaatccccagcccacgattgatgagattaatgaagtgcatgaacagttcatcattgccctgcgggacctgtttgagaagtataaggggaaagctggatatcctggccttcatctaagagtcctatgacattccagcaccagactcaaagttaggattcagcaataacatggctctattgctcctccctcaactgaagtgtcaaactgcacttcgcaggcactcaggcagtagttgcgacattgtggtgatgataataaggctccagctctgatgccaaaacatgcacgagttgctcacgattcagagcccttgctttactttttttttactgttgcttgcttaactttggtggctgaaatgggtatgcaaagataggtaatttaaatactggttatgcgatgttgcatatgagaatatgaacattggtgagatataagctcctgtatttgcagctgtggcatcagtgtatgaatcactaggaagttgctgatattgggcagcctgtgtacctgcagttgtgtcattgtctgaaaaactttcagatatattagaacccctacaagcccatttggttt

SEQ ID NO: 9868 - DNA, 721 bp, Sorghum bicolor
  Clone ID: SORBI-28MAY03-CLUS3857_1
gccgtaggcaaatacagactgccgcgtgctaataagaggtcgcggcagcattaaagatccagcacgggaggagatgatgcgagggaagccaggatatgaacacctgaatgaaccccttcatatattggttgaggcagagctacctgttgaaatcatcgatgctcgcctgatgcaagcccgcgagatccttgaagatctgctaaagcctgtggatgaatcccaggacttcttcaagaagcagcagctacgggagcttgcaatgcttaatggtacccttcgtgaggaagggatgcagagatctggttcagcgtcccctttccacaacagccttggaatgaagagagctaagacaagggggtaatgaacagaggtgcaagcatcatgaagggagaaccaaatcatctattctgagaccgatcctgtgtacacatggggttgccttgctggctactggcccaatacggtctcgcaccaccagcatcggggcggccgtaccgtacctgataaaacatatatctggagttgtgtttcctgctactggggtagtttggttatgcgccataggtcgttgcgctatatattgggttgtgcagggttttgtagcaatgtggtttgtgtaatgctcatttggagcgtttgaaagctctcggcttgtatttcttatcaagacaagatagtatttaaggacgctgtttgggattgaagcaatgctctaactgtt

SEQ ID NO: 9869 - DNA, 1591 bp, Sorghum bicolor
  Clone ID: SORBI-28MAY03-CLUS38623_1
gcgcgtcgctgcgttcttcttgcaggagctcaccgggcgtctgctcccggtggggtggctgctcgcccccggcttcgtctgctgccctcgacggatgccagctgggccactgccgttctggctttgtgtggtcggtggggtctttctagagaggggccagcggcccaggattggcgccggcttcttgctcctacttgggaagctctccgactccgatgtgccgcgctgcttggccagtggtctcgtgtccttccgtcttcccgccgggaaccatggtcgttctcggaacgggttcgtggcgcacgctgcccgtctcttatggttccggtcaatattttgtcatcttgcagtggttcctttatgaaagatgaactagccatcagccgaaagccttccaagtctcctcaaaccctcatgaaagaacttgtatcttctctactggaaagtaaagggatgccccctcagttgttggagcagcttccagctaggtgggagacacttggtgatgtcgtcatacttccgaagacatgttttaagaatccattgtgggaatcagttagcgaggaactttggcctcgcgtcgccatggctcctggtgcgctgcgtcctgctccccagggctttatcttgccttttgcttctagaggttgttctctggaacttcttctgggtgataatggatgggttacccattatgaaaatggcatctgctattcacttgatgcaacaaaatgcatgttttcttctggtaatcgttcagagaaacttcgcatgggacagctaaactgcagagatgaggtggtcgtggatttgtttgctggaattggatactttgttcttccgtttcttgtgaaggctaatgccaagctagtttatgcatgtgaatggaatccacatgctctggaggctcttcggcccaatgttagtgacaacagtgtggaggatcgatgcattatacttgaaggagataaccgggtgactgcacccaaaggtgttgctgatcgagtctgtcttggattgttaccctcaagtgaatgtagctgggccactgctgttgaagctttaaggattggcggcggcatattgcatatacatgggaatgtcaatgactctgatgagacacgctggttggacaatgttgttgaatccatcagtaatatcgccaaaaaccatggactatcttggaacgtgttagtggagcacgttgaacgtgtcaaatggtacgggccacatattcgccaccttgtagttgatgttagatgccggcaaatctaacaaagcagacgccaccttgtagttgatgttagatgccggcaaatctaacaaagcagacgccttcagagaatacttgtgcagtgccaggcctgggattcttggatagttggatgcatatacattatagaatgtaatgttcaacagtttgcttcggttgtgttttggtcccaagtgtattccattgctcctagtcatcatggagcctctgttgtgaccttgaaagcatgttcaggttcttgataacaattcgctactgcatagctacagtaaagttgtgttcttgtaccgagtactttatgttcttttttcttatata

SEQ ID NO: 9870 - DNA, 660 bp, Sorghum bicolor
  Clone ID: SORBI-28MAY03-CLUS38658_1
gacgtgctcgctaccctcccccaactcgcaagtcgcccgctccccgcccggttagcaaggaagcaggcacgcaggatatttggtgcgcgcgggcggcgtgagcctgcagcgagcgagcacaaggccagcagcagcagcgagcgcgacgtcggcatcggcatccggcaggggagagcccgggcagcggagccacacctgccctctccacctggaaccccgcgcgggctccgccggccgcggccggtgccgccacgactcggcacgcgctagctagctgttgcccttccccgggggccccaccactaccgtccctgctgcccggcctcgcgttggcgatgatgattcctagggagccgcggcggccggagcacccttcctcctcctgatcccgagctgccctcgcccgtcgcagcgtctgtgtccagactagaggatggagactcctcaaatcgagatgggcggtttcaaggtcaacagcccgcaagtgcctaacggtgggttgcggcccaccgtgtcttcctcctggaactcgcgagggacggtcgagagggcgatcaagagcatcaggatcgtcgttttcacttccaagctcaacgtgctcatgccgttcggccctgcgtccatcattctccacttcacgactaggaggcatggattgga

SEQ ID NO: 9871 - DNA, 1038 bp, Sorghum bicolor
  Clone ID: SORBI-28MAY03-CLUS38691_1
gcacgaggctctcttctccctccccttccccttcacctcacaagccacctagccgcaccgcattggcaatttggcatggcgtcgtcctgcccccccgcgccgtctggcgccgcgctctgccgcccgcggcggccgaggtgccgcgtcgtcgcgtgctcggcggccgacgccgagccggcgtgggccaagggcgccggccgcctcgcgtgcggcgtgctggcggcctgggccgtcgcgtccgcgtccaatccggtcatcgccgcgagccagagattgcctccactctcaacggagccaaaccgatgtgagcgtgcatttgtggggaacacaattggtcaggcaaatggggtgtatgacaagccccttgatctccggttctgtgattactcgaacgagaaaactaatctaaaaggcaagtctttagctgcggcgttgatgtccgaggcaaagtttgacggcgctgacatgtctgaagttgtcatgtccaaagcttatgctgttggtgcaagtttcaaaggaactgacttcacgaatgcagtgatagaccgtgtcaatttcgagaaggccgatctcacaggggcaatcttcaaaaacgcagttttgtcagggtcgacctttgatgatgcaaagatggacgatgtcgtgtttgaggacacaatcattggctacattgaccttcagaagctatgtacaaacaccagcatcagcccagattcgagattggagctgggctgtaggtgattcagcagagttcaaccctatcgttcatgttaatatatatgtcgatatcgtccgttgagtgttcatgcctgtctatagagccaccatgacaagccgcaaatccccagcagaaagacgtgatgccgattttcatcatatctatgtatctatcgatctatgtacaaacctctgtatatctcaaatatcagcagcaatgtaaccatgctccttagttcttacacttggaaacttaaataaacatccccatatatatatatacatatatacataaaaggaagccctatggtttcccccccc

SEQ ID NO: 9872 - DNA, 922 bp, Sorghum bicolor
  unsure (1)..(922): unsure at all n locations
  Clone ID: SORBI-28MAY03-CLUS38736_1
actacagattcctggaaaaatgttgaaagtcaggcctcatcggtttccatgccaataaatggagtacctgttgcaagctttccagcaaatgttagattccacaatgcagcagcagcagaacctgctttgctgccacaggttgctccaaccgaaacaggttctgatcagtctgggttggcctttcaatccgctttcggaaacatctggtcagatccttgcatcgagtttgcttttaagactcttacaggtgacattcctgttctggacgacacaacagccgtcacagactacttcccagagcaacaagacttgaataaaggcccagcacaaaatggtgcaggttctgtatttgacaattccagaaaccacacacaagtcgatgttaaccttccaccacctacaccggatgatttctgcaatggcagttggttccctccccaatgaattcagtgtagggaggaaaaaatgcaataaccttttgtacctgtgaaaaggcaaagcgaaggggaaggctagtggccaaaacccaaagcaatagttgtgcactcttgttagcgctctgatctgaatgtgtaatcccagtggacacaatttgtaaatgacagtagcttcttagccttattagactgttaatacactcaactgaatgatgtccggttccatcaacaaggcttcacggagactgtcgagtagctgatctggatcatgtttcctatattttgcttctgtgcagttgcctaataaacccattcgttgtaaactagctagttctaacttaaaaagctgcctcagggcctatgtggctctaattattgtgcagatgaactgttcttctggacattttgagcacgcagatgtaacaggctcacatgtgagcttgttcgctggtctaaaaagatatgagctgaaagtactgtttnct

SEQ ID NO: 9873 - DNA, 1299 bp, Sorghum bicolor
  Clone ID: SORBI-28MAY03-CLUS39789_1
gcacgagggtcaaagatgtatctagaggcttgtccaaagttaattgaacgctttcgggaaagagaggagaatgtaaagatggatatcttcaacaccttcattgagctgttacgccaaacttgtaatgtaacgaaaggacaaggcgacatcgatgagtccagtcctcgatggttgctgaagcaagaggtaccaaaagttgtcaagtctatcaataggcagttacgtgaaaaatcaatcaagacaaaggttggggcattttcagtactgaaggagcttgtggttgtattaccagactgtcttgctgatcattttggatcacttgttcctgggattgagaaggctttgaatgacaagtcttctacctccaacctgaagattgaagcccttgtatttacaaggcttgttatggcttcacattcgccatctgtgtttcatccatacatcaaggcactttctgcccctatactatctgctatcggagatagatattataaagtcactgctgaggctttgcgggtgcgtggagagctagtccgtgtccttcgcccaaatcttgagacaagctcagtcgatttcaggccatacagtggtccaatctataatgctatactgggacgtttggctaatcaagatcaggatcaggaggtaaaagaatgcgccatatcttgcatgagtctggtggtctctacgtttggtgatggtcttcaaagagaattaccagcatgccttcccatactcgtcgataggatgggtaatgaaattacaagacttacagctgtcaaggcattttcagttattgcgaattcacctcttcgtattgatctctcgtgtgtcctggatcatgttgtttctgagctcacagctttccttcgtaaggccaacagagctcttaggcaggcaacattgggaactctaaattctttggttgtcacatatggtggtcagattggctcttcttcatatgagacgataatagcagaactttcaaccctcataagtgacatggatttgcatatgaccgctcttgcattggaactttgttgcacaattatggttgacagaaaatccattaaaaatgttggtttagctgtgagaaataaggttttacctcaggcccttgttttgatcaggagtgccctcttgcaagggcaggcactacaggctcttcagagattttttgcgtcacttgttcaatctgcaaatactagctttgatgctttgatggattcccttatttctgctgcgaagccatcacagtccggtagtcttgccaagcaagcactgacttctattgctaag

SEQ ID NO: 9874 - DNA, 800 bp, Sorghum bicolor
  Clone ID: SORBI-28MAY03-CLUS39807_1
gctccgcgagcccgcccctgccctgctcgcaaggccatgccttggccgcatgctcgcaacgccgcctcgccgctgccgaagccgcgcccgcccctgccctactcgcaacgccgcaccgccctctcctgctgaagccgcgcgcccgcacccgcccctgctggagccgcgctcgcctcggatctccagagccgcgcccgcatcggactgccggagctgcgcccacccccgaccgccggagccacgctcgcggatccgctaccgccagagccgcgctcgccggagccgcgaccgctggagccgcgctcgccggagccgcgaccgtcggagccgcgctcgccggagccgcgactgccggagtcgttggagggtcgtccctgtgcttgctgatccattcgtctccaacagactgcaacccaaggaggacgttaggtcgtgggagcacaggcgttcctcaaagccgtgggtctgcctgcatcgctagcctgacttcaccgccacccaagctcgtcgagccgggctggtctccggcaccagaagagtgaggtcccgaggcccctgagcggggcgacagtctcaatagcacccggacgcctcgcggcccatgtggaagacgcagtcgatccggtccttgaacttctggttttttcatgctgttcggcgttttgccggacgttgcttgggcttgtgctttccttactcttgtgatggacttggtgatgaacatgtgtttatgtatgtgacatgtacgttatatgtatgtcagagatttggtatatcatggttattgtggtaaatgtgcg

SEQ ID NO: 9875 - DNA, 1276 bp, Sorghum bicolor
  Clone ID: SORBI-28MAY03-CLUS39811_1
gcacgaggctcaccactacaagatctattcataaaagagttcctgtgcaaagaatcgaagatgacagcatatgcatcgaggatatgatgagggagtgtggtatcattgacactagattagatgagagcatgaagggccatcctggcattccctctgatattttgtccgatctgtttgatgatggcagcataaaatttgatgctaatttacctagcaagaagatccgaggtcatctaagatcattgaaacctggagatgcttgcaaacttcttgagaatttagtatctgcatggataataagatctggtagcacagaagttgtattgcgctggatatactgcctgttagtcattcatggccgttttattccctctgagaaaacaacaaaagtaattagcaacctgcacaagatgtgtgcagaaagatacaaagctactgaagatttgctgaagctttctggccggcttcgattaataacggctcaggtcgacaaggctgctagtagcatgtctgagccgacatcagaggagatgcaggatgctgctttccagtctgacgaagacgaggatgaagacgttgatgaaacagtgtttggtcaagattcacaaaatagcgatgacgacgacgatcatgatgatgctaagtaggctgtactgctggtattcatcattatggtgatgtatttttttaattacattttcaagcttgatttttgtcaagtttgtaaactaggcaacgcagaaaggttgcacagaattttgacagggtgtggttgcattttgaagccacttggaagttgtgccgctcgcctttacctcctttccttatacgacggctatgggggattagtctgacgggtcgaaagttacgtaccctagggttatctccttttagtctgatcggttagactgactggtggaaagttgtgcttgtcatggacacgtcatctacccatttttgcctagtcacccaaacttttgtggtggtgttaattgtgatgacttgtacggttgtggattgccttttcttcccaagtagtttcagctttcaccccacctccatatagtgatgtgagatgtgcagcttgttggtgaaatactctgggccatacaatctccatggcttcatatagtaagcgtgaaaagccttttctttaaacaaaacttggacgtttttaaaacgatgcaaatctacattgtatctatagatgtgtccttttttgtcgtgtacaaaaattaagatgcaaacttattcggtaaaaatgcacacataaatt

SEQ ID NO: 9876 - DNA, 792 bp, Sorghum bicolor
  unsure (1)..(792): unsure at all n locations
  Clone ID: SORBI-28MAY03-CLUS3984_1
gccggccgggccgggaagaaaaaggctcgattcgctgtttcctgccacaagtccacagctcgccgcggacgtcgtccccgctcaagtgaaggtccggagtgaagagccttgcgatctccgctgcgcgcgcgcaagatggctgacccagagttggaagctatcaggcagaggaggatgcaagaactaatggcacagcgtggtggggcaaatcagcagaatgcgggccaacaaaaagctcaggaagatgcgaaacaggaagctgaggaacgccgacagatgatgcttgctcagatattatcttctgaagccagagaaaggctctcccgcatagctttggtcaaacctgacaaagcaagaggggtggaggatgttttgctgagagctgcccaaactggtggaatatctgaaaaggtgtctgaagaaaggcttatctcccttctagagcaaattaacacccagacaaacaagcaaaccaaagttacgattcagaggcggcgaagtgtccttgacgacgatgattagatgcgacctgcaaaactttgcttcagagtgtatgatgggctggtgattgattaaaagcggtaccgaactgtttgcttaaagacaatgatctgatgcgactatcaacagccatcaaaacttggtacttggtagactatttcatggatattcggttgtatatgatccgatgtcttattggtgtgtgtgtgccccattgaggacagtcgatattggctgtgtcgtttatccctgaaacaccgttcttccttgagttatggcatttgntaatgg

SEQ ID NO: 9877 - DNA, 656 bp, Sorghum bicolor
  Clone ID: SORBI-28MAY03-CLUS39180_1
caaccacagcaaccagcagcagcacaagcacagagcagccaaaaccaggctgtggaaaccagtagctctgctgcggatacggctacagaagtaactcaggaatcttctgctgctagctagcatctttcgtgaagttgaggaatgcaggttgtgtaccatctgtcattctcttctctggagtgatgctggtgattgaagaaatgggcttaatgcttgcaggttgtgtaccatctgtctctcagggtccaagatgtgttttctgtctgatgcatctcactggaggggtgtcagctgctcggctgctgcatgtggaggcctaaatgagagcatgatggcgaggcccgtagccaatctgacaagatctaagtttacttgatgggtacttctaattttcgattatgcacagcgaccattgtaaagtaaagaggttaacattatatatcatctttaaataggactagcaaatatgtccatgcgttgcaacgggacacaaagcctatcaaacgtttaacttgtttgctttatctttttgcacaactgcagcagccgcaaacttaatttctatagttgttacttttgatgttgagtggttgttgcaacaatcacaaacacatgggctcgttaatgaaaacaagactaaccaatattgcatatct

SEQ ID NO: 9878 - DNA, 710 bp, Sorghum bicolor
  Clone ID: SORBI-28MAY03-CLUS39198_1
gagaaggaacggtcattacttgttaatatttcagaattacagtctaggatgataacactgactgatgaactaattgcagctaagctaaaacatgttcagttgcagcaagagctaaatgcattgtactgccgagaagaaattgaggattttagggatgaggataacgaagaaacataattgaggatccatgctgtataaattaactgcctctccctgagacgtatgaattacctgcctctcgctgaggtcaagggagaacaagagaaggaaagcggcagggagaacaagagaaggaaagtggtagcgttgccgcaaatatttgctggatctggagactagctgcggttctatggaatttgttctttgaaggttgttgtgcccctggcctgctgccatcagtgtgtataaccgtctttcttttagttaccttttttttaattagtttgtggttttccttttttttggtgaccacaagattgaggcgtggtcatgctgctatttcagccagctgtgattatgtagtccgtaggctaccgggtggttatctatgcagaattgcagaagactgcataataaattgtattttatctagcaataggatgtatattaaatattggtgcattcgttatatgtatcatatagggctattcgcaaacatccaaacagagttgtttgcatatatagtatctaataaagtatgcattgactcc

SEQ ID NO: 9879 - DNA, 695 bp, Sorghum bicolor
  Clone ID: SORBI-28MAY03-CLUS3922_1
ctacggatgaccctttgcaaattcacctgacaaaagaaccattggtggaagaatacagcattgctgcttcgctgtggaagctcagttcttgtgatttatgtgaaattgcaaggaactccgtttatcaatctggattttcacatgctcaaaagtctcactggattggcaagaactacttcaaaagaggacttgctggaaatgacattcacagaacgaatgtaccacacatcagggttcaatttagagaaatgatctggagaaatgaaatgaaactagtttactctgacaatgagatcttaataccagacgagctggatctgtaagatgtccggcctcatgtataacctgtagtggcaatgggaattatacttcatgttttgttgctggaagtcagcatgagaagcgatgtgatcaagagtgtctccaaaccctattgaggaaaacctccagaaatgccccaagcacgccaagggatgcaataatgtggcaaagtgaagcagcagagatttgtgctagagttgcattatagcattatagggtgtcccctgtcccccctcgtttgtaagcatgtactcgaagtggttgtactctggttggatcctatagggtgagaataaagtgctgccggttgttttgctgcccacatgaaaatggaatcgaaccatatgaggaggcaattagataattaagtaaag

SEQ ID NO: 9880 - DNA, 928 bp, Sorghum bicolor
  Clone ID: SORBI-28MAY03-CLUS39238_1
gcacgaggcgggctcccacgaactcccccgtccacccacccctgcttctctcgcccgcccggccccgccggacgcatctcgggggctctgcgctcccgccccggttcttggggccggtggatgcgaccgcgtccccgcccccgcccccgaaaatcagctggcccgcgtcctcgtagcgctcccgggatccaggccgtgagcaatggcggcggccgtggcgccgccgctctgcacctggctcgtcgccgcctgcctctccgcggcctgcggcgatggcgagaaggagaagcagcgcaggcaccgcggcgtcgggggtctcttcggctcgcaccgccgcctcggctctgggcgccgcggcggggcgcgctctggaatggccatgtctgttgccttgcagcctgaaaggacagctgtggaaagtaagaaacctgatatgaaacaaaggagagtggtggtcactggcatgggcgtagtgacgccactaggtcatgatcctgatgaattctacaataaccttttaaggggtatcagtggaataagcgagatagaggcatttgattgctctcactatcccacgagaatcgcgggagaaatcaaatcattttcgacagatggttgggttgcaccaaagctagctaagcggatggacaagtttatgcaatatttgataacggctggaaagaaagcattggagaatgctggaatcactgaagaagtcatggatgagttggaaaaatcaagatgtggagtcctcattgggtctgctatgggtggcatgaaggttttcagtgatgcaattgaagctttgagggtttcctacaagaagatgaacccattttgtgtaccttttgcaactacaaacatgggttctgcgatacttgctatggatctgggttggatgggcccaaattactctatctctaccgct

SEQ ID NO: 9881 - DNA, 868 bp, Sorghum bicolor
  Clone ID: SORBI-28MAY03-CLUS39314_1
gcacgagggttagggcagcggaagggtagggatcgggagggtataaaccctagtagcttgataccatgcacaattaaggcaaacacctcataccccttgggttgggtggctttgattatatactcaataatgacttgagttacaagtaagcaatatacaattaaccccctagatatacatatatccaacactaactgctcacaaaacgaagtaaaataatttctaaagttgggtttagaccataaataataaagatctagtcacagtttggatcacaacatgttaagattgattttttctgtggctcaaatgcttgcatggtgttctgttatttttgcctgtgccctcaacatgactttatatgcacattctctgcacatagcatttctcatcctatcccctctgcctcctagtccctatcgtgctttgtgacttcagaatatctagatttgaaggaaaatcagtttatgctgcttttgtttgtgacagcaaactacattgtaaatggcctcgaccaacctgaagaaacacaagcggctaatagaattgaaggtccaaatacaactgtgacggaagaaactggtgtgtcaggaactgaaacttaagctgaactttctatctctgctcatgatctcgatgcagcaaatacgatctggttggatatgcttcaaaatcgttcgttgaggtcacccagcttgtctggattgtgaatacgactgttcctgaaaggccaaatctagagataatgttttagctttaggtagatatccatatagcaactaaaatgggtgctggacaaatttgtagcacccgttgtgttgtcacctttcacgtttgagcaatttgaatcctgcgatgaacactcttt

SEQ ID NO: 9882 - DNA, 674 bp, Sorghum bicolor
  Clone ID: SORBI-28MAY03-CLUS40333_1
tattactgaaggaataggaatcaatagggtcactaaaaatttcatgatggcggaactggatggagcttatcgcggatcagatagggaagctgttgagatgtcaaggttcttgctgaaaaatgatggactatttgttgggagttcttcagccatgaattgcgttggcgctgtaagagttgctcaagatttgggtccagggcatacaattgtgacgattctttgtgacagtgggatgaggcatctaagcaagttcttcaatgagcagtatttggctgatcatggattgacaccagcagctactgctctggaatttcttgataaatgagcatttcacagggaattttcagtttcagtgaagttggcatgctccctcttactgcgatgataccttgacacagggtgaacactggataggtgaaagcatgaaaatatgccatacagttagtgaaccctaatggatgaagcattgatatatgctaagtactaattgtagtctactaggcattgccattggataggattgggatagccagtgttttggcttttgttttgatatatatctattgaggctgttaccagttagaatgctgcactgagcatctttgctgtaaacaactgcaatatatgcatttttttgttaaaaaatgtttcaagaacaattcacccgttttgtc

SEQ ID NO: 9883 - DNA, 746 bp, Sorghum bicolor
  Clone ID: SORBI-28MAY03-CLUS40283_1
tgacaaagcgtaataaagactctgatgatgaacagaacagagtgcggaagtatagaaagaaacatcaagaatctgatgaggaagaagatgaatcagaggagagctataagcactcgaggaagaggcatcgcccagagcattcaagaggccggagtaaggatgttcataaacataagcacaagagtcactccaaggacagggaatccagacatcacagacaccgttataactctctggaagatgagcaggagcatgaacgtcggagttccaagtcaaggcataggcatagagatgatcaccactactctgatgaggaggaacataggtcacataagcatcggaggagggagcatcactccagctctaaaagaaagcacgaggaagaccgataccagagtgaacagtctcaaggtcgtttagaagtgtcatccccgtctagatcaggtgccaagtttgaatcagacaagctgcctgacgacactgcacaatcaactgagggagcaactgcagtgccgagtgaactgagagcaaaaatcagagcgatgttgctcgagagattgtaatatctgcatcacatcagattaacattatatgtccttgggcttgggcctctgttttgtagccaactgccctttcaatttctgtatttgctttgaacgttccaactctgtgtgcattttatttgaaatcaatgacctgcacgctaagtttgttggcctgctcccccatgttggcgtttctgctgc

SEQ ID NO: 9884 - DNA, 781 bp, Sorghum bicolor
  Clone ID: SORBI-28MAY03-CLUS40352_1
ggacagtaggcgctcaaggagttgcatttggtgcagaagctgggtatgacactgctacaggaaaatttaccaagtacactgctgcaattggtgtaaccaagccagactaccatgctgcattcattctggcggacaaaggtgacaccattaaagtgtcaggtgtttatcactttgatgagaaacagaagccctcagctgtggctgagctaacccggaggctctcaacaaatcagaatacactcacagtcggtggactgtacacagttgatcctcagacatccgtgaaggcaaggctcaacaacactggaacgcttgccgcgcttcttcagcatgagcttaaacccaagtcagtcttgacaatctctggtgaattcgacaccaaggccctggacagaccccccaagtttggcttggcgcttgcactgaagccctgatcagatcatcccagattggtgaattttgaattctttggttgtttctgcaaagctgtagccaataattcgttccacgaaccttttctgttaatctggcaaatgtttggagcactgtggtaaggatccggatgggtcgtctacaggaattttacctgtctgcttttattgttgaaaagcatctggccgttggtagatgtacattgtgcttgtttctttagcacctaggcctctctgccactgtgttactgagtagccgctacggtaatcttttgcatgcaggaattgcatgctaattttgttcggtgtttgatttaccactcactaaggtttaccacgtgttggagctc

SEQ ID NO: 9885 - DNA, 840 bp, Sorghum bicolor
  Clone ID: SORBI-28MAY03-CLUS40377_1
ttccgcccggtggaagtttaaaaaaggtcctgaatatggtaatggtgtttcagctctttctgtacccaaacagtacagttctagcactaagcaatcatctgggaataagttccaaagtatcagcagtgcaagagttgccccatggcttgagactggcgatgcagtggcaaatatgtactcagaatcaagaggagaagctcgtgattttgctagggtccgaaatgcgtgcttcgagcaggctagacaggcttacttggttggcaacaaggctcttgcgaaggaactcagcatgaaggggcaggcatacaatgcgcaaatgaaatcagctcatgagaaagctagagaagctatttaccgacaaaggaatcctgtttcttcccaacgtgggggtgaccgcctgattgatttacatgggttgcatgtgaatgaagcaatccacatcctgaagggtgagctcactgccttgaagagcgcagcgagggcagcaggggagaggatgcaagtcatggtttgcgttggaacgggccaccacaccaagggctctcgcactgcgaggttgcctatagctgtggagcagttcctcctggatgaaggcctccagtacacgcagccacaggcgggtctgctccgagtgatggtgtactaacatcaacaaaaaaaaaaggagaaaagagatgtacgaaaacacaaaaaaagcgtcgttggagcacgcactgtaattccttgtagctgtatattaaaagaggcagcaggagaatagcctgacaacagaatacagtgtaaaattatacatagcttcattcaattcacattccttttccaaaaaaaaaaaaaaaaaaa

SEQ ID NO: 9886 - DNA, 645 bp, Sorghum bicolor
  Clone ID: SORBI-28MAY03-CLUS40415_1
gagccttgagatgtgtgcagagagagcagttgcttatttcaaggaccaaattattcttaaacttgtggctggaaagcatgtaatgattgctgcccatgggaattcacttcgttcgattataatgcatttggacaagttgacttctcaagaggttatcagccttgagttgtctactggcattcctatgctgtatatatttaaggaagggaaatttatcaggcgaggaagtcccgcaggaccttctgaagcaggtgtctatgcttataccaagaatttggctcagtacagacagaagcttgatggcatgtttcagtagtcatctgttaggcttttcgtttgcttctactcatccgtcgaacatacatttggtcccaaaagaaggggtcaagctcctactgttcatcatttggaatctttgagacctacaagtttgtagcagctcatttctctcttcagaatccttccagcacctggtagtaaaatagatgataatttaggcgatgggctatagatacaaatggggatagattttgatgtcagttgtgttatctcttggtgttccccattcgctgagattgaaatatttgtaatggcgacagtagtgaacactaatggtgaacggcatgaaaacgaaatggtgttatc

SEQ ID NO: 9887 - DNA, 797 bp, Sorghum bicolor
  Clone ID: SORBI-28MAY03-CLUS39666_1
gcaccacgcgcccacaatccccgtccccggcatcgccgaacggtcacatcagtcggccacgggcgcacgggcgcggcgtgagccaaaacaaaacccaacccccaccgccgcggggcaagaaggaccaggcggcgggcgagcaggaggggaggaatggcgggcgcggcggggcggaagaagcgcgtgggccgctacgaggtgggccggaccatcggccagggcaccttcgccaaggtcaagttcgccgtcgacgccgacaccggcgcggccgtcgccatgaaggtgctcgacaaggagaccatcttcacccaccgcatgctccaccagatcaaaagggaaatatcaatcatgaagattgttagacatcccaacatagtaaggcttaatgaggtgttggctggaaagacaaagatatacataatcttggaacttgtcactggaggtgaactgtttgataaaatagcccgccatgggaagctacgtgagaatgaagccaggaagtatttccagcagcttattgatgccattgattattgccacagcaaaggagtttatcatagggatttgaagcctgaaaatctgcttcttgactcacgtggaaacttaaaagtttctgattttggacttagcacactgtctcagaatggagtaggcctccttcacacgacatgtggaactccaaattatgttgctcctgaggtgctaggtagcaatggatatgccggatctgcagcagacatttggtcatgtggtgtcattctttatgttttaatggctggttaccttccctttgagga

SEQ ID NO: 9888 - DNA, 938 bp, Sorghum bicolor
  Clone ID: SORBI-28MAY03-CLUS3968_1
ccggtcgacccaggcgtccggcgagacagaccaggaactgacgcatttgaatcggaggccaccgctgcgctccgagggccctcctcgctcgccacccgctcacggagacagggagaggtcgatggcgagctcgctggcccgcctgggagcggcgctgccacgcgcgcgcccgtgcgccacggcccgcgccctgccaccggggcggtgggacgccgcggcgctcggcgcctcccgccgcgccgcgctgaacgcttgcaggtgccaagttcattccgacgttaaagtagcccctgcatcggatctgaaggatggtagcaaatctgaaacttggaggatcaagatgctctacgacggtgattgccctctctgtatgcgtgaggtaaacatgctgagagaaagaaacaaatcctatggagcaataaagtttgttgacataagctcgaaagattactctccagacaacaatcaaggccttgattatgaaactgccatggggaggatacatgccattctttcagatggaactgttgtcacagatgttgaggcatttagaaaactgtacgaggaagtaggacttggatgggtctatgctgttactaaatatgagcctgtagctaccatggcaaatgcagtatatggtgtgtgggcgaaataccgtatgcaaattacaggtcgacctccactagaagagattatggcatcccgaagagctgcaggcgaatgtaaagatgacaaagtatgcaagatgtgagcataaaaaatggagctgttcgctgcagctaaaaagcagccgccaccgccgccgctgtactacatacctcacctctaggctcatatgcatagttttaacactaaaataatcgctatggtattaaaaagaaaggtgaatagcttatttaatgatttatcgaagtaaatatatacatttgtatgtacac

SEQ ID NO: 9889 - DNA, 657 bp, Sorghum bicolor
  Clone ID: SORBI-28MAY03-CLUS39715_1
gcacgagggccacgcacgcccccgctgtctccctcccgccgtcccgccctccctccgccgccgccaccgccggagtctctggccaccgtcactctctcccgccttcaccgtgcctaactcccctctttgcctcccgctcgcgcttcagccgctccactccccatcgctttcgtctggccagatccaggtatcctttgaccgagaccgcgcctgccgtacccctccggtcggattcttcgccgtcttcgtccccactgggcgccgctggggtggagcggagatcggatccgccaggggctgaggagctgattccatctctcgcagtctagtttgatgcggattcatttgctgaccggcatagcatgatcctgcggtgatttgcggatagcttgtttaagctggtggcgtgggagttctctttttaacctggtctaaagaaaccctgagacagtatcgcgacatggatgcgagtgcggaggttactgatgctattggcgcaatgggcattgacaatgggaccaaggggaagttgccgcccagtgataatgtagagggccacgcagaagaacatgacgggctggccgatggagcgcattcgggcgagagcgaggtgatcaacccatctgaagaagtggaaatggaagccacctcgcaatc

SEQ ID NO: 9890 - DNA, 748 bp, Sorghum bicolor
  Clone ID: SORBI-28MAY03-CLUS3964_1
gaggccccctatctccagtctccagcgccattagtccatccaccagaaccgaggacgcagccagcacgccgcacgcctcgggcaaccgccacggacgcacgccaagcgccgctgctgcacgcggacgcccgccgccgacagcccccgccgccgccgcatacggaccccgcgggcagccgccgccacgcactgggcactactccgtcgatgtcactaactcctacgccgtgcgtgggcttggtctacctcggattctgatttggtcgtcgtgtcactggaggagctagaggagatgaacggcgccgggggcagccaccaacagcagcaggtgctcctaatgcagcaagcactgcagcaacggtacccgtgccccccctcaccaccacggcagtggcggacatgagccagatgaagatttcagtttcattagttcatcaagagcatagtagtagccttgcttgtatactctcaagccagtcccactcacaaaaggggatatatcttagtagcgcacaatctggagctgctgcattagttcttaggtacctcctctctctcaagtgagtgtagctcgtctgctcctttacgtgcatagcgctcaccggatcgaccgggggacatgcggcgctcgcgttggcttccatccgcgccgtgtttctcgccaattccattgtggctcagcgctccctctccccgccgcgtaactctgaaatgcatagttaattaaaatattaagtcttcatgcatg

SEQ ID NO: 9891 - DNA, 617 bp, Sorghum bicolor
  unsure (1)..(617): unsure at all n locations
  Clone ID: LIB3481-032-P1-K1-D11
cgtccgcctggatggttccagcctattgtagaatatattgcgaaattcaaagagctctccttcccattcgcttctgcaactcaagcatatattgatttgcgttatggtctcctgctgcagctgctgaattaattcttagggctcactgacctacacacaactgcatatttggtgctgccatcttgccccacactttaacaaggccatcctagaacgtatgtgccttttgatggctatctcaagagccaagaatcatgtgtggactggtacctgagcaaattttttcacaatcacatatctgttgagcacggctgcacaagcaccatagtacacatcgtatagatgatggaaaggggaaaatacagtgtttgcatttgtttcagaattgttctatcagccagctgagaggatctttcacattaatctggagaatgaccaagaggaacacgtgagagaccagctgaacaaaggagttgtacctgaggacattagtgttcactgctacatnncgcttccgtatatgtacttggngtacaggagaataaaggaggcttaatctggctggtccggtctggtcttttgagaatgacatcagtttcatgtggaggaatccattc

SEQ ID NO: 9892 - DNA, 667 bp, Sorghum bicolor
  Clone ID: SORBI-28MAY03-CLUS39744_1
atccgtgctcacagtctctcctcgggcccgccgcgtccgcccggcgatggcgaagcccccgtcgtccgcggcggcggccgccgccggaggccgcggcccggttcacaaccggacccggctcctcctcgtcctcctcgtggccgtcgccgcctccgcatccacagcggggttcctcctccgcggtgccctgcgagacccctgcgacggccgtggagaccccgccgccctcaacaccgccgtcgccgcggggagtcccctcgggttcatgaggtccaaactcgtgctcctcgtctcccacgagctctccctttcgggtggcccacttttactgatggaattggcatttcttctgaggcatgttggttcggaagtggtgtggataacaaaccagagatcagaagaaacaaatgatgtcacatatagcttggagcataggatgttgagccatggagtgcaggttttaccagctaggggacaggaggcagttgatattgctctaaaagctgatctggttatcttaaacactgctgttgctggcaagtggcttgatcctgttctgaaagatcatgttcctaaagtccttccgaagattttgtggtggatccatgaaatgcgagggcattactttaaggttgaatatgtcaaacatcttccctttgttgctgga

SEQ ID NO: 9893 - DNA, 1094 bp, Sorghum bicolor
  Clone ID: SORBI-28MAY03-CLUS39770_1
gcacgaggcctcaagagcgtcctctccggcgtcgtcgtcaaggaggagacgggggagggaaagaaggatgcagcgaaagcgacggggaaaggggacgctgcgtcggatggtgggcccacgggggctccccgcccagacaaaaagttgctactcttcatcctcgataggctccagaagaaggatacttacggagttttctcggagcctgtcgacgcagaggagcttccggattactttgacatcattgagcaaccgatggacttctcaacaatccgtgagaagctgttgaatgactcgtattctaagttggaacagtttgaggatgatgtgtttctactcacatcaaatgccatgtcttacaattcagcagactcaatctacttccggcaggcacgatctattgaagctcttgccaaaaaggattttgagaacttgaggcaacccagcgatgaagaagaagaacccaagccaccagctcgaagaggtaggccaccgaagaatcccaggacagagggtgatgtgtcaccagatctatccaatgtgaaaacaaacaaaactgaagacaatgttgatacattcagaaaaaggtcaactggagacagaactcgaaatacaaataccccgatgaaagatccgtccagttttcacaatatgcttggttcttctagtgcaaaaagagcagacaaaatcggtgattattcaggttcatccaagtggggaaagaaacctgttgttaccctagatgacgaccgcaggagtacatatgatcagcactattcacgtaatagctctatgtttgctgccctggatgatgaaaggaaactactggggccggtaggggttcagcagcaacatgcatatgctaggagcttggcacgatttgcatcaaaattgggcccagttggctgggatgtggcaacaaatcgtatcagaagggcactcccccctgggacaagttttggcccaggatgggtagtagatggtgaaccacctcaaaactctcagtgggctcctgtcgcatccaccaatccctctgagtgcactgctccacccaatatgccatctaagaatgatgttctacatcacaagtctgg

SEQ ID NO: 9894 - DNA, 660 bp, Sorghum bicolor
  Clone ID: SORBI-28MAY03-CLUS40784_1
gaatccccgagatcgcccggtgtggtcgtctcttttgaccccaagccaattccgggagactggaacggcgctggtgctcacaccaactacagcaccaagtcgatgaggagcgacggcgggtacgaggtgatcaagaaggcgatcagcaagctgggcctccgtcaccgggagcacatcgcggcgtacggggacggcaacgagcgccgcctcaccggccgccacgagaccgccgacatcaacaccttcatctggggcgtcgccaaccgcggggcgtcggtgcgggtgggccgcgacaccgagaaggaaggcaaaggatacttcgaggacaggaggccggcgtccaacatggacccctacgtggtgacctcgctgatcgcggagacgaccatcctgtgggagcccagccactccaacggcaagggcgccgcggctccttgattctccggcgaagactgactggcctctgtgtgtgagccgggctgcgtaggtggcaaatgagactgacgctgtcagaaacttgagatgatgacaataataatagctgatgtgtgctggttctagtgttggataacgagccaagaacactttttttgggagttttctctgaaactggtataattttattttaaaagaaaatcaagttcaatcgcagcatttttt

SEQ ID NO: 9895 - DNA, 697 bp, Sorghum bicolor
  Clone ID: SORBI-28MAY03-CLUS40814_1
cactccgttgggggcttcagttacggtgttctggccccgtcctcgtattgtcttcgggccgctacggtgttgcgcatccctgtaagaaacacacacgtttatgcatttgctgaacatgggactgaccttgggagttccaaggatgtgaaaggaaaccctacagagtttttcaggcgtgttggtcatggatcttcatatggtgttggtgtcaagcttgggttggtaaggggagagtacattgtagatcacaatgctggtaccggaaccattttcttcagatttggtgagagattttgagtacgcttcattccgccactgtggaacacagacttttgaggcactctgtttagcgatgcttgtggactgtgataggactcaaacggcattggagctctgctgaaataatgaagctattttctgaggaagagtgatagctagtgtgagattaacttttctttatgtaggatgtaagatctgttctttcagagcttggagctcataaatagatgaatgttcagaaatattggcccaatttttaccgtcaagcgtgttgctggggctgcgggctagctagtgtgagattaacttttctttatgtaggatgtaagatctgttctttccgagcttggagctcataaatagatgaatgttcagaaatattggcccaatttttaccgtcaattgtgtgtttgtgctc

SEQ ID NO: 9896 - DNA, 811 bp, Sorghum bicolor
  unsure (1)..(811): unsure at all n locations
  Clone ID: SORBI-28MAY03-CLUS4086_1
cgtccggctcgccgagctcgcgctcctcgaccccaagcgcgccaagaggatcctngcnaaccggcagtccgcggcgaggtccaaggagaggaagatcaagtacaccagtgagctggagaggaaggtgcagacgctgcagacagaggccaccacgctttcggcacagctcacgcttcttcagagggacacctcaggtttaaccaccgagaacagggagctgaaactccggttgcaggccatggaagaacaagcgaaactccgagatgctctaaatgacgccctgagagaagaagtccagcggctcaaaatagctgtagggcaggttcctaacatgaacggaaatcccttcaatggaggactaccacagcagcagcagatgccaagctatttctcacaacaacagcagatgcaatacttcggcagccaccagggccagcatcacaatccaaaccatcacccccagaactcttcaaacggtggtggccagtccttgagtgactccatggatttcatgtgaggaccgaggagacagctcaggagttgcctgagatcacaatcacataccaacttcaactaaagtactgtaaaggtagctgatgtataccatattcagtaatgatatgaatcattgtagcttagctagctgttccttgtaccattaatcagaaattcattcatgcatgacaacctatcggcgcttttgttctggggttaaagtaaaattggcttgactggttgacgaggtggtgtcgttgttggcctgtaaagtttttcctgtaatagtaacggaatggtttccggttgaaagttg

SEQ ID NO: 9897 - DNA, 830 bp, Sorghum bicolor
  unsure (1)..(830): unsure at all n locations
  Clone ID: SORBI-28MAY03-CLUS40884_1
tcaaatcaggaacatggtgatggcattggggggaccattccagcaactataggatctgggggtctggatgcacctccagaaagtccccttccccaacctgaggtggtggtggcaacaacaggaatcacacagcctaacaaggacatggaggatgtgttgcctccagcaattgaagatggtgcactacaagcaacccttgaacatgctgttggcatactggaagttacacctgatgatggcttggaggatgttgcaccttctgctgttggagaatcaggtgatgacatggaaattatgccccctgctattgcagaacctcgagtaggcaaggatcctgatcctattgctagccctcctgacagtcaagagaagccctccatcatgcaagatactgagacaggtatggaggttgaggttgataaggttatcgatgatagtcctggggtcggtagggtgggctctattctcggcaccaaacttgatgttgctgcaactgatggggattctgaagctttgttggtggaaagtagggtaaatttaagtcggataccgaattccccagaaagtacacattgaactccttttattccattttaattcctttttgtctgagggtcttgtgccctcagcctagcttttttgagctgccatattttgtttatatctgggcgttctttttatagtgtaatgttcgcagtgagataggtatgcttatggggaacttggacgtacccgtggaatgcaggacctgctgcaatggcacgcctctcaangttgtcncgtgcctatcccagctgcgtttcttgttttttctgcttgggccgcactag

SEQ ID NO: 9898 - DNA, 665 bp, Sorghum bicolor
  Clone ID: SORBI-28MAY03-CLUS40914_1
gcacgagggcggcggcgccctcgggcgccgggtcgggagaggaaggcggtgcgcggcgcaaaaccccagctcctcttcgtcgtcaagtgctctccggcctcgccgaccttggggtcgcgatgagggtgaaggtgatttcgcgctccaccgacgactacacgcgcgagcgcagccaggacctgcagaaagtgttccgcaactatgatccagcgctccgtagtcaagagaaagctgttgagtatactcgagcactcaatgctgccaagttagagaagatatttgctaagccatttatcggagctatggatgggcatattgatgcggtatcatgcatggcgaaaaaccccaatcatttaaaagcaatattttctggttcaatggatggagatgttcgcctttgggacattgctgcgaggaaaacagtttgtcagttccccggacaccacggtgctgtaagaggtttaacaacatccacggatggtgattttcttgtatcatgtggcgttgactgcactgttcggctctggaaagatccgatgcttaaaatggtggacaatagcgaccctgcccggctctggaaactgccgtcgcctgtcttcgccggcacccgcgccctctggggtgctgacccccagccatcagcagtctacacctggaagcatgca

SEQ ID NO: 9899 - DNA, 870 bp, Sorghum bicolor
  Clone ID: SORBI-28MAY03-CLUS3989_1
cgtccgcccacgcgtccggcggattagcgaggaggcagggagggaagaacacctcaccgctgcactgctccttcgcggcgctgcttctctccctctcccggctcccctcctcccccgcgccgcgatgaacacggccatggccaccacttccttatccctccaaggccgcccttcccatgcccccaccaggaagctctcctccccgtttctcggcgcccccgcgtccttcctccggccgctggcgcccgcgcccgccgccgccccctcctcgcggcggactctcgccgtcagggccatggcgccgcccaagccgggaggcaaggccaagaaagtggtgggccttataaagctggccctcgaggccggcaaggcgacgccggcgccgcccgtcggcccggcgctcggtgccaagggtgtcaacatcatggcgttctgcaaggagtacaatgccaagacggccgacaagcccggctacatcatccccgtcgagatcaccgtgtttgatgataagagctttaccttcgtcttgaagacccctccggcttcggtcctgctactcaaggctgcaggtgtcgaaaaaggttcgaaagagccacaacgagcgaaggtgggaaaagtaacggcggatcaagtgcgtgcaatagctcaagagaagttgccagacttgaactgcaagagcatcgactctgctatgaggatcatcgctggcaccgccgctaacatgggcatcgatatcgatcctccaatccttgtgaagaaggaaaaggtcctcttgtagtttgttttgctggcacacgcagatcatcccaccaatggccatttgtagattatgctttccttttttgctcgtcaattcgctgtgcctacttg

SEQ ID NO: 9900 - DNA, 731 bp, Sorghum bicolor
  Clone ID: SORBI-28MAY03-CLUS40034_1
gcaggcgattcctgcgcaggctctggaggctggcctcttgctgccgagaaagagtttaaatttcaaggcaacaccaatgcccagcttttacaaggaaccacctccccccaaggttgagttgaagaagatccctacaacaagagctaccccaccttggcttgatcgcgccccctacacctcctccgggggcaccgaagcttggtcgctccctccaccccgccccaggagggacagaaggaaattcaaatcctccagctcattcagctcgactgagtctcgatgaaagggtctcccaaaatggtgtcaagaaagcacctgctgcaaatgcagtgaagaagccccaacggaaatctctccctaaactgccttcagagcaagcaaccaaagttgacattgcagcatctgtttcatctgcagaagagctagaaaacaagtcatcgtcgacgtgtcttgttcgagaggcgatccgcgctcaagttacacctgatgaacctggactcagtgcgtaggaacctatcaagccgactccaatggaaggagagagttgtgcctcagcttcctttatcacattttgctatttctgtagtaaactgctggctggtattatatgtactaaaatcagtctcatcaccaggagtttgaagaatggcaagtgacccagtgtcccagtgtattgtttatcttagtttctgttgacatatgaggtatttgtagtggccaaaatttctttt

SEQ ID NO: 9901 - DNA, 616 bp, Sorghum bicolor
  Clone ID: SORBI-28MAY03-CLUS39969_1
cgccgatgtcaaggctaccacctccgatggtctcggacctcacgctgctctcctcgtcgctaccaacgagaagcccttccaacaggctactcagtacatccgctctcgcggtactgtcgtctgcattggtctccccgccaatgctcagttctctgctcccgtcttcgacacagttgttcgcatgatctccatcaagggatcttacgtcggcaaccgtgctgataccgctgaggccattgacttcttccgccgcggtctcatcaaggtccccttcaagactgtcggtctctctgagctcaacgaggtctacaagctcatgaaggctggccaaattgtcggtcgctacgtcgtcgacaccagccgataagcgcgcggctgtcgcttgggcagtgcgcgaaaaaggaaaagcacgccccccaaaagataaacagggctgcccatcgcgcaaaggggtttaccctccaaagaggagttcaggcgggagttgatttgggttttctggcgggtgttgtcgaagtagccagatggatgatcttggttacactctgtgtatagccctagtttatgagttttatgatatctcctagcatcaaataacagaacgaacatttcgttc

SEQ ID NO: 9902 - DNA, 1052 bp, Sorghum bicolor
  Clone ID: SORBI-28MAY03-CLUS40077_1
atccaaagacttcaactggtggtactccctgggtttattactcgacatatgcttttcttgtcttcgtcttcaatatttttgatattgctaacttacccaaagagatatctgattacctgaataagatgagtgcgagggtaccaaggataaagcctggaagagcaacagtagactaccttacaaagatacaaacatcaacgcgtttttggggaggtctactgctaagcttgcttgcaacttcctctttattgcttgaccgatatctcaggcaaataaatgaagggttttcaatacgggcccctccagcctggctttctgggggtgcatctcacgccctcgcgtcacctcgtcccttgatattttgttgttcttctcccgccattagggcactcacagatgcagactctatcatggagtctaaagttatttattacctcgaacaatgtggacttggagtctaaataagacttggagtcttattttttctacctctttcttcaataaatatgctgccacatcagcaaaataccataaataatatgtaattaattgtcttggactctgtgatagagtcttgcattgggagtgccctaagcagaaactgttatggtggatgtggctgccttcgttgaccttgtgatcgcttcttttagcagtggtctaatggtccacgggttgctggcaccctcagtgagtctcactgtagggcatcctatcgctacctgtgcagcaactcttgtctctcgttcctgcgggggcctgcacagtgtcagaaaacgggaccgtcccgtggcgatgagcacctggtgcggccctgtgccggccggtcctccgcgaagctggggatggggggctgcctggtctcgggccccgccccggttgcgatccccggcggcgcgctcccgtgcggcatgacgttggcccctcctcccctcttccggtagctccccgctgtgttcgtcctttccccgtggtctatataattcatcacgtgatgggatcaccaaatgatttgtggttcccgtcggcgtctttctttcatgaatatcatt

SEQ ID NO: 9903 - DNA, 696 bp, Sorghum bicolor
  Clone ID: SORBI-28MAY03-CLUS40086_1
acaccagcacagaacggagatgttggaaaggcaactgtcaaccctgtgcaaggtgcaggtcatgatccaaagatcgcgaatgacaataattctgctcacccaagcttaaattctggtgtccagccatcaggttccccacctaggggaaagctggcaaatccaaagcaccccgatctggctttgcagctatgagtgcagcagtagccattgacatagtttgccttagtactgtgatctgtgacagaggcatatgagttcaacattgcttccccgggcctaattctcaagctcccggtatgctgagcggagcatgagattgattgaagaggtaacaaatgattggtttctcgtcggagagagaatagcacaaagttgcagcagaggtggctgcaggaggaggcgcaacatcatctaggtcctccatttaatcatttgacccccagtgagttgttgtaaaagggtagggtagcttctgtacaggttctaatcttattggagatgataatgtttcggatgaggcggcgcctgttgtccaatttgtaacattatagtagaggagggaagtatacaggcgaaaaggcagtgaataattgtgccttttttgccccctgagaggacgcactccgtttcgaaatgtacaagtggccgattggcgatagggtttccggttgagcgacctcggtcaaagcttgcttg

SEQ ID NO: 9904 - DNA, 1257 bp, Sorghum bicolor
  Clone ID: SORBI-28MAY03-CLUS4017_1
cccacgcgtccgggcagaaaaggctaaagtcacaaaaaagcagaaagtagttacaaaggagaagaaattctcaaccccagaggctaaaaaggatgcaaaacaagattcggatagacgtactgaagaaaagggtggcaactcagcagaagaggataattcccattcatccgctgaggaagataacaagagaaaacggcaacagactccagcttatgggaaacaagtagagcatctgaaatcgataatcaagtcctgtggaatgacaattccacctaatgtgtatcggagagtcaagcaagctcctgagaacaaacgtgaggcctgtttgataaaggagttacaggatatacttgaaaaggaaggattatcaaaaaatccttctgaaaaagaaattaaatcagtgaagaagagaaaagaaagagcaaaggaacttgagggcatagacatgagtaatattattactagttctcgtcggagaagtacatcaagtttcatacccctgccgccaccacctaaaatagaagtggatagtgatgatgaagaagaagatgatgatgcagaagatgatgatgaagtagatgaggagaatgtaaaaggtggagatgaagacaccgatgaagttgatgaggagaatgtaaaaggtggagatcaagacaatgatgaagttgatgaggagaatgtaaaaggtggagatgaagacaataatgacactgccgaagctggtgatggttctgctgatgctgctgaaaaggagagcgactgattctggccccagataaggcagaatcagttctgaccatatataggttcagcttcatgttgacttcctcgttcgtggatggtctggatgtagccagttgctccatctgatgtttattcatgtgtgcgtgatgggaacatttgttggcttcagctttggtgaaacatgaggaacatattgttcttgtagttatgtacaatgtcacattcgttctcgtagcaccttgttcgcgatcgtgtagattgcaagagttgcagaacatataagttagcagtaatcaagtactgattggtttattagtttctggtataatatagactttggtagatgaaggattggaattcctctgggctcatgtttttgctttgtttttcttaggtagtgtttagttccgaggaatctggggcttttgatgttctgaattctgattggcattgtgccgttgtggcgttcaaaagttgtactgtaggctgtagctactgtgaaatccaccagaa

SEQ ID NO: 9905 - DNA, 948 bp, Sorghum bicolor
  Clone ID: SORBI-28MAY03-CLUS41229_1
gcacgagggcggaagccgcgaggcttggccagccaatgagcatggtcttgccaggtgttgttggctttaagttatcaggcaagctgaagaatggagttacagccacagacttggttctaacagtaactcaaatgcttcggaaacatggtgttgttgggaaatttgttgagttttatgggcaaggcatgagtgaattgtcacttgctgatcgggcgaccattgcaaatatgtctccagaatatggtgcaactatgggtttcttcccagttgatgcaaagacactggactatttgaagcttactggccgaagtgatgatacagtggccatggttgagtcctacctgcgcgcaaataagatgtttgttgatcacagccaggttgaagctgaaagagtatattcttcctatctagaacttaacctggaagaggtagaaccatgtctatcgggaccaaaacggcctcatgatcgagtgacattgaagaatatgaagtctgattggctttcttgcttggacagcgatgtgggattcaagggttttgctgtccccaaagaatcacagggcaaagttgcagaattttcgttccatggaactcctgcaaagataaaacatggtgatgttgtaattgcagcaataaccagttgcacaaacacatcaaatcctaatgtaatgctgggagctgctttggttgccaagaacgcttgtgagttacgcctggaggtaaagccatggattaagacgagtcttgcacctggttcccgtgttgtgaagaagtacttggataagagtggtttgcagaaatatctccaccagcttggcttccatattgttggctatggttgcacaacctgcattggaaattctggacagcttgatgaatccgtgtctgctgcaattactgagaatgatgttgctgctgctgctgtattgtccggaaacatgaattttg

SEQ ID NO: 9906 - DNA, 499 bp, Sorghum bicolor
  unsure (1)..(499): unsure at all n locations
  Clone ID: SORBI-28MAY03-CLUS41510_1
ngccgcccccaccatcgccaacctcgccgcgcgcaacccgcccgtggccgccagctagccagtacccgtggcggccactccactcgtcgacaagcttgctcgggcagcgaggactcttcagtgcggctgcaccgatcagctagctgtaggccgtacccgtacctgtacgtaggctacctaggcatggatgagtgtgttgcagccaggaaccgtcgtcgcgggatgagtagggtgattcttttctgccgccatggatgagttgcagactgcttgcagcaggacgccattaccgccggcagcagcagttagctagctagcaagagctacgacggagcacgcaacggactgacgatggacggcacgcaactggacgctacgtagaaacgaataacgaagctttgtggtgacttagctacctacatgtacaaaatcagtagtagtaaattaaaagattaattatatattattaccatgtgttcttgagctaaatttctgcttc

SEQ ID NO: 9907 - DNA, 621 bp, Sorghum bicolor
  Clone ID: SORBI-28MAY03-CLUS41366_1
gcacgtggactcgctgggttgtgctacctgacccttatagttcagatatagctggagtcagtgatgcttcatgttagagcttgggttttgttaattttgaacaaaaatgcacattagaatattcctcctttatttattggttggattactaaatttaaactttattgcctgttgttgcgtgctttggccttttttggggcatgtgcatctgctggctgctcgggtgtgctggcctgttgggggcgattttcgtcaccgccctcacctagtttcaactttggtgcctctcctgcagcgggaccaggccccgatggtgtacatggcaatggtgcaggcagatgcaggaatccatgcccataagtgggatcttatcaaatgaagagcaaaatgatattcttaatttgaaatgagaagaactgacatatcatgctacaaacataacaagaagggaagatcctcttgtattgtcactctaggtttatgagtgcaggcatttaaaaattgtatggaaccatcaatgcactagcataagttgatgttgcacactagctagctgcagagaaacttgcctcaacttttgctaggttaactagctcttttctctgattgtgccttggcctc

SEQ ID NO: 9908 - DNA, 535 bp, Sorghum bicolor
  Clone ID: SORBI-28MAY03-CLUS41533_1
gaagccttttattcagaaaataaggagcatagtagacactgacacaagatatggacttattctttcaccctacacactgctacaattattgtctgagcacaactgagtacaaagcttgggtcaaaaacacgggaagcatgattcagctaacttgtcacgcatcgccatggaaccgcaaggtgccattagattgatcggtcaagtgcatgctgcagagaacaggcttggtggctaagctttccaggccaaggttttattgccacgatatagagatgaagccatgaaaattaccttagtgaaaaccatatccaataaagggatgatgctgcggtgtacataatcgcggccaatgtgccatataggtataattcatttttcccttattacattttctctctctttttttgtaactgtaccaattgtttttgtatcatgtatgtaaattggttggactctatatattggtcatcccagactacaacctagtgaaatcaatataattattatttggagatgcaatgataataatttttgt

SEQ ID NO: 9909 - DNA, 747 bp, Sorghum bicolor
  Clone ID: SORBI-28MAY03-CLUS4157_1
cgtccggctggagccattccacaagctcacatgggaacaagttggtcttgttgtcggaaaaggtttgatagacaatgttctgagtgactacttgtgggcgaaagcgatccttctcacgacaactacggtcgctacagctggcctcacaatccaagttccgattgctgccattgtggacacgctcaccggtcatgctcctcatctactggactatatcggagctgctgctgtcctagtcggttttgctgggatcaacataccagttggagagtctccgcaggttgttcagcaagagcaggaaactccgattgttagcatggttgatgacccggttcatttgcccagcagtaccaatgctactgatgtcgtctcatagttgcttgagaccgtgcgatttatcaacactgtatagaggtggggttggccagatgagtagtttctttgtttttccttaagctgtgccatcaggacaagagatgaacatggactgaagttagagtagccttcttagtttgttcagaactttgagtaacaagtgttttgggatcagtattttattttatcttgtaattatttacatctatacaaccagtttcatacagaagagtaaatgctgtttgtgattcatggaaggtgttgcgtttctagaagggtataagtagctgaaaattgtattatgtatatggtgaaacgcagacaatggtaactgagcctatatgtaatgagccaatgaggtgttttaagccc

SEQ ID NO: 9910 - DNA, 749 bp, Sorghum bicolor
  unsure (1)..(749): unsure at all n locations
  Clone ID: SORBI-28MAY03-CLUS40476_1
tcgcctccctctgcgcgccgccacgcaccagcccagccatggcgttcgccgcaaggaggagcatcgccacccggctctctcaccacctcacccgccgcgtccatccctgcgtcccgcacgcgcttacctcccactcccacgacgagcaagcgagcccctcgccgccgctcccaccacttcacgccccgctccagcaacgttctcgagcggcccaaaccctaggcttcctccctttctcgctccacctcgcgggatcaacccgccgcagcttctcgtcctcgtcctcagcccccgcccccaacctcgaggacgcaccagccgccgaggtcgatgccgcgggcgtccttgcagatgcagcggaggcggcggcgtcagtgccggcgccgttcccgggagaggtagccgccgcggctgccgactcgttccccccggttgccgcacttcagcacattatcgacgccatccatacctttaccgggctcaactggtgggcgtgcatcgcactgacaacgcttattatccggagcgccacgatcccgttgcttgtgaaccagttgaaggccacgacgaagctnagagcaataaatccagagatggaagccattaaagaccagatgaatagtatggatccaaaatcagcgcaggagggaacaagctaaaatgaaagcgctgttaaaaaacatggtgttagtccttttactcaatgaaaggactcctgatccaagggccaatgttcatgagcttttact

SEQ ID NO: 9911 - DNA, 887 bp, Sorghum bicolor
  Clone ID: SORBI-28MAY03-CLUS40598_1
tgaaaaaaaccatgacatggctgcatatattggaggtatctttccgaacactgagggttcgggaccaggctttgagcagaataaagagcaacattgaactcatggtagcaacaaatggtggaaatagggtggtagtgatcccgcactccatgggggtcctctattttctgcattttatgaaatgggttgaagcacctcctcccatgggaggcggcggcggtccaaactggtgtgagaagcatattaaagctgtaatgaatattggtggacctttcttaggagttcccaaggcagttgctgggcttttctcatctgaagccaaagatgttgccgttgctagagctattgctcctgatgttctggactccgattttcttgggctccaaactttgcgccatttgatgcgtatgacccgaacatgggattcgacaatgtcaatgattcctaaaggtggtgatacaatttggggaaatctggattggtctccagaagatggccttgaatgtaaagctaagaagcacaaaaccaatgataccgaggtttctaaggatagcaatggggaaaatgtcgaagttcaacctgagcctattaactatggaaggctggtatcctttggtaaagatgtagcggaagcaccttcttcagagattgagcagatagaatttcgtgatgctgttaaaggtaatagtattgcccattcaaatacttcatgccgggagatctggacagaatatcatgaattaggatggggtggaataaaggcagttgaggactacaaagtttacactgctagttctgttatagacctccttcacttcgttgctccaaggatgatgcagcgtggaaatgtccacttctcatatggaattgctgataacttggatgat

SEQ ID NO: 9912 - DNA, 585 bp, Sorghum bicolor
  Clone ID: SORBI-28MAY03-CLUS40700_1
catagactccagcgggagcagccataatattgaattggacagctttgaaccaccaaaagcagatctgctgatgccattctctgcaaagcttgtggatggtatcaaccgaaatgactcgaggaggagggcactgatgattttctgttttgagtactttaatgtgatagcgagaaacgctgtcatgctttccattgaccaccacggttttgatgtcctcgccaaagtgcctgaaagaaccatccttactgatgttcctcgacaataccactggaaggagttcaggttcacattcaaggaaccagccaaggatgctgaggacttttgccgcatgttggttgggttagaggacgaggttttgaagagcttgaagagctatagcggtttagggtgacagcccacttggcagaatctgaatctgtgaagaattatatctgacattcagattctggtactcatatttgaagtatggtttcatgttgctgtgttattggacaatatggtttcttgaagtttgtaaaaattgttgacagtgaaaccctggattgcaaacccaaaaattatatatttagatttttccagccaccc

SEQ ID NO: 9913 - DNA, 702 bp, Sorghum bicolor
  Clone ID: SORBI-28MAY03-CLUS40655_1
tttgttttaggggaggttgttcacatattcaggccacttgtatatgtacttctgatcagaaagtttggaatcaaatcatggaccccatggttagtgtcactagctgtggaactcacaagtctaggcatccattcccatgcgaccgatctgaatcacagattagggaaagtgcatcatctaagttctgctgagagggatgagttgaaaaggcgaaagatgatgtgggccctttatttgatgagagaccctttctttgccagttacaccaaacgtcatctccaaaaggctgaacaggtcctgaatccggtgccattgattggcttccttacagggaaacttatagagctgctggagggggttcagacaagatatacatacacatcaggttcatagagatggcaagtccaagcttgctgcttgcatctcgatttgcccgggaggacctgtactttgtgcgagttggttgatgggttctgtttgaatggctgagaacttgtgcccaaacctgaaacatgtactgccgtttctttgccaaatgtggcatccttgtcttgtggatgcgaagctgcagccacttcgtgtatcacggcagatgagggatttcagaatctaagtatatagtaaatactggtttaacgctaagaattgacatatttaccatttatcatgaatgacttattaccttgtggaaaaataatatgt

SEQ ID NO: 9914 - DNA, 767 bp, Sorghum bicolor
  Clone ID: SORBI-28MAY03-CLUS40783_1
aaatattccgacacatagcaggaacaacttctgcccagttacaccagataatagagaagcagttcgaaatgggaagccaaactcagctggtagtaactcgtatcaaactccatcaagccaaaggtgccgcacaactaatactagagctgttactgctgaaagcttgaagaaagagcagactggagcagctaaaagaatgtttgcacatgcactggggctgtctgcagctcgaggaagttgtggtgcactgcccaaaccgaagtaaagatctggagttgagaatgcggataagtggagaaggttgccagttgcctatggaagctcccactgagcttcctgtcctgtcatatgtatgccgtgggatgagcctgcaacagttggtgctcttttgtgccatctacttctgtgaaatggtttttgctatgtggtagcagatgaaaggggttattggttggaatgttaattgttggacccagagaggatatgtgggttcgaaaggcaagcccagttggggaaagagcttgctggatacgcatggtatgacaagccaagtggaagtgcttcaccagagtggaatgaaagaaaaatgatcctcgatgctcgtattgtactttggttatatcgctctaggttgctgcaatatgtttactctaggatgttatccaatgctgttatttttttcccctttgactatacctatgtaagaatgacttgctggatttgtggtgtcgtcttgatttaatttgcaccctcaagttaaatgttgt

SEQ ID NO: 9915 - DNA, 1250 bp, Sorghum bicolor
  Clone ID: SORBI-28MAY03-CLUS41968_1
gaaacccaaaaccccagcctcgccagcagcctgcatcactcgtttccattgaaaatcgttttttctccttggaaatctgctggcgaatcccaggatccgaatcccccatcctttactagttgctcgttttgaatttccggatcagattgcaactgcttatataagcgcaccacccagagttcgctctcgcccgaccgccaaccaaatcgggattatatatataaatcaaacggtgcacggtggggagcgtgaagccagcggcaatggaatccctagccgccacctccgtgttctcgccctcccgcgccgccgtcccggcggggggggcccgggttagggcggggacggtggtatcaaccaggcggaggagcagcagcaggagcggagccatcggggtgaagtgctctaccgtggcgccgcaggcgagctcagcggttagcaggagcgcggtggcggcgaaggcggcggaggaggacaagaggcggttcttcgaggcggcggcgcgggggagcgggaaggggaacctggtgcccatgtgggagtgcatcgtgtcggaccatctcacccccgtgctcgcctaccgctgcctcgtccccgaggacaacgtcgacgcccccagcttcctcttcgagtccgtcgagcaggggcctcagggcaccaccaacgtcggccgcctcccctgggcccgggcccacccgctgctcccgtatcgattcttatcctcgttaagaatgcgggactgagcgcgtggccttcctcggccgctacagcatggtaggagcccacccggtgatggagatagtggccaaagagcacaaggttacgatcatggaccacgagaagggccatgtgacggagcaggtagtggacgacccgatgcaggtccccaggaacatgatggagggatggcacccacagcagatcgacgagctccctgaatccttctccggtggatgggttgggttcttttcctatgatacggttcggtatgttgagaagaagaagctaccgttctctggtgctcctcaggacgataggaaccttcctgatgtgcacttggggctctatgatgatgttctagtcttcgacaatgttgagaagaaagtatatgttatccattgggtcaatgtggaccggcatgcatctgttgaggaagcataccaagatggcaggtcccggctgaacctgttgctatctaaagtgcacaattccaatgtccccacactctctcctggatttgtgaagctgca

SEQ ID NO: 9916 - DNA, 1254 bp, Sorghum bicolor
  unsure (1)..(1254): unsure at all n locations
  Clone ID: SORBI-28MAY03-CLUS4195_1
cgtccgcaacaacaacctcagcgacgaggagagccggcagctggacaagcggtcgcggcagatccagtcggagatccgcacggtgggccacatgcgccaggcggacctgctgccgctggcggcgcacgtgccgcgcccggactgccactaggccgggcacgggtacatgaagaacggcagcctgcaccacgcgctgaaagccggcaacagtgccgtcgaggtcgaggacggcggcggcggcgaggacggaggcaccggcacctgcaccggaacctccggcgggctttcgtggccggcgcgtctccgcgtggcggtgggcgtggcggcggggctggagtacctgcacgtctcccaccagccgcagatcatccaccgggacctgaagccggccaacatcctgctggacgacgacctggagccccggatcgcggacttcgggctggccaaggcgatgccggactcgcacacgcacgtgacggcgtcgaacgtggccggcacgctggggtacatcgcgccggagtactaccagacggtgaagttcacggccaagtgcgacgtgtacagcttcggggtcatcctggcggtgctggccacggggaaggagccgtccgaccagttcttcacggagacggaggaggtggtggggctcgtcaagtggctgcgccgagtcatggagagcggggagcacgcgcaggccatcgacccggccatcgccggcgccggacacgacgagcagatcctgctgctgctgcgcatcgcgctcttctgcaccaaggacgaccccaaggagcggcccaccgccaaggacgtccgctgcatgctctcgcagatcaagacctagccacccagccacttcaatcagatcaatcactacatacaaattactacccgtttgagattatctcctagatttaccagtcatcagcgaatcgtatctttagtcataacattttaggcaaacgaagaaagtagtttcaaatttcaataaattctctctgcgtctctggactgtggattagtgctagctagagtagcaactgttgtattgtagcacgtatcgtgaaatcgtcgcggcagctgtcaagtgggaccggttgactaggactggtcagtaggatagtactagatcgggaagtcggcgcacgcgctggactagggaccggacctggtatacacatcaatgcatctctatctttgtttttgcttgcgagatgcttgcgagctttggcatggttagtgctaaataccagtatn

SEQ ID NO: 9917 - DNA, 1090 bp, Sorghum bicolor
  Clone ID: SORBI-28MAY03-CLUS42066_1
ccgcgggcctggggcgccgagccgcgagtgtgcttcttgttgctttcccacctagcaaaaaaatatatagtgaaaagataaatctcctcatatttgtggtctgcccttttcttgagcattcttctggggaggtggctcccagccctgtgtctgccgcccgccgggggcacggtctaggcggcaatctacttgggtacgttctgtgctgcgctttctcccttggtcttgtcagagctccctccctcccccctcgctcccctggccggcttcttcctccccgccgcatgctgcccgcgctcgtccccccgccccccgtccggcgcctccccgtcgcccctccccgccgcccccctccccacctggcccggctcctcgcgccgcagccgcggcccgtgcctccccgcgctctccccgtgcgtcgccgccctgcgccggtccgcccaccgcggcaagcccacctggggcgcgccggcggcgctcggacgacctctgcagttgcttgtacatcgtagaaatacatatgtattgtgcaagtaaataatcagtcaataatcgaagatgtcgctgtggtattccttgtgctgatcttttctcctagtactactgaaaagagttttgatctgcacaaaactgcactttttttaaactgacaaatactttgctgcaaattcagcaatgttcttgtcagagctccctccttcctgcatcgcttccttggccttcttcatccatctcgccgcgttctgcctgaactcatccttcctctccccttccatcacctcccggatgcacctctccacctcctccctcctcaccaagcccttccgcatccgcaccccaatcccccatgcgctctccacatacttggccgtcgtcggctggtccgcccactgcggcatcgccgccattggaacaccagtggccatggactcgatcgtcgagttccacccacagtgcgtcaggaagcaacctgtggccttgtgtgccagcacctcaagctgaggacagaagggcacaacgaggcccttctccttgcacttgccgccgagctgccgagacagcttctctgcctcgtcggacctcagcaccc

SEQ ID NO: 9918 - DNA, 814 bp, Sorghum bicolor
  Clone ID: SORBI-28MAY03-CLUS42187_1
ttttacgagaagttgaggtcccgctggaactggatgtttatgaattctgctctgatgaactgaaacagaaactccaagctcctcggcagatgctgagagatgcagaaaatgcaaagttcggattgaaagcacatgggaaagctagcagctcaaaagaaaatgaggagtcaagtagcgctggggaatcgtccagtatggacattgacaaagctgagtcttctctaccaaagaaacaattaactggtgtctatgatttggttgctgtcttgacacacaagggaagaagtgcagactctggccactatgttggctgggttaagcaagatgacggaaaatggatcgagtttgatgatgacaatccgaacattcgcaaggaggaagacattttgaaactatctggtggaggtgactggcacatggcttatatctgcctgtacaaagcccgcatggcggaatcaaagagttaggccgaagtggttctacatttccgtgtcgcgaatacaacactagtttttgtgcccacgagtcattgtggtaattaattttccagttcgtaaagtggctactgtcgaatttgcttcaatgtggttggccattattcaccgggatatgtatttttaggatttcaaatctagtacattttgtgttgtcaaaatatagaacaaagaaattcaggggaaagcttttgccttgacagtggatctgattcatttgcacgaagcggagaatatatatttttaaaaaactcaaaactagagcctgtctgaacaaaaagtttatgccacaagcttaattttctatcaatgactcaggc

SEQ ID NO: 9919 - DNA, 810 bp, Sorghum bicolor
  Clone ID: SORBI-28MAY03-CLUS42401_1
gcacgagggcgctccgcgctcgccacgcgcccccctgccttcccgcccccccctccgcccccgccgccgcctccgcccccgcccccccccctaaccctccacccccgccgagccggcccgtccccgccggccgcgccgtccccgccccccgccgcttcgcgccgccccgccccttctcccacggcgtcgccttctccctccccggcgtcatcggcctccccgccgacgccggcgtccccgccgcccccctcgcccgccccgcgcccctctcccgccccggccccccctccccccccggcgccgtctccgaggccaccatggccgcggccatggcctccctcggcgccgccgccgtcgtgcactgcaacaccgaaccccacgcccaggccgccatcgtccgcgccgccaagtcacgccgcctccccttcgtctcctccgtgcccttcttctccccgtcctccgccccgacgctcaacgacttcgctggcaacgagtacgccctcgttactcagcaccggcattcgctctccacgctcgtcggcgtcgctgccgcagcccggccgccctcccgcccggtcccggtctcggtctcgcccctcttgtgtccggcgccgcgcttagcctccgcctccttcgacttcgagaaagcggccgccttccttgccgatgagggtctggattacgcccctcttgtatccgacgacggtgaggttgtcgatctcatcaccgccaaggatgtggagcgcatccggagctatccgaagctaggcaagccgtctcttggagcagacgggaagtttgtagttgcgg

SEQ ID NO: 9920 - DNA, 708 bp, Sorghum bicolor
  Clone ID: SORBI-28MAY03-CLUS40919_1
cctactgggggacctggcggtgcacgcccacgttccagccgtcgtccagcgagtccccgacccccgaatccctaaatccaagattcgccgtctcgggcgtttccgctccgctcctctcccacggtcggccgaccccgcgatggcgtcggcgtcgccgccggcgccacgccggagcgccagagcccgccgtcttcctccacgtctggccgacagcgcgattcaggcatcgacgtcggcacgaccccggaccgccagagcccgccgtcctctcccacagccggccgacggcgcgatggcatcgacgtcgtcggcgccacggcggtcctccagagtccgccgtcttcctccacgtctggccgacagcgcgattgaggcatcgacgtcggcgcggccccgggccgccagagcccgccgtcctctcccacagccagcatcgacctcggcgcgacggcgggccgccagaggccccgccgcgcagcccgtcttcctccccgaagagatctgggagtacatcttcctgcgcctcgacgccgcggtcgacctcgtccacgcctccgccgcctgctcctccttccgccgcatcgtctccgaaccccagttcctccgccgcttccggtccctccgctcccctgcaatcctcgggctcatcacttctagcggataccgacgattcttccccgccgggccgccccaccgctccgccccgga

SEQ ID NO: 9921 - DNA, 1096 bp, Sorghum bicolor
  Clone ID: SORBI-28MAY03-CLUS41007_1
gcacgagggtcctgcggcctgcggccgtgcatcgtgctcgcccgtcttgcggtgtctgatctcccgttcctcgcgtgctctctctctctctctctctgggcgacggctggtcgaccgccaccaccgccgtacgccaggttcccgggtcgtcgtcgggctcttagccaggtcttctttgggcctttcaccggcgacgagcacccacaaggtcgccagtatgggtctggcgaaggatggcgccgagctggaggaggggtccttggagattggcatggagtatagaactgtctctggtgtggctggaccgctggtaatcttggacaaagtaaagggccctaagtatcaggaaattgtgaacattcgattgggagatggcactactcgtcgtggtcaggtcctggaagttgatggtgaaaaggctgttgtgcaggtctttgaaggtacctcagggatagacaacaagtatactaccgtgcagtttactggcgaggtcttgaaaactcctgtctcacttgatatgcttggacgcatttttaatggttctggcaaacccattgataatggtcccccaatattgcctgaggcttacttggatatttctggaagttctatcaatcccagtgagagaacatatccagaagagatgattcaaacaggaatatccaccattgatgtgatgaactcaatagcaagagggcaaaagattcctctcttttcggctgctggtcttcctcacaatgaaattgctgctcagatatgtcgtcaggctggtcttgttaaaactctggagaaatctgccaaacacaaggagagtggtgttgaggacaactttgccattgtgtttgctgccatgggagtaaacatggaaacagcccaatttttcaaacgtgactttgaagaaaatggctcaatggaacgggtcaccctttttctgaatctggcaaatgatcccactattgaacggatcatcactcctcgtattgctctgacaacagcagaatatttggcttatgaatgtgggaaacatgttcttgtcattcttacagacatgagttcatatgcagatgcacttcgtgaggtctcagcagcacgagaa

SEQ ID NO: 9922 - DNA, 652 bp, Sorghum bicolor
  Clone ID: SORBI-28MAY03-CLUS41038_1
atcaacactgttcagccaccaaagcacgggagagcagaggaattgaaggagagcagagctttgtgggagcagcaatggcaggaacctgggtgaagatggagcagaagggtggcggccctggagcacgaagctcccactccatcaccctggtggggcacacggcctactcattcggcggcgagttcaccccgcgcgtgccggtagacaacaccatgtacgcgttcgacctcggcacccagacctggtccgccctcgacgacgccacgggcgacgtgcccccgccgcgcgtcggggtgaccatggcggccgtgggcggcacggtgtacacgttcggcgggcgggacctggagcacaaggagctgaacgagctctacgccttcgacacggcgacgcgggcgtggacgctcctgtcctcctccggcggcgggccgccgcaccggagctaccactccatggtggcggacgcggagggagggcgggtgtacgtgttcggcgggtgcggcgacgccgggcgcctgaacgacctgtgggcgtacgacgtggcgagtgggaggtgggaggagctgccgtcgccgggggaggcctgccgcccgcgcggcgggccggggctggcaatcgccggcgggaaggtgtgggtggtgtacgggttctc

SEQ ID NO: 9923 - DNA, 541 bp, Sorghum bicolor
  Clone ID: SORBI-28MAY03-CLUS41157_1
gcacgaggccacctgcagacctccacttgacgctccccgccagctactactccaaccaacaaaatacctccgtctccgcctctcccatggattggaggttgggggcgtgaccgcgtgagtgaaggaagggtaggtaggtcgctggatagggacagggagacggcgggaggcgtttcgccgagcagttggcgtgcttcctccactccacaggccgaccgacgcgcgccccgctccgcgccgctgtttcaggttctacaattccagtgttgagtgctttaggctactatgggcaagtcaccggggaagtggatcaaatcggtgcttttggggaagaaatctaccaagtcaggttctaccaaggtgaatgaatcgaaggctgataacaacagatattcaactggggaggaccgcacattatctgagaattctcctgtgatttctgagccggtactagttaacatccacaagaatgtagctgtcaatgtgatggctgaaaatgtcagtgatagggaagcgcgacaagatctgcagaaccaaagta

SEQ ID NO: 9924 - DNA, 1258 bp, Sorghum bicolor
  Clone ID: SORBI-28MAY03-CLUS41163_1
ccctccgcctccgcaccgcagagccgcagcgaagccagctgcgcccctcgacttggcctcgccggagaagcggagctcgagtagaggcggcgcgcgggagatagcaagcagtcggccgctggtgccgcgtcggcggagatgacgggcggccaccacttcaacaatatcctcctcggggggcgcggtggcacgaaccctggtcagtttaaagtgtattctggtggacttgcatggaagagacaaggtggaggaaagaccattgagattgacaaagctgatgtaaccgcagttacttggatgaaagtccccagagcatatcagcttggagtcaggattaaggatggcctgttctaccgatttattggcttccgtgaacaggatgtgagcagcttgaccaacttcatacaaaagaatatgggtgtcacaccagatgaaaaacagctttctgttagtggccacaattggggagggattgatatagatggaaacatgctaacctttatggttggttcaaagcaagcatttgaagtatccctagcagatgttgcacaaacccagatgcaaggaaaaacagatgttctcttagagcttcatgttgatgatactactggagccaatgagaaagactccctcatggatttaagttttcatgtgcctacttcgaatactcagtttgttggggatgagaatcgccctccagctcacattttatgggagactatattgaaatttgctgatgttggttcttctgaagaaccagttgtcacatttgacggaattgcgattcttacaccaagaggacgttatagtgttgagcttcatctgtcatttctgcgactccaaggacaagctaatgatttcaaaatccaatacagcagcatcgttcgcctctttcttttgccaaagtcaaacaatcctcatacatttgttgttatcactcttgatccaccaatccgtaaaggacaaacattgtatcctcacattgttattcagtttgagacagaagcagtagttgaaagagacctggcattgagtaaagagctgttggttgacaaatacaaggacaggcttgaggaatcttacaagggtctaatacatgaggtatttaccaaagtcctccgtggtctatctggtgctaaagtcacaaggccaggttctttcagaagttgccaagatggatatgcagttaaatcatcactcaaagctgaagatggactgttatatccacttgaaaagggtttcttcttcttgccaaagc

SEQ ID NO: 9925 - DNA, 555 bp, Sorghum bicolor
  Clone ID: SORBI-28MAY03-CLUS41208_1
cttcgctggcacgaggcttcgctgtaatcgcgtcaggctgctcattcatcagggagagggggaaaaaacagaggggaaaaaaaattcaattgggaacagcgaagaactagtttatcaaagaaagaagaataacttctataagaaagatcgccaaattcccgattcatcttcttcgctcgggtttcagagacataacgcgcggcaatttagccaagatggtggcgatcgagaacaaccagagccaggtccaagtggcggtggcggcggaggcggtgccggtgccggtgccggggccgcggatccccagggaggcgcggagcctgctgcacgagctggcggcggcgtgggcggacgtggcggactgccgcgcgctggaggtcgtgccgctcaagggtgccatgaccaacgaggtctaccaggtgcgctggctcaccggccctgccgctgccggcgagaaggaggagcctaggagggagagggagggtgaggaaggtgctcgtgcggatttacggcgacggcgtcgaccttttcttcgaccgcgaggacgaggtgcgc

SEQ ID NO: 9926 - DNA, 707 bp, Sorghum bicolor
  Clone ID: SORBI-28MAY03-CLUS4285_1
gccggccgggttccgccggcagctgagaacgaagggaacggtccctggattatttagggttctgggttctcgagtcggcggcgagcgctttctttgtcttggaagacgatttggtttggcggggagagaaggttgtgctagtaattgatccaagttaaggcgtcgccatgagccggtcagggcagcctccggatctgaagaaatacatggacaagaagctccaaatcaagctgaatgcaaaccgtgttgtcattggcacacttcgtggatttgatcagttcatgaatctggtcattgacaacacagttgaggtcaatggaaacgaaaagaatgacatcgggatggtggtcatcaggggaaatagtgttgtcatgattgaagcactcgaaccagtcgccaaggctcagtgaactttcagcggatctagatgtggttcagtcgttaagctagtagtattaattcaaaactgttgtatggcattgggcatgttttagcctgagttccctcattcttactcatctgcaagcttgcgcacctctgtatgactgtatagctcagcaagatttacactgctttctggtgttattctgatgggatttgtgcgtcgtggtatcatgctaaaaagggtgtgaattgtgatgtgttccttatctaaactggagatgctagttcagatccccaaaaaaaaaaaaaaaaaggcccttagg

SEQ ID NO: 9927 - DNA, 704 bp, Sorghum bicolor
  Clone ID: SORBI-28MAY03-CLUS42894_1
gcacgaggagcacacgcgcggcggcacgggggccacacgagcaccagtcagccgccaccgccatgcggctccccgccggcgcacgcctcgcgctcctgctcgcccgccgctctctctcctcctccgcctcctcctcctcccgcctcccgcgggcgcacagagggatatggagtgacgcagcacgcgtggtgccctcccggagttcgcccttctcgtcaccgagtagcgcccacaggttcttccacggaaccaggccggtggcggcaagggactactacgatgtgctcggcgtcagtaagaacgctagccaatcagacatcaaaaaggcctattatgggcttgcaaagaagcttcatccagacacgaataaaggtgatgcagatgcagaacggaagtttcaagaggttcaacgagcttatgagactttgaaggatgaacaaaaaagatcattatatgatcaggttggtcctgatcaatatgagaaagctgcttctggtggaggcggaactggctttgagggtggttttggaaatccatttgaggatatttttagtggtggcggtggcagcggtggaatgaatgatttctttaggaacattttcagggatagggactttgggggacgagatgttaaggttgcacttgaactatcatttatggaagcagttcaagggtgcagcaaaacgataaactaccaaacgtct

SEQ ID NO: 9928 - DNA, 676 bp, Sorghum bicolor
  Clone ID: SORBI-28MAY03-CLUS42922_1
cgagctgcgcgttctgtgcgacctattattggagcacatggatctgcagaagctactagcgcaattttcaccagagatgagaggtatgtcctatcttgtgggaaagattcttgtgtcaagttatgggaagttggcactggacgacttgtgaagcaatatgcaggagccattcgcagacaatttcgttgtcaggctgtcttcaatgaaaccgaagaatttgttctatcagttgatgaacaaaacaatgaggttgtcgtctgggatgcacttactgcagaaaaggttgcaagattgccctctggcagcactggtgctcccagatggctcgaccactccccagttgaaccagtttttgttatttgtggaaatgatagatcgatcagattctggaaacaaaccgtatagcttgtagattcaaccattcaaatcaaaagtatgctttcagtattacgtttcaggaggaatgtgctcatgtaactttagttgtatatgggagaaatttgcataagcattttttttattggaaactgcataagcaattgattgatctaatagcccacccccctgttggtcctgtttttgttatttgtggaaatgatagatcgatcagattctggaaacaaaccgtatagcttgtagattcaaccattcaaatcaaaagtatgctttcagtatt

SEQ ID NO: 9929 - DNA, 615 bp, Sorghum bicolor
  Clone ID: SORBI-28MAY03-CLUS42931_1
atcagctcactcatttatctccaatttgagaggttatttcaattcaaccggaaagttgaagaattgacatacaccattgctgctgaggagattccgtttcagctggggttgtcaaaaactgacctaaggagggtgctgaagtccagcttatctgggattgataagtcgattggcgccatgtacaggaggttgcagaagacactgacgtctgatgagttgtttccttcgctgtgggacaagtgcaagaaggaatttctggacaaatatgagagctttgttcagatggtaacacggatatatgggaatgagccgatcatgtcggtcaacgaaatgaaagaagtccttgctagtttttagatacaagtacagcaccatgtattccattcatttcattgaattttgcactcacttgcgttaggccttttttggtttaatgtgtgtatgtgtatgtcctctgtatagaagtgaacgcggcatgctttccctaattatacgtgttctggtgtcacatcaagcctctgattgtacttgaacaggcactgctgcccgtagattgtggatcaataccaatgcatcccaaagtaccggaaagaatgtgttcatgttcacactgcc

SEQ ID NO: 9930 - DNA, 896 bp, Sorghum bicolor
  Clone ID: SORBI-28MAY03-CLUS43075_1
atcgtacccagaactaacagcaatgcaagcccgtgctatctttgaagctgctattgctgtgaatgatcaaggtttccaagttttcccagagataatggtgcctcttgttggtacacctcagagtgatgtttttcaggaacttgagcagcaaatgagtgtgattcatcaggtcgctcacaaggtttttgccaatccagaaacaactattagatacaaaattgggtccatgattgaggttcctagggcggccctcatagctgatgagatagcagaactggcagagttcttctcatttgggacaaatgacctcacacagatgacatttggttacagcagggatgacgttagcaagttcctcccaacctacatatcccagggtattctccagcacgacccattcgaggtgtttgaccagaagggagttggggagctggttaagattgcaactgcgaggggccgaaggtcaaggcctgatttggaggtgggcatttgtggggaacatggtggagagccgtcttcagtagcattttttgctaaggctggactggactatgtttcttgttcgcctttcagggtcccaattgcaaggttagctgcagcacaggcagcccttgaatgagcacgggtgtttgtagcttctcagcaagcaaccggtaacgcgtcttgcaaataaataatgcacagaagggcccctgttgaatgcttgtttgagatgtacgatcacttctaaatgaaagtttgcatgcgtatgtaaattattaacctttggagtaaggcaaatgtgaagcgctggacccaacgttcaaaagttgtataatagctcgtttgcgttcagcgctgtacaatggttctataatgaaagtttgtacaaaggttgtataacagtattggagtat

SEQ ID NO: 9931 - DNA, 804 bp, Sorghum bicolor
  unsure (1)..(804): unsure at all n locations
  Clone ID: SORBI-28MAY03-CLUS5506_1
ataacatttttattgtttccttaatccacccctggccgttggccctcgccatgtccccagccgtcctgctgctgctcctatgccaccgccttgccaccacttgctccgtggccaccgcgtaggatgcgccatagctggccgcgtgggatctccgcgtgcgctgactcgctctggcaccggactccttctgaaccctagctgcggtgtcgccgccgcctccgactacaaggtcggcatcgacgacgatgacttcgaggctcttgcgcacaggatgcagccaagctgacgtccggcggcaactgcggagcgcggcgcatgggcggcccctgcctcgcacgcctactacccttcggcttgaggagcacgtgaggtcacgtgtgctggagccggcgacgaggggaaccatcaacgtgctccgttcctgcgtccgcgcggggaccgtgcgccgggtcgtcttcacgtcctccgtcagcacgttgacggcggcggacgccgaggggcggcggaaggccgtcctcgacgagtcctgcctcagatccctcgacgacgtctggcgcaccaagcccgtcggctggatctacatcctgtccaagcggctgaccgaggaggcggcgttcaggttcgcgcgcgagaacggcgtccacctcgtctccctcgtcctgccccccgccgcccggccgtccctggaggcggcgttcaggttcgcgcgcgagaacggcgtccacctcgtctccctcgtcctgcccaccgtcgccgggccgttcctgacgccnagcgtccccacgagcatccagctcctgctgt

SEQ ID NO: 9932 - DNA, 917 bp, Sorghum bicolor
  Clone ID: SORBI-28MAY03-CLUS55097_1
gcacgaggtgaaatttgggcggcagaaggcttagtggaacatcaacatactggtgagcagtattttgaccaacttgcacatctgtcatttttgcagaaatatccacggtcccatgagaactatgtaatgcatgatttgatgcatgacatggcacaactggtttcaaaggacgagtgctttatagtaaaagaaaaaaatgatcttcctaagatccctcagaatgtccgccatctgtcagtgctcaaaggcggagatgttcagtgttctgacttactgaagcatgacatggcacagcatagaaagctgcgcaccctattttgccacctgtctttaaagagtgagactgataatactatgatgaagaaatggtgtaatgaacttcggtgcatgcgtgtcatggtctgttctatctctaagtggggcttaccaggtagtattagcaatatgaagctacttcggtaccttcaaatcctcaactctagcctttgcaagagccttccttcagcattctgttgcctctataacatgcagatattttacgctgcgaaatgggttattgatgacattcctagcagcattggtatgctgatcaatatgcagaaatttgagacagggacgtgtcaatttcatcatagacgtatacattcagtggatgttcgtgaaagtgcaagtgcaactgacaaagggcagagagggcaattcaggattggaaactataaaggggaattttttccaagctggtctcatccacaaaacttagagcagattcccagttacgatagcactaatagcactttttcgtccccgactgatgtaaaaattataaattgccgaaacttatcaagcatcgatcaatttttacaaccagcttatatgcccatcatcaataaaatagaaatttcctgctgggcaagttt

SEQ ID NO: 9933 - DNA, 603 bp, Sorghum bicolor
  Clone ID: SORBI-28MAY03-CLUS55200_1
gccgctctactgctgttaactctgctgccgccaacgctgtcactgccggtgtcttcatggctgttgctgccggtaacgatggtcgcgatgctacgaactactctcccgcctctgagcccaccgtcttcaccgttggcgctaccgacagctccgaccgccttgcttccttctccaactacggcactagcgtcgacatccttgccccaggtgtcagcattctctccacctggatcggtggccgcactaacaccatctccggtacttccatggctactccccacgttgctggtctcgctgcctacctcctgggtctcgagggcaagaagacccctgctgctctctctactcgcatccagaccctttccctcaagaccaagatcagcggtgttccctccagcaccaagaactaccttgccttcaacggcaaccccagcgcttaagcggttgattggttggacgaattctttcttttgtatctatcttatgagcgtatgatggctggattgcgcatgccatgggttggtgcatggatctctgggagatagcatgagtgtatatacggttgaacgaacttgattgggatttttcctggatatccctagt

SEQ ID NO: 9934 - DNA, 638 bp, Sorghum bicolor
  Clone ID: SORBI-28MAY03-CLUS55212_1
cttgcttcagttactcaatgccatgaaaaacatgaagcttctctcaggaaagctgtttctccaatttcttcaaatatggtgcctgtgaagcagcaaatatcagataatggcaattaccccattttattggagccccaaactccaatagaaacacatagcatagtcaaggagactcctggtgcaacaccactagagagatttaacgtgctacagtctaacttaaaggaagctcttgttcaaccataccttgaagttttaaatgttgcaaacaaggaagagctacagaagctgaaaggaattggcacgaagagagcagaatatattctggagttacgggaggactcaccaagaccattcacaactcttgaagatttggaaaacattggcctcacgtcaaagcagatccaagaactcctaaagaaggtggccgccactgggatcttcaaatgatgaccgaactagatgctgtatgtggacgggaagttagttcaaatctttcttttggtgacttcaggcagtgtcctgctgctgctttcaactagatttcctttaagcgtctatgtaactaaactgtcgaagttgtgctgctacttttacgtccagcagagtttttatgaaacgagctattcgaatatttt

SEQ ID NO: 9935 - DNA, 589 bp, Sorghum bicolor
  Clone ID: SORBI-28MAY03-CLUS55251_1
tcccgcactttggcacccggagtcgcagctcgactctgatctacaagcctgacgagcagaccagccctggaattcccgccgtgtttgtcgaagacatgactgacgagccgattgccatgagcccgcttgatgctgctaggcctatcaaggctcaaaccgcgcgacctcctgtcgagctgatgaacgatttgtaaatgaattactgggacggtgttaatacgatgagcggttacatgatgggctttcctttgtttccttatttctttctgaactctctggctcttttggggagcagaaagagggttctcggtcggcgttggtggacacatgatgcatgattagattggtttacagagtctgtggacatcctctcgtggtatcatcctaatttgggtttggagttttgggttgttgcttttcatactggatttaaatccttgcagggagttggttgataaaaacagaaagtttcccgtctttgaatagatacataccaattgctggatacctaggtagatgggcacaatattagtagccattacgcgactttatgaggtcgttgtgaaattgaatcaaactattcaactac

SEQ ID NO: 9936 - DNA, 1051 bp, Sorghum bicolor
  Clone ID: SORBI-28MAY03-CLUS4366_1
cgtccgcccacgcgtccgggaagatctaagcgtgatcaaagaaatatgcttcaaaccatgcgtcggtgactgaagcaccaaagatctgttgctaagaacttgggaaataaatcactttggcccaagacaatggaagatgtaatctagcacggtaaatattaagtgtttatattatctatgttgtggactaacaactctatgttctgttgtagattgtagcgaaacttgtagacattgtgcatgtcttaaattttgagatcagaagagctttcttgaagaaccacggagatcaatctgtagcgccagtgaccaagcttcatcaaacattagggcctactggtcttgcattgcattatgccaatgtcattctgcagataaatacattggtattggcctcacctgcggctgtttcttacaaagctagggatgcactgtaccaggcactgcctccatgcatcaaatcaaagttgcgagagtgttgtcatagagagagaacgatgaacgtagcggaggtcagagctgagatggacagaatactccagtggcttgtgccagttgcagaatccacaacatcgtactacaagaatggggcattcggtgaatggataaacatggtgatgccagaggatatagttgtcgaggaaccatactggcctggagaagaagaacgtcagaccatcgctggtgcctctgccattcaaaggcatgtggtgaacaagatagagacattgtaccacgctgataagcagaagactgaaggttacatcctggacctaattcgaggtctgcatcgtcttgtttgctagtccgacttaccatggatgcctctgccattttccttgatatgtattgaccaaagttcaatagaagttggaccttcaagcattctttagaaggtacttttggtccattctattggtcaaaatgcaatgaacaattgaggttttctttccgctggaacttttaaagttgtttaatcaagacatccgcacactatctatataagaggaaatacacaacttttgcagctgaagttcttgcagtttcttgt

SEQ ID NO: 9937 - DNA, 673 bp, Sorghum bicolor
  Clone ID: SORBI-28MAY03-CLUS43538_1
ggattcattgactgtggagtcattattggaactgttggatgaggatagcttgaggaaagacacggctcttccttctcctgaatggtcgtcagatcatatagcactcctagcagaattccggtgcaagcctagagttagacgataatactttaggaggagctgtaggggagggattctcgacaatcacatgagaatgtacccttgcggaagccaggaactaaaagccaaagaggcttgtgatgttcctcacccttttacatttccgccctgatgtttctttagtggcactagttggaatgggacttcctatagaagatatatcaatgcaaagagaaataatttaatagatctgtatgtcatttttagttttccagcctcacattctcgccccctcaccttcaatgtgggtttgttgtccacatttttgtttcctgatttactctagtagttcttacaaactggaaatgatcccttccattgtgtatgtctcttgagcggggatcagctttggcatagtctttagttgaaaagtgatgttgggttatcatgaaggatatggaacaaatatctggtgaggctgtcgcaaagaaattgagcttcacattggggatgctatgttgaatgaacactgtgaaatttgatgtctcttctgcaatggtttgacttggtttag

SEQ ID NO: 9938 - DNA, 689 bp, Sorghum bicolor
  Clone ID: SORBI-28MAY03-CLUS43745_1
gttgagcgtttccgttcctcactgcacctgcacgccaccaaattccaaatccaattccacttccacttcggatacccccatggcctatcacacctgttgctgaatccccgctttcttcgacggccggacggcgtacacgccctagctaattgatgcttgcttcagcccagggttttccgacgaatcctctcctcttccagccaattgcagtttgcggctgtgctaggctaggctaggctttcctcagcagcacttccgcccttcggctcttgtggctgatcgaattggctcgctgcttccatcggcaatccaatcgggagatggctaccactcagttcgccatggttgaggagctggcctcgctcatcaaggacaacctgcacagcaagcaccttatcctctccactgaggagtccctcatagcagccctccagcagctccactgccgcgacggcgacggcgaccttgaagaggacggcgacgcggcggatacgatagagctccagcctgccggggcctaccaccgccttctcttgcatcgccttgctgaaatttatgggttcgctcatgaatcggttggtgaaggcgaggatcgacatttagtcctccagcgctgccctgaaacagccatcccatctgtccttgttagtgatatgttatggaagtttgattacagcgatgatctgacg

SEQ ID NO: 9939 - DNA, 587 bp, Sorghum bicolor
  Clone ID: SORBI-28MAY03-CLUS43758_1
gcacgaggctttctcctcttgccaccgcggccccaacctgtaaaccccccggtgagcgatgcggcggctgccgaaatccctcctcctcgcctgcctctccaggcccctccgccaccgccccccgctccctctgctccacccttcgcctccacagcccccgcgcccgggggcccgcctactccccttctccactcaaaccctagccccggctcctcctcctcccccggcgcctgatgcggcgtcgacggccgagcccgcgggcctcgcgcttctggaggccgcggagcggcgcgagtccgagggcgaccaccaggaggccctcgccctcgccctcaaggcgctcgcgccgctgcaggcgtctcacggcgggtggtcgctacccgtcgcgcgcgcgctccgcctcgccggcaccgcggccacccgcgccggcagcctcagcgacgcgctcgagtccctcggcgccgctgcggagatcgtcgactacccggcccccgcgcggcgcgagggggtgcctaaggaggtggcggctgtcggcgccaccgtgtacgagcagctggcgcgcgccaagacggccatggggcaccggt

SEQ ID NO: 9940 - DNA, 1406 bp, Sorghum bicolor
  Clone ID: SORBI-28MAY03-CLUS43762_1
gcacgaggctcttccaatgctcacggtcttgactgacaaaggtactggcattgtgactagtgttccaagtgattcacctgatgatttcatggcgctgcaagatttagtcacaaagccagccttgagagcaaagtatggagtgaaagatgagtgggttcttccttatgagattataccaataatccacattcctgaatttggagacaaggcaccagggaaggtttgccatgatcttaagattaaaagccagaacgacaaggagaagcttgctgaagcaaaaagaatgacgtatctgaagggatttactgatggaacaatgattgtaggtgagttcagtggtagaaaggttcaagaagcaaagccgctgattaaaagcaagcttttggaagaaggcacagccgtgctgtatagtgagccggagaagaaggtcatgtctagatctggtgatgaatgtgttgttgccctcactgatcagtggtacataacttatggtgaggctgaatggaagcagaaggcagccaaatgtttggaccgcatgaatacattctcaactgaaacccgtaatggttttgaacacacattgggctggctgaaccagtgggcttgttcgcgttcttttggccttggtactcgaatcccatgggatgagcagttccttgtagaatctctttctgattcaaccctatacatggcttactatacagttgcacatcatttgcaaaatggtaatatgtatgggaaagaaatatcttcagtaaggccagaagaaatgacagatgaagtctgggattttgtgttttgtgatggcccagcaccaaaaagtgacatccctgctgctctgttgaacaaaatgaagcaggaatttgagtactggtgcccgtttgatatccgtgtgtctggtaaagaccttattcagaaccatctgacattctgcatatataatcatacagcacttcttcctgaacaccattggcctcttggtttccgctgcaatgggcatcttatgcttaattctgagaaaatgtccgagtccacagggaatttcctaactctcgaagatgccatcaaaaagtactcttctgatgccactagatttgcccttgctgatgctggcgatggtatggatgacgcaaactttgtcactgacattgcaaattctgctgtgctgaggcttacaaaagaaatttcatggatggaagaggttacagctgctgaatctaaattaagaactgggccgcccactacatatgctgaccgtgtgtttgcaaacgagatgaacattgcaatcaaagaaactgagaagagctacgatgctttcatgttcaaggaggccctgacgtctgggttctatgacctccaatcggctagagatgagtacaggctctcttgtggcgcagcaggcatga

SEQ ID NO: 9941 - DNA, 746 bp, Sorghum bicolor
  Clone ID: SORBI-28MAY03-CLUS42454_1
gaagtccaagcaaagcaactgaagtaaaaatatcgaatttaccagggatctacaatgagaaagcggccatggttgagagttgagaggccacgaactccaccaagagtccacgacccaatcgcaagcatccactgccttgctcagttgctcgccttttctttaaggcctccaacggtggagccggaataaactccggccacttcggcatccgccggggaatttgattcttctctccactatatactcacgctaccttccacctccccctaattctctccctcgtctttcttcgccgccagccagacagctccagctcaggtgggcagacacgcagcggccaagatgatggcggaggcagcgtggacgccggtgctgtttccgccgacggtgccctgtttctggcagcctgacacgcacccggttttttggcggagaggagacgcgtggacggcggaggagaacaagaagttcgagaaggcgctggcgctgatcgaccggaacgcgcccgaccggtgggagaaggtggcggagctgctgcccaggaagacggccgacgacgtgaggaaccactaccacgacctcgagaacgacgtcggctacatcgaggccgggctcgtgccgttcccgcactacagcagctcggtcccgtcgtccgggttcaccctcgagcgctcgcgcgggtcggaccaggagcggaagaagggtgtcccctggacggaggaggagcacaagcttttcttgatggg

SEQ ID NO: 9942 - DNA, 1084 bp, Sorghum bicolor
  Clone ID: SORBI-28MAY03-CLUS42532_1
gcacgaggggcttatcataccgggaagcagccccccagtcgtatcccccctggctccggcagcgccgcagcggcacggcaccggtatgatggccgctgcgagaatggcgttcgcctcttgcgcccgcctcctcccgtcctcatcctctccgctcaccctcgcaaggccccgcgccggcgccgtctcgttcctggctgcccgaccgtcgccgagatccggcaggaatcttgctctcttctgctcttcatcaccgacgtcgctaccgctaacggatgcggtggaggagacgaagcccccggtgccgagcggggacgacaaggcggaaccgaccgtggaggacctagtgggcttgctggacgtccgggtgggccgggtgttgaaggcgtggaggcacccggaggcggacacgctctatgttgaggaggtggacgtaggcgaggcggagccccggaccatctgcagcggcctcgtcaacttcatccccatccaagacctccaggacagcaacgtgattgttcttgctaacctcaaaccaaggaacatgcgtggcatcaagtcaaatggcatgctcatggctgcctctgatgcttcccatgagaatgtggagctgctcatccctccagaaggttccttgcctggtgaaagagtatggtttggttcagaagaagaaaagcatcgtcaatctgaccctgcatcaccaaatcaggtccaaaagaagaagatctgggaagctgttcagcctcatcttagaacaacagataactgcattgtggttcttggtgataaacaaatgcgtacctctgcaggcccaattttctgcaaatcgcttcagggtgcaagagtgtcataaatctttatggtgaacatctttcttgtatcatggaatcgtgtgtcatgtaccttccccgcaaataataactatacgagtagaacaacagtgacagaattttctttccgactattgagatattcaccatactggaatcattcacatttagttctcacttttcaggtgtcaaaactaagtgcttcctggacattatatttaggaatttacattattccctagctaaatttcaattga

SEQ ID NO: 9943 - DNA, 855 bp, Sorghum bicolor
  Clone ID: SORBI-28MAY03-CLUS42555_1
tcaacccgcgaatccacacaagaacccatcaccaccctcgcatcacatgcccgcatagtcccccggccgcaaggtcgcaatcaccaccatgccgcctccgctgttcgtctgcgtcctcatcttgctcgtcgccgtgccgaggccgtggtccgtcgccggcgagccgccgaggccggccgccaagcctcgtgcgttcccgctgcgcgcgcggcaggtgccggcgggagcgctgccgcggccgccgagcaagctgcggttccaccacaacgtcagcctcaccgtctcgctcgccgtcggcacgccgccgcagaacgtcaccatggtgctcgacaccggcagcgagctctcctggctgctctgtgcgacggggcgccaggggagcgccgcggccggcgctgccgccgccatgggggagtcgttccgcccgagggcctcggccacgttcgctgccgtgccctgcggctccacgcagtgcagctcccgggacctgcctgcgccgccgtcctgcgacggggcctcgcgccagtgccacgtgtcgctgtcctacgccgacgggtccgcctccgatggagcgctcgccaccgacgttttcgccgtcggcgaggcgccgccgctgcggtccgcgttcggctgcatgtccaccgcgtatgactcctcccccgacggcgtcgcgacggccggtctgctgggcatgaacaggggcacgctctccttcgtgacgcaggccagcacgcgccgcttctcgtactgcatctccgaccgggacgacgccggcgtgctgctcctcggccacagcgacctcccctttctgccgctcaactacacgccactgtatcagcccaccctgccgctccc

SEQ ID NO: 9944 - DNA, 1014 bp, Sorghum bicolor
  Clone ID: SORBI-28MAY03-CLUS42584_1
gcacgaggattcccaccagtgccccagccccaccattccaccaggcacgaaacctaacccacccggccgaggatcccaagcggcggccatggagccctccaccgtcggcgacggcggctcggcggagcggtggcgcgcggaggcggcgcgggcgttccagcactacctggaccgcgcggctccgcacacggcggggcggtgggcgggcacgctcgtggccgcggcggtgtacgcgctgcgggtctactacgtgcggggcttctacatcgtcacctacgggctgggcatctacctgctcaacctcctcatcggcttcctctcccccatggtcgacccggagctcgaggcgctcgaggccgggcccgggctccccacccgcggctccgacgagttcaagcccttcatccgccgcctccccgagttcaagttctggtatgccatcacaaaagccttttgcattgcttttgtcatgaccttcttctctgtattcgatgttcctgtcttctggccaatacttctttgctattggattgtgctctttgtcctgacaatgaagcgacagattgtacatatgatcaagtacaagtatgtcccgttcagcattggaaagcagaggtatggtggaaagaagggccctggagccagtgcatcaaaagagtaaagacctgagggtctgggacctcaggagcaaatgcctgtgttatctgtgaggcatcctgctggcatggtggtattttgagtaccagctactgatagtgaatgcacaccatattcactagtggagagtggagactccagagaagctaaccagacttttgcattggttgatgattcctgtttcacatatgtagtttatgtacaatgacatggaacatagcttactgatcaaatttccagttcctctgttgtactgtactgtgacaagttgtgaacctgttgaatctttgcaaacgcaatacaagcagagaccgagaggacaaaagggaattgtggtgcccggcccgcatggtggtg

SEQ ID NO: 9945 - DNA, 597 bp, Sorghum bicolor
  Clone ID: SORBI-28MAY03-CLUS42717_1
gcacgcggccctcacacccccccggcaacccgcccccccacacctcccttcccgccccctccgcccgcccgcggccgtcgcccccgcgacgccaccgccggccatacccccccggcccccgcctctcccccccttccccccccctcccccagcccgttcggcaggccccgatccggctctgtgtgttttcgccgctccttccctgggccctcgcgcagccgatgggcgtgggcgagagggcatgaccatggagggcccgcgctgtggcacttgtgcgcgctgtcgctccctcttcccagtccctttctgggttcttgtttcctagattaggtgtgcggctgtggtgttcttgctcttgcggtctaccagaccttttctgtagcaatcttgctcgttccgcggtgggcgacgttctcccccgtgcagagcatcttggggcagcaactgctcctcgcccagttcgatctccccttctcctagtggtcgcttgtaagaactcttctatgcagtctccaacttgcagagtggattggctactgttgcaaaccattgtactcctaccatgctgttgttgcagcaatcttgcttgcaactcgg

SEQ ID NO: 9946 - DNA, 1015 bp, Sorghum bicolor
  Clone ID: SORBI-28MAY03-CLUS4411_1
cgtccggtgaggttaacctccaattggtcattcacaattcagaagctcataagattttggtgagagtggttggttttgatgtaatgccagagaaaagccaaactgtccatcctcatgactcaaacagtgctcagggtggatggtatgatgtatcactggaaaatgacgtaaaggccatctctagttccaagagtacacatcaagagaagcaatcttcgaagagcatttcaccatatgtttggtgttcattgagttgtgctcaaactgagctccaacctgacagttgtgctagagttcctctaaaagtgtgcatattcgcaccaggtacatacaatttttccaattatgagctgcaatggaaagtgcatccatctgagggaccacatgtggatgaaaatgagaaattgttatctggtggtggtctagggcatcctttctatgttactgtccttcaaagtgtctaagtaattatcaggatttgagaagtaccttcttgaacgtcaataagttcaaaactcaggaattacaaccaattgcaatggggcgatgataataggcgccaaccaatgcagtcctggtggctgttgtgcaaagaagtgctgcaagtgttccctgactgaatatgtttggatatgctcatgattgttctgcttcgatactgatatatttactcatcattttgaaggatgagttttggtgagtacatgtatacaattgttggtggaaaaaaaaattaacggtaattgctggtggaattttggcatagacgcatacagatagaggttttgcttaattgttgatgtggctagtaggagcatatactattcatgtacattctgtttaacttgtcactgctagacgttttctcaaatgtaggatgtagtgatagtcggatcagatatttttttctgtaattttgatgaggtaatcaggcaattgtctcgatattgttgttgtatggacgacaataatttttgtttgtacaatccttttaaaagcattgtttggcctgagc

SEQ ID NO: 9947 - DNA, 706 bp, Sorghum bicolor
  Clone ID: SORBI-28MAY03-CLUS44127_1
ctgtcatattcaaggcccagagagttttgatatctttcgagggcattcgagggcaacactgtttctcatttgtaacaatgctgctcaaggcattctctcctctttcttcttcaagtatgcagacactattttgaagaagtactcatctactgttgccacaattttcactggtctagcttcagctgcatttttggggcaacccttgaccgttaactttctcttaggcatctcaatagtatttatttcaatgcaccagtttttctctccactagcaaaagtcaaggatgaaaagccagctggaacagttgagctgggagattcacaaaatcataggtcctctgagtcttcttttgtaaatatgactgccggtgccactgatgatgcaaggcatcttaacgcaactgatgagagaaaaccactgctgccaatttgagattacattcaaggtaggtatagaagaaattatttttgccgagagtagaacaaatgctctttgtcaactgtataagcaaaagaatatctatacatgcagaattcaggccaccttgttcctctgttttgttgttttatacccccacatttggggccaatatatggcagtagggccttctacacagctaatgtattaattgcttattatgtaccacaattctttccccctccttttcggggcaaaatgatagtgtacaacttttgttgcgatttt

SEQ ID NO: 9948 - DNA, 848 bp, Sorghum bicolor
  Clone ID: SORBI-28MAY03-CLUS44210_1
gaaaaggtagcagagtcacttgagcttccctggcacgacggctctttaggttgcccagagatcttcccatactacagcaagataaagcatgaagcgcagtgcagcttcaggccatataactgcccctacgctggctctgaatgtgctgtggctggtgatattccattccttgttgcacatttgagggatgatcacaaagttgacatgcacagtggctgcacattcaaccatagatacgtcaaatccaacccgcgcgaggttgaaaatgccacctggatgctaacagtattccattgttttgggcagtacttctgcctgcactttgaggcattccagctcgcaatggctccagtgtatatggctttcctccgattcatgggtgatgagaatgaagcaaggaactatacatatagcctagaggttggtggtaatgggaggaaaatggtatgggaaggtactcctagaagcatccgtgacagccaccgcaaggtccgtgacagccatgatggcctcatcatccagaggaatatggcgctgttcttctcaggcggtgacaggaaggagctgaagctgagggtgactgggcggatctggaaagagcagaccaacccggatggagcctgcattcctaacctttgcagctgagcaagggagacgattgaaaagaaaaaagaaagaaagaaaatattgtgctatttggctggcttgtttcaaaattgtcatcttgttatgttttcattatagtcttctgccgttgcaatgttgtaccagtaaaattgtagggtgtaaaatgtttttgtaaagtaattgtgtataacgaattcaagaaaccttccaagttggcccct

SEQ ID NO: 9949 - DNA, 909 bp, Sorghum bicolor
  Clone ID: SORBI-28MAY03-CLUS44284_1
gcacgagggttaatcccgcggccatcatcttgatttggtcccttgcttccgtctcctctctagctagcttgctctatataacaagagccaccctgcaccatctctcttctcacatccgcgtggacagaagcagctgtcaggaagacatattttcaacagattcagagaaagagctagcatatagagaggtaaagagcgagagagctacggagaggattatcaacctacagctagagcttccatggagagagttgcatcaagctgtgtcagcctcctagcacaaaggagggcctactctgtggccgcggccatggcgaagggagtcgcacggaggggcgccgacgagaagaaggcggcggcggcggcggtgaccaagcgcgtgatgggcaagaaggaagtgaacaccgcagccgctgctgcggcggaggagaagaaggcgtgggtgccggaccctgtgaccggctactatcgcccagcaggtagcgctgccaaggaggtggacgccgcggagctgcgcgccaagctgctcacggaggctgcggccaactgattaatcacacggttaccttgtcgagctcgagcatgcatgagttggctgtccaccactccacctagcttctcttgctttaagatccgcgctcgttgatcgcggggctccttggcctagagcatgagggtgctctatacctgttctctgcagcatctattagtatagtatcgtcaggaagtgctccgccccgtgtcttctttttaagaaagaagaagaagaaggagaagaaggaaaaagttcccggcttctactacagccatacacgtccaaaccttactatatgtattttatgctcaatcgctgattatctgcacatcatcatcatatcatatatctgaatgatacatatataataagca

SEQ ID NO: 9950 - DNA, 1213 bp, Sorghum bicolor
  Clone ID: SORBI-28MAY03-CLUS4433_1
gcacgaggcctcgtgccgaattcggcacgaggtctgttcttgctctactatttgtctcttcctctgttatcctctgcaatcagaatcagttgtacacactcacatacccacccccgcgggctttctgggtagcttgtgggtcccagctggaagtcactcagacttggcaaagaatcgtcttccttctctgttgaattcaactctgctctagcagtgccagtctagctctactcaagggattaggagcagaaatcggagacttgagggactcacctgctactcaagagtcaagacgtcccattatcttggcttcacctccacctgttagttgctgatccaggaggaggagacgacagccatggcgacggcgaagcccatcctgtacaacgcttggatcagctcctgctcccaccgtgttcgcatcgcgctaaacctcaaaggtgtggattacgagtataagtcggtaaatcccaggacagatccagattatgaaaaaatcaatccaatcaaatatattccagcattagtagatggggacatagtcgtttctgattctctcgctatctcattgtatttggaagataaatatcctgagcatcctctcctgcctaaagatctcaagaggaaagctcttaatcttcagattgcaaacattgtttgttcaagcattcaacctcttcaaggctatgccgttattggtctgcatgagggtaggatgagcccagatgagggccttcatattgttcaaacttatattgacaagggattcagagcgatcgaaaagctcttggaaggatgtgagagtaaatatgctactggagatgatgtccaattgggagatgtgtttcttgaaccacagatacatgctggcataaatcgcttccaaatcgatatgtcgaagtacccaatcttggagaggctccatgatgcatacatgcaaaatccagcattcgaatctgcgcttcccaaaaatcagccagacgcaccttcatcataagcatcaagattgtatgaataatttgcatgtccttgggtaataatttggatagggagactccgcttcctccatcctgcagtactatgagttataatctagcttacccttctgtcatggctcaagagtaattaattgacactttccctaatgatgcccatactttgtatgaagaccgaatgcttctcattctaaatattatggaaagtacggtgattt

SEQ ID NO: 9951 - DNA, 1103 bp, Sorghum bicolor
  Clone ID: SORBI-28MAY03-CLUS43326_1
aggtcggcggctccagctccagctcccagtgcgggtgcggtgggcaggctggatcattaggaaacatctgtgaatggaatcaaataaaaaaaaagaagggttaggaaacatggatctgaatcactgaggagaggagaggggggtcgttacgaggaccgggacttcaggagggagaggagagctgtcctgtcgctgctctctgcccgcatccatctccacctatctcccaagctcgatctcatcgcatcaatggccatctgaatcaaccaagccatctggaagctttcagtcccatggaacggatcctcaagtccgccagggagtcgggctccctcaacctctccaatcgctccctcagggagatacccaaagaggtgtacaacaacttggacacaggcagccaggacgaaaaatggtgggagggagtggacctccaaaagctcattctggctcacaataaccttgaggtgttaagagaagaccttagaaacttgtcttctcttgttgttttaaatataagccacaacaacatatcttcccttccagcagctattggagatctcccgttgctaaaatcactggacatatctttcaatcaaataaacactctgcctgaagagattggcctggctactgctttagtcaaggttgatttctcaaataatttccttactgagcttccacctagccttgccaaatgcccggacttgtccgaactcaaggcatcgaacaacaacatatccagaatacctgatgtacttgctggctgttccaagttaagtaaattggatctagagggtaacaagcttgtgatgctttctgaaaactgtttgtgtcatggacaatgctcacagagttgaatctcgcaaaaaacctgcttacagccatcccaagtagcatcggagcacttccaaaactaattcgcctggacatgcatcagaataaaataacatcaattcctccttccataaagggttgctcttcgctagccgagttctacatgggaaataacctattgtcttcaataccagctgatattggtatgctatcaaaattaggcatacttgatctccattctaatcagctaaaggagtatccagttg

SEQ ID NO: 9952 - DNA, 875 bp, Sorghum bicolor
  Clone ID: SORBI-28MAY03-CLUS43383_1
tgtccatcacgacgtccgtggtgatcggcctcgtcttctggtgcctcatcctctacttcgacgacaagatcgcgctgctcttcacgtccagcgcggtcgtgctcgacgccgtgcaccacctgtccgtgctgctcgccttcaccatcctcctcaacagcgtgcagcccgtcctctcaggggtggccgttggttcaggatggcaagcattggtcgcctacgtgaacgtcggcacctactacctcatcggagttcccttgggtatcatactcggttggccgctgcagtttggagtagggggaatctggtccggcatgattggagggaccgccgttcaaacgatcatactcgcctacctcactgtcaaatgtgactgggatgaagaggcgaggttagccagtatgagaatgcagaaatgggccgacgacttgaaataaacctactccaacaatatactgctgcactttgttgttagacaggcacagggaaccctgaagcgctaagatacagccatgcatgttccggccttcaactacatttggcggctgacgaccccaggtttctgaagatagtgtacggaacctccgatatatagcggaattgcgtgctgtcctagggattacgtaactatatataattgtgatcctttcgcagcattgtcgcaaggataatttttgcaatactgtttcagagtcaaaatattgtgtcattattgagctaatctcaggacaggtcattcgaattcttcttcttcttcttcttcttccttctcctcctcctattattttttgctaatattattattaaaacaaatgacataggtgtcaatctaccgagcatgtatttgtatctaatataaagagcgaagtattcctccc

SEQ ID NO: 9953 - DNA, 652 bp, Sorghum bicolor
  Clone ID: SORBI-28MAY03-CLUS43475_1
gatgagaggtgaagaacttgagggattgagtgttgaagaactccagcaattggagaagaacctggaaactggtctgcacagggtgcttcaaacaaaggatcaacaattcttggaacagatcagcgaccttgaacggaagagtacacagctggcagaggagaacatgcaactgaggaatcaagtatcccagatacctccagctggcaaacaagcagttgctgatactgaaaatgttattgctgaagatgggcaatcctctgaatcagtgatgactgcgttgcactctggaagttcacaggataatgatgatggttcggatgtatctctaaagttagggttgccttgtgttgcatggaagtaaactgcaaaagaggctccgtgtggacctggttggagctgaggcctcagcggataagtacttgtgtgttatggtcttatggacgacccccgactactgcaataaacttgcattggaagcgagatcagttaacctgatttgtcatccttgtggcttcatgatgcgatgttccgcttgtaccgtttgctaggatgttaactgagcttttagaatcatgttcacttctgttcttatatcactgttgtactggtcgtgaaatctatctactatgcaaagttatgacccggcttgcaa

SEQ ID NO: 9954 - DNA, 749 bp, Sorghum bicolor
  Clone ID: SORBI-28MAY03-CLUS43506_1
cgaggcctatggcggtgcagacggcggcccactggctggcgtcaaggtcaagaacctgctgaacggggaggtctcggatcttcaggtggccggcctcttcttcgccatcggacacgagccggcgaccaaattcctgggcgggcagctcgaactcgattcagatggatatgttgcaaccaagccaggttccactcacaccagtgtcaagggggtctttgctgctggcgacgtgcaggacaagaagtaccgccaggccattactgccgctggatcagggtgcatggccgcattggacgctgagcactacctgcaggagattggtgcacaggagggaaagtctgattgactatatctgggtgtagcaaccagcagtccatcgaatggtcagttgccggtgctgaaagccgccctgtgatgtgcgtttatgccatgggttctcatgaactcatgattgaagaacctgacgatttatgctgcttagtatcatacattcttatcattaggatccagaagtacgtttgaactgtctgggcttctatttactggatacagattcatgattactgttttgaagtttttggcctagatatctctattgctcaagtctcattattgtgttaatggtggtgttatgctgagctcatctccgtcactgttgagcctctcagcttcgtttctttctctttcttttcagaatacattgatattttcattttggaacgcaaacattgatttgtcttgacgtgcaa

SEQ ID NO: 9955 - DNA, 692 bp, Sorghum bicolor
  Clone ID: SORBI-28MAY03-CLUS4352_1
gcacgaggcaaggttatcactagtttgccgccgcctgaagaaggacctaatctgagcttttacacacttgatgaacagcttgagcttttgagcaaggtgctgaatgcaggggatgacatgattggtgttgagcgcttagaagaagattctgatggcaaggctcttctaagagcacgacgctctgctggatcaatgagcgccttctctggagctggtggaatggtctacatggagtacagcactggcaagggaaaaggtgctcccaagaaacacaaggacccatcaaagaggcatcatctgttcaagaaacgctatgcgtagcctgttgtgctttgctagaactgatttggttcatgagaatcttcttgtttggcatcgaatgtcgttgccttataaacacacaagccaggttatgcagaactgttacttttgctcaattgtttcctcggttcgagcaaggttactgagctactgtagcaaagaccaattttgatctcaggtttacacgtgatgcttaaagttggcatacccggctttcgtgtgggacaacaggacgtgtcttgaaattgtaaatgctgttgtaagccttgtattatacgagtaaaaacacgctaaatcgcaacgcttcatatttgttgctaggttcaggcttcctgtatttcaactccaaaggaaactaagttttcgaaaaa

SEQ ID NO: 9956 - DNA, 757 bp, Sorghum bicolor
  Clone ID: SORBI-28MAY03-CLUS43598_1
gacaaaaatcaagaatatcaagaagaacaagaccactggagggttctcagtaactttcctgggcgacattgtggcaactggactgaaggtcgaggaccagctctcccttgggaagaggttgtcactagttgccagcactggcgcgatgcgagcccaaggggacactgcatatggagctaacttggaggcacgtctgaaggacaaagactatccgattggccagtcgctctcaaccttgggtctctctctgatgaagtggcgccgggaccttgctctgggcgcaaacttgcagtcccagttctcaatcggaagggggtcgaagatggcagttcgacttggtctgaacaacaagctgagtgggcagatcactgtcaggacaagcacctcagaacaggtccagatcgcactcctgggtctcataccggttgcagcctccatctacaggagcttccggcccagtgaaccgtcctttgcttattagcttgtctggaggagtcccagttttattatttcataaccatatcgtttctcttagcaattttccttttcatatgaaccatgtttccttatgttttagttcgctctgtaattcctatcataattttggctgaagagggttgtgagatttatctggaactatagctgaataaataatgtcgcgggatgtacggtccttgtggttaccaatctgttatagcgtttttaagtctgttctgattattcttgtgattatcaatctattagtgtttctaagtct

SEQ ID NO: 9957 - DNA, 1015 bp, Sorghum bicolor
  Clone ID: SORBI-28MAY03-CLUS44906_1
gcacgagggaaggcgactccttcctcgcggccgcccgcctcgaccccgaccccgaccccgatcgcttcgcctccgcgcgccgccgccgcgcgcgcagtgtccatcaacacggccgccctccgtgtgtggggcgcatctggtgctacctcgccgggctagggttggctttacccccgtctaccttttccgtctcgtctgacgcgcgcaggctccgtgcacgcggtcgtcggctctcgctccggttctgactgcgcgccgtcccccgcttgctccctcctgctacgggtgggccactgctgccgtcgcgtccaccgacgaattcccctacagagcaactatcttggagttggagatctatacctgaagattcatttgaaatctggaagcttctgttgttgggtacagagaaatatttcctgccttttgaggaagactgcagatcttctaaatgtgaaatttgcttcttttcttgtctactcctgaatgctgatgaactcagcctctcacgttacttagctcaaggtcgtactggtacggacactgaggatggagcaagcaacaggtgtaagtggtcctgagcacataattgatattccaagggaaattggtccttctgcttcggtttctcgtagtgttggtagagagaaccatgaagaattgaatcccgtggacaggccttcaacaagagctctagtacctgccttgcaggcaccatcagcaataggtgccgtacctaatgcagggcagacttcaggcactaggagaaatgataactatgttcgtcggcacagaagccctttgaattctggactgtggatttcaattgaagttatcgtcaatgtgagccagattgtagctgccattgttgttctttgtctgtcaagaaaggaacacccacaagctccattacttgagtgggttataggttacactgttggttgtttcgccacgttaccacatctctattggcgctatatacaccgtaatattgtaaatggtgagcatgaaccagcac

SEQ ID NO: 9958 - DNA, 722 bp, Sorghum bicolor
  Clone ID: SORBI-28MAY03-CLUS44945_1
tcgcaaacttgtgttcacaaacggtgacagagctcatgcttcaagggccttgaagaggctcgggatagaggattgctttgaaggagtcgtgtgctttgagacactgaacccgacatctcctccgcctgtcccagctgaggaacttcaaatctttgatataatgaagcatctgactcacccacagcctggagtggagctaccaaaatcacctatcctgtgcaaaccgtcaagggaggcgatgctgcaggctctcaaggtcgcctccattaatccacagacaactatattgttcgatgacagcttcaggaacattgaagctgcaaagcaaattggaatgcgtactgtcctggttggaacatctgagcggaaaaaaggtgctgaccacgccttggaaagcctccacaacatgaaggaagcactgcctgagctgtgggaagaagctgtgaaggatgaagatgtgaggaattcaagcaaagccggaatcgagacatccgtgattgcatgatcttttgttggtcacaaattagcccttttgttttccttggaggagaacacgaggtggtgaatctttgtattttttagcactgcctcttgtacgaaaaagagctcctaattagaggacaagaaaaccagctcctcaagggggtgggaggactgactgatcctgctaccactgatgttacatcccatatactattactatccgataagaatgcttgccc

SEQ ID NO: 9959 - DNA, 682 bp, Sorghum bicolor
  Clone ID: SORBI-28MAY03-CLUS44963_1
gatgctggactaggactaggagacgtcttgaagcctgatttggtcttgccactaattgagaacttgcccattgaacaattagcatcacatcttccggagggctcatggactcctgctgatatcattgagcttctccaaagtcctcctttgcgccaacagttagatgcattcacccacgttctacggactgggcagatagaccttgcacaatttggagttgaccccagcaaatataagttcacggttgcctcgttcctggaggcattggaagactcggttggaagaggtgcctctgaagctggagacaaggatggagaggcccagcgaggcagtgggaatgatgccatggacgagagttgatagttgataggggcagcatccttgtatcaagtcaactgctcatatggtgacaagtcttgtgttgttcgcatagaacgctagctagctagctcatggtattttggcacactgaaagtaagtctctagacaagttttggacattattactgtgatgagaagtagtgataggcaacagttcatcagacggtctggttggatggatcttggattcgatggcattgaagcttggaaggctggattgtttgttttgggggtaaatcttgaatgtctgtgctctttgctgacgttttgaacgaggcttggtaaacaaattgcattttta

SEQ ID NO: 9960 - DNA, 561 bp, Sorghum bicolor
  Clone ID: SORBI-28MAY03-CLUS45323_1
cgccattgcgtttcctgacaaccagtgctggtggcctggcaattgtgaccagcggcatgtattgtgtcgggcgatatgtgtcggatattggtgttcggcgtgatgttgtcaaggtccctgtcgaaaggcttgtggaacagaatgttacttcgattcctcaaagtcgggctacagagacagatatcacatctggagcaccacagcagcagatggaggttccttgtgtggttgctgaggaagcatccattataccccccacagcgccgtgatccattggtgaaatgtcatataacaggtgttggcatgagacaagacaactggaactacttgtgtggaagtatatgtaatgatgtatgtatctggtggtgttatgtaatccatggtagttgctgctaatgttccaagcaagcaatgatgatgttggatgtgattccattgccgttattattacagaatttaaaagacctgtatttgcactcaattatgcaggagcttgatgatgtctgttatacagttgcttatggatgcatctaatctaattgtgcaaagttgctatacatt

SEQ ID NO: 9961 - DNA, 1064 bp, Sorghum bicolor
  unsure (1)..(1064): unsure at all n locations
  Clone ID: SORBI-28MAY03-CLUS451_1
cggcgtggccggatttgcgcgcggcaacatcgtcgtctatgtagcaacgacggccggcggcgacacatggccattcatggcgcatacacctgcgatggagaatagctatgtacaggtacatcacctcgccacctccatggccatccacacccacaaaccatttcttgcccctccaaaacatgtacaccttgcgtttcactctcccactagcgctcctagtaggcttctagctaccaccaggagtcgtcccggattgagccagccagcggcgatgatggcggagacggacgccgacaagctccggttcatcgaggaggtgacggccgacgtggccgccgtgcaggagcgcgtgctggcggagatcctctcccgcaacgccgacgccgagtacctctcgacgcggtgcggcggcgccaccgaccgcgccaccttccgtgccaaggtccccatggtgacatacgaggacctgcagccgtacatcctgcgcatcgcccacggcgaccgctcccccatcctctccgggtccggctaccccgtctccgagctcctcaccagctccggcgccggcgaccgcaagctgattcccgtcgtggacgacgaccacgaccgccaccatcgactgcacagcctcgtcggggcagtcgtcaatcagtacgtgccggggctcgacaaggggagtggtctctacttccttttcgtcaagtcggagacgacgacgcccggtggcttgcctgcgcgcaccatcctcacgcgcatcttcaccagcgacggcgtctggaagctcccctacaacccccgccgtggcctcacgagtccggcggcggccgtcgtctgcgaggacacgttccagagcatgtacgcgcagatgctgtgcgggctgtgccaccgccactccgtgctgcgcgtcggcgccgcgttcgcctccggcgtncttcgcgccatccgtttctttcagcggaactggccggagctcgccggggacattgacgccgggacgatcaccgaccgcgtcactgaccacgttctgcgtcaggcgctgtctagtgtgatacacatatttacct

SEQ ID NO: 9962 - DNA, 659 bp, Sorghum bicolor
  Clone ID: SORBI-28MAY03-CLUS43806_1
gcacgaggatcctcccttcccatcccgaccgccgcccccacctcctccgcggccgcctcgcggcgattccactcgcccccgactcccatcgcaggggcatcatcgtcacctcctccgccagctcccttcctcttccggagcttctcgtgcggagaggagccgaggaggcggtggtggtggtggcgcccgaaccggcgtcgtcgccgccgacgccgctgccagccgccatggaggcgtacaagctctgggtgcgcaggaacagggacctcgtccgccccctcgagtccctcgccaacgggttgacatggatactccccgagcgctttgccaactccgagatcgcgccggaagcagtatatgcactactgggtgttgtgagttctgtcaatcagcacataattgatgcgcccactgagaatcactcatttgcctccaaggagcaatctatcccatggggtcttgttgtctctgtactaaaggatgtggaggcagttgttgaggttgctgcccagcactttgttggcgatgatcgcaagtggagctttcttgctgttacggaagcagtgaaagcaggtgtcaggttagctgcttttcgggagagtggatacaagatgctcttacaaggaggggaggtggcaaatgaagaagaggtgactgtt

SEQ ID NO: 9963 - DNA, 596 bp, Sorghum bicolor
  Clone ID: SORBI-28MAY03-CLUS43816_1
atcgcatcgcaagtaacctccccgtttcgcttgctgcttgtcatcgtctcccccggcaaaggcgggcaagcccgcagccgcagggccaagccgtgagcaagctcgatcacctcgtgccgaggcccagctagctcatctatataagcgccagcctctctctccccactcaaagcaagcccccagtgttagctccacacgcgcacagaggacggaaggggagagagagcagcgaacgagaggaagagcagctgcgacggcggcgagcgggcaattaacgccagacagataggtgaggtggtagtggtagtagtagtctggtagaggtagagagagagagagagagagagagagagagagagggtggggaggttagcaaaggtataagctgtgggcttccgcaatgaggtcgaggaggtcgtcgccttcgtggcggcggagcgtggtcgccgcggtcgtcatagcgttggctgcgtcgtggtccgcggcggcggcggcgcaagcgcagctgagccagagctactacgcttcgacgtgccccaacgtggagacgctggtgcgcggcgccgttatccagaagctgccggagaccttcaacg

SEQ ID NO: 9964 - DNA, 631 bp, Sorghum bicolor
  Clone ID: SORBI-28MAY03-CLUS43930_1
gcacgaggatgcttccgtccgccgcggcgctgcatccctcttccctcctccgcctcctctctctctctctagctctagctctagctctctctctctcgcgcgcgctcccagacgactgttggctcgccgccgccccaggccaggtgctgaggcctttcttggcctcttcgccggcgacgagcacccaccaggcaccccttctcttcccttccctgtacgaaggtgacaccatgatattgatgtgaagttttgtggcacttcctgcatcccttatatggtattaacaaggtttttaattgtctgggtgatccatttatcaaatggaaggcaacgacctaccccctggaaacatgttgcaaggggttccctatgatactttagacttacgtggcagctctatgcaaaagcatactccaaactcaggaaaacagatcttcagtagctcccagatgccggggactttcacaatgtctatgatcagggctacagagcctgatgactttcctggctttcagttcaaagaacatggaaagagtgatgaccaccaccaccaacaccatagtcatcactcaaagaactgcaaaagtgatggcgaggaacatgatgtggctgaagatgctattgatacccc

SEQ ID NO: 9965 - DNA, 889 bp, Sorghum bicolor
  Clone ID: SORBI-28MAY03-CLUS44008_1
gcccctcgttccatgttccaacacatcccaaactgcacacggctctccgctgcccactggccccgcggcccgccctccatgccgtcggcttccctccgcctcgccgtcgtcggcgcgggcgcggcgggcctggtggcggcccgcgagctacgccgcgaggggcatgcgcccgtcgtcttcgagcgcgccgccgccgtcgggggaacctggctctacacgccgcccgccacgtcctccgacccgctcggcgccgcggcgacgcactccagcctctacgcgtcgctccgcaccaacccgccccgcgagaccctcgccgtcccccactgcccctgcgccgctgccgccgcggccgcgggctccccccgagacccccgcaggttcccggggcacgaggaggtgctccgctacttggaggcgttcgcgcggcggttcgatctgctccggctcgtccgcttcgagacggaggtgctcagtgtgaggcgggaggacggcggcggcgggaggtgggcggtgacgtcgaggaagctcggggagaaagggagcggccaggaggagttctacgacgccgtcgtggtttgcaatggtcactacacggagccacgcatcgccgtcattcccggggtcgatgcttggccagggaagcaaatgcatagccacaattaccgtgtgccggagccattccttgaccaagtagtgatcgtaattggggcctcggcaagtgcatttgacatttctcgagacatcacaagcatggcggaagaggtccatattgctgatagatcagcaccagcttccacctgtaagaaggagcctggctatgataatctgtggcttcattccatgattgaccatgcgcaggaggatggcactgtggtgttccaggatggca

SEQ ID NO: 9966 - DNA, 688 bp, Sorghum bicolor
  Clone ID: SORBI-28MAY03-CLUS44010_1
tactgggcggatactccatctctggaggtccatttcgcaaaaccgcgccagcaccaaccgccggtcgtctcgtccccttcctcctcccgcctcgtctccgacgaccccatcgcctccgccctcgcctcgcctcgcgcactctccgatccaatccctcccttcccttcgccggcgatgcatccctcctccggcgcgggggactacgccccctactaccctccttacccctccccggcttccgcgccgcctcccgccgccgcctacccgtcggtgtccgccccggcttccgcgcccccgtactcgtcgtaccccgcggacttcgcccccgtgccgtcgtaccccgcgtacccgcccgccgacctctcccactacgcgccgccggccaccgcgcccgcgcccgcgccgccgcagccgtactacccctacgagccggcgccgccgctcccgcacaacccggtgcccccgtacccgtcgctggatcgggcggggacctacggctacggatccggccctggctccgggtacggccaggagctgtacccgcccaagccggcgggcgggggcgggggcgggtggtccgacgacggtgcgtacgcgtacgacggcggcgacgcgcccgagccctacggggccagaggcacagcaccgaggttgggctcgggatccgcgctgtttgatgactacggga

SEQ ID NO: 9967 - DNA, 1475 bp, Sorghum bicolor
  Clone ID: SORBI-28MAY03-CLUS45961_1
ctactggacctcccctctctcttctcctcctctcctctcctctccacccttcaccgccgccggaaaagcaggttccattccatcctcgtctccacttgcccgcgattcctctcaccctctggggagggagaggttcgctcggctcactcacccactcactctggtatatcggcggcggcggcggcggcggcggcgccctctattccactccggtccggtgcactccatgaactggaccgtgacttgttgaattctcttcctgccgccgtcacatgaggaactagagggtcgggggaagctccagcgtctgggtcaactgtgctggcccgccgctccggcacgccccctctggagctccgtctggtgcttcctggccgtctcctccaccaatttctgagccaggatcttcttctcttctcttctcttctcttctcttctcgtgctactactattgctcgagcaccgcgccaaatccgtggagctgtcagtgcagtaggcaactcttgtcgtgccggggtgggtagttgcggccaagggaacacgccaccttctccgagttggaattaggtgcggccctccgcctcaaaagggctggtttggtgggaactttcgcttgcctactcgctgctttctcccgtggtcctcactgatggagattgctggaattggagttggaaggacattctgattgaattggttgggtgggtttagtgtccattggctgaggatggaggagaaggtattgtccgaggcagcctcgaggggtgaggatgacttcaggagctgctgtggggatgaggaagagtgggaggacaccgaggaatcgttcacggccggcatcggaaagggggagcttgatgaggcctcggtgcgcctcttcttcaagggcgtgtcgagccccgaggcagaggggaagaagctctctgggatcggcgtcgtgatggagaggtcccctggggtgcctgttcttaaggtgcagaagaagctggatttctatgtcgaggagctggtggctgagcacctcgcgctcatggatgggctgctagtcgccctgcagaatggcatccggaagatcttcgccttcactaattcggaaaagctctactttcagatagcagaagctgaaattcttgaagatcagcttttggtagctttaggacacaggattcttgaactggtggataagttggaagactttgatttgatattgcttccaagctttgaactcgagaggcccttgcagttggccaaagaagctataggcatcagatatctgtctccttatgaggttggtacctgcccgatttgccgtgaggagaaactaggttctcagatgatcaaggcaggttgttcgcacacatattgctataattgcctgactgggtatattgaagacaagctgctgacctcaaagctgcctataaggtgtccacaattaaggtgtaaatatattatttctgctagcgagtgtaaat

SEQ ID NO: 9968 - DNA, 1439 bp, Sorghum bicolor
  Clone ID: SORBI-28MAY03-CLUS45988_1
gcacgaggcccgtcgctcggacccaggacgagtttagcccggagagaaaaggacaaatcacacacacagacagagggaacaaaaggcacaggaaccgggtcgagccaccgtgggacgcgtacggcgcaccgcccggccgccggatctgcgccggcgacgcgaccggacgtcggatctacgccgccgcaggaggagggaggcggcgctgtggccgttccttgcccgcgagcgcccagatccgtcccgccggatatatatacggtcctgtgatatcgagcttcagttgatgcagaggtggtgaaaacatctttcttcttcaaagagtgctggttgcaagttgcaaaagtttgtcttgcccttgctgtgttgttgctgccttctctggtggagtacacaagagaagtttgcagatattggcagctcctttcagctcttctatgtccagggatttggactgtcctgttcagacacagatggctgtggcagtcctggatcggagctttagcagtgaatatcctggaggtagcagaactgaggggaggcagctgagctggaagagagtctttgtccaaactgacaatggttctgtccttggcatcgagctggagagaggagaaaatgtgcaaactgtgaaaaagaagctgcagatagccctcaatatgcccactgatgagagctccttgacctttggtgacctggttctgaataatgatcttagcagcattcgcaatgactcaccattgcttctcaaaaggaatcagattcaccgaagcaattccacaccatgcctctcccctactggcaaggatgtttggcaaagagacccgcgtgggcccattgaaatccttggctgttcaagcccttcctctcggatgaagcagcttgctaaagatgtcattaaagccataaagaatggtgttgatccagttgctgttaacagtgggatgggtggtgcctactacttcaagaacatttggggagagcgtgttgcaattgtcaagccaacagatgaggaaccatttgccccaaacaatccaaaaggttttgtggggaaggctctgggacagccaggcctaaaaagatctgtgcgtgtcggtgagacgggcttcagagaggttgctgcttacctcctcgactatgatcactttgcaaatgtccctcgcaccatgctggtcaagataacacacaccatcttcaatgtgaatgactgcgttggctgcaaaactaaagtattctgcaacaaatcagaggctgtgagcaagattgcatcactgcaggagttcattcctcatgattttgatgccagtgaccatgggacctcaagcttccctgtatctgcagtgcatagaattggcatacttgacattagaatcttcaacactgacaggcatgctggaaatcttctggtcaagaagcttggtcctggggctgacaatttt

SEQ ID NO: 9969 - DNA, 1052 bp, Sorghum bicolor
  Clone ID: SORBI-28MAY03-CLUS45973_1
gcacgaggcaccccccaccaacctctccccctcaaaaactatccaccccacccccaccgtccacccccacctcacccctacccgccgacgagcgcgatcgattgattcgcttcgagccgggcggaggaggaggaggagggagcgccgggcggcggggggaacccaccagatccggcggctatgatgaagtcgctgctgccgcagagccagctgcggcgctcgtcggcggcggccgcgcggtcgtcgtcgggcggcggcgcagcggggggagacggggctatggccgacggcggcggcgcgggcccgcgggcgccggcctcctccaccttctggttcctgctccacgcgctctgctgcctcatctcgctcttcctcggcttccgcttctcgcggctcctcttcttcctgctcttctccaccaccgcgctctaccactccaccacctcgtcctcctcggccgcggtcctgcgcgccaccacgactaccaccacaacgacgacaaccacgacgacgaccaccaacaccttcacgctctccttcgccgccgccaacactcccccttccggccccgctaaccgcaccgcgctggaggcggcgggcgacaacaagggggcggcgtcgtcggggaacccgcagagccacgtcgtgggtggggaggcacgggattcggatccggccgtggccgcacccggaccccgtcgaggtgatgcgcgcgcaccggatcatggagcgcgtgcaggaggagcagcggcgctggtacggcgtcaaggagcccaggcaggtgcttgtcgtcaccccgacctactcccgtgcgttccaggcgctccacctcaccggcctcctccactccctccgcaacgtgccgtacccgctcacctggatcgtcgtcgaggcaggcggcaccaccaacgccacggcgtcgatgctggcgcgctctggcctcactttcgtccacatccccttccctgaccgcatgcctcatgaatgggccgaccgccacgccactgagaaccggatgcgcctccacgccctacgcgtgatccgtgagagga

SEQ ID NO: 9970 - DNA, 884 bp, Sorghum bicolor
  Clone ID: SORBI-28MAY03-CLUS46012_1
ctctagaagcagataatctgctttggttagctgagattttagctgacaggaatgctgctgatgagttcgctgtcatatgggctagccaacgtgagctggctgggctgcactccaagttgccagttaagtcacgccaccttgtcagttgtgtcacagcgaggctatttgtggcaattgggaaaggagagatgcttccttcaaaggacacaaggaggcttctcttggatgtctggttgcagcctctcatggatgactacaattggttacagcacggttgcaggtcattcgaccggaaagtggtggaggaaggtattgggcggaccatcttgacgctcccgctggaggatcagcagacgatcttgctgtcctggcttgggagcttcttgaaggttggggacagctgccccaatctccagaaggcctttgaggtttggtggaggagaactttcataaggccttacgctgagcaacaaggtaatcgatcgcaatcaggtcggagttgaaatatcaatcggttgcagaagaaaatagtcttgtttcctagtgtagtatattgatgagaaattagagtggtaatttcttacatggtaggctgtttgggaaatccccaggatgtggaagaaatgggggtgtaaggattagtgttgttgacttggaggcttgagaagtgtgcattgtgcttgtgatgcttcatatgtatgtgaagatctctgaattctgggtacagaattttgttctcttgtatgtatatcatggagcatctgtttgctgctctgttctgcttcttacaacgttgcacgatgttaattctattgtgctaaggatctgttatttaaaaactcgatgccttgtgcaactgtaaatattttgcaggaaggcaaaaa

SEQ ID NO: 9971 - DNA, 1299 bp, Sorghum bicolor
  Clone ID: SORBI-28MAY03-CLUS46080_1
gcacgagggccgcgtcctcctcgcgctctaccaccccaggaaccgctacatcttgcacctcgatgccgaggcgcccgactccgaccgcaccagcctcgccgccgacctcgcctcccaccccgccatcgccgccgccgccaacgtccgcgtcgtcgaccgtgctaacctcgtcacgtaccgtggacccaccatggtcgccaacacgctccacgccgccgccgccttcttgtggggtcacgccggcgacggcggctcacaatgggattggttcatcaacctctccgcctccgattacccgctcgtcacgcaggatgatctgatacatgtattctccaagctgccgcgtgatctcaacttcatcgaccacaccagcgacattggatggaaggagttccagagggcgaagccggtcatcattgatccagggctctacatgaagaagaaggccgacgtgttctggataccgcagaggcggagcgtccctacagcattcaagctattcactggttctgcttggatggcactgtccaggccctttgtcgaatactgcatatggggctgggataacctacctcgcacagtgctcatgtactattccaatttcatctcctcgcctgaaggatacttccacactgtggtctgcaacgccgatgaattcaagaacacgaccgtgaaccatgacctgcattacatctcatgggacaaccctccaaaacagcacccgcactacctgacggttgaagacttggaccgcatggttgccagtgacgcgccatttgctcggaagttccacgaggatgatctggtgctggacaagatagatgaggagatcctgggtcgtggcgtggacatgccgactcctggaggctggtgtgctggaacgcgggagaacgggagcgacccttgcacgatgattggaaacaccagcctcctccagcctggccgtggagctgtgcgactgcagcggctgatcacgttgttgctgtcggaggagaagttccacccaaggcagtgcaagtaggtggatgcctgactcagctatatatgatatgatacacatgcatgaactgctgctgctgttagcgacacatacataggtccgctttgacttgtagttggtcgctgttttgccaggcagctaggtgcctgccatttaacctgtgctacattgctgttgtactaccacactagtgtctgtagagccctgttgtatccacattacatgtgagactccaatatgtactttgtcgtcacaaggtctaaaccctggacaaccctgtgatctatatattttagctt

SEQ ID NO: 9972 - DNA, 1124 bp, Sorghum bicolor
  Clone ID: SORBI-28MAY03-CLUS46049_1
taccgggcccccctcgacgagctcctcctcaacgacgacgacgagttcgagggcgtcggcgcccgcccctccgttccctccccgccggcggccccggcgatccccgcgccccgccgcagatccgcggacgcgccgttgcccggggcaggcgagtccaacgcagtgcagttcacgctcgagcacgaccttggcgacggcaagggcttcgtcccagctggaaccttctcggcccgcctcaagaccttcgcccacggcacgcagaccctcactaagcttcgctttacaaggaatgatttaaatgaggatgataaagtggctttcaagaaactgcttcaggaagatggcttttatacaattaggctgccatctaatgtgttggacactacaaagaaacataatgttgcttcttcaatcaaagctagatgcattccacgtgacagtttggatgaacacattgttatccacatggatggtgtaaatattttggcagtcaattatggctctgttggtggatgccaataccctaggccaatgaaattgccatcaaaatggacattcagctcttacactatcctgaagactgctgaacaggcaccaagaaccccatcatttgcagatcagttaatagaagctgacaatggtcttggcgaagtaatgaaaccacctgagaaatctttctgggctaaatattggatgtacatcattccgcttggtcttattgtcatgaatgctgttacggcagctgccaatataccagaggaagctgcagggcagggccaacctggagcacaacgggcacctgctgctgctgccgggaggagaagatgatggctgcctctatgttttcccataccacagattcaggggtaatggtaggagattgaacctgtctgtacctggccagaagaactggagctgtacttacacgactcatacaatagtgcgctgatgggctctttctttcttttccctggttgtattgagctgctctgtttatagcagaatcaccttcaatggtgtggttaaacacatttgttgttgagaagctgcaatcaatctttaacacagttcacaattgtatgttttgatattaagtagtttgatatacggaatttttgtgctgg

SEQ ID NO: 9973 - DNA, 608 bp, Sorghum bicolor
  Clone ID: SORBI-28MAY03-CLUS44782_1
tccttctcgcctgctcactggtgaagaaagaaataatgctccaaaaggttgccatgagttggatcctgctgcaactccagttgacctgcttaagattattacagatgtcaaggaagataccacacagtgaagctccgagtagaactcaacttgtctgtcctacagacttgcaactgcaagctagcatggctgaagtctcaatatgtgcttcactcactggtcagcatcatatggctcacttgccttaatctatcattgaacttctggatgacgatgaggacttaattaggcatttctaacatttaattttattgtaatatcgatatcgtatagagtaaaaacgattatcgagaggctgcatattgtgctgaggccagttctcaaaatggcaggtctcatgacttgctgcgaggttggtgccactaagtgatactcgactgtaaggttatgtcaagtaagagcgtagtttgagactgctgctaggttttactctgtacccgtactcatttacttatcatgttgtattttcattaatgcatagcataatccttatataatctatcgtattcagttattttgattaaatattatgtcttttctgtggtgct

SEQ ID NO: 9974 - DNA, 916 bp, Sorghum bicolor
  Clone ID: SORBI-28MAY03-CLUS44815_1
catggactccggcggcaccggcggtaggccgggcacctgcacctccccttccacctcgtcgaactccacggggacggactcgtggagcacgggcaggtgcagcatgagcgcgagcagggcggccgtggacgacatgaagacgtaggacggcaccccgaggccccgcgccacgtcgaccaggggcgcggcgaagatgtcgagcacgagcgcggcgacggggcacgacatggcggccacggcgtccctgacgtgcggcgcgtggagggcgatgtaccgcgcgatgaactcctcgacccccgcggcgtccgagggcgcctccacggcggggaggcggtggaagcggatgtccagcccggacgcggcctcgcggcgcacgtgcgcctccacctcggaggtggcctcggcggtgggcgggcgcatgacgagcagggtgatggtgaaggccttgccgccgccgccgccgccgccgccgccgctgaggaggacgcgcttgcaggactcgagcatggacatgaggtggccggtgccccactccggcaggagcaccagcgcgggcgccgccatgggaacaaccgtcggtgtaaggctgtagccgtaactctaacttcactgctgttcggtggtggagggtgatcacccaccccacaccccccggatggcaggatgggcgagcacgggacttggaagttgaaaccgtactctcttcagcagattcggcaggtgcttcttggtctgattaggatagcgcatcacttttctgcgtagacttggtctggttaagacattgtttagttccaattttttgtcaaatgaactaattaaactcaaaagatcggtcttgtaagttacagaaaaactatgtaattagttatttttatctatatttaaagctccaatgtatgtgccgcaagagtcc

SEQ ID NO: 9975 - DNA, 903 bp, Sorghum bicolor
  Clone ID: SORBI-28MAY03-CLUS4453_1
acaggtaagcccaaacgactgtgccgcctcttcctcctcctctgcaccccacgaactccactccatggccgccaccgccatggttgcgattactaatttaggctgccgccatgacccgctctcctcccttccccgcgccacgtcggcgcccgcccgctcctgtacgcttcctcctcgccgccgccgatgcagaccgctcactccccgttcttcttgctgctccccgccttcctcctccgtctctccgcgccgggtcctccggccaacagcagcactgaagcgcatccctgccggcgacaccagcttcgtgggtccagccaataatgacgccaccacgcttaaccaccgatcgtcatcgtccgaccttcgccgaagtctgatcatccccaactccaccgctagcaccggacacgccactgcttcctcaggagtgctcccctctattcttggggtggcacatctggctgtgtcgctgggcattatgctcgccgccgacaagttcctcaaaaaggcattcgtcgccgcgggcatcaagttcccaagcgccctcttcggcatgttctgtgtcttctccgtgctggtcgtcttcgacatattcgcgcctcctgtcgccaaggcgttcatgaacttctttgagcctgccacaatgttcatcaagaggtggctacccgtgttctacgtcccgacgctggtcgtgtttccgctcgccatcacggagatcccagcggcttcagcgctcaagatttttgcaatcacttgtatgtattattctcgttctcgatcacatttttcatttcatcagaacattaataaactggaacggctacttttatactgtttttgttttgatttgatttttcccgctttttcagttggtggctggtttgctaccctcacggttgc

SEQ ID NO: 9976 - DNA, 261 bp, Sorghum bicolor
  Clone ID: LIB3481-040-P1-K1-A11
cgtccgccacaatgttcatcaagaggtggctacccgtgttctacgtcccgaccctggtcgtgtttccgctcgccatcacggagaggccagcggcttcagcgctcaagatttttgcaatcacttttggtggctggtttgctaccctcacggttgcaggatatacagtgttagctgtgagaaaccttgtgaaaacagagcttattccagatacagagcctgtgagcaagccgtccccattttctacgtcggaaatcttgtcat

SEQ ID NO: 9977 - DNA, 1177 bp, Sorghum bicolor
  Clone ID: SORBI-28MAY03-CLUS446_1
accaaaaaacacttctctggttgttttacctacttatgctacaaatccgggtgaggctgaccgcctgagattcttggcctctgccgctgggaaggatgagtatgctcaatgggttgtggcaagtcaaaggagcctgttggaagtcatggcagagttcccttcggcaaagcctccactaggtgtcttctttgcagctgttgcccctcgtcttcaaccaaaatattattctatttcatcttcacctagtatggcagcaaccaggattcatgtcacatgtgcgctcgtgcacgaaacaacacccgctggaaggcgtcataagggagtctgctcaacttggattaagaatgctgttccatcagaagagagcaaggattgcagctgggctccgatatttgtgaggcaatcaaacttcaaactacccgctgatccttcagtgccaatcatcatgattggccctgggaccggtcttgcacctttccgcggcttcttgcaggagagactagctcaaaaagaatctggagctgagcttggtccatccgtgttcttcttcggatgcagaaatagcaagatggacttcatctatgaggatgagctgaacaatttccttgagcaaggagcactgtctgagctggttcttgccttctcgcgtcagggccctactaaggaatatgtgcaacacaaaatggcacagaaagcatctgaaatctgggacatgatatcccaaggtgcttacatctatgtctgtggtgatgccaaaggcatggccagagatgtacatagagttctccacaccattgttcaggagcagggctccctcgacagttctaaggccgagagctttgtgaagaatctccaaatggagggcagatatctgagggatgtgtggtaaaaagcgattgtgaaatatgaaaaaaaaatggtattcaggggataaacactcattcgcattacacatgtgtacaactattaccggaagagtactgacaatggcctagatctgatatttttattggttctgtatttatttttattttctctcattttctttcgcttttgaggttctcccaagtgccttttgttttcttttgtctttgaggttctctcaagagttttttgtacctatgtattataaattctttatatatatatatatgtataagatgaggacaatttggcc

SEQ ID NO: 9978 - DNA, 445 bp, Sorghum bicolor
  unsure (1)..(445): unsure at all n locations
  Clone ID: LIB3480-007-P1-K1-B1
ctctgcatctgttgtttctcatgcaattgtcgacatttttggcaaacagggctccctcgacagttctaaggccgagagctttgtgaagaatctccaaatggagggcagatatctgagggatgtgtggtaaaaagcgattgtgaaatatgaaaaaaaaatggtattcaggggataaacactcattcgcattacacatgtgtacaactattaccggaagagtactgacaatggcctagatctgatatttttattggttctgtatttatttttattttctctcattttctttcgcttttgaggttctcccaagggccttttggtttcttttgtctttgaagttctctcaagagttttttgtacctatgtattataaattctttatatatatatgtataagatgaggacaantttggcaataagcctcactgtgttattagtactattg

SEQ ID NO: 9979 - DNA, 736 bp, Sorghum bicolor
  Clone ID: SORBI-28MAY03-CLUS44826_1
gcacgaggaccactcacgagtgtaccagcgttgccgtttcacctcggtacccagtggttcggttcctcatcagaggagaacaggaacttcctcctctgcgtctttgaaggcgtgctaaagatctccaacaacaagaggtccaagatgaggacgatccctgcggttctcctgctcctcatcctagtggccgccgccgccgcctcgttccagggtctcaccgtggctgcagacaccagcggcgcggtcccggacggcgtgtgcgacggcaagtgccggagccggtgctcgctgaagaaggccgggcggtgcatgggcctgtgcatgatgtgctgcggcaagtgccagggctgcgtgccgtcgggcccgtacgccagcaaggacgagtgcccctgctacagggacatgaagtcccccaagacccagcgccccaagtgcccctaggatatgcatgatccgtcgatcgagctcgcaggattaatttcgctcgcgatcctgcacagattgtaaggtgtttgttggtgtcgtgctcgtgcgcggccgtgcgtcggaatctccggagttcttccgcgtgtgccgtgtcgtcgtctatggcttgtatcctcggccgtgctagaataataaacaatgctgccagatcttcgtgtcctatgacatgtcggaaccaaatttcgaaggggattctactgcgtactgtcacccgatgatggcgatacaatggcattatttggttcccctg

SEQ ID NO: 9980 - DNA, 836 bp, Sorghum bicolor
  Clone ID: SORBI-28MAY03-CLUS44859_1
gcacgaggccgtctccttccctccctccagatctcggcgcgagttcaccctgcagatttccatttccaacacgacggcggagaagagctgcggtccggagaagtaaaccctacccgccgtctcgcgccggttgcccggtgcgcgggcaagatccaggcggagatctagggcgcggcgccggccatggcgagctccggactcgcctaccccgaccgtttctacgccgccgcggcctacgctgggttcggagccggcggggccacctcctccgcagcgatctcccgcttccagaacgacgtcgccctcctcctatacggcctgcaccagcaggccacggttgggccatgcaatgtgcccaagccaagagcgtggaaccccgtggagcagagcaaatggacaagctggcatgggcttggaagcatgccttcagcggaggcgatgcgtctttttgtcaaaatcttagaggaagaagatcctggatggtactctagggtccctgagttcaaccctgagcctgttgtagatattcagatgcataaaccaaaagacgagccacagagtgtaccggcttcaacaaatggaacatcaattccagaaccaaaaatcatttctgaaaatggaagttctgtggagattcaggacaaagatgttatcctggaaggccttagtactgttagttctcatgatgagtggactccattatctgtcagtggtctccgtccgaagcctcgttatgagcatggagcaactgttttgcaaaataagatgtatatatttggtggaaaccataatggacgttaccttagtgaccttcaggctttggatctgaagagttt

SEQ ID NO: 9981 - DNA, 497 bp, Sorghum bicolor
  unsure (1)..(497): unsure at all n locations
  Clone ID: SORBI-28MAY03-CLUS46479_1
cctactggaaaaaaaaaaaaaaaaagaaattcacacttggccttcctccctaatcccacttatcagcatcacgccatcgcgcccccgcctgagcgccgtcttcggtcgccatccctgcatcgccgctgccgccatgcgccgcttcgcagccgacagggcgcgccgtgcggtggccacgtccctgcgcggcgcggcgtccagatcagcagcgccgtcgcctcacgctccggcgccgcgtcatccagccgccccggtgggggcggcggcgatggnggncgncatggngagggncatgtncacggnggncgtcggcgcgccgccggtgtcactcnacaccatcaaccccaaggtcttgaagtgtgaatatgcagttcggggagagattgttacacatgctcagaacttacaacaagaattgcagaagaatccagaatcacttcctttcgacgagatactctactgtaatattggaaatccccaatcacttggacaacaac

SEQ ID NO: 9982 - DNA, 1062 bp, Sorghum bicolor
  Clone ID: SORBI-28MAY03-CLUS46618_1
gcacgagggttccgagtccccataccggtccccctctgcgctcgcggagcctccagaccctccacccgccgcctcctctcgcgccgcgagagattgatccgtccggcgatctgggccctccggccggcgcccgcgcctgggaggcttctccttccccgccgcacaggcggagatgctctcgctgcaacagcagcacggcggcgccgtcgccggcggcggcggcggcgacgcgcgcaaccacgcaccgcagccggcggtgctcggggcaggcgtggactggctagcgttcggggcccgcgccgacctggaggagcccgcgaggaatgccccgtcgcccgccttgttccttctcccgcccgcgccgctcgacgacagggcggcccagcccgagcccaagcccaagcccggacagctcgccggagctgttgacgaagagcggcatttggcactagctcatcaaaactacaggtcagggaagtacagagaggcattagagcatggtaatgtcgtttacgagaagaatgcacgtcgaactgataacctcctcctccttggagctatatactatcagattcgtaattatgacatgtgcattgcaaagcacgagggaggctcttgccatagatccacaatttgctgaatgctatggcaatatggcaaatgcttggaaggagaaaggcgatattgatcttgcaattcgttactatcttactgccattcagctgcgaccaaacttctgtgatgcatggtcaaatcttgctagcgcatataccaggaaggggagactgaatgaggcagctcaatgctgtagacaagcacttgctataaatcctcgattggttgatgcacatagtaatcttggaaatctgatgaaagctcaaggtttcattcaagaggcatacagttgctacatcgaggcgttacgcatagatcctcattttgcaattgcatggtcaaaccttgctggtctgtttatggaggcaggagacctcgacaaagctttaatgtattataaggaagctgttaagcttaagccatctttcgccgatgcatatcttaacc

SEQ ID NO: 9983 - DNA, 819 bp, Sorghum bicolor
  Clone ID: SORBI-28MAY03-CLUS46755_1
gcacgcgccaggccagagcaaaaatggaagcagcagaagctgtcactgtgggtgtggggggcagcatcggcgccccttccgcgcccggcggcgtcctgctcctcttcctcctcgcgctctccaccctcatcatcatcatcagatggagatggaataataaccgcaacagcaggctgccccctagcccgatggcgctcccgctcgtcggccacctgcacctcatccggtcgccgccgcacaggtccttggaccgcatcgtgaagcgctacgggcccctcgtctacctccgcctcggcccctccacgcactgcgtcgtcgccggcaccgcggacgccgcacgggacctcctcaagcacgaggccagcatcccggagcggccgatcacggtcgtcgcgcaccacctcgcctatggcgacgccggcttcgccttcgcgccctacggcgcgcactggcgcttcatgaagcgcctctgcatgtccgagctgctgggcccgcgcaccgtcgaccagctgcggcccgtgcgggaggccgagctggcggccgtgctgggggcggcgcggcaggcgtcagccagcggggagcgcatcgacgtcagccgctacctcatcagcatgtccaacaacgccatcatgcgcatggtggccagcgcgctgccgggccacatgacggaggcggcgagggactgcgccaagcacgtcgccgagctcgtgggggccttcaacatcgaggactacgtcgggatctgccggggctgggacctgcaggggatcacgcggaggacacgcgaggtgcgagacaagttcgacgcgctcatggaga

SEQ ID NO: 9984 - DNA, 1218 bp, Sorghum bicolor
  unsure (1)..(1218): unsure at all n locations
  Clone ID: SORBI-28MAY03-CLUS4656_1
gcacgaggccctatcgatcgaccttgcaaggtttaatccggcagaattccaccagaaattcattgaagtgctaatcgccttcctgccgggtcctcgtggctctgcgctgctcccgctgtggtgagaaaccctaagaatggcggaggtttcgacggcggcggcgcccgagggggtgctgcaccggcggattgagttccaccccgcgcggaggccgcatgcctctgtggcggtgggcggaggcgggttccgtatggagacgctgaaccctgacgccgctggtaaggcgggggccggggcggcggttgggagcagcgagggggaggcgacgaggtcggagaaggcggacgccggcgggattgatccggagctcagcgtcgccaggatctacctagggagaattggggctgccctgggttgtcgtcggtgtgcctgcggcctcttctccgttctgctttgcttggcgttcgcggggccctgcgccgccgcccggctcggcggcccccacagctccccatgtcgcgcgccgggattttgcgcagctggggctcttcggtaccttgtcgtgactcctcgtgtttcttctggtcgcatcgtggcaccatttcgtattgtcaagaacttgcgctgcatttctcgcactttccgcaattcaagacaagaagatgcacatgagttaatgggcacgtggcttgaatccatgcataaatgctgtttaccttctggggtaccgagtgagtctcaaagtgcttatgacaaaagcttagttcacaaaatatttggtggtcgccttagaagtcaggtcaaatgcacgcgttgctcacattgctccaataaatttgatcctttcttggacctcagtcttgatattgccaaggccaccactttagtgctggcacttggaaattttacttgggaataatcttgctgnacctcannactcagttnnctgcaatgctnntgacgtacacnggagnnccgttcgcaagcctatttctgcagagcgggaaaagcacaagtcctnncatgtaagtgcttgttggtacttgtcanaacgaaccagttcgacacattatgntcagacgacaatgnttacanntatgagcttgtggatttcaagaaggcagcagtaacctgaaccctgaatattatatgcanngctggaagttaaagcttaaaccaatttcaatgtactttattgtcatttattggggtgtgaca

SEQ ID NO: 9985 - DNA, 1109 bp, Sorghum bicolor
  Clone ID: SORBI-28MAY03-CLUS46858_1
gatcgacgttcctatcatcttattttctacattgacatattactggcagtcacctctatgagttagaacaacaccttgaccgcttcctgaggtctgcattgatggccaaaatactcttacctttcgatcgctcaacaattagaagcatacttattcaaactgtgagtgcatcaaattgcacccaaggatcactcagatactggttgtctgtcggacctggagacttccagttatcttcatctggctgtgcaaacccagccctctatgctgttgttattgataggccgcccgtacaagtaccatcctgctgcaaagtggtcacatcatctataccgataaagtctcctcaatttgcagtcatgaaaagtgtgaattacttgcccaatgcactcaccaaggtggaaggtgaagagaatggtgcatttactggcatttggctagatgatgagggtttcgttgcagagggttctaacatgaatgttggctttgtgacaaagagcaaggagcttctcatgccttgttttgacaagatcctgagtgggtgcacagcaagacgggttctgaccctcgctgagcatctagtagctcatggaaagctcagcggggtaatatcaaggaacgtgagtgttcaggaagggaagatggccgatgagatgatgctcatcggtagtggcattcttgtaaaacctgttgttcagtgggatgatcagataattggttctggacaagaaggcccgatagctcaagcgctttatgaccttattcttgaggacatgagatctggtccgccatctgttcgtatccccgtcccttactgaaactgtttgaagttttgcatatggttgtaagggtgaacaatgatttgttgttgttggttatcagagttgtacggtggtcatataaaatctatgtattaaaatatatgacatctaggaatgctaattatgcaaaagagttgggttgtacagttgagtgtcccctgagttcatggattttcgatggacattgctgggcgtgtaccctttcttcatttttacctttttggctacctgatgatacctgcccatatcgttggtcataggtgcaagcaaatttcaatttcgggtgtg

SEQ ID NO: 9986 - DNA, 935 bp, Sorghum bicolor
  Clone ID: SORBI-28MAY03-CLUS6488_1
cctcctctcctccttcctaatctcgcggaataatagcgagggggagaaagtggtttgagagagagagagacacacgcgtccgggaaagggaaagcagcgagctgtgggagagagaaaggttaagaggaatccgagctgcggtgccgcttcttcttcttcctcctcttctttttcggcaccgccactggtgggagaagattcttgggacgaggcgacgcggaagggatttctttgggctggctccgctccggtggttgctttgcgtttgcttccatggagagggatttcctgggcgtgattgacagggcggcggggaagggcggcggcgatgtggtggtggtggaggacagccgaacggagctagcagaggcggcgcagtggcagtttccggccaagtccggcagcggcgcaccggcgttcatgtccttcaggacggcgaggggggaggagggctctgaggagttctccatctccgggttccggccggccggagacgccttggacggcatcaagaagcagacctccttgcctgctgtgatctcccagcaccagcagcagcagaggcagttcgggctcagcagcagccaggtcacggcacagcagtatcctgccgcggcgcacggcggccagcgcttgcaggggatggattacagcgcggcggcgcttcattatctccctggaggatccaggctagtgcagccgctgtcggtgcgccaccctgcgccgttcaatcaggccaacctgatggtcaggtcgcagagcttccacaatggcaccggtgtcccctcgaggaatcagcagcctttcaccatgagcaacgggtttggtggctctacagttggcgtgtatggcgcaaggaatccacgaaatcagacctcaacgcagctgacgatattctacaacggttcggtgaatgtttttgataacgtcccggt

SEQ ID NO: 9987 - DNA, 977 bp, Sorghum bicolor
  unsure (1)..(977): unsure at all n locations
  Clone ID: SORBI-28MAY03-CLUS45392_1
gcacgaggcaatgaaggagcttcgtttgtacgagaattctgaaaaggctcttcttagctcttcatcagccaatggtactgcaattcttagagttttgcaggctttgagctctcttgtcactactcttaaagagagaaaggatccagaacagcctgctgagaaggaacattcagatgcggtttcccagatttctgaaattaacacagcattggatgctttgtggttcgaattgagcaactgcataagcaagatagaaagctcttcagagtatgcatcaaatcttagtcctgcttctgcaagtgcagctacattaacaacaggagtagcacctccattgcctgctggaactcaaaacatattaccatatatagaatcattttttgtgacatgtgagaagttgcgtcctgggcaacctgatgctgtacaagaggcttctacttctgatatggaagatgcttcaacatctagtggtgggcagaggtcatctgctcaagccagtcttgatgagaagcaaaatgcttttgtgaaattctcagagaagcacagaagattgctgaatgcattcatccgtcaaaaccctggattgctggaaaagtcattctcactgatgttgaaaattcctcgcctgattgattttgacaataaacgtgcatatttccggtctaaaatcaagcaccagtatgatcatcatcatcatagtcctgttagaatttctgtgcgtcgtgcatatattcttgaggactcctacaatcagcttaggatgcgctctcctcaggaattaaagggtagactcactgtccattttcaagcggaagaaggaattgatgctggtgggttgacaagggaatggtaccagtcactatcacgggtcatttttgacaagggtgcccttctgtttacgacagtcgggaatgatttgacgtttcaaccgaatcctaattctgtgtatcanactgagcacctctcatacttcaaat

SEQ ID NO: 9988 - DNA, 936 bp, Sorghum bicolor
  unsure (1)..(936): unsure at all n locations
  Clone ID: SORBI-28MAY03-CLUS454_1
agggggncccccgccgtcccggcacgctatctctgcaatcttctcctccttcccccactccggctcagcggcgctcaggctcgggccctcagcgacggaggggcagtcccaggctcggcggcggcgtcagcggctccccctcccgcctctcgccagtcacctcgcgctcgcgcgctcgcctccgtcctccgcgcaccggccggcgaccccgcctaaggtcatggcagaggtgatagatctaacgggagatggaggtgttcttaagacagtagtccggaaagcaaaagacgatgctatagcgccgtctgagagcctgcctttagttgatgttcattatgaaggtacacttgctgagactggtgaagtttttgataccacccatgaagacaactctattttctcatttgaaattggacaaggggctgtcatcaaggcatgggatatagccttaagaactatgaaggttggcgaggttgcaaaaattacatgcaagtcagaatatgcatacggagctgcaggctcaccaccagagatacctcctaatgcaacccttatttttgaggtggagctattagcttgcaggccgaggaaaggttcaagtgtggggagtgcatctgatgagaaagccagacttgaggaacttaagaagcaacgagagctagctgctgctaccaaagaagaagagaaaaagaagagggaggaagcaaaagccgctgcagcagcccgggtacaagcaaagcttgatgcgaagaaggggaagggaaaaggaaagggaaaatagattacaacgctgctgctgactattgtataacctagaaaataattgtgggagcatcctcaaactgcacgtcacttgctggtactatgcttgatgttgtacccttgctcctgcctggcatgtatcgaaaagagcgaaggttgaattatattggtgtc

SEQ ID NO: 9989 - DNA, 704 bp, Sorghum bicolor
  Clone ID: SORBI-28MAY03-CLUS45477_1
gaaggattgagcagcgtgcaaggaactctggggagctttcgcctcattacctacatctttacacggactgaagatcagctgcaaagcctggtgcctatgtccagccaataatgataaggaaaaaaaaggattgccgactaactagtattgtcattggagaagttttgttggttcccggagaggaaggagctcctcctggaacacgtcacagtcggttcggcaatggcatttggagggcagatcatggagcaattctgccttccaaggtccaggatttttgtggaccacttcccacgttctctttttgtgttggtttagttttcccgggggggttccaaacttttgcccaagggcaagagggttggttggtgagccgcccgtggggtgtgtttgtgggttgtggcggcaatcatggtcatggccttgtgcaagctttagaattcattaacctgaaaacatgccgatgccagctttgctgccagatagagtgagtgagtataaaaagagggtagtacgagtgggcttcactagtttttgttttcttttttctataaattcttttcctgtaaatcttctagctgtatgtaatgtgctttcggcttctggaatgatgaggtgttgggtgtgtgcatagcatgactgttgtttgatggagcgcatcgccgtgacagtctttcccttttgttcttttcgctctttttttt

SEQ ID NO: 9990 - DNA, 932 bp, Sorghum bicolor
  Clone ID: SORBI-28MAY03-CLUS45533_1
gcacgagggtaccaccaggcagtggcatttggggatatggtggttgctgtgaggacgaggagctcacaaacagtaagtgactacacctgtaatggtcgacatgtgcttacaatgactagaaatcttgagcgtccaatcattggctcagttctgcagagcatgtggggggtttcacccacgcatctgtcatggagccctgagcataacgccacggttgttgattacacttggagcactggacatacaccatttggtcctttttcagagaccaaatcactgtcttttgtgcagaaagatgcagctcgtaggaatgttcttctcacaaccctgaactacacaatcaccagcacaatagatattttggagtcgatggcggcacatggtggggagaaaatacttcttagaaagaaaaggcatgttgaattcaatcagaggtggaatctgctcacgtataaactggagaaggtgatctcagccatgtcacgcttggactatgacaaagcactgtactttttgaggtcttcagaccatgatctgtatgaaattcactcattggtgtatcaggcatcacaggagctggaggcttcactggtttgcttcaaagatccaccattcccatgggtctctgtttccatgtctggagtgtttgtttttggtttcttttatgtgtactccaaaagagacaagttgtttaggagcaaaaggaaacagttttgagtttgggcagcattttagttcatggatactgtctgaatgtttgagcctgctcataccatagttagacagcactaaagatgttgcaaccctgcatgttacatggatctgtaaatgtacacgggctgcatcttgtttcaaccagatgaatttccatgtatgagatatactggattcttctgaaggaagtaatacttccactgtctgtaaaaaaaaaa

SEQ ID NO: 9991 - DNA, 690 bp, Sorghum bicolor
  Clone ID: SORBI-28MAY03-CLUS45676_1
agggctgcttccatatgacttgctggtgtgggcacgagttctgctactcctgtggtgctgactatgctagtggtgtacaaacatgccaatgcgtgttctgggacgatgaagccgtggaggcctcctccgctgagcgatccacccaagcagcatctgagatctgggcatgggacacgtttgactgcatgccgaccgccgtggaggggtactcggagcaggaaagggcacagctggcgctcatccagaggttcctcgcgggaggttttagcctgggagacaaccacaaccccaacccctgccagtcaccgccacgctgcgccgactcgtacatcgtcgacaccatgaaggacctccaccagctcccgtggcttgagcggttcgtgtcggtgatcagcgacacctacaatgatgactacatccagtgaatgaagagagtgacagttatagatagcagtaaagaaacggcacataccgagttctccgttcagagtaataatatgttttccatgcccctgtcgataattgacgcaggggaaagtgagatgctttcatcataaatacactggtgttgtttcctcccttgtatggtaacctttggtgttagtgcatcagcaaaagagttatctgtttacagtctcggttatatgattctctcattcctttcaagtgagtaatatcttcgagtttctc

SEQ ID NO: 9992 - DNA, 805 bp, Sorghum bicolor
  Clone ID: SORBI-28MAY03-CLUS47289_1
gcacgaggccgtctctctgacttcgttagcgaagcactggatgaggatgtggtgcccattattcatgttgcttccacctgcgaccttcaggacctgctcaatcagtgtattcacagggttgcggtctccactctcgatagccggtacctcgagaaggaacttccagatgacatatactgcaggatcaaggaaatccgccggagcacgtttcatgacgaatcatcagagagtgccatgcacgaggctgatcatgacaagagggtcagaaacatcctcaaggccttggattctgacgatgttgatcttgttggcctgctgttaaaggagtcgacggtgaccttggatgatgcgtttgcgatacactatgctgcagcctactgtgagcccaaagtgtttgcggaattgctgaaactggattctgctaacgtgaatcggaagagtaatagtgggtatacaccactgcatatagcttgcatgaggagagaaccagacatcattctttcgcttgtggagaggggagcctctgtgctggagaggaccctagatgggcgtgatgctcttactatctgcaagagactaacaagagagaaagactgcaataggaagttggagaagtacgaggagaaaagtaaggcttacttgtgtatcgacatactggagcaagaacttaagaggaaatcctttattttggacccgatctctatagaggagtccattgccacacctttgttggttgataattttcacatgaggctcataaacttggtaaacagagttgcgtttgcacgaatattcttcccttcgg

SEQ ID NO: 9993 - DNA, 941 bp, Sorghum bicolor
  Clone ID: SORBI-28MAY03-CLUS47414_1
gcacgagggtagattcattctactgggatggtactaatcctagcagcagtagcagtactgggagcagaggaagcaacagtatgggctttgaaccacagagcacgagctcaattctggagaacagtgtcttcccatggacaaacatcggacaagaaaaagatacaagggctcacctagtagaggaacttaagtggcctgacttgctccatggaacctttgccgagacgaccacagccatgcagaaccagagccagacgctctatgatgacgtgatcaaggcagagagccaattcagcatggaagggatatgtgcttcttggttccagaatcagcagacacagcaacagctgcaggctgcacccaacatgtatgacaaggacttgcaaagaatgcaactgtcttttgagaatatctaggcactatgttccacctcatggaacagagctgatcagcagaagcagaaacttgtattcagagatttgtgggaagaactatgctgaattgcttacatagatacattaagttgatacagaaattatcctccacagctgttcctcagttgaagacctggcaatatcaaggaaaggacagccctggcattagaagtggcagcagaatgcatagaaaagtacgttctagagtctcctttttctttctcttgaaaattgatgtttccttctgtacacgacgactcaacttttgcatatttgagtttttgttcactctctggtggaaattaaataaatatagacagccatgggcaaaattgcatgtgtcggtagctctcaccatgcaagcagccccaaacttttcaactgctgccatgcacgtccatgcaaattaattattgcatgttgtattttcatttcttttgataagttgccgacaaacggcagttgtatattgtaaaggaagaaatttggaacattgacctgagagct

SEQ ID NO: 9994 - DNA, 612 bp, Sorghum bicolor
  Clone ID: SORBI-28MAY03-CLUS4745_1
cgcctcgccacccgacgccgccgtcgccgctgcggcactcaccgcggccgtggctccaccagcgcacgccgtcttcgtcttccgcttcgagctcgccggctgcgacgacggcgaggagcgtgacccagccgacgacgccaaggagaaggagctgctcgacaaggccgggggagtcggagtcggaggcggaggcggctgggcaggctacgttggtaggtggggaagaggtggggactggagcgagagcagcagcaatggcgagaagcggaggaggaagagggggcaggccagcaggctggccaaggcgagctcctcctcgtcggcgtcagtggcgtcgtcctccgcgtcgtgggcgagtggctccactgtcatggactggggcagccccgaggaggccgagctgcagagcggcgacggcttctccctcctcgtctacgcctggaagaactagtgtgtgtgatggactagcggcggcggcggcggcggcggcggaagcggcttgcggccggcattgtttcgattgatgattggttggcaattcagggaggatttctcttcccatcccattgttgtaagttgcaattgttcagcgagcaatgttcttgtgcaaaa

SEQ ID NO: 9995 - DNA, 994 bp, Sorghum bicolor
  Clone ID: SORBI-28MAY03-CLUS47544_1
gcacgagggccccgtcccccgcggctggccatcaccggcgacgccaccgccggccgcgggcaacgggaccgcaaccagccaagccctatcccgccgaccgacgtgttctctcgtggacgcgccccccgctccccatagccccgccctctgctggctgggactgcaccggcgtggagtagagatccagggcccagggggacggatcggtttctccattccttggcccttcttcctattcctagcgctcaaggcccatctatccgagggttgagggcgagctcccgttgacggaggcgatggacaagttgctgcaattcgggcggaaggcatggttcgtcgtgcgggtgatgtctggtcaagaggagaggaggatccgctcctacaggctgcagctgcagaagcgcctcgagatggcacaagctagaaaggaggagctgcggaaacagccagaacaagttatcttatcggaggttcgtcaagtggttcagcagatgcaagctctaaatcagcaccttgacgaagctgaagctgctatcgatgagtattttaaaccaattgacaagaatgctaaaatcatatcggatatgcagttggagaaagaggaaaagcaaatgaaggagatggcaaaagttatgcaggaacaaataaaaatgcaaagagaaatcacaatgacaagagctgaggctgcaagcatcgagtctaatgatactaaagtgggtgaaaaagtggctgaaatccctccaaaataagaaactgtaaaatagatgctaggcattgttcctctttttttttttgagcgaagttattgtgcgtgtgcatactatttgcatatgtgctatgggctaggtaataagtgtgtacttacaatgagacaatcgccaattttacgcttatagaagctattggcctgctgctttccgtttgttgtttaatatccacacaagcttcgttttgcgcggtaatgtgttctgtccattaacatgtaacctttagc

SEQ ID NO: 9996 - DNA, 1215 bp, Sorghum bicolor
  Clone ID: SORBI-28MAY03-CLUS47570_1
catcgaagcgacgtatatagtttcggtgtggtgatgctagaacttcttactggtcgtaagccgtatgacagctctcgtccacgtgctgaacagcatcttgttagatgggctgattctcagtttcatgacatggagtccctgtcaaagatggttgatccttctatccaaggagagtgttccatgataccgttgtcacgttttgcagacatcatcagtgggtgtattcggccggaaccagaactcaggccagcaatgtctcaaatcgtccaagacctagctaggattgtaggtgctagtggtgaggtatcagagtgacaaataaaggaggaacagtagacatccagcttgtcagtcgtgtggccagtgaagactcctacatccttagcgcagtgccaggggtactctatctgcatttatattggacgagattgcggctagtgtatatgccattttggagcctcatttattctggaaagatgtagtggtactgtggtagtattgcgcaaccagtgagatatggcttcgcattgttgctgagcagattcccgtgctcctcttgacatgataatttcacctgtaggcagtatttcttgtaactaattctaattttattattttattacagtatagctagtcatgttaaatatgatgcatgtcttgagactcatgtttctccggaataaaaactgccttgctaactccatatggtttgttaatcttagaagtctactgtcattgggattcttttcagaggcaaagaggccttccctcttgacatggacatgatcatcgtattgacctggtgtcttctgccgacctgtacatgaagattctcctccttgaagcgaaaacacctctgctactgctaggtatgcattgtgtgcttggttactgtcttttcttcgtgtgatttcttcaagacctagaataaattaggacaatattgaactatgctgattgggattagataaacttttgtattgatctgttcttaattgatagatggcaccctgtggttgattgcaagtttgatctgtcatggtgccttgtagcatgtactgtcatgttctggatttctggctggctgctttcttctttttccccccagcttacagtgctaacagcaaagtcgattctagagcccaggagtatattttggcttacatttttgtatgcttgattgaactgacagtatatcatcttgtcttttggcag

SEQ ID NO: 9997 - DNA, 724 bp, Sorghum bicolor
  Clone ID: SORBI-28MAY03-CLUS46117_1
acgccatcgtgtaccggaacatggccatcctcggcgtggacggcttctcgtcgctccccaagaactgcctcaccctctgctacatcttcttcgcggcggccatcgtcgtcaacctgatcagggacctggtgccgaagaaggtcgccgggttcatcccgctgccgatggccatggcgatcccgttctacctcgggtcctacttcgccatcgacatgttcatcggcaccgtgatcctcttcgcgtggcagatgatcaacagggccaaagccgacgccttcgggcctgccgttgcgtcggggctgatctgcggcgacggcatctggaccctgccgcagtccattcttgcgctcgccaaggtgaagccgcccatctgcatgaagttcctgtccaggtcggtgaacgcccaagtggacggcttcctcggaaattaaactgtgaaattacgatctgtcagcagtcagcatgaatcacaagtgtatattgtgttgatgctccatgctgtaaaatgtaccgggacgggtaaatgttgcttcgtcacgatctgcttttgctgtacatgagtaagtacactagtcgtaggaatttgccaaactaatgtttgccgtacacgcgtcagcattatggtaccaacagctgtatgttaactatatactgtaagacgttttgactcgaaattgttttcactgtgacgagtcaaaacccataattagcagatacagctgtt

SEQ ID NO: 9998 - DNA, 646 bp, Sorghum bicolor
  Clone ID: SORBI-28MAY03-CLUS46206_1
agtgcaggaaatcagggaatgctatcaccctacagatccagttcgtttcctgtgcctcaatatgcgttgcagagagataatgtatttcctgagagacctgatgaaccagaatgccaatattacatgaagacaggagattgtaaatttggtgcagtgtgcaagttccatcatccccgggtgagatcactgccccctccggattgtgtcttaagtccaatgggtcttccaatacgtccaggtgaagaattgtgcaaattctattctcgttatggcatctgcaagttcggcgccaactgtaaatttgaccatccaacaatggctgctccaatgggagtctatgcatatggtttctctgcgtctggttctcctgcatctgcttcaactaatgtacctatggcgcgacgccttctgggatccccatccgcttctggatatacgtcctaggcatctttttcacttgacctattttgatgtataaaatccacggcattgcctcaggcgctgtgaatgtttctcctaacttcccgccgggatcaaagttctgtaaattgagttgctaccggagatgtacagcccccccttttttttgttaatccagatctttgggaataactctgggaaccgaataaactttagatgcagaaat

SEQ ID NO: 9999 - DNA, 618 bp, Sorghum bicolor
  Clone ID: SORBI-28MAY03-CLUS46293_1
gccgttgatagagcacaccgtattggccaaacacgacctgtcacagtatcacgattaactataaaagacaccgtggaagatcggattctggctctccaggagaaaaagcgggagatggttgcttctgcgtttggggaagacaaatctggttcccgacagactcgattgactgttgaagacctgaactatctgtttatggtgtagaatcgctcctgagagtctaacagttttgctcattgggtggtgttagacagtggtagacaaaaaggatctaaaaaaaatgctttcatttagggattattagttcttgtagcttgtacagttgcagagatttaggggttattagtgacatgtcttccaattctttttgcactgaaagcagcaagatgaactaggtgaattcttcagatagctgctatagtgcctgttgacttaatatcatgaagataacgacagtcaaagctaacatgataaaagtgtgtacatattttttttttgtcggcacgtctgacatgtgggtcgcagcatctgccaacgcgataaaccatcgaacatattgatctcggtttgtcatattgacttgttatattatggattacttgttctccagtggtcgtt

SEQ ID NO: 10000 - DNA, 822 bp, Sorghum bicolor
  Clone ID: SORBI-28MAY03-CLUS46400_1
gcacgaggcgacggcatgccgccgccgccgcccaggtggaagggcgcctgccagcctcctgttcggtgcaacaacaagctcatcggcgcggcgtcgttcgtcgtggacaacacccccgccgacgacgtcggccacggcacgcacaccaccggcactgcggccggccggttcgtggaaggagtctcggccttcggccttggcggcggtggcaccgctgccgggacggcacccggcgcgcacctggccgtgtacaaggtctgcgacgcccaagggtgcttcgagtccgacttgctggccgggatggacgccgccgtgaaggacggcgtcgacgtcctctcggtgtccctcggcggcgtctccacgccgttggacaaggaccccatcgccatcggcgcgttcgcggcggtgtccaagggcgtcctcgtcgtgtgcgccggcggcaacagtggccctctgccctccacgctgtccaacgaagcgccgtggatactgaccgtggcggccgggtctgtggaccggagcttccgtgccagcgtgcggctcggcgacggcgagatgttccaaggcgagtcactgactcaggacaagcacttcagctccaaggtgtatccgctctactactcagacggcatcaacttctgcgactacttcaacgtcgacatcaccgtgcatggtggtcctgtgcgacaccgagacaccggtgccaccgatgagctccatcgaggcggtccgcgaggctggcggcgccggcgtcgtgttcgtcaacgaaccagacttcggatacaccatcgtcttggagaaatactacaacctccccatgtc

SEQ ID NO: 10001 - DNA, 681 bp, Sorghum bicolor
  Clone ID: SORBI-28MAY03-CLUS46411_1
gcgttcacacctgctttgcccctgccccccgcgcgcctcgcgtgcggcgactagggcgaccgccgccgccctacgcccagctgcccgccctggtcttcgtcgggcgctttgccggcgacgagcagccaccacaccagattggtcacaggaggattgctacatttgggaaggatgagcaaaggcccagttccatttgtcaacattgggaagagagcaaaagatctcctgtacaaggactacaactttgaccagaagttttctttgtcgacatctagcagctctggtttgaatctcacagccactggtgtgaagatcaatgaagacttcattggtgttatacggacacagcataaaagtggtagaactactgttgatgtcataattgatagtgattctaaagtgtcaaccacagtcactgttgatgaagcactaactggtttgaagacctcattcgccttcaaggttccagatcacaagtctggaaagcttgacctgcaatatgcccacaatcgtttttcattgaattcgaccattggtttgacatcaacacctttggttgagctggctgcaactgttggcacaagtgaacttaccattggtgctgaggtcgggtttgacagtacttcagctgctgttactaagtacaactcagggattggatacaacaagtccgatttttct

SEQ ID NO: 10002 - DNA, 1057 bp, Sorghum bicolor
  Clone ID: SORBI-28MAY03-CLUS47930_1
ctactggatgttgttcttgttacttctcgctcggagcacacggcaagcgtccttctccccaatctgccactgccaggattcccaatcccgccgcagccgtttccccccttctcggcgtcaacaatgacgcgctccgcctccggcgagcgcaagcgtcgtctgattcgttccctggactaccagtgcgtgagacgctttcgtctccgtcggctcctctccttcctctggcgttacagctaccacgaagcgttcgaagcgctgtccaaggagacgactgtgtacttccgcgtgtcccatctccagcatatggtgcggcagggcttgtggaccgacgccgtcagatacgtgctccgcttcgtcccggctatcgatctgaccgacggtggcaacttccttaccatcttcatcaccttgctctccagcatcgctagatacaaaccgactgtcccctccaccttccctctatacgatccgtatgcccgccatgagctcgattggcaaggtcgcgtcaggcccggtggtgtcaaggtcgctgagatcatccggtctgtgtgctgcaaggaagcctggggtcggattaactgggcactggtgaggctgaaggcagcggagatcgttggtgatttgtttactgagttgccagagtttgatgacatgcgccgactgccaccctgccctgtcattgtcaggccagcaaacgtgcttcctctcagggcgagttcaaggggtcacagcaggtttcacaagaaattaggccggattccaccagatgttcttgcccggtattttgttcccaaggagacaagccaaccaggtttaccacttgagccatttacaatgatccggatggcagagattttagatgaatgtttgcaagctggaaaatgcctggtgatcaatgacagacatcgtgttgagagttcttccactgaaggcacgaaggatccaatggtaactgaggctgctgttccaagaagcaatctgaaaaggccacgagcaactgagcaagaagttgatacaagaaaaatacagataattgggggagcatgttcaaagg

SEQ ID NO: 10003 - DNA, 750 bp, Sorghum bicolor
  Clone ID: SORBI-28MAY03-CLUS47988_1
aaaaagagcttcaaaattaataatggaatgcgcaacagaagagcaaggatttatgtaaatggctttcctatctctgatcgtgcggtcaggaaggctgagaagctagctggatcaatctgccctggaaactattggtatgactaccatgctgggttctggggtgttatgggacgtccctgccttggcatgataccaccttatattccagaatttaatttccccatgcccaagaactgtgctggcggaaacacaggcgtatttgttaatggaagagaacttcaccagaaggatttggatttacttgtcactagaggactctctgattcccctggtagatcttatgtagttgaaaattctggaaaggtttcagatgaagtatctggtgaagaactttatggccttggaaaacttgcaccaacagttgagaaaatggggcgtggatttggcatgcgcgtcccaaggttcatccagtgacaggtcagcttggcacatctaaacttctgaacctcgaaggcaaatcgatggagataattcagatctactgtaggttacttcaattgtgaagctagtttcatgtatctttctttttcctgattatattccgattaacatgaggcctagttcagtcaagttgaggttttcttgtaattttctgatgcatttgtttttactgaaaattttcctttttcatttacatgttatgcaagaacaatttgaagcatttacctaattgaatcgtatgaattgttc

SEQ ID NO: 10004 - DNA, 1087 bp, Sorghum bicolor
  Clone ID: SORBI-28MAY03-CLUS47996_1
gcagcacgaggcttcctcaacaactccgaacaagtggtagagagatggagatacaagcacgacagctactggtggccattttgggcattgtgatagcgatagctttcgccgatgccgtgcaaggagcgacagcaacgccggttgttgtcggcctggccaagtgctcggactgcgccaggaggaacatgaacgctgaggcagctttcaaaggtcttcaggtggctgtcaagtgcaagaacagcaagggcgagtacgagagcacggcggtgggacaggtggacaagtccggcgccttcagcgtcccgctggccgccgatgccgttggtgaggacggggagctcaagtcggaatgcttcgcgcagctccacagcgcgtcgagtgcgccgtgccccgggcaggagccctccaagatcgtcgcggcgccaccgggcggccacgacggcaacgagaagacgttcgttgcgctcggcggcaaggtccaccgctcgtcgcccgagtgcgcttcggctttcctttgccaccatttcttccacagcattatgcaccatcatcacgtaggaacccacacgcctgtggttctccctcacgcgcctgatcacggccacggcggccattccctgccgcctgtccccaagccgccggcggtagacgtgcctgagcacaaaccggcgccggtgaccgtgccggagcacaagcctccgtcgacgccggtggacactccgtcaacgcccaccgccccgtcgacgacgccagtgtattcgccgccgacgccaactcccatctaccacccgccggcgcagcgggacgctgtcactggcccgtagctcttcaagaagctgctgccgttcctcaagatgttgttgcctttctttcctcctgatgcgatggagactcagcactatgagtgtttggtcagtgttttcttggcttttgcaggttatgcagtttcttcagaataaggtgtgtgtgtgtgtgtgtgtgtgtgtgtgtgtgtgtgtgttctatctattggggatagttgaatcttatgcgatttcctgtgaaccgtttttatttagtaaagctctgcaacaagtggggaatacgt

SEQ ID NO: 10005 - DNA, 645 bp, Sorghum bicolor
  Clone ID: SORBI-28MAY03-CLUS48014_1
taaaggatcaaataggataaatgttttcagtgagtgtgccaagaccgaatcatttcttccatttggttctgggagtcgagaatgtgttgggcagaagtttgtggttcttgcaatatcgatgttgattgccagcctgctccgcagctatgaggtacatcctcatccaagtttgtctaaagaaatggacacagcagttgacagcagccaccttcatatgccaaaccctaagatcatcctcaccaaaagaaggatctgaagggacagtttggcaaacgaaaatctggcacacttacgttcactatattgtttttcactggtgttacaccagtatatgatctttactttcctaccgtcgtttggaccacgctgaagtttggaaaaggcgatactttgtgttgtcgatgtggaagtgctttttttcctccggatttttgacagaccctgtgtgcttcgttggatctagtttttgtcaggtttttggagcacccgtggggctgttagatcacaggaggtgtatgctgatgtgcataaacagactagttttttttttcagttggggttttctcctccctctgtggggaatgtaatgtccaacgcatgattcactcgacacatatatatttatattattgtaggtaaaaaaaa

SEQ ID NO: 10006 - DNA, 731 bp, Sorghum bicolor
  Clone ID: SORBI-28MAY03-CLUS48028_1
gcccgggctacggagctcggcgtccagcttgtcttggctccccttcctgcgttcgttgcggtgttcttggcgctttggtgcctgcggcgtccaaggagaccaaagcctaagatcaactgaggacgagagtctgtcgctcatcgttgcaactaatgagcagcgtaggccataggattcttgtgaataggcacaacatggattacagatggtgctggagcatggctcaggatttgtaaggtccaaaacactgtggcaggtatgaaagtttcagaagattacaatcctgaccctttcccaagttgtagccgagttaaaatactttaatttgttcatgctgtaatgttcagggaaccgagagattgtctttacagcaactctgcagcgtaggccataggattcttgtgaataggcacaacatggattacagatggtgctggagcatggctcaggatttctaaggtccaaaacactgtggcagggaaccgagagattgtctttacagcaacactaatggctagtggttagtatcgtcttccagtcatctaaaatgttactagtacaatccagttgtctgtttccagccgtttacatgtaaaagtccatattcaagttcgacggaaagaaacatgttctgccatttattacaaaatgaaaccaaataaaaatgttgtgcgcctggtaggaacagtatggttagatgtctgcctggtggaaagtggaatgcttgcttg

SEQ ID NO: 10007 - DNA, 526 bp, Sorghum bicolor
  Clone ID: SORBI-28MAY03-CLUS46905_1
ttgcaatacaggcatcaaattttctgtcatccaaaattatcactccataaactattttatgacattttccataaattatcacgcctatattcgtggaacatgtagtggaacgatcgcttactaatgggcttacattttccgcagatcctttttggcggcacctgaaggaaaagtaggactgtttgaacggcttgcgtcactgtctttgtggattgaattattaatgtcgagcttttagatgcccattcagcaattaacgtgctactgttctttcgtgggggaagaatgtcggtcttgacagatcaattttgtatagtttgtagacttgtagagcattcagtgcctgctaatcttgtgcactgtaagtcttttggcgcttcaggtggtttaactgaagttactgaacccttgtcgtcaactatgaattcaattaggatattcagattaccgctggtatgctgacatatgatggtttaatggttatctgaaccttctctttttttaaaaaaaaaagttagtttcttgg

SEQ ID NO: 10008 - DNA, 1182 bp, Sorghum bicolor
  Clone ID: SORBI-28MAY03-CLUS4662_1
attgctcagttggcgctcatcttcttgtcttctgatcttctggactgcgagctcgtggccatgtctgcttctcctctgatggcgatgctcctgctcgcctcaacactggcgccgcgcgttcctgtcacgcgggggagcgggagcggcaccagcgccgcccacccggcgtacgccgatgccacggcctacggtctcgccgcggcctctgccttggaggcggggctggaggagtacggcggcgggcgcatcgtggacatcacgcacgcgtaccggccggagctgccgttccccgggcgggacgggctcggcgcggtcaccggcctcacggagtccatggccaacgcccccggcaacaacgtgtcggagctgcgcatggtggtgcactccggcacccatgtcgacgcgccgggccacatggtccaggagcacttcgtggccggcctcggcgtcgacaagctcgacctcgacgtcctcaatggacctgcgttgctcattgatgttccgagggacacaaatataacagctcaagcaatggagtccctaaatatcacgcaaggaattcgccgagttcttttcagaacactaaacactgacaggaagctaatgtggaccaaggaaattgacacgagttttgttgggttcacagaggatggtgcacaatggttagttgacaacactgacatcaagctagttgggattgactatctatcagttgcggcatttgatcacttgatatcagcccatttggtctttttaaatagacgagacataataccaattgaaggtctcaaactagaccatgtaaagactggagtatatatgttgcactgcttacctctcagacttattggatgtgatggctcaccaattaggtgcatccttatcaagtgatcactagtagctggtactgctgaacatcatataaagctggtactgccgaaggctggctaatgtacttgtgtactttccccctctctatgaaagaaaatgatgtgtgcgatgttgatatgctcaagaacaacatagttcattgatccattatattgtaaagagtattacagctaagtctgtgtttgtaagaaatatatctgcagtaaagagaggtaaagcgagtctttccagcgatttcacctggtaattggctgtatccttgatttggactgctattccgttatgttcccc

SEQ ID NO: 10009 - DNA, 607 bp, Sorghum bicolor
  Clone ID: LIB3481-047-Q6-K1-B8
gtcgacccagcgttctttcggcgtcgacaagctcgacctcggcgtgctgaatgattgcagggattttacataaactctgtaggacttctgtatgacagtatgagtatcaatccatacaaaccacaacaaacttctgcattctattctacttcactggacctgcgttgctcattgatgttccgagggacacaaatgtggggaggatgcaaatgggatatgcatagtaacctagtatagtgtccaaatacccacttactctatgtagctcaagcaatggagtccctaaatatcacgcaaggaattcgccgagttcttttcagaacactaaacactgacaggaagctaatgtggaccaaggaaattgacacgagttttgttgggttcacagaggatggtgcacaatggttagttgacaacactgacatcaagctagttgggattgactatctatcagttgcggcatttgatcacttgatatcagcccatttggtctttttaaatagacgagacataataccaattgaaggtctcaaactagaccatgtaaagactggagtatatatgttgcactgcttacctctcagacttattggatgtgatggctcac

SEQ ID NO: 10010 - DNA, 1119 bp, Sorghum bicolor
  Clone ID: SORBI-28MAY03-CLUS47045_1
gcacgaggatcatatggctatgagggctcgtggaacaggcacctactttcctgacccaaacttgcgcaaggaaagaccacctactggacgtggggagagaggaaggaatcattcccatcagaataattatcaaaagtttcaccaccatgcccgaccggatatgcctgtagatatgataccttttgatgaattgaggcatgagtcaccactgcagatatacgctcctagtgcaaatgatcatggaatcccatctccaatgaatataccaataccatcaccatcttcccagtctccaagggatcctttgaacgtaccaatgcattctccatcttcccaggttagaaaggataattttcatggcaatggttttatgctctcgcaagacagtaaacttgagtttgggaccttgggggcgttgccaagggaagttgcctccaaagaccatgctagcagaccaagttctgcctccaacaatcaaggttctgggcctgtgactgtgagccccatgtctgtggtgaaaaacactggaatgggttccaacggaatgaggaatgttcaagcataccgtctcaaggacagtggtgacttcccgccactatccagttgatgtcgattctgtgtgtttgagaggcaacaggataatgatgaatggtgtgctcccgacgcaggaatgggagaccatgtcagggcaccgagttctttggcaaaggcatacaccatgttgtacatcctgttttttcttcctttttctccagttgccataagcattgtcactgcaacgcggcctgtgttttctgtaactgagtttttttgcgacaaaagagaaggcaaaaagaaaaaaaaagaaaagaaagagagagagaagaacaagaaatggaagggaaagaaggaaagcaaaagggctctgaaactggatgacatgtagatacttttaggggtatagcccccttgtttcagttttacagattatggagtccctcgaaggggaacagatatgctagggaaagtaatagagctagctagctagttttgttgtttcgacctcaggatcattggataactggattttgtccatgccttcgtgtaatgaggatagagttgtagcccctgtttgcattt

SEQ ID NO: 10011 - DNA, 629 bp, Sorghum bicolor
  Clone ID: SORBI-28MAY03-CLUS47145_1
gcacgaggccgcctcccggctcgcgagtcgcaggcgcagcgcagccgagcgttccgtggggatggcacgagggcgcgatgtggtggagggcggtgagggcccgccggcgggtcgccggggcgcggcccgcgtccaccgcggcggcgggggcggagaagagctgccgcgccgtggtggtgccgcgtttcggtgggccggaggtgctggagatcaggcagggcgtgcccgtgcccgatctgaagccgcgggaggtgctcgtgcgcgcacgtgctgtctctatcaaccccctggacctgcgaatgcgatctggctatgggcgctccatattcgagccactcttaccgctgatcattggtcgggacattagtggtgaagttgcagccacagggacttctgcatcgtcattttctattggtcaagaagtgttcggttcgttgcatccaactgctctcagagggacatatgctgactatgctatcctgtcactggacgagcttactctcaaaccatctacactcagtcatgtggaggctagtgcaatcccgtttgctgctttgactgcatggcgtgctttacatggtacggctcgaatttctgaaggacaaagagttcttgtgattggtggagga

SEQ ID NO: 10012 - DNA, 814 bp, Sorghum bicolor
  Clone ID: SORBI-28MAY03-CLUS47151_1
gcccgcggctctcctgctgcgccgttcccctcccgcccggccccggcccctggctccgcgcaaccccacagctccgcgcccctctcccccgacggcgcgggatcggcgtctggtctggaggagaagctcgcggggctctcaacgggcggagacgcgcagaatcctccgccggcgggtgagggtggacaggagccgcagctctcgaagaacgccaataagagagaggagaagaggaagaagctgggagaggagcggaggctcaaggaggaagagaagaagaacaaggctgcggcagctgctgccagtggaaagcctcagaaggcatctgctgctgacgatgatgacatggatcccactcaatactatgagaataggctcaagactcttgattcgctcaaggccacaggtgtaaacccctatccccataagttcccagttggcatctctgtagccgaatacattgagaagttcaacaccttgagcaatggggagaagcttacagatgtgacagagtgtttagctgggaggatcatgaacaagagaacatcatcatctaagctattcttttatgatctttatggtgggggcatgaaggttcaagtgatggctgatgcccggacctcagagttggacgaagctgaattttctaagtatcactcaggtgtgaagcgaggtgatattgttggcatagctggctatccaggaaaaagcaacagaggggagcttagtgtattcccaaagaaatttgtcgtgctctctccatgtcttcatatgatgcctcggcagaaaggtgaaggaagtgcggtgcctgtac

SEQ ID NO: 10013 - DNA, 710 bp, Sorghum bicolor
  Clone ID: SORBI-28MAY03-CLUS48823_1
tttcccgtgaagaattgcataagctacttcaaccattttctgcgtcagagttgtatcaggatctgcaacatttccctcgtgttgatgtgaaagttaagcttcgtaatgaacaggagcgatccaaacctccaactttaaacatcagattgcaattgaaaaattcacgacgttcagcatcaagagcatttgcccctagatttcccaaggcaaaacaagaagcttggtggctagtcctagggaatgctacaagttcagagctgtatggtctgaaaagaattagttttgcagatcgggtggttaatactcgcatggaattgccacagatgttcgatgcacaggagacgaagctgattttggtgtcggattgctacctaggttttgacttggagtattatcttgagcatctcaccaagggttgagtgctttgttcagtttgggctgtaacattttgtacgggttgagcaaccagcccatcctagattgatcctgtcatgaattcattccatggaattttgttggaatgactacatccctggtgctcatgcttacatatcatttaatagcgatgtgatggttgtagatcaactcatttcattccccctaccaaacaaaaagtaaggatgagaaccaacacctttttttgtcaatataagatggtggcaccgtgtagccactcacaatatgggaatgtcaaaaaaaaattgagagcc

SEQ ID NO: 10014 - DNA, 605 bp, Sorghum bicolor
  Clone ID: SORBI-28MAY03-CLUS48811_1
ccttccactagccatggcacatgcagtaaaagtgcaacttccaagagccttggtggtaaaagtaagagtggcaagaacagggcatcaagcaccagttccaaatctggcggctcaagccgaggtggggatgatagtaatatctggacgtgcgatcagtgcacatatgcaaaccccagatctgccagagcctgccaggcttgtgatcgccagcatcgatagcgctatcagtccttgctagagatttggaccccatttgttgagaatcttctggttttgtcccgtgtgatacacagcatacatgaaattgaatgttagctgatctctgggggtagtgaggaggtacttgtaggaggaatgctgcgtgcaggcatgcaaatgaagtaggttttcgtgtaccctggattgtttgtcgactgacagcaccggtgaagcctcaactcatcatccagttcgatttgtatatataagtatatccatatctgtaacaatgttttgttcaatggaagtagagctaggaggcgtctgctgccaaaggaactgaactgttgtgctgttgtaatgtaataatgcatgggtcaaatttaaagaaagttagtcatcctgtt

SEQ ID NO: 10015 - DNA, 1318 bp, Sorghum bicolor
  Clone ID: SORBI-28MAY03-CLUS4887_1
ccccaaagttgtccacctcatccacatgggctggagacaagtggttcatttacccaagctatgactatgctcattgtttggtagattctcttgagaacattacacactcgttatgctcactagaatttggcatacgtcgtccgtcatactactggctgcttgcagccttgggccagtatcagccatatgtatgggaatattcaaggctaaacataacaaacaatgttatgtccaaaagaaagctgaatcaactcgtcacggacaagtgggtagatgggtgggatgatcctcgacttttgacgctagcaggcctacggaggagaggaatatcagcagcagctattaattcattcattcgtggaatgggaataacaagaagtgacaatagcttgatacgcatcgaacgccttgaataccatattagagaagaacttaacaatgtttgccctcgagctttggttgttttgcatcctctaaaggttgttataactaatttggattatggaatggttattaaccttgatgccaaaatgtggcctaatgctcctgacagtgatgggtcagcccactataaggttccattctcaagaatcatctacattgagaaatctgatttccgtctgaaggattcaaaagatttctatgggcttgctcctggtaaatcagtattgctgagacatgcattcccaataaaatgtatggaagttatctatggagacaatgcagatagtattgttgaagcacgaggcgtgtatgatgcttcaaaggctacaaaaccgaagggtgtcctgcattgggttgctgagccttctcctggggttgaaccactcaaagttgaagtcagattgtttgagaaattgtttctttcagaaaatcctgcagaacttgacgactggctgggtgatctcaacccacagtcgaaggaggtgataaagggagcatatgctgtaccttcacttgcaagtgccgtactgggggacaaattccagtttgaacgccttggatactttgctgtggattcagactcgacgcccgaggaactggtgttcaacagaactgttacccttaaggactcctatggaaaggctggacctaagtgatctcactttgttaaagcgagttgctcacagtttgtcagagatttggtggaatactgatagtgtttctaaagagttgtaggacaatggtcttagaccggtctcaatggagtttcattaaaatttcatgcacattaaatatgttaatgttgcattgtattaatgaagagagagatgataagagtttcatggaagcagagagagttttatcatcataaaac

SEQ ID NO: 10016 - DNA, 624 bp, Sorghum bicolor
  Clone ID: SORBI-28MAY03-CLUS48962_1
cccatatttagtggatctaggatcacctcagtttgtcggtgttcctcctgacccacagtggtcaatcgacacagagatgcacctcaagagcgttgttcatctggacaggtctcaggaggtagtgaacattgttgggagcaatggacagacttcacctagggacaaaagaagtggcacgaggaacagggtcatgagctcggcctttgtccccctgtttcacctcagcatcgagctcccaaacgatgaggacgcagaagggacggtgcaggtcctacaggcactcatcgagaaggggaaggcaaggaggtgggacaagaacatcctacaccgaagcaacatcagttgaggttttctcaagacagagcagataccagcatacatgatggagaagagataagaggtagtgtgaataacccattgttacataggtgatcaccgtggcaccgttggacgtgctttggttttttgcagtctagtgtacacttgtagcttctagaagttttgtcgaggagctatgtatagcaacaccattgtaaagattttggcagcaaatatttttctgctcttttatttgaaatgtttacaaacttcgccattcttgggctatggatatttctgattgac

SEQ ID NO: 10017 - DNA, 664 bp, Sorghum bicolor
  Clone ID: SORBI-28MAY03-CLUS48989_1
aggcatctacttggattgccgtgtactggtcgagtatgacattaggataaagagagggcagacaaggcaagaggatttgccggtcatcgatggggctgcaaccttcagtgagctcacatatatacgtggtgcaattaccaatcggatcagtggtgattctggtgggagcatggacatagcgcgcgcgctctttcgtaattcagtggaggccacagtagaagtttgggtatccaaccttggtaggtgtgtcagtggcttagacctgtttataactggttttgttggtcgaatacctgaagaaattaagatcttccgtggcagtattggtgacctatgtgtcgtaaagagatttgtggtggctgtgagattgaattctgtcttatttctactcttcaaggttccagcttttgggacagatcctatctgtaggtttgcctacagggcagtagcacacggatgcatttctggctaccgagaactcaattcctgtactgtagacgttaaagtgacttggtcaaacctgtactagccgtctagctgtatgtgagcactggatccatagtgcaagcttaattatcagaagaaatattgatgtaatcttcttatgtgttcatgtcttcatgtgtagaagttttctaatccaatatggtctaatgttgttttt

SEQ ID NO: 10018 - DNA, 885 bp, Sorghum bicolor
  Clone ID: SORBI-28MAY03-CLUS6400_1
cccaggcgtccgcgacccgaccaggcagccgcactctgttcgccggcggcagtcgctggcggcaacgggcggatggcatggcacaaggctactggtagtttgtagtaggaaacaatccgattcctctccccggccgcccccagcccccagccccctaacgcctgacctgaggaatcctgtccgcgtcgccgtctccagctctccgcctccagccctccatacagcacactgccgccccgcgccccctgacggccgagtgcccaacggagggaggaatcgaggaaggcagccggcgcacctgggaaggccaaggcttggcctgagagaatgcaagacccaagggatgatgatttctcagcaccaaagctgcataagaagaaggttgtgtaccggccactgccatcaggccagctcaagggtgaacctgaactgctgcggagagagtttccacagtcatcaggcatggtccaaaagccacccaaaagaagcttgaaggttgagcctcacacgtccccttctgacagagggactccagattccctgacggaatctggtcctactgatgaataccgggcgttacggaggaagtacctgatgctggaggaagagaactttgcactggacaaagaactgagcatggaagaggaagaaatgaaggccctagaggatgaaaagcttgcactgcttgatcagcttgttgtcttggaaggtcttgtggagccatcccagctgcagtctcagcgtaggccgtgaggtgttttggtttatgtgtaatctcgttgtcgttcagtgtaatactgcaactagtagatgttaaactttctgggtctgaacagtgtgtagaaacagcataaacctgttatcggcgaataaaaaactcttatt

SEQ ID NO: 10019 - DNA, 541 bp, Sorghum bicolor
  Clone ID: SORBI-28MAY03-CLUS64012_1
agaactggacctggactggcggacccctgccaatgaccgagtgacagcccacagtgcctgctgctggagctagaactgtacctggaccagcggaccccctgcgagacgccaacgccgatgaccgagtgacagccgctcccggcgggctggccacctccgactgcccacatatgaacggcagtctgaaactctgtttgcttgacagcctgctctgaattggggaaacataaagggtactggattgtagattgagagaaattgggggatggagctgttgattgggttcagtggtgaaggaagccgctagctgctgcttgggttgattcaagagagattagagaaggattggaaatgttgctgttggttcgcttgaactttgagtttctgattgtttgcttgttctcagaatgtagtgtcatgtagaactttaggttgccaacaccttggttctgagatgtgacaataaaaaaattgcgactgttgtgatggtatttttgaaatttcagttggtaagaaatgctgaaagaagaaatgtcatcat

SEQ ID NO: 10020 - DNA, 1039 bp, Sorghum bicolor
  Clone ID: SORBI-28MAY03-CLUS6409_1
cggacgcgtgggcggacgcgtgggttttttttttttttaactgaaccgttttttttcaacgtggctacaaatatttaatccatatataaattcgcggttacaataggctcagaatgaaacaatcgcggtccaagacgtgggaaatatacacagcctttttgcatctattacctgcccatgctgctacagaaagcctaagcatccaaaacgctctcatacttattccatcgcctacaaaattaaaacaagactgctcgtcctgatctgtgcactgcgcgctttttatccagcgtcaaactgttaagcagcgtcatctctgtgtgtccaccttctccggttgattcgcttggcttgggtcagagtcactcacagcaagagccggaggagcaggagcagcagggccatcgcttcctcctgatgtagctgcgccctcacttggagtagcggcccctgcttcttgctgttgcgacgtggcaggctctggtggattccaagcagcagcagctgatgcagcaatttgttcttcagttactttcatgagttcctcgctagtgtaaggtgcaggttcaggcttgacatttgggtcggcagcaggttgttggttgttgttcatggttgtgggcttataattcgtcgattgggaaatctcatcaattccgatttctcgttcaagagtgctcctgaattcccttgatacatcctgtatctctctaatggttggttggaaagcacgcaaagtcttccccaaattcctggctacctctgccagacccttggggccgaacaccaacaaggcgactactccgatgaccagtgcttcgggagctccaactccaaacagggaagcacatatgacgtttctgcggcgtgttctgctcccaaagaaagaagaggagaccatccgggtctgtacggaaccccactccacacctctccagcataggcgaggccgatggcggccgcgcgggggaagctggaggcggcgcacatcggagacggagacgaatgggggagccgggaggaggaggctcgccgtcgg

SEQ ID NO: 10021 - DNA, 1260 bp, Sorghum bicolor
  Clone ID: SORBI-28MAY03-CLUS64122_1
acgcagctaagggtggtgctgataatgtcattggcattgattcatcaggattggcactagaccttgccaatgagaatattgttctcaatgagctaaaccatggaaaaatctcatttgtaaaaggagatgcaactacattcatgaaaggagctatctcagaaaatgagctgtgggatttggtaatccttgaccctccaaagttggcgccgcgaaagaaggtgctacaaagtgcatccggtatgtatagaagcttgaacgcgcttgcaatgcaagtggtgaagccaggggggttactcatgacatgctcttgttctggagctatgacccaaagtggcatgttcctgaaaaccattcagggtgctgcatcaatggctggccgtaaggttacggtcttacgtcaagctggggcagcctgtgatcaccccatcgaccctgcataccctgagggccagtatctcagcaattacttgctgcgcgtggcatgaaaaataaaagagttaaaagcagagtcaagttagtagctgtagcaggctgacaagcctacgaggaccgatcatttctgaagagctcaagttcatctcatagcttagtcatgcaggttaggtttagttgttttatgaagaaaaaacaaagcatggaactgacattcacttctgacttctgattatacagttttgtagaaaataaagctatttgtttcaatgtaatgtacaatctgtgcacgagtggatccaaagttgtcacttgtacacgcatgcctactttgtatatattctacaccaacgatcacgaataaaatttctatttggtacaagatacatttggaccataatctgaattgtttggtgtttgcctgtgtaacatttaacttccaaagcatatcagcgacctaaagtggctctgttccatgacaagtagctgttatctcccattttccttggttttatcaagtatagcaaggtgaatgcaaatgccaagaaaaagcagattccaccaacagtgagatatgcaaggcccagaaaatcattctttccaccaatccaggttgcagtagaaagcaccaacttcttcttgccactaaagctataggtgttgtagttgttctccaattgaactgtaattgtatcgttttccttgagatcaacatatatcctaccatacagctttctgaatgttggaagtgctgcagttcgcatccaaacaataaggtcctcttgcttactcaacgggatacttgaatcaagtgtttttccaccttta

SEQ ID NO: 10022 - DNA, 858 bp, Sorghum bicolor
  Clone ID: SORBI-28MAY03-CLUS64138_1
gtgggacatggctgtctagatctggaggattccccacgtatggcctgcctcagcccttgctgtcccatctccgtgctgctctaggttgtgatatagacgaatccactacggaagctgatataaaggaaaatgacaaggtggtgctggaaacaatcctgtccatatttaatcccatgcttgaagcattgcctgagcaagatgattcccaccgggagggcgccagttgggatgtgaagctatcattggactacaaagatctgcagagaaagataatatcgtccattgtcacttcctgtacctcagccttggaaaatttttaactcatgctagatgcaatcatggatggaagtgcttcactgattgaattgcaagaaccacacactggagccctgttggaatgcctatgctgacgtgtagattgcgaagctgttgcacatgggttatctgcaccaactgcaatttgtgagcatctcgactaactgaagttgctcgtcgtgggtttgcttcatccgaggagtgcggagtcatgggttgtgcttccatggcttgtgatgattcaagtcgcacctgattgttactgcatagtggcgtttggtgaaagaatctacttttgaactagttctttgggaaccaaaattgcttttggagttttggtgaacgaaagctacttttgaactaatttcagcgcaatgtgcttgtagtccatgtgctaaaatcgccaagcaggggtaaattgtgtgttgcaatacactgtatattcgacaatacatattggctagcaccgatagtagagctagcggccggtgcccgctatagctataagagcatctcaaccagatcgaggatatccaattctct

SEQ ID NO: 10023 - DNA, 1132 bp, Sorghum bicolor
  Clone ID: SORBI-28MAY03-CLUS49433_1
gcacgaggaaacagttgaagggtggaatgcatctgcaccacccctctatttgtggagtcatcctcattggacaaagaagcacatgcaagttgctgaagagcgtggtcacacctgtatggggaatatagcttgccatgttgaagatagtaatcttttagatgatctgcccatgaggaaacaatctgaggctacaaacaaacggaactccagatcaggaaagcacgaggcatgcaatgacagaaaggccaatcgacttgatggtggtcctgctaagaagcaagcaagatctgaagaagagaaggaaactctagggaagatagaacaccatgtgaaagaggctaatataccagataacctcccagtgaagatagctgaaacttccaggaaagtcatctctcattctggaaaagatagagagaatggcaggtacaacagcaggagatatgataacaggagtaggaagcggacacctgatcacatagagagcctcccccctgaaaagcaagtggaagttgcatatgaagaaacaaaagttattattcctagcaaaaagattactcataacgaacaaagaggtgcttgccgtgaaaatagaagttcttgtgtggaggaaactaagagtgctcagtacaactatgagaaaattgcagcagggatgccgaacatgagctccagagagggaggggattctgacatgagtatctcacccccagtcagtagcaatgctcgaagcaaatccatatgctattccccctcgaaaccaattgaacactttgatacgacagctcacccagataaatacattgactctgtgctcaatcaggacagagctcacccagataaatacattgactctgtgctcaatagggctactcatcaggacagttatttggcacttaacaggaaatatgatcctatgtttactgacattgatgatatctcaaggatgaagggttccagcatcgaagaagtgaccaagccgtatactactgctccaaccagtgatccgtacagcttgcgatctagagatggcagcttctacaggcatccgagctcagaggatttaaacatcaatactgatgtgcctatgcaaggatacagtgcaagatatggacaaattggtggtgacagt

SEQ ID NO: 10024 - DNA, 793 bp, Sorghum bicolor
  Clone ID: SORBI-28MAY03-CLUS4944_1
gaaccaagctggcgtgcttcttgcttgtggtgcgacattgtactgggcagatggcaagactgcaaatttcaactgctcatttcttactaacctcgcttttgacgtcaccttatatggcacaaacggtactctccatgtcactgacttggtcattccgtatgaagaaaattctgcggagttcagtgtggcctcaaagtcaaactttgtcaaacccaccatcggatgggatccattgccaaggaagcatgttgttactacagatctgccacaggaggcgctcatggtccaggaattcacaaggcttgtgcagaacatccgggactccgggggcaggcctgagcgtaagtggccggctatcacccggaagacgcaggtggttctggatgccgtgaaagcttccattgacaagggatctgaaccaattgaggttgccagctaaatacgataacagatggcagctcgtactgctaagtttgtacttaatggcttctactcgcatttgttgtcccgtaaatgaaactataattgtaataatctgaaggaatctggtcaaattgaggagaacattaccatctaccgaatcattgatttgtgacgaatagattgtgtcatagatcagggttggtcgaacccctgacccctgagtggctttgtgatccactgatgggcgtggttcgatacactgttgattgttcaggaataggctcgtatatcagacatatttgtgtgctcgctactgtatgcaagcactgtagactggttgttgagctgaagcatgcaaatgaagaaggtc

SEQ ID NO: 10025 - DNA, 760 bp, Sorghum bicolor
  Clone ID: SORBI-28MAY03-CLUS49489_1
gaccccccactcacgagtccatcaaaccactccaccccggtgccggtggctcgtcctccgacgccaagccacgccacctcgcgccccaatccggaaagccccgccgccgccgccgctcgaccggccgtcgacccatgcttcgcgcggcgctcttccgctcagcccccgggctccgccggtctccggcgatggccgcggccgcggcccccttctccaccgccgccgccgccgcagcgtggctctccaacggccccgcctccaccccgcctagggtgcggctcctcatcggcggggagttcgtcgagtcgcgcgccgacgagcacgtcgacgtcaccaacccagcgacgcaggaggtggtgtcccggatcccgctcactacggccgatgagttcagggccgccgtcgatgccgccaggacggctttccccgggtggcggaacacgcccgtcacgacgcggcagcgcgtcatgttcaagttccaggagctcatccgggctaacatggacaagcttgcagagaacatcactacggagcaggggaagacgctgaaagatgcttggggtgatgtgttccgtggcctagaggtggtggagcatgcttgtggaatgggaacactgcaaatgggcgaatatgtatcaaatgtttctaatgggattgacaccttcagcattcgggagccacttggtgtttgcgctgggatatgcccatttaattttcctgctatgattccgctatggatgtttcccatagcagttacatg

SEQ ID NO: 10026 - DNA, 1213 bp, Sorghum bicolor
  unsure (1)..(1213): unsure at all n locations
  Clone ID: SORBI-28MAY03-CLUS4951_1
caactacccttgatgctccaaagaagcttctctcatcagaggcccttcaacgattagagccctgcaaacttaccttggggtctccctcagatagattgaatgcacttgttgaggccgtccttgttaaaccatgcactggattttgcatcagtcatgaagtcgcagtgttcctcagaaattacttttttaggcatgatgggacaataacttcttttattactgctcaggcttgcatgctgtaagcacttctccatggaacctctaagctttttgtgcattggaatgctggaggaagattctgaggaattttggcgtgataagtttgaatcgctccctcaaacaatacggaaatatgcttttgatctaccctcatccaaaaatgcaaataattcaaacaattcttgcaacatggtagaaggattgtctaggctgctgaaattgcaaaaggattggagttctgttctcttgtgcttgtatgaagctggaagacatgacaaaatgcagcttttggatatcttctgtgaggcagccaacccagatttgcaaactgaaaatgcaccagataattacttatgtgcctctaaagtgacttgtgaaaacttattaggagtaaagtcagggtctgctaaaggatttatagcccaagtaatgaatacaattaggtacttgcctacagaaattttgttacatgtccttgaagtttggagcatccatttaaaaggaatgagtgagatcaacgacagagtgaaggagcttcagtcaaccacaattggtgctgatagtgttaggaccaaaaggagatcaaccgccaatactggaaatggaacagttctactaaatgataaagtggctgcactattacaggatgtcattaggaaatatttggtacctgttgagtgcttgccttttcatgaaatcatctgcttcaagaatgttgacatcctccaatctgcgctgattggaaatccaagaagaatgattcaacttgatcttctgaagtcacagagccatctgaaatgttcttgttgcagcaggagtggtgctgctgtgtcaggatcgttgcatgacacatcaatcatgtgtaacctagcccaagaatatggtgtgtgattaaccttcatgaatggacacggccttgaaggcattatcaagagcacanattcaaaaggcaaaccggaaatcctacagttctccctcgaagaagaaatcaaaa

SEQ ID NO: 10027 - DNA, 647 bp, Sorghum bicolor
  Clone ID: SORBI-28MAY03-CLUS4806_1
gcacgagggcaacaacaacaaccaccacctcagcagcagcttcagcagcagcagcagcagcagcgtagagatggttctcatcttctcaatggttctgcgaatggaatttctggaaacaatcctttaatgcgacaaaaccaaagtactgcaaatgttatggcaacaaaaatgtacgaggaaaggttaaaggtaccttcccagagagactctttggaagaggcatcattaaagcaaagatatggagagaacgctgggcaactacttgattcaaatgaagcatcgttgttgaaagcagcttcaagtgcacaatcctcagggcaaattttgcatggaactgttggtggcttgtcaggcactctgcaacaagttcaggccaggagtccccaacttcctgggcctgctcagggtatcaagacagagattaatcccattctgactcccagagctgcaggcccagaagggtcatttataggtgtacaaggatctaatcaagctgggaacaatttgactctgaaaggatggccactcacgggactcgagcaacttaggtcaggaattcttcagcagaagtcatttatacagaatcaacagcaattgcaccagcaaatccagatgttgaccccacagcagcagcagcagcttatgct

SEQ ID NO: 10028 - DNA, 1461 bp, Sorghum bicolor
  Clone ID: SORBI-28MAY03-CLUS48150_1
ttctcttctgcaaactccttggatgacctcatcagctcggatgttcttggctggctgctcttctacctaaacaatggcgactacgccgtcctcgaatgcaccctcaagattttgaggcatctctctgaggtttctgaggagtacaacaggatgatgggcagagcagggtatttgagcgccctgtcaagcttgcttggagcaaaatcctgtcgagtccgggaaatggcggctcaggttctctccagcttgctgatgcttcaccccaatcgcgtcatcttcattcaggacggcgacaatctgaacaggctgctgcagcttcttgatccagcagagggcaagctgatggcgaaggacctgatcctctctgctatcatgtcattggctgagacccacagtggaaggaagaagattgtgacatcagagaatttctgctgcctgaaagaactggcagacactggtgacttcgacgccaagaagatcgtcaggaaactatctactaacagactgcaaaccatcttcagcaaaatatggagtgtctaagttatctctgactcctttttcactgaggtttagctgtagtgtgtttcatgtccatagtttttgctttgcttgtaagctcgacacatccatcagtatgattcccttgtgttgtactccctccatcccaaattgtaagtcgtttgactttttttaccccaagtttgaccactcgtcttattcaaaaaaatttgtgcaaatatagtcaaatttaagtcattcttgaagaacttttattaataaaccaatacacaacaaaaaaaaagtgatattttatacaaaactttgaataagacgagtggtcaaacttgatattaaaaaagtcaaacgacttacaatttgggatggattgagtaccccactacggttcatggaactataatcacaactaataaagaaactacgtgattataggaatcatgtcccgatcgtgtgaccctcccctgtcccgaacgtgtgaccctctcccgtagaagcccgatgtctctgcagatcgacaccgcgcgagctagggcatcgatcgagttcctcaccgcgggctagggcatcgagcacagccgggccaatcaaccactcggcgaacaggcggcgatcgtgcctccccatcaatcctttcccggtcatcgactccggcagcatcgccctgacgccggcagccttctgcgtcctagacctcaaggcagcagcacatcgttctttccctgaccttgacggtgccatcatcgctactcgacgccgtcagcatcgctacctcggtaagcgccgcggctctgacaacggtacgtcatccatcattcaggttaatgaattatcctgcgtgcgtgcgattcctgggtgttctgcctctttagcctctcagattaactgtgccctctccctcgacttctcaggtccgtcagacacatcacatgactatgcttttag

SEQ ID NO: 10029 - DNA, 912 bp, Sorghum bicolor
  Clone ID: SORBI-28MAY03-CLUS4837_1
tcgagccctgagaaattctccattctccactggaccctagccaaaacagagaccggcagcagatcgcacgaatgtacaagtcgcggctgcaggagctgtgccagaagcggcgatgggcgccgccggtgtacgagcctacccgcgagggtcctgcccacacgcccctcttccgcgccactgtcgtcgtcaatggcgagagtttcagctccccggatgaaggggagaggtcagtcaaggaggcgtgcaacctcgctgccatggccgccttcgagaacctcagcgcgctcccggccgaggcccctgcccctgcccctgcccctgcgccgccgccgcccgagacccagcttcgttacaagaatcagttacaagaatatgctcagaagcgaggcaaactcctgccttcgtatcgtcccattcatggaggttctcttcgtgcacctctattcaagtcagaagtaaccatagatggtcaaacatttgagagcccagagtactgtcgcacaatgaaggaagctgaaacagcggctgcaaaagttgctctgatgttcttacctcaagaagcaggcccaacacagcaactaccgcttccatcagtatcctataagaatcttctacaagaatttgttcagaaagaaggctttcccttgcctacctatgatacaactttggatgtctcgaactattctgctgccttcatatcaactgtggaaattcagggtgcaacttttcgtggagagccagggaacactaaaaagcaagcagagatgaatgctgcgaagattgcttttcaacatttcaaagacagggtaaaagactctgcttgttctactggccatggaggaccacctgtgcaacaaggaaccaagaacttgcctgctggacaaaatatcaagggtctagaacctggttttt

SEQ ID NO: 10030 - DNA, 533 bp, Sorghum bicolor
  Clone ID: SORBI-28MAY03-CLUS48529_1
gcacggcagtgcgaagcacctgtgtctcttgctccatcagcttagccgagatcaggcttcaggaaagaaaaatgaagctctcggcggcagtcctctgcgcccttgtggctgtccaggcggcggcgctcctcctcgccaccgtgccgtcggcgcaggccaaagagctggaggtcggctactacggcaagaagtgcaagggcgtggagaacgtggtgaagtggcatgtcatcaaggctatcaaggccaaccgccgcaccggcgccgcactcgtccgcctcctcttccatgactgcttcgtcagggggtgtgatggttctgtcctcctggacgcttcctccgacaaccctcacccggagaaggaggcgccggtgaacatcggcctcgccgccttcgacgtcctggaggagatcaaggccgccgtcgagaagaggtgccccggcgtggtctcctgctccgacatcctcatctacgccgcccgcgacgcggccagcgccctcagcaacggccacgtccacttcgccgtccccgccggg

SEQ ID NO: 10031 - DNA, 619 bp, Sorghum bicolor
  Clone ID: SORBI-28MAY03-CLUS48565_1
gcacgaggctcctctcacagtcacacggaaaaagctcgctagctacccatggcggcgtcttgtgtttcgaaggaaaggacaggcgtgcccgtggtagctctgagtctgggcaagccgatgccgcgcgtcggcttcggcacggcgtcggcgactctgggccaggccgagggccgcgccggcgtgacggaggccgtcctcagcgctctcagcgctgggtaccgccacttcgacacggcgtcggcgtacaactcggaggccgcggtcggggacgccgtcatccacgccgccgccgtccgcgacgacctctacatcacgacgaagctcgccatcaccgacgcgcaccccggccgtgttctgccggcgctacacaagtcactccggaatctgcagatggagtacgtggatctttatctcattcactttccggtgagcatgcggccgccggtggtggaaggaggcctggcggtggtgaaggaggacctggtagagatggacatgaagggggtgtgggaggagatggaggagtgccacaggcgagggcttgcgagggccattggcgtcagcaacttcagctgcaagaaactagaatacttgctatcctttgctaacattcccccgg

SEQ ID NO: 10032 - DNA, 1192 bp, Sorghum bicolor
  unsure (1)..(1192): unsure at all n locations
  Clone ID: SORBI-28MAY03-CLUS4867_1
ctagttctagatcgcgagcgcccaaccaagagacgctacagatatactggctatgcaaatgctgcttttgatcaggaccgcagttgctcacacttggcaaagatgatcattcagcatgactacccacttcacattgtccaacagccggcattttccatttttattgaaagtctgcagccacgtttcaagattgtggatgttgatacgatggaaggagaggtgtatgctgtttatcagaaagaaaaggagaacctgctacaatcattcagcactatgcctggaaggatcagtctcactataggattgtggacaactagtcagactcttgggtatgtttcacttgcagggcagtttatcgactccgagtggaaagtgcatcgaaggatgcttaacttcatgatggtgtcatctcctcattcagagaacgcacttagtgaggcaattagcctgagcctttctgactggaatatgaaggacaagctattcaccatcacattggataatgattgctcctcacatgatatctacagtgcaaatttgagagatcatctctccaacaagaacaatctcatgcttaagggacagctctttgttgtgaggtgctacgcccatatccttaatgctgttgcacaagatgtcattgcttcgattcatggtgttgtatacagcatccgtgaaagcataaagttcataaaagcttcttctgcccgtgaagagaagtttgccgagattgctctgcagctggagattcccagtactaagaccctctgtctggatgttacaacccagtggaacaccacttatctgatgttgttagctgccttggattataagcagactttcactacactagaaacatgtgatgataactacaatgaagctccgtcagcagaggattggaagaaagttgaggctgcctgtaattacctgaaactgctatacgattctgcacatagcatcatggcagcagcaaacccaactgcaaacatctttttccatgaagcttggaaacttcagctagagctagcaaatggcacaggacatgaagatcccgctttcagtagcatcgccnaggatatgcatgagaggtttgacaagtactggaaagattgcagcctcgtgttagccattgctgttgtcatggatccacgttttaagatgaagcttgttgagttcagttactcanaaattt

SEQ ID NO: 10033 - DNA, 746 bp, Sorghum bicolor
  Clone ID: SORBI-28MAY03-CLUS50067_1
ccccccctccccgccgcccgccgcctccagcctcgcatccgggggcaggaggcccgcgcgcgcacgaggaggccggaagactacgtgcccccgcatgccctgtcccccccccgcccgcgcaggccccggcgcgctccacgcggcactcgcccccgcctccgggtccacgccgtcgctgtcggggtccgccgacccccgcccgcccccggccgcggccccgccgagtgcgccttcaccttccacccgtcgcccgggcgtggtggcggcggcgccagcacgggcccgctcgcgcgccggccgggcgcctctccgcgtccgcggagcgcccccgagttcgtcccccgcccgccgccagcccggctgtcccgccggccccatgcggcaccgccatcctgcgttccttggtccgctccccgggcgcgcccttcccgcccgccgctgccgctgcccgcggcctgggcccacccgtcctctccgcggtccccgccttcgccgtctgccgcgcccgccgcggcccgccgctgccgccgcccttcttcggcgtcccctgcctggcggtggtcccgggcgtgccggccgggttgctccggagctgctggactggagctgaataaggatggatcagactgcctttagtttgtgcaagctcatgagcgcgatcgatcgagcattgtcagtggttgttgtaatgcagtattgtaatctttgttattatgtacgtccacttgtaccataccactggaatc

SEQ ID NO: 10034 - DNA, 1166 bp, Sorghum bicolor
  Clone ID: SORBI-28MAY03-CLUS49815_1
agctcgctgacccgcaaggcgcaaacatacaaaaagagtggaacgaaaaaggagactttttttgacatataaaagttggtcttgtttcttgagcctgcagaggaatggtgcagctgtgaagggaggggcaggagcaggagcagggggaggacataggaggggagaggagccgcagaagccgcaggcatggctgcggcggccattggggtcgtggcgctgttcttggctgcagcttcatttggggctaatgccaacaccgactcgaatgatgtgaatgccctcaatgtcttctacacaaccatgaactcgccaccgcagctgacgaactgggtgtcccaaaatggggatccctgtgggcagtcgtggctgggggtcacctgctcgggttccagagtgacagcaataaacttatctgggatgcggcttaacggcaccttgggctacaacatgaaccagctgactgcactagttcagctggatgcgagcaacaataatcttggaggcagtgacattccttataatcttcctccgaatctccagagcttaaatcttgaaggaaataacttcagcacgagggtgccttactccatctcccagatggttgcacttaggaatttaaatcttggtcataatcagctctcaaacatcaatgatatgtttagtcagctcacaaatttaacaacgctggatctatcatacaacacattttctggtaatattccacaaagctttaactccttgacaagtttgaaaacactttaccttcagaacaacaaatttagtggcacaatagatgttctcaccaatcttcctcttactgacttaaatgttgaaaacaaccaattcaccggttgggtacctgataaactaaagggaatcaataatctccagacaagtggaaactcgtttaacaatggccctgctccaccacctccaccatcatcactatcaccactatcaccaccatcaacagatacccctcctccctctcggcgacctgctgttccaagtagtgctggtaaagataccccagccaaagatggtggcaaacactcgaaacttggtggtggtgcagtagcaggaatcgtaatatgtttgcttgttgttggcgcaatagttgcattccttgtgatcaaaaggaaatcttggaggttatcacggggaca

SEQ ID NO: 10035 - DNA, 1152 bp, Sorghum bicolor
  Clone ID: SORBI-28MAY03-CLUS4979_1
cttatgaagcgcattgcacggcaattggaagaagcatcagtgtcagatcttctgatccctacagtggatggggataccactgtttacgacattgacctgattcttagcattgttgaagaatttgtcagacaagatagtaagaatgcccagagacataatggtggtgaagtgaatgaccatgtatcagctcctagtgcatcaatgattacagtggccaaaattgttgatggatatctcgcagaggttgcaaaggacccaaatataccggtctacaagttcttcagtctagctgagacagtttcagccaattcaaggccggttcatgatgggctgtatcgcgccattgatatgtatctgaaggagcacccaggcttgggcaaaagcgataagaagaggctttgtgccctcatggactgcaagaagttgtcgccagatgcatgtgctcatgctgtgcagaacgagcgcctgcctctgaggattgtggtgcaggtgctgtaccacgagcagacaagggcttctgcagcagccaccatccgagctgacagcatcggcatcggctcctacgagagctcaaggtcaggggccacaacaaacacagaagacgagtgggacggcgtcatggccgtggaagacctcagtctgtccaagaccacgaagctagacaaatgtcacacagccagcaccatcgtggagaagaaccacggtggcaacaagggtgccaacggcagggtgaaaggtggcgcaacgtcaaagaaggcgcttgggaagatcatgtcaagcaaagggcagactggggagcgcagcagctcggattcatccgacagcgccatcttgcccagccaggagcatcccaagaggacccccgcaaggagcaccaccaagtcagctgctgcgtagctgcagccctttgctgagtgaaatgcttaaggagcactaggttgtagcagtcgtctgttctttgttatgaatgttgcatagaagcaaggaccatgttttttacacgtctgtagggatggtataatgccaggtacgtacgttgttaggtgatgttgttagcatgtagtaggcttgccgtgaaacctatgagaccttgggctgtgctgtgaatgtctgaactcggagtagtgtataagaagcctacttgttagagtg

SEQ ID NO: 10036 - DNA, 1365 bp, Sorghum bicolor
  Clone ID: SORBI-28MAY03-CLUS50197_1
gcacgagggcggtcccggcgacccacccgaccgacccccggagcggccgaggcctcgcctcgctcaccgacatgtgggccctcaacaacgccaaggccggcggaccctgcctcacgccgcggcaccctgcgccgccctccctcgcgtcgccgtcgacggcggcggcggcggctgggcggaggttcttgaggcgcagccccgtgtgggcgcccctggtggcggtgcgcgcgtcggggggcacgaggaaggcccgtcccggcggtggcgaggccagcagcggcgaggaagccgatagcaaggcgtcgtcttccgggcacgatgatgcatctaccccaactggggatacctctgctgggttgaaccaaccccatgacgagacgaaaacaaacaagccgattaatgtttctagcagcaactactggcgagatgtcagggcaaaccttgtgcgtcgggaacaggagctattagtggatccaagcactcccacagagtcaaagccatcgtcaggagatccattacagctccctcaaaagtgggctcatgctattacaatgccagaggcaggatgtgttttggttgctactgaggcgcttgatgatgatagcatctttgaaagaaccgtcatcttcatccttagacttggttcaagaggtacgttcgatggcccgttcggagttatcctgaatcgtcccctctacacaaagatcaagcacgtgaatccaacgttccaagaccaggcaacccctttcggtgattcccccctcttcttcggaggccctgtcgacatgagcatgttcctggtgaggaccgacgacagctcgcgtctcaaggggttcgaagaagtcgtaccgggcatctgctacggcttccggactgaccttgagaaggccgccgttctgatgaaaagtggtgcgatcaggacacaggacctgaggttctacgtcgggcatgctgcctgggactacgagcagctgttgggtgagatcagggcaggatactgggctgtcgcgtcttgcagcacggagctgatcagcgatgccttgacgggcgatccttcttgcctctggactgagatactgcagctgatgggaggccaatactctgagctcagcgagaaaccgaagcaggacagctcgtaggcatttgctcatttgagatgtaataatttgttataggcttatggtcaggtctgtacataattggaatagggtgactcgcttgttacccctgcttcatgtagcgactgttatgcgttgattatactgaaataggctctatataatggctgcctgcctatggatttcagcaattgctgaatatgaagatagcgtttttgatgaatcacacatcataagtgtttctttt

SEQ ID NO: 10037 - DNA, 1269 bp, Sorghum bicolor
  unsure (1)..(1269): unsure at all n locations
  Clone ID: SORBI-28MAY03-CLUS49171_1
gcacgaggaacttctttgggaagccatgaataccactgatgactcaactggacttatcagagggttcatgcttatatcaagacagactgcagctccttcatcgctgtacacagtgagttgcagagatgaaaactgngaaaagcatggcgaagtattgtgttgaagatttaccaaatcttttgaaggcagagaatctagacaacgttgcagcacttttgtcccgtttaattgagtctcttccagctgatgctgaatctttgatcaaatgggttgtagaagttaggagaaaagaggaaggtggaccaagcttaagcaaagaggagaaagaaaggcttttcttgaaggaaaatgtactgcagcaagttcgtgataccaggctatttgccatagtccatgatcaacagaatgctaataaaccatgttgtaattgctcatcactgtgcgaagaagattcccttactaggattgcagccgttgtgtgctgtcagggagctgcaatgctatcaggaaaccttgtgccaagagatgccttctgctgcaaagaaacatgtttgaaatgtgtccaagcgaatggtgatgggctcaagaccgttatctcaggctctgtggtatctgaaggcagtgagcaaggtgttgatatgcttttaccaatgtcttcacctagtgccagttcatgcaattcaaacttgaggaacaatgtcatcaaatatccatcacccgtggatgttctaactgttcttctgcgggctttacatcccaacacgtggttgggcatcaaagatgagaagctgaaagctgaatttcagactcttatttcaactgacagtctacctgatgatctgaaacgagagatattgcatctaaggcggcaactctattatctaaaggcctgtaaagaagaggaatgtgaagacgcggagccaccatcgcctaagcagcaaagctgaagtggcaatgtgcccacgtcattaatttacttacaagaaattgatgtcaagagaaaagttggcagagtccagatatcaaatgagcaggattatgatagtagtgtagtgatggtatcttattattcaggtctgaaatttcaaaaaaaaaaaatcaggtctggtgttgtttccttctaagagaggctattatcctccttgctcaaggagctcaaggagatgctattattttttttctgaatgatgattaaaccatttctccttacttgctttttgataaaccttgtcatattctctatactctgaatagattcctgtatccttc

SEQ ID NO: 10038 - DNA, 1024 bp, Sorghum bicolor
  Clone ID: SORBI-28MAY03-CLUS49205_1
agcccaggaacgaaccgaaagcctaatcgcagtcccactccttcccagcaacaacctacgccgccccaggctcccaatccagaactccagagtccagaggcagaccggcaagctggacacctgcggcatggagcgggtggcgctgctccgcacctcaggccgccgcctcctacaccgctgccgcaggggcaggtccgtcgtcgtgcccaccgccgcggcctcatccttggcacgccggacgtcctcgttctcactcccggcgcgcggctactcggctctgccccgcggcggcgcgcgattcctggccgcggcggcgccgctgcactgctccggccggtactggccggccgctgcgccacagctcgcgcggaggctgtccgcccccgccgtgtctacctcgccctcacctgtgccctatgatacagatgacgtacatgagtatgctgcaaagctcggatttgaaaaggtctctgaacagactatagatgagtgcaaatcaaccgctgttctttacaagcacaagaagacaggtgctgaagtgatgtctgtgtcaaatgatgatgagaataaagtctttggcattgttttccgtacgcctccgaaaaattctactggcataccccacatccttgaacatagcgttctctgtggatcaagaaaataccctttaaaggaaccatttgttgagctcctaaagggtagtttgcatacattcctgaatgcattcacatatccagatcggacatgttatccggttgcatcaacaaacaccaaggatttttacaacttggtagacgtataccttgatgctgtctttttccctaaatgtgttgacgacttccaaacctttcaacaagaaggttggcactatgagcttgacaaccctgaagaagagataacatacaaaggtgtcgtcttcaatgagatgaaaggagtttactctcaacctgataacataatgggacgtgtatcccaacaggcactttcccctgataacacatatggtgttgatagtggtggggac

SEQ ID NO: 10039 - DNA, 702 bp, Sorghum bicolor
  Clone ID: SORBI-28MAY03-CLUS494_1
gctcctagaaattatcagtggtcgtcgccctgcacagtcagttgagtctgttgggtggcagaccatatttgaatgggcaactcctctagtgcagtcccaccgctatcttgatctgctagatccacacatccaggaattgccggatacaggagttatccagaaggttgttgatcttgtctactcctgcactcagcatgttccttcggtgcgcccaaggatgtcgcatgtcgtgcatcaactacagcagcttgaactgaagtctgcagcgtcggagcagcagctaaggagcgggacaagcaccagcgcaacatctccaatgttgccattggaggtccggactcctcgctgaaaatccgctagcagaatttgagaaccttttatgtactacagcttcagtcagcactccgtaggtggtagcacattctttaagagtgtataatgacccaagagccaccattatcgtaatcagtagtttagtctccccaagtgctgatggggtaagttgtagtcatttgtactcaggttgacctctactctgctacatatctcatgggttttgtgtagtgacctaaagaagctttaggcctatgctctgaagtctgaagaagcaactcgtgtatttgacagagtaataccaagtagtatgtagtacttcctatctacacaactagcagtttggtttctatcatatttacattcgac

SEQ ID NO: 10040 - DNA, 1090 bp, Sorghum bicolor
  Clone ID: SORBI-28MAY03-CLUS49401_1
acgcacggcgcacccggcagcttggcagccgcagccgtcaccgccagtgtcgcgctcgcctctcgcccggagcccccgaggccggagcggtcgcccctcgccaccggaggccggagcttgcccctcgcccctcgctcccaaatcctgcctacgcccggtgagcctccctgatctcgtctccccgcgagccggcgacctctcagatccgccggccccgtaccgcctctcttcgcccccactgccagatccggctctgcctccgcaaaatcctgcgacatcgcagacgatccggggtggagagcggaggtaggtcgcagcagccatggcggccgcagaggagaatagctcgctgttcctgattttcatcctcaccatgatcgcgctgcccctcgtgccctacacgatcctgcgtctgtgtcgcgctgcttccgagaaggccaagaccatccactgccgctgctcgggttgccaccgctccggcaagtaccgcaagtcgatctacaagaggatatccaacttctccacgtgcagtaacctaaccatcgttctgctctggattgttatgatattcctggtttactacataaagcatgttagccgtgaggtccaagtttttgagcctttcagtattcttggactggaatctggggcatctgaatctgagatcaagaaatcatataggaggctttctattcagtaccatcctgataaaaatcctgatccagaggctcataagtacttcgttgaatatatatccaaggcatatcaagcattaactgatcctatatctcgcgagaattatgagaaatatggtcaccctgatgggcggcaggggatgcaaatgggcattgctttgcccaagtttttactaaatattgatggtgcatctggtgggataatgcttcttggaatagtcgggttttgtatattattgcctttgatgatagctgttatttatttgtcaagatcgtcaaatataccgggaactatgtcatgcatcaaacactgtccacttactactactttatgaagccatctcttgctccaagcaaagttatggatgtcttcatcaaggctgccgaatatatgg

SEQ ID NO: 10041 - DNA, 645 bp, Sorghum bicolor
  Clone ID: SORBI-28MAY03-CLUS4941_1
ctctcgtcaccatgatcgataagcagagactagataggtggctgccagcagtggcagtgctatgctatatagcgcccccggtgtgctcgcctcgggagcgccttggaagcagcagcagagaacagagcagagatagcgttgtgtagagggaggacgagtgctccttctcgttcgtccaagaccatcagcaaacgacgaccaaccgcgcgcacagccggccggcgcccagctcgataatttgtggcggcggcggcggcagcaagcaaagcaaagcagcagtcacatacaggcggaagcgaaccgttcatcctattcttcgtccgctgcttgggagaagaagaagcgcgtgagccctccgccgcaaacgccggccatttcctcaaactgctgctcgtctcactagaagccagccatcagcagctcgacgccgcactgctgacgacgaggcccagccggcggccctagcttgttcaatggcaactccgccccgcccccctcccctgcgcggcgccccgccggcagccagccgcccacgccgcacatcattgcatgcattgcactccagtccttgctttactttgcttcctcctttcggcttttcaagtgcacgggctttcacatacatacaggctcgcattagttttg

SEQ ID NO: 10042 - DNA, 1097 bp, Sorghum bicolor
  Clone ID: SORBI-28MAY03-CLUS49410_1
gcacgagggagcgagagacgagagagaaagcagtttcgagctcgccgcagcgaggaccggcccgctctcaagcgataaggggcgtgggcgtcggcatggagagcgagatggcggaggagtccccggccgcggcggcggcgcgggcccggccactggaggcggtcgcggaggaagggcaggaggtggcggagcagaaccccgtggcgccggtggggtccaccctcaccatggagcgcgtcgccgccgcgaagaagttcatcgagaaccactaccgctcgcagatgaagaacatccaggagcgcaaggagaggcgctttagattggagagacagctagcttcttctcaagttcccaaggagcagcaaatcaatttaatgaaagatcttgagaggaaggaaactgaatacatacgacttaaaaggcacaaaatttgtgtggatgactttgagctgctcacgattattggaagaggtgcttttggagaggttcgattgtgtcgagagaagacctctggcaacatttatgcaatgaaaaagctcaagaagtctgatatggttgtcaggggccaagtggaacatgttagagctgaaagaaacttgttggccgaagttgctagtcactgcattgtgaagctttactattctttccaagacactgaatacctttaccttattatggagtaccttcccggtggtgatatcatgacccttctcatgagagaggataccttgactgaacatgtggcgcggttctacattgctgagacaattcttgctatcgaatccatccataaacataactacatccacagagatattaagcctgataatttgcttctagataagaatggtcacatgaagctgtcagattttgggctgtgcaagccaattgattgttcgaagctctcaactttgaatgaagatgaacccatgggagatgacaacttgagggaatcaatggatattgatagttccttgtctgatacagcaaatggtagaagatggagaagtcaacacgaacagcttcaacactggcagatgaacaggagaaaactggcattctcaactgttgggacaccagattatattgctccagag

SEQ ID NO: 10043 - DNA, 1137 bp, Sorghum bicolor
  Clone ID: SORBI-28MAY03-CLUS50741_1
gcacgaggtcttcctcgatgatgacattgttgttcagcgtgatttgtctcccctttgggcgatcaatcttgaagggaaggtgaatggagctgtggaaacatgcacaggggaagacagctgggtgatgtctaagcgtttcaggacgtatttcaacttctcgcatcccgtgatagctcggagtcttgacccagatgaatgtgcttgggcatatggtatgaatatatttgatctggcagcttggaggaagacaaacattagggacacatatcatttctggttgaaggagaacctaaaatctggtcttacactctggaaatttggtactttaccacccgcccttatagcatttaggggtcatgtgcatggcatcgacccatcatggcacctgcttggcttaggataccaagacaagacagatattgagagcgtcaggagggctgcagtgatacattacaatggccagtgcaagccatggctagacattgcttttaagaacctacaaccattttggacaaagcatgtaaactactccaatgacttcgttagaaactgccatattttggagcctcagcatgtcaaggagtgacttgcagcaaatgctggacacagcaagggagtataaagtttatgatttcgtttgttggctggagaggccgattgctgctggataaatatactggataatcaagaaagcaaccagcattcaatacaactgaccatcccctgcgaaaactggcattcaaatacctctggagttttcatctgtatcataggggaacacaattcttaccatctgtatcatactggtgcatcattcttttctatactgtaactgtgcaaaaggagctcttcgactggctgatccttcgtcacagaataactcagaagactagaagattgaatgattggttgatcaagatgaagaaaggaggcggatattatgaggtggcaagtttatatgctttccatccatccatttaattctttttatactcgagtcattgaaattttgttctggtagttttgtgattgctttggtaggttggagatgattgtagtagagatgccattgtttgtggagtaacctacaggatattgttacaattgttgacatactaaagatgtgcagataattct

SEQ ID NO: 10044 - DNA, 1048 bp, Sorghum bicolor
  Clone ID: SORBI-28MAY03-CLUS50751_1
aaaggaccgcctccctgaattccgcgccgccgtctacatcccccaagagtccaaaaaccatggcctccgccgctgccgacgccgtctcggcagttccgccgtctgtggtctcggctgctgaggagacgctcgcggctgccgaatccgtaggggaccatctttcccatctactcgcggcggcggcggcggaccccgacgccgtggccgagctcccgccactgctccgggcgcgcgctttccttgccgtggcgcaggccgccacctctctcctcgcagttcgtctaaggtgttcgggaattgaccctgacgagcaccccatcagaaaggaatctgaaagattaagcctatggcaggagaagttaaatcaatttgaggcctgggacaaggcaccacttcgccctactactacaataaatacacaagcagcagcaaggtttattggacactcactttcccatctgacatccgatcagaagaggagcatgcaggaaataagtagaggagaaaagcggagttggtctgggcagaagagaaagcctgagcctttaccagaaaaaaagtctgtccgtgctgctgcagaagagttccttgcaaaggctgctcaggaacttattgggcatagtgatagcagggtcaagggtcctgttatagtgattcctgatgaagatgaggactagatcgaaaaaatggtttttaccagattacatgcctgattcatcggctaggcaaaggaaggtagaaagtccaggcgaagaagataaatttacctacattgctgtgatgatgaagataaatttacctacattgctgtgctgttgtacatggaaacagggaatggggcaaatgcttgcatacttccccctgtttttggagcaatttttctcgaattttgagtgcagtttatctgagtttctttccagaaagaattttgacatcctatttgttagtggagctggagtaacaattctatttgatttgtgtgctagagtacccctaataatgagtaatgtcacaaaaaataaaaaaatttaaataatgagtactattt

SEQ ID NO: 10045 - DNA, 817 bp, Sorghum bicolor
  Clone ID: SORBI-28MAY03-CLUS50907_1
gcacgcggctcgccgcccgtcgcttctttgtagtagtgcgcgctgctcgcttgcactagctagccagcggcgcacagccacagtgcaccacctctcgccgccgcagcagcagcaacgggagcggcgagaagctagctatagcacagcgaactcgagcctgtaactcccttacacacagtagagaagcagtacagccgccggtagagatatatagacagcggcaccgagagtgagagaggcatcagccatgacgatgaggcagtcgaggttcaagaggatctgcgtcttctgcggcagcagccaggggaagaagcggagctaccatgacgccgccattgagctcggcaacgagctggtggcccggagcgtcgacctggtgtacggaggcggcagcatcgggctgatgggcctcgtctcccaggccgtctacgacggcggccgccacgtcatcggggtcattccggagacgctcatgacaccagggcgccgccattgagctcggcaacgagctggtggcccggagcgtcgacctggtgtacggaggcggcagcatcgggctgatgggcctcgtctcccaggccgtctacgacggcggccgccacgtcatcggggtcattcccaagacgctcatgacaccagagataagtggcgagacagtcggggaggtgcgcccggtggccgacatgcaccagaggaaagcagagatggcgcggcagtccgacgcattcatcgccctgcctggagggtatgggacgctggaggagctgctcgaggtcatcacgtgggcgcagctgggcatccaccacaagccggttgg

SEQ ID NO: 10046 - DNA, 594 bp, Sorghum bicolor
  Clone ID: SORBI-28MAY03-CLUS5086_1
gcacgaggctccctccctgcccctcccctacctgcgactgcgactgcgagagaggaggacggtgggcggaggacctcctcgcaagccaacttcttccatggcttccgccgccgccgctgctctcctcctcctcctcctcctctcgccgtccgctgcgcagcctggtttcatcagcttggactgcgggggagctcgcgatcacacagatgctatcgggatccaatggacttccgacgccaccttcgtctccggcggcggccagaccgcgcagctgcaggtccagaccgcccagcagcagctgaccaccgtgcgctacttccccgcggacaaccgcaagtactgctacaccatgaacgtcaggaaccggacgcgctacctcgtcagggccactttcctctacggcaacttcgacaacagcaacgtctaccccaagttcgacatctccatcggcgcgtctacctggtccactattgtcgttgatgacgccaccacacccgttgttgaggaagccattatcttggcggctgctcccacgctcagtgtctgcctctccaatgccagcacgggacagcccttcatctccactctcgagct

SEQ ID NO: 10047 - DNA, 325 bp, Sorghum bicolor
  Clone ID: LIB3476-003-Q6-K1-C3
ctcctcgcaagccaacttcttccatggcttccgccgccgccgctgctctcctcctcctcctcctcctctcgccgtccgctgcgcagcctggtttcatcagcttggactgcgggggagctcgcgatcacacagatgctatcgggatccaatggacttccgacgccaccttcgtctccggcggcggccagaccgcgcagctgcaggtccagaccgcccagcagcagctgaccaccgtgcgctacttccccgcggacaaccgcaagtactgctacacctatgattgacaatccagatttcaaggatgatccatacatttatgcatttg

SEQ ID NO: 10048 - DNA, 1065 bp, Sorghum bicolor
  unsure (1)..(1065): unsure at all n locations
  Clone ID: SORBI-28MAY03-CLUS5103_1
cttgagcaagaggaatatgtggaggatggcattgactgggcaaaggttgactttgaggataatcaagactgtttgagtctctttgagaaaaaaccactggggttattgtctctgctggacgaggaatctactttccccaatgccacagatcttacttttgcaaacaagcttaagcaacatcttgactcgaactcttgcttcagaggagaaagaggcaaggcatttgctgtccgtcactatgcaggagaggtggcttatgatacttcgggttttctggagaagaatagagatttattgcacatggactcgattcagctccttgccaaatgcaagacttctctgccaaaaatgtttgcatctaagatgctagttcaatcagataattctatgtctgttccatatagatctagtgctgctgattctcaaaaactaagtgttgccatgaagttcaagggtcaactgttccaacttatgcaaagactggaaagtacaacaccacactttattcgctgcattaaaccaaataatttacaactccctgcaatttacgaacaaggacttgtgcttcaacaacttaaatgctgtggggttcttgaggttgtccggatttcaagatctggatatccaacaagaatgactcaccagaagtttgctcggcggtatggctttcttcttcttgaggatgttgcatcccaagatccactcagtgtttcagttgcaattcttcatcagttcaacattttacctgagatgtatcaagttggctgaacaaagttgtttttccgaactggccagattggcaaacttgaagatactcggaatcgtactctgcacggtattttaagggttcaaagctgtttcagggggcatcaagcccgtcatcatgcgagagaacgaataagaggagttgggggggggaatcattcattcntggtgagaatgcacggcaaatttattcctctttgtcgaggaaacatagagcagcagttattttgcagagaaatgtgagatgttggctcgcaagaaggtatttcataaaactccggaaggcctcggnaataatac

SEQ ID NO: 10049 - DNA, 667 bp, Sorghum bicolor
  Clone ID: SORBI-28MAY03-CLUS49550_1
tgtgggtgcagggcggcggcgggcccgcgccggggtgcgtgccgcggtctctccagccccgcccggcgccgcgtccccatttcggcaacgtcattggcagttggtgctgggcggccgcggatcctcgccggtgtgcctgatgccgatcctcctcccccccccggcgctggcgcccccttgccccgcccgatggtcgcttcccgggtccgtgtccggcccgccccttcagattgactgatgccaaacgacgtcaattcatcagcaatggctgccacttgctgggcgtgattttctattgccgtgaccgtgacttgtccaacaaaatgcagattgctaacaagccttcaactggtaatgagacttctcgatagcagcttgttacattacagagcaggaaacagacatgacctgatctcaaactgatcaatagtcaagcactaggatgcacatattggagtagtgtcagtgtgctacagtgctagattgagaatgtgcaagaaaaacaattaaatttagatcctgcaatgttgagtaaccttttgtggatgacatatgttgttttacaatgtctaccaatcgatgttgtattttacgtactgtatcaatctttgtaaatattttttattgtagattatcgtaaatattcgttaatgcaaaatctcgtaaa

SEQ ID NO: 10050 - DNA, 850 bp, Sorghum bicolor
  Clone ID: SORBI-28MAY03-CLUS49589_1
gagtaaatggaccaagaaatcatgggaaaaggcagttatttttgttgataactctggtgctgatattatcctgggcatattaccatttgcgagggagttgctccgacgtggcacaaaggtgatacttgctgccaatgatatgccttcgatcaatgatgtcacatatccggagctggttgagattataaacgagctcaaggatgcagatggaaagctatcaggtgtggatgcatccggcctccttgttgccaactctggcaacgatctgcctgtaattgatttatctagtgtgtcaccagagcttgcctttatggcaaatgatgctgacctggtggtgctcgaaggcatgggaagagcaattgaaactaacctatatgcacaaatgaaatgtgactcgatcaagattggaatggttaagcatcctgaggtcgcccaatttttaggaggaagactttatgattgtgtcttcaagttcaatgaggcctgaactacaagatacattggataacacaataccggccgcactagtagtggtttagttttccccaagatcagcttgttaggtgttgcactgaacataattgtgttagcatcagcaatgatatcaagcaaaataagctacgtatgtggtggtttttgtgacgtgttaagaagggtgattatgaggcggttgcattttgtatgaaatctgatgcaccagttcccatttgacgcagtagcaaaatcgcgcccgtctgaacttcaggtcatactcgtttgtgcttatggtccataataattggttagctaccactggcttgtaaacatcgacggtggatattcttttttgacaactatttctctaacattt

SEQ ID NO: 10051 - DNA, 778 bp, Sorghum bicolor
  Clone ID: SORBI-28MAY03-CLUS49564_1
cgatttggtggagctgtgcctggtactgcaatatgtgcagataaggttgaggaaccccgcgatgaaagccctctaagttgtgtctcaaccacaggctcctccactaccctttctgcaacacagcaatcagtttctgagccaaattctgaaccttcagagaccagtatcgaggcatccccaagacaatgccatggagagaaaagccaagatgttacagatggtgaggctgattcttctgaaacaccacccaaggatgaagttatcaagcctgtgatcagcattaaccttcagccagagcagtcagttgtccaacaggacatagttgacatgtacatgaagagcatgcaacagttcacagaatctcttgcaaaaatgaaacttccattggacgttgagaatagtagtccctcaaacgaagattcctactccagtacaattgagaagacatcgccatccccatcttcagcagcagcaaagggttctagggtcttttatggaagcagggcctttttttaagtttctcatgcaaagtagtgcactagcttgttatctcatatatacatatacatggtccaggtttgtcaaatatcggctgtcatgtaatcacaaactttctgtctctataatatgcttctaggactcacacttggtattgctaatagtgttatgctctgttagaagataataatttcagaataatctcatctcatagttgtagattaatcccctgtactaatacatatcaatgaatataatgtcatgaaatcagttctgactc

SEQ ID NO: 10052 - DNA, 681 bp, Sorghum bicolor
  unsure (1)..(681): unsure at all n locations
  Clone ID: SORBI-28MAY03-CLUS49599_1
gcacgtgggctttgtggactggtcttggtcctagtgtcgcacgcaatgccataatcaacgctgctgaggtggccggctacgagcagttcgcacagatgtttctcaaacctcctgggtttgctgattacgtttttacccgtcttttagctggcctcagtgctgtctttcccgctgtttgcagggtcgcgccaggggatgtggtgatgttctgaacgctggggcatgcaacgtactgtggtactctttcatgttgtgccaggatttttttgattgacgtttagggtacaataataatttcctagtctaattagtaaagccctaaattttgctcaattacggaaggtacaagttggctgatttgtttttctattccacttgatgaatttaaaaggttagaagattctttctatgaagttcacgcctgcacagcaagtaggggttgtgtgggacaggtggatgatgatatatatgagagctggcatatatacatagttgcaagattattgaagctacaggttctcatgttgtcatttgtcaaccgacagaaaggagccatatttgccatactgccacttagattacataggacatatacgttctcantgttgtatttcgaattataaccgtngttgtaatcttgtatcgcagaattgattgattatacagaccacttctgttggt

SEQ ID NO: 10053 - DNA, 627 bp, Sorghum bicolor
  Clone ID: SORBI-28MAY03-CLUS49675_1
agtgttggatcggcgacttgtctattgggggggtgccctatgctccgtttggtcgcctctttttcacagtcgcctcctgggtcttaatgtttcatttcttactgtaaccacgtgctcattggttgattctatttatcttgttttgacggtagtaggtagggcccagagagatgtgcagtagctgttgctgcattgccagcccgtggccatttaggaaacaatagctacttgactcctacttatatttgtaactttgcagcttcgctcttgtcatcttgtgactttgctttacaatagagacttattggttgctatgatttttcaggtgcttataaccagtgcactaattgaaggcaaactactcgtcattttcttcattggtgtttgtagcattagtatgaaggcaagctgctccttatcatattcatctgttcatacctgtatgttgccaaaaacttgtatgttagttggcagatagcagaatcgaatgacttgaatatttccttcaagataatgattttctctttgaatgtcattctgcttttgtttttggagcagagctagacccggccccatccctagtgttctatcaataatgattctcttcgaatgtcattttgctattgc

SEQ ID NO: 10054 - DNA, 639 bp, Sorghum bicolor
  Clone ID: SORBI-28MAY03-CLUS49726_1
tatttacaaagtttgctcatcctcaaagtggcgggttccgagggttcaatggtagtggtcttggccttgccatctgcaaaaggtttgttagtctcatgggagggcacatctggatcgacagcgaaggaactggaagaggttgcaccgcaacattcgtcatcaagctcggcgtgtgtgacaacacaaacacctaccagcagcagttgatccctctagtctggccaagcagtgcagactctgatttgtctgctcctaaagtgcttcccgacgggagagggtctgctacttccctgaaatctcggtaccaaagaagcgtatgagcttagtgtaaatgatgattgacggcatagtgccaattaggggaccgattagtgccatcgtctaattttgtttgtaaccctgtcatagcaggcatataatgtacaaataatgtaaagcaaatggagactgcggctgtgtatctgggtggcaacgctgacttgctgcattgagtagtatatcctaccagcggattgaattccttgttctgggatgtgccgcgcgcgcccgtgtgcgacccccgtagctctgtgcttgttctgttgtaacttgtaatcacatattcatcgtgtaatatgaaattcaatgcaaatacacggt

SEQ ID NO: 10055 - DNA, 849 bp, Sorghum bicolor
  Clone ID: SORBI-28MAY03-CLUS51521_1
aaagagcggacggggaattggattccattccgatttgttgtttctactagggtttgcttgctcatcgcctcttccctccctctcgccccctcctcctcctcctccacctccaccaccaccaggaagactagctatgatccccaattccgtcttcctctgatctgcttggcggtcgaattccgattcgattggagtagggaaggagaagggaacaaacaggacagcacgtgcctccatactatggtttacgccccgtgccgctcatcgaagccgccgtcttcgtcgccgatgctccacaagaacctccgcgcgctcggacccggcttgaatccctttgctcccttcggcatgggcaactacacccgctagtcttctcttctcctccgatccccccctcttctccgattccaatctctgaattgtgggtgcttccctttgtttccgcccaccaccccggccgcttgctccatcggaacccatccccgctactttccgccatttcgcttcattgctccgttgctttggatctgaggctggagatcctcccctgtcctgctgcccgaggagccgccaaggataacatggtgctggtgcgcaggtcgctcaccatgagccgcccccggagctgccacgacgctgacgaccgtggctggaatccgctccatgttgctgctcgcaagggagacctcaaggaggtccgacgtctgctggatgatggcatggacgtcaatgcacctgcatggggaccaaaatgtcctggtgctaccccacttcatctggctgctcagggtgggcatgttaaaatcatggatgaactattggagcgtggtgccaatattgatgctcgaa

SEQ ID NO: 10056 - DNA, 627 bp, Sorghum bicolor
  Clone ID: SORBI-28MAY03-CLUS51536_1
gcgttgctagtagatcgttgatctctggtcactggtctttggacctctggtgcccactgcccagtgctctccactcgcacgaggcctccctcccctcctctctcttcactcttcagtcttcagtcttcacccccttgtttgtcgctggccactcgtcgcaccctcctcggcaggccagcagcagccagcagcaaggaagaatggagtacgagaggattcatcagaaagctcagcctggtgctctttccccaacaaagctaaggatgaagattatgggagcccacaatcgagttagagtcatcaccagcaattcatcatcgcgaacgtcgcctgcaaaaaacatcgaggcttcacaagcgcagaacaggctactagtctgtgatgttctcgaagaagtttcagacagcacatcagatggcaccaaacacccttcggcagtcaacaaaactgaagccgtggaaaaggattcagcagtggacagcaataaagttcagaacatttccaagagttcagttcctcaaccagcaacaggcagctctagcatgatacacccagtgggtcctctgggtgatacagtgccctttggcccactccccctgtcaccccgggcccctgtccccttcagag

SEQ ID NO: 10057 - DNA, 1053 bp, Sorghum bicolor
  unsure (1)..(1053): unsure at all n locations
  Clone ID: SORBI-28MAY03-CLUS51529_1
cacgagggaggagtcgggtccgggaagcggcggagggggcgcagcgcgccgcggcgcccggtgcagccgccggcgacgtggatcgaggcggtgggcacgctcgcggagacgctgcggttcacctactcggagacgctcggcaagtggcccatcggggacctcgccttcggaatcaagtacctcatgcgccgacagggcagctcgcgggttgccagtgtatatgctggaagcgagtgcattgaactgaaaggacctgaaatcatggaagagctgattgttctacggcggttgattgatctgtgcttccttttctctaagaaaccatttccagtgttccgggagttagctggattttcacaggaggatgttcttattgaagaaccaaaggcggggattttgaagcctgctcatacaattctacgtgatgagtgcaccaaatccttccttgttttgattcgagggactcatagcatgaaagatactctgactgctgctactggggctgtggtgccatttcacctctcacttttggatgaaggcggtgtgagcaaattagtgttaggctatgctcactgtgggatggttgcagcagcccgctggattgcaagaggtgtaacaccatgccttcgtgaagcagtcagacaatgtccagaataccaaatcaagattgttggccattcnattgggtggtggtactgctgcattgctaacctacatccttagagaacataaagagttttcttcaacaacttgtgttgcattcgcaccagcttcttgcatgacatgggaattagcagaatcaggcaaacattttgtgactacgattgtcaatggagctgatctggttcccactgtatcgactgcatctattgatgatctccgttctgaggtaacagcttcatcatggttaaatgatttgagggatcaaatacaacagacacgtttcctaaatgtcgtttaccggtcagccactgctttaggaactcgcctgcaatctttttctggtgcgagagagagggttgcaggtgctggagcatttctacgtcctgtttc

SEQ ID NO: 10058 - DNA, 604 bp, Sorghum bicolor
  Clone ID: SORBI-28MAY03-CLUS51571_1
gcacgagggccgcgggccgcgggccgtgccttctcttcaacagcactcatccggactccacttcacggtcaatttcctcacgtaagccaagcaagggacagtggggtgatcctgaagaaacctgcagcgccatataatcccaaccacaccgcctcgtttgggtgtgcagttcttcttcctctcctgattaggtgagaacagaagacacagtgctagcgctatagcggctagaggtgtagctatagcttgtggcagctagcattgccacagagagaaagagatgggcagcttgggagaggtggatcatggcaaggagatgttccatggccatggccattctgatcctgtcgtcgacgagctcaaccgtctgcagaatctcctcagagaaaaggaaagggagttaggacatgcatacagtgaaatcaaaggcctgaaggtgacggaagctcttaaggacaaggctattgctgagctgagcaaggaactgaagaaacaagacgagaagatgagaagtttggagaaacaacttgagcaaaagaatttagaagtcaaaagactaaacaatgagcgcaaagaagcattgtccgcacaattcgctgcagag

SEQ ID NO: 10059 - DNA, 901 bp, Sorghum bicolor
  Clone ID: SORBI-28MAY03-CLUS51596_1
gcacgagggttccgatgcagaaccacgcgtacagccggctgggcatctcgggggccggggcggccgtgccgtcgcctccgtcgtcgccgcggcgcgcgtgggggaggagggcctcggcgaagggcgggtggtcggcgagggccagcgcgggcgcgggctggggctggggcgcggcgcggaggggcacgagggcggtgcttgcggcgctgctgcggaggcaggcggtgttcctcttcgcgccactgctgtacgtggcggcgatgctgctctacatgggctccatctcgctcgacagtgtgccccgcatcatctcgcgcccggcgcctgggtcagtgtaccgcagcccgcagctctacgcccgcctccgcgccgatatggacgccgataatgccaccgacgcgctagcaactgtatggcggcatgcttacagaggtggtgtttggagaccttgcataagcaataataccaacggtttgcctgaatcaaatggctacatatacattgaggctaatggtggtttgaatcaacaacgaacatcgatttgcaatgcagttgctgttgccggttttctgaatgcaactcttgtaatcccaaactttcactatcacagtatttggagggatcccagcaaatttagtgatatttatgatgaggattactttatccaacgcttaaagaatgatgtccgggtggttgacaaggtgcctgagttcatcatggagcggtttggtcacaatctgagtaatgcatttaatttcaagataaaggcttggtctcctattcagttctatgaagatattgttctccctaagttgatcgaagagaggctcataaggatatcaccttttgcgaatcggctgtcattcgatgcgcctcctgctgttcacgtctacgatgtcta

SEQ ID NO: 10060 - DNA, 724 bp, Sorghum bicolor
  Clone ID: SORBI-28MAY03-CLUS50370_1
aatacgaaccagtaatgtaaaagaggaggccccagtcactgttgcaaatcaaaagtttaatgaggcaccaataccaaatgaggaattgacaattggagtagtgcaagaacaaaggaaggatgtgaagccacgctcttatccggcagcaaaaccagagttgtgcgacacaactataacagaagaatcatcgcccattagcacactaaaactggcgcatacagagagcgcgcctgcggagtgggatcatctgaacatagttcagcagagagccgatgccctggagtcactccttgagctctgcgtgaagctcctggagcaggagaggctcgatgagctcgccggtgttcttcggccattcggtgaaggagccgtgtcatccagagagacggcgatctggctgaccaagagcctgatgactccaccaaagtttggagagtccccaacaaagcttctgtaacagagattgtaatttgtttcttcgacgagtgccatttcgagagtgtacatagcttcaacagaattcaagattgctgtgcttaccgaggcttgggctttatttatcttgatgtatatggtttgcatgacagcagccattgaccattgtgagcgctgactatttatttaccggccttttttatttgttgtacaatgtagcatgagcataatttctgcttctgctagtgttcaagaaataatggaaatcatgccgactccatttctgttt

SEQ ID NO: 10061 - DNA, 668 bp, Sorghum bicolor
  Clone ID: SORBI-28MAY03-CLUS50490_1
cttgtgactcgctacctgctactgggacaagtgggactattgatgattttatggccatgcaaaccaattttggtagctttacttctttggttcgtgctgttgaagatgttccactgagcaggattatgcaagatcagtgtgatttgcaacttggatttggtggctccaagcagcagatctatccaagctttgagcaacagctaaggatggcctcggctggagctccgccttatgggggcatgggtaggcatgactctatacctgtaccagagccaacattgatgctaggttatgcaccacagctaggtaactgcccccctccgttccagttgggctggggtccgtcctattctaagatggttggcatgctccaatctgtgtgcgtgtggtgcaatagtccattccagcatttcggcaccgttgctgagcagcaggcagattctcttggttacatttgcccgtcgtgcaaggggaagttttctggtcatcttggcatcaacgggccatctatttgagatcaatttcttgtaacctgaactggtgctggttcaccatcagtttctagtctaattaattagtcaatttgcacttgtagtatgtaccgccttcaacttttggccttgtgctaaggaatgaatgcccttaaaatcttaagaaattggtaattc

SEQ ID NO: 10062 - DNA, 999 bp, Sorghum bicolor
  unsure (1)..(999): unsure at all n locations
  Clone ID: SORBI-28MAY03-CLUS50500_1
gcacgaggacaagaccgactggggactggagcttgggtggatctacgggtcgatcacggaggacatcctgacggggttcaagatgcactgccgcgggtggcgctccgtgtactgcatgccgaagcgggcggcgttcaaggggtcggcgcccatcaatctatccgaccgtctcaaccaggtgctccggtgggcgctgcgcgccgtcgagatcttcttcagccgccacagcccgctgctgtacggctacaagaacggcaacctcaagtggctggagcgcttcgcctacatcaacaccaccatctaccctttcacctcgctcccgctgctcgcctactgtaccctccccgccgtatgcctcctcaccggcaagttcatcatgccgtcgattagcacgttcgccagcttgttcttcatcgcgctcttcatgtccatcttcgcgacgggcatcctggagatgcggtggagcggggtgagcatcgaggagtggtggaggaacgagcagttctgggtcatcggcggcgtgtcggcgcatctcttcgccgtcgtgcagggcctgctcaaggtcctggcagggatcgacaccaacttcaccgtcacctccaaggccaccggcgacgaggacgacgagttcgccgagctctacgcattcaagtggaccacgctcctcatcccgcccaccacgctgctcatcatcaacatcatcggcgtcgtggccggcatctccgacgccatcaacaacgggtaccagtcatggggcccgctcttcggcaagctcttcttcgcattatgggtcatcgtccacctctacccgttcctcaaggggctcatggggcgccagaacaggacgcccaccattgttgtcatctggtccgtgctgctggcctccatcttctccctgctctgggtcaggatcgaccccttcatcgtcaggacaatagggcccggacgtcaggcagntgtggcatcaanctgctgagctgctttattattaacgattca

SEQ ID NO: 10063 - DNA, 1208 bp, Sorghum bicolor
  Clone ID: SORBI-28MAY03-CLUS5057_1
ctcctcgcttgccctaattccgcacccccccggctgaggcagcagcggcggcgccggcggcggctcaccagcggtacagggaagaatggggaggtacagccccgcgtacagccccccgaggagaggatacggcggcaggggaaggagcccgcctccgaggagaggatacggcggtggcggtggcggtggccgtggtgaccatggctctgtcagcctcctggtccgcaacattccattgagatgcaggcctgaggaactccgtgtccctttcgaacggtttggccctgttcgggatgtttacctgccaagagactatcacactggggagccaagaggggttggattcgtggagtttgctgatgcttatgatgcttctgaggcgcaataccgcatgaaccgtgagatgtttgctgggcgtgaaataactgttgtacttgctgctgattccaggaaaaggcctggggatttgcgtagacgaactggtccaagaggttattctggtcatgaacggcgtcgtccttatcgccatggccggtctcgttctcgttcatactcgcgttccaggtctccacgcccgcgtggccgtggtagatcacagtcatactcccctgccccgaaaaggcgtgatgactactctgcttccccaccacggtcaaaggaagagaatccgaggtcatcaaaacagcctaaagaaaatgacagggataagaagaggaggtcctatactcccgatgatagaaatgatcgccgtggtgcggagatcggtcatgacgagaggaagaagtgcccagcaggcgaggaggacgagaagcctcatcgcggtcgccgcaggtcgccccgcccagcgtccatgtcgcctccagggtcgcggtcaaggtcggcgtcgccagctatcagcagctgatgaatgtggcgatggaactgaagggtgtgggcacagattggttggccccttgtgctgattggggcagtttatctctgctgctaggctctgttttgtttttcctaagtggattgtttgtatgtgtcggctaagtcaggtgttggttgctcggaatggatggatgggtggtgtcggtgggtggagacggttttgtatggtgtctttgtatgtgtctgagatattttgaagactctggttgtaaacctggtatggtactagtggtaattgttcgggatgtgctgttttaggttaatgaatgaatgat

SEQ ID NO: 10064 - DNA, 663 bp, Sorghum bicolor
  Clone ID: SORBI-28MAY03-CLUS50648_1
acgacgaggcaaatgccaagtcatcagaggacagtgtagctgtggagaagccacagcaggaagaggacaatgtagctacggagaagccacagcaggaagaggacaatggtgtcaaggcattagaggaggacgtgtcccctgagaaatcagccaatgggaaaccattagaggaagaggacccagtccatgagaagctggcagacgccgacacagtcgttgagccgtcatctcaggacgacactgccactgaaaagccctcagctacaactgacactgcagaaactgcatgagacagcagttagctggttacagttactagttagcaacagtttttaacagagtgtggatcgaatactatttattggtgatagttcggcgtgccttctgtttgttttttttttggggttttgtacattgcttgagttgtaaaatttgagggaaagaaactataagttttgatttgatttgattttttacaagcaataatcccctcctctccatgttaggaggaggataccattgaagttcaatatataggatttgtgtgcggttttgatttttgtttggatggtgtactttgtaaatgattttgtgcaaatattactgtgcttgctcattatttggttttctgcgtgtaaattgatctagcaagattttatgtgc

SEQ ID NO: 10065 - DNA, 1011 bp, Sorghum bicolor
  unsure (1)..(1011): unsure at all n locations
  Clone ID: SORBI-28MAY03-CLUS5067_1
gcacgagggtcctgaccgtgaaagacacgcacacccacacctccacctccacctccagcacgggcacggggcactgcactcgccgacggggaacggtggtggagcagagcttgcgctcgcgcggcgttccattcatggattgggatctcaagatgccggtgtcctgggacctgcccgacctggagcacgacgccgccatgccacagccgccgcccatcgccgccacagcagccgcggcttcccccgcggcggcgtcgggcattgccgccgcagcaactgccgcgcctccccacgcggcggccacgcgcggggcgccgagccgggcggagtgctccgtcgacctcaagctcggcgggctcggcgagttcggggcggtggccgacgggacgaaggagcctgcggcggctgcaactgcaacggctgcgccatccgcgccgtccgcgagcccgatgaagcgcccgcgctctggtcccggtggcgccgccggggcgcagtgcccgtcgtgcgcggtggatggctgcaaggccgacctcagcaagtgccgcgactaccaccgccgccacaaggtctgcgaggcgcactccaagacgcccgtcgtcgtcgtcgccggccgcgagatgcgcttctgccagcagtgcagcaggtttcacttgcttgcggagtttgatgaggccaagcgtagttgtagaaagaggcttgatgggcacaatcggcgtcgcaggaagccacagccagatgccatgaactctgggagctttatgacaagtcaacaaggcttgttttcgagtgcagggacaaggttctcgtcgttcccggctccaagaccggagccaagctggtctggggtcatcaaatccgaggacagctcatactacacaccccacccgcacccggtgctcagcaacaggccgcacttcgccggcggctccacgtcatcggcctactccaggggggggcggcgcttcccgttcctccaggacngcnaccannncancttcagcgcaggcgccg

SEQ ID NO: 10066 - DNA, 1022 bp, Sorghum bicolor
  Clone ID: SORBI-28MAY03-CLUS52267_1
gaagtggaatgcaggacagcactaaacttgagcttcgtaggcaagctgaactgaaaaaaagcctgcgatctggttttgcttctattccacagccaaggaacgagtaccagatagtcatgccacctattacagaggatgaggcagaagaagctgaagagaaaattgaagaggacatgtcagacagactggcacgagaaagggctgaggaacaagctaggcaggaggcattgctcagaaagagatccaaagtgttgcagatgagtctgcctaggccgcctgctgcttcagtagaaattatccggcaatctcttattagaagtggagaaagcagaagcagaagcacctttgtgcctcctacatcacttgaacaagctgatgaactaataaatgaggagctccttaggcttcttgagcatgataatgcaaaatatcctcttgatgaaaaaactcaaaaagagaaaaagaaaggaagcaagcgtcagcaaaatgggggacctcttgtccctgaaattgaggattttgatgaagatgaacttaaagaggctagttctatgggcgcgggggagattcaatatcttcgagtggccatgggtcatgaaaatgaatcttttgaggactttgtgaaagcacatgatgcatgccaagaggaccttatgttttttcctactaacaatagctatggtttagctagtgttgctggaaatgctgataagatttctgctttgcaaaatgagtttgaaactgtgaagaagcgaatggatgatgaagctaagaaggcttctcggcttgagcagaagattaagcttctgacacaaggatatcaggtacgggctggaaaactgtggtcacaggtccaagatacattcaagcaaatggacactgctgcaacagaactcgagtgcttccaagagctgcagaaacaggaacatcttgctgcttcgtatcgaatcctaaatttgactgaagaagtgaataaacagaaagcactagaaaggaccctccagagccgctatggtgagctt

SEQ ID NO: 10067 - DNA, 967 bp, Sorghum bicolor
  Clone ID: SORBI-28MAY03-CLUS5237_1
cctggaaccgcgtgctataacagcaaccaaacggcggcgatgcggcttttctccggcgtcctcgattcttcttccgcgtttgcctccgccgtcctgggctccgtgtccgaccgcctcggattctcgcgcgtatttttcggtcgagcgagcccatccagcatgccggctctcgcttgtgaagccgcggcctcgtcttctgcggcagccggtgccgacccctgtgccggcgcccagaaaccatggctcttcgtcggtctggggaaccccgggcggatgtacaaaggcactcggcacaacgttggctttgagatgattgatgctattgcagaagctgagggcatttcagtcagcagtaagcaatttaaggcgattgttggaaaaggcctcattggtgatgtccctgtaatgcttgccaagccacagacttttatgaatgcaagtggtgagtctgtgggacagttggtttcatacttcaagataccactcaatcaattagttgtgatctatgatgatcttgatctaccctttgcgaaattgcgtctgctaccaaaggggggacatggtggacacaatgggatgaggagtattattgaccatttgaaacaaagccgcaatttcgcgcgtctaaggattggcattggacggccacctgaggagcagggtgctatcagttttgttctacagtcattcactgttcaagaaaaggaagagcttgaagtcgtgttccaaagaggcttgcaagcagtaagaattatggtacaggaaggattcaacaagagcgcacaatttgtgaacactccacccccagcagaaatgttgaatagatgaaaaccaaacgacacggattattaggtttgcttagatgttaacacaagggccattgccggcaagatataatgtaccctaattgatctgtagaggttgtaatttgattacaaagcaagtaatgtaaattagatacacatat

SEQ ID NO: 10068 - DNA, 831 bp, Sorghum bicolor
  Clone ID: SORBI-28MAY03-CLUS5236_1
gtgcggcgctcgaggcggcccgggggaaaaatcccattccaaaccctctctctgtcccgtcccatacccccatcgccggcgatctcctccttcgccgccaatggatctctccgccgtccaggccgccctctccgacaagtcctactccgccctcgcccccctctgcgacgagctcctcctccaggtcgcggccaagggagccatcaccgacgaatggccctactccgtccatctcctcgcccacctctacatcaatgacctgaacagcgcgcggttcttttggaagtcgttgccgcaggaggtgaaggacacgcggccagagctcgccgcggtctggaggattggtcagtgcctgtggaacagggattatgctggcgtcaacacggctgcacaggggttcgagtggggccctgacctcgctgatttcatcactgccttcctagagagctacagacagaggatattcaagctgttgacttctgcatattccacaattagcgttgctgatgtggctcatttcatggggatgagtgaggaggatgttacaaactatgctgtgcaaaacagttggagcttggatgcagcgactgggatgcttactgtaaaaaagccaaaggctcagaccaaccagaagcttgactcgagcaagctgcagcgtttgactgagtgtgttttccaccttgagcactgatgctcactgtcaattatgtcgcatccctgttggttctctactccacattttatgaagcatgtttatcaattatcatgtgatagctagatgcctgaaacgactggttgctttggctgacaagtgagatctctcagcgctga

SEQ ID NO: 10069 - DNA, 773 bp, Sorghum bicolor
  Clone ID: SORBI-28MAY03-CLUS52561_1
cctactgcaacggcacaaccacaacacaagcacaacaagaacaagaacagacactcctatcactcctccactcccgcacgagggctgcccccatcctcactcttcctccgcccgcctcttctcttcttcccccagcagccagcagtctctctctcatacaaacacaaacaagcaacgacttgctcacagtagtgctccccggacagaatgaccaaagacgaggagttcaagctggtcaagatccagaaccatgtgctcaaggtgaacatacactgtgacgggtgcaggcacaaggtcaagaagcttcttcagaagatcgaaggcgtgtactcggtggccattgatgtggacaaccacaaggtgtcggtgacaggcgatgtggactcggagaccttgatcaggaagctcaccaggggaggcaagcatgcggagctgtggtcacagcagaagggcggtggtggcggcaaccagggccacaagggcaacaatggccagcagaagcaccagcagcaccagcagcaccagcagcacaatcagcagcagcagcaacaacaacagcagaagcaaggtgctaatccgggcaaggatgcgcacaacaagaacaacaacaatggcggccagaaagagcaggggaagcaaggaggggttgggagcctcatgcaagggcctcaaggcattcaagaaccagcacagcaacaagaaccagctccctgagctcagctcggaggatgatgatctgtatgatgacgaaggatgatgagttcgacgacgac

SEQ ID NO: 10070 - DNA, 1016 bp, Sorghum bicolor
  Clone ID: SORBI-28MAY03-CLUS52661_1
gcacgcggctcccgtccccttccggcctccgggcaaacctccgcgccccgtttgggcccgcatctgggcggggtggattcgcggggcggcccggggggcgcggttccgttcccgggccggctgcggcggtctacccggcgccggcgcgcccggccgtggtcgtcttgcccgcgcccccccggcacgcccaggcgccggtcccccgccgctcccgcaccaggccgctgcgcgggggcctccgcggagccctcagccgggccgtcgcccgcggcgcccgcccctggccggctctgtcttctgcctcaggggctcacccgctgcggcttgcgcttcctggggttgtgcccccgactgccaacgaggaggatgataaatttgattgtgaaaacatgcagtggaatagttcagatctggcctccgatgatgcacaatcaccaaagccacagcggtcaaggagcaggcagcataggggtttccacagaaaatccctcagccgttcaatgtcatgtgactcccactccaagacgtctgtgtcatcttcctcaagagctcacacgaaagttgatctgagcaagctagaactgactgcactgtggagatattggcgccacttcaatctcgatgcatgccctaatccatccagggagcagttaattgatgctgttcaaaggcacttcacggcccagcaattggatgagttgcaggtcattgtcggctttgtgcaagctgcaaagaggctgaagacaactatgaaagtggcctgacagtgaagcctgaacttcaactaacagattcaagataggatgcagcatgtttgatgaatgttgccgtgctatgtaatatatatgcatgaagttctttagattcaggtggctagttaatggactagactatgttagcctcatctgatgtagatatgcagtatcctgtctaaagatgtttcaacctctagctcagttctttcctgctgactggatgtggattgaaatgacaagtttaaaacaagttttttagtc

SEQ ID NO: 10071 - DNA, 1087 bp, Sorghum bicolor
  unsure (1)..(1087): unsure at all n locations
  Clone ID: SORBI-28MAY03-CLUS5092_1
gcacgagggaaaaggtcaaactgccaaaggataaaaaggttctagcaacccgggcaaacaaagaggatagcactgctaatgaaattacactagctgatccaaaccaggtggcagtcctgttttctgagtggtgtcagatgtgtaatcatgtaagtgctagtgatgcggcctacagtcgttttgtctcacagttgcagcaggatggtctgctgaagggagatgatatctctgaacgcttctttcgtattctcacggaacttgctgttacacactctctagtctccgagcaaattgttgctcctggtggatcatctcagcaatcaccacagcaacctcacatttcatatttttccgttgattcatacgcaaagcttgtggttatggttctcaagtactcttcattggagataacaccaaataaagccagtatactttccaagattctatctgttacagtgagaaccattcagaaagatgctgaggaaaagaaagcttcatttaatcctcggccatactttcgattgtttataaattggctctatgaccttactactaccgatggccaccatgatggttctaattttcagattttgactgcatttgcaaatgcattccacatgctacaacccttgagagttcctgcctggggctttgcttggcttgagctggtgagtcacaggagcttcatgccaaaactgctgatgtgcaattcacagaaaggttggccatttctacagcggctgcttgttgctcttttcaagttctaagacccatacggtttgagagatgctgaactcccagaggcggtggaccttttatacaaaggaactatgagagttctgcttgtactactgcatgattttcctgaatttctttgtgattatcacttcagtttctgtgatgtgattccttcgagttgcatacaaatgcgcaatgtcattcttagtgcttttccacgtaaagacatggntgagaatactgaaagggggggggtggaccaacgcatggaagttgctgttggagaaccatcaagaaacccggagcccaaagaaactagaattttgacaagacattcttttaaagaacc

SEQ ID NO: 10072 - DNA, 655 bp, Sorghum bicolor
  Clone ID: SORBI-28MAY03-CLUS51148_1
gagcacgggggccactcacaaggcgatagcagcaggtggcaagatgacggtgctccactctccggttggagtgaggagcatcgtcacctccatggtggctttcttcatcttagccagctccatcgtcttcctccttgacagaggccaggaagagcaagtgcaaatggcaatcgagcatggacgccaagaagtgcaggtgaagctggaagctgggctccaagaaccagcgatcagagggacaactgacgagggggacgccagcaatgaggagtgcaactggtcgagggggcggtgggtgtacgacaacgtctcccggccattgtacaacgggctcaagtgcaccttcatcttccccgaggtggcctgtgacaagtatggaaggaaggatgtcatgtatcagcactggagatggcagcctcacggatgcgacctcccaagatttgatgccatcaagctgcttgaaaagcggctagctccatcgtcggcctccgtggctgacgccggcaacagcaagcgctggggcccgccgggctgcgtcgccgaggcctccaggcccgatgacaggctcaagacacgcatcttcaatggctcactcatctcctttaaggcattggaatacaatgcaacaatagatttctactggtcaccactactg

SEQ ID NO: 10073 - DNA, 1129 bp, Sorghum bicolor
  Clone ID: SORBI-28MAY03-CLUS51176_1
gcacgaggccaaagtccaaacggccccgaacgtctgctcggaagtctcacgagttcctctccccgtttgcaattgcaactccttgttgccagcaaaacttccggtacttctcgccccctcggcgagcagagagaggggctccagactccagaggcttccgatcgccgtccctgtctgcttcagtgcttcttgcgggctccccctcccccctcgcggcggcggcgcgagtccagtcaacacctcccaggtccccagcctcacaccacctcccaaaccccccaaaccccacttccaccgaagcaaaccacatcagcgcttcggtcctcttcgttggagtggagatccatacgggcgtgggttgatttcgtcttctggtggctggagagtttgctgctggcagaggccagcagtgttgtgaatcagaggttctgttgaagaaactgtcgctatagccacttgattacagaaaaatgtctgagtttctggaccttgagacccaggatgggataagaatgacatggaatgttataccaggcacaaagcaggatgccactaactgtgttgttcctgtttctgccacttatactccgctcgagccaaacccttccattcctgtccttccttatgcccctctccgttgccgcatgtgccgttcgattctcaaccctttctcagttgttgattttgttgcgaagatttgggtctgtccgttctgctttcagcgcaaccatttcccccaacattacaactccatttcagaaaacaaccttcctgctgagctgtttcctcaatataccaccgttgagtatgcatccacttctgaaacgggtcctgtggcacctccagtcttcctctttgttgttgatacatgtatgattgaggaggagattggctatttgaagtctgctttagcacaagcaattgaactattgccagatcagtcccttgttggatttattactttcgggacatatgttcaggtgcatgaattgggttttggcttgttgccaaagtcatatgtgtttaaagggacaaaagaagttacaaaggagcaaattttggaccaaatgagtttctttgctgggaaaactaaacccacatcaggtgtgatcgcatgcgcaagggatgg

SEQ ID NO: 10074 - DNA, 735 bp, Sorghum bicolor
  Clone ID: SORBI-28MAY03-CLUS51261_1
cttcctccaactgcaccactggatctacaaggcaatgctaaggaagtggatgtccagaaaactggtggagtaagagaaattactaatcctcctagtatcattgatataaagtcaagtttgcttcagcagatcagggataagacagaacagctgaagcttaataatggacatgaaaggtcaaaaaaagcagtaggcggtgacattaaaagcttggacgagagggaggagttgcttcagcaaatcaggagcaagaccttcaatttaagacgaacaaatgcatctaagacagatggctcatcacaatctacagccaattccaacgttgtagcaattttggagaaagcaaatgctatccggcaggctgtggccagtgatggtggcgatgatgatacatggagtgatatatgaccacctaactgcagacgtgcattgtagtcttttcctgtatattcaactattacaagatgaagtgagaaaaatgtgaataacatctttttcttcattgtaattaggttttgcaggtcttgttctgtacctttcttagttcatattagtgtattctaccgtaggtctctatggttgtggaaatggcagaccattttccacattatgtaaatgtgtctttattatttatttatgatagtgagaacagctgataaaaataagcatactaatctatctttttatcattgtattgatttttttacaatgataataagatggagcatgatgtgc

SEQ ID NO: 10075 - DNA, 794 bp, Sorghum bicolor
  Clone ID: SORBI-28MAY03-CLUS51317_1
tcttcctcgccggcgacagcgccggcgcaaacatcgtgcacgacatgctgatgagggcggcgtccgcgcgggggccgcgcatcgagggcgccgtcctgctccacccgtggttcggcgggagcgcgcccatcgagggggagccgccgggccctgcagcgggcaccgctgggctctggacttacgcgtgcccgggcgcggtcggcggcgccgacgacccgaggatgaaccctctggcgcccggcgcgccggcgctggagaagctcgggtgcgcgaggatgctggtgtgcgccgggacgctggacgcgctctacaggagggaccgcgcgtactacgaagccgtggcggccagcgcgtggcccggggacgtggcgtggctcgagtccgagggagaggaccacgacttcttcctcgggaagcccgagtgcgagaacgccaagcagctcatggaccgcgtcgtggccttcatagccggggcctgacttgcgctctcttgtgggcgcggcgcggcgagtcgtcattgaagactcaagttaattgtgggcaagtttctctcattgaattgataaataaatagtggtcttgtctaaatatgatttttttttctctcgtagaagtgtggtactgaagtcttgaaactgaattttttataagcaaattaaactttacattattcatcattccagctcggccacaatgtgtaagcagggcagatgtccagttgtccactgatgaatctcgttgcttattctgctaaaaagctttatatatgatagtttttgcaaaggtaaaaagtt

SEQ ID NO: 10076 - DNA, 1206 bp, Sorghum bicolor
  Clone ID: SORBI-28MAY03-CLUS5377_1
ggccccgcagccagctccccgacgcgatctgccgcgggaagatggcgactccgccgccgcccctccgccgcgccgctgcgcttctcctcgtcgtcctcgccggcgtcctcgcctccaccgcgcgcgccgatctcgtcatctccaaggcagatcggagggttgatctgacctcgcatatcgtccgcatcctcgcttcccttaaggttgaaaatgttggaccggaccctgtctctcaagttttactgtcttttcccaatatccaagccaagaacttggcagctattagagcattcggcagtgaaggaaaagtgaagggtcaaagtactattctgccaattgaagttgttcaaccttctggagctccaccggacctgacgttcttttcagcattgttgcccaaacctttggagaagggaaagactctgtacttggatgtcttgactgtgttcacacactctcttcaaccattcccagaagagatcactcaagctgaagcacaacttgttgtctatcaggatagtgctcattacttgtcaccttaccctgttaaggcacagacacttgctatcagattgcctggcgggaggggttgaatcatacacaaggccgcctcttcctatccttgtggattcagaactgaaatatggaccatttcatgatcttcccccgttttcctacttacctgtgattgttcattttgagaacaacaatccttttgcagtcgcaaaggaagttataagggagattgaaatatcccactgggggaatgtacagattacagaacactacaacattgcccatggtggtgccagactcaagggtgaattttccaggatcgattatcaatctagaccttacgtaaggggtgtttcatcttttaggcatcttattgcaaaactgcctccaagggcacactctatttattacagagatgagattggtaatatttcaacatcacatgtgtggagtgattctatgaagacccaactggaaattgaaccaaggtttccattgtttggtgggtggcaaacaaccttcactgttggttatggtttaccacttgaagactttgttttctattctgatggaaagagatttctcaatatcacatttggttctccattggaggaagttctcattgaaaagcttggtgtaaaggttgttctacctgaaggatcaaaggatatcgaagtttcagctcccttt

SEQ ID NO: 10077 - DNA, 671 bp, Sorghum bicolor
  Clone ID: SORBI-28MAY03-CLUS54560_1
agcgagcaaagcactctgcctgccgtgcttggagttggagttgggagttgaagcaccaccaccattcctgcagcctgcagcctgcctccccctcctcttcttcttcctcctcctgctccaagcacacgagagatagagagaggagatggcggtgctgttgctcctggtggccgtgcttggcgtggtgctggcgagcagcctcctcctgcggtggaacgagctccggtacagccgccgccggggcctgccgccgggcacaatggggtggccgctcttcggcgagaccaccgagttcctcaagcagggccccagcttcatgaagcagagaaggctcaggtacgggagcctgttccggacgcacatcctgggctgccccacggtggtgtgcatggagccggagctgaaccgccggacgctggccagcgacggcgccggcttcgtcccgggctacccgcagtccatgctcgacatcctggggcccaacaacatcgccgccgtgcacggcccgctccaccgcgccatgcggggagccatgctcgcgctcacgaggccacacatgatccgcgccgcgctgctccccaagatcgacgccttcatgcgcgcgcacctccatggatgggccggacgacgcgtctacatccaggagatgaccaaggagatggctttgctct

SEQ ID NO: 10078 - DNA, 1043 bp, Sorghum bicolor
  unsure (1)..(1043): unsure at all n locations
  Clone ID: SORBI-28MAY03-CLUS54576_1
ctggcacgacggagcgttccctgttcccgaaaatagccttcactcctgccggcgggcggaggccgggtcgacgagagaggagatgacgctggcggcggggctggggtacgccctgatcgcgctgggccccgctttctccctcttcgccggcgtcgtcgccaggaagcccttcctcgtcctcaccctcctctccagcaccttgttttggcttataagtttgatagtcctctcgggaatatggaggggatttcttcctataaaatcagaagcttggtgggcatatgcaattctgatccttacatctgtcgcattgcaagaaggcactcgtcttgtgttttggaggctttacaagaaaatggaagagatgctagatgcttttgctgatagaatatccaagccacgtcttagtttgactgacaagatgctcatttctttagctggtggtttaggccatggagtggctcatgcagtctttttctgtctcagtcttttgactccagcgtttggtcgagccacattttatattgaaacatgctcaaagatgccatttttccttgcttcagccctaattgcacttggattcttggtcatccatacgttctcaatgattattgcttttaatgcatatgatgagagaaagaaaagtgatcaggtttttgttccagttattcatttggctgctgctgtgatgacacttgttaacctcgccccaggaggctgtctcattggtaccccactgttgttggtcatggctgcgctgaccttgcagcactgctggcgagtggcatgccagagattaactgagcaccggcatcagcagcacaacagcaactagttcttgcagatttgccagtgctccttacatcatgtaattttccncatgtatgtttgactgaatcttctgatgtattaggacagcaaaaatcaggttctgagtcacgtcgtgtagagggtttatcggagttgcactgatgtttgcatatgcaatacatcttcttagccggtgaaaacgttgtaattggcattttttgctctataattat

SEQ ID NO: 10079 - DNA, 1155 bp, Sorghum bicolor
  Clone ID: SORBI-28MAY03-CLUS54735_1
gcacgaggcccatcccctcttcgccccgcgccccccgtccccctccccgcctccccccgctccccccccccgccgccccccccgccctcccggccccgccccgagcgggcccccgccccccgcgccctccccggcgccggcgccccggaccccccccgtccccgacgccgcgcacgcggccccctcccgctcccgccccccccgcgctacccctccacggcggcttccccccccgccccggccccccaggcgctgctgccgcgcacccgcgcctcccccgccgccgacgaccgattcatcgcacacctcgcgcagcacttcgaggtgtcggaggtgggcatgctcgcgcgttgcctctgcatcccccttgtctccctgcgcgttggcaaggttcagagggaagggcccccccgctgcccagctcccgtggggtgggccccgcctctgccctactctctgttgtgggaggctggagcttgggcttccgccatcttcttcctcgcccctcaccttgcttgcggctgaccggtgttcggggcgacgggctctctgggccaccggctctcttgagcaacggctttgaattttcagaagttgtgcgtggagaaatatcagctgataattctggacgctctttcctaatcagaatatcagaatctaaagtattttactactggtgtgctgagaagtccaaggaacgcgcgagggaacttcttacaaagatgaaaaaccttttggacggggaggccaacactctctgatctaactggcatctccaattcgcgacttgatgcttttgccactcatttacatgcttatcttcttgcatcaagtattggtgatgttaaatcgttgggatcacttaatgactttctgagtacttcaaggtcacatggtcaatatttacagctccagtcagctgtttccaaaacttccaggttccgtgcctcggctactagtgcaattaagtcaagctctgcctatcaagccagcctaagtccgagatctggcacttttaaagatggggtaccaagggcttcatgtgcaagggttgttgggagggacaaactgaagcgtcgtgcggaatggtcgggctcattaactgctccgcttgatacaaatcctttgacaattaaccgtgattcaaccagtgag

SEQ ID NO: 10080 - DNA, 870 bp, Sorghum bicolor
  Clone ID: SORBI-28MAY03-CLUS5446_1
gtgaatggagagacaaaaactgtaatggcgcggggaactcatggcgcctgtgactatctcttaaaacctgttcggctggaagagcttaggaatatctggcagcatgttgttaggaggaaattcagtaactgtgagcgtgctaacattgatggctatgaggagtgcaccaggccatcaaatgcagattttgatcatgtacacagccaaattacaggtgggacacctgaccaaagtgggaggtccagcaagaagaggaaggaatatcatagtgaagaggaagatgaaggagaagagagtaatggccaagagaacgatgatccttcagctccaaagaaaccaagggttgtttggtcagttgaactacaccgaaaatttgttgctgctgtcaatcagctaggaattgacaaagctgtgccaaaaagaatacttgagctcatgaatgttgagagactcaccagggaaaatgttgcaagtcacctgcagaagtatagactctatcttaaacggctaagtgctgtggcatcgcaacaggctagcattgttgctgctttcggaggcaatgacccctttatgcggatgggtgcatctctatgaccgccgccgtccacgtcgctgcttccgcctgcgtcgcccttggtcgcctctgctactcccggggtgcctgcgtgtgaccgccgccgtccgcctatctgcgccgccctccgcctcgcattgtctgctgcgcctcgggtgttctgcttaggtgaaattgtagctgtgcgcctatctatgctgctcacagccaagaaaatactgtaactactaggttgttctgtatgtaatgtgctagcagtaagatatctggattctcgaaggtaatgtccatttgct

SEQ ID NO: 10081 - DNA, 329 bp, Sorghum bicolor
  unsure (1)..(329): unsure at all n locations
  Clone ID: LIB3476-006-Q6-K1-C7
nncgctagtgctgtggcatcgcaacaggctagcattgttgctgctttcggaggcaatgacccctttatgcggatgggtgcatttgaaggactccagggttatcaatcttttgcctcttcagcagctctgccatcttttactccacaggggttgttaaatagaaatagcccaacatcatttgcgctccaagggatgtctgcttccaggccaattcagattgcaagcaattccacaataagtcattccattagcgatccaaataaatatcaccttagcttaccaggtactagtagccgacaaggaaatctggcacaangtttgactacttc

SEQ ID NO: 10082 - DNA, 1545 bp, Sorghum bicolor
  Clone ID: SORBI-28MAY03-CLUS51796_1
ataaagcgtgaatgtccatgtccaactccaaattctgacattaaggaacctcttgtgaacaactcagcaacaacttctgcatcagcctctgatacaagcaaaatggaggagtttgtgaatcagcaaaaaacacttgaagcagatgcatcaaattctccacttaatcagtctcattctcacattttcccagtaccttctgacaatcatgatattgagcgtgaatgtccaggttcaactccaagatctgacactaaggaacttgttgtggacaactcagtgttaacatcagcagcacctgaaattctaacaacaacctctgcagcctctgattcatgcaaaatggagtcagtgaatcagcaaaaaacgcttgaagcagatgcatcaaatgctccacttaatcaccatcctcattctcacagtgttcctgtatcttctgataatcaagacattcagcgtgaatgtcctagcccaactccaaaatctgacagtaaggaacctcttgtggacgccccaggattaacatcagtggcgcctgaaatgctagcgacaacttctgcctctgatacatgcaaaatggaggagtttgtgaatcagcaaaaagcacttgaagcggatgcaacaaatgcttcacttaatcagcctcctcacattttcaatgtatcttctgataatcaagatattgagcatgaatgtcctagcccaactccaaggtctgactgtaaggaacctcttatggacaactcagtatttacatcagcggcgcctgaaattctagcaacatctgcttctggtacatgcaaaatggaggagtttgtgaatcagcaaagaccaattaaagcggatgcatcaaatgcttcacttaatcagcctcctcattgtcacattttcactgtatcttccaataatcaagatattgagtgtgaatgtcctagcccaactccaagatctgacaggcacgaggctctcgtggaaaacttagtgttaacatcagcagtacctgaaaatctactgagaagttctgcagttgcctgtgcctctgatacatgcaagatggagatcttgaataagaaaagaacatttgaagcagatgcttcacttaatcagcctcctcactctagtattttcgcttcatcttctggtgataaccaagataatgtgtgtgaacatcctagtccaagtccaagacctgagggtgagcagcctctcatggataactcagggttaacatcaacagtgcctcaaaatctaacttcttctgcatctgcttccaagatgtgcaaaatggaggagatcttgaatgagaaaagaatacttgaagcaaacccatcagatggttcgattactcaatctcctcaatccaaggttttccttgtaccatctcctgatatcctagagcgtgaattttctagtaaagcgcctaggcctgagtttaaggaacctgctgtggacagctctgggttaacatcagcagcacctgaaaatttaatgactaagcaacatgtccactcaccagatgcctttgtgccaccaaagtcttgtgctcca

SEQ ID NO: 10083 - DNA, 890 bp, Sorghum bicolor
  Clone ID: SORBI-28MAY03-CLUS51826_1
gcacgaggagaagtcgtcttgccgaactcaagacccacgcacgaggattccccgtctgtttccctcgactcaactcccctccgtcgcgtcccctccgcctcgcctcaactctcctccattgccgccgctcggccctcacctcgacttctcctccatcgccgccaccgtgcaacaccagcaccaccgtctcccgactctacagatgttggggctgcggacggcagcatcttcctccccactctgccccgtgcatccgctccgcgtctctgcccccattctattccgcaatccatcctcaccgctgcccgcttttcctcgacgctgaccaacgccgatccgatccccggggcgtacacgcacggcatggcacggtagttgacatctcagtccatcttcaccaggccaggctgccatcgtccggtcctcagtcctcattgcctttcttgctttctaagagtagtctccctgcctcgcattgcttgatctaaaatataaacatgcaatcctatgtttctagcactaactggttctggtagatccagtttactggttcatgaatgcacttgttgatatgaattggtagcatgaactggttctggtagatccaatttttaacacatgctagaagtttttctgcacaattgcacttggaagcattagccataggttgatagttctctgacaggtgaagtctgttgtgtcagtttccttttttaatttttgactttggttcgagggttgctgactttgtttcagtgtgtggattaaaatgcctattagtcactacttgctgctgtccacaaaacactgcacatgttttgtgatttaggataggcctcattagatcttgattggaaaattaaatacagtagcagctaacctaaaatata

SEQ ID NO: 10084 - DNA, 523 bp, Sorghum bicolor
  Clone ID: SORBI-28MAY03-CLUS51861_1
gcacgagcgcggggcagcacgaggaatacggttaatccatagcgaagaagggcagcaccaccagtagcagcagccatgcccgctcgcgctcgatggcgactcctcgcgctgccgctcgcgctcttcctcgtggcggggtcggcgcatggcctcgtgaagccggaggccgccgcgacgcccaagccccccgtccccaaggccatctcggacctgagggacgcgatcgtgaaagggctggggttccaggccgaggggctgaaggtgtccggattcgacgtgcgggacgcgctggtggggcacgcggtggcgtacgagttcgacatcgaggtcggcaggaaggtcctgccggtgcgcctgctggaggacgtcagccggtgggacttcgtcgacctccccatcttccgttcccaggccgacgccgacgacacggcgctcgccgagatcaggcggggcgggaggggcagcgtcgtcgaacctaccctgccgcccttccagctcgccgggcccatggagctctggatcc

SEQ ID NO: 10085 - DNA, 593 bp, Sorghum bicolor
  Clone ID: SORBI-28MAY03-CLUS52097_1
gcacgaggggagatccagcggatgtacgagcggggagggtttgcgctcgccaccacccctagaagctgacaccgtcaccgccatgttaacctgctgttgtacaataccctggtttgatccaggacgctgctgtgtgtaacactttctacatgatgaaatgggtcccctgttcctccgagtcggcgccagcaggcccaggtgctgccccttccgctgccccccctttgtgctgctgccgccctgggtctgcccctcgccctcgagcgaccccagttgcatgcgcggcctgcgcggcgggggagtccggacgcctgcgccccctcactcggcccggggcgtgtaccgggaggagatccagcggatgtacgagcggggagggtttgcgctcgccaccacccgtagaagctgacaccgtcaccgccatgttaacctgctgttgtacaataccctgtaaatatgaactaatccttgcagcagagaaagcccagatgaacaaacccccccaactgaattggctaatggtgcagggtttgatccaggacgctgctgtgtgtaacactttctacatgatgaaatgtgacccaagttcctcc

SEQ ID NO: 10086 - DNA, 847 bp, Sorghum bicolor
  Clone ID: SORBI-28MAY03-CLUS52134_1
gctttcacttgatgaagatgtattgaattcagcactagaagttcattttaaggctggttcaatgcattgggttgttgacaaagtccctgatcagtctctactgaacacagctaattggaaatttatcattcctcgtttatactggaattacccaaatgatgatatgctgctaaatatttcaatggcctcatccccggtgataaggattacatcagaaaaaaattgaagctaccattaacgcagatatggtaattgatgttgtagatggcaaggagatagttccagttgcatgcatctcagtgattgtcagcacttcaggtgttgtggatgcatcaggcaataaagtatatggtagagttggattagataatttctcccttgcgttgaagtggagtagaattgggaacttccatatgtctttgattcagggagtgattcgcgttttcctgaacacagtgtgcatgccctatttgaactcccggcttgggaatggatttatcttgcccgtggtccatggtttcacacttcaagacgtctacgttttaacctctgctgagcagctgacgctttgttctgatgtcaccttcaatgcaagcagcttggcgagtttatcacttttgtgagtcaggaaagtgcgtgtctgggtcgcaaagcaggccttgcgcatttcattttagcgttgaagtacaacacttgcacatatgtgtacattattgtacatactagtacataacatctcgttaaaaaatgttattcacattcagttctaccaattcatgaatgatgtacatacgaactcagacatctgtgcacattatcttaggtaatacaaagttgcccgcagccc

SEQ ID NO: 10087 - DNA, 689 bp, Sorghum bicolor
  Clone ID: SORBI-28MAY03-CLUS55354_1
taaccgttttcggtggcttactcgtgtttctctagatccatatacagagaacacagactcaactgaaaagcacgcggcagcattgggtgatactgcagcccaaacaacaaccatgcttctgtatttcccatgcgggttgataagaggtgccttgaccaacttaggaattccgtgttctgtctctgctgacatgtcaaaccttccagcatgttcgttcgtggtgcgcataaagacatgaactgtgagaaatgatacaagtacagtatgaagatctgacagtacctgcttgtggttcaagcgggttgaacattgaaaacaacagagtttgggcatgcattagatgtatcgtggtactgcattttagcctgggaaatacgctgtggagctgttgatttctgtttacttttcctccagcaattacctcatttcactatctcaaaattattttcccaccttctattcatgaccatatttccagagttaggtttgttattactgcactgtaggtagccaccactggcaccattgtgagagataactatggttgttggttgtattaggttgtatccctgtggcctgtgtttggttacctggctttatgagctagaactcttcttaaagcatgtttcttgccatggttcgtgggctagcactctaactaataaagcatgattgttgccatggcttgc

SEQ ID NO: 10088 - DNA, 1242 bp, Sorghum bicolor
  Clone ID: SORBI-28MAY03-CLUS5550_1
ccaagtcatatggaggatcctatggactacactccagctccagcagaaacattagatcatgatgttactattgaggaaatacaggagtacttcacaaactacatagttaatgagagtcttggcattatcgccaatgcgcatgtggtctatgcagataaggaagatctgaaggctaagagtcgaccatgccttgaactggccaagctcttctctatagctgttgatttcccaaagactggagtgccggctctgattccacctgaattacatgtcaaggagtatcctgattttatggagaagctcgacaaagcaacctatgaatcaaagggtgtgatcgggaagctctacagggaaataaagaagcacacaccgcacataaggcactttacgagggaagtggcaagcggtcttatgacaccgatttgattgttgatggctatgaagactacattactgaggctatagagttcaaggaagagtacgatttcaggctgggtaatcttatggatcactatggaataaaaagtgaagcggagataataagtggatgttttctgaagatggcaaagaatttcaccaagagtagtgatgctgatgcaattagaatggcggtgagatctttgaggaaagaagctaggtcatggttcaatgagatgagcacaagcgaggatgaccaagatgccacagaggccaaggcgtctgcttggtaccatgttacttatgatccacagtactggggcaactacaatgaaggatatgatcggccgcatcttattagctttccatggtgcgtatatgacaagcttgtgatcattaagcagaggaggaatttcttcacgcagatggatcctaatctggtgtctcccatgaataacatgagattgcatgagcattgccagcaggtttgctcttgtacgtatccttgatcaatttgcagtcagcactgccagcaggtgtgcatgaatgatctgatgcattaagacaggcaaactgccccaagctgacgtctggcatacgttcttaaaactttctgatgctgctgtttaactaaatgcattaccatggtttccactggacccttgaggtattgaagtgtgtaaattttctatcatttgcttagtacgtgtacccagaaatatgctgcttatgatgtattagtattggccctctatcatggggtaaactggtgtatctgtgctctcaactatggtatctactggggtatctgtgctttcgggtttc

SEQ ID NO: 10089 - DNA, 678 bp, Sorghum bicolor
  Clone ID: SORBI-28MAY03-CLUS557_1
gctgcgggagtacccgaagctgcggctgacacaggggcggatggtgttcgaggtgcgtcccaccatcaaatgggacaagggcaaggccctcgggttcctgctcgagtcgctcggcttcgcggactgcagcaacgtcctgcccgtgtacatcggcgacgaccgcaccgacgaggacgccttcaaggtgctgcggcgccggggccagggccacggcgtcgggatcctcgtgtccaagcaccccaaggagacgtccgcctcctactccctccaagagcccgccgaggtgatggagttcttgctgcggctcgtcgagtggaagcaactctccagggcaaggctcatcaggctgcaatgagattgagatggacgacgcaacggatcaagctaactgtcaggtgctaattaagagatcctgctacgtgaaatcgtgaatggcagagaatctggcactgtattgtgtcttctctactgtcccgtagtcatctgttttcctctcccttctctgtacgtgttccctgggaacctctctggcctctgctaggcgtgtgtgtaagtgtttaacaagcatgcatgtacattagtattacctaatagtagttaacttatatgctacatatatatatatatatgtagtacagtttatacaagagggaagaatatatgaagcaacgaagaccg

SEQ ID NO: 10090 - DNA, 565 bp, Sorghum bicolor
  Clone ID: SORBI-28MAY03-CLUS55599_1
gcacggcgcgccggtctcaccagccagacaccacgccctctccgtgcttccggccattccccatgatttcgccgcggatgccgacgaatctcctcccggcgcggacgatctcccctgtctcaaatggctgcgcagcgacggcgagcccctcttctccctcggtggctgcacggccacggcgaccctcttcaggccttcaatctgtgactggcagagggaagtttcccttggcagccatcactctagatgattaccttccaatgcgaagtaccgaagtgaagaaccggacatcaacagatgacatcacaagtctgagactaatcacagcagtgaaaaccccctatttgcctgatggaagattcgatctggaagcatatgattctctcataaacatgcagatagagggtggtgctgaaggtgtaatagttggaggaacaacaggagagggtcatctcatgagctgggatgaacatatcatgctcattgggcatacagtgaactgctttggctctagaattaaagtgataggcaacacaggaagtaactcaaccagagaagccgttca

SEQ ID NO: 10091 - DNA, 641 bp, Sorghum bicolor
  Clone ID: SORBI-28MAY03-CLUS55717_1
aatttcacctctctgatgtcttcgtctctcagtctctcacactctctgtcgacccttctccttccccaggcaagccccctgctccgatgtggatctcctcccacgtcgggcctccactgtcgccgtcctctccctcactctctgccgacccttctccttccccaggcaagccccctgctccgatgtcgggcctccactgccgtcgtcctctctctctctctccgtttctcggtcgcggctcctcattcacccctggcagtggccctccgccgcaactcgagtctgtcgtgacgccactacagcctgctactgcctctccctctcgtctgactcggacatggcccctccctctcctctgcatccaggccatggcccctccgctgcatcttgagcttgcactcagctgcgtcacatcatctgtcagcacggatcaaggtcgcccttgccgtgtcccctccgcttctgcagctcaagctcgtgacgaggagctccatttgtgcaggggcacatccatcgctgctccatcaatgcaggggcacagatcttgagttttctactttttcgttcttagctacgatctgattttcccggaatttggtttgatcccaagcgatgatcttttggggatgagttcgtgctag

SEQ ID NO: 10092 - DNA, 1149 bp, Sorghum bicolor
  Clone ID: SORBI-28MAY03-CLUS5271_1
ttcagtgactcgactgtcctttactagctatccccacaagcttgctcgcagccgctgctgtccccccgcgacgccaaccccgatgctcgccaccaccgccgcttcccttcggccgcccctccgccgcttcccgagcgtatcctctcccttgggtacctcccatggaggcgcctcgctcctcccatggcgcaggcggcggtcgctagcctgccgcgcagacctgcagcaggacgcgccgttcgcggccgccatcggcgcctgcgtgctcgcctcgctcgtgctgccccctccaaggccccgaggggaggcggtcgaggaggtggaggaggaaggggagtttggctttggcgcgacggacacgaggatggccgtgatggggatcatctccttcctgccttacttcaactggctgagctggatctttgcgtggctagacagcgggaggcgccggtatctggtctacgctgccgtctacttggctccgtaccttagaactaacttatcgctgtcacctgatgagagctggttacctattgctagcatctttgggtgcattttacatattcagctagaagcaggcatcaggagtggtgatattgagagtttcaagttcatcgagagcgctcggaagctcatctttcctagtgctgctaaagagaagtatggcgaccatggaaacaagagaggctcaatcggaacgggcgatagacaaaatagaaggataccaacagcacatgaatctagggagaggcttcgcaattcagatatcttcaagaggaagcttgatgactccaacgatgagaagcaaaagaagtcagattggaactgaggctcaaaatgctcgttttctcctgcattttcctgaatcaactgaaaatggatagggggatgcatgaatttgtaggaagccatgcggctacaggtgaaactgaaatggagctgtagcagtctgctgtttcaaatgggtctgaatcgtcagattttttttgcccctggctccaaatactagatcttaggaatagctagcttcttacaatgtagcgcgcacaaataacttgtcagccgaagtggacacatcacatatggtgactccagtactccaggctttgaggctccgttgtgtactcgtatgaatgaaatcatttgtgt

SEQ ID NO: 10093 - DNA, 687 bp, Sorghum bicolor
  Clone ID: SORBI-28MAY03-CLUS52849_1
atatgtatagaaggtcaaccacttggggtgattcaaccagttccctaccggactgacaatgggactattcgagtgttgctgcgatcatttgaaacaatcggacgtgtctgtatggctgattctgttgatgaaggtgtgacatggagttatgtccatgagactgaccttccaaacccaaattctggaattgatggagttaagatgaaggatggaagagtactgcttgcctacaacaccttctccagaggaacgctcaaaattgcagtctcctcaaacgatggcgattcatgggatgaagtaatgacgctagaggataccaaaggtatggaattttcgtatcctgcagtgatccagtctttggatgagctcatacatattacctacacatacaatcggacacagattaagcatgttgttcttcaacctagtgcaatggtgaagttgtgagcctgcaactgatgaatacctctggctggcaacttcaggactcttcaagtatcatggtagaaaaatgtgtttctaagaagcatccatgtaaccgggtaccaaaattgtgaaacctgttatgtacccgggatatgtcaagccacgcactccagattgtgaagaaaactttgaagtagaacaggaatctgtcatccgcacgctctttgtgaataattcaagcttcagctgaacttgtccccg

SEQ ID NO: 10094 - DNA, 844 bp, Sorghum bicolor
  Clone ID: SORBI-28MAY03-CLUS53371_1
gcgacgttttcagctatggggtgatattatgggaactctgtacaatgcggcagccgtgggaaggtatgaatccgatgcaggttgttggagctgttggttttcagcaacgaaggcttgatattccaggcggtgtggatcctgctgtagcagagataatcaagagatgctggcagactgatccaaggatgcggccatcattttcagagatcatgggcactttgagaccattgttaaaaaacacgcttgccaaccaacctaataggaagcgggcacagcaaacagatgattaagaatatagtggtcagtatcagctgacaacacaaaccaaaaaagtgtgcattggtttgtgttggcttcccagcttcaagcaactggccatctgtaactattaccattggtttgtacagtacgccaaatgcgtatttgatgaagaacaggtgaaattttggcccttcgccttcaacattggttctctgttgtagccagcggaacctgtctgtctgatgaaagccaacccaaataacacagatccatgaagccaaagaaaagaaattgaaaaggaaacttgcgaacataatagtgttgcaggcacaatggtgtactggagtcagaagttgacatgtagagcgggttcatcgtcttctatcagtgaggccatatttttgttagtcctcggactaatggcaaagtattccatcttcaaggccccttcaaattgtaatgttttgtgatgaaattgttggttcacttgcaggcccttgtgtatatcaagtctcaacaaatatgttgtaattgacagttagattacaaaagaaaaaatatgtcctttgtacttaaaatcatc

SEQ ID NO: 10095 - DNA, 1145 bp, Sorghum bicolor
  Clone ID: SORBI-28MAY03-CLUS53468_1
gcacgaggcacaagcttataggaaggttggctttaacccaccccttacaggcaaggtcaccccaaagtttagtgttttggttgctgaatgtgttcgtcagatccaagacaaaaggagaaaatcactgaaacctacagcacgacagaaatgtcctaaagatggaaatgttgactgaaccatacctcgatgtacatgtgtgcacaaacttcatgagattattgttctgaggtttatacaaagcaatgataacgtactctgccagattactacagtcagtcctggttgaatgatatgaataatggaagcttgcatggtatgcatgagttgaaggtttaagtgtcattggaagaatggatgtcatgggaattgttgtcagtagcatagttgaaatgaaaattgaatgaacaagctcgtgggagaatcaagtatcaactgcgagagtgtgcagcgtgcagtaatagaatcttgaggagttctatgttctattatttagcaggcagtcttttatcatgagtttttgtgagttgctgaacatgcagcaagactgcatggttgatatggtggtgtgttgaacatcatcggcttgttggtagtattatgcagcctgcatgagaactggtgattgccagcatcaaacctacctacatgggctcatatgaaaaacttgaccactcctaggatatcactgttcacatgttgatattccattttggagttacacagatccaaattgcaacccgtataggtagctcggagggaaattgcgcatattctggaggaaacagttgccaaattgagattcagtacaggcgcttattgtgtgctttgcagagagatgtatgaatgcaagatttgtacttccatggctaatggactttgcacaatatgagatgctacttactgagaatgtcgcgcatcatgcaccaaagttagaggttatgaggatactgcagtacacatttatgtttatagaatttcatggtgttgcacaaataattaccctttgtggctttatggattgtagctgataaaaaattaaaatctcgctacaatgtataggtgtattagattatttggttgcagttaaatggctgtaagaactcaggtctgataagggctaaggcgacataagagcctttttcccg

SEQ ID NO: 10096 - DNA, 990 bp, Sorghum bicolor
  Clone ID: SORBI-28MAY03-CLUS5375_1
ggcactccggcgaagacatctgcagatggatgaaacacaggacgctagcagacgtgctgacctgaaggctggtgccatcatgatggccagtaacatcagggcgaatacgggcaagagagtaggaactgtccctggagttgaaataggggatattttctatttcaggatggagctgtgtgtccttggattgcatgcacctagtatgggaggcattgattacatgactactaaatttggaaatgatgaggaatctgtagccatatgtatcgtctctgcaggaggttatgagaatgaggatgatgacacagatgtgctggtgtacagtggtcaagggggaaatagtaggaatactgaggagaggcatgaccagaagcttgagaggggtaacctagctcttgagaggagtttgcataggaagaatgtgataagggttgtacgtggcttcaaggatccattttgcctaactgggaaaatttacatatatgatggcctctacaagattcatgagtcctggaaggagaaaacaaggtctggtgtcaattgcttcaaatacaagctgctgcgggaacctggacagcgtgatggagctgcattatggaagatgactcagagatggatagataatcctgctaccagaggcagggttctactagctgatctgtcatctaaggctgaagctttgccagtttgtgttgtcaatgacgtagaccatgagaaaggacctggagaattcacctatactaatcaggtcaaatactcgaggcctctcagttctatgaaaaagttgcagggctgtggatgccagagtgtttgcctgcctggtgatgccagttgtgcttgtggacagcataatggaggtgatttaccctacagttcattaggattgttgtcatgccgcaaaccgattatctatgaatgtggtgaatcttgcaactgttctataaatggccggaacaaagtgacccaaaaagggtccaggctacattttga

SEQ ID NO: 10097 - DNA, 1256 bp, Sorghum bicolor
  unsure (1)..(1256): unsure at all n locations
  Clone ID: SORBI-28MAY03-CLUS5376_1
gcaccacagtgcgccaccctcctcacccaccaacgaaaccaatcggtagctagaccggcgacgaggtgtggcactctccgcgatggattctgactacggcgtgccgcgcgagctctcggaggtgcagaagaagcgcgcgctctaccagcccgagctgcccccctgcctccagggcactactgtcagggtggagtatggtgatgctgcaattgcagctgacccggcaggtgctcatgtgatcagccatgtgttccctcacacctatggtcagcccctcgcacacttcctcaggaagacggctgttgtccctgatgctaaggtcatatctgaacacctggcggtcagggttggcattgtcttctgtggcaggcaatccccaggaggccacaatgttgtttggggactctatgaggctatcaaggcccacaaccaaaacagcaaactcattggttttctcggtggatcagatggtctactagcgcagagaaccttggagatcactgatgaagttcttgcttcatataaaaatcaaggtggatatgacatgcttggtcggacaaaggatcagattaggacgacagagcaggtcaatggtgcaatggctagttgccaggctttgaagctggatgctctggttatcattggaggtgtcacctccaacactgatgctgctcaacttgctgagacttttgctgaggcaaagtgtgcaacgaaggttgtaggtgttcctgtaactttgaatggggaccttaagaaccagtttgttgagactactgttggctttgacaccatatgcaaggtgaacgcacaacttatcagcaatatgtgcactgatgctctatctgctgagaagtattactactttattcgcctgatgggacgtaaggcttctcatgtggcattggaatgtgctcttcagtcacatccgaacatggtcatcctaggagaggaggtggctgcttctaaacttacaatttttgatattacgaagcagatttgtgatgcggttcaggcaagggctgaaaaagacaagaaccatggggttattcttattcctgagggccttgtggagagtattcctgaactatatgctcttcttcaggaaatccatggtctccacggccaaggtgtttctgttgagaatatctcttctcagctttcaccttgggcatctgcactctntgagtttttgccccttttatcaggaagcagctacttctccatcctgaatctgatgattcagctcaactttctca

SEQ ID NO: 10098 - DNA, 734 bp, Sorghum bicolor
  Clone ID: SORBI-28MAY03-CLUS64208_1
ttcatggcaaagtgaccccaacaacagttccaggggctgtggtcccagcagagcaatggatacaggatgaacgtgaactcaaaaggcaaagaagaaagcagtccaatagggagtctgcacgcagatctaggttgcgtaaacaggctgaatgtgaggagttggctcaacgtgcagatgttttaaagcaggaaaatgcttcacttagagatgaagtaaatcgtatcagaaaagagtatgaggaacttctatcaaagaataactcactaaaggaaaagcttgaaggcaaacaacacaaaactgatgaggcaggacttaacaacaagctgcaacattctggcgatgacagccagaaaaaaggaaactaatcgagctatcatgcaatgcttgcttagcatggctctaactagattattgggaggcgcaattgtagtatgcgtattaactccttactttattgcagttaattgttaccaggttgtgataatgttgattccaaccttgtgtgtgggtgtttcctgtttcagatctatcttggcttatcttttagaagtcaagatgtgactgaagatgtaggttgtgacccagttcactatatctgttagaaatagtggataagctcatatttacaaatttgtattgctgactaatattgttatgtatacctggcaaaagaccggtttcttttaattcagtctggttgaacatttttctgggcttgctctgctgcctagttt

SEQ ID NO: 10099 - DNA, 570 bp, Sorghum bicolor
  Clone ID: SORBI-28MAY03-CLUS5625_1
gcggatccagttggctccatcctcgatggcagcagatctgggctcaggggcagcggatccggttggcctacaccggctgctccgcgacgaggcctcccatggcctaattatgaatcatgtctaccatgtatacacttgattttattcttcgagccaacatcagggttgagtaaaacccactccattttgcttgaggagctaaaggggatttgtcacatggtgaatcagaacctcaagctcaggaggcagtgcttgcaggcaaaaaagctctatgaattggctattcgtctcgaatttggatttcttgaagttgcaacctacctgatctgcttgttgctaaaggacggcattgatgccttggtttattggagttgcactggccctagctgatctgcgtattgctaaacgatgacattaatgcctgctgctctacatcacacgtttcgcattgaaaaacttattgttgtattagtataaactagatattttggtgaattatttagctgtatgcataatttgattctgaacacagtaagaaacatgattttagcttgaggcacatgacacctg

SEQ ID NO: 10100 - DNA, 831 bp, Sorghum bicolor
  Clone ID: SORBI-28MAY03-CLUS56498_1
aagccaaacccctccagttcccgcggcccccgccgccgccgccgccgccgccgcccagagcacccccaccccctcacggtccccatgtctgccgacgccgccgaggcggcgatggccgcggcttccctctgtgacgaccttgagcccgccaccgcgcgcacccgcatccgtgatgtccttgccgcaggcaccgcgcgtgccggggaccgcgtcgtggtcggaggctcgcgccggacgggccgggagcaggggaagggctccttcgccttcctggagctcagcgacggctcctgcgccgccacgcttcaggtcatcgtcgacgccgccgtgcacccgctcgcgcgcctcaccgccaccgggacctccgtgctcgtcgagggcgacatcaaggagccgcccgaggggaccaagcagaacgtcgagctcaaggtcagccgcgtgcttgaggtcggcgaggtcgatgccgccgtctacccgctgcccaagggcaaggtcaaactcacgctcgagaaactcagggacgtcgttcatctccgttcgcgcaccaacacgattggagcggttgctaggattaggcaccagttagcctatgcgtcacacactttcttcgatgagaatggatttctctatgtacatacaccaataataactaccagtgactgtgaaggtgctggtgagatgttccaagtgacaactctgtttagtcaggctgaaaaaactgagaaggaattgagagagaacccggcaccatctgattctgaaattgaggcagctaaatttcttgtcaaggaaagaggtgatgtggtcgcacagcttaaagctgcgaaagcc

SEQ ID NO: 10101 - DNA, 813 bp, Sorghum bicolor
  Clone ID: SORBI-28MAY03-CLUS56867_1
ttcggcacgaggccgctccgtcgtacggacgctcgcggcgccgcacaaaggacagcccgcgaagatggctgactcgccaacggtcgatgccgtccttcacaacgcggtcatcgtcaccatagatggcgcgctccgcgtcctccgggacggcgctgtcgccgtcgccggcgaccgcatcgccgctgtgggcccctccgccgacgtcctcgccgccttcccctgcgccgtgcagaccctcgaccttggtggccgcatcgtccttccagggcttgtaaacacgcacgtgcacacatcgcagcagctggcgcgagggatcgccgacgacgttgacctgatgacgtggctgcacgggaggatatggccctatgagtcacacatgacggaggaagactcctatgcctccaccctcctctgcggcattgagctcatccggtctggggtgacatgctttgcagaagcaggtgggcagtttgtttcagaaatggcacgcgctgtggagttgttaggcttgagagcgtgtttgacaaagtcaacaatggattgtggtgatggtttgcctccaaattggagttgttgctccactgacgattgcattcagtcacagaaggaactatatgaaaagcatcacaatacagctgatgggcgtatcaggatatggtttgggttgagacagataatgaatgcaacagatcgtttactgcttgaaacaagagatgttgcccagaagctaaatactggaatccatatgcatattgcagaaataccatatgaaaatcaacttatagttcggaccaaaggaattgatcatggcac

SEQ ID NO: 10102 - DNA, 615 bp, Sorghum bicolor
  Clone ID: SORBI-28MAY03-CLUS56955_1
acctagacattccagtaccgcttctgccccccagcactcgcgccaccgccgattgcctcctctccactccaccagatctcatccccttctcgcccaccccgatcaccgcgcgggtatcggagcatggcgtctgcggcggtggtggacgccggcgacgcgccggagcccacggtgcggaacctcctggaccaggactccctcaagtgggtcttcgtcggcggcaagggcggcgtcggcaagaccacctgcagctccatcctctccgtcctcctcgccggggtccgccagtccgtgctagtcatctccaccgaccccgcgcacaacctcagcgacgccttccagcagcgcttcaccaagttccccaccctcgtccgcggattcaccaacctctacgccatggaaattgacccaaaggtagaaaatgatgatttatccaatgaaggaatggagggattcctttcagaactgacaaatgcgattccaggagtagacgaagctatgagttttgctgaaatgctaaaattagtccaaacaatggattactccgttgtagtttttgatactgctcctacggggcatacattgcggttgcttcagttcccagcaaccctggag

SEQ ID NO: 10103 - DNA, 579 bp, Sorghum bicolor
  Clone ID: SORBI-28MAY03-CLUS742_1
cgtccggatcgtccggggaacagcgaagaacagaagcaggcgaagcgactgtcgcgaggacctcatccgccatgacgctctccctctccacctccttcctccccacccccgccgccgcgaccgcgagggccaccacagcccgcaccctacgctccgtcgtcccctcccaggggatgcggtgctcgatgcgcaagaaggggctgcacccggagatctacgaggacgcgaaggtgtactgcaacggggagctggtgctggtgacggggggaaccaagccggagtacacggtggacgtgtggtccgggaaccacccctactacgtcggcgacacctcggcgctggtggtgatggacagccagatcgagaagttccgcaagaagtgggggcacgtcaaggagtactggcccgaggaccagtggagggagatgcaccccgacggcgacccggagttcgagcccgagggggacaactgaaatggctcccgtcttcttcctcatcaatcaccgtaccggtgctgtttctctctgtgtcctcttgagtctgaatggaattgagacttttggtctgtttgcagtgctc

SEQ ID NO: 10104 - DNA, 674 bp, Sorghum bicolor
  Clone ID: SORBI-28MAY03-CLUS74306_1
tactgtgtctctgtggtttggtttcttggccatgcgtatataacaactcccagcacttccgatctcttcttatcgccccctccccctccctattcctcccctcgattctccgggttgatcccgtcgctgtctgggcctgttccattggaggagaatcgcccggctagaagaaaaggcttggaaaggaaggtaattatctgacatggatgagcacatgggaagacgaacagttggcggcctcctcttcaccaagggaggctcaattcttctcttcagagaagacggttcgcgccccaagtccaagaactgctgctcgcgccatggctgtagtggtcagcattctgctgacaaagccaaaggcaaggaggtgcacagggcggcggcgcccaatgaatcaacgccagccacccctgggagatcacagatttttcggaagcccaacagaaagcctccacatgaaagcagtgcttcaggcagcatcagcagggatgcaggaggctcttgtagcgaaaccggcaacaggtcaagagacactcctgggcccgggcgtgatctactggctaggcttaaggagagggtcaacacatcaaggaaacgatcgttgaacagggagaacagcccacagtcaccgagtggattcagtgctggttccccgagcaatagtcgatcggtct

SEQ ID NO: 10105 - DNA, 621 bp, Sorghum bicolor
  Clone ID: SORBI-28MAY03-CLUS74240_1
gccacccctccagccacgctacctcccgtctcatcgcctaccgtcgccgtcgccgcgccagccccgacgactccggctccggtcgccgccccgcccctggccatgtcaccagcggcgcttcctccggccacgttccctccagcaacggctccgacgccatttctcgctgccccgatcctgcctcccaccgcgccaccggtggctgcacccgcgccggcccccgtgtctccggctccggctccaagcgtcgccccgaccccgtcgccgacagaagccccgacgccgtcgcccaccgaggccccaaccccgtcgcccacgctggcgccggagctggcgcctacgctcgcgccgttcagctcggtgtcggtgagcccgtcgctggcgcctggccccgcgctcgctgcggaggaggagtcggccgcgccgagctcgcgcaccggcgtcgccgccgccgctctggtgtcgtccttggtggccgccgggctcatcgtcgtcttgttttaagtagagctgagtttaccgttgtacgtccgtaccgttcctcgcacgttcttgtcctcctgttgttgttttacattcttgctgtacaacacattgataatttattctttctattcagaa

SEQ ID NO: 10106 - DNA, 717 bp, Sorghum bicolor
  Clone ID: SORBI-28MAY03-CLUS74337_1
atgaagactcgctttcgctacggctccggtgggttccattcccttaaccaagccactgcctatgagtcgccggctcattcttcaacaggcacgcggtcagagatcactttcccccccctcgactgcactccacgctgctcaggtcgggaaacacagcacagagcgcggggcaacaccgcagcaacagggaggaacgaaagcttctgcgccgatcgaccgagaagacaagagggagccggccagccaccagaaggagaacgagttcgggaggagggagcggacggatggcaatggctctgctcccgctactgctctcgctcctcatcgtctcctgcgccgcgcagtcgccggcctcctcgccgtccgcgtccaaggctcctccggtcgtcagcgcctcggcgccgcgggcctttctcgcgccaccgacaaaggcggtctcggcaccgcaggcctctgtagcaccaccgacaacggcggtctcggcgccgcaggcctcggtcgcggcaccgacaacggcggccgcggcaccgcaggcctctgtagcaccaccgacaacggcggtctcggcgccgcaggcctcggtcgcggcaccgacaacggcggccgcggcgccgcaggcctctgcacagccgccaacaacaacagttgccgcgtcaccgacacaagcagcctccgcgcctcaggtctccgccgtggcgccgacaactgcagcctccg

SEQ ID NO: 10107 - DNA, 764 bp, Sorghum bicolor
  Clone ID: SORBI-28MAY03-CLUS7437_1
ccgcgtaacatataacccagccgcccgggatagggctacccgtctcgccgccgattcgctgtagctttcgcctgtgctgcccgtgcgatttctgcgccgcgccttgtactaccccaagtcagtagcctcctccaggcggcggcgttttcgtgccgagttagggttagggtttctgtggttgcggagatggaggaggtgacggagggagtgaacaatctggcgattacggagccgcacaagaagaacaggatccaggtctccaacaccaagaagccgctattcttttacgtcaacctcgccaagaggtacatgcagcagcacgaggaggtggagctctcggcccttggcatggccattgccactgtggttactgttgctgaaattctgaaaaataatgggctcgctgttgaaaagaagatcatgacatccacagttgatgtcaaggatgatacaagggcccgccctattcagaaagccaagatcgaaatagtgctgggcaagacggataaatttgatgagctgatggcggcagctgatgcggagagggaagctgctgaggcagaggaacagagctaaacgtctatcttaaattttgatgttgtattagtacaatgctgctaggttgtgggttttaatctctggctaacaagagactggtacttctgtgttagtaatcaagagctggtgccattttatttgttcccatgatactttatggtttatgatagatttcgttccaaaaaaaaaaaaaaaaggccctaggg

SEQ ID NO: 10108 - DNA, 645 bp, Sorghum bicolor
  Clone ID: SORBI-28MAY03-CLUS74462_1
tggactgatcacacacgttcctgcaggaactggcaggcatggcgggcttctgcactcctgctgccactgcagctgcccatgccactccaacccctctggcgagctcaaggaagcacatcgtcatgtgcctctcccccaagccaggcggcggtggcggaagcaagagggtgcggcttgcgagtacaggcgcagctcctcaggtgcgcgcgctggcgccggcgaccgcggcggaagaagcggcggggccctcccccgcccctctcaacgtggactacctggccgccgagttcgccggccacggcgtcagcttcgagcccgtgggcagcagctgcgccgtcaagatggcgctgcgcaacggcagcgtggcccacgtgctgctccccagcgggctcgtcacgtcctacaagcccgccatgtggcacggcacggtcacggaggtgctccacacgaacgtcgccgagggccccggcgggcgggccgtcatccgcggcggcgtgtccgtggacctccgttgcgctggcggcgatggcggtgtgtggtcgccgagcgcgagcggagcgtggtcgctgcgcgacgtccggggaaacccaaccacctccatcgagatcgagctcgcgtcggcggcgccggggagcgcggccgcgg

SEQ ID NO: 10109 - DNA, 1164 bp, Sorghum bicolor
  Clone ID: SORBI-28MAY03-CLUS5767_1
tgttgagatgttgggttactgtgtggatgggaattatcgtatacttgcatatgaatttgcaaccatgggttcgcttcatgatgttttacatggaagaaaaggcgttcaaggcgcgcagcctggacctgtacttgactggatgcaaagggtcaaaattgctattgaggctgcaaaaggtatagaatatctgcatgaaaaggttcagccttcaatcatccatcgggacatcagatcaagcaatgtactgctgtttgaggatttcaaggcaaaaattgcagacttcaatcttttgaaccaagcaccagatatggcagctcggctccattcaactcgtgtattgggaacttttggatatcacgcacctgaatatgctatgactggtcagctgacacagaaaagcgatgtctacagctttggtgtagttcttttggaacttttgactggaaggaaaccagtagatcacacaatgcctcgaggacaacaaagtttagtcacatgggctactccaaggttaagtgaagacaaggtgaagcaatgtgtggatcccaggttgaagggagaatatcctccaaagggagtcgctaagcttgctgcagtggcagctctatgcgttcaatacgaagcagagttcaggcccaacatgagcatagttgtgaaggcgctttcgcctctccttcaacaaagacctgcaccagccaccgcagagccagccccgcaacctgtgagctgaaaccagtcatatgtgatgggaccctcggcatgcattcaaccagcacattctatgagtcattgagagtattttggctatttgttctgtagcattctcagttgggtacagcatacatgaacttgcctctactgtttgtggacaacaacagttcgtggcttgatgttggcgccacacaatggtatatgcagtaggctcgaagttgtttttttaccttctctaccaataccaactgtttgtaggtttcagaattcgttgcttgaagaatgatgcagaatgatctggactttttacctttggcgtggcgttgctgccttgccttccatgctggttatcatgaacttcctcccaaatcacaattcacttttaatttgttgtaagccaaaattcttaaactgtgatcaagtttatgaaatatagatatggacgtctaaaac

SEQ ID NO: 10110 - DNA, 1322 bp, Sorghum bicolor
  Clone ID: SORBI-28MAY03-CLUS57767_1
gcacgaggcttatcactatgctccgtttgcttcggatttaagtggattgggccaacttaatattaaatttgaacttgggacgccattcaaacctttcgatcaacttatgggtgttttcccagctgcaagtgcccatgcgctaccgctacagtatcgtcaattgatgaccgatccacattcaccaataattgatttttatcctatagattttgaagtagatatgaatgggaaaagatattcttggcaagggattgcaaaactaccgtttatcgatgaagctcgcttattggctgagataaaaaaagttgagcatactttgacgcctgaagaagcaaggagaaacagcatcatgtttgatatgctctttgtgaatggctcacatccactttcgccttatatctactctctcaacagcaaatttggacatctgcctgacaaaagcggagcggggtgttgagttgggcccgagcgttagggatgaccttattgtacctgttcaacgttttcaagggtctcgcctagcctctggggctgtacctgtgccatatcagcagaatggatcccatagaaacaataaagaaaggaacagtcgagctccgaaagttgcacgagtatcaacgtcaggttccagcatttccgcagccatagttgaagctgaaaatgaccttgaagcccaagaacgggaaaacaaagaagaactggaggcaatgcttaaagatgcacttcgcgagaaatcagatatttttaattctgacaatccagatgaggataaggtgaaactcggagaaccaggatggagggaaaggtactatgaagagaaatttggggcaagaacacccgagcagatagaagaaatacgcagagatgttgttctcaaatacactgaaggattgtgttgggtaatgcactactattatgaaggggtctgctcatggcaatggttctacccttatcactatgctccgtttgcttcggatttaagtggattgggccaacttaatattaaatttgaacttgggacgccattcaaacctttcgatcaacttatgggtgttttcccagctgcaagtgcccatgcgctaccgctacagtatcgtcaattgatgaccgatccacattcaccaataattgatttttatcctataggtttgctgattttattaatgtgatgtgctctatattatcatatctttgattagctgttttctggttcatgatcccattcactatgcagattttgaagtagatatgaatgggaaaagatattcttggcaagggattgcaaaactaccgtttatcgatgaagctcgcttattggctga

SEQ ID NO: 10111 - DNA, 1111 bp, Sorghum bicolor
  Clone ID: SORBI-28MAY03-CLUS576_1
cggtccgccttccgggtcgacccagcgtccgcttatgcattcctctcagcttagaggatcacattctgcagtaaaggaaactggctggttacctttccatgttgttgcacgggatgagaatggacatattataggtgttgttccgctttaccttaaagtcattctagaggagagtttgtgtttgatcaatcatgggcagaagcttactacaactatggccttgaatactatccaaagctccagtcctgtgtgccttttactccagtaactggtcaaagaatattacttcgaaatacatcatatcgtgatcaagtttttgatgcacttgtcccaggtttgatgagcctgactaccaagatgaacgtgtcatcattacatattacttttccgtctgaaggtgaattcagcaaattgaagaatagtgggttgttacaaagaattgggttgcaatatcactggagaaatcggaattacaagagttttgatgagtttctgatggatttgaagcaacctaaacggaagaatatcagacaagaacgtaaaaagattcctgctcaaaatttgcaaatgaagcgacttcgtggagacgaaataaagagcagccactgggatgccttctataaattctaccgtaacacaactgataatcattggggccgaccatacttgacaagggatttctttcacctcttgggcgaaaagatgggggagaatgtgatgcttattgttgctgaaaaagatgataaactagttgctggagctcttaaccttattggaggtgatacactgtttggccggttatggggatgcctgccagatgcttactttcccaatttgcattttgaagcttgctattatcaggcgattgaagcagccatagagttaaacctgagtaatgtggaggcaggtgctcagggagagcacaagatccagcgtggttacctcccagtgacaacttacagctgccactacttttcaaatcctggttttgcggcagctattggaaattttcttacacatgagacggctcatgttaagcgtgctattaaggtccttcatgattcgggttcatacaaggaagacatactgaaagaatttgcagcttaacaag

SEQ ID NO: 10112 - DNA, 345 bp, Sorghum bicolor
  unsure (1)..(345): unsure at all n locations
  Clone ID: LIB3478-010-P1-K1-A6
cacttgtcaaaggtttgatgagcctgactaccaagatgaacgtgtcatcattacatattacttttccgtctgaaggtgaattcagcaaattgaagaatagtgggttgttacaaagaattgggttgcaatatcactggagaaatcggaattacaagagttttgatgagtttctgatggatttgaagcaacctaaacggaagaatatcagacaagaacgtaaaaaggtttaccttcttttggcttaattgattcaaatgtgcttgtcaattgaggataatcttttttggaaacttcccagattcctgctcaaaattngcaaatgaagcgacttcgtggagacgaaat

SEQ ID NO: 10113 - DNA, 1178 bp, Sorghum bicolor
  unsure (1)..(1178): unsure at all n locations
  Clone ID: SORBI-28MAY03-CLUS57803_1
gcacgaggcctcccctctgatgtatgcccagaatgccatagcagtgaatgagttccttggccatagctggcagaaggttgtcgatagcacacaaagcaacgacacactccgcgtggaaatcctaaaggcccgcggcatctttgtcgatccaaactggtattggattggtgttggtgcattgcttgggtatatcatgctcttcaacgtactcttcgttctgttccttgactggcttggcccacttggacaaggtcaggccgttgtttctgaagaggagctgcgggagaagcatgtaaaccgtactggtgaaaatgttgagttgctgcctcttggaacagcttcccagaattcgccttcagatggaagaggagaaattgctggagctgaaaccaggaagagaggaatggtacttccatttatgccgttgtccatcacctttgacaatgtcaaatactcggtggacatgcctcaggaaatgaaagacaaaggtattactgaagaccgtctactgctgctgaagggtgtaagtggagccttcagaccaggagtccttacagcactgatgggagtcagtggagcgggtaagactaccctgatggatgtgttggcgggaaggaaaactggtggttacattgaaggagatatttcaatctctggatacccaaagaaacaagagacctttgctcggattgctggctactgtgagcaaaatgatatccattctccacatgtcactgtttatgaatccctcctgtactccgcatggctccggttgccccatgaagtggattcagaagcaagaaagatgtttgtggaagaagtcatggaactcgtggaattgacaccactgaggggagcattggtaggactgccaggagtaaatggtttatccacagaacagaggaagagactcaccattgccgttgagctcgtggccaacccatccatcatattcatggatgaaccaacttcaggactagatgcaagggcagctgcaatcgtgatgaggacagtccgaaatacggtggatactggaaggacggttgcctgcacaatccaccagcctagcattgatatctttgaagctntcgatgagctatttctgatgaaacggggaggggaagaaatatatgttggacctttgggacgcaactcatgccatctgattgactactttg

SEQ ID NO: 10114 - DNA, 710 bp, Sorghum bicolor
  Clone ID: SORBI-28MAY03-CLUS55771_1
caagatgcttcaagagcgttagagttgaacccggaccaagctaaagcttacaaagtccgaggtactgcacgacgttatctcggcgaatatgagctggccatcaaggatttatatcaaggaaaccaaattgattttgacgaagaaacagacaaattagctaggagtattaaagacagagtagaccacttagtttcgagaagaagagaaaaagaaagaaacgctcaagaagcagagagacgcagaaagttagctgaatatgaacgtagaaagaaggcagcagaagaaagaaggaaagctgaagaggaagcccaacatacaccaggcgcgcctggtggaatgcctgaaatgcctggaatgggcggaatgggtggtttacctccggagttggttcaacaactattctctgatcccgaagtgcaagcagctctagaagatcctgaaatagcaccgaaactaacagaaattctgcaaaacccctctgcagccttgaaatacctttcggatccaaaattagcgcctctcttccgtaaattcgctccgatgtttgctggtgctggagcacaaggtcctcaggggcatgctcaaggacagccccaccaacatcatgcaggatgctctcattcccattccggtggcgcagaagaattcgatcttgactagcattccttcctcagtcaagaaattaataaagagactaatgtaaagagctc

SEQ ID NO: 10115 - DNA, 649 bp, Sorghum bicolor
  Clone ID: SORBI-28MAY03-CLUS55992_1
agcaccgatagcaatgagcacgggctttctgactatgaagttagtggggagggactcagagaagcaattaaaggcggggatgttaagggtgtaaagaaacttcttacacagggagtggattgcaactactgtgacaaacaaggatttactttgctgcatttggctgcattgtttaaccagacggagattgctcttattctcatggaccatggcgcaaatgttgagagcaaaaatgggcaaggggaaactcctttggactgcgctccaacaatgctgcagtacaagatgcgacaacggatggaagaacttgcggcttcaaggagaccactagagtgaacggcattcatgctattttctggtgtttttcctattccagtttgtgtcaaacgtggtgtcaacgaataaagcagttaagtgagctgaaagcttcttgctggtgggataggtgtttggtccaccagtatactatccagaaacgttggaatgccagtcacgactcacgcgtatgaaataatatattcagcttcatcctacgttcctactcatgtacctatgtatgtagccagtgaatacttccatacatttaccatgtacaatatttttttctaggagatatcagttcagtgacagcataaagcttcttgccgtt

SEQ ID NO: 10116 - DNA, 1051 bp, Sorghum bicolor
  Clone ID: SORBI-28MAY03-CLUS56053_1
gcacgagggtggggcgctccttggtagtggctcgtttggtatggtctatgaggccatcactgatgagggtgtcttctttgctgtcaaagaagtaagcttatttgaagggatccacgcgaagctatgtatctttcagcttgagcagaagtatcacctgcaagacaatcatgtctctacatatacaagacagatccttaacggattgacttacctccatgaaaggaacattgttcatagagacattaaatgcgcaaatattttggtacatgctaatggatctgtgaaacttgcagattttggattagctaaggagctttccaaattcagtgcggcaaaatcatgcaaaggaactgtttattggatggcacctgaggttgtcaatccaaagaagacatatggacctgcagctgacatatggagccttggctgcaccgtcctagagatgttgacacgccaagttccctatcctgacatggaatggacacaagctctattcaggatcggcaagggggaagcaccatcaattccaagtgctctttcaaaggatgcccgtgattttataagccagtgtgtaaaatccaatccagaagacagaccctcagcatccgaactgctgaagcatccattcctcattaacaggtcaatgagatcacccatatgaggacacgctctcgaatttatctacacgtggcatcagttaatgagcgcagtggcagaatggcatgttgttaacccttgcactccctctgggagtaccttttgttccacgcacacgctacaatttacatatcgctagaaaatgaagcgcgctttgtgacgccttacgtggcaaattcatctccaatttcttagagcaccacagggatcacccatagaaccaagcacaaacattgcaggcttgcagccaaataggactcatgcatctatcttttgttgtgtacggatgaaacatactgttatccttttcagacaattttcggtaatagatttcagatgttccaataaatttgttggatgactgacagattgcgcagataagctcccttgtctg

SEQ ID NO: 10117 - DNA, 758 bp, Sorghum bicolor
  Clone ID: SORBI-28MAY03-CLUS56209_1
ccacgtgcccctgccgccatatggattgcctacccggtttcgttcgtgccaccttctgggccctcctctgacgcccgaggggccgcggccgccggatggagtgcggagtccctgactctggcggctccgcctccgcccgcctgtgggacttgggcggtcgcggctccagggtgcacaaaggctttccgcacccacgcatagcagcttccatcggcatggtgggctgcggcgaacgcatgtccttgggatgcaggaggtttgctagtaggctgcaatcagacaatgcttttccttgcagtccgcggctgatcgcaggcattatcccatcggtttagtcctgatagctgttgtcatgtctatggtcggacgctattccaaggcgtatgatggacactgctcgtccctaggtcccgggggttggctgttcctgtcacccatcttcttactcagtgggggtgctcatctgtggctgctcgagctctacgcctagaccttcctgttccctgcgcgtgccgtggccccatcgcttcgtttttcttgttagtattgcagttccggtgtgtggctgctcaccggcgccggttctagtagtatgtctaaaccttccattttcatttgctaaaagtatctatatctcatcatttttctttttaaaattgcagttcagatatatggctgctgactggcactgtttttatatgatttgtatcctctaaaaaacgaacatatggtctttctatcctgattttaataacttc

SEQ ID NO: 10118 - DNA, 1050 bp, Sorghum bicolor
  Clone ID: SORBI-28MAY03-CLUS56222_1
gcacgaggctcaatttcacatatgcatgatactgatgatgaggatctcactggaagccgccataaaaggagaaaggggaataggaggagaaagcggcataggtatgattctgatgaggacaagcttgatgaactgcttgaacttggatcggctgatggaaagaacggtgttgagtcacaacgtggaagctggcgcctttcaactgatggcttctctgcttcttgggacattgcagacataccagatcacctgtctacttattattccacagtttgggtaaagcgggcttgctttagatgattgtccttgcagtctgtcaatcctggtacctcttcagcgactgcttctacgtgcatcgtccgctggcatgcacggtgctgcgtcacatctacaatattttggtgatgggttctgatggtaattgttaacttttggtgctttgatgttacataccatgaattcatttcctatgagagcttttaagttctattgtcatgcacaccgtataatctttaggtttatcactggcatttgtactctccggtatttttttatgctgacatgctacaactttaaacaattgatttgtttgatttaattgtcacattgatcaatgtccttgcagattcattcttggattgctgaatgctggacaaccctgtttagttgggcttgctgaaggttgatgacacctattgaagaattttggctgcatagacattgaatatggatccaggcatttccttgaaacccatttggattttggagttagttgctgagatcacagatgctgactaagctaagcaaaaacgagtctgtaattgtgttgtccagtggtagcgacattttgctgactacacctgttgtacatggataccagattgatactgtgaatttcacaaccttaaaggaattcttagacacttccagctttgcactgtattctggttcctcagtatgcgctgggaagtattgtagacattttgctgactacacctgttgtacgtggataccagattgatactgtgaatttcacaaccttaaaggaat

SEQ ID NO: 10119 - DNA, 750 bp, Sorghum bicolor
  Clone ID: SORBI-28MAY03-CLUS56378_1
ggatgttatgctgggaaccgttcttgcttctgtttgtttgctcgctgccctctggtagagttgccgggctccgctttttcttgtggtcgtttgatgcccgcgaagtgaactattttatatgttccgctaactcctggtgccttctcttccgctcgcaccttcctgtattgtcctttatgctaattcaaggccccctattctcatgcttatttttactttccgcatacttatatgatttacgaatgattttgatgccaccttccaggttcctaattatagctgacctctaatttgtgccacttacaatacactcacgtggcttaaagaatgatcgaagctgcccatccttcagaggtttttgggttaatgagacatcctcccatgtgctcatgcttgatggattcaggtgcaacctatgtgtcgctaagaagaatgtaaaggcgacgacgaacaacgacggtatcagactgaagcatgaacattgggtgatagtgatgcctatagcataggcaaccaaactcttaaacccacggctctcttccgtgtaaaatatttcgaacgcactgtctaaaatgtctgaacaccacatctgatggaaattagcacccaactatacaaacatgttgtgtaatgtagcgatccagcatcttatgatgctttggtatgttcaaccagactcaaacgtataccaaacctaaggactacttggagtcttgtccttgtataaccatattgtctacattattcttc

SEQ ID NO: 10120 - DNA, 887 bp, Sorghum bicolor
  Clone ID: SORBI-28MAY03-CLUS58520_1
agagaacaaaccgtaacgtgtgacgaggccacgccgccctgacgggccccgccgccgcccaggactaatcgtgcaggtagtctcttctttacaaagtcactctggttttcgcctcagcgcatgtggatctgttagttcacctcctgcaagcaagtatagctacaaggttcaccgctgcagaagtatgaatccttactttgttgggattcttgtccctgtcgcggtctcccttttgctccgcaagaggagaaaggccgaaaggaagaggggagtgccagtcgaggttggtggggagcctggatatgcagtccgtgcccgtcgatttgagcagcccgttgagacacactgggagggggtctccacacttgctgagctgtttgagcaatcttgcaaagagtatgtcaacatgccactccttggcaccaggaagctcatctcgagggaaactgaagcagcacctggcgggagatcgtttgagaagttgcatctgggcgagtatgagtggaagtgttatgcagagtgcttcaagagcgtttgcagcttttcatctggactaattcgagtaggtcacgagaagaatgaacgtgttgctatttttgctgagacacgggctgagtggcagattgcgttgcaggcgtgcttcagacaaaacattacagttgtcaccatctatgcctcattgggggaggaagcattgtgtcactcactaaatgagactgaggtcactactgtagtttgtggtcagaaagaactaaagaagttgattgatataagtgggcaacttgacactgtcaagcatgttgtctatatcaacgaggaaggcatatcagctgaagtttctttagctcaaaactgcactagctggaaggttgaatcatttgaggaag

SEQ ID NO: 10121 - DNA, 770 bp, Sorghum bicolor
  Clone ID: SORBI-28MAY03-CLUS582_2
gcacgagggtctactcctgccgctcatcttcaccgccttcactcaccctgcttccaccctgcttcaacggtggccacatcaacccccagcttgataagctctgcacaccatatcggcgacagcgacagcgcaccatgttgcctgaagatatgggtatcctctgccatggcgaccaaggcgagcgcacggtggcagaactcttgttttccaagccctatgagattgagctatgcctgctgcacaatccacctcctgcaggatcttcaatggaatggaaggttaagaaggtgcagatccctcctgacacgaagataagcacctactcgtggatgactgacgccgtcttccccattggtacatgcttgtgctgggtcgacaactaccagggcatgctggccattgatgtcctcactgacagcaacagcaacccagatcatcagcaatgcctccgttgcatccctctgcctaaaaaagctttgaagtctcagcgcctgtacaaggatgcaggcgaacctgatccgttgcgctctgtttgtgtcactgacactggcatcattaagctcgtctgtattcttaccgaatgtcctactttcaccataaaagcatggactttggatgacatccatgaaggcagatggacaatggatctcagcaacaccatgggagcagaggagttcttccgtcttcttgggactggccacagttgccttccacaggtacagccaagttttcctttggttagcttggttgatccagatgttatctgcttc

SEQ ID NO: 10122 - DNA, 613 bp, Sorghum bicolor
  unsure (1)..(613): unsure at all n locations
  Clone ID: SORBI-28MAY03-CLUS582_1
gcgtccgcggncgcgtgggcggccgcgtggggggagcaggggagttcttctgtcttcttggcactggccatagttgccttccacaggtacagccaagttttcctttggttagcttggttgatccagatgttatctgtttcctgcttgaggacgaggaccgtggccttttctggatgattgatgtcaacatgaagaacaagaagctgctgtcaagcgccctctatatcagtgaagaggaagaagaagatggatacccccctaaaagaggccgcaggaacaatttctttggtcattgcttcatccgcagcaagttctcctcttacttgagtgagaatgccatcacaagccgggacctaagtgaaaaggtgcagaagacaaaagaggatagagtgatgcagcagaagagtcgactggaagcccaattggagtgatttactagatgcatcggcagtgcagtgtgttggagcgatgggcatcctccgccatggagacaatggcgcggcgttgtcgaggtggggcaactcatgttttctgagatgatgagtttgagctctgcctactgcaccatctatctcgtgtctggcatttcaaccaaatggagtaaggaaagtgc

SEQ ID NO: 10123 - DNA, 914 bp, Sorghum bicolor
  Clone ID: SORBI-28MAY03-CLUS5856_1
gcacgaggccccaaagccgagccagcgagcgaaccaccccgcccgcagccgcaagcacgcgggcaggagccgccgcctcctcggcctctcggcggcgtgtgaccggctgaccgaccgttccgtccagcccaccatggaggcgccgccgggaccggagcccatggagctcgacgcgccccctcccgccgccgccgaggccgcggcggcggttccccccgccgggagcgacaagaagaaggaaggggaagggggagacgctgttacgggtcatatcatctccaccaccatcggtgggaagaacggcgaaccgaagcggaccatcagttacatggcagagcgtgtcgtgggtacaggctcatttgggatcgtcttccaggctaagtgtttggagaccggagagaccttcgccatcaagaaggtgctgcaagatcggcgatacaagaaccgggagctgcaacttatgcgtgccatggagcaccccaacgtcatctgcctgaagcactgcttcttctcgacaacaagcagggatgaactgtttttaaacctggtcatggaatttgtcccagagaccctataccgagtcctgaagcactacagcaacgcgaaccagaggatgcctcttatctatgttaagctgtacatgtatcagctttttagaggcctagcttatattcataatgtaccaggtgtctgccatagggatgtaaagccccaaaatgttttggttgatcctctcacccaccaggtcaagctctgtgactttggtagcgcaaaagtcctggttcctggtgaaccgaacatatcttatatatgttctcgttattatcgtgccccggagctcatatttggcacaacggagtatactactttaatagacatatggtcagctggtagtgtactatctgatgctcttt

SEQ ID NO: 10124 - DNA, 1409 bp, Sorghum bicolor
  Clone ID: SORBI-28MAY03-CLUS5853_1
atgagcctacgcctggaaattactacttcgaagagaggtacgatttggtcaggttcataaagacggtccagaaggccgggctgtttgtacatctccgcatcggtccctacatttgcggcgagtggaacttcggtggcttcccagtttggttgaagtatgtaccaggcatcagcttcaggacagacaacgaacctttcaagacggcaatgcagggtttcactgagaaaattgtgggaatgatgaagagcgaaaaactctttgcatcccaaggtggccctattatcctctctcagattgagaatgagtatgggccagaaggcaaggagcttggtgccgcaggtcaggcatatatcaactgggcagcaaagatggccatcggattgggcactggtgtgccgtgggtgatgtgcaaagaggaggatgcacctgatccagtgatcaatgcatgtaatggtttctactgtgatgcattttctccaaacaaaccatacaagcccacaatgtggactgaagcttggagtggctggttcacagaatttggtgggaccatccgccaacgaccagttgaagatctcgcatttgctgttgctcgctgggtacaaaagggtggttcttttatcaattactacatgtatcatggaggaacaaatttcgggcgcactgctgggggtcccttcatcacaacaagctatgattatgatgctccaattgatgaatatggacttgttagagaaccaaagcacagtcatcttaaagaactccacagagctgttaagttatgtgagcaggctttggtttctgttgacccagcaattactacccttggaaccatgcaagaggcccatgtcttccgatctccatctggttgtgcagctttccttgcaaactacaattctaactcctatgcgaaagttgtgttcaacaatgagcaatacagcctcccaccttggtcaattagcatccttcctgattgcaagaatgtagtttttaacagtgccacagttggtgttcagacatctcaaatgcaaatgtggggagatggagcctcatcaatgatgtgggagaggtatgatgaggaggttgattctctggctgctgctccattgctcaccacaactggtttgcttgagcagcttaacgtcacgagagacagcagtgattatctgtggtacataaccagtgttgacatcagcccatctgaaaactttctacaaggtggtggcaagcctctgtctctcagtgtgctgtctgctggtcacgccttgcatgtctttgtcaacggagagcttcaaggttctgcttatggtaccagggaagatcgaagaattaaatataatggtaacgctaaccttcgagctggtactaacaaaatcgcactgctgagtgttgcttgtggattgccgaatgtt

SEQ ID NO: 10125 - DNA, 1205 bp, Sorghum bicolor
  unsure (1)..(1205): unsure at all n locations
  Clone ID: SORBI-28MAY03-CLUS5897_1
cacccgcgtgcnnacaactactcgtcctcacccccaccctagtcgccgcggacgcctgggtctagatctgagccttccgtgaccagatgatggccgacgacccgccgcggcgtccgccgtcggcgctagccaggaagagcgcgccggcgcagccgtggtcgcacgtcgagaccatgcacctcatcgacgcgtacgaggagcgctggacggcgctgcgccgcggccagctcaaggcgcaccaatggggagaggtgcggccgaggtcgtcgcccgctgcgccgccacaccggggtcgtcgcccagcgcacgacgggcacccagtgccgccacaagctcgagaagctccgcaagcgttaccgcaacgagggcgcccgccccgtcacctcgctctggccctacttccgccgcatggatcgcctcgaacggggccccctcgccgcctacccggccgcggctggctccccgcctgcccccggcggcgacgaagaggatgaggaggaggaagaggaggaggaagaagaggaagacgcgcaggaggaagaagaggaagaggaagagctcgtcccccgcaacaaccacacccggagcatcaacggcatcatccgggaattcggcaccggcctggccccgcgacacccgcagctgcagctccacgcgccgccgtcttccatcacgccgtccaccgcgcccccgcgcaagagggtggcctacgaggcgttccaggccaaggccgccgcggcggccaaggccaaggacgacgacgacgaggccgtggagatggcctacggcggcggctcctctgggcgtggggccggcgcgcagctgtcggctgtgctgagggatttcggcgagggcgtgatgcggctggagcggcggcgcatggaggtgcagtgggagatcgagcgcgggtggcaggaggcggacgcccgccacgccaggatgctgcaggacgcgcagcgccagctccgcgacaccgtcgctgccgcctgcgccttgccgccgaagaaggccaggagggaccatggagactcgtagcaatagcaattgacaccgtcgtcggttagtgatgctgatgctaaaatgctagtagcaggggaaggcatcccatcccatcccaattggatgtttccttccacttctgctctgttagcagggagggaaggatgtacttcttttaactatgtttatttatgttaattctgcgt

SEQ ID NO: 10126 - DNA, 1133 bp, Sorghum bicolor
  Clone ID: SORBI-28MAY03-CLUS58990_1
gcacgaggctttttaagaaagaaactgcaccggatcaaagttggtttcttcctccacagcccatttccctcgtctgagatctataggacactgccagtgcgggatgaaattctaaaatcacttcttaatgctgacctcattggctttcaaacttttgactatgcccgccacttcctttcatgttgcagcaggctgttaggccttaattatgagtcaaaacgtggccacatgcgcgtggagtacttcggccgaacagtgagcctcaagattcttgctgcaggtgtacatgttggtcggcttgagtccatgttgaagttgcctgctacaattaacaaggttcaagaaattgagagtagatatagtggcaagttggtaatcttaggtgtagatgacatggacatctttaaaggtatcagtctaaaattgcttggcttggagcttcttctggaaagaacacctaagcttcgagggaaggttgtccttgtacagattgttaatcctgcaagaagcattggaaaagacgttgaggaagcaaaatatgaagctgtatccgtagctcaaaggataaatgataaatatggttctgcgaattacaagcctgttgtcctcattgactattcaatacctttctatgaaaagattgcattttatgctgcatctgactgttgtatcgtaaatgctgtgagggatggcatgaatttgataccctatgagtacactgtatgcaggcagggaaatgaggacattgataagctcagaggtgttaataagagctcatctcacacaagcacacttattgtgtctgaatttgtgggttgctctccatctcttagtggagctttcagggtaaatccttggagtatggaagatgtggctgatgcattatacaatgcaacagatctaacacaatatgagaagaatctgcgccatgaaaagcactatcgctatgtcaggtctcatgatgttgcttactgggcacacagctttgaccaggatctggagagagcatgcagagagcaatatagccaaagatgttggacaactgggtttggtttaaattttagaattattgctctttcacctggattcagaagactgtctctagaacacctaacctcatcttataagaaggc

SEQ ID NO: 10127 - DNA, 510 bp, Sorghum bicolor
  Clone ID: SORBI-28MAY03-CLUS57093_1
gcacgaggccgcgtcgagggcgtctaccccgtcaggcccccgctccccgccgccatcggaggctacgagggcgtcggccaggtccacgccgtcggccccgccgtcaccgccccgctctcccccggcgactgggtcataccgtccccgccatcgttcgggacctggcagacgtacattgtcaaggatgagaacgtctggcacaaggtccgcagcgatgtacccatggagtatgctgccaccatcaccgtcaacccctcgaccgcgtttaggatgctccaagactttgtaaaactcaatcctggtgattccattgtccagaatggtgctaccagcatcgttggccagtgtgttattcagcttgctaaagtacatggaatccacactatcaacattataagggacaggcctgggtcagaggaagcaaaaaacaaactcaaacaacttggtgcagatgaggtgttcacagaatctcagctagacatgaagaaatgtcagagcttgctgggtgcc

SEQ ID NO: 10128 - DNA, 1335 bp, Sorghum bicolor
  Clone ID: SORBI-28MAY03-CLUS57001_1
actgcgagcacaggaactccctctctctgcctcatccatcgccctcctctgctcttcattttgcccaggtgcagcagctcactctgcccaaatccaccaccgcgatgggtggggaatctcgccggctgaaggttgggtggtggcggcgtgctccactgtggtgcgggctcggcaaccatgccccccgggcaagccaagaaggccggagcatgctgatgtgcggggatttggactccagcaacaaccctcctcaacttgacactcagttcttctcccttctccctcacatcttcctgttctttttttaacctatttgcaactccgtaactcaaagatatatacctgagtgctctagatgtacaggtccttgtgttagtgttttagtcaaagctcaagttttttttatgtgcagctttctactaaagaaggaatgctagtgcttgttctgataatagttagcatatatctcttggcccaaaatattattgagcacctaattattgtgctgctctagaatagatttgaggtccttcccgtgagatgtgctttgtgttttcagtaaaggggaaaagaaatattctaaggcatgcctgtgaacctcaccttaatcttgatgatgtttaactccaatcttaggcttgtttccctcagacactcactccttctcttgccggtcttggttgcttcaaaagtgcgtccagagttgcttgcaagcacttggggttgtctggtgatttccctctcccggtcaacctccttcctccgcaagtcctcatccggtcaccccatgtcgacctccatggtgattaagtcaccctcttgtgctggtggaagagttggtgtttttttttccagcaaggagtggacgaggtgtgttcctggagacctcaactttgagtgaagagccgggaactgagtggctgctactttgatggaggcaagacccctttcatctataatactgagctcttcttctactactaccctctgcctgcactcccaaatattttaatcctagtcatggcctagtcaaagaaattcactgtatattgtccagctgttgctactagagtggattatctcgttctagaagggcatggcaactcttgtagctacagtgagatgtactgctatgtagtggctccagtgttttgtactactactctctatccttcgttggagatatttaccatagctcaaactagtgcaagagtggacacaaagatatgtactagtatgtgccgcaaggtgtacagaatgatatatgttcctgtgtaaaatttttatgaagttacaatggtctaaacatatccaaatattaatataaaattatgt

SEQ ID NO: 10129 - DNA, 1257 bp, Sorghum bicolor
  Clone ID: SORBI-28MAY03-CLUS57096_1
cccccagctgcatctccggagtcggtcttctcccagttcccgtcccggcgctggtcagggggcctgggcgctcggccccgcgcgcgcggccgccgttcgcgcctggggccctctcgcaatacccgagccgccgggggtcggggcgcccgggcgcgcggccgccgcgcgggccggtccccaggcccgcggaggcggcggccccgggcgctgccccgccccccgtggtcgcgcaggtgctgccaccgcccggggtcgccagccgccaggtggttggcccggcggcgggcatcggggagctcgcggccgcgcacgcgctccctatcatgccctcgactgctgtcgggtggcggcgccccggccccatcgtcctgctcggcagcccctgccgcgtcgtcggcaaagccggcgtgaccttgcaaatcttggtcgctggggcccgcccaacttttttgcggctcctgcctcgcacgcccgcagattataggcctgatatcattcatcaggctctactagcaatatttgatagccctctaactaaggctgcccgcttactggcgctggatggttgcacgcaaaagggagtattgtttgaaatcaaacctcatgtccgcatgccaagaacatttaaacgtttctgtggtttaatgtcacaattgttacaaaaactgagcattacggcagttgggaagcgtgagaagcttcttaatgttgttaaaaatcctgttacccgctatctacctgttggtgcacgtaagattggcctttcatttagtgctgagaagtcagtcaacttgtttgactatgttgccaaatccagtgacgatgaaccccttgtgtttgtggttggtgccatggcccatggaaagatcgacaaggaatacacagatgactacatacaaatttgcaactaccctctcagtgccgcctgctgtttaaatcggatatgcagtgctctggagcagaagtggaacatccaatgagaggaacttttgacacaagcatgggaatcttgttttgttatatacaattagctagtagcattccctgattcttcatcttacatctaccgccttctgtttatgtacaactcctagctttggctttgttcgagagttaagagtcaaatgtttcagtgtagcattatgactgttttagacatcaacgccggtgcttatgattcatggcctttaaacgggtctgttcatcaagtcattctagctaaaaaccgagtgtttgcgtgaagagaccgaacttggc

SEQ ID NO: 10130 - DNA, 577 bp, Sorghum bicolor
  unsure (1)..(577): unsure at all n locations
  Clone ID: SORBI-28MAY03-CLUS57218_1
gcacgagggcaagaagggctaactagtgtggcaagcactttggagagcaactcgccctatcttgcctgttttaagttctgcgtgaagcacctggtgtagtgatgccggtggtatggagtccgctggcgttggtgggggcgctgctcaccttgtcgaacaatgtgatgcaactcgctgaatcagctaaggcgaagcgctacaggaagaactgccacctcctccaggaccgcgtgcggctgatcgccaaccacctgcgggagctgcagcagggcacgtcggagtcggacccctctccggcgacgcaagacacgatgaagtgcctggaggacgtgctccgccgcgcgcaggagctcgtccagtcctgccagcgcaagaagagggcgttcgacttcctgagggcacacaagaagacgggcgagttcgccttcgttggcaagcgcatctccaacatcatggagagcttccacatggcgaaccggagcctcatccagggcctctacagcgaccgcatcttcatggtgctgctaaagacgctgctccaagatcacgatggcatccgcgtgctacagaacaacan

SEQ ID NO: 10131 - DNA, 1112 bp, Sorghum bicolor
  Clone ID: SORBI-28MAY03-CLUS57283_1
gcacgagggctgcttctgctccttccctgccgacgtgaagccgaggccgtttgatcgcagcgacgtctaccagcagatgcaggtgcagcagcatcgcgaaggcttcaggacagcggcggtggccgtcgacgggatcccgccagactaccttttgaacaagggctggacggtggtcgccatggcgaaacccaagtaccatgagctcgccgacgacgcgcgaggcgtggactctggtctccgagaccggatgcctgacctcgacagcctcggcggcgaccctcctcctccttccgctgtcgtcgtcgtcggcagatggtatgtcccgttcctgttcgtcaaggtcgacggggaccgccggctcagggaccaggtccggaagagcatgttctacaagatgaccatggagcagagctgggagcagatatacagccgggagaacactgccgaccttcatggtgcaagggcggcagagatcgcggtgactgctactgtgcgccgcttcacggcactgctgggcggcggcaccaccgtggtacaagcaggcgagccgcaggcgaatgacgatggggcgatgtggttccgaccggcggcggcgagaaccaccggtggaggtgtggcgcttgacatggtgctgtgggagaggatgaggtgggaggtggagaggggaggccgccggtgggttgcggccacaggaaatggcggcaacgaggagaggatccagcggaccgagaggcgcgacgacgacagcagcattggccactggaccaagtttggatgctatttgctggtggagagatttgtgctcaggaggatggacggcaccgtggcactcacctgtgagttcaggcacacagacaagattagagcaaggtgggtatgagtatgaccaaatatgtgaagatgactactcaagctatatatgtgtgttcgtcaaaattggagtcaaattctgtgcctatatatatggactatgtacctcgtttcagtttcatcagttgtggttattaaggagtccgtatatatttcttattgttgtgctttgctttcggctagctagttgggtacttttggtttagcttgtgccatgttcaggtgttgttaattagtggctg

SEQ ID NO: 10132 - DNA, 651 bp, Sorghum bicolor
  Clone ID: SORBI-28MAY03-CLUS5754_1
tctcccatctcccatcccccgtgttctccctcttccgcctcccctccgatctcctccgccgcatccacctcccccgaaccctagacccactcgcgcgcgcccattggcctccggtcgccatgtccgccgctcatcttctccgtcactcccgcaagctgcggagtttgcaaaatgctgtgggttgtgagaattttagtcttgttcggcatttctccagcggttccggatccgttatcgccaaggaaaatggtgttggaaaaagaaccagaggtaccagattttcccagcataaccagcctgcaaaagagctcgagacattctcactaggagtaaatggaagctgcacttggagaagagcatccaacagccttaccccaagtgctgctagcaggctcaatggttcattctcatgtggacaggtagtttcagctcgtccattctcaagtagtgcagacctgcctccacatcaagaaattggcatgccgtctctttcgcctacaatgactgagggaaacattgccaagtggcttaagaaggaaggagacaaggtctcccctggtgaggttctctgtgaggtggaaactgataaagccactgtggagatggagtgcatggaagagggctatcttgctaagattgttcaaggagatg

SEQ ID NO: 10133 - DNA, 859 bp, Sorghum bicolor
  Clone ID: SORBI-28MAY03-CLUS5940_1
aatttcttaaggttatttttatttctggtccaaaagtgtccatattgacaattaaattgagggaagatacgttctaattgtatgcagacttgatgtttgatgactattagtgtaatctatttacagtgtatactgacaaacaatatttgttccatgtttgactccaatctcattgtctccttatgtttggcaggacaaaaactgaaccacctatttactacatgccaactaaaccaattattgatgatccggccattgttgagcagaacaaggaagtggcattcgaagaatggaagtctatgcgcagggctgagctgactcagttccaaaagcaagtggaggagcaatatctttcaaatgtggagaggcagttggagaagatccagaatgcccggaatgctcggaaggcgaatgggcctgctaacatgcaagaaatggacaaggagctggacacacacagggcggagcatggtccaaagactcggcgagttcctgaggagggtggcaatgacgatgacgaagatgcagaggacatggctgcggaagatgagctgatggatgaagttctgggcatcaacgatggaatcaatgaggacccatccaagccgtccgaagaagccactactgaaggcggtgggcctgcacccgaggaagcacaatagcattctttttcacacaagctaggcacacataggcgtaccattccgtatgcttagttgccgtcttgttgggaactgcttgtacgtgtatttttgttagacgttccccactggttaggctgtgttttaatattgctgttttggctttttgatgttgagatcgtactactttcgattattatattatcttataattgtgt

SEQ ID NO: 10134 - DNA, 1155 bp, Sorghum bicolor
  Clone ID: SORBI-28MAY03-CLUS59492_1
gcacgagggcttccagggggagcaaggggaggaaggcagaatcaggctctctgcgtgctgcaagcactatacagcgtatgacatggagaaatgggaaggattctcgaggtacaccttcaatgccaaggtaaatgcacaagatttggaagacacgtaccagccgcctttcaagacctgcatccaggaggctcgtgctagctgcttgatgtgtgcatataaccaggtcaatggcgtgcctatgtgtgctaaccaagatcttctacagaagaccagggatgaatggggcttccaggggtatattacatctgattgtgatgctgtggcaattattcatgaaaaccagacatacactaaatcagatgaagattcgatagcaattgttcttaaggcaggaatggatatcaactgtggttctttcctagttcggcatactaagtcagcagttgagaagggaaaggttcaagaacaagatatcgaccgtgccctttttaatctattctctgttcaattgcgtcttggaatatttgataagcccaacaacaaccaatggtccactcaactagggcccaacaatgtgtgcacgaaagagcatagagagcttgcagcagaagctgtaaggcagggtgctgtccttctgaagaatgaccatagttttttgcctctgaagagaagcgaagttagacatgttgccatcattggaccatctgcaaatgatgtgtatgcgatgggtggagactatacaggtgtagcctgcaacccgacgaccttccttaagggcattcaagcctatgctacacaaacaacctttgccgctggatgcaaggatgtttcctgtaactcaacagaattgtttggcgaagctattgctgcagctaaaagagccgatattgttgttgtagttgctggcttgaacctgacagaagagcgtgaagacttcgatagagtgagccttctccttccaggcaagcagatgagcctcatacatgccgttgctagtgtagcgaagaagccccttgtgttggttctcttaggtggtggtcctgttgatgtttcatttgctaagcaagatccacgaattgcaagcattctttggctcggatatcctggtgaggttggtggacaggtccttccgggaattctttttggagagtacaa

SEQ ID NO: 10135 - DNA, 875 bp, Sorghum bicolor
  Clone ID: SORBI-28MAY03-CLUS5956_1
aaaaaaaaaaaaaaaaaaaaaaaaaaaaaaaaaaaaaaaaaaaaaaacacgagagagaacggctggaagaaccgagagcgctccagagatgtcggcggacgacctgcgatcggagctggacgagctgcggcggctggagggcctcgccaagcacccccgcgtccagaccctcctcgccaacgagatccgcaacgttgaggcaaagttggcgaaggcaaccgaaccgtcgccggagccactggcggcggcttccgcgcccgcgcccgcgcccgcccccgcggcgcgtcctgttttaaactacgtcacgttggggtcgttcagctgggaccaggacaacgagaagatcaagatatatgtctcccttgagggagttgagcaagagaaggtggagactactttcaagccaacatcagtagatgtaaagtttcatgatgtcaaaggcaagaattatcggtgtgctataccaaagctcaacaaggaaattgttcctgagaaatgtaaggttgtggtgaagccaacaaaggttattattacccttttcaaggcttctaaaggcaactggttagacttgcacttcaaggaagacaagttcaagccaagcatggacaaggaaaggatccgatgtcaggaattatggacttaatgaagaacatgtatgaggaaggtgacgaggatatgaaacgcacaatagccaaagcttggtctgatgccaggtctgggaagacgactgattcactgagcggattacgttgagctggtatagtcggttgatggacttctgtttctgatagttcaaacagcgctacagtgtcttgttcgtgttagtgcttgtttatcttatatttggagtgaagttggacgtgccaggcttagga

SEQ ID NO: 10136 - DNA, 1252 bp, Sorghum bicolor
  Clone ID: SORBI-28MAY03-CLUS59595_1
tagaaaaggttgtcaaggatctacgtagaaatgaatctgaagaggattttcgctgtagccaaactgctccagtccgtgcaattaagcacagtacagttctgaagcaagctgcagaatcatatacacataggatctacaaattatttgaagcagaatttctggatgggtgtggagcaacttcttgccacgaaacttcgagtggtggaaatttattgaggtttggaattacaatgcagggaaggggttcaaaagtatgggatgttgttcttgacacttccactatggagatcagttgtggttgtagaaagtttgaaaggatgggtcttctttgttcgcatgccctcaaagtcttcaccctgcagaatgtggacacaattccagaaaagtatgttttgaaacgctggacaaaagatgccaggagaagcatgtatacacttgctcaggatgattcaacccaacaggaatgcacagaggctgaacttgcatatcgcaatcgggcaatgcagtatgcatataacctaattataaagagccaggaattggaagaatcaagaaaaatattctgggattccctcgaggctggagagaaggcactggaagtattctttgaaatgagaaacatgcgcactcaagcagcaaaggatgctaataagaatgagaaaaagaagaagaaaacatcaaaaggaccaaacccaaaaaaagcaaaacaagccccaggagtttcctcaactgagcacgaggtgatagtccaaactaatgagcatcaatttcaatcttcacaagatgctcagggtaatgcaaccattggaagaccatattactatcaggttccgcagacttttccaaatgcccctatccaaccaaaccagatgtacatgcatccaaatatgcacacagtgcccctttgcacaccgcaggatctgtctgcatttgcaatacgccccaattcaacttttggtggtgccaagaacatctgaacttctgaaggatattaaggtccaggttcctctggatgtcattggaaaaccttattcagggattgtgagttgtgactatcaactccgcttttgagctctgtcgacctatttatgtaggcctggcggcacttcttcatgtttggttggttcaggggttctttcttctgatcttagggaagcagctattctggctgttgcagtgcagccccttatccagatagcagtggcttgctattaatatcactcaggcaattttaggtttgtaaactgtaagg

SEQ ID NO: 10137 - DNA, 702 bp, Sorghum bicolor
  Clone ID: SORBI-28MAY03-CLUS5977_1
gctgcggatgcgcgcgcgtcggatgcgcctcgctgccgtcgccaggacgaccaggatggcagccgaggagatgaggcgggcctcggcctccgcggcggtcgcggccacggcggaggcggcgccggcgccggcgcaagcggggtccaggtgggcgcgggtgtggccgagcgcgctccggtggatccccacctccacggatcgcatcatcgccgcggagaagcggctcctctcgatagtcaaaactgggtatgtccaggaacaagtcaacattggctcagctccacctgggtcaaaagtaagatggtttaggtcagcgagtgatgaaccaaggttcattaatactgtaacatttgatggcaaggagaacgcccccaccctggttatggtccatggctatggagcttcacaggggttcttctttcgaaactttgacgcccttgcaagtcgttttagggtgattgccattgatcagcttggctggggtggttcaagcagacctgacttcacatgtaaaagtaccgaagaaactgaggcatggttcatagattcttttgaggagtggcgcaaggccaagaacctcagtaattttatattgcttggtcactcctttggaggatatgttgcggcaaggtaggccctcattgaccctcttcacaggcagcacttaagctggcctgacttcacatgtaaaagttcagaaac

SEQ ID NO: 10138 - DNA, 914 bp, Sorghum bicolor
  Clone ID: SORBI-28MAY03-CLUS5781_1
acagttatcagcacagaacacagtaatactcttcgaagccttgcacactgttgccgcacattgcctacaaataaaccgtggtagtggtctgcgttcccaggttgcaggagttgggctcgatgacgcaaatgcaggacccgccattgttgcgccttgagaacgagtcataccagctgtgcctcagtatccttcagaacatatttctggacatctctcctgatcatggaagcacagaggtggtggagagtcaccttattggcttgtgcaaggaggtccttgaggtatacttgagcacagcaaaaccttctcagctttccagtggcacacagccgctaggccattggcttatccctgttggttcatcgaagcgaagggaacttgcggcaagagcacctcttgttgtatcaaccctgcaagctattagcggactaggtgactcagctttcgagaagaaccttggccagttcttccccctcctctctgggctcataagctgcgagcatggctctagtgaagtacaggtggccctgagtgatatgttcagcacttgggttggcccactcgtgctccagtcctgctgatgctgagcatcatgttatacatagtagtagtatacatcaccgtgtaagtttttctttgcttaagtggaatcccattgtgttcctcctttcccccattttgttctgttattaatcatttagttgctgggggagttcatattattgtgccgaactgatcttgcagatcattttttccttgacattcttttcttgttcgtgtcgggaggagtgtatgttactatagagaactgaattatgtacggtagtttagttaaaattgtgcccattctgttcctaatgtactgatttctagagtttttgcaggcatgttttacatgctttgtcgaaagtagc

SEQ ID NO: 10139 - DNA, 757 bp, Sorghum bicolor
  Clone ID: SORBI-28MAY03-CLUS57897_1
gcacgaggatctcattcccccttctccagttccccttcaggccctcactgagtcacgactccagatctcgcaccgctcgccatggaactcctcgacgcgaggcaccgccacacgccggattcggcacgaggcccggacgccgcctccgacatggggctcccgctcgccggtgccgcctaccagccctacgtctccgagctcctctccttctccatcgagcgcctccacaaggagccggagcttctgagggtcgacgcggagcgggtgcggcggcagatgcaggaggtggcggtggagaactacggcgccttcatcgccgcctccgaggcgctctccttcgttcgcgcgcagctcgagagcttcgacggccacctcgaggccatgatagaggagataccaaacttgacatctggctgcactgagtttgttgagtccgcacagcaaattttggaggagaggaagcttaatcaaacattactagcaaaccatactacattgcttgacttgcttgaaatcccacaactgatggacacgtgtatacggaatgggaactatgatgaagcacttgatctagaagcttttgttagcaaaatctcgaagttgcaccccgatttacctgttgtccaaggattagctgctgaagtcaagaagacagtacaatcattaatttcacagcttctccagaaacttcgatcaaatattcagttacctgaatgcctccgtattgtagcacatctgcgtcgaattggagttttca

SEQ ID NO: 10140 - DNA, 1513 bp, Sorghum bicolor
  Clone ID: SORBI-28MAY03-CLUS58_1
atcgccttgcctaacggataaccaacccccctcaaacggttaaaggcacgaggctaatcgccgccgcagcctcggcggtcgcgccgcccccaccccggcgagtggtggctcccctccgctccctcagcactcgtagacccggaatcctagccctaactgtcacctgctgctccccctcccctccgccccctgtcgtcgctgcggaggcgcctgcgcctgcgccgccacaggaagcgaagccgaagccgaagccgcggcggtacccgaagcagtaccccggcgagtcggtgggcgtcgccgaggagatgcgcttcgtcgccatgcgcctgcgcaaccccaagcgcaccaccataaaggacaaggcggggacggagaacgcggacgcgggggcgtcagaggacgaggacgaggaggaggaggaggaggagcaggaggaggaggacggcggcggcggcgtgaaggaggagcacgagaaggaggaggagggcgagctagaggcaggggagtggatgcccagcatggaggggttcgtccgctacctggtggacagcaagctcgtcttcggaaccattgagcgggtcgtcgccgagtccaccgacgtcgcctatgtttacttcaggaaaagtggtttggagcgttcagctagcatttcaaaagatttggagtggttcagaaaacaagggatcgcaatcccagagccaagtacttcaggatcaacttatgcagcttatctgactgaactggctgaaagcaacgctcctgcattcctctcccattattacaatatctattttgcacatataactggaggtgtggcaataggcaataagatctgcaagaaaattctggaaggaagggagctggagttctacaagtgggatactgatgctgaacttctattaaaagatgccagggagaagctgaatgagctcagcaagcactggactcggaaggacaggaacttgtgcttgaaagaagctgcaaaatgcttccagtacttgggaaagatggtccggttaatcatcttatgatctgttatgattgttggataaaccccagtctaatctcactgcatgcattatcggatatattttagaggacagaaaagctagagagacactactatcgctgcaggcgtagtgcagttactttatgatggatgtcgaaatggcaggccacaatggcttctttttccgcgtgcatattagagctgctggtttgatgcatgagtcagcccttgcttgcggcacctttgcttgctgttgtgaggatagcctgatgagcaagctgctggatcatgccatccacgcagtgatgaggtcatgagcaatgggctagcatgcaggttagttctgggagaccataaaaatttcgtctctggtccccgaatatttcacctgcattgctgcgaacaacgatgtatcagtctcgaatatatagctgtaaactagtatatctgagttttcttttaaaaaaaaaaaaaaaaaagttgaattgttgatgctatattgcg

SEQ ID NO: 10141 - DNA, 841 bp, Sorghum bicolor
  Clone ID: SORBI-28MAY03-CLUS58244_1
ctattgcccccggccgccctccgccgcgcttggccttctcccttctcgagaggccacgctccatccccgcccgcgctccgcctcccctggcgaccggcggcgagcgcagcccaacgaaggcgtcgtagtcatccgacgctcggctggttggggaacaaggcgccaatggggatcgcggaggtggctctccacaccatgccgggggcacgcgccacccactccccggcatccattctgtccctcagggcagtcgctaggaggaggaacaagaacactgattcggtgcccaacaccagggcactgcaaggcctcctaaggattccgaggctgaggtccgtcaggcggctgtgccagcggatagacgacattgcgagggtcacagaggggaatgggacttgggtcaaggaagccatgaataacgccggccaggttcttggcgacatcagcgtgcctggtcaggctgtaggtggcaatggtagcctaaatgggagtgttgccaagcctccacctcagaggcggaagtcctcatcggttgaggatgaggcctgggaacttctgcaggagtcaatggtttactattgtggtagtcctgttgggacaattgctgccaacgatccaaatgacagtgatccggtgaactatgatcaggtgtttattcgggacttcataccatctggcattgcttttctactgaagggggaatatgaaattgtgcgtaatttcattctacacacccttcagcttcagagctgggagaagacaatggactgccatagtccaggtcaaggtttaatgcccgccagcttcaaagtgcggacaattccgcttgatggtgatgagg

SEQ ID NO: 10142 - DNA, 1167 bp, Sorghum bicolor
  Clone ID: SORBI-28MAY03-CLUS58442_1
gcacgaggggcaagggaccttgagactggaaagatcgttgccttgaagaaggttcgatttgacaattttgagccagagagtgttagattcatggcaagggagatacagatattaagaagacttgatcatctaaatgtcatgaaactggaaggcttgattacttcccggttgtcatgcagcctttatctagtatttgaatacatggagcatgatcttgctggactttgctcctccccggacatcaagttcactgaagcacagctcaagtgctacatgaaccaattactgtcaggactggagcattgccattcgcgccgtgtggttcatcgtgatatcaagggtgctaatctcctcgtgaataatgaaggggttctaaagatagctgattttggtcttgcaaatttctttgatccaagcaaaaaccatcctttgaccagccgtgttgttactctgtggtaccgaccacctgaactgctactaggttcaactcactatgatgcagctgttgatttgtggagtgtcgggtgtgtatttgccgagatgtatcgtgggaaacctatcctgcagggaagaaccgaggtggaacaactacacaagatttttaagctatgtgggcccccggctgatgattattggaagaagtcgaagttgcctcatgcaacaatatttaaaccgcaccatccatatcctagtaccctaggagaagtttttaaagttgtaccagaaaatgcattgagtttactagaaactcttctgtcagtggagccctacaagcgtggtactgcatcaggtgctctttcttctgagtttttcaggacaaaaccttatgcgtgtgaaccttcgagcttgcctaagtatgcacccaacaaggagatggatgcaaagttacgagaggatgcactcagaagaaaagctagtagcagagggcacgggacagaagcatccaagaagtcttcaaggctcagcagagcagcaagagaacctattgcagtccctaagcagataataagtagcacagaggaatccaaaactaatgtgaatgcaaccaaagatggtacaatacaggatcgtaccaaactaaatggtgatgctaggctatttgcggacatacaaccagtctcagcggctcaagttaaagagagtgctcgtcatgttaagaatgaatca

SEQ ID NO: 10143 - DNA, 749 bp, Sorghum bicolor
  Clone ID: SORBI-28MAY03-CLUS5823_1
gcacgaggctgtttcaataataataaaaggattctcgattcgatctcctccccaatttttccggtgagcggcggcgatcggcttcggatcggcgcagcggagatggttgccgtggcggcggaggtcccgatccgcggtgcggacgccgtgccggcggcggagagggaagcggtgagggcggcggctgcggaggcggcggcgaagggcggtgagggggaatcggggacccagcccctgcgccacctcccccgcctccttcggcgcctcctcgtgctcccgccgacggcgccccccccccccccccgcttccctccgcccccccgcccccccgtccccctccgcctccgccgcctctcgggcgacgcgcccgtgttcgtgtcgccggcgatcgactactacgcgcgccaccaccagctcccgccgccgccgctgcagcagcagcagccgatgcacgtgcttcagtttgtgggtggcgtcggcgggggtggcatgggtggcggcggggggagggactcaagcagcgatggatccgtcaatggtcagccgaatcgacggagaaggaatggtttcatccaggggaggagaaggatgatgggtggccggcctcgtcgatctgacagggaggatagtgtgcggcggacagtctatgtctctgacattgatcagcatgtaactgaacagaaacttgctgaagttttttcaacctgtggacaggtggtagattgccgtatctgtgatgatcctaactc

SEQ ID NO: 10144 - DNA, 359 bp, Sorghum bicolor
  unsure (1)..(359): unsure at all n locations
  Clone ID: LIB3476-011-P1-K1-C2
ctggcctcggccgctcaaatcccccactccgcagtccccgacgaccgacgggccacggcagagccaccagaccagcagccccagccatcgagcaatcgagctgctccatggcctcaccaacccgagcaccggcgcctccgccggcggtagagcccatcgcgccttcttctccttcttcagaacacccgccgtcaatggtcagccgaatcgacggagaaggaatggtttcatccaggggaggagaaggatgatgggtggccggcctcgtcgatctgacagggaggatagtgtgcggcggacagtctatgtctctgacattgatcagcatgtaactgaacagaaanctggctgagtttttt

SEQ ID NO: 10145 - DNA, 682 bp, Sorghum bicolor
  Clone ID: SORBI-28MAY03-CLUS56319_1
gatggcaaagtccgttttgctgaaggttcagtggtggctgcagacattattctttactgcacagggtatcgctaccatttcccgtttctcgacctggatgggctcaccgtcgacgacaaccgtgttggaccactgtacaagcacgtcttccccccaaagtatgcgccgaatctgtcctttgttgggctagcatataagaccatcgtcttccagacactggagcaggagtccaagtgggtcgcggccgtgctgtcggggcgggccacgctgccaagcgaggaggacatgatggcggccgtgagggagcactaccagctgatggaggaggccgggaggccgaagcgccacacgcacacactgtcgcctcagtgggcggagcacatgaactggctcgccggccaggtcggtgagcccccactcgagccgtggaagcgcgagatgttcgatagggtgcttgggagcatcttgacgctggacgaggcctaccgagatcgctgggaacaagaggaggacagagacagtggcacaggggcgcattagggattaggatgagaacgagctccatcgtgtaacggaaggcaatctgacgccgtcgtatcgtatcgtgattatactcatcatactttacttcgttgtgatcttcacggaaataatttgccaccacaaaacaggaataaaaaaa

SEQ ID NO: 10146 - DNA, 788 bp, Sorghum bicolor
  Clone ID: SORBI-28MAY03-CLUS60878_1
gcaccacgcgcagcacagcacaatggacgccgccgtctccctctccctctccctgcccctgcaccaccacgtccacggcgcgcacccgctccctctcccagcgccccaccaccaccaccaccacaaccactgcgccgcaaacgcgccgtcgtccaaggcccacgcccaggctcctccatcggcgcgcctgagcctcgccgtcgccgcgcgccccatctcgccgtcgtccccggcgcccgcggtcccagctcaagccccacccgccgcgcgctcctccagccgcgccgcgacggggtacgctgccgcgctggccgacgcgtgcgcccgcgccggcacgctgcgccgcgccgcgcgccacgcgcgcaagctcctcgtcctccgccctgggcggctggaagtggacgctgccgcggtcgtggagcagatggacgcgcgggtggccgcgctcgtcaggatgctcgtcgccaagggcaagaccgggatggtcgccgaggccctcgccgagttcgccgccatctgcgaccacctgctgccgcaccagccgccgcgcgcgcgccacgcctactagctaggcctgctgctttaaacaaaagttaattgaacatctgtacaatgatgaacactacgccatgcatgctttgtatcaaatacacgaccattttggcgctacagcatttgtcactctgaattatgcagaatatgcagtagcatttagcagcaaaacaggtggagcttacttattattggttggtttacttgcttggctagtggctacaacattttatccc

SEQ ID NO: 10147 - DNA, 643 bp, Sorghum bicolor
  unsure (1)..(643): unsure at all n locations
  Clone ID: SORBI-28MAY03-CLUS61351_1
caagggctntgacacgtctgttgangaggaccagatccggagtgctctcgaagaacattttcgctcatgtggagacattacccgtatttcaattccgaaggattatgacactggtgcaagcaaaggaatggcatacatggatttcaaggacccggattccttgaataaagcatatgagatgaatggaacctaccttggtgactacagcttgtatgtcgatgaggcaaagccgagacctgataacaacagggacggtggcttcagtggtgggcgtggtagcagagggaggagtgacagggggcgtggtgacagaggccgtgggcgtggatttggaggccgtggtggaaggggtgacagaggccgtggaggccgtggcacgcctttcagacagactgctggtacccctagtgcaggaaagaagacaacgtttggtgatgacgattgaagatcccatggctggcgattatagtgaaaccaactatattgtacctttcatacttctgctatctgttctccttttggaggctgtagtgttttgtttgcttgataattttgacaattgtattgccatttttaacattcggagctatgaagttatatcgtagacgtgatttatatttataatatatgagatcaagttcgt

SEQ ID NO: 10148 - DNA, 630 bp, Sorghum bicolor
  Clone ID: SORBI-28MAY03-CLUS61383_1
acaattcaacaggcaacaagcctgatctcatcgtgttgagtaccggctctgaactagagattgctgccaaggctgctgatgagttgaggaaggaggggaagactatccgtgttgtatcatttgtttcctgggaactttttgaggaacagtcagacgaatacaaggagagtgttcttcctgaggccgttactgcaagaatcagcattgaggctggttctactctcggatggcaaaagtacattggagcccagggcaaggccattggcatcgacaaattcggtgcaagtgctcctgctggaaagatctacaaggagtatggcatcactgtggagggtgttattgcggcagccaaaagcttctaagactcataactgagttttgttgtcaccgatgccaaaggaatgtcatacctggaggtcttgtgcccaaaacatgcaataattgagggagcataagatgcctgtgcttggagggtgagtgatactttaggactggaataaacaatgtattttccttgtacattggtttttattcagtgactccttagacgattcatgaagttgagtttgattaaattgggtgctgggttttttggtaacactggcaatcaacttatagtcttgctcttgc

SEQ ID NO: 10149 - DNA, 685 bp, Sorghum bicolor
  Clone ID: SORBI-28MAY03-CLUS61683_1
gcacgaggaatacttaaattaggcatgtaaaaagcacaatcactattataaagtttacatcaacgtggtaatatactccatttttgtgtggctcaactatttggtatttcatatgttaatgctccctaattacttccactctgagtttagtttgatgctaatgttcaatgttttgcattctcccaaatgggaagttcttttaagaaggccattttcgatgaaaatatctccgaaggcctcaccaactgggcagaaaatgctaggaggcgtaatagaatggcaacaacaagtgtcagtgacaattcacctattggtgagggaattcaaatgtcaaataaggcacagagagaatcagcaatggaacaaggaactgcaaggttgatctaatgtggatgtacaagctagtgcacaatgtacatatactaggtaggtaagcgcacttcgccgcacccatagtggctgctggctccaatagacatctctgtattatgaagtgctgctctacaacatgtctgccatgggcacaacattaacatatgtataacatagtgaagagtttagacaactgaattgtgcattagttaaataaatgtgttaatagtaccacatatatgtataggcttttccaagagaagagaaaacagtttgtaaacatcatggcaagagaggttcttgcttcgatttc

SEQ ID NO: 10150 - DNA, 1265 bp, Sorghum bicolor
  Clone ID: SORBI-28MAY03-CLUS5902_1
cccgctcgattagtcatgctcgcgaagcaaatccaaaggagagacgcttccccttcttccccacctcgccgatggagtcgcttgcctcgcaagcgaggccggcggcggtgctctggctcgccggcttcttccaggccgcgcgcctccaccgcgttgtctccttctgcgctagctcgagggcactatccatcaggattgcacagtgcttcctgctgaacgggcttatcttcctggggagcttgctaaccctgaaatcggtggtcattccaactctattgtggatactacctgaccaatgcaatcaaacggggggacatctttgtgagcacacggcagccatatctatctattcattcttacgctctggccttgttgagattttttatgtactttggttttatccactttatgtcttcagcttcatattaagtacgatttggtataatgacattgccaagcatgctttggatgttgtgaaaagtaaacgcctagttttgactcgagccctggatgatcacaacacaactgaaacagaagagcagcctgaaggatttgacagggttgcacttggtattggggaacaggtctattcaatccttcttttaaccattttctttgttgaggtttcagtgattggttacataccttactttggcaaggcaatgaacttcctgctcttgtcattgatgtatgcctactactgcttcgagtacaagtggaacttctttgcagtgagtctgcatgagagacttgatttctgtgagtcaaattgggcattctttgctggatttggtgctccatgcgtccttccaattttcttcttctctcctcttacaagctatggatttctggctatactttacccattgtttgtcatgactgctgcaggcactcaagctgagcaagtaattgatggactgagacctgcacatgaagggaaactacaaagaatacctgtgttctttgtggcaaagcgactgacgacaaaagtgctgcaactgtttccattggcacagaaagaacaatgaaggatccacagaaacaaatcaaggagagaaggcactggtgttgtgcttatcacaatgccctccgtccgaactcacacacgcctccataatgtggaaggaaggggggcttgccttcacgctgtaaatatcctgtaacattgccgttgtaacaagcacttctgttgaatgtgaaaatatagagaattgcactttgtacacatgaaaccacccatattgatgtgcatacaaattgcacca

SEQ ID NO: 10151 - DNA, 938 bp, Sorghum bicolor
  Clone ID: SORBI-28MAY03-CLUS59107_1
gcacgaggaacgagttatgcaagagctttcccaaattgggctcatgccagaaatgtggggtggtgacaccccaatgattcagataagtgctcttactggggacaatgttgatgaacttctagagaccgccaggcttgttgcagagttgcaagaattaaaggccaatccacatagaaatgcgaagggcactgttattgaagcatgccttgacaaggccaaagggcctcttgctaccttagttgttcagaatggaaccctaaacaaagctgatattattgtgtgtggtgaagcttatggaaagatccgtgcattgtatgatgatcgtgggaagctcgttgacaaagcaggaccatccaatgccgtgcaggttattggcctcaataatgttccccttgctggtgatgaatttgaggttgttgacaaccttgatgttgcacgtgaaagggcgaatgagcgtgctgaagcactgcggctagaaaggatatctgcaaaagctggggaaggaaaagtcacgctttcatctattgcagcatcggtttcatctgcgaagcaaactggaattgatacacatgagctaaatgttatccttaaagttgattttcagggtacaatcgaggccattaggcaagccatccaagctctaccacaagaaaatgtctctctgaggttcctccttcaagctccaggagatgtgagtgttagcgatgttgatctggctgttgcttcagaaggaattatatttggctttaatgtcagagcaccaggatcagttaaaaactatgctaagaagagaagtgttgaaattcgtctgtacaaagtgatctacgatttgattgatgatttacggaatgccatggaaggtcttcttgaacctgctgaggaggaagtaccaattggttctgcaaaagttcgagctgtttttagtagtggcagtggaa

SEQ ID NO: 10152 - DNA, 1132 bp, Sorghum bicolor
  Clone ID: SORBI-28MAY03-CLUS592_1
ggctactggagccaaccaccgtcaccggccggctttcatcccatggctgtcgtgaccagcaccgcctccctctgcccggccgctgccggcggcctctctgcttcgtcgtcgtcgccgttcacgcgcaagcccagcagcaccaggaggctgcaggcagcatccacggcctgccactgccgccctgctcgggtagtagaggggctggaccggagggacgccttgctcggcatcgtcctctccgccgcggtggcgccgctgctcgcccctgccggtgctctagcggacgagcccaccaccgagtcgcaggagggcttcactacgtacgaagatgaggccaacaagttcagcattcaagttccacagggctggctggtcggcgccggcgaggccagcggcatcaggtcggtcacggcgttctacccggagcaggcagccgccgattccaacgtcagcgtcgccatcaccgggatcgggccggacttcaccagcctcaagtccttcggcgacgtcgactccttcgccgagggccttgtgaacggcctggacaggagctggcagaggccgccggggctcgccgccgagctcatcgactccagggcggcaaacggtttgtactacctggagtacacgctgcagaaccccggcgagcggcggcggcacatcgtctcggccatcgggatggcgttcaacggctggtacaaccgcctctacacggtgacaggccagtacatcgacgacgatgacgattccgaaaagtacaggcctcagatagagaaggctgttcgatcgttcaggctgacatgaaagatgccatgtcattcagcagaggtcttgtgcctgaaaattgacaccttgccatttccatgagatgagacaagacaagacatgtatgccaattcttgagcactgtaacactgcaagtatgcgaatatattttctcctttttgaggtggatataaatatgttttttgtaactcttgtgtaacgttgctgcggtgtttttttggttgtgtatatgtaatgtttagagggtcgggctgaaggagcaactatgtgacctttattctctttttaaggcaaagttcgtgtcacttcttttcaaaacaagcaaatggtttttttcttgagctgg

SEQ ID NO: 10153 - DNA, 1491 bp, Sorghum bicolor
  Clone ID: SORBI-28MAY03-CLUS5932_1
atatttgctcatatcttaatatggcatctgcagggagaatacgttgatgaatctgagaaagatgcagaggctctgaagggcagtgctttccaatccttgcttcctgctgttaaggacaaaattatagagagtttcactccagaggctcgtgacatgtttgaaagagaatttgatttctttgacaaagtgacctctatttctggtgtccttttccctcttcccaaggacgagcggagagcgggtataagaagggaactggagaagatttcgattccaggtgatgacctctacctacctactgcaacaaacaagttagtacggggtatacagttggacagtggtattcctctccagtctgctgcaaaagttccaataatgattacttttaacgttgttgcccgtggcggggacccaaatgatgtaaaaccacaggcttgtatttttaaggttggtgatgactgtagacaagatgtgctggcgctgcaagtgattgctctgttaagggatgtatttcaagctgttggattaaacctgtatctttttccgtatggtgttttgcctactggaccaggccgaggcataattgaggtggtcccagatactcggagtagaaatcaaatgggtgaaacaactgatggtggtttattagagatatttcagcaagattatggtcctgtaggttcaccttcttttgaaactgctcgagaaatgtttatgatcagtagtgctggatatgctgttgctagcttactccttcaaccgaaggatcggcataatggcaatcttctctttgatagccatgggagattagtccacattgattttggttttattttggagatttcacctggaggtaatatgggatttgagagtgcacatttcaagctaagccacgagatgactcaattgctggatccatctggaactatgaagagtgatacatggaaccaatttctcagattgtgtgtcaaaggatacctagcagcaaggaggcatatgaatgggattttaagtacagtcaacctgatgatagacagtggccttccttgctttagcaggggagatcctatcaataatcttcggaagcggtttcatccagagatgaatgaacgtgaggccgctaacttcatgatacgaacatgtgctgatgcttacaacaagtggactaccgcagggtatgacttgattcagtacttgcagcagggtattgagaaatagtctgtttttctttttgtaaatggcgttcgtgtacatcaattgtatgtagccactatctttttatgtagaatttatttattgagttgtatcgttgggtaaggatggaattcacgtgattaacgtagggtgtttgttgcacagaggcttttttttttctcgcgccgtaagactgcctagaaaatattagctagtatagtaagtagatcaagattttgtattgctgtcgcagaagtattttcttttactaaacatgtatgattcgcatgcgattca

SEQ ID NO: 10154 - DNA, 712 bp, Sorghum bicolor
  Clone ID: SORBI-28MAY03-CLUS59327_1
cctaagtacacgagagcttgtcggaggctgtgtgtctctgtgattgataaataaaactgataagcagcagaggaggaagcgaggaggaagctgcgacttggagttggattcgtctttggttattgtccgtccctgctgctagctgctgagctgggggtgaagtggacgggacgaggaaggagaggagcctaggagaagggcgccgccgcggccatggctggacgtgcgccggcgacggcgagggacaagaccagcttcgccgccacgtgcagcctgctgagccagtatctcaaggagaagaaggacggtggcctgcagcgccttggcggcctcgccatggcgccggcagctggagcaggagcaggaggtttccggccgccgaccaccatgaacttgctgtcagcgctcgacgcgccggccgaggagcccaccagcgacgcggcaaaggccaccgtcgaggagccaaaagaccatcacaaaagcaccgccggaaatccaagggaggcagccggagacgaggcgcaacagctgaccatcttctacggtggaaaagtggtcgtcttcgacaagttcccctccaccaaggtcaaggacttgctgcaaatcatgaaccctggcggcgaccgcgtggacagggccggtgccactgccactgtcccaacgcagagcctgcctacgccttcacacaacagtctctctgatctgccgattg

SEQ ID NO: 10155 - DNA, 682 bp, Sorghum bicolor
  Clone ID: SORBI-28MAY03-CLUS62437_1
ccacaccctacatcatctgatgcatcgtattactatcctaataacatgccggcggcaccacttggacctggtttgccagtgggcatggggttcccaccggcatatggtgcccagcctgtcatgtataatactcaacctggagcatcaccgcagggttacatgcatcctgctggtccacagtatgggcaacagatgatgatgggggggcagactcgtcctgtttattattatgcgcctgagatgcaacaatacagaggaagaaacttctagatatactattttgaactgctgctagatgaaagctgcagcaatccccacaagtgggactatgaccaggcaaaaaccgctattagaatggaaagaactggtgatgacctccctgactttgtgttgctcggattgcttggacaaaaagccccaccgactttgtgttgctcggattgcctggtcaaagctcttcatttttctgtcagtgttgctccgaagcaggttgactggaatttcttattatttttgtcagactattgatgttgtaaattaaattgcgggtcatctgttcgacccagaaatgacattcataaatgtgtgagagtgccccatgtaacatttatgtgttccttaacgcttgttctgatgtaagatttgaatgaattctcagagctgaaatggattaaattgctga

SEQ ID NO: 10156 - DNA, 640 bp, Sorghum bicolor
  Clone ID: SORBI-28MAY03-CLUS62473_1
gcctgctggccgccgtctgaggtggtcggcgactgcgcgctggttccagaacgcgtacaaggaggctcgcaacggcacatcgcctacccccaggaacgagcacaaggtacatggggagttgattcagcttccatggttgtcatttcatagatatatgaatggattgatgtcgggtgcttctgttgttcctggatccaccattcttcagggcagtagcgttgcattttcatgataagagcaagtcgacacatatacttcagtatgttgctttggagctgcgatgctcttgtcattggaagacccatcagccagaacagagaggggaagcaacaaaaatggaggcagggagaaggaagaaatatgttgcagcgctgttgccctgtggtgctcgctactgatgtctaacgggccaggattgacgaaaacaaggattggaaggaatggattcgcaacgatgattccattttcctcaatgttgagatgggtatcctacaaaaattactaagtacagatgttgttgagattcattaaagtatccagttttctcacttttcttattttattttttcactttcttatttctgaagtccaatatcttttaacacacaagtaatgcatggttttatttcattattttgtg

SEQ ID NO: 10157 - DNA, 675 bp, Sorghum bicolor
  Clone ID: SORBI-28MAY03-CLUS6265_1
tactggaaaaaaactcccctggacctcaagcaagcgacccgaccacaggcgcttgctagccatggcgaccctcgccgcgctgctcctccttgtcgccgcttccaatgccgccgcgctgagcgccaaggccgtggagtaccacagcttcgtagccaccccgctctcgccccacgcgtacaccgctgctccgtccgccgacgcggacgaggatctcttcggcggcagccttgccgtcgcagacgagggcgccgcagccgcgtcggccgtgcacttccgcgtggtccaccgtgacgccttcgcggcgaacgccaccgcggccgagctgctcaggcaccgcctgcagcgggacaagcgtagggcggcgcggatctcgaaggcggcggccggcggtggcgccggcgcggcgaacggcacaaggagccgcggcggggccgtggccgcgccagtggtttcggggctcgcgcaggggagcggggagtacttcaccaagatcggcgtgggcacgccgtcaacgccggcgctcatggtgctggacaccggcagcgacgtggtgtggctgcagtgcgcgccgtgccggcggtgctacgaccagtcgggtccggtgttcgacccgcggcgctccagctcgtacggcgccgtcgactgcgccgcgccgctgtgccgcaggctggactc

SEQ ID NO: 10158 - DNA, 725 bp, Sorghum bicolor
  Clone ID: SORBI-28MAY03-CLUS62688_1
gatttagtggcagagatgccactaaagatatgctatcctgctcttgagaaccaggaatggaaaatcatcactgggagtgatcctaaaaacacgccttggtcgtaccacaatggaggatcctggccaacattactgtggcagctcacagtggcatgcatcaagatgaacagaccagagcttgcagccaaagctatagaggtagctgagaggcgtattgctacagacaaatggcctgaatactacgacaccaagagagcacgcttcattgggaaacaggcacggctgtaccaaacgtggtcaattgctgggttcctagtagccaagctactgatagaaaaaccagatgctgctaggattctgtggaacgatgaggatgcagaaatccttaatgctttgagcacaaacagaaaacggggcaagaaagtgttgaagaaaacatacattgtgtgagttctcgcagcaagttccatcaaataaccaaagttagcatttttaagttataggaagtatcgttcctgtatataaacttacatgaggttgcatttttgatggggaaggtgcctgctgttggatgctgttattatggatgcatctggctttgcaacaaagctcttgcttgagcatagacctgcctcgtgtagtttgctatacacttcatttggcatgacaagttttctggagtctcattaccaaacttaaaacttttggttcctggaattacctcg

SEQ ID NO: 10159 - DNA, 689 bp, Sorghum bicolor
  unsure (1)..(689): unsure at all n locations
  Clone ID: SORBI-28MAY03-CLUS62780_1
ctngaagggatactaagctcactctctgcggtgttgagtacgataatcggtgttcactatgggcatgtgcttgtccacatgaagagtcatacagacaggctgaggcagtgggtaaccatgggaatatgtcttcttgttctcggaatcattctacacttttcacatgcaattccactaaacaagcagctctacacattcagttatatctgcgtcactgctggggctgccggagtcgtcttctccgtactctacttcttggttgacatcgtgagcctgcgctacgtcttcgcgccgctgcagtggatcggcatgaacgcgatgctggtgtacgtgatggccgctgaaggcatcttcgaggggttcctcaacgggtggtactacgagggcaccaacaacactctggtttactgggtgaggaagcacgtgttcgtgaaggtgtggcactccaccagggtgggcatcctcctctacgtcctcttcgcgcagatcctcttctggtcgctcgtctccggcgtcctccaccgcgctggtctctactggaagctctagcgaggatcatacacatagtcacatacacagacagtagcattagcatgttcttgtttgaatcgtattggaactgcacatgatacctcaaactcaaaatcagatgtatatttacaagcgaagtcagtgtctcgatagtcggt

SEQ ID NO: 10160 - DNA, 1399 bp, Sorghum bicolor
  Clone ID: SORBI-28MAY03-CLUS6029_1
gcacgagggcctgctgctgtgcgtgatcctttgctaagtaatacaaaggaaaccgtgcgaggacagggcacaaccctgtatagggaaggctccaggccaaccggtatatggcttgtttctattggtgtagtaaagtggacgagtcagagattaagcagaaggcattgcttagatccaattctatcacatggaagcactttgggactgtatgaggtgctgattggaaagccatatatctgtgacatgaccacggattcagtggcacactgtttcttcatcgaaactgaaaagatagaagagctgcgccattcagatccttcgattgaggttttcctgtggcaggaaagcgctctggttcttgccaggcttttgctccctcgcatattcgagaaaatgggaatgcatgagatgagggttctcattgctgaaaggtcgaccatgaacatatacatcaagggagaagacttggaagtggaggagaattgcattggcattttgctggaaggattcttgaagaccgacaacctgactctaatcacgcctccagcggtgcttctgccatccgatgctgacttgggtctcgagtcctcagactactgtcatactgcacctaggtatcaggtggaagctagagcacggatcatcttcttggaggaggcagaggcccatcttcatcgaagtgcgtcgcggctgctgctgccccaagggcaaggaggaggtcatgagccaacacggagcatgagcaaggagcacagcggcttgctcagctggcccgagagcttccggaggtcccgtggcaacctaggcctagcagctgagatgctgccgggcggcttgtcttccagggccctgcaactgagcatgtacggcagcatggtgatcctctcctccggccagggccactctcaccggcggcaggggcgtcatcgcgtgcaggcgacgacaacagaccagaagcaaagctcgtcctacccaaggatgccatccatatccaaagaacggcctctgctctccgtgcaatcagagggctccaacatgaagcgagtggcagctctacctctcagagacgacgctgctgaggttgaggctccggcagcccagcagcggcggcggcggcggaaggctatgcacttgcaggaggacaactcaagcgacgactccgccggcgaagaagtcatcgtcagagttgactcgcccagcatgctctctttccgtcagtcagccgccgcacctccgccgcaggaccagtagtcgtcgtctcctctttgcgctgtcatacaaatatatcatatccatttctcttgtattgtattgtacttgtacagaaaaaataaaataaacacattctctgctctatattttctcttcataatcactgaataaaaaaacagatctcctt

SEQ ID NO: 10161 - DNA, 1208 bp, Sorghum bicolor
  Clone ID: SORBI-28MAY03-CLUS60358_1
gcacgaggacttcagcctcagtccatcttcaggctccagccgtccagcccggcgcccccctccgccgccccccccggctccccgccgccgccccccgctgcccgtcgccggcgcccccccccccgacccatccgccgccctccccgttccccgacgttcttccggatcccctgccgtcgtgcgggcgcgcccccgcgcgagggctgccccccgtctgcgcgtcacggccgcgaccgcgcgccttccgccgcctcccgccgcacgcccgccccggagccgcgggcaccgcttccccgcctcgcgccccctcccgcccggccgtcggctgcggctgctgcaccggttgggcctcaccgcgcgccgcggcgtctccgcggggcccgctggccgcgagcccccggggggcccgctggggggcctccccgggtgcgcggtgcggctgccgtacttcgggcgcccgggcgtcccgcgcggcgccggcaccgccgccgccggcgggctcgtcctcggccgcttgcccgggcgcctccgccggctcggcgaccctcacacccacttcccggctgtgcatatcgctggcaccaaggggaaaggttctactgctgcgttcctgtccaatataatgagggcgcaaggctacaatgtgggctgttattcaagcccacatcttctaacaatacgtgaacggatttctgttggaaatgatggaggccctgttccagtaggactgttgagtgatctttttgatgaggctaaggaagctattgatgaagcaatagagtcagaaaatggatccctgacacattttgaggttttcactgctctctcatttcttctattctcacaagaaaatgttgacattgccatcattgaagcaggtcttggtggagctagggatgcaacaaatgttattcgaagtactgaattagcagcatctgtcataacaacagtagggagggaacatctggctgcattgggtggctccctgcaaagcatagcaatagcaaagtctggaatcatcaaacaaggacgaccgtaaatggttgatatgacaagctctgctcctgacacctggttcattccattgttgtgattggtggaccatttgcagcagatattgagcaaattattcgtgacagggcattcttgacacaatctcccgtgatatctgcttgtgatcctggcgtgaagagctttacaaaatgcat

SEQ ID NO: 10162 - DNA, 581 bp, Sorghum bicolor
  Clone ID: SORBI-28MAY03-CLUS60_2
ccgggtagagtagataatgaaataaagtgccctcacaatcgcatatctactattctcttggaagcgaggaaaccaccgccatggcagccaagatgtttgcattgtttgcactcctagctctttgtgcaagcgccacaagtgcgacccatattccagggcacttgccactagtgatgccattgggtaccatgaacccatgcacgcagtactgcatgatgcaacaaaggtttgccagattattggcgtggccaatcccgatgctacagcaattgtcgcttcagccggcgtatcagacgccaatgacgatgccgaacatgatgccaccaatgacgatgatgcccagcatgatgtcgttgccacaatgtcactgtgatgccatctcccagattatgcagcaacagcagttaccattcatgttcaacccaacagccatggcgatcccacccatgttcttacagcaaccctttgttagttctgcattctagatagaaatatttttgttgtactgaataataaagttgacatgccatcgcatgtgactcattattaggaataaaacaagcccataaattgcttttcct

SEQ ID NO: 10163 - DNA, 665 bp, Sorghum bicolor
  Clone ID: SORBI-28MAY03-CLUS60_1
atcgccctcaaaacgcatatctactattctcttggaagcaaggaaaccaccgccatggcagccaagatgtttgcattgtttgcactcctagctctttgtgcaagcgccacaagtgcgacccatattccagggcacttgccactagtgatgccattgggtaccatgaacccatgcacgcagtactgcatgatgcaacagaggtttgccagattgttagcgtggccaatcccgatgctacagcaactgttggccttaccgcttcagccggcgtatcagacgccaatgatgatgccgaacatgatgccaccaatgatgatgaggccgacgatgatgccaccaatgacgatgatgccgagcatgatgtcattgccacaatgtcactgtgatgccatctcccagattatgcagcaacagcagttaccattcatgttcaacccaacagccatggcgatcccacccatgttcttacagcaacccttcgttagttctgcattctagatagaaatatttgtgttgtgtactgaataataaagttgacatgccatcgcatgtgactcattattaggaataaaacaagccaataaattgcttttcccttattatatctctctgtgtgtttgcaaagcctgttatcatttactgttatgaatcggaactctagtttt

SEQ ID NO: 10164 - DNA, 1076 bp, Sorghum bicolor
  Clone ID: SORBI-28MAY03-CLUS60383_1
gcacgaggaaagaatcaaaagacagttcaagtgaatccaatagccatgtaaaatctgaaggtgtcaattctcagcaaagcgagcaaagtgcaaagcagagttcaaagaaatccagtgatggtgtgtgcggaaaagaggacggaaaagaagaccatgtcttatcgcacgagggttcttctctagccgcccacaccatgtcaaatgctacagccaagcttgatttcgacttgaatgaaggaatacctggggatgatgggcatcagtctgagccaactatctcacctgttgtatgttcctcagcaatccatttaactgggcatttgccattcacttcgcctattacaagtgggttgcagccagctccaataacagtagctgctccagctaaagggccctttgttcctccggaaaacctactaagagcaaagccggagattgggtggaaaggttcagcagctacgagtgcatttcgccctgctgaaccaaggaagattttggagatgcctactgccacacgtgacattccagtatctcatgctgctgggaagcagtctcgccccacacttggttttgatttgaatgttgcagatgaccaagctctcgaggaagatatcccacagagttctgcacagactacctgttctgaatctggaaatacgagaagtcgagatggctcttcacgaagcgctggtattgaacttgatctgaacagagttgatgaagttgcagataatggtcaatttgtaccaaatgcttcgcacagagttgaagtcccattgttgtcgacgagatcgttacctggagttttctctaatgctggcacaaatagctcgagggactttgatcttaacagtggaccaggccttgatgatgttggcaccgaacctgcaccaaaaccttctaaaaatacaagcagtattcaattcctacaacaacttcctgttaggatgaatagtgctgccattagtaatatatcaccttggcttgccgctgccagcccttgtggtccagtagctatacaatcttttttaccatctagagaacagccgtacccaattgaggcagcacctggagcc

SEQ ID NO: 10165 - DNA, 746 bp, Sorghum bicolor
  Clone ID: SORBI-28MAY03-CLUS60611_1
gcacgaggttatcatttcaacgatcaacttcccccataatgatatctatactacctaatattgtcatgatatcagccaatttcatttttttaactagctgaggaagaatttgcaaattaataaaacccggtggacgaattttccatctccaggggaaaagactatcatctcctaccagataaattcctaattcgccttttggagcttctactcttacataaagctcttgctttgataattcaaaattgggcgacggttttttaccaagaaatcgatattcaaaatcattccattcgggattctttgctttcttaaagcgtcgggcttctaaattctcataaggtcctccaggaattttctctacagcctgttgaattatttttatggattccctcatttcaccgactcgtactaaatagcgagctaacgaatctccttctttttgccattggactttccaatcgaattgattgtaagactcataaggatcgattttacgaagatcccattgtattccagaagctcgtaacattggtcccgataagccccaatttacagcttcttctccgctaataaaaccgactccttcaactcgttctaaaaaaatgggattccgtgtaataagttgttgatattcaacaactccttgtaaaaaataatcacagaaatctaaacatttatccatccatccataagggagatcggctgctacccctccgatgcgaaagtaattatgcacctcgtgc

SEQ ID NO: 10166 - DNA, 531 bp, Sorghum bicolor
  Clone ID: SORBI-28MAY03-CLUS6052_1
gcacgagcccgatcgccaatcatggagttcccgcaccaccaccaccaccacggccaccgccgcgacgacgacgaggacgaccgccgcggcccgccgcccccggcctacggcggctacggccagccgccgccgcccgacccgtacggccgcgcgcccgtcgaccccgatccgtacggccgtcctccgccccagtccgcgtacggaggcgggggtgggtacggcaacgtcgtccacgtcgggcacgagcccggagacgggaggccgcactacggcggcggcggccttggtggcgcgtacgggggtggcggccccgagtacggccacgagggccgcccgcaccaccacggcggatccgagtacggccacgagacacgcccgcaccacggggccgggggcggggcgctgcgccggtgaggcagcagacttacaggatctactgcaaggccggggatgaccagtacagcctcgccggccgcgacgggaaggtctgcctcgtgcgcactgagcgtaacgacgacacgcagcactgga

SEQ ID NO: 10167 - DNA, 711 bp, Sorghum bicolor
  Clone ID: SORBI-28MAY03-CLUS6352_1
gttggcactagaagagcggaggaggtagtggatcccgacatggagttgaaaccagcgattcgtgctctgaagcgcgcacttctagtggcactgaggtgtgtggacccagatgctgagaaaaggcccactatgggtcaggttgttcggatgctcgaggcagaagacgtcccatcacgggaggaccgccggagccggaggggccacagcaacaacgcagacagcgagtccaaggcaagctcaagcgagtttgagataagcagtgatcgaagagagttaggaccgtcatcgaggttccagccctaactccctgtcagagagcacagcagatcaccaggttcaagaactcggtttcagttcagttcgccgggttgtctcttgctggctcgctcatgcattcagtgggccgttcgaaagattgacctatttgtgaatccgcgctggttttcacactggcggggctttggatggtggtaatggttgttggtactggctttggatggtgggcattggttggtacttgttagagatataggaaggacatggacattgcattttgtactgtaggtattacctttccttggtggtagccagcgtagagggcagagttggatcgattccctgggagattgagacttgtcgtggttcctattcgtgttctgtttgtctagcagcttgtacagaaactttattattgtctggttcttggttagg

SEQ ID NO: 10168 - DNA, 558 bp, Sorghum bicolor
  Clone ID: SORBI-28MAY03-CLUS6363_1
gcacgcgtatagcaagctgcgagcgggcgtggttcagcttcgggtgaaggggatggcgctgtcgtctcgccgcatggccgccgctcccttcctcgtccttgtgctcctcctcgtcgccacagagctggggacgactccggtggcggaggcgaggcactgcctgtcgcagagccaccggttcaaaggcctgtgcatgagcagcaccaactgcgccaacgtgtgccagaccgagaacttccccggcggcgagtgcaaggccgagggcgccacgcgcaagtgcttctgcaagaagatctgctagctagtgctagccttggcggacaggggcaggtccggtcgtcggcatgcaattcaaagctagccgacggcggcgaccactgttgtcagtcgttggtccgctcccagcgttgctgtttttgtttactaccgttgtttctcttcctgctgtgctgcgctgttacgttgtagcacgcgcgtcgctgtgttcggcctgttgcttcctttcgatctgttcccgcgaataaactccgggccatgcatgtcccgggatatgataaa

SEQ ID NO: 10169 - DNA, 632 bp, Sorghum bicolor
  Clone ID: SORBI-28MAY03-CLUS6359_1
aatccgtgcccgcgcgtcacttcgagatcgatctcttcagtcttcagccaccaccctcccagttggccatggtggaggatcggagccccaagcccatccattgcaaagcggcggtatgcagagccgccggcgagccactcaccgtcgaggagatcgtcgtcgatccgccgaaagcctacgagatccgcatcagggtcatctgcacctcgctctgccacacagatgtcaccttctggaaagctaaggtggcaccagtatttccaagaatattagggcacgaggcgtacggggtagtggagagcgtcggggagcacgtggagggcttcgccgcgggcgacaccgtggtgccgacgttcctgggccagtgctcgcagtgcggcagctgcacgtcggagcacagcaacatgtgcgactcggtgccgttcgtcatcggccccgggatgcggcgcgacggcaccaccaggttccgggacgcgcaggggagcccgctgcacgacctcctcgccgtgtccagcttcgccgagtacaccgtcgtggacgtgaaccaggtcgtcaagctcgaccccgccgtgccgcccaagctcgcctgcctcctcagctgcggcgccggcaccggggtaggagcagcgtgg

SEQ ID NO: 10170 - DNA, 706 bp, Sorghum bicolor
  Clone ID: SORBI-28MAY03-CLUS63749_1
tgggccaaggaccggcgaccggcaagcgcgccatgccatctctgcccctctgctggcggccaggcgtcctgctagggggtgttcccggggcgggctctgggccaagaagcggcgacagtcaagcaggagatgtgatctttgcccaaaaggaagatgccaaatgatcaggtagagattgttcacggatggtgcagtgcacgtcgtagcttcaggttaagggaaagaataatttaccgtcggttactcagtttactgctctactactacttgctagtgacgaagttaggaattattctggtggtcatcctaattggccacgagcatatacgtaaggtcagtcggtcagccgttcgttggcgagattgtttgctgctggagatgaacatgctcgcagcagtttcgctggtccgtgaccggcgccatatgttgcaacgaatggctcgctgctgccttgctcgatatgttgaggagcgatgtgtagtgcacgttccggtacattttattgtcctctccctgtcatggatcctccctctcgtagagggtttgtatgttcagtggaagatgtttatttggtctatttaattttgtttttatgaacatgtattgtattgtggtatgttgtataaatacacgctttattatactccctccgcactataaaacatgtagatctcatttttcaagacaagtttagtgaaagtataaa

SEQ ID NO: 10171 - DNA, 708 bp, Sorghum bicolor
  Clone ID: SORBI-28MAY03-CLUS63835_1
tgatgtagaaagccttttgaattcatacaagcaactagtacttcggtatgtagcacttgcacaaggtatgggtgtcagccctgaaaccactcttgctcggagcgggcagacatctgatcttgtagtgtctgaggacccagataatttgaatagcgtggtaaatgacaatgagaaaaaagttgatgatgttataagtgaaaatcatcattcagaagcggttgacacagaagcatctgaacaaatgacccagaaaactgcagttgattccagtgatgatctgaaggtatcagcctgagttgatttctgtgtcatcagcctgagaatgcatgacctgttggtcaagccaagatgaagtggcgatacatggcggaagtactcttaagtttggtcctatagctaaagacgacaatgatcacaaaacagagtgcacatttcccctaagccatatgcagcagctcctcgagccgcaaatgttcatagtggaagattaatgcattctgctgaagctgttcttagatccaaatgttcattgcattgtagttcttgggctctgttgtaatttcattttgtggcgagcacaccctttcgtgttcttatgcttctgtaactagagtttcggttaaatgaagcttaggtcatatcaaaattttatattcagagcaaagagtgaaaattccgaaaactgatgcaatttttggtatatatttc

SEQ ID NO: 10172 - DNA, 825 bp, Sorghum bicolor
  Clone ID: SORBI-28MAY03-CLUS61908_1
atttacgaacattgcccattctgtgagtaggggtttgtcagagcaggatgttgaggttttaagaggcattgctggttgtggtgaggatataggaagagatgaatttgataggctatggtactggttgtacccagtggctgtttcattgtcgagagagaatattaaaaagctgtgggattgcacaacacctagatggatagagggcttgattacaatagaagaagctgagaatgcactaagaagttccagggaactgttaaaggagccaggaacatttgttctcagatttcctaccacccgaagctggccacatccagatgctggatgcctagttgtcacttacattggctctgacaactcaattcatcataggctactctctcttgattccagtgatgctagtgctgagaacctgcaagatttgctgctccaggaacctgaactatcccaattgggcagggttgatcggctcccaaccgccatccggagatgaccaaggattcaaactgttaaacttgcatgcgaaagcaggattaggatgctatattgctatgggccacgagaagagagggtcaccagcagctcaacgcatccaagttcattgccatccaggagaccaagcatagcccataacacctgttgcggttgttaccatgtacaagttgtaaattggttcccttctttgtacaaagaaaggacgctttgccatgttaggccttgtttggccacccatgtgtcccccttaatatataggcgttggagtggttagttgtggaatttaaactaaattccacaccaaatcactctaacaatacacatggattg

SEQ ID NO: 10173 - DNA, 743 bp, Sorghum bicolor
  Clone ID: SORBI-28MAY03-CLUS61978_1
aggtccagcacgacgagaagagccaaagagggggtcacgtaggcgtcggcgacggcgacggcgaccggcgggagaccaaaacgaggccgccacgccctggcccggcgccgcccgctccaccgtcgtcgcgcgccgtctccgtccaggcccgtcgtcgtgtctcgctccgcttccctaccgcaagagtccatcccccgcgcgtgctcggcactcttgtcgtggttgtaccgccccgcccccccccaccacgactccccccccccggccccgccactcgacgcgaccgagaccagccagcgcgaactcctcccaactgcaactcctcccacacgcccgccggcagttgggcgccgcacagcacagcgagcctgccagtcaaaccgaggcggcgacgaacgcacgcaggcagcgcgggggcgggcccggcggtgccggtgtgaatgcgggcgccgcgcggccacgcgcccagccagccggcccgggggcggccccggccgcgccggggtgggcgcggccgccgccctccctggcgccgtccgcgccggccccgtccccgcgcgcgccgcggcccgcggggcccgccggcggcccaccccgcccgcctcccccccgcccccgcccgccccggcgccgcgccccgcccgcgacatcggagggactctgatcaagctggtgtacacggcgagctgcggcggcggggccgacggggcggacctgcgcttcgccaagttcgagaggcgacg

SEQ ID NO: 10174 - DNA, 686 bp, Sorghum bicolor
  Clone ID: SORBI-28MAY03-CLUS62033_1
tgtgcctggagctatacaaggtcattgctggggagcaccccatcgaggactaccgcaacacatttgccaacctagctcttccgctgttctcaatggccgaaccagttccggcgaaggttatgaagcatcaagatctgagctggaccgtatgggaccgctggactatcaagggcaacctgactgtcgctgaactcctgcagtggttcagtgacaagggcctcagcgcttacagcatgtcctgcggcacttctcttctgtacaacagcatgttcgcgaggcacaaggataggctgcagaagaaggttgttgatgtcgccagggaggtggcaaaggtggaggttcctgaataccggaagcacatagatgtcgtggtggcatgtgaggatgatgacgggaatgacattgacattcctctcgtctcggtttacttccgctagtctgcatctgaggccaggccctaggaagattactgcattcaactcgtctctagcccactctagtggtgtcaagcgtagaatagttggttgccacattggcgatggtagctcggctctatcctggtatctgattaagttactctatttagcatccgttatatgatgtgctgctcatctaattgggttggtgtgattattaaggtacacacactggtaaagttaatcgacaggtgacttgaatttgttttc

SEQ ID NO: 10175 - DNA, 1142 bp, Sorghum bicolor
  Clone ID: SORBI-28MAY03-CLUS62_1
ggaattcggcacgaggtcgctcccatgcttgcagcagcaatggtcgttgccgcgattcgccgccgccgctacaagtcggcgagccatcggcgtgtgctacggcgtgataggcagcggcctcccttccaagagcgacgtggtgcagctctacaagtccaacggcatcaccagcatgcgcttctacttcgccgacaaggacctcctcaccgcgctgcgcggctcaggcatctccctcgccctcgacgtcggcaacgacaaggtcggcgagctcgcctccgactccgccgccgccgcgtcctgggtccgggacaacgtgcaggcctactacccggacgtggacatcaggtacgtcgtggtcgggaacgaggtccccggcgccgcgtcggtgctccaggccatgcagaacgtgcacgccgcgctcgcgtccgccggcctcgccggcaacgtccgggtgtccacggcggtgaagatggacgcgatcgagaattcctcgccgccgtccagcggcgtgttcaaggaccccgccgcgatgtcgcccatcgtgcagttcctcgccggcaacggcgcgccgctgctcgccaacgtgtacccttacttcgcgtacgagtacagcgacggcatcgacctgaactacgcgctgttccagccgagctccacgacggtgacggaccccgctaacgggctggtgtacacgaacctcttcgacgccatggtggatgccgtccgcgccgcgctggacaaggccggcggaggcggcggcgtcgacgtcgtggtgtcggagagcgggtggccgtccgccgacgggaagggtgccaccgtggacaacgcgcggacctataaccagaacctgatcaaccatgccggcaagggcacgccgagaaagccgggatccatggaggtgtacgtgttcgccatgttcaacgagaaccagaaggacagcgaccccacggagaagaagtttgggctcttcaatccggacaagacaccagtttaccctattaatttcgcatgaaattgagcacagagcacgtacacatacaaggcggatttatatatgtatatgtctacgtataaataatatttctgtccttttttttgcaaccatataaaataacgagatgaaataaagtgaatcatatcct

SEQ ID NO: 10176 - DNA, 691 bp, Sorghum bicolor
  Clone ID: SORBI-28MAY03-CLUS62167_1
aggctgccgaactacatcaacaaccgatgcgttcttcgcaatctcttgcaagtgcccgtgattaaagaggacagcttgaaggacaggatggaggatcagcgcaaggggaactacgtgataaccagtgaggagctggaggacatcatggaagaggcgatgcacatcatgtgggagttcatcaaggctgacagagtcgaggcgacgacgacgacatcggtgctcaagggcttgtcgagcacccacgtcgagctccaggaccccatggatcatgatctcatggcgcacatccattccaccttacagaagaaagagaagaggctcaaggacctcctcaggacgggcaactgcatcgtgaagaagtttaagaagcccaaggaggacagatcgaaccagaacctcttcttctcgcaggtggacatgaaactggtggcgcgggtgctgaggatgccgaggatcaccagcgagcagctgcagtggtgcaaggcgaagctcgacaagatcatactggtagatcataggaagatccacagggaggcttcatttttgttgtttccctgttgagagagtacatatatatgttttcttcttttcttttgttcttctcttttgctcgataaaaaaatatatcttcaccatgtaatcattccacgggtgtaggaatttttttaaccttttggtaattcagtttctt

SEQ ID NO: 10177 - DNA, 697 bp, Sorghum bicolor
  Clone ID: SORBI-28MAY03-CLUS62393_1
ccgcgccccccctggcttcacacgattctgcaacccatcccggtgtcgcgggtcccctgggctgtgtccaggccccaccgagggttcctgcagcactctgctcccccgctgccgggcgacaacctcggtcaggttgccgacctatgtcggggtggcccctgtgggttccccggcttttcagctcagcccctctctgtacgtagtagagctcaagaagtcccatggtgatcctgcattgtacagacagctctgtgagaggatctgcagtgacctaggtgtgctcaagatggatcagatctttgggacgagatcgactgccgatgatcttgcatgcttggcaagacgatctgcgacgcctttggttgcattgtgaagaaggctgtccccctgacgtgatgtagcgtgagatttagtgacaacgaagcagttcagctgcaacgcagctaggaacggttgtattgtaagtaggatcataatcccgcagaaatagaggagaagataaaagagtgttgccgtgtaggatcatacgtaaataaagcagtagtcaccgatgtaaaacacaatgtaaaatctaagaaataaattgttttcggtggcatacacaatctccacattcactaattactggtggctcatttctttttaacgtggatccaattcatataactaaaaaaaaaaaaactcgagggggggcccg

SEQ ID NO: 10178 - DNA, 1172 bp, Sorghum bicolor
  Clone ID: SORBI-28MAY03-CLUS6435_1
gcacgaggaaaaagagaaggctgaggctcatatgttcactgcattgaaggtggcccgagactctgatttcaaagagcaaattggaagacacatgcattttgatctcgtggactttgacaaagttaatagcttccgtgcacctaagaacgcgccaggcaacgatgtcaaggaggagctttcgaaagaatttggcatcccagtagaatcccaacgattttgggtgtgggcaaaacgacagaactttacctacagacccagtcggccattgaccttcctggaggaaacatctgctattgggtatctcaaagacgcaatagtggcaaagttaccaaattctgaagtacggttgttcttggaggttcatttgggacaggagaatcaaggaattgcttctgggaagaccaaagaagatatattaattttcttcaagctctatgatcctgaaaaggaagacctaagatatgtaggaaatttttttgtgaaagcatcaggaaaaccatctgatatagtagaaaggctgaatgagatcgccggatttccgtctgatgaagatattgagctctatgaggaagtaaaatttgaaccagcggtgatgtgtgtaccaattgagagcaatatttcgttccgttcaagtcagattgacaatggtgatataatatgctaccaaaaacgctgtttgccagattcaatggatcgataccgatatccaagtgtcccttctttctttgaatatattcataatagacaggttgtctacttcagattgcttgataaaccaaaagaagaaggcttctctctggagctttcaaaacgctccacatatgatgatgttgttgagaaggttgctcggcaactacgtctggacgatccttctaaaatccggcttactcaacacaacctatcgtctcagcaacccaaacctcaccacatcaaatacaggagtcttaattatctttcagacatgctacataatcataatcagatgtgtaacattttatattatgacgtcctggatattccgttgcctgaactagaatctacgagatcactgaagatcacttttgaaaacgccacaaaccatgagatgtcgtttcacactatgcggttaccaaaaagtaacactcttcttgatttgattgaagacttaaagtcaaaggttgaactttcttgtg

SEQ ID NO: 10179 - DNA, 701 bp, Sorghum bicolor
  Clone ID: SORBI-28MAY03-CLUS6461_1
tgatgagggtgcagaaaacgagttatctttcaagaatggacccagcaagtgcaagagatgctgaacacaaagaagtttgggggcattgcgtttagagataaggattttaagactgcaattgactactactccaagctagtggcaatgatgtcaacgccttcagctacagtttttgctaggcgcagtttttcctacttgatgaatgggcaagcagaacttgctctacgggacgctatgcaggctcaggtctgcatgcctgagtggcctacagccttctacctccaagcccttgctctttcaaagctcggcatggaaaccgatgcgcaggacatgctcaacgatggagccacatttgaggccaagaagcaaaacggctggcgtagttaggaaacaaagtctcccaactactccgtgttgttgcccttttagaaaaaggtacaatggcgagtgtcctccaaatcagttcactgggacgtcagttgcactactaggagtgggattgaaatgcactgttttatcgtgcaatctccgcccgaatgtcgataacgagtggcggtgttatgatcaggagtggaagaataggtcaggggctttgaacgcatagcatactcttccatgagttgctctttgttttgcgagtgttggtggcaggatactgctgattatttgcaactgcagttgtaattaaagggatgcttttt

SEQ ID NO: 10180 - DNA, 755 bp, Sorghum bicolor
  Clone ID: SORBI-28MAY03-CLUS647_1
gcacgaggagacatatgtgtatctcgtgcttttggggacataagatttaagacgcgaaagaatgaaatgctggtgaaaggagttaaagagggaaggtggactgataagttcatctcacgaataaaatttaaagatgatctaataatctcgtcacctgatgtatctctggtagagcttggaccagatgtggaatttgttctattagcaactgatggtctttgggattacataaaaagctctgaagctgtagcttttgtcagagatcaactacgtcaacatggtgatgtccagttggcctgtgaggcacttggtcagaaagctctggatcaacggtcaaaagacaatattagcatagtcatagctgacttggggaggacaaattggaaggcgttgcccgatgaaagaccaaacatgttcttggaactaagtcaagcagtcgcgactgtaggggttgtctcaataggaatttggttttcgtcgttccttggattacagtagaactaggtccgttcagatgtgtatattactttctggttactgagttacattttctgctggcagctgcaaatatatgtatatattcttatagggtgaataattaatagggtaatatgttgggtaatagtgaacgtgtgaagtactgatgaagatcgtgtagtttcagctcctggtgagtgatgacagctgagtcgctttgagtccaatgggacggagtgaatgatctgtctggatttcctttttctttgccatattga

SEQ ID NO: 10181 - DNA, 679 bp, Sorghum bicolor
  Clone ID: SORBI-28MAY03-CLUS64771_1
ggtgcaaataatgataaacatgcagttgaaaggcccttgaagagaagtaaaaagcgcagagtgtcatttagagatcaggttggaggagaacttatccaagtggttgggatttcagatggtgcagatgttggaactgaacccggccctgtaggtgtgaaggaaggcagtcttgttgggaagtatgaatctcttgtacaggttactgtcataccgaagggaaaggagcaagcatcaccaaaagaatatacctctacctcaacgagtggtgtaacggataagctacaagaggtgcttaaaaaagtaaagagcacaacaaaacctggaatttacgatgatctttatggggattctgttccagcaaaagtgggctcatcttgggcatacaaatcagatgacctgtcagataaagcccaacctgttgaggagaagacacatagcatgaattcagccgatgacagtgatgacttgtttggtgactcgtgattcagaatcgtcagtggatacaaacaaatatattcttcagaatttcgtggcagagctgtttcatttgttagaggctttttttgggggggcttagttatacatgattgtacccttctgcaaatcaaggtgtgttctttttggctgatgtgagcaacttaaggacacgctttcatatagtgatgctcattgtgagttt

SEQ ID NO: 10182 - DNA, 696 bp, Sorghum bicolor
  Clone ID: SORBI-28MAY03-CLUS62993_1
tggttatgctactacagatgctagtggtgctgcattctgccgttcagctgcacttattttaatggcgctgttgcttctacgacatgcattgtccatctcagacaacgaaggaaatgatgatgatgcttctaccatgttctcactttttctgctgcgagctgctgggtttctgctgccgtgctacatcatggcatggatattcagtattttgcatcgcaggcgacaaagacaggaggaggctgcactggctgcagcagaggtggccttcatcctacagtcagccagggggcgcgccctccagtttgccatcgctccagactcccccgccaccccgcagcacgagccagcaccgcagcaacagcaatagtggctaacaatacaaccccagtagttcctcacgactactgaccatacttctctggttcgttttgttgttgatgatgcccccgtcatgcatcatactgactcgcaaatgttaagcctgggcttctgcctcccgtcccaatttgggtgtctgtcacccacaattcgttgcgcctgaaattctgtaatttgtatttagaccgagtgtaatctgagaatataccaatgtagtgtaaattcattgttgcatcttttcgtcgcattgctgcggcgtgaatattaacttttatatgtaccgtaatgtacagtctttcataatactatttgttttct

SEQ ID NO: 10183 - DNA, 990 bp, Sorghum bicolor
  Clone ID: SORBI-28MAY03-CLUS63228_1
ttatggttaatatgtgaggttagtactttctaggttttttcagtggatcaaacgattttgtatcagtgttcaggctataaaaatttcttcatatttgcgctaatttgctaaggtcatcagatccatacctatgcttttagtgtagcatatgtgtgcttttatcttacatatctatcaggtaaatttcatcattgttttgtttctaatggtccacccaaaagatttatttgtttcttatcagagccgcgaggctcagcgtttggttacatggtgtcgatctgttttgcggatttgagcctctaacttcctattctgaaaatgatgggtttcaaatcccttcaggaaatacattttgtttgtcctctcatgttctcatttgtgtcatacctatagatgcagtctccacatcggattggctcagcaagctgtcctttataatgttatctttcgcaagatcggtcctgcatttgcaatatgaacaaggccatactcggtgcatagaacagctcatggttcaacttgataggttcaactgaactagacatgccagcctgcttatgaaatttcaaaatgctattttccccaatgtatattatttgaagcacctatactcagctatgtataggaactgttataggtccgtccacagaggtctaaaatcatggatgtcaacttcttttgtaacccgagtttatccagtattacataatacattatttactattttgatttccaatcggcgcgcagggcgcgccattcctactagtaccaattaagggtctatttggggctcggcttcggtaacagcttctgcaaggaaccgtacaaaacgctctacaaggaggatgagttattttttgataagcaatggaagagtcagagtcgtttcttgagcgaaaaccaaagttgtaaacaatgactcctcttgaggaggagcacttgaggagtcgtgtcaaaccagctctaactattgaatgattttgtatgaag

SEQ ID NO: 10184 - DNA, 710 bp, Sorghum bicolor
  Clone ID: SORBI-28MAY03-CLUS63300_1
cctcggggctagtcctgctcgtgcccggccagccgcccctgccattgtgcctcctcattctgtggctggctcgggggaatatactctagtttaccaagaccctcttggagacagcatcctggttggggtccccattggaaggaaagtagaccttggagcctatgacagctacgagaggctatcattgggcgtcaaagagcttttccatggttttcttgaagctcaaaaggatctatctagtgctggaagtacacagccaggggccactgaaaaaatattttctcaattattggatggatctggtgaatatactctagtttaccaagacaatgaaggagacaggatgctggtaggggatgtgccgtggaatgtatttgtgtcaactgctaaaaggctgagggttttgaggagctcagagctttcccatggtttgattgcagtagctcctagaagaggaccagattgctgaaagcctgaaacagtgtcaaaattctatcatttgaaatgtgagcaaactgaacccggaccattccccttctgtgatgtgatgatacctaactttttccctttagagactaatctaatgagatgaagtagcatttcagatgcatggagaggtcctggatattttgtaaattaggctagcacatgtgattcggttgctgtagagtaatgttctaatgtaattcgcctgggcattgaattttccg

SEQ ID NO: 10185 - DNA, 674 bp, Sorghum bicolor
  Clone ID: SORBI-28MAY03-CLUS63389_1
cggccttgcccccctttgtccatccctgctggggtcatcggtcgagcggtcatccgtttttggggtctgtatattggtatgcccagatcatgagaaatccgcctcggggcttgtctggtgttccgtcggtgtttgggggggattggttccccccgcgtgcgtagccccaatgggccctaggactctgatgtgtacgcggttcgccttttgtctcagtagtaagctacaggggagtcggaccctgctgttgtgtggttgccgggaactgggttgcgtcatcccccggtggtgccgctgtctaccggtggccttctgttgtatcgcgtaggcagtggatgctgttatctttcacgccggccttttgacatcgcattgttgttctaccacgttggtgagacctttcaccacattctgtaaagcagatggagacatagatcgagcggtcatccgttcttgtggtctgtatattggtatgccctgatcatgagaaaaccgattcgttgcatatcttttcttttttttttggtgagattgatttgttgcatgtctgtatcaccaaatgaaacaaaaactcatatgtatacttgatctggattctgtatcagtagtaagctacatgggagtcaaaccctgtctttctctaatagtagtgaacagggaaaggtcatccacag

SEQ ID NO: 10186 - DNA, 688 bp, Sorghum bicolor
  Clone ID: SORBI-28MAY03-CLUS63514_1
tgtgacgggttatggaaggtaatgaaaaaccaagaagctgttgatctggtaaagtcaaccgaggtcccgcaaccagcagcgaagcgattgtcgtctgcggccctagggaggatgagcaaggacgatatctcatgcattgtcatccgtttccgatgctgactgactcctgcgtaatccagctcatccattgaaccttttgccttaagctgcctctgtgcatcagcagtattctcttttttccccatacctgatctgtgtacattgcagttggtagcgtctggatctgttgcagctcaggatcagattggtgattggacttggacaggttcttgaccaaagaaaagaagaatactgggtgttcatttttttttctgtgcatatatatacaagttagaagcaaatatatgtacagttggactggagacaaaaaaaaagcatatctttccaggctagtggccggtgtacgtactgtgggacgcgtgtcgacatatagtagctcggctttcgcgtctagtgacccggggtctttgtggggtgggctgattgtctgtgtgttgctgggttttggcttttggtgacgctccgtggccgtgctggcgcgggaccttgcgtgtgcttctgtgtatttatttttcctctacttccgttgccattcaagcacgggtccatgcgagatcaacttcaaatt

SEQ ID NO: 10187 - DNA, 718 bp, Sorghum bicolor
  Clone ID: SORBI-28MAY03-CLUS66399_1
tggatactatcatataataatggcaatggagaagaacaacacacacagcacttcccacagctagaactgctcccaagtttcagctcatcgcacgctccaccatcaccgccgcttcattacagaggaagaggagccatggagagattctactacgtcgccgtggtcacctccgtgctcctcgtcttgctccaccacttcttgacgaggcgcggcaagaagcagcaacggctgccacctggcccgcggttcgcgttccccatcctcggccacctccccttgctcaagaagccgctccagacctcgctcgccgacctcgtgtcgcgccacgggccggttgtccacctgcgattcggcggccgccacgccgtcgtcatcggctcggcggcgctggccaaggagtgcttctccggagagctcgacgtcgcgatcgccaaccgcccgcacttcccgtccgcgcgtgaggccagcttcgactactcggtgctcaccgtcgtcaactacggcgcgctctggcgcaccatgcgccgcgtcgccaccgtgcacctcctctcggcgcaccgcgtcaacatcatgtccgacaccgtaatcgcccgcgagctgcgcgccatggtgcgccgtcttgcccgcgcatccgcctcccgcgccgggcgccgccgccagggtcgagctgaagcgcaggctgttcgacctctcccacagcgtcctcatggagatcatg

SEQ ID NO: 10188 - DNA, 1211 bp, Sorghum bicolor
  Clone ID: SORBI-28MAY03-CLUS6645_1
accccacgcgtccgctccctcgcttcaaatcgattcggcgctagcgagcgccgagcagcaacgccaaggcggcggcagcagcatccagcaacagcagccgctacctccctttgtctagttgtcttcctcctccggtccactcctgcttgctagagtgcctagcctcatgaggaccccaaggagcctccttcccctcctcctcctcctgctgtccgccgccgcgctgctcaccgtcgccgattcgcaggagcgcaagaactacgtggttcatctcgagccaagggacgacgccggcggcgacagcgccggttcgctggaggagtggcaccggtccttcttgccggaggccacgctggactcggcggcggatgacggcccgaggatcatccactcgtacagccacgtgctgacggggttcgccgcccgcctcaccgacgcggaggcggaggcgctgaggagcaaggaggggtgtctgcggctctaccccgaggagttcctgccgctggcgaccacccactcgccgggcttcctcggcctccacatgggcaaggacggcttctggagccgctccgggttcggccgcggcgtagtgattgggctcctcgacaccggcatcctgcccagccacccgtccttcaacgacgcccggccgccgccgccgcccaagaagtggaagggcacctgccagttcaggtcgatcgccggcggcgggtgcagcaacaaggttattggcgcgcgcgcgttcgggagcgcggccatcaacaacacggcgccgcccgtggacgacgccggccacggcacgcacacggccagcacggcggcgggcaacttcgtgcagaacgccgacgtgcgcggcaacgcgcacggcacggcgtccgggatggcgccgcacgcgcacctggccatctacaaggtgtgcacgcggagccggtgttccatcatggacatcgtcgccgggctggatgccgccgtcaaggacggcgtggacgtgctctccttctccatcagcgccacggacggcgcgcagttcaactacgacctcattgccatcgccacgttcaaggccatggagcacggcatcttcgtcagcgctgcggccggcaacgacggccccaccgcgggatccatcaccaacggcgcgccgtggatgctgacggtcgcggcgggcaccatggaccgcgcgatacgcactaccgtcaggctcggcaacg

SEQ ID NO: 10189 - DNA, 732 bp, Sorghum bicolor
  unsure (1)..(732): unsure at all n locations
  Clone ID: SORBI-28MAY03-CLUS66809_1
gcacgagggcaggagggagcatctgaagatgacataaacaacctttccaaattcaaatttcggacaatgagtgatgcagacaagctagctgccggcattgcagcacctgtgggtggagtgatgacagagtgtggtaccaatcctcctgtcgaacatattctttcagctgaggatgcggagtgctgtatctgcctatgcccatatgaagatggtgtggagctacgtgagctcccttgcaaccaccattttcactgcagctgcatagacaagtggcttcacataaatgctacttgcccattatgcaagttcaacattgtcaagagcaatctcgacagagaagaggtctaggtcactaagggaaaaaaaatgtggcgaaacatttcggcatgtcccagctgtgctccagtactacgacatttgggaatcgagttgtgattaccggtcctgtagttaaaagtcatagtgatgcacagatggttgcaatgttggttctcgtgaatattccttttagcagttttctgcaggggctgtacattctctttctcctcgatctgattgcattgcagatttatttgtacatgaacagttgaacacatggtcatgttggatcttgaaagcagtcagtcgtttgtaaaatgattcatgaattggaggcntagtatgcagactgcttttggttggcataaatgatttgggcacaatatgatgcagatgtgcaattccaaatattgg

SEQ ID NO: 10190 - DNA, 1300 bp, Sorghum bicolor
  Clone ID: SORBI-28MAY03-CLUS6703_1
gcacgagggagttttagggttcgcggcggctagatgcaatggagtctatatacatgccacatttcactcgtggccagaagataagattgttgggcgcccgccgctcatccgcaaaaccgcagctcctagcgaaagtggcggcatccggaggaggaggaggaggctgcgaggcatcccagcggcccagcgtcgtaggcaccttccccgcggccatcggcagaggcggctaggcatccgagcgggccaagcgggccccacaatgacaccttcccggcggccggcggcagaagcggcgcggcatccacctcgacaccctcgcgccgctcgagcttccccacgccggtccgcgtttccgtccccacaccgcttgagcttccccgcgccggtccgcgcttccgcccccggcagttctccgagtcgctgcctactcgcgtcctcgccttcatgggcgccgccgtcgtcctcatcgaccgattctcttctccatcagccattcccaaaccaaacagagcacagcagctactccctgcgtcaaccgcccaccgccatgacgccgccaaggcgccaaggccacttctacgacaagtactacagtcatgacactgaccccgacatccggcctcctcctccccgctgcgaggagaaccaccaggtgtgccaaccccgtttcccttcctgctgtgcggaagctgaatggagcaccaacccaaaccttcgacgatgactgcttgtgctgattatcacaaaaacaaggagtcacccacgccagctgaggccaatcgctgaacagcaagttacttgacatcatggtgtgcagggtcattgacaaaatgaattggagtaactcatgcatgatgccaatctccaaatagcaaggtacccaggtccacaacatgttgaacactagggtgcgatgacctcaagctggagcctatgtcatttggcctgcatgaattgctggtcgcattgatagacctgctaattagatgagatgtgcctcatgctgcaatgagcctcgaagatgaactcattgcctcaagaccattagtgcttaaatttctactccatattttggggttgtacaatgatgtaagggaaatacaattcgaacagatgaaccctttttggtttcatgcccttatacaagttccttcttcaagtctagctactatgttcattgcagttcactggccaaccagtgacttgaggtgacagtggctgttgaatttgaatctgtgacataattgtccatgcctttacctcactggaaaatggaataatgattttatggtgatatgga

SEQ ID NO: 10191 - DNA, 914 bp, Sorghum bicolor
  Clone ID: SORBI-28MAY03-CLUS924_1
ccacgcggggcacccccccctggctgcgcgcgggcgccccttcctcccgcacgcgccccccggcccctccgcccgggctcccctcgccgttcctcctccacccttcccctccctccgccccgcacgaggctcctcctttgcctcccgcccccgccgcgcgtcgccgcgtctcctcccagtccgcgccatggcgtcggggaacccctacgccgccgagctggccgccgccaagaaggccgtcaccctcgccgcccgcctctgcaagacagtgcaacaggacattgtgcattctggtgttcaggccaaggcagacaaaagtcctgtcacggtggctgattatggatctcaaatattggtcagtcttgccttaaagatggatgtagcatctggaccattttctttggttgctgaagaggactcggaagaattgagaaaagaaggtgctgaagaaattttggaagaaattactgatcttgtgaatgaaaccatcgttgatgatggttcatataacatttcatttacaaaggaaggtatactctctgcaattgatgatgggaagtctgagggaggtccatctggacgacactgggtgcttgatccgattgatggtactaaaggtttcttgaggggagaccaatatgccattgcattggctctgcttgatgaaggtaaagtcgttttgggtgtattggcttgtccaaatcttccattgtcatcagtaaacaacctcaatggtaactcttcgggagatcaagtcggtgccctgttttctgctacaattggttgtgggactgaagtggagtccctatatggctctccaccacaaaagattagtgtttgctccattgacgatcctgtcaatgcgtcattttttgaatccctataaagtgcacactccatgcatgatttgactg

SEQ ID NO: 10192 - DNA, 658 bp, Sorghum bicolor
  Clone ID: SORBI-28MAY03-CLUS92888_1
agttcaagatcaactactacccgaggtgcccgcagccggagctggccgtcggcgtcgagacccacacagacgtcagcgccctctccttcatcctccacaacggcgtcccgggcctccaggtgctccacggcggccgctgggtcacggcgcgcgacgagccgggcaccatcatcgtgcacgtgggcgacgccctcgagatcctcagcaacggccgctacaccagcgtcctccaccgcggcctcgtcaaccgggaggccgtgcgcatctcctgggtcgtcttcgccgagccgccaccggacgccgttgtgctgcgcccgctgccggagctcgtcacgccagaccaccccgccaggttcacgccgcgcacattcaagcagcacctggatagcaagcttttcaagaagaaacagcaggagcagcagaaagcagacaaggatggcaataataatggtgaccaccaccacgacgagccgccgccgcctcagactcagaccaactgatctcgctcgctcgctcgctttcgtccatccatcaataatacgtcgacaatctatctatctatctatctctatgcatccggccacgcatatcttcgctcgccagtaattaataaggaattattctgcatttttcatatatttgtgtggaaatcatatcg

SEQ ID NO: 10193 - DNA, 703 bp, Sorghum bicolor
  Clone ID: SORBI-28MAY03-CLUS9308_1
gcacgaggcccgccgaaatttcccatcttttcctcaattccttgggggatttccccatccttgtccccatcgatcagaggtcccggtgctgttggctttcgcattcaattccttcggaagcaaagggaacttatttccttttggggtcggattcggggccgatttgctctgtccctgtgagaggagggcttgttggatcagggatcgagcaaggtagcagccatgagcggaggaagcgggactttcctcgagatccagccatcggagctcgcattcccctttgagataatgaggcagagctcctgctccatgcaattgaccaataagactgaccattatgtagcattcaaggtcaaaacaaccaacccgaagcagtactgcgtgcgtcctaatattggcgttgtattacctgggtcaacttgtgatgttacagtgacaatgcaagcacagaaggcttcaccatctgacatgcaatgcaaggacaagttcctagttcaaagcgttgtggctgagaatggtgcaacagctcaagaaattaatgcagcaatgttcaataaggagccagggaaggttgttgatgaattcaagctgcgtgtggtttatgtgccaacaactacacccaacccgatccctgaagaatctgaactaggggcttctgctccctcatattcacaagaaaatgggatcagtcattccacgatgc

SEQ ID NO: 10194 - DNA, 698 bp, Sorghum bicolor
  Clone ID: SORBI-28MAY03-CLUS9328_1
gcacgaggcccacgcggaggagactggtccggcaccacgcacgcacgagccgcatcgcacccgtagcatcgggatccctctggtttctgggaccggcctgcccagccggtcgatcgacgtcggtgaggagactggtccggtactccggttggttggatcggaggctcggccatgggggcgctgtcgcggccggaggaggtgctggcgctggtgaagctgcgggtggcggcggggcagatcaagcgccagatcccgcccgaggagcactgggccttcggctactccatgctccagaaggtctcccgcagcttcgccctcgtcatccagcagctcccaccccaactccgcaatgccgtgtgcatcttctacctcgtgctccgtgccctcgacaccgttgaggatgacactagcatcccgacggaggtgaaggtgcccatcctccaggaattctaccggcacatctacaaccgcgactggcatttttcgtgtggaacaaatcactacagagtgctgatggataactttcaccacgtatccactgccttcctggagcttggtcaaggttaccaaaaggcaatagaagaaatcactaggcgaatgggagcaggaatggcaaaatttatatgcaaggaggtcgaaactgttgatgactatgacgagtattgtcactatgtggccgggctaagtggttatggact

SEQ ID NO: 10195 - DNA, 654 bp, Sorghum bicolor
  unsure (1)..(654): unsure at all n locations
  Clone ID: SORBI-28MAY03-CLUS9359_1
gccggccttggttcgngccccacaaaccacacctgagccgcacccacgctcaccgctatctcctccgaatcctccggccgccggcgagccccctcctcctcctccacgacctgcgcttccccggctaacatggattcagagccgtcatcacagaacccaacagatatgactgcatttgtccagaacctccttggacagatgcaaacaaggttcgagtccatgtcggagaacattgtgtcaaagatagatgaaatgggaaccaagatcgacgagcttgagcagagcatcaacaatctcaaagctgagatgggcactgagatgccggccaagaagcctgatgagccaaagcctgctgactccgcgtaacttgggtgtaacccagagattgttgagtaaagatttggtgatggtgtgacaaatttcagcattctgtgtatcttctgaggatcatctgttgcatgagtcctgtcaactatgtagacactagcccatcatgtgaatgatgaatccatagttcgggctctccagagttcagacatcaacgcatgttcctagttagtttttctgtcatctttcggcaagtatttttgactgttataagatttgtggcatctattccatttaaagtaaaaaaaaaaaaaaaaaaggccccta

SEQ ID NO: 10196 - DNA, 797 bp, Sorghum bicolor
  unsure (1)..(797): unsure at all n locations
  Clone ID: SORBI-28MAY03-CLUS12481_1
cggaggaggagttgcggcagtacgacgggtccgaccccgagaagccgcttctgatggccatcaaggggcagatctatgatgtctcacagagcaggatgttctatggacctggcggagcatattcgttatttgctggtaaagatgccagtagggcattggccaagatgtcctttgaaccactggatctgaatggtgatatatctggcctaacgccaatggagctcggttccttgaatgactgggagtacaagttcaccagcaagtatgtgaaggtaggaaccataagaagaacagtgcctgctgaagaggtttatggcagcatttcacctgaaataagggaagaagttactgtgcctgtggttgaggctgagcttgaacctgagcctgagccgcatgatggcgatgcaccatgaataggaaacactctaagacatctcagttctgataggaagagtgaagtggagagtggggcactgctgataatgttccaaaggtagtcagaatttagaaataacagaatgcctcgtacctgttgcattgcatggttgtatgcaagtatagtgtctaatttaccccaatagtagatgtgtacactgcagtaggattgaatggttgtttgcaaaaatagtgtctaatttttgctcctccgctcatgcctgtctctgatgtatagtttctcctactcaatggacgagaagcgtcagaaaaactatagatagatcttgtgttgcctcgtgtttctttaanaaaaaaaaaaaaaaaaaaaaaaaaaaaaaaaaaaaaaaaaaaaaaaaaaa

SEQ ID NO: 10197 - DNA, 851 bp, Sorghum bicolor
  Clone ID: SORBI-28MAY03-CLUS67539_1
cgaaccggcacgacccggcgaacccggccgtgttcagcatctacctggtgcggcccgacggctccgggctgcgccgcgtgtacgtggccgggccggagggcagcgcggaggcggacaaggagcggatcaaccacgtgtgcttcagcccagactcgcagtggctgctgttcacggccaacctgggcagcgtcgtggcggagcccatctcggggcccaaccagttccagccgtacggggacctgtacgtgtgccgcctcgacggctcgggcctgcgccgcctcacctgcaacgcctacgagaacggcacgccggcgtgggggcctgcctccgccgggctcgggctggagtcgctggcgattggcccacccgccggggaggacgcgttgggccagttcgacgagccgctgtggcttacatgcgacgtctgataatgactgtcagactcatggtaatagcgcttctccggattgggtcattgggataagaatcatgacgctgtattgcttgctgtttgggacgtccctttttgttttcttcgttgctgaataaaaagaacgtgttttacgttcaaaaaggaagaataaaaaggtcgtgcttgtgtggactccattatccattgtcagctaaaagttgcgtttcggtggagtacggagtgtacctgttatatatagttgggtgaagtgaacgtctagggctcttggcattcacctgatgccgaccgtttggttgcacgtaacatcacgagagggagggtacaaacctttttcagcagggactagaaactacgcgcggcgttgccgcgcgtctactagcctgtttttggtggactgtgattatgcctcaatatgaaa

SEQ ID NO: 10198 - DNA, 703 bp, Sorghum bicolor
  Clone ID: SORBI-28MAY03-CLUS67810_1
tactggactcgagtgcgagtcggttcgggggtactttcccccaacagttcgcgcacagccgggctcgtcgccgcgtccgcgtggccggccttcgattcgtggcggacccaggcagcagacaggatctcgggggctagcgccggcgctcggctgccgtccgccggagatggggaagcgggactttgagcgcctgcgccacgtggcgttcttcgacgccatggccacggagctccccgacgaatacgcgtcgcaggaggtcaaccacctcaccctcgcctacttcgccgtcggcggcctctcccttctccgggagctcgaccggattaacaaggatgaaatagccaaatggattttgtcttttcaagttcatcctgaagcaaatgatgatataggtgtcggtttgttctatggattctgtggttctagatcgactcaatttcccttgcctaatacgaaggatccttgctgcgatgttagtcatcttgcaagcacttattctgcccttgctatcctcaagataattggctacgatctagcaaatattgactgcaaggcacttctattatctttgaaaaaactccaacaaccagatggaagcttcatgcctactcatattggtgctgaaacagaccttcgctttgtatactgtgcagctgcaatctgctcaatgctagatgactggacaggaatggacaagttaaag

SEQ ID NO: 10199 - DNA, 989 bp, Sorghum bicolor
  Clone ID: SORBI-28MAY03-CLUS6784_1
gagatggcgatcctgtacgcgctggtggcgcgcggcacggtggtgctggcggagcacagcgcggcggccaccaacgcgggcgccatcgcgcgccaggtcctcgagcgcctccccgacggcggcgccgacagccacgtctcctacacgcaggaccgctacgtcttccacgccaagcgcaccgacggcatcaccgcgctctgcatggccgacgactccgccggaagacggattcccttcgcatttttggaagatattcacggaaggtttgtcaagacatatggccgggctgcgctgacggctcttgcatatgcaatgaatgatgaattctcaagggtcttgagccaacaaatggactactattcaaatgaccctaatgcagatagaataaaccgcatgagaggtgaaatcaatcaggtccgtagtgttatgattgataacattgataaggtccttgaaagaggtgatcgtttggaactgctggttgacaagactgcgaatatgcaaggaaatacagttcgattcaaaagacaagctcggcggttcagaaacactacttggtggagaaatgtcaaactcacggccgcattgatacttctcctcctggtaataatatatgtcgttcttgtgttcatgtgccatggtttcaccctaccaacttgcataaggtaaggtatgatctgcgcactgtggtttttagtgtgcatgtttgtgtatgtccctgtccccgggagcagcagctatcgcaataccattgcaattgttttttgtgtagaggaaagctacagattatggtgtgattgtgaaaactcaattaaagatgtaaacttcacacaaaactgcttcttgtgggtttggctattgccttgtagctctacgagaattcggtgcttggatttgtgtttatctatggctattcttgtgtctgtacatgaatgaattcagttacgactacatttatggttatgctaatgtaatattcttgaattgac

SEQ ID NO: 10200 - DNA, 726 bp, Sorghum bicolor
  Clone ID: SORBI-28MAY03-CLUS67863_1
actgggcttggtattgctcccagaagtctcggtgatatcattggagtggtaaaagcctacacaactagggttggatccggtcctttcccaacagaactattgggtaagactggtgatttgcttcgtgcttctggagtggaatttggtactacaacaggtcgtcctaggcgttgtggctggcttgatatagttgcacttaaatactgttgccaaatcaatggtttctcatctttgaatctcacaaaactcgatgtcttaactggactcaaggaaattaagctgggtacctcatactacactgatgacggtaacactgttcaatcattcccagcagatcttgatcttctagagcaaataaaggtcaaatatgaggccctacctggatgggaggaagacatttcctcaatacgagactacagtgatctcccagaaactgctcgtcgctatgtggagaggatagaggaactggtcggcattccagtccactacattggtgtcgggcctggacgtgacgccctcatatacaaataatgacccgtcttgtttctgagatccctcgcttagttcaaattgttttggttactaataaaacaggctgattgtggagggtgtaaaattcatcatcctttgctaaatgatttcagcttagcttcacgaaggatctctgtataaattgccttttgtatctattatttttactggccacctaaatttaagcatctcttt

SEQ ID NO: 10201 - DNA, 611 bp, Sorghum bicolor
  Clone ID: SORBI-28MAY03-CLUS67892_1
caagagcgatgtgtacagctttggagtagtactcctagaaatgttgtcaggacgccgcgcactggacaagaaccgcccaaatggggagcacaacctggtggagtgggctaggccatacctgagaagtaaacggcgcatatttcgcatcctggacccccggctgggtgggcagtactcccttgctagggcgcagaaggctgcagcgctcgcattgcaatgcctctcagtggagtccaggcacaggcccagcatggacgaggtggtaacagccttggaacagctccaggacacgaaggaaggtggtaaccatcacctacagaagaggccaagcagccggagcatggacaacaatggtgtcaaagcggcagtgaaggggaagcctgctccttctgtaaaaccagtttgagtgagtggattatatgctagagtatttttttccccttttgtaggtgtaggtaatatagtaggttcatagagggatttgtaaagaggctgagttctggatgttttgtgtctatcatgtagtctttacattttcatgtctttgtaaagcacagtatgtaaatacataattgcatccagtccagagtgttatgaaatttgttcaagcc

SEQ ID NO: 10202 - DNA, 753 bp, Sorghum bicolor
  Clone ID: SORBI-28MAY03-CLUS65004_1
tcagtattgttaggctggaaaagatactgcatttgcttgctgggagtgccaagctgcctggcgggatggataagatgaaagccatgcagtcattgtcatgcgctggtaccacaaagagctctgccaacatcgtggaagagttcagtaagcttgataacttgaaggaactggaactgtattactatgcaactgaaacgccaggaaatgagaagcaaatcatgttccccgttgatgggctcaaaactgttaaacaactgtgcatccggtgcacatcaccatcagtaacatttgagccccgtgtactgccaaaggtcgaagcacttgagctgaggtttgagaaaggccgtgctgatgaatcgagtggcgtgtctggcttagggcatctgtcgagcctgaagcatttggtcctcgagtttgagcagcatgatgtgggcgccatggcgacagttgatgctgtgaggaaggctgctgaggggctccttctagatcgtcaatatatcactataaaagtggatgggaaaaagtactaatgcagtgagggttgaggaagagccgaagaggtaagctgcacctaggtctcttaccacaaacagtgcaaggcgtcttctcattgtgtcattcagtttctaagcacttccttgagcatgcgatgcattcatggtttactgaaatgttgatacttgagaatgtttcaattttccgtgctataaactttctatttaattatgtgtaattcatttatattcatggttt

SEQ ID NO: 10203 - DNA, 673 bp, Sorghum bicolor
  Clone ID: SORBI-28MAY03-CLUS65076_1
tcaaagactatgctgaagctcatgctaagctgagcgatcttggttcaaagtttgatcctcctgagggattctcactggacgatgacatgagcactgcacctgcagacgaaaagacggaagaagatatctcttttgcagtggcaccgtcaccagtggctccagaacctgaaccagcagcagaacctacaccagaaccagtagcagcggcaataacaacagcgacagccgatgacaacaacggcgcagctccacagccggagcccttcgtcgctgccaaatactcgtatggaaagagggagctgtcagagtcgatgaagcaaaagatcagagcagagtacgaggggttcggaggcagcccggacaagcccatgcagtccaactacttcctcaacatcatgatcctgatcgcagggctggcgttcttgacgtctctggtcgggaactgagtgcgatatcatcgattcctgaagcctacgactgtccatattttgcaaactccgtaagcatatgaaacatatataaacggcatgcgaccaagtggctagcatcagagctacgtacactgtgtaaacagtttttcacatagcaagtgtttgagaaatagtgacctgactatcagcactctacatatatgatttatttactatgaaacagtgaatgtatagatattccc

SEQ ID NO: 10204 - DNA, 770 bp, Sorghum bicolor
  Clone ID: SORBI-28MAY03-CLUS65213_1
agcgggaaagaaggagctgtacacataccagacgcttgatttttgggaacagatcaaaaccccagggatgtctttgagatgctctgggttatatctttctcagttccgccgtacctctcctcatcttttagcctcaggagacggcaaaagaactgccactattgttggcgatgtgtatatccatccatctgccaaggtgcatcctacttcaaagattggccccaatgtctctatatcagcaaatgcgcgagttggagctggtgccaggcttatcaattgcataattctggatgatgttgaaattatggaaaatgctgttgttatgcattcaattgtggggtggaagtcatccattggaaaatggtcacgtgtacagggcgaaggcgatcacaatgccaaacttggcattactattcttggtgaagcagttgatgttgaagatgaagtagttgtagttaacagcatcgtgctcccaaataaaactctcaatgtcagtgtccaagaggagatcatcctataatagctgtcatttttttttgttttatcccaaataaggtctcagtaccaatcacatagtttatgcttattcgttctcaccttgtaatcttccattagattgatattattagtttgtatctatacccatcttgcagcatgatactgcacaatattgacttgctatgctactttggttagcgagcgcggtgatgtaaaaaatgtacaaacaggtgacaccaattttgttgagaatgactgaatgaacactttac

SEQ ID NO: 10205 - DNA, 625 bp, Sorghum bicolor
  Clone ID: SORBI-28MAY03-CLUS65318_1
ggtcgttttcaaggtcaggcgacagacgttgacattgcaagaaaagagattcgaaatgtcaagatagaaatggttaagctgctggcaagacacattggtaaaccgattgaagagattgctcgcgacatcagacgtcctaaatactttagccccagtgaagctgtggattacggcatcattgacaaggtgatatacaacgagaaaatccaggaagatggcggtgttgtgtcagaactcaaaagatcaaatttgatatagtgttcttttttcacaagtagacacgtcttgtatgtttagtggtcattcacgtgtttgagtattgagtagttaccactcaatcactcattagctggctgtagaggcgtagagcacatatgagtagccaatgcaatgagcaagcatttccttcctccaccatttcaacgccttattgcccttacccaacgggcgcgctgaaagatgaatttttgtaggttgttgggcgttggtgccctgtttgagtgtatgttttagcttgcaggggaagcatatatataaaaaaaaaaaaaatttggcgtgtggtttgttacaatctgggccctcattgtttcagctcagctcatacttgtaacaggctgcaagtagc

SEQ ID NO: 10206 - DNA, 715 bp, Sorghum bicolor
  Clone ID: SORBI-28MAY03-CLUS65781_1
actatcttgctactgggacaaaaggatgtttgcacgcgcgtcactgtgctcctccgttgccagtggtgtctccctccactttcacggtatatgatggaaaggctggatcagacattattgtgtctgaaacagttgactaccccctaaaagctcttgtgttcaccagcaccaacctaaaaacacttgtgagtgttctcagtgaaatatccttttctctgcatgacaatgctactgcatacagcctgctgatttccaacaatggcacaaaggttttcttgtttccacaggtaaaatcttttaaaccttttattccatttatagacaatattattcagcaaccatggtatggaaacacatgaatatctaatatttggttgataaggtgaaaaatctggttactggctgctgtctgtctgcttgggagtgtggcggctactttgtttaccaaaccaagtttgattttgataatgcttctgagactgaaatctccaacagaatgggctctgtttcactcgaggatagcacctttgaagatctgaaacatctttgttgtgctattgcagacaatcttcttatgtaagcccatgcagaatgttaatgcatgataaatagtctctgttaaccgcttcatatgtttttaagttcagctgattgcccatatacagtgtggaaactgtcttacattcggattgatcaataaagcttgcggtttttt

SEQ ID NO: 10207 - DNA, 781 bp, Sorghum bicolor
  Clone ID: SORBI-28MAY03-CLUS6511_1
gtgcggcatatagggacactgcagatgctcttctgccgtggtggaggatgagaagaaacctgaagatgcaccacagtttgaggttgagaaggacaaggacggtgcagagaatgaagaggaggaaaaggaacctgaggataaggagatgactttggaggaatatgaaaaggtactggaggaaaaacgaaaagctttacttgcccttaaggctgaggagagaaaagttgaaattgacaaggagctgcagtccatgcaacaattgtcagttaaaaaggatgctgatgaagtgtttatcaagctgggctctgacaaggacttggaaaagaaagaaaatgctgaaagagaagaacgggccaagaagtccctgagcatcaacgaattcttgaagccggctgaaggtgagaggtactataaccccagtagccgtggccgtgggcgcggtaggggtcgtggtgagcgtggggggttccgtggtggttacaatggtagctatcggggaccagctgctgctccagccatcgaagaccaggctcagttccctgccctggcctaagcacagctcggtttactcctgagttcgctcaagatcatgtcactgttgttgagtcctcttgttgctgctgctgctgctatgtcgctcccagcatgtttatcgccgtgccgtgtggtgtatccgtgtgtggtgttgtaggggttacctgcttctgtttttttggtaggattatgtgtccaacatttctcatgtactggtgtgctcgtgattaaaggttttgctcactga

SEQ ID NO: 10208 - DNA, 536 bp, Sorghum bicolor
  unsure (1)..(536): unsure at all n locations
  Clone ID: LIB3476-021-P1-K1-B8
ctctccccggccctctccatcttgccccctcctctccgccatgggggacaagaaagtcgcgtcgggcttggggattagggagggcgagggctcgcgtgttgcctccgaagcggtcacaaaggtagtaccattgacgggctcgggctcgggctcggactcgggctcgggctcggcggaggcatcggcatcggcatcggcggtggccgaggtctccgtccaggcggcgccggcggtggccgaggtccccggcgtggggaacgacccgccatccgcagacgatctgatttcgaaaagactccgagccatacgaaagaagatcaaatatgcgacttccattgaggagatgagtgctgcagtccatgcaacaattgtcagttaaaaaggatgctgatgaagtgtttatcaagctgggctctgacaaggacttgaaaaagaaagaaaatgctgaaagagaagaacgggccaagaagtccctgagcatcaacgaattcttgaagccggctgaaggtgagaggtactataaccncagtagccgt

SEQ ID NO: 10209 - DNA, 891 bp, Sorghum bicolor
  Clone ID: SORBI-28MAY03-CLUS6531_1
gccggccgggtcggggaccgcagcgtgggcggacgcgtagcttcagcagctcgagcacgatggccctcgcgctcgccacgaccccactcacgcacctcgccgttgcgccgctcccgatctccggctcccagtcctcgctgctgctgctcccgcgccgcgcgtcgcacgcccccgtctctctctccctccccctccggtcccgcctcatcgcggccgtcgcgaccaaggaggaacccgagctcggcggcggcggatcaggaggcgacgacggtgcgggagggagcggcggcggcggcggaagcgacccgaaggaaggagggcaggaaggggaaggggaggaagagaagatggagcagggcctgtccttgtcgcagaaactcactctcgcctacgccgcgctcgtcggagccggtggtgtaatgggatatatgaagagtggaagccagaaatccttggctgcaggaggcatatcagccctggttctgtacttcgtccatactcaactcccagtgcgacctgtctttgcatcgtcgatcggtttaggtatagcggctgcgcttctgtcagtgatggggtcgcgcttcaagaagtccgggaagatattcccagctggtgtcgtgtcccttgtatccctggtcatggtcggaggctacttccacgggatccttcgtagctcgcacgcgtgatgcaacccgttgcagtcacaccatctgcgcttcatattacaatctttatcctattttctgtttcatcatgcaatttcactcccttttggtgtcttagaatctcaaggaactgttttctgtttcatttcggtggatgttttgttagtgtacccattctcaagtagtagttcatcttttgtgagtgggtaataaccaaataagcatg

SEQ ID NO: 10210 - DNA, 702 bp, Sorghum bicolor
  unsure (1)..(702): unsure at all n locations
  Clone ID: SORBI-28MAY03-CLUS6838_1
gccggccggnngccgggaaaaaaaaaaaaaaaaaaaaaaaaaaaaaaaaaacccgcgatctcccaatcgtctcgcacctacggcctcaggcgcatcggcctcgcagctgcacagacgccggtgacgaccacggcggcgagatgacggtcttccacttcctcaactgcgccttcctcaccttcggcccccacgtcgtctactactccgccactcccctgtcagagtatgatacaatcggcacttctgtaaaagcagctgctgtttatcttggaactgcacttgtaaagcttgtttgcttggcaacattgctcaaagtacctgagaatgatagctttgatccctatcaggagttaatgaaagtttttattggattcattgatgtagctggactgtattttgctttgacacagttgacccacagaaacatctctcagaatcataagttccaggctgttggtcttggttgggcttttgctgattcagttctgcaccgactggcacctctctggattggggcaagagggcttgaatttacatgggagtacatatctcaaggacttgaaccaaatgctaatcttgtgatgaccctctcccttgctgcattaggatccctgatgtggcttaggaaagaaaagcctaggactttgattccaataatttatgcatgtgccctgctcttggcaacaatgccatctatcacca

SEQ ID NO: 10211 - DNA, 827 bp, Sorghum bicolor
  Clone ID: SORBI-28MAY03-CLUS6863_1
acgcgccgctcgtctcgtgcgctcgcgtacgcaaggcgagagagggagggagtttttttttttttttgctcgaaaaggaaaaacaaaaaaaagcacggaggaggaaaagagatggtggcgggatcgatgaagcacctcgtggaggtggagccggcgaaggaggcggcgggtggggcgccgtcggcggggccgacgtaccgatgcgcggccggtgacaacgccgcgtcgccgcccgccgtgccggggctcgactgctgctgggacatattccgcatgtccgtcgagaagtaccccgacaacaagatgctgggccgccgcgaaattgtcgacgggaaggctggcagctacacatggctgacttacaagcaggtatacgacaccgtgctcaaggttggggctgccatccggagctgtggcgtcggcaagggcggtcggtgcggcatctatggagccaattctcctgagtgggtcatcagtatgcaggcctgcaatgcccatggcatttactgtgttccactgtatgacacgcttggtgctggggcagtagaatttgtattgtgccatgcagaggtacaaattgcttttgttgaggaaaagaaagttggagagatgctcaagacatttcccaacgcgaccaaatatttgaagacaattgttagcttcggtaaggttgatcccgtgcacaaggaaaaagttgaacagaatggcttgtccatctactcatgggaagagtttctgcaactgggaggtgaagagaagtttgaacttccacccaaggaaaaggatgacatatgcacaataatgtacaccagtgggacaactggtga

SEQ ID NO: 10212 - DNA, 762 bp, Sorghum bicolor
  Clone ID: SORBI-28MAY03-CLUS6830_1
tttcactctatccacctgaactgcaagcagacaatatgctaaaatcctatactaaaaatagtttatacacaaaatagcagctgcctatgtaccaatatttgtgtccagtgaatgaaattgtgcagctgcttgccttctggaatggtcatcttaatctcagttggctgtagggagggactataggtggatcatctcgtgcctcagccaacgacagggacaacagcgatggccattaagttgtgcggtgccaggaagtattttgtgaagccaaagtcttttgtttatctactatggctaatagcaacgaccagcaagttcgaaggccgtgcatgtgtcatgctgggtattttggttgtgcgtgggctgctgcatatttagattgtgaagcaacatatgcagattccatcgcgcttcaagacatgtgtgctagttgtggagtaccagattgtttattccctgcaggcatgcttatgtagaagtgggtgcatactgctatcaaactacagcttgctacttatagacttcctgggtcaaggaaggtcgattttttggctatcttgtgcagaagtggttgtgtactgccatgagatagcagctagctagctgaagttgtgttgggagatagatagcacctagtcgtgaggtagcacaaaacttgtgctgccggttaggtatctaactagaaggcactaattattatataattttgtatgaatgaacaacttgaatgatgttctaagattatataatatttattacttt

SEQ ID NO: 10213 - DNA, 355 bp, Sorghum bicolor
  Clone ID: LIB3476-025-P1-K1-A5
gttggctgttgctgcttcacttggttctctggtttgtgaagtgaccttgaagtcttggacaactactgtgactcagctagctgctgggagggactataggtggatcatctcgtgcctcagccaacgacagggacaacagcgatggccattaagttgtgcggtgccaggaagtattttgtgaagccaaagtcttttgtttatctactatggctaatagcaacgaccagcaagttcgaaggccgtgcatgtgtcatgctgggtattttggttgtgcgtgggctgctgcatatttagattgtgaaagcacatatgcagattccatcgcgcttcaagacatgtgtgctagttgtggagt

SEQ ID NO: 10214 - DNA, 676 bp, Sorghum bicolor
  Clone ID: SORBI-28MAY03-CLUS68650_1
gttcttccgctcccggcctctagttcttcttcctccagaagtccagagtgatggccaaatgctactcagattggcccccgattccgcctctccatccatcgcgaagaacgccgccgcaatcccacgcctccccgtgcacgatcaggcggcagcccgcgaccttcgtgctccactgctccaggtcctgcgctcctcctctcctcgagcccaagaacctgcgcgccgatgagttcgaggccgtgccgacgacgccggtgtcggcgctgcctgacgccgtcccgaagctggggatatccaacaagttcatccgaggcctctgcggcgacccgcagaccgagcagcttgccttcgagggctacaggagggcgctgctgcagccggagttccggttggagaagaagacggccaacgcgctgaccctgcagctgctcagggagaagcagtggggctcgctggagctgctggtcgaggacttcagggcgtacggcgtgctcccggagaagcggacgtgcgcgcgcctcgtcgcctgctgcatcagggcgaggaggttcggcctcgccgacgccgtgctcgaagtcgtcgaggtgaagaagggagcccccgctaccatggccttcggcgcggccatgcaggcgtacaacaagctgcacatgtactcgagcacggtgctgctgta

SEQ ID NO: 10215 - DNA, 693 bp, Sorghum bicolor
  Clone ID: SORBI-28MAY03-CLUS68737_1
ttgaagaaacaatagttccagaaattgatccagaagcaatcaagttcaaggaaatgcctgaggcccagaagaaggctgccttagagaatgatatgcctgttggtccaatgccacttccgcgcgcggaagggcatattagttatggtggtgcattgaggcctggagaaggtgatgctattgcacagtatgttcagcaagggaagcgtatcccacgacgtggtgaagttggtctgtctgcagaagaaattcagaagtttgaggatttggggtatgtgatgagtggcagtaggcaccaaaggatgaatgctatccgtatcaggaaggaaaaccaggtttacagtgctgaggataagagggcgttggccatgtttaactacgaggagaagtcgaagcgggagcacaaggttatggctgatttgcagcgcttggtgcagagaaccattggccacgatgtgggaccttcgcatgatccatttgctactacggatggttgagtaatgatttctggatcaactaatcaactatatcgttctggatcaactaatcaactatatcgtgtgtgctttacctgtttgtgtttccttctctctgttgtaattagtgatgttgaacttgcctagttatgctgcaaatttcttatgagatattgcatgagaaccaaatttaaaaggagcgtactgttagcttgtatct

SEQ ID NO: 10216 - DNA, 583 bp, Sorghum bicolor
  Clone ID: SORBI-28MAY03-CLUS67077_1
gcacgaggactcacagcccacttgatcatcgcccgtggcgtaggcgcgtagctaaagtgacattgcgctcctcgtcagctgcagcctgcagagcgcaaccgatcacacgcgagtcctgatcgatcgagctccaaagaacccggccggatcgtccctagctagctctgcactgcaccccgtccgatcccagcggccagccagcccggccgaccatgtcggccagcggcggcgagacgacgacgacgacgacactgctgggctccgtcgtcgtcggtgacgcgcagcaggcgccgttcccgtggaagctggtgctgctgtgcgcggcgctggcgtggtgcgccgtgcgcgcgctggagtgggcgtggtggcggccgcggcgcctcgcccgggtgctgcggtcgcagggcctccgcggcacggcgtaccgctccctcgcgggcgacgcgccgctgacggagcagctcaacagggaggccacgtccaggcccttgccgctgggatgccacgacgtcgcgcccagggccatgcccttgttccatcagaccatgaaggagcacggcaagacgtcgatcacctggttcgg

SEQ ID NO: 10217 - DNA, 739 bp, Sorghum bicolor
  Clone ID: SORBI-28MAY03-CLUS67102_1
ccggcgcgcacaccgtgggccgcggccactgctcctccttcagcgaccgtctgccgccgaacgcggacgacgacaccatggacccggcgttccggcggaagctggcggccaagtgcgccagcgaccccagcgggaacgtggtcacccaggtgctggacgtgcgcacgcccgacgccttcgacaacaagtactacttcgacctcatcgccaagcaggggctgttcaagtcggaccagggcctcatcaaccacccggacaccatgcgcaccgccacacgcttcgcgctcaaccaggccgccttcttcgaacagttcgccaggtccttcgtcaagatgagccagatggacgtgctcaccggcaccgccggagagatccgcctcaactgctccgtgcccaatatcgtcgtctcatcatcagcccacaccgccgccggcgacggcgacgaggggcgagcggccgacgagtgaatgatgattagctgtacgtaactcactgtaacaggtcatgggccatggcgtgtctcttctccatcagtgttgtcaaactgtcagatagcttagcaaccatgcgtgctgctgtcatggactcatgcatggtcgtcatatagcttttcaaataagccaggcctatatatagttgagtgagttttgcttcttctgttttttctagttttcgtggtttgctactttggccttgtttagttcctaaaaaattttgcaaatttttccagattctcgtc

SEQ ID NO: 10218 - DNA, 679 bp, Sorghum bicolor
  Clone ID: SORBI-28MAY03-CLUS67402_1
ccaccgcggcgcagatggccgaggtggcggagggcctgtacagctccggcaagccgttcctgtgggtcgttagggcgtcggagacgtccaagatccctgacaagttcgccgacaaggcgaacgagagaggcctcgttgcgacgtggagcgcgcagctggaggtgctagcgcacccggccgttgggtgcttcgtgacgcattgcgggtggaactcgacgacggagggactgagcgccggcgtgcccatggtggcgatgccgcagtggtcggatcagcccgtgaacgccaagtacatcgaggatgtgtggagagtgggcgtgcgggtgcggccagacaaggatggtgtggtcaggaaggaggaggtggagagatgtgtgagggaggtgatggatggcgacaggagcatggagtatcagcaaaatgcagctgagtggaaggagaaggctaggaaggccatgagtgcaggtggcagctcagataacaacatcaaggagtttcttggcaagctaggactgaaagtctaaatgagttgcttgggtagaaatcttcgaatcctttggttctgcatttgttactttccctagcgagcactgtgcctctccttaaaactccatctgctattaaataatgtgcatattttaaatgtaataataaatcgtggaagatgttggaagcctct

SEQ ID NO: 10219 - DNA, 1002 bp, Sorghum bicolor
  Clone ID: SORBI-28MAY03-CLUS67_1
gcaaaggttggcatgggaggacccaaacagccggctgcagagctggctgtgtggacacacttctgaatcctgcaggaatggcgccccagtttgcagcagcaggattcctcaccggccttcttgctcttgcaacatttgcaagctgcaacactgaaggtgacatactgtacaagcaaaggttggcatgggaggacccaaacaacgtgctgcagagctggaattcgacgcttgccaatccctgcacctggttccatgtcacctgcaacaacaataactctgtcatccgcgtggatttgggcaatgcaggcatctccggtcctctgcttccagatcttgcagaaattcagaacctccagtacatcgagctgtatggcaacggcctgaacggttcgattccagaaacactaggcaacctgactaatctcatcagcttggatctctgggacaaccttcttaccggcgaaatcccaactacgcttggttctgtcagcacgctgcgatatctgaggttgtaccaaaacaacctgacagggcctataccatcatcgtttggcaacctgactagccttctggaattgaagcttcaagagaattcgttgagcggcgctattccggcctcccttggcaacatcaaagcattacaattcttgagattaaacgataatatgctgactggcacggttccatcggaagtcctctcccttgtcatttctggcaacctgactgagctaaacactgctagaaacaacctggatggcactgggacatcgtctggactgagagttactgcaattatccaggatgcgctgaagactgcatgatggcttgataagtcctaggatcaaggctttgttttaatttgctttatgcaatcgctgaaaataaatgaataattccgatggggtgcattggtctagacatcttgcagtagaatatgtttgtcgagtttagctcgatttgtatggaaataatggataatgtgagttagacatctatttctct

SEQ ID NO: 10220 - DNA, 721 bp, Sorghum bicolor
  Clone ID: SORBI-28MAY03-CLUS67439_1
gcacgagggcctattctgggtaggtgttgttgataatgttgactttgagaacaaaggaactgcgctgaacctccctggaatccctattgcaattggattgtatggttattgctactcagggcatggggtgttcccacacagccacgcttcgttcagcctccgtggtctcttccctcctcattgctctatctgtacccttctttggacttgtgatggccttggttggttctttactcacgatgcttgtgacctatattctaccttgtgcgtgctttttagcaatcctgaggagaaaagtgagctggcaccaggtagcagcgtgctcattcatcatcatggtcggggtttgctgtgcatgtgtggggacatactcatctctgtcaaagataatccagaactacacatgagcgcacatgatatatacagctgttcctgcaaatccaaatttagttactcctacatatacagtaaccgaaccaccccattactcatgtgctcacactatgagccatacaagacaaaaattttgcccagcaaattagtcaagttgatgtaatgccagcatattagttaagtttatgtataataaatttgtgtgatgtcaatgcttgcatgttaatggatcaacacaaataagtttgtagcaaggatttaaggttgtatcatgcatatatgtaacaagacattatttgtgaacacaagatcaggtggattttgtgct

SEQ ID NO: 10221 - DNA, 730 bp, Sorghum bicolor
  Clone ID: SORBI-28MAY03-CLUS69154_1
cggtggatgtgtgaaggaggaggcccggctgcagacggcgacgatgatcaagcaggcgaggacaatggcggacggcaagaagctgggcgacgcgctggacaaactagtggaggcgcagaacgcgctgggggacgtgccggtggcggatccgtacgacgacccgctgctggacgcgctgaggaaggagctgcaggagctgcagaagctgatgaagtcgccggcggtgtacgagcagcagggccggccgtacgccatgtcgtcggagacgtcgcacgaccggcagcggttcgcagcgaggggcgacatggagaagaacaggctgttcgcgacgccgcgcatggacaagtacctggagcaggccaagaagttcgacgaggacccggcggcgccgctgccgccggcggatgtggacgagaaagaggaggtcgccgccaacccgctcgcgccgttggctgggcccatcaccttctacatccaggccgccgtccaggcactgcaggccattgagaagctcatcaacaatggagccaaggcagtgtagctgtaacggacacgcagatgcagtcgtgtcgtgtttactataattttacagacatccatcgtcatctcttctttgcgtgtattgtgggtttttttttcaacatcaccttgctgccatgtatgcagtcgaataataatttactcttcctggaaatttctggactcagaaataaaagttcttgtctatctg

SEQ ID NO: 10222 - DNA, 664 bp, Sorghum bicolor
  Clone ID: SORBI-28MAY03-CLUS69809_1
aatcccaagaacacaaaactctctctctctctacacaaatctcctctctgaatacaaacaagggatcgggagtagtgcagcccacagctcattaatctcgctataggctagcagctaaccacaagaaaagatcccgattgctttcagaggcgccggccatgtccatgtccatgtcttcctcccccgccgacctctcccgcgtcctcccccgcgtcctcatcgtctcccgccgcactgtccgcaagaacaagttcgtcgacttcgtcggtgagtaccacctggacctcatcgtgggctacggcgcggtgccggtgatcgtgccgcgcgtggcgggggtgcacgcgctgctggactcgttcgagcccatccacggcgtgctcctctgcgagggcgaggacatcgacccgtccctctacgactcctcctccgacgccgacgccgtgtcgctctcgccggagcagctggaggccgtgcggcgcctgcacccgagcgacgcggccatcgaccacgagaaggactcgatcgagctccgcctcgcgcgccgctgcctggagcgcaacatcccctacctgggcatctgccggggctcgcaggtgctcaacgtcgcctgcggcggctcgctgtaccaagacgtggagcacgagctggcggtcgggcccggcgc

SEQ ID NO: 10223 - DNA, 862 bp, Sorghum bicolor
  Clone ID: SORBI-28MAY03-CLUS6995_1
gaactcataaatgactctgtgccacccaaggatcctgaagagggaggtgaaaattgtgaaggcaatgctgattcagaaagcctttctgacatcgacgatgcagaggttgattggtaccttcacaatgaggaagaaaaacagtataaaaagattatctgggaggaaatgaacaaagaataccttgaggaacaagcagccaaggaagctttggcagctgaattggcagctagagggattgttgtggaagagggaaagaagaaaaaacgaagacgtaatgaagacaccaagagctcgacacctgctgaaacaccggcagaagccacatacaacatgctgaaacggaagggacttggttcaaagatcaatgagggagctgttggcgaattgtacaagactaaagatgaagttggcagcgcaagtaaggaagaagagatggactttgacgcactgtttgggccggacaatgctgatggtgaaactgttgatgatggttacaatgggggctataacgacgatggcgtagaagcctacaatggcattgacgatgattttgatttctaggatgtagcagcatttgccgaacggcaaagctgaccagcacgggcacgattcatcatgtgtacattatatagtttcttttgttttggctaagtttcaactattattacggagctattggatagtcaacatagttttgcttgtataataataatatttgaaactaggttctgcctggttgtagttgtaactaagtcctgtgtgctcaagctcctaaaagggcattgtagatccaccccaaaagattgcaagcggtgatgtaacatttgtattattaataataaaggaactgagccgtcttaga

SEQ ID NO: 10224 - DNA, 726 bp, Sorghum bicolor
  Clone ID: SORBI-28MAY03-CLUS69967_1
ttggtttccttcctcaacaactccaagggagccaccgttggagatgctgtcaagaaccttggcttgtcggccccgcccccccgccgccccccgctgcccactcggttgcccgcctcaacaactccaagggagccgccgttggagatgctgtcaagacccttggcttgttgggccttttcacccgcggccttcctcttcgcattctgatggtcggtaccctgactggagctcagtgggtgatctatgattccttcaaagttatgattggactgccaacgactggtggagcgcctgctcctactactgtcccactggaaggactgggagagctaaaagcctcagcctgaagttctaaactttggcagagaatatacttcttccgtccatagcgtatccatagcgtatattggtgactgcaacagcacctcaaccccacctccgatcccaccacaaaggattgtttcaagctggtgaattttttgaataaaatgagttattactgtatgttctgaatacagaatacgacaggcagaagactagaagttactagacataaaagttggatgtaatttttgggttcgtactgaattggctctcctagacgttcatttgattgattgcactaaattgtacatgtgctctaatgtgaatgtattcatattgcgcacacaccataccatgtactcgatggtttgtctctgtggaatgatgctgattaaacaaact

SEQ ID NO: 10225 - DNA, 792 bp, Sorghum bicolor
  Clone ID: SORBI-28MAY03-CLUS6999_1
gttcttcaagaattcagtgcttacaaaaacatatcacatgattgatgaggatgaaccaattctggagaaagccattggtactgacattgaatggtaccctgggaagtgcttgacacaaaaggtgctaaaaaggaagccacggaaggggtcaaagaacactaaacctatcacaaaaactgaagattgtgagagcttcttcaacttcttcagtccacctcaggtccctgatgacgatgaggaaattgatgaggatacagctgaacagttgcagaaccaaatggagcaagattatgatattggatctaccatcagagacaagattatcccacatgctgtctcgtggttcactggagaggctgctcaagatgaggactttgaagttatggatggtgaggatgacgatgacgaagatggtgatgatgacgaagaagacgaagacgacgaggatgaagatgatgatgattatgacacaaagaagaccaagggaactgctggaggggaagggcagcagggcgaacgacctgccgagtgcaagcagcagtaaggtggtgcgcatcgaatattggcaggcattggttgtggagcacttagtttggttctgcttgatgcaatgtcattgagttggttttgtggagcccttgagggggcacttgttggttttatggaattggcggggggatttttctgggacatggtgttatatgtggtagttttgtcagttgctgtattgggtattcagatattatatatgtggtcttcttatgcttggagtgaagatggttaccaccctgt

SEQ ID NO: 10226 - DNA, 984 bp, Sorghum bicolor
  Clone ID: SORBI-28MAY03-CLUS67938_1
tttcaaaactctattattggtacagtttatacattgccaactgtgctgaattttcctcaccatgtaaacaaagcacattattttcagagctaatgttcatgtgaggactactaggactaggcaagtttaaattttcaagcaaaaggagcaagaaaaagccaaagccttttggcctataacccatccttgcaagttgtccgtccagccagtcacatagataagggccaattccacggtcccctccaattgcttgcttcagacttcagaggccagcgctctctctgtctccccgggaaagccatggaggaagagcagagcccgaggcttggccgggagccggcgaccgagcccagtccttcgctggaatggccggagccggaatgtaagaacgacgacggtgtgaaagacccagaagacccggagagcaccggcggcggcggtgacggcaacggcatcagctccctggagcagccgctgctcaagcggagcaccaccctgacggccagccacctcgccatcgtcggcgccaaggtctcccacatcgagagcctcgactacgagatcatcgagaacgatctgttcaagcacgactggcgcagccggtccaacgtggaggtgctgcagtacatcttcctcaagtgggccatggcgttcctcgtcggcctcctcaccggcgtcatcgcgtccctcatcaacctcgccatcgagaacatctccggcctcaagatgcaacacatggtcaacctcgtccgcgagaagcgctactgggcgggcttcctctacttcgccggcgtcaacttcgcgctcaccttcgtctccgccgtgctctgcgtcgtcttcgcccccaccgccgctggccctggcatccccgagatcaaggcttacctcaacggcgtcgacacgcccaacatgttcggcgcgccgcagctcatcgtcaagatcattggcagcatcggcgccgtgtcgtcgggaatggatctcggc

SEQ ID NO: 10227 - DNA, 645 bp, Sorghum bicolor
  Clone ID: SORBI-28MAY03-CLUS67966_1
cggccccccgcatcccacggccggggcggggttatacgcgccgccgccgttctcggacctggcggcgtgccgcgcggccccgccgtccggccccaggccccgggcccgccccgcggccccgagcggctccgcccgggcccccccgccgcccgccccggcgccggcgtgcggcggcggcgagcggcctgaggtgcagagccagcccaagatcgccgagtgggagcgcacgttcgccggcgccggtgccggtccggggatcaacccggccggctcgatgctggggcttggcgggcatcatcagctcggcccggcggcggtgggggtggggcagctgcccgccggcgacccgctgctgcaggacatcctcacgtactggggcaaaccgtactgagaccgaggaaggacggtggctagccgcaattgtcgtcatcgggatcagtggcccgagccgccggcgatgcggccgtgtcgagccctgatcgtggagctagcaggactacaggaccattgcttattgccgcctcggccacgcgagtcgctggaggctgtgtgttcgcctttgatttggacatttggtgctggaatttttgtgttcttatgttagtactagtacatactagaccgagtatatagttttgcttatat

SEQ ID NO: 10228 - DNA, 879 bp, Sorghum bicolor
  Clone ID: SORBI-28MAY03-CLUS6813_1
gttgaatctccatctttctttctagtattatcgaatcatcaaatcttacaagagcagcgaaactctctcgtaagaaaaaaaaaaaccaagaagaatagcatctctctacaacccatttcaatttccatacaaaccaatccagcctgaggaaggcaggaacccaccgaattaatcgatccacatgacgcgacgcgaactccccaaatcacagcgcgatggtgaggcgctcggcgtccgtcgtgctgccgccgagaccgagccaggaggaggccgccggctgcttcgtcttctccgcctcctccgcgggggacggagacgggcgggtgtagggcgcgcgctccacgaggcggtccttgcgtttggccaggaaccgctgcagcgacgccttcctggcgatgggcaggtcgtcgcgcggagccggagccggagccggggccggggccgggaccgccacgcgctcggcgccgccggctgcgaggcgcatgacctcggccgccttctccgcggggaagtcctcgaacacaccaccctgccgccgtagaagatggtgagcggcgccgccgtggaggcgggcccagccatctcctcgcccctcgcggcggcggccggggtcggctcctgctcggcgccgacgtccgcgccgggcatgaggctcagcgtcgtggccggggcgcgagcggcaggggctgcggcggccgccatctgctgctcggccttgacgtactggctcagcaccccgcaggccagcgcgaacctccggctcttgccctccgctgccgccatggccatgggaatcgagacgactgcttcgcgcttgcttctcctccttctctttgccttggcttgtgttgctgtttgctcttgctcttggtggtgtgt

SEQ ID NO: 10229 - DNA, 746 bp, Sorghum bicolor
  Clone ID: SORBI-28MAY03-CLUS68158_1
ctggaactccgcccctccctcgtgtgcgtgctacctgtccccccatcgttccgcctccctctcgccgctcgccgcatcgctttttagggttttctcgctcctcctgctcccctctaacgcacgcgcgtcgacgagcccgtcccggcagcagcgcaccagtccgccgccgacactcaccacaaggagtgatggggaacagcgacgccgcatcgcccgcatcggcggccgccgcgcgcgacgccaagaagaagagggggaaccgctcggcggcgaagctgaagcagagcaagcgcgagacgcgccgcgggcagtttctgtccaaggggcaaggcaacgatggcaatgatgccaaggttgcaacttcaccaacaggagcaggttcaaatgctggctcacccatccttgcttccccgcaccctccacttcctcgtcgccgggttgattccagatcaaggggtagtgatccggaggacagggaggaggctggtgctgctggccttgaggtagacggcagtggccttgactccccaggctcagacaagtcccaaggtggtgactgccatcagaggaaagggttctctggcaatggcggtggccgcagcctcagcagtggaagcagtgtttggtccagctcaaggagtgtgagtgatgctgaggaggataccggcggccctgaggatgagagtgaagtcttcgatgattgggaaatggctgctgatgcgctttatatcgatgacagttcttgt

SEQ ID NO: 10230 - DNA, 659 bp, Sorghum bicolor
  Clone ID: SORBI-28MAY03-CLUS68227_1
actgggttgcgttgcgtccgtcgtctgcgtctctctctctctctcactccgcccgtccgtctgcccgtcgtcaccagcctcctccctcgcgcccaccgccgggatccggcgcccccccgtctgcgccagcctcggtctagatttctgagaaaatggcgagaagtgcaagagctaggaggcatgtggctcgtcagctcaagtccacccatcccattccttcgtaccgatggaaggcaaaggcgatgaaaaaatccaaccgaaagcaagcgtcgccagccttgcaaaagatggactgggaagatgccaattgctctgtgtgcatggaatacccacataacgctgtgctcatcctctgttcatcccatgataagggctgccgtccttacatgtgtggaactagctaccgccactcgaattgcttggatcagttcaagaaagcctacaccaagggggcattgcttcaggaagttcctgcaaatagcattggcactaatctggattcagcgcaattgactgcagaaaaaactgagtccatggaccttgcatgtccattgtgtcgtggcaaggtgaaagggtggacagtggtagaaccagctcgaagctacctcaatggaaaaaggagaacatgcatgcaggatggttgctcatttgtggggacc

SEQ ID NO: 10231 - DNA, 778 bp, Sorghum bicolor
  Clone ID: SORBI-28MAY03-CLUS6826_1
attttccaagtggaaatttgcgtttatatcgatgaatcggccagactacctccaggattcagatgttatatctactcgctttcagaggagagaggtctatggagcttgggagcaatatcttgggatggagcacactgatactgcaccaaaaagggcttatacagtgaatcagaaccgtcactcatacgagaagccagtcaaaatttacaattgaaatttctaactggtctggcctcatggtgaggtaccccatatgagaggagcaaccaaaaaggcaggataaggaatttgtactgtcagggggaaacctcatagttgtcaaccattcgggccatgaccatctattccagtgctacaggccagccgctgtcatctcatctgtagcagccagatcccacagcaatgatttttttttcaagattttccttctttgcccccgggcgatggtgctagagcattgatgtccgtttcggttgggtacaagggccagatattgcttcattcttagagcaaagttgggtacataagattttggtaggaggcgtgtatacaggcaggcggtatatgttgtcatgtactgctgttaatgtagtgacagtggttgacttgtaaattggttccagtttccagcgcatgtctgaaaaaggagagtaattttgggtcctttcagaaacatgcaatatttgacttcttgttgcaagaaactacaacttgctcaaggccctactgcttcgattatcactaaagcaagagaaaaaattgtaccttttatttttgc

SEQ ID NO: 10232 - DNA, 1503 bp, Sorghum bicolor
  Clone ID: SORBI-28MAY03-CLUS7066_1
gcacgaggatcagaagcaatcatcagctatttccatatgcagcttcagatgagaaacaaacccaattatcagaggacaaaattccaagtcaagatcaggcaggaaaagagggcaacagaatagaaacacaaggagttgaaaagcacctgaaaaatgcttcccagctttcacacaatggtggttcagattcacttgtggtgtgctgtgaggatgttttgtttttgttatccctggcatcattgattcagggaagcagcaagcatctacagaagacgaaacttacaaaaccttgttgctggtcagcagttttcaagaatatggatggcaaaatttgtgggttaatattagcttatcagactggcattatagaagtgaggtctgtgccagatctggctattgttgctgagagctccttgatgtcattattgagatggagttacaagacaggcatggataaatcagcgagctcctcaaatggacaaataactttggtaaatggatctgaatttgcaattatctctcttatggcctcagagaatgacttcaggattccagaatctctgccatgccttcatgacaaagtacttgcagctgctgctgaagcagctattagtttctcaactgatcagagaagaaagcagaatcctgcagcagggattattggtggcttcattaaaggaatgaaaggcaaggctgaagaaaatgcaaaaatgagagaaagtttgactatggaaactccaagccaacagttggagtcaattttcttgaaagaaccatttgctgaactttcaatacccgatcttgatgatccgatagaagaattgtcaatcgatgacatcgagattgacgatgaagtacccatagccccggcaccagcagcatcctctacatcccaatggaataagagaacagcagtagaggaggagagagcgaagctgtttgaagggtcaagcaatgttgataaaccgagaatgagaactccacaggaaattctaaccaaatataagtttggtggggacgcagcagcagctgctgctcatgcgaaagataagctgatgcagaggcaggagaaactggagagaataagccaacaaaccgccgagcttcagcatggagcggaaaactttgcttccctggcacaggagcttgcgaaaacaatggagaacaagaagtggtggaagctataatctggttctgtacgtatgttgttggacactcatacccattgcatgccatccgtcgggggctgtgtacagtagtatgacttgcaagtgcagtttgcagaggtttcctcctctgttacgaatcgggtagctagtttagcttaggaacgttgtgatgttttgtgtaccgtgtcacacaccagcattattaccatgtatgtaataatccttttgtgtccgtattaagcgtgcgtcccgtatccacttggtcattctttttggtttttggtgatgtatatctatatctataccttaataataaaggcaaaatttcagcctc

SEQ ID NO: 10233 - DNA, 878 bp, Sorghum bicolor
  Clone ID: SORBI-28MAY03-CLUS7077_1
tctagagccgaccccccacacattcatttcgctccccagccgtacgaactcgcagatcggagaaaccgaggcgcccgcggctttgctttccttccttccctgccccgttgacgagagaagtttctggagtgttcgagtcgagcagggttccgatggcgctgcagtggatgatcctggcttgcgtggtggcggtggaggcggcggtggctgcgctggtcacgctcccggtgccccgcgccgtgcggggccagatcgtcgcgctcacgtccttgttcctgcagcccctctccaccgtgatacccttcgccgccttccagctcctcgatatctactggaagaaggagcacaggctgatgtgcaccgcggagatttgcactgccgaagagcgcattcgcttcgagaaatctatgtttaaagctcagaggaatgtcatcctttgtgtttcagcatgcctcctttactggtgcatttatcgcatagtaaaattcaacaaggatattaaggcattggaagagaccgagaagcgcctcaaggaagagtagatctattgtgttttaaggtggctgttgtggtgctcctggccttcagaagatattgttatgcgggtggctgttgtggtgctcctgaccttcagaagatattgttaaatgtcatagttcgtaggattttctggtgtatagtgttcttgcagcaaagaagagaatgttataatgtttcggcgaacttgtgaagtatgagtcttattttaagaggtcgtttctttaacatatggtgacggttttgttattgcgatcatttttagcatcggtcaattatcaaacagtttaaatgttttctggaaaaaaaaaaaaaaaaaaaaaaaaaaagccccctagggc

SEQ ID NO: 10234 - DNA, 581 bp, Sorghum bicolor
  Clone ID: SORBI-28MAY03-CLUS71089_1
gtctctccattggagtctaagctgcttgcctccacgactgctctgctcctactgtcaaacttacagtcgctttgctatggctgccatcgaggatgatcaagcagcagggtccgcggtgccggcagtggcactgagctccggcaagccgatgccgcggataggcctcggcacggcatccttcccgctcgggaacgccggggatcgcccagtcgtacgggaggccgtcctccgcgccctggacgccggctaccgccacttcgacacatccgcggtgtacggcacggagcgcgcgatcggcgacgccgtggcggaggccgtgagtgctgggacgctcgcctcccgggacgatgtctacatcacctccaagctctggatcgcggacgcgcaccctggacacgttctgccggcgctcaggaagaccctccagaatctgcagatggagtatgtggacctgtacctgatccacttcccggtgagcatgcggctgccggaggcggaaggaggggcgggagcgggaccggtgctggcaaaggaaaacctggtggagatggacatgaagggtgtgtgggaggagatggagg

SEQ ID NO: 10235 - DNA, 603 bp, Sorghum bicolor
  Clone ID: SORBI-28MAY03-CLUS70907_1
tggcggactccagtcgtccctacaatcttcttgcgaacacacactcgggtcactctgcagcttcaaccagcagccatggcgcaccggccggacgccgcggcgccgctgctcgccaagcccgacgccgacgcgacgcctcctccgccgccgaagcgcaacaagtaccccttcttctgcgccgtgctcgcctccatgacctccgtgctcatgggctacaacgtggcggtgacgagcggcgcgcagatcttcatggcggaggacctcggggtgagcgacgcgcagatcgaggtgctctcgggggtcatcaacatctactccctcgtcggcgcgctgctggccggctggacctccgaccgcctcggccgccgcctcaccatcgtgctcgccaacgccttcttcctcgtcggcccgctcgccatggcgctcgcccgcggctacgccttgctcatggtcggccgcttcgtcgccggcgtcggcgtcggctacgcgctcgtcatcgcccccgtctacgccgccgagatcgcgccgccgtcttcccgcggcctcctcacctcacttcctgagatttttatcaacaccggggtgatgctgagctacgtgtcg

SEQ ID NO: 10236 - DNA, 844 bp, Sorghum bicolor
  Clone ID: SORBI-28MAY03-CLUS71136_1
cttcatgtgcttgggggctccatccaaagcattggagtgatgatcggtggggctatcatctggtacaagcctgagtggaagatcattgatctcatctgcaccctcatcttctcggtgattgtgctgttcaccacaatcaggatgttgcgcaacatccttgaagtcctgatggagagcacaccccgcgagatcgacgccaccaggctgcagagggggctctgcgagatggaaggggtggttgccgtccatgagctgcatatctgggccatcacagtggggaaggtgctcctggcttgccatgtgacaatcgcccgggaagcagatgctgatcagatcctcgacaaagtaattgggtacatcaagacggagtacaacatcagccatgtgaccattcaggtcgagcgtgaataggggattgtcttttggctgtcaggaggcataaatggcgtcacgtcttcactggttatcttatttgtgtcggttaaaactagttttttgcacctgggaagttcatcagggattcgagctttgatgctgggtagtgtcatctattactagtctattagtcggaggaattatttgggtggtggtaggcgtcagtcggtgcataaacatggatgaaattttcagtcatgctgttgacagcattgtggttcatcgaactgcatctgtagtttagtacgctgtgtcatcaccttttgtgtaaggtaacgtttctgtggtatggaagatgtgaagttcgtgattggcctgttaccctttgttctgtttgttctgaccatgtttggtcgctgcagttgaatgaacttgtgtgagccgagacagccaagttctctcggttgcc

SEQ ID NO: 10237 - DNA, 1088 bp, Sorghum bicolor
  Clone ID: SORBI-28MAY03-CLUS68895_1
gcacgagggtttttcatatacttcaacaatcttgtgatgtccttgctaaattcaatgcatcaggttcatcttcttccgccctagtagtactttattagtgattcctttatctaaaacaaacagtactctatggggaatgccgctttcaggtccttgcctaccaaaaacaaccgaaggatgcgccaaattaagaacgagatcgagtcaattcttctgggtctaattagtaaaagaatgcaagctatgaaagaaggtgaaagcgccaaagatgacttgctgggcttactgctcgagtcaaacatgagagagacaggcgagaacggccagtccagccaaggaatgacgattgaagatgtcatggaggagtgtaagctgttctactttgcaggaatggagacgacatcagtgctgcttacatggacgatgatcctactaagcatgcacccagaatggcaggaccgtgcaagggaggaagtccttgccctgtttgggaagaaccaaccgggatacgacggcctcagtcgcctcaaaacagtgaccatgattctctacgaggttctccggctgtacccgccggccatcgcgttcagcaggaaaacatacaaggagatggtgatcggggatgtcacataccccgccggcgtgatcgtggagctccccgtgatgttcatccaccacgacgccgacatctggggaagcgatgtgcacgagttcaggccagagaggttcgccgaggggatcgccaaggcgtccaaggataggctagcgttcttcccgttcggctgggggccgcggatttgcatcggccagaactttgctcttctagaggctaagatggcgctgagcatgatcctgcagcgctttcagtttgagctcgcgccgacgtatactcatgcgccgcgccaagtcataatgctgcgcccgatgcacggtgctcagatcaagctcagagcaatatgatgctggcctgtattggacctttttatgttttttttttggcgttctttcatcagagcccaatagtgttgtgtagtattggacctttttatgttttttttcttgatcaacgatgatgaatagtcgggtcc

SEQ ID NO: 10238 - DNA, 603 bp, Sorghum bicolor
  Clone ID: SORBI-28MAY03-CLUS69017_1
tgaggttcgtgaaagtgatctgcgcacgggggtggagactatagctaaaggcctggctgatgcgtctggtgacctaagaaagctgaagtcgtccatgcttactccagagaacacagatcttattaagcagtctattttcacccttatatttaccctgaagaacattgagagtatcagctcggacatctctgggttcactggcgatgagacgacaaggcggaacatcaagcttctgatcaagtctctcagcaggctattgtgattggtttttcagtgcgcaggaaaaaagaaatgatggattgctttgctttgctttgcttgagacggggagttgatgctttgctggtactggtagagtagggtggcaggagtagctaattaatgttccacaagattttgataattctggttccaagtttttaaaaaatcttgaacaatctaaaaactcgatctcggtcaatcacgaaaagagcaggcatgaggagagagatggatctccctccttgttgagctgttgtaagtcatcatcatcataaatagtaggcccattttttcggttgtacatcagctgttggaaatgtgcaaccaagttaagaaatatat

SEQ ID NO: 10239 - DNA, 648 bp, Sorghum bicolor
  Clone ID: SORBI-28MAY03-CLUS6909_1
acagtccatctcacgctcccgcaccctctcctcctcgcccattccttccgcctccctccccgcgccgccggtcgccggagcccagcgactccgcccgcgccgcgctgcgccctgcagaatcctcgatggctgccgccaggggcattaaccagcttctgaagagaactctccacaaccagtctgctggttcatcgctgctttcttcattgaggggaaagcatgaagagtcctctgctggactgagagcattggctcttcttggagttggtgcctctggtcttttgagttttgctacaatagcatctgctgatgaagctgagcatggcttggcagccccagattatccctggccccatgctggcatcatgagctcttatgatcacgcgtcaattcggcgtgggcatcaagtttacacacaagtttgtgcttcttgtcactccatgtccttgatttcgtaccgtgatttggttggggtggcctatactgaggaggaaacaaaggcaatggctgctgagattgaggtggttgatggtcctaacgatgagggtgaaatgttcacccgccctggtaagctgagtgatcgcttcccacagccttatgcgaacgagcaagcagcccgatttgctaatggtggtgcataccccccgg

SEQ ID NO: 10240 - DNA, 681 bp, Sorghum bicolor
  Clone ID: SORBI-28MAY03-CLUS69103_1
tatgttccatcaatataagtatgtaccatgcatgtgcttactataagctagcctgagtgagagtagttaacaacaagcaagtgcctctaccagttaagaaagaaagcttgctagagctaggcaacaacacacaaaaggtagccatggcggtggtggacaagtggacgggcctaggttcggctctggcgagcttcctgttcctgtggtccatggtgcagagacacgtccccgtcacgctcagccaccgcgtcgccacctgggccaacaagctcgcctcctacctcaacccctacctggagatcaccatctccgagtacggcgccgagcgcttccgccgcagcgacttgttcctcgccgccgaggcctacctctccgacgcgtgcgcgctgcgcgcccgcaagctcaaggccgagatcggcagggacagcagcaacctccaggtctcggtcggcgacaacgacgaggtcaccgacgacttccagggcgccacggtctggtggtacgtcgccaagaaggtgcccaggtccaacgtcatcaacctctacggcaaccaggacgagccccgcttctaccgggtcgtcttccaccgccgccaccgcgacctcgtcgtcgccaagtacctgccccacgtcctccgggaaggccgcgccgtcaccgtccgcaaccgccagcgccgcctct

SEQ ID NO: 10241 - DNA, 1195 bp, Sorghum bicolor
  Clone ID: SORBI-28MAY03-CLUS6970_1
gccatccatcttcccttccttcgtcgttctctcctctcctaggcggccggccgccgcagagtggacttcgaattggctccttcctttgctgggtactaccatgaagaggttggtgtcgaccgccctcgccacgagagggctcctgagatctcgcggagcgccgagcacaactgctgttatgtcccgaccagctttccagcagtttatgaactattcgtcaccacaaggtggtgatcctaatgctagcacaaactcaactgcagcacgaatagctgctgatcctgatacacatcaagattttgagccaaagagcagaagttcagacatgtctttgaatgacattgttgctcaggatatcaaggagaacccagtcttgatctacatgaagggttttcctgagtctccaatgtgtggcttcagcgcactggcagttaaggtcctccagcaatatggcgtccctatctgtggcagagacattcttggagatctcaagctcaaagagagtgttaaagctcacactaactggcctacatttccacaaatatttatcaaaggagagtttgttgggggatctgacatcatattaagcatgcaccagaagggtgaacttaaggatcttcttggggatattgcacaaagagctgaacaaaaagcagatgctcatgattcatgaagcaatcctacagtatgttcttttactgtgctatctacttagccacaaaaatgttacttctatctcagagtctttaggcgacattgtgaactgtcctacacattggacatggatgatcggatgtgttcccagaatcctaggctataggtgttttatctggcattctggcagaggcaaaatcatgaatggatacccgtatgccgggttctctatcaaatgaataagtgccacttttagcagtgccgttctttggtgccttgtatatgtactacatccgttccaaattataagacatttcgttttttctagatgcatagcctctgttatgcatttagctatacactatgtttagatatgtggttaaaacaatgagtctagaaaagccaaaacgtcttataaattataatttggaacatagggagtactatggaacgagttccaggattcataggtcgtgtttcattctttttttttaatcgaactgaatttgtaataacagataaggctgcaaaggtgctatac

SEQ ID NO: 10242 - DNA, 755 bp, Sorghum bicolor
  Clone ID: SORBI-28MAY03-CLUS71890_1
gcgccctcactcactcttccccgccccagcgccccgccgccgacgccccctgtagcctccccgtcggccaggaccctgatcccaccgcgccaccacggcgcagcgccctccccgtccacctccggcgactcctcgctccgcctcctccgcgcgcacccgcgacacggccggcgcagccgcggggtgtccgtctccacgccggcggcgcggagccggccgttcgtcttctcgccgcgcgcggtgtccgactccaagagctcccagacctgcctggaccccgacgccagcacgagtgttcttggaatcattctcggaggtggtgctgggactagattgtaccccttgacaaagaagcgtgccaagcctgcagtgccattgggtgccaactatagactgattgatattcctgtcagcaattgtctcaacagcaacatatccaagatctatgtgctaacgcaattcaactctgcttccctcaaccgtcacctctcaagagcctatgggagcaacattggagggtacaagaatgaagggttcgttgaagtcttagctgcacaacagagcccagataatccaaactggtttcagggtactgcagacgctgtaaggcagtacttgtggttgtttgaggagcataatgtgatggaatttctaattcttgctggtgatcacctgtaccggatggactatgaaaagttcattcaggcacacagagaaacggatgctgatattactgttgctgccctaccgatgga

SEQ ID NO: 10243 - DNA, 877 bp, Sorghum bicolor
  Clone ID: SORBI-28MAY03-CLUS7248_1
cagagatgagatcaaaggtggcagacaattggaggcgttctctattcagctaattgttcttgcaacctggaagcaagcaattcatttatgcaatacctttgtagcttcacctgcaagggagagtccctcacaggatatccctttgcttgcgacctcgaagctagctgatgatgcctgcatgcagatagagaaacagtttctctctgaagttgaatatgccgaagaactagccagcactgtgggccagatagctgatggtacagagataccagatgcaattgaaataatatttcaatcggctttacttataggaaggcgaggcggtgttgatgagatgtttgggaaagcagcggatgccatgactgggtatatgagggcggtatccatgctgcgttttctcttgatcgaggcaccatcacttgccctcaacccccctttgattctgacaagatccgatcggcatcgactgcgcacatatattgaagctctcaacaccaggctctgtcagatgcaaagccagaggcattgacttctgccatgtgcccccaaatcttgttcaggttgaggaacggtggacttgtacaatattctttcatttgtaaatatatttgttggcccaaactagggcatgtaagatgtcagaaatgttgaactaggcagagcagcgaaaatctattgtaactcgatcagactactattgtaatgtggaattaggcggagtgtacgtgttacgttcattctgtgtcaattcaggcagaagcttgaaaaccaaatgagcaatcatgatcacttgtggaaatgtaaacagatcggctgctactttgtagattctttattatgtattagcaaagtgtgctatctgaaaaattacgcccct

SEQ ID NO: 10244 - DNA, 705 bp, Sorghum bicolor
  Clone ID: SORBI-28MAY03-CLUS72502_1
cctactggatgatgtatcttaggaagagctactcttagctaagtatgagaatagagggaagagagtgaggagttccccgaggaggagtcccggcttgtcgggagtcttcttccaggagcgcctcagcggatgcttgtcttctagtaagtcttccttctagttgcctttcatctgagtacttctggtatttactttctgtcttagtttattttaagtatacaaccggcctatctggcacattgctttgccttgtgtgaagtgctcgaaaccttagctgggtcttgagtagtagaattagtgtagacatggtgtctagactaagtctgcccttgtggacttcttgtcgcacctcaagaacgccagcagcgaagcgtgacagacctctgttggacattaggagttctcttcagggtgttgttaggcaagttgcatataatagttggcctacatggtagctgcctagggaagtgtttcgccacacccttttcacctatcggccacagtaggaagggagttaactctcacgtatacttaggatagcttagccacaagccaattccttgcaccacctctccgcccttgccgaagcccttcgttcagcctccggcggcgcagtgcgccttgttcgtcccctcctcgttccccgtggaaaatacgatacgtggaatactcctggtgaagtgctgcattgaccaccatccgctt

SEQ ID NO: 10245 - DNA, 732 bp, Sorghum bicolor
  Clone ID: SORBI-28MAY03-CLUS72551_1
aaacagggttgtaaaggttgcagactttggtgttgcacgtgtgaaagaccaatctggagtgatgactgcagaaactggaacttaccgttggatggcacctgaggtcatagaacataagccctacgatcacaaagcagatgtttttagctttgctattgttctgtgggaactgctaaccggcaagattccttacgagtacctcacaccactacaagcagcaataggtgttgttcagaagggtattaggccaatgatcccaaaagacacccatcccaagcttatcgagctgcttcagaaatgttggcatcgagatccagctgaaaggcctgacttctccgagatactggaaatccttcagaaactctccaaagaggtgaaaactgaccctgagggtcgccacaaaacaaagtcaggttttcttgcagcgctgaagagaagccactgaagggcactccaagaactccaatgcaatgttggtgctcgatgcacactgtaatcacagcatgctactgaagttctgatgcaaatggataatggaatagtgtgctgtagttgtacagtcacgatttttctcttgtaattgcagttgcttttcactttttggctgaattgccttttgttttgcttctttgtctcatgcatgtaaccgtagatgtttttgttgaatgtcctaacgactgacatagatgaactgtgctgaaataaattccagctgatgagaaacaatctctc

SEQ ID NO: 10246 - DNA, 638 bp, Sorghum bicolor
  Clone ID: SORBI-28MAY03-CLUS72566_1
tgcttgcaggtgaccatgatactgtacgaggttctcaggctgtacccgccagtggtgcagctggatcggcagacgtacacggaggtggagctgggcggcgtcacgtacccgcctggggtgctgctctcgctgccgatcgtcttcattcaccacgacaaggatgtgtggggagaggacgccgacgagttcaggccggagaggttcaaggacggcatctccaaggcgtccaaggactcgccggcgttcttcccgttcggctggggtccaaggatctgcgtgggccagagcttcgcgctggtcgaggccaagatggcgctcagcagcatcctgcagcacttctccttcggtctctcgcagtcctacactcacgcgccgttcccggtgtccactctgcagccggaacacggggcgcacatcatgctcaagaaactctctagtgtctagatttttggcttacgtcaagcatgctacgaactacccatctcaaactactttagagtctcctatttgatatctgaacttatgaaagtcgttgaaatttactacatttaggacatgtccggaagagatgggttggtaaagaacttttcaatggtttaattcaaatcaatttgtactaaattttaaggatttggagc

SEQ ID NO: 10247 - DNA, 896 bp, Sorghum bicolor
  unsure (1)..(896): unsure at all n locations
  Clone ID: SORBI-28MAY03-CLUS70095_1
atgtcgcacacactaggatagctttgcctgcctctgcttcgtcttcctcccttctctgactccgccggactctgctcgacctttttcccatccatggtgcagcttttgctggcgctcgcgctcgcgattcttctcgtcggagtaccggtggcggatgcggcgacggcgaaatacacgttcacagtggggagcatgcaaatcaatcagctatgcagcagcaccagcattattgcggtgaatgggcagctgccgggcccgtcgatagaagtgaacgaaggtgatgatgtcgtcgtcaaagtcgtcaacaattcaccatacaatataaccatccactggcatggtgtgctccagctcatgacgccgtgggcggacgggccgagcatggtgacgcagtgccccatccagcccagcagctcctacacgtaccggttcagcgtcccggggcaggagggcacgctgtggtggcacgcccactcctccttcctccgcgccacggtgtacggcgccttcatcatccggcccaggcgcggcaacgcctaccccttcccggcgccggacaaggaggtccccatcgtgctcggttgtcttgaacaggcgagtggtggaaccgcaatgtggtcgacgtcgagagcgacgccatcttggccggtcagcttcccacccagtccgacgcgttcacagttaacggcaaaaccggcctgctgtaccagtgcgcaaatgagacgttcacggcggtggtggagcccaacacgagggtgctgctccgggtcatcaacgccggcctcaactcgcacctcttcttcaaggtggccggccacaacttcaccgtcgtcgccgtggacgccggctacaccgccnacctgaacacggacacgctcgtgctcgcgcctggccag

SEQ ID NO: 10248 - DNA, 903 bp, Sorghum bicolor
  Clone ID: SORBI-28MAY03-CLUS7_1
gcacgagcgccgccgctgctgccgccatggccgacgagatcgacacgaggccggcctccgcgggctcccggggccgccccgcgcacgctacggaggacgacgacagggaggagggagagatcgccgacgacacccccgcgcccgccctccccgtcacgcacccgctcgagcactcatggaccttctggttcgacaacccgcagggcaagaacaagcaggccgcctgggggagctccatccgacccatccacaccttctccaccgtcgaggacttctggggcctttacaataatattcatcaccctagcaagttggtcattggagctgacttccattgcttcaagaacaagattgaaccaaaatgggaagaccctatttgtgctaatggcggtaaatggaccatcagctgtggaagagggaaatctgacacactgtggctgcacactctgttggctatgattggcgaacaattcgactatggtgatgaaatttgtggagcagtcgtcagcgtgcgtggcaagcaggaaagaatagctatctggacaaaaaatgctgctaatgaagctgctcagataagcatcgggaagcagtggaaggaattcctggattacaaggactccattggattcattgttcatgacgatgcaaagaaggcggacaagggaccaaggaaccgatacacggtttgatcctgttgctggaaatctcagagtgtagcatgcgcacgtgtagggtggttctatccgaatctaatgcagacatgcagtagcaccttgcagagtttagactctagtgttgaaggttctctatttgctgaggagttgcttaagcataatctaacatgttgaatgtatttcctgtatgttccataaacataatctaacactcgggtgttgtttcgtc

SEQ ID NO: 10249 - DNA, 1357 bp, Sorghum bicolor
  unsure (1)..(1357): unsure at all n locations
  Clone ID: SORBI-28MAY03-CLUS7015_1
gggactgggttgggatgaagctggggacatcacatataggtgaggttcaatttatataagtgatctataaatatttttcgaccaatattttaagctccatcaaacttctagagatgttcttacttgaactaattacaaaattatcttctgtggtctaggacaatttcctacaccaatcatacagttcttcctgaagctcttgaaaaatggtcacaaattgtgatgaggaaattacttccacgacacatggaaattattgaggaagcagacaagcggttcagagaattggtaatctccaaacataaggaaatggagggaaagatcgattcaatgaaagttttagatagctcgaatccccagaagccagtagtgcgcatggcaaatttgtgtgtggtgtcttctcatacggtgaatggagtggctgagttgcatagcaacattttgaagcaagaactatttgcagattatgtctctatatggcctaccaaattccaaaacaaaactaatggaatcacgcctcgaagagcgcgccggttttgtaaccctgagttgagtgaaatagtcacaaaatggctaaagtcagatcagtggactagtaatcttgatctgcttactggacttcgcaaatttgcagatgatgaaaagcttcatgctgagtgggcagcagccaagttgtcttgcaagaagcgcctagccaaacatgtgttggatgtgacaggtgttacgattgatccaactagccttttcgatatacagattaagcgtatacatgagtacaagagacaactcctaaacatattgggagctgtttacagatacaaaaaattaaaggaaatgagtgcagaagagaagcagaaggttacaccacgcactgtcatgataggagggaaagcatttgcaacatacactaatgccaaaagaatagtgaaattggtcaatgatgttggtgctgttgtgaacaatgatcctgaagtcaacaaatatctgaaggttgtctttatcccgaattacaatgtatcagtggctgaagtgcttattcctggtagcgaattgtcacagcatattagtactgctggtatggaagcaagtggaacaagcaacatgaaattctctctgaatggttgcgttatcattggcacccttgatggagctaatgttgaaataagggaggaggtaggagaagataatttcttccttttcggtgccaaagctgatcagattgctggctggagaagacagagaaaatggctgttaaaccagaccacctaagtnctaccggcatngcagacatgacactgggctgcaaaacgatggagaaagcttgagagaagaacacagctagctatattttccactc

SEQ ID NO: 10250 - DNA, 923 bp, Sorghum bicolor
  Clone ID: SORBI-28MAY03-CLUS70446_1
gcacgagggtccaccagcggcggcgaggacggcgccttctgctcccagccagagccaccaccagcgttcccgccggccgccaccgccgccgtcgccgccgtgtgccagcagctcgcggcgcccgccgcacccgcgcctccgccccccagcaaggtgggtggcgtcgccggacggcggacgatcctcccggtgccaccacctcggccggccggacagcgggcgcggaagaagatgaggctcccggagatccagcagatggtgcggtcgctgtcggtggagaacgatgccctccgcaaggagatgaaggcgttgcagagggcatgcgcggcgctgtcccaagaaaacggcaagctagagacaaggctggatcagtccacttcccgaaacaaggtaatctccgtggagaacaaggggaagaagccacaagctgagcatcagcacacagctgagcaggaagctccgaacggtttcgttctccctgacctcaacctcccggcagacgtctgatacatggctgaatttgttggtggccacaatcttcagatcgaattagcacgctaacctgataattaactgtacatagaggaagctgggccagaagggggttctgaatgatcacacttgccagaaggatactgaaggagaacggagattatctttgtttcataagttgttgacacttagggtttagagccgtctgtaatcctcccgactgaataatgttgttttatgttcagagcggtggatcggttttacgtttacctgacgtttttctgataaggttctttagtagtgccccgcgcatcagtgtggatgcatgcgcagtgggttatatatgtattttcaggtagttcaagacttcgaaaatgaacccatgatgtagctttgtttcttctaaacataatataatatagttaaaactg

SEQ ID NO: 10251 - DNA, 646 bp, Sorghum bicolor
  Clone ID: SORBI-28MAY03-CLUS70255_1
cctccccgccgccgcccccgccggcgccgccgccggccgcgccggcgcctgggtcggcgagtcatcggcggcaagcctgaccaaattcgaggacgtcttcgagctcttctgccagggacggtaccccggaggcccctactggcgcaacgccatggagttctggcgcgagagccagaggaggcctgacgaggtgctgttcctgaggtacgagggacatgctgggagacccgggctgggtaacctgaagaaggctggcggcggtcgcggcgcgcgcgtgctccgagggggtgggggggggggtcgctgccggcggcggggcgccgtgcggggtcccctgcgcctgggcgtccccgagggccggggtcgtgcgcggctgggcctccacggtgcggccgtcctcgggtggggcctggtccgcgactgggcaggctacatgaccgtggacatggcggcgaggctggataagattgttgaggaggccactcgtggtgctggcctctcctggggcggggcgccccctcgccgcctccgtcttgcttaaccatgaagcggttttttgttgtagccctcgtctttttttgttctatggcgctgggttcgttcttgcgttcactcgtccgtcaccgcaaaataaagattgtacaac

SEQ ID NO: 10252 - DNA, 1441 bp, Sorghum bicolor
  Clone ID: SORBI-28MAY03-CLUS7050_1
atttataggcgtcctcagatgatttatgtggtcaaacgccttcggatatttagaaaagaattaaaggacagacatgaaaattattcagaatcaattttggcatcacaccattcatggcgcaaaaacaacaagcaagagatgatcatgcccacctataattctaagatgcagattaggaagagtttgggctctttcaggaggaaccttagcaattctaagattcagtcagaacccagcaatgtgagaattttcacacaggaggagctaaaagaagtcacacataattactcgtatcgactcagcggaggtacttcaggtcaagtttacaaaggaacacttgaggacaatgcagtggtagcagtgagaatattttctgaagtactagagggctttgaagaagcgtttatcaatggtgggatgatcctgtctcaaatattccataggaacatcatcaaacttttgggatattgctctgattgcccggctttcgtgtatgagtatgctgctaaaggtagtctatctgatgttctggacgggcatgaacactttccactagatttacgtacgaagattgcagtaaaaattgcagaagcattagaatacctccattcctcaggagctggtattatcagacacggttatgttgtaccatccaagatacttctagatgataatttcatgccaaagctcactggcttttcatgggcaaggaagtttatcaaggagagtaacattattgccagcgatgcaattactagtcatcagcttccatcaagcgggttctacaatgacccaattcacgatcactgtgcgtcactaaaagtgagaaccgatgtgtaccagtttggtgtccttctcttgacgcttattagtaggaagaactttgtattttacgccgatcatgatgacctcatttcacaattccgcacagcttgcctgacagatggcagtggaagggcattttttgatgatgatattgcagctcatagtgaagatatttttcttcttgaagagattgggaggctatcgctgaagtgtatttgcgaggaaatagatcagagaccaacaatgaaagaagtggcagaactccttcgaataattaccagatcttggaagaagtgctcttcagagcgaactacactggtatctaaaactgtttctacatctcatatcgccagagctgaaggcactaaatctaacaggccacttgattaggatattagagattgaccataagcaatcgtgtacatactgtgaatgatgtgttgtattgtatcgttatcagcaatcttgcatgcgcggcaatttgatttgcaattattgcatcagaacttgcaatatgatgtaatctgctcctcattttgtctagcacatgatgtaatctgaatttgtttttttttgtctatctgaatttgtttctgctaacagatgtaggtacttt

SEQ ID NO: 10253 - DNA, 731 bp, Sorghum bicolor
  Clone ID: SORBI-28MAY03-CLUS73565_1
caaatttccagtgtcattttagcacgaaaggaggcaggacccgctgtcccgccccctgagcgagcgcgcgtgcccgtttgtggccgagatcgcacgcagcgcgggtgggtagactgcaggaccagccgagctgccgaagccacccatggcccccatgtcggtcccagccaccctcgcgccgccggcgccgccaaaggcgtcgccgacagccaggagctcggcacgacgggcgccggcggctgacgcagcgtccgtggccgcctcttccgtcgccggctcggccgcgttgctgacactgacgccggccgcgcccgccgcggccttgtccaaggaggacgtcgccggctcgcttatcaaggtggtggacacggtggacgacgtcatcggcgtcggcggcaaggccgctgagcaggtggcggccgtgctcaaggcgctgggcgaggccgtccagccggcgtttccggttctgaagagcgccagcgacgaggccctcaagctggcggcgcccgtggtgtccggcgcctccaagcaggccacggaggcactccagggcgccggcgtcgaccccgcccccgttctgtccgtcgccaagaccgcagcggagcagagcacgaaggtgatcgacgccgccaaacccgtcgcctcggcgaccgtggagaccatcacgacgttggggcccgagggctacgtcgtcaccgccggagcggcgcttctcgcgtacctcctcgtgc

SEQ ID NO: 10254 - DNA, 695 bp, Sorghum bicolor
  Clone ID: SORBI-28MAY03-CLUS73727_1
agaacatcgagctagctcagcagatctcttagtctcttatctagctagctcaacagaacaatggcggcgaagctgtgcacattactgctggctgcagtggtcgtgctctcacttctagtgagccccattgcttgcagccgcaagctcagcaagaccaagcccaagacaaagcctgcagccagagtcatccacaagccagcggccgcgcctgctgtcaaagccagccacaagccggcaactcctgccaagtcccacaccaaccacaccactctctatggctccggcggctggctgtccggcgccggcgccacgtactacggcgcccctaacggcgacggcggtgaaggcggcgcgtgcggctaccagaccgccgtcgggaagcagccgttcgactcgatgatcgccgcggggagcgcgccgctttacaggggaggcgagggctgcggcgcctgctacgaggtgaaatgcacgagcaacgcggcgtgctccggccagccggtgaccatcgtcatcacggacctgtccccgggcgggctgttcccgggcgaggtcgcgcacttcgacatgagcggcacggccatgggcgccatggcgaagcccgggcgcggcatggccgacaaggtccgcgccggcggcgtcgtgagggtccagtacaggagggtgccgtgcaagtaccccggcgtgaacgtcgcctt

SEQ ID NO: 10255 - DNA, 757 bp, Sorghum bicolor
  Clone ID: SORBI-28MAY03-CLUS74024_1
caaaaactggcttcgctttttaccttatccatagcccggaacggaaccggaccttataacctccgtattggttccggctcttggaacacgccgagcaacagatgcgagaagaggcggacgactcgagcagcagagcaagaggcggcgcagggcagcgtggggcgaccacggagcggcgcggggtgactgcggggcagcgcaaggcgactggcgggtggcatccttccccatcctcgtcgttctcgtcgatgattcactcgctatctccttcatcctcgtcctctccctcgtctagggttctttgatcttgagcaagatagtctcctggtagttcgatggatgatgatggagatcagtactgggggctagaagtgggcgccgatctatcctactgcaggttcagacatatagtttttttggtatgcttagatctagttaggcccgttgaggagggttggggtagtgctactaattttttatttgatggcgttcagatacatagttttatcagtagttctttggtgtgcttagatgtacatacagtatctgtggacataatggaccaggattatatattagcctattggagagttgagtcgagttggagtcgtttaacaatcttgggacatttgacccgccggctgttgaggcttgaaaatgctaggcatttggaagctgatgaacttaccgtcggtcctctgtttggatccttgagtactgccatggaattattctaagcgaacggctgccttttttt

SEQ ID NO: 10256 - DNA, 753 bp, Sorghum bicolor
  Clone ID: SORBI-28MAY03-CLUS74143_1
gtcgtggtccttcaaacgtcgtcgtacgctttcgtggcccctcacgagtcgtgttccggtagacaaacagtcgccggctcgccgcccctctcttcacgcggttcgacgccgttcgccacggtcgccatctccgccgccgccgccggaaacttggcatcttcgccgatctcgttctccccttttcccacccaggaggcaacatgtcgtcgctcgctgcggcgagagcggataacttctactacccgccggaatggagccccaagaagggtgggttgaacaagttccatggacagcatgcgctcagggagcgggcgaggaagctcgaccagggcatcctgattataagatttgagatgccttttaacatttggtgtggtggatgcaattccatgatagcgaagggagtaagatttaatgctgagaagaaacaagttggaaattattactctaccaagatatggagcttcaccatgaaatcaccctgctgcaagcatgaaattgtcatacagacagacccaaagaatactgaatatgtcataatcagtggggcccaaaagaaaacagaagattttgatgttgaggacgcagagacattgctgctgccagcagatgaagatcgagacaagcttgcggatcctatgtatcggcttgaacaccaggaagaggatcttcggaagaaaaaagaagctgagccagttttagttcgccttcaacgactctctgacagccgtcactctgatgattatgctctga

SEQ ID NO: 10257 - DNA, 810 bp, Sorghum bicolor
  Clone ID: SORBI-28MAY03-CLUS71360_1
gctcgcggcccccctcagcgcgccagcaggctgcctcctcctcctcctcctcctcccctcccccgctcggccgcgccagtcgcctccctccctcctctcccgcccccgctagtcaatactactgtgcagtacgccacccaccacctctccattaaagaaacagcgcaggccgggcaaaggcgagcaaggaaccgcgggtgtgtgtgtgtgtgcagccccggcagggcagatccgcgagatccggcgctcgggggcgccgatgacgagcggcgccgggggagccgccgccgggatcgggggcaccagggtgcccacgtggagggagcgcgagaacaaccgccgcagggagcgccggcgccgcccgcccgccccctgcgacaacaacgaggtgctcaaggcgctctgccgcgaggcgggctgggtcgtcgaggacgacggcaccacctaccgaaagggatgcaagccgccgccggggatgatgagcccgtgctcgtcctcgcagctgctgagcgcgccgtcgtcgagcttcccgagcccggtgccgtcctaccacgccagcccggcgtcatccagcttcccgagcccgacgcgcctcgccccctgcagccccagccccccccccccccccctcccccccgccccctccgccgcccccgccgcgccggcggcctcctccctcctgggtggtgtcgagggcaactctcttatcccatggctaaagaacctttcctcgagttcctcatttgcctcctcctccaagttcccacagcttcaccatctctacttcaacggtggttccatcagtgcacc

SEQ ID NO: 10258 - DNA, 1106 bp, Sorghum bicolor
  Clone ID: SORBI-28MAY03-CLUS7154_1
gcgcgggggggcttctcgtttcggggcgggtcttgaggttctcccggtcccggcttcagcatgggcgttgctcgcgggatcggctcagcggcccccgctgttggtcctgccgttccggccggggctttgagagaacatgtctatcaatcttgatcatccgaacctcagcggggaaacaactgtccaaaatgctgttacagaagttgctgccatggttggggagaatgtgaaactcagaagaggcttcatgctgtccacaactgcacatggtgttgtttcatcttatatgcatacctgtccccagccaggtatgggtcggattgctggattggtcacactagaagcagaagatagcattactctccttgatgctgtcaaaagtgttgggtcatctattgcgatgcagattgttgcaacaaagccattattcttatcaaaagaactggtttctgcttccgctctagaaaatgagcgtgaaatacttcgaacacaggccgaaagttcagggaaatcccaaatggctatggataaaatggtggaaggccgattgaggaagtactttgaagaagttgtgctcatggagcaaaaatatgttttaaatgacaacacaaacgtgaagaccgtgctgaatgacttgtcgaaagaggttggttctaaagtaacaatcggtaacttcatcagaatggaggttggagaagggattgagaggtacaatatatttgtcccatcccatgtcatctctatcgacaagtgggtttttgtttgtgatgtgtaaagtggcagttgatgaccacatgtttcttgcttggcagaactgaagccgctgatggttcagaggttgctgctggggctatgtagatttcaggcagagatggatcaaacgggatcattaggatctactcttctttaaagttagaggccatagtttttttccaataaaaattttgggctcccatctttgctccattggattgttacaggtgtataagctaggacggaactaatgtttaggcaagcaaggtagttagcgttctgggacctgcgaggctgcctagttggtttgtcgattcctagcttgtttgtttacaacatttggttcaaccctc

SEQ ID NO: 10259 - DNA, 868 bp, Sorghum bicolor
  Clone ID: SORBI-28MAY03-CLUS71622_1
cggagaaagcagaaaggagtagctcaacaggagcatgattgtattccggatgaacattatgtgcagacattattttctatcaaaggtcttgaagatgaactggagagaagaactttgacctatacctcgtggaaccaatcatcaaatccgaaagacaaaatgacttggcatcctatggtatttgagtatggtacatctagccccgagcatatcaatgctatcaagagaattgatcatgtcaactatcaaatggagcagaggacagagtggtgccaatgcaatggtaccttggttccatgttttttatttgccaggaagttctcctatagtgcggccatgcatcttttggaacaaggagccattggcacaccgaagtctgctcagctgatgattaacttttaacaaaattgtttacacaagtccgcactcaccgttttgatgggtcagatactgttcacaattagtatcagcctcaatgggagctgttgcatttgcagcagtaggtagagacatggattatcagagtattgacagtgaccagagtgcgcttagacagttaaggagttaaaagagggttgatgtacagactacagagcatcggttttgaagtttgtcagctccatcagtatgcaatatccaggagacagatcattggtagtgaaggacagagtactcgcaacccttaccctaacaaaacaagaaagttataacaatagcataatttttcttatacatattttccccttgtatgattaaagaatagatagttttgttactgcatacaggttattagacatagtgaataggaaaatatgcaagaaagatacatttgtccatctgacttgctgtttagaacattggtcacatt

SEQ ID NO: 10260 - DNA, 1019 bp, Sorghum bicolor
  Clone ID: SORBI-28MAY03-CLUS71804_1
acgccaagacgtcaaactccttggtccttgccaacctctcccgcccggtctgcgacgcggcgcgcgacgacgacggcgcacctcgccatggccctcgccctgtccctctccctgtccctctccctcctcctcgtcggcggcgttgtcgtccgcgcgcagccgctcgactacccgacggcgaagccctcgacgaggtgggccaacacggacgcgtccctcccgcaccacgtcacgtacgcggacggctccgtggcgcgcgccgcgctgctgcggctcaacccggcggggtacgggccctcctacgccttcggcttcttctgcaccaaccaccaggcgccgccctgcgccgagttcctcctcgccgtcgccccccgctgttgccgccgcgacggtgccgtgcccgccgccggggcgcgccgcccgccgccggccgggcccgccgaccccggccgggtgggcgccggtgttcgacgtcctgcgcctcttcccggacgactgcgcgttcccgacggtgtgcggcgcgtacggcgtgtgcacggacatgcagtgcagctgccctgacgcggccaacttccgggcggtggacttccggaggcccaaccgcggctgcgtcccgacggcgccggtagcctgcggcgggccgccggcaaggctggtgtcgctgccggggctggcctacttcaacgacccggccaccagcctgaaggcgctggagagggtgagcgacgccgcgtgcaggaaggcgtgcctggacgagtgccggtgcgcggcggcgcagttcgtgtacggcgccgacgccggcgacggcttctgctacctgcagtcggaggtgctgtcgatggagacgtcgcggccggaggtggtgcactacaactccaccatgcatctcaaggtgcgggccacgcgtcgtccgtcagccggattttagtgtgagtggaggtggagtggactactgttgtcttggattacgtacgttcccagtccaagactgtgatgaaagatatgtcagaataaagttc

SEQ ID NO: 10261 - DNA, 800 bp, Sorghum bicolor
  Clone ID: SORBI-28MAY03-CLUS71676_1
gggttttttcctcgtgctgctgctgctgctgctacctttctcaccgtctctctctcctctctcctctccgtcctgtcctcccccccgcggggggcgctccacgcttccccacccgcaaccgccgcttcccgccgccttcctccccccctccctcctcccctcgcgcccccctcccgcccccaccacgaagccacggtttcgccggcttagatccagccgggctacgggcgctggccagatggccgagcagggcggcgccgcccccggggaggccgttggcagcgacaccactgcgcctgcgccagcgccagcgcttgctgcggacgcggccgggcagaggtcgctgccgacgccgttcctgaccaagacgtaccagctggtggacgacccggcggtggacgacgtgatctcgtggaacgacgacgggtccacgttcgtggtgtggcggccggcggagttcgcgcgcgacctcctccccaagtatttcaagcacaacaacttctccagcttcgtgcggcagctcaacacctacggatttaggaagatggtgcccgaccggtgggagttcgccaacgacttcttccgccgtggggagaagcgccttctctgcgacatacaccgccgtaaggtagcgctggctccggctacgccagtggcggggctggcgaccgcggccgccgccgcggcgtccggggcggtgacggtggccgcggcgccgatccccatggcgctgccggtgacgcggccggcctcaccggcgctctctaccgacgagcaggtcctctcatccaactccggat

SEQ ID NO: 10262 - DNA, 838 bp, Sorghum bicolor
  Clone ID: SORBI-28MAY03-CLUS74463_1
tcaagaaaacagactcactttttttattataaaaaaatcttcgtgacgccgacatgtagaccgacccaatcccaactgacaaaacttggcgatcttcgagctggtgccgtgcgatttctatacaccactatcatatcagttcccatgctcagttgctcaccgtgcgatttttctacacaatcgcctcgcaaagattctcgctggccagttggagccttggagttggaggagaacagccgcgatccgcgatggcttctccgccgcttcagctcgccgccgcgcccttgctgctgctgctgctgctgctgctagtagtggtgccgggcacagggtccagccgcgtcttttcggtggccgactatggtgcggcgggcgatgggtcccattacgacacggcggcgattcaggccactgtagacgcctgcgcggcggcgggcgggggccgcgtccttctcccagcgccgggcgactacctgacagcgaccgtccacctccgctcgcgggtggtgctggatgtgccccccggcgcgcggcttctgggcgggaccaggcaggcggactacccgcccgagtcgcgccggtggtacgtcgtactggccgagaacaccacgggcgccggcgtcacggggggcggcgagatcaacggccagggcggggcgttcgtggtcacgcccagcgaggtgaagaacgtcatggtgagctggaacgccaccggcgactgcctgggcgatgagtgccggccgcggcttgttggcttcattgactccaaggatgttaagatccacgacatcacactcaacaaacccgcctactggtgtcttcaccttgtcagatgtga

SEQ ID NO: 10263 - DNA, 806 bp, Sorghum bicolor
  Clone ID: SORBI-28MAY03-CLUS74814_1
ctcaagaaaatgctggaaggcttggcaagacatctatttggtgctgtagagatgcgatgggttgacacttacttcccatttaccaacccatccttcgagcttgaaatatattttcaggatgattggttggaggttttggggtgtggagtcaccgagcaggaaattttgaaaagaaatggcaggagtgaccatgtggcatgggcctttggattgggactggagcgccttgcaatggtcctttttgacattccagatattcgactcttctggtcgaatgataaacggttcacgtcccagttctcagaaggcaagcttggtgtcaagttcaagccattttcaaagtttcctccttgttacaaggatatgagtttctggatcaatgatgcatttacagagaacaatttatgtgaggttgtcagaggaattgctggcgatcttgttgaggaggtaaaacttattgataatttcaccaacaagaaaggcatgacaagtcattgctacagaatagcctataggtcaatggaacggtcgctcacagacgaggagattaacaatcttcagttgaatgtcagggaagctgtgaaagataaattgaaagtagagttgagatagaagcagctagctatgctgttataccatgaactaaattttgcctgtcttgtatatgtaaatccatttaaaaagaaattttcttttgtctatcgagaaaatgcaccatttgtttctgtattgatcacgttttcctgtttacaggagagaaaaaggtcccgttccgattggtactcatcatatcttgcacgtaattc

SEQ ID NO: 10264 - DNA, 794 bp, Sorghum bicolor
  Clone ID: SORBI-28MAY03-CLUS74932_1
cccgggcccgcgccgccgagctcggcgcgccgcgcgccccgcgccccggcgacgtcgcccgccccgcggcgggcacggccactcccgatcggggccacccgagacccgagctcttcaatgactagcgagggctgatggttgcggatgtgaggtggactgcccaagacatctggcagtttttgtttcccttcgcggggcggcgccggcgcgccggtcgccggctccacagggagctcggccgcggcccctgccgcctcggctgcctccaggatcatcactcggtcgtcccgcatgcatgcgctgaccacgggttccagctcggccgggtgcgcggcgcgcaccggccgtccggcggcgcggacctcacgagcggcctcgcgcgcacggaggccggtgtcggggcccgcgccgggctcccgctgcggcgcagtgtccctgatcggcgcctgcgtcgccggcccgcgctccctggccggggtgaatactaccaacccgcatgtcgtgagcggacggcgcgtaacttgttttcacaccccgtagtagggatgaaaacggtacggatattttccgaccgtattcgagaccgaattcgtttagaggggttcagatctgtccgtatccgagtccgaatattcaacatccgataccgtatccgtatccgaatatttaaatcgtatatttatgatgtcgacatccaatcatatcttatccgacatggttgacattatccgtattcggatccgaatccgaccagaaatataaaaacaaatattatatcaatgatatccgttcgt

SEQ ID NO: 10265 - DNA, 1600 bp, Sorghum bicolor
  Clone ID: SORBI-28MAY03-CLUS7503_1
gcacgaggcttcccactcccgcaaagcctgccgctgctgcctgctggttgctcacctgccgcggtacgcgatggcgggggccgcagcggcggccgcggtggacgtggaggacctgctggtgcgcgtcaagaccggcgccgaggacgagctcgccgccgtggccagggaggtggaagcgctggcccggggcggaaggctcggggaggaggacgacgaggacggcctcctcgtcccggcgctgctcgcgcgcctcgccgccgcgggcaccgctgacgccagggtcagcgtcatggccgcgctcaggcgcctcgcgggctgcgtcgccggtgagagcaaggagaggctggcgagcatcgaggcgctttccagcatagtccgctccctgtccagagacgttgacgagaggagggaggcgattgcggtgctgctagacctgtccgacatcccacaggtccggcagaggattggcaggatcaaagggtgtatcgtcatgctagtcacgttgaggaatgcgcgtgaatcaggcaccgaggacgatgcagagaagttgctcagtatcttgtcgtccaacccgcagaatgtgctgttgatggcggaggctggttacttccggccgttgatacagtacctcaagcaaggttctgacatgaacaaggtccttatggccactgctatttcaaaaatgttcctatctgaacatatgaaatcttccctcggtgaggatggagctattgaacccctcgtggacatgtttaaatatggaaaccttgaagccaagcactcagccttaggcgccttgcgtaatctctctagctctctacaaaatgcagaactcctgataaattctggcataacaggaccgctgctccagctccttttctctgtgacctcagcgcgcgggaccctcagagagccagcctcagctatactcgcggcaatagcacaatctgagcgtattctacttcataaagatgtagcacctcagatactctcgcttcttaatttatcgagtccggtaattcaacttcatcttctgagggccctaaacagcatttccgggcacgccaatgctaaaagagccaggagtaaaattaggcaaaatggaggggtgcaactgcttctacctttcctaacagaaaagaatgtggatatcaaaattgctgcgttgcacttaatgttccatctatcgaaagattcttctcaagaattggctgaacagttcagggagacccatctagatatcttggtaaagatcatctcatctcctacttctcgagatgagaaggctgcagctgttggtatcctaagcaacctcccagtgacagataagaaggtaactgagattctgatgcggtcaaacttgcttcctattctgatcaccttgtttgaagcaaacatcgccacttccgtgacacctcaaaggatgtggtgcttgagggcattgccgggtatttattcggttcacagttacctgggacaggaaactacagagttcacagttggatattggggggtccttgccttgttaagttgctttcaagaagacagtggacgccagtctaaagcgcaacaaccttggcccactatcacagagcacaat

SEQ ID NO: 10266 - DNA, 708 bp, Sorghum bicolor
  Clone ID: SORBI-28MAY03-CLUS75209_1
atgccttcgccgaccccctcctgcaggaaccatccaaacacgggctgagctatgccgttatcatctctctccctcctccgccaccacccgccgcgccctctcccgccaacttcaaatcgtcagccgccaccgccacacccccgcctcctcctccctccgttcacagggcgccgcgccttcgtctgccagccgctcgccgcggccacggacgacatggctgctgcggccgcggcggcgtcgccccccacgctgctcgagcacatgggccaggcgggcacggccgctgacctcactgtcctcgtgtcgcatatccagagcgcatgcaagcgcatcgcggctctcgtagcgtcccccggcaacgccgagctgtcgcggtctaaggcggggcgtgggaccgtggcggccgggcgtgacgcgcctaagccgctcgacgaattgtcgaatgatatcatcttgtcatcgctccaaagttctggaaaggttgcagtgctagcatccgaagaaaatgatcttcccatttggatatctaatgacggtccatatgttgttgttactgatccgcttgatggttctcgcaacattgaggtctccatacctactggaacaatatttgggatctacaataggctggtggagctggaccatctccctttggaggagagagctcagctcaattcactgcaaagtggaactcgccttgttgctgct

SEQ ID NO: 10267 - DNA, 709 bp, Sorghum bicolor
  Clone ID: SORBI-28MAY03-CLUS72643_1
cgcgccaccaccttccatgcaagggcagtaggcgcaggcgcaggcgcagcacggccctctcgtgtcgccgcgccgcttttcgaccgactcgccgcgcgcccgcagctagccgttcttcgcggtagatccatggccgtggatagtcccccgccgccggcgcagccgcggcggcagtccgaggccggcgcgggcgggcggcggacggacaagcacggccgccgcctcgaggtgtacaacgaggtgctcgcccgcctgcgctcctccgccgccgccgccacggtctccccggccttcgaggacgcgctctgggcccacttccaccgcctccccgcccggtacgcgctggatgtgaacgcggagagggcggacgacgtggtcacccaccagcggctgctccaggaggcgcgcgatccggaacgccggcccgccttgtccgtgcgcgtcgtgcaggtttctaggattattgatggtgatacagccgattcttgtgatactgacatggagacggttgcttctaataatcatgtggtggctagccagatggctcacccaccccctgcttttggttcttcctccaatctagaggcgctcgggctcgagacaaatgagggtgatgtaaggagcaccaatgatactgatcacagtgtactcctccagatggtgcagatgtttgggaaatagaccttaaactgctcaagtttggaagcaa

SEQ ID NO: 10268 - DNA, 1214 bp, Sorghum bicolor
  Clone ID: SORBI-28MAY03-CLUS72856_1
tgttggcctgctggctaacttatctccgttaacagatgccctcaagaagagctcaatgcaggaaaccaccttatctccatttgcagcttctcacaaggatagcttgacgcaagaggatggcttgatgcagcacgcggatttatctccgttgatagctaatcacagggatagcttgattaaagaaacagaattgcctccatcaacagcttctcacaaggacagcttgattgaggaaactgacttaactcagacaatatcttcttatgtgaataacttgaagttacaatttaaggaagggacacagatctgtgatattgatatgctgccacaagatgtggacctgattgagttgcccgatcaaaggaaaatcattggtcgtgatgttggtgcagaagctgtcattgaaatggaagaaggaaagctggatcaatctagctcactaaatctatcagatattgacctagttggcagtacagaggttgccgctatacacaataatccagtgttggtccagccgtctacagctggatcttcctcagagtcaaataataagcagcaagaagatcttgaaatttttacaggtgccaatgccagtcctacagatgatttatgccagcttccgttagacaataaggatgttcaagtaattgatatagaatgtggcacaccagttgatgttggtggatttgatttgtcaaagtcgaagaatgagatggtatgctctagcatggatagcatcatggacaatggaaatggaatacatacggatgttcttcctggtattcaagatggctacagccttgcattttcagattttctcggttctgatataccatgctacccaccaatgcaatcagatcttcatgctggaataggtgtcaatgactcagagggtattactgtcatggatgatccaatatatgggtctctcactgatattggtttcatggacgtgtgggggcagcccactcaagactacgacaaattcttctaggctgctgccgaaggccgaagttcaggaatttgacaggaaaattagttgagttagctcagtacaggcgataataaatagattgggttatctcagagaaatgttgtattcatccctaatggtggagatagagatactgttttttttccgatacccatttggacggagttactgatccaaagactggtcttatgcgttcaagttgaatgatttgactgcgtgt

SEQ ID NO: 10269 - DNA, 659 bp, Sorghum bicolor
  Clone ID: SORBI-28MAY03-CLUS73122_1
tactggaaacaacccaggcgaatcgccgcggcccgcaagcgcaaacgcatcctcaaaccccagcgagccgagcccacgcggacgcgaaaccccaacacctctcggcggccgccgcggaaaagaagaaaggcggccacgacggcggaggcggcagcttcagcgagggcgacggcgctgatggagtccctggaggcgctcgtggcgcacatccagggcctatcgggcagccccgaggaggtggcgcacctccacagcctcctcaagcaggcggacggcgactccctgcgcgcccacgccgccgcgctgcttcccttcctcgcgcacctcagccccgagacccactccctcggctacctctacctcctggaggcgtgcgcgacctccggttccaatctgagcgacttcggcggcggggacttcctggtcaccatcgccgggttcctcaccgcgtgctcggcggaccagatacgcctggcgcccgacaaattcctgaatgtgtgtagggtgctcaaggatcaggtgatgcagctcaacatgcctatcagagggatcgccccgctgcgggcggcggtccgtaagatccagtcttcgcccgagcagctgactccgctccacgcggactaccttctcctttgcctgctggcgaagcagtacaaggc

SEQ ID NO: 10270 - DNA, 755 bp, Sorghum bicolor
  Clone ID: SORBI-28MAY03-CLUS73336_1
atggagagcatagtgatgtcaaaagtgagcaaggtcagaaacatgagattgatggtcaagatataaatgatttcaacccaagagatgcggagcttggcacaaaagtaagtgaggacataacggatagtaagagttcaactcctgtgcaaacagaatccgtggttcagcaaaatggacctgatagcgcaaaagtgactgcacaaactgttattcgcaacccctttgagtcaagcttctctggacctagcattacatcaggtccactaacgccctctggtcacataccttattctggcaacatttctcttcgatcagaaagtagcacaacaagtactcggtcctttgcatttccagtgctacagaacgagtggaacagcagccccgtgaagatggcaaaggccgaccgcaggcgtctgaaggaagaccgaggctggggttacagaatcctctgctgtaaattctgaatgcgcctggccctgcatccttttttgcctgttgagttgagcccttcgtgtctgtcacgcttgagcccgtggaggtccatgttaaattcattcaaatgtttctcttctctccttttcttttctcttttcttttctgccccccccaatgccctgctgttcttatttatctctagcaggttaatggcttgtcggattcggtagtggcttgtaatttacaaaacactatgatgagtgaggaattaaggtatagctttggtatacgatttgtggatacttttgaagtaatatccc

SEQ ID NO: 10271 - DNA, 660 bp, Sorghum bicolor
  Clone ID: SORBI-28MAY03-CLUS73140_1
attccattccaattccctgcagggcggcggcgacaagcaccaggtgcggaacccagcaccacagctgtccccctctccgtcctccccgaagcacgcagcgcgcaccctcccctgctctgcggcctcgagaatttaactttggagtaccagtgatgcaaagggacactagctctagcgatgtttctgcttctcatgcagggcgcgtaagacgtcgcagacatccaactgaggctaccacagatgggaatagagctaatggacagccgttgcttgtcaatgatcagaacaagtataaatcaatgcttatccgtacatattctacattatggatgattggaggctttgcctttattgtttatatgggtcatctatatatctgggccatggtggttgtgattcaaatatacatggcaaaagagctttttaacctactcagaaaatccagtgaagagaaacaattgccagggttcaggctgctgaattggcacttctttttcacggcaatgctgtacacttatgggcgctttcttagtcggcagcttgtgaatacagtaacttcaggtcacttgctttataaggtcgtcagtggcctaataaagtatcagatgtttatttgttattttctttatattgctgggtttgtatgggttattttgactc

SEQ ID NO: 10272 - DNA, 925 bp, Sorghum bicolor
  Clone ID: SORBI-28MAY03-CLUS73416_1
atggcgtttatttaagtctccaccctccgccccggggaattcttttctgtgtacgtatcgcggaattttttgggttctcgggctccgcccccctccctccccccccgcgccttcccgccggtgtacgtatcgcggaattttttgggttctcgggctccgccgcgatccatcccgatcctcgccttgccgctgctcccgccggttctcccggagctttctttctggccggcgcagcagacagagaaggcgaaacagaattgcggcggcggcggcgtctgcacacgcaaaggaaataaccagcactgtttagcaaaggcagctcctgagttctgaggcatgggtagtacttaaggatactgtatgtgcagatcatgaagatagatgatgaaaggccttaccaaagtcatatttttcatgatctttcatctaacggcagtcctaaattagactgtgaggctgaaagacaaggtgatctcaaatttttggctgataaaatggttgaacagaccaatcaatctgaacttagttttgtgaaggctgagcatctgaatggaggtaaaattgggcagacacgcattgaggattactcgtatgacaaggatgttgtcgaagcctcactgcccgacacagttctttcttctgatcacggtgtccatttcgtcaaggatgtctgcattgatgcaggggtgcttcctgctcaagcgacttcatcagaaacaccaccacatcagaaggggcccatgccctttgattcccttgcctcctccgccatctcttcttggggtggttcggtccgcggcttgcgtgcgcccgctcctgtccccctgtccctccgccgccgcctccctcgctcccttctcagtcagttttaattttaatgcaatctctatattgacttgatggcgacagaaaaacattatctggt

SEQ ID NO: 10273 - DNA, 864 bp, Sorghum bicolor
  Clone ID: SORBI-28MAY03-CLUS76457_1
aagccgccgtcgcgcaggctgcgcgcacccagaaaaaaggcggcgccccactccgcctcgccgcacccccttcctttcgtccccacctcttgctcgcgtagtcgcgttccagctcccaagtcccaacaccacccgccggctgcgaggggatgcccgcgatcccaacggccccagctcccagcccctcgagcttcctcctcgcccgccgccacagcctccacgtctcctacccatcgcctagctctaaccaccagcggctcccgccccgcctcctgcgcctgcccgctcgtccccaggccgctcccatgtctgccgtggcgcgggcacccgcgtcgccggtggcgccgccggcgcaccccacctacgatctcaaggccgtcatcgcgctcgccctcgcagaggacgccggcgaccgaggggatgtatcttgtttagccaccataccttctgatgtggaagccgaagccacatttattgctaaagcagatggtgtcattgctggaataagcctagcagatatgatatttaaccaggttgatccatctttgaaggttgaatggtttgaaagtgatggaaattatgtccataaaggattgcagtttggaaaagtatatgggtgtgcccggagcatcatcgttgcagaaagggttgtgctaaatttcatgcagcgaatgagtggcattgcgaccctaacaaaggctatgtctgatgctgcccgtccagcatgcatattggaaacaaggaaaaccgccccaggtttacgtctggttgacaagtgggcagtactgattggtggcggaaagaaccacaggcttggtttatttgatatggttatgataaaagataatcatatttctgttgccg

SEQ ID NO: 10274 - DNA, 541 bp, Sorghum bicolor
  Clone ID: SORBI-28MAY03-CLUS76840_1
aacgcagcagtactactgcctccgttccagttcagtcccagctcagagctctcagtgggcacgaggggcgaccggcgaccggcgagctcctccggcattgagtcccgtcgagtggagcgctgagccacgcagcccgcctgcattcaccgctccgtgggttcctttagtcttctccgcgtgatctggttgctctggtcagtgatggccggtgacattacatgcggatccttgctgcaaaagttgcagttcatatgggatgaagttggcgagagtgaggaggaccgtgacaaggtcctttatcagctggatcaggaatgccttgatgtttacaagaggaaagttgaccaagcaactaactctagggatctcctgatccaggcgctggatgactcaaagatagaacttgctaggcttctttctgctcttggagaaaaagctattgcaagaacccctgagaagacaacaggaacgatcaagcagcagctagctgctatagcaccaacacttgagcagttgactaaacaaaaaaaaaaaaaaaaaa

SEQ ID NO: 10275 - DNA, 970 bp, Sorghum bicolor
  Clone ID: SORBI-28MAY03-CLUS7723_1
gcacgaggtaggagaggatgtagaatctatattatacaagttactcacggtggcagattttaatgtgcaagcagcacagcaagggatggtgtacatagatgaagttgataagatcacaaaaaaggctgaaagtcttaacatcagccgagacttatctggtgaaggtgttcagcaggcattgctgaaaatgctggaaggcacgatagtcaacgttcctgagaaaggagcaaggaagcatcctcgtggtgataatatacagatagataccaaagatattctgtttatatgtggtggtgctttcgtggatttggagaaaactatatcagagagacggcaggattcttctattggttttggcgcgccagttcgtgcaaacatgagggccggtggcatttcaagtgctcaagtgacatcatccttgttggaatcggttgagagtggtgatctaatagcttatggacttatcccagaatttattgggcgcttccctatccttgtgagcctggccgctctaaatgaggaccagcttgttcaggttctcactgagccaaagaatgccctgggtaaacaattcaagaaattgtttagcatgaataatgttaagcttcactttacagatggtgcacttagaataattgccaaaaaggcaatgtcaaaaaatactggtgcacggggtttaagaactatccttgagactattctcatggattctatgtatgagattccagatgcaagatctggggagaagagaattgatgcagtggttgtagatgaagatgcagtaggatcagtggaccaacctggctgcggagctaagattctttatggtgatggtgctttggatcaatatctatcccagataaaggtgtcgggagatggagtggcaagcgaaatggatggagaaactgagcgagccattggcatgtgattcctgattctgaccgcactagtgtaacctgtaaaatctatc

SEQ ID NO: 10276 - DNA, 1178 bp, Sorghum bicolor
  Clone ID: SORBI-28MAY03-CLUS7729_1
gtctctgatgagttctactttgttggaagacttggagaaagaagattgcacccctccaagcagaagtttcatggactacccagggagaccagaaacatgtcaaagaagggtacctgcactgaactatgatgcagagagtgaaactttatccagagcaggatcaatgctatctgaaattatcaccacgagggatggactgaagggaaacagctctgttgctggtgatacagaatttgttgctggcataggtgaatttgtcgcggagctaaaagaaatggctcaggtacagtatcagaagcaacacggtgatcagggtgataatggagaattggccgaagggaccataaggagcgtgggtctggatcccattatggatgccttgcaatcgccttctcgctggccattagaattcgagaagaaacaacaagagatcattgacctgtggcatggatgcaacgtttccttggtccacaggacttactttttcctgctgttcaaaggggacccagccgacgccatttacatggaagtggagcttaggaggctatcattcctcaaaaataccacatattccaacggaagcatggggcgtaacgtggtggtagcaggcagtccgagcacttctctggtctcaagtgcaaagaagctgcaacgtgagagggagatgctctgcaggcagatgcagaagcggctgacgatccaggaacgtgagagcttgtacaccaagtggggagtctcgctgtcctccaagaggaggcgtctgcaggtcgctcgccgcctttggacggagaccaagaacctggagcatgtgagggagagcgcgtccctcgtggccagactgatcgggctcctggagcctggcaaggcgctgagggagatgtttggtctcagcttcgcgccgcagcagttcacccggagatcgcacagtagttggcgatatggccgttcttctctagactgactgaactcgaaagacgcagctgacaaaaaaaaaagtctttttcgttttgtgtaataggttgttgttgccctgttggaaatagaacatttttgtgattagttcgcgaggaaatttgcctggtaccattagcaagatttacacttgtttacagttgcaattggcagcaaaccgtcgacgagaaatcgagacgagttattaataagaagataaaaaaaag

SEQ ID NO: 10277 - DNA, 851 bp, Sorghum bicolor
  Clone ID: SORBI-28MAY03-CLUS77446_1
atccgttccgttgcgtgctcgtctcccactccactctctacggtccacggcggccagcagccgcttgccgctttcccagccacccgccgcctccgcgtgtcgccccatccagccatcggttccacctggcctgcaaatccggcgcgctactaaccgccgggtggcccgaaatttccccgccgcaagcttcgaagccggaacagcaatggcagcagcagccgtcgcctccagttccacgccgcggccgctccgcttggcgcagcgcggggcgctcgcaccccaccacgtcagcgccccgccgccccgctcccgcaggccgcggctcgccgtctgtgcctcggccggcgtggagacggagaccaccagcgggtccgggcggttctacttcaacttcaccgggttccccttcccgctcggcccgttcctcaaccgccgcaccatccgcaccgaggccgtgaagggcagcatatggctgttcgagcaggagcaggcgctgggattcagcagcgtctccaccaacacccgcatgaccgtcatcaagctcaagtccggtgggctctgggtgcacgcgcccatcgcgcccaccaaggagtgcatccagctgctcaaggagctggacgcgccggtggagcacatcgtgctgccgaccttcgcgtacgagcacaaaatcttcgtcgggcccttctccaggaagttccccaaggctcagatatgggtggcgcccaggcagtggagctggccaatcaacctgccgctcgagttcttcgggatcttccgggccaagccgctcaaagatgaggatgacgccacgccctgggccgtcgaaatcgagcagaaggtgctcagctctc

SEQ ID NO: 10278 - DNA, 691 bp, Sorghum bicolor
  Clone ID: SORBI-28MAY03-CLUS1215_1
gggcgaaaagcccaggcgcaggcggcgaaacaatcgggtccttctcctctcgtcttgtccccatccctctcccctttctttcctcatccaccagagtttcgctagctagggtttccaccaatggcggcgcccaccacctcccgccgcggccccggcggcgcgcgcaacatggacgacgagaacctcaccttcgagacctccccgggggtcgaggtcgtcagcagcttcgaccagatgggcatcaaggacgacctcctccgcggcatctacggctacggcttcgagaagccctctgccatccagcagcgcgctgtcctccccatcatcaacggccgcgacgtcatcgcgcaggcccagtccggtaccggcaagacgtccatgatctccctcaccgtctgccagatcgtcgacaccgccgtgcgcgaggtgcaggctttgatactctcgcctactagggagcttgcttcccaaacagagagagttatgctggctattggcgaccacctcaatgtccaagtgcatgcttgcattggtgggaaaagtattggtgaggatatcaggaggctcgagaacggagtgcatgtcgtctcaggaactccaggcagagtctgtgatatgatcaagaggaggaccctgcgaacaagagccatcaagcttctagttctggatgaagctgatgagatgttgagta

SEQ ID NO: 10279 - DNA, 707 bp, Sorghum bicolor
  Clone ID: SORBI-28MAY03-CLUS1235_1
cgtagggagatcgtttggcgtgacagacttcgtcaatccgtcgcaactggacaaccgttccgtcatagaggtgatcgttgagatgaccggcggcggcgtcgactacagcttcgagtgcatcggcgtgccgtcggtgatgaccgacgccttcagatgcaccaagatgggaaagggcaagacgatcgtgctggggctgggaagggacagcgaccaagtgtgcctgccgtcgctggagctgctgttcggcaggtgcgtcatggggacgctcttcggcgggatgaagcccaagaccgacatccccatcctcgccaagaaatgcatggacaaggagctgcagctggacgcgctggttacgcacgagctaggactgcaggagatcaacacggccttcgacctgctcctgcagggcaaaagtctgcgctgcatcatctggatggacaaggacaacaagtgatggacaacaggggcggcgcgccccggaccaaacctgtggctctgaataaatttgccgtctttcagtttggcgatgcgatgcgtcgctgaaaactggtgctacaagcgaccaggagtatctgttcctgaaagccgacgttactctggtgtatcagtttcgtttcgttgtctgaattgattaattataacgtatttgttactcatgtcatgtatcgacatcactacatggacatcgtatgaacagcaacgttcag

SEQ ID NO: 10280 - DNA, 898 bp, Sorghum bicolor
  Clone ID: SORBI-28MAY03-CLUS12404_1
gctcgaggcgggcccgcccccctcttcttccgcacccctccctgccctacggcaaatctccgctcggtcttctgcacccatccacttcttcttcccctctcgccctcctcctcccaaatcggcgctcccatggtgcccccacccgccccgccggagcgccacccgtgcaccccgggcgccggctcctgggcggcccccgccgctcgggccgggggccctgtgcgcgcgctgcctcccccggtcgctcggcgcggggtccctgccaggccggccgcgggcgctgtgcgtttgctgggtacagccatggctgtatggatcgtctccgccgtatggctctctgctggctggactccgttgggaacgcggtagactgttggcagggctagattgtgcagattgaaggccggcaggattaataaggacgaatatatgaaccagtctggatagagcagattgaaggcagtcaggattaataagggctgatatatgaaccagtcgatctccaaacgacaccgtccagtggcaccggaggtcggtggtggcagcatgattccagatgaggtgctgctgttcgagatcctggtgcgccttcctgtgaagtcccttgtgcgcttcaaatctgtttgcaaggcgtggtgcgccaccatagccagcgctcatttcgtccgcctgcacttggaacttgcaagagctagaagctcatcatccatggtcatagtccctcggaaggagcagccgagaccgacaaagctggcctctgtttgcgtccacatcttcagcttccagccagcacggcaaagcaatgtcgccaagctcattatgaagagcaagcctcgtcctggtggcatcccacatttcaccatccccctgcactgcgatggactgattctgatcccca

SEQ ID NO: 10281 - DNA, 655 bp, Sorghum bicolor
  Clone ID: SORBI-28MAY03-CLUS1246_1
agagcactttctagagaaatccttcatccaccgtgggccagttcaccgcaccagtggccggcgtccggcgacgatgagcacccgcgccgcaggatccgtcctcctccgccacctgggcccgcgcgtcttcggctcggtttcctcctctcccgcggctgcgccgccgaggccactgctggccctggccggcggcggggaatggcgcggggcggccgtgtgggtgcggctgttgtccacctccgccgccgaggcgaaggaggaggcggcggcgtccaaggggaacgcaggaagcaccgcggcggcgaaggcggaggcggtggaggccgctaaggagggagacggaaagaaggacaaagtggtgagcagctactggggcgtcgcgccgtcgaagctgatgagcaaggacggcgtcgagtggaggtggtcttgcttcaggccatgggaggcgtacaagccggacacctcgatcgatctcaccaggcaccacgaacccaaggtgctgctcgacaagatcgcctactggaccgtcaaattgctgcgcgtgcctaccgacatattcttccagaggaggtacggctgccgcgccatgatgctggaaacggtggcggcggtgccggggatggtgggcggcatgctgctgcacctgcgctcgctc

SEQ ID NO: 10282 - DNA, 1478 bp, Sorghum bicolor
  Clone ID: SORBI-28MAY03-CLUS12466_1
gaagctgcagatgctgtggatgtcggggatgaacctgactggtggcatccctgacaacctgtcgtcgctcactgagctgacgctgttggctttgtctgacaataaacttgacggtaaaatcccggggtggatttggaagcttcagaagcttcagatcctgtacctctatgctaacagcttcaccggtgcaattggaccggagatcaccgccgtgagcctgcaagagatcgacctgtccaccaactggctctccggctcgataccggagagcatcggcaagttgagcaacttgtggttgctctacttgtacttcaacaacctcaccgggagaattccgtcgagcgtcgggcgtctcccgaacctcgtggacatccggctgttcagcaacagcctctccggccacctcccgccggagctcgggaagtactcgccgctgggcaacttcgaagtgagcaacaacttgctcagcggcgagctcccggacacgctctgcttcaacaagaatctgtacgacatcgtagtcttcaacaacaacttctccggccccgtcccggcggtcctcggggactgcgtcacggtgaacaacatcatggtgtacaataacaacttcaccggagagttccctgagaaggtatggtcggcgttcccaaacctgacgactgttaagattcagagcgcccgcggcccgggctctttgccctgtctcatagcctccgccatccctcgcctcgtgtgggcgaactcccgctgcgccgccgccgtgccctcctccgctccggggttgttggcctgcgcgcccgggaacaacctgttctccggtcctctaccggagaacatgtcgggtctcgccaacctctcggagctgaagctcgccgggaaccggatatctggctcgattccaccttgcatccgatcactggaacacctgaattacctgaactttagcagcaatcagatatctgggccactcccggcagagatcggatcgctgccggtgctcaccatccttgatctctccaacaacgagctcaccggagaaatacctcaggagttgaacaacctccgtctcagtttcctcaacctctcttccaaccaactcaccggcgagctcccccagtcgctgcagagcccggcgttcgaggactcgttcctcggaaaccatggcctctgcgccgcggcgagcccgaacataaacattccggcgtgccggtaccgccgccacagccagatgtcgactggcctggtcatcctgttctccgtgctcgccggcgccgtcctcatcggcgccgtcatcgggtgtttcatcgtccggcggaagaagcaacaaggccgcgacgtgacgtcgtggaagatgatgccgttccgcacgctggacttcagcgagtgcgacgtgctcaccaacctccgcgacgaggacgtgatcggcagcggcggctccggcaaggtgtaccgcgtccacctccccggacgcgggcgcg

SEQ ID NO: 10283 - DNA, 808 bp, Sorghum bicolor
  Clone ID: SORBI-28MAY03-CLUS78289_1
cgtgtgtcctctccagcccaacgagcaaccaccacgagcgcgtcctcgctgccgctgccgttgccgtcgtccactgactgccaactcaactcgtcgcctcgcgggtcgcccatcccatcaatggcgctggcgcgtcagcggccccggccccggccccggctgctgctcttcttctcggcggccctggtcttcttcttgctgtttgcggcgcaccaggcagcggcggcgcaggtgggcgacgcgtgctcctcctcctcctcctccggcggcggctgcggctccggcctgcactgcagcgcctgcggcggctcttccggcggggacagcagcatctgcacgcgcgccagccccgtggacccggccacccacggcacgggcctccccttcaacaactactcgtggctcaccacccacaactccttcgcactcgccggcgcagaatccgccaccggcaacccactcatcaccgagaccaaccaggaggacaacgtcaccgcgcagctcaagaatggtgttaggggcttgatgctcgacacttacgactttgacaatgatgtctggctgtgccactcatttcaaggaaaatgctacaacttcactgcctttcaacctgccatcaatgtcttcaaagagatccagacgttccttgatgcaaacccatcagaagtagttacaatttttcttgaagactacaccgcaacagggtccttgccgaaagtattcaatgcttctggccttatgaagtattggtttccggtgtcgaaaatgccaaagagcggtggcaactggcctttgctcaaggacatga

SEQ ID NO: 10284 - DNA, 787 bp, Sorghum bicolor
  Clone ID: SORBI-28MAY03-CLUS7849_1
gcacgaggcaagaattctggaagcagagaagaactccgctctgtcgtcagatttaactgcacgaggattggcttcagagggaagatctccaccaaggataggaattgttggtcatatgacacggatagctaacaagctccttcagctggccaatactaacatcatggttcaatcacatttgcagcaaaattctgattggattgagtggcatgccagtaccctaacgaagcgtaatgcattagaaaatgtttaccagtgggcttgcggtcgaccaacgtcactgcaggatcgtggtagggatagcgatgatgaagacttccgagatagggactacgatgtggctgcacttgctagtaatttaagccaggcatttaaatatggtatttacagtaatgaggatattgacgaggctcaagcatcacttgagccgcatccggaggatgtatattttgatgatgaatctgcagaggtagtaatctcctcccttcgccttggagacgaacaagaaagtggctcgctctttacaaattccaactggtttgcatttgacgaggacaaaccactgaatgatggtttggttagttcagaagcttccccatctccaaattcggaaatgtccgcactaaaagaggatgatgaaaatgatgaagtcattcttggcgaggaggttatggatgacacaaaaggttctgaaccacctttacctgtccccaacaaagacgcaaatgaagagtctggtcacaccggcttggcaaatggtaccattgacacattggaagatgatatc

SEQ ID NO: 10285 - DNA, 1445 bp, Sorghum bicolor
  unsure (1)..(1445): unsure at all n locations
  Clone ID: SORBI-28MAY03-CLUS78500_1
accaacaacctgctctccatttccaatttccacgccgccgccaacatgcctacctccgccgccgcctccgccaccgccgcgtgggccaccctatcctccgtcaatccccgccggtcgtcgtctgcgctcaggctcccaccgtccctccgccggtcccttcccagcagactctcatcgtcgtcaccctcgcgctctccgctcgtgccggtctccgccatggcctctcccgccgccgccgcctccggtgagacggcctccaggaagaaactcatcatattcgatgccgaggaggacctcgcggcgtcgctggccaagtacacggcagagttgtcggcaaagttcgcggcggagaggggcgccttcactgtcgtcctctccggcggctccctcgtgaaggccctcaggaaactagcggagccgccgtacctggaggcggtggattggagtaaatggcatgtgttnctgggtggatgagagggtggtgcccaaggatcacgcggatagcaactacaagctcgcctcagatgagttcctctctaaggtgccaattcctgctgaccaagtttatgctataaatgatgcactgtcatccgagggtgctgcagaggattatgaaactcgtttaaagcaacttgttaaggatggtgtgattgaaacatcaacagtgtccgggttccccaagttcgatcttatgcttatggggatgggacctgatggccacattgcctcactcttccctggccaccctgtagtcaatgaaaaccagaagtgggtcacctttgtcaaggattctccgaagccaccaccagagagaataaccttcactttcccggtgataaattcgtcagcgcacatcgcacttgtggtcaccggtgccggcaaagctggtgctgttcataaagcactttcgggagggcaaaagacatcagatttgctgcctgttgagatggtttctcttcaggatggggagctcatttggttcactgacaagccagcggtgtcaatgttgtcaagcatttgaagccacgattgtataaatctgaaagtttcatctgaaggaattcgtacatgtttgatgggaatctattgggttcggcatgaaactatgaggtgtttatgtgtttatataaattgtgctggggaaatttgtcttggactccagtttctacccaataatggtcttttatggttttccatttggttgagcatacaccgtatcttgcaaatgtgtgcttgtaaatgttatctagcacgtgaactgtgatgttttataattcttctaaggaacatcagctgaagaggattttttactagtatttgcacttgctagcacacatctgtttctctggggttttaagcaaaagatttttggtgtttagtaatttgtacattgaaattcatgtatgtatatctgtatgaaaggttaatgtgaattacttactttt

SEQ ID NO: 10286 - DNA, 915 bp, Sorghum bicolor
  Clone ID: SORBI-28MAY03-CLUS78504_1
gaggacggagggcggcgcagccggaaccgcagccgcagccgtagcctcggcgagctgctgcattgcgctgagacgccgccgttcctcacgcccagaacctcgccgtcgccgctgcacacggcctcgatggacaactcctacaacccgctcttcgagtcccccgcggccagcccgggcccgggcgctgcaccggcggtgtcgccaccgcccaagttccagttcctccgggatgccgaggagaagctctaccgccgcgcgctcgccgaggaggaggccatgagggcgcggaggtcgccaaggtcgccggcggccactgccgaggaggatggcgggtacatcaccatcgtggtggccaagaacaaccgcgccatccccatgccgtcgccacccgcttgcgccgccgccggcggccattagtgagcgcgcgactgatgagcagagctgttcagatggacaggaggttttgatggattaacgacttgcttcatactccctccctgtgcattcttcagtgtgttctactagtgtagtcgctcttgtgatgtagtaaaactctcccttttttttcttttgtttttgtttggtctatggtcttgtgaccatatgccaaatttgaatcagtgattggatgtatataacatcgaactgatgaggaattgacaatttcagttcaaatcaatatgtttctctccatatcttctgtttagtactcctacatgccaaatttctgtagaaatgtttggttccaatttgatatagtgtgcttcagtggagctttttttttgctagatctttttttttcttggtgtttgattgtacttgtagatagacatgtatggaaggatgtgtacagctgttcgtgcacatgatatgagcctatgaggatggctagtggattatgatgtctgaaagccc

SEQ ID NO: 10287 - DNA, 985 bp, Sorghum bicolor
  Clone ID: SORBI-28MAY03-CLUS78550_1
aaagaaaaaaaaaaaaaaaaaactactggacccgcatcgcccccgctccgcattgccccccgtcgccgccaaaatctcagcgcaatttcgcgcggagtttaggccttgtgggagggagtggaggtgtgacaggagcagcagcaagcccgccatggacccgtgcccgttcgtgcgggtgctggtcggcaacctcgcgctcagaatgccggtggcgccgccggccgccggtgccggcgccggcgtgcacccgtccacgtcgccgtgctactgcaagatccggctcgggaagatgccggtccagagcgtcccggcgccgctcgtggtctccgacggcggcgagcagacgccggcgtcgggggccctcgccgccgcgttccacctgtccaaggctgacctggagtggttcaacgggaagccgtctctcttctcgtcgcgcggggaggccagcctgaaggtgtcggtctacgccggccgcaaggggagtacctgcggcgtcagttccgggcggctgcttgggaaggctacgatcccgctcgatctcaagggcgcagaggccaagcccgccgtgctgcacagcggctggatctccatcgggaagcgagcagggaagggcaaccccgcggcgacggagctcagcctcactgtccgcgcggagccggacccgcgatttgtcttcgagttcgacggggagccggagtgtagcccgcaggtgctgcaggtgggcagcgccatgaagcagcccatgttcacctgcaagttcggatgccgcagcaacagcgacctgcgcaggcccgggatgcagccggagcgtgacgccggcgcgtcggccaaggagcgcaaggggtggtcggtgacggtgcacgacctgaagggctcccccgtggcgatggcgtccatggtcacgcctttcgtgccgtcgccgggcacggaccgcgtgagccgctccaacccgggcgcgtggctcatcctccgccccgctggcgac

SEQ ID NO: 10288 - DNA, 672 bp, Sorghum bicolor
  Clone ID: SORBI-28MAY03-CLUS75254_1
gagcttcgccaacacgaacgtggtcagcggtcagggcagcgcgcaggcgatcaaccagacgacggacgcgctcacgaccgtcaccggcggtgcggcgtccgcgtcggcgcagcagcaggtgcaccagagcttcccgctctacatcttcctgggcggcgacggcagcggcacgtcgtcgcagcggctgatgcggcgcgtggagatcgggttcgacgagacgcggtccaagggaggaggaggaggaggaggaggggcggcgacgagcacgctgcggaacgcgcaggcggcggcggcggaggtgacgctccgggacgaccccgtggtgggcgcgtcgtggcggatgcatcagacgtacgcgtacggcgccagcgacggcggctgctacctcaggaacgtaagcagcgtcggttacgacgtgcttttcgaccatcatgacgcgtcctgcgccggtacgctcggccgctgacgcctgtcgccgacagcgccttgtcggcgcctccgccgcgcgggccggtggataacggccggggaagcgacatgggtgtaaatggaacgctgcaccggtggacgaactgtactggctttggctcggcatggcctggcctggcccacatccggtcttcaattattaaatactgtcctaaatgatgggtcatttccatgtgctaaaaa

SEQ ID NO: 10289 - DNA, 1109 bp, Sorghum bicolor
  Clone ID: SORBI-28MAY03-CLUS75338_1
cctcagccttcacgcggacactaccaccatgcaacacgcctcccatttcggggcttttccctccacatctcagccaagtgaggactgaggtgagctagccatgccgactgcctcctctgcccaccgctcactcctcctctgcctctgcgtcgctctgctctccaactcggccgccgccttgccgtcgccccgggacctccgcttctccgtcgaggacatcgcggcggtggaggccgcgctgccgcgccacagcaggcggacgtcctccaagaccaccttcttcgaggtggaccgccctctccgccctcccaggggcagctccggcccctgctccacgctgctgctgtcgcactccttcgccttcacgctcaccaagccgcccgtcacggcgacgtactcgccgccgccgtgcctagcatccggcgcgtcgtcggtgtcgctcgcggtgctcgagtggcgcgccgagtgccgcggcgcgcagtacgaccgcaccttcggcgtgtggctcggcggcgccgagctcctgcgtggcagcaccgcggagccccgccccggcggggtggtctggtcggtctccaaggacgtcacccgctacgcggccctcctcgccgccggcgacgccacgctcgccgtgtacctcggcaacctcatcgacgacacctacaacggcgtctaccacgccaacctcacgctccacctctacttccgctccggcgcgcggtcctctccgccgtcggccgccgccgacgccgtcgtccccgtctccaggagcctgccgctcaacgacgggctgtggttcgtcgtccagaacgccaccgacgtgcagtccgcgcgggtcaccgtgccgcgcaacgcgtaccgcgccgtcctcgaggtctacgtctcgtcccacgacgccgacgagttctggtacatgaacacgcccgagcagaacgggccgttccgcgaggtcaccgtgctgctcgacggcgacgtcgtcggcgccgtgtggccgttcccggtgatctacaccggcggcattaacccgctcatctggcggcccatcaccagcattggctccttcaacatgcccacctacgacatcgagctcacgccattcctgggcaagc

SEQ ID NO: 10290 - DNA, 893 bp, Sorghum bicolor
  Clone ID: SORBI-28MAY03-CLUS7541_1
gcacgaggcttgtgatggcatatggcaggtcgtacggtcttcctgtgattaccactcgtggcaacaatgtgtatggaccaaatcagttccctgagaaactcatccccaaattcattcttttggccatgagaggtctgcctcttccaattcacggagatggttccaatgtcaggagctacctgtactgtgaggatgtggctgaagcttttgaggtggttcttcacaaaggggaggttggacatgtgtataatattggtactgtgaaggagaggagggtgattgatgtggccaaagacatttgcaggctctttgacttggatactgagaaagtaatcaggtttgttgagaacagacccttcaatgaccagaggtacttcctggatgatcagaagctgaagagactgggatgggcagagcgcacaccatgggaagagggcttgaagaagacaattgagtggtacaccaccaatcctgattactggggagacgttactggtgctttgctccctcacccaaggatgttgatgactcctggagttgaaaggcataactggactgaggagatcaaatctcttacttcttcaccagctgaagctagcacaacagctcctgcaaccagtaccaaaagagccactgatgctcctcaaaagcctttgttcaagttcttaatctatggcaggactggatggattggtggcctccttgggaagatttgtgaaaagcaagggattccatatgagtatgggaaaggacgcttggaggagcgctctcagctgttggaggacattagaaatgtgaagccaactcatgtcttcaatgctgccggagtcactgggagacctaatgttgactggtgcgagacccataaacaggacactatccgcaccaaatgt

SEQ ID NO: 10291 - DNA, 684 bp, Sorghum bicolor
  Clone ID: SORBI-28MAY03-CLUS75974_1
agcaatcggtggcccagaaagatttgctaaaaatgattcaccgccagatatcgtcgatgcctcgttcgtcgttccccatcatcaccgccatggatttctcgtaggctcccccatccgctcggctcgcttccctcctccccactctctctgatcccgtcgcacttccctcctcctcctcgccgccggcccccctctactcgtccgactaccgtttcctcgttccccctctcccttttcggtcggcaacgatcatcgtcggcagcaatcaacagggcaagcaaatcctcgatttccgccgccccactctcagctagcgcaagaggagcgacgcgatgtctatgccggaggcggggcaggccgcggagagggatgagcagcagcaggcccaggtgatcaaggcgctgatgcagggcatctgcgccgtgcggtaccgcaaggccgataacacgccctgccccatcgcgcagggtctctacttgggatctgttggagcagcattcaataaggaggctctcaagagcttgaacatcacccatatcttgattgttgcaaggtcgctggacccagtatttccagctgaattcaattacaagaagatcgaggtacttgacagcccagacactgatctgttaaagcattctgatgaatgctttagtttcatagatgaagctataagctctggag

SEQ ID NO: 10292 - DNA, 739 bp, Sorghum bicolor
  Clone ID: SORBI-28MAY03-CLUS75790_1
gccgggaggacagactgcaccggctgcagaaaggggtggctgctcgtcgtgaccgggatcagaagaagctggagagtatcctacttgcagagaaagaagccatctttggatctaaaccaagcccaaagagaacgagcagcttaagtaggaagacaaatgggtaccggccaaatggaaacactaatggactcaagactccaactcctcgtcgatcatctcttggcagtgctactcctgagcttttgacgcccagatcatactctggccataatagatactttggcgatttaagtcgcctatcgacttcccatttgaactttggtgacgattcactgtcaacatttacatccatcagtggctctgaaccggaatccccctctattggatgaacaccatactgctggacgattgaatggtctgattgacgaagtattgagtattgtaaatgggcaccataatacgaagttcttgcactggcatgtacattcctgatgtcatatatttagctcgtattcgactactaagtatttgataggttgacttggtttgggttgggttgggtgtgaagttgatttgtatcaagctattggctttgtagattgacaattaggcaaaagatgtagggagtgatttggatttgggcagtcagctgtaatatatcataagttatgtgattggtttgtgtgtgctttgtgggtccggtgctgtgcaaaaaatgtgtgtgcagaatctactactc

SEQ ID NO: 10293 - DNA, 874 bp, Sorghum bicolor
  Clone ID: SORBI-28MAY03-CLUS7603_1
cgtgactccgggacccagaatcggcggctgacgcaaggccgagcaggcgacggccgcagcggcgtcaatggggcacccttacgcgccggccgaactggatctgccgggcttcgtgccgctgaagctgtcccaggccgagatcctcgtgtcctacctcggcgcctccctcttcgtcctcctcgccgtctggctcgtctccggaagatgtggcagattgtccaagaccgaccgtctgctcatgtgctggtgggcattcacagggttgacccacataatgatcgaggggccctttgtcttcactcctgatttcttcaagaaggagaaccccaatttcttcgatgaagtttggaaagagtatagtaagggggactctaggtatcttgctagggacgccgcaactgttactgttgaagggatcactgctgtattggaaggccctgcatcactgcttgctgtctatgctattggatcccggaagcccttcagccatattctccagtttgccgtctgtctaggtcagctctacggatgcttggtttactttatcaccgcatacttggatggcttcaacttctgggtcggtccattctacttctgggcatatttcattggtgcaaatagtttctggatttggataccgatgctcattgccataagatcctggaaggaaatatgcgcagcatttcaagctgaaaaggtgaagaccaattaaaagcctgtcttagccaccatttgattggaaccaagacttctattgtggagaacatcatttgttgtctgaaattcttatgttggtattggaaactgcctgtactctttgctcaaacaaaattgtgaatttgtgatgcaaaaaaaaaaaaaaaaaaggccccta

SEQ ID NO: 10294 - DNA, 640 bp, Sorghum bicolor
  Clone ID: SORBI-28MAY03-CLUS80410_1
tgcctgaagggctggctggccagcgccgaggcactcctcgtccgcgtcccgattgtccggctcacgccgcccccaacgagctgggaaattgcggcaagtggctatccggagaaaggtgatgtcgcgagagcttatgagctgaccaaaaatgccctctatatgtacgcccctaattctggctgggtccctgagccttcgatgattgagacgatgcccaagtatccccgcgctgtatgggcccccaaggccggcggggccctcaggcctccgctgatcgtggcggtgcctatgtaccctggtatcgcgggggcggtctcgggggctcgtgcgagagaagaaaggaaaggtgaaggggcaagggaagctctccgtgaggatcttattgcctggccttgattgtcagtgaaatggtgtttcaatactgctgtctgatcctatattctccctccgtccaaaaagaatcttgctatgatgttcgtgcttagtttgactagtttttagaaagtattagtatcaattgtatctctaaataagtttatttagaaattgtattcagcgattaattatgtgagagagggagtgctgctcctaactatagagtaaattagtttgttatcggatcaatgatgggaagcgatac

SEQ ID NO: 10295 - DNA, 711 bp, Sorghum bicolor
  Clone ID: SORBI-28MAY03-CLUS80492_1
gcacgaggaccacacctaaccttctcggagctagacccacagcaagagagaagacgctggagacatcaaatccgttcctccactctcttccaaacaactaaaccgctccatttacgcggccggctagaaaacatacacgccaagatacatacttctgtcgatgtgtatatataccatggcttaattgaccatggacgtcgccggtgacggcggaggcggccgccgccccaactttcccctgcagctccttgagaagaaagaggagcagccgtgctccagctcggctgcggtgggcacgtcggcgggaggcaacgggaatggatcgggggccggaggagagatgcaggtgcggaaggcggcgcccaagcggagctccaccaaggaccggcacaccaaggtggaaggcagggggcgccgcatccggatgccagcgctgtgtgcggcccgggtgttccagctgacgcgagagctcgggcacaagacggacggcgagaccatcgagtggctgctgcagcaggccgagccggcggtgatcgcggccacaggcaccggtaccatcccggccaacttcacctccctcaacatctccctccgctcctcgggctcctcgttctcggcgccgggccacctccgcgccgccttgcctagccccgccgccgccgcacggttcggccgtgctgacgcgtgggaccgggttgtcggccttggctt

SEQ ID NO: 10296 - DNA, 841 bp, Sorghum bicolor
  Clone ID: SORBI-28MAY03-CLUS80812_1
ttattctagaagtgacatcacagccctagcaaaagacaaggtctacacacatgttcggctggatgagatgaccattcatcaggctttgcagcttggacaagatgccaatacaccttttggattttttaacggtcagagatgccagatgtgcctccgatctgatcctttgctaaaggtgatggagcgactggctaatcctggggtgaggcgggtgttcattgtggaagctgggagcaaacgagtggagggcattatatcactgagtgatattttcaagttcttgctgagcttgtgagaagagagaagaggagcatggacatttgtttgtgacaaagtgactggagggagttttaacagtagcaaacagcagtgtatgtgaagcaagccgccatgctaactctggcactctccctctctttggcctttgggcaagtaagacaggattgaaggtggcgggcttgtctttgcggataatggctgtccgggttcatggtctgtaaagttccttttttttttggtttcaagttttaaccattttgtgcctcccgttgttaccaaaatatctggtgatttttatttattggattgtttccttgcgttgctttgtcgctgagaggaccgaccgccggagctcccaaggagacaaactcttacatgcattctagtttttagggattgaacatggcattgctttcgcgggggcatttaccatgtagtgctggtgtccattaaaagatagaccgtttgtgtttgttttgctggttccatcagagcgatcaatcctgatgcctggctggatgttgtgtatttaattgatgctataataaatactaggttgggt

SEQ ID NO: 10297 - DNA, 964 bp, Sorghum bicolor
  Clone ID: SORBI-28MAY03-CLUS8105_1
gcacgaggagggagacaactgttttcagatggagatgaaagtgaacgtaacagatacaggcgccatcagagtttagatgtttccccagcaaattcaaatttgtctgagccaacaaaaattgtagtactaaagccaggactctccaattctcatgattccaggattgcgaggtcttcattatcatctgcagaagacagtgaagatgaaagtatgatgacggttgatgaaaccgtgtgctcaagaagattggcagcgcggggcacttggcagatgaggatgcggctaaaagacaagcaagacgaagagagcatgctctcacgtgaataccctgacttttatatcggagatgactccttcggtaaatcagaagttgagattgcaaaagagatgtctggtgaaacaagtgaggaattggagtttggcactccaacttctgggcgttcttgggattttctgagtagaagcggaagtccttactctgcatcatgctctagtcaggcatcccatagaagggaaccatcagtagttagggaaggaaagaagaagattttagagagatggtctatggtatcatccacagtcagtggtgaagaagaaatggaaggtcgcagaagtacaggcacacttggtgacatgctcacaataccgaaagtcaaggaccaggaagaaattggagctgaaacactggggagcccagcacttgagctggaacctgaagagtctttctcatgtttgccaagatctcgatctcttccactttctttgtcctatggagtcgctgagtcaaatggattagcctctggcactcaggaagctgaaaaggaaagaatcaggaagtcatcatcatttaggggaaaaagtttctagcctgttttctaaaaataagaaatcaactagggagaaagtagatccatctgcgagcataggactcaagcctggaggggctgtgactactggtgatgtg

SEQ ID NO: 10298 - DNA, 683 bp, Sorghum bicolor
  Clone ID: SORBI-28MAY03-CLUS81449_1
gctaccaccgcgccggtgtcgcctgaacggtcgccggcctcgtcgtcggtgaccgagtcgtcgtccatgacggagcaggagcaggagcagggcaacacggggagctcggccggcgggttccccatcaaggaggagagcttcacctcctccgcctcggacgccgaggagttccagttcgacgacaccttctggtcggagacgctgtccatgccgctcgagagcttcgacgtccccatggagccctacgacgcgttgggcgcgtcgtcggttggcgccgacggcgacttggactactggctcggagtgttcatggagtccggcgacgtgcaccaagaattgccgcagatttagaccgcgcgcgcgagaggaattttcagttccttggctaattgattcatggttcttttcctctccctctgcacacgtcttgcatcggaggggacatagccaattaacagaggagggagagagagagagtctccacgacgaaattaggcagaaattaaacaacgcgagaagatatctatcttgtttgccctcttgtatataaagatcgatcgacaagatatcggtgatcgaagcctatgctatgcaatccatctgagaagaattcttttgcagctgtgcatgcagatttcgatgtacagtagtgaaggatcacaagaaagggactcgggctctgc

SEQ ID NO: 10299 - DNA, 767 bp, Sorghum bicolor
  Clone ID: SORBI-28MAY03-CLUS77549_1
gcacgagggtctactggcaccaggatccgtcagtcgcctgacgccttcgtcgacgacctcatcttccacctccgggaccagctcacgaggctgcacacgctggacgcgcgcaagttcgtggtggccaacgtggggccgctggggtgcatcccgtaccagaagaccatcaacagggtgggggaggacgagtgcgtgaagctgcccaaccagctggcggcgcagtacaacgcccggctcagggagctcatcgtcgagctcaacggcaacctccccggcgccaggttctgcctcgccaacgtctacgacctcgtcatggagctcatcacaaactaccccaactacgggttcgagacggccagcgtggcgtgctgcggcaacggcgggtcgtacgacgggctggtgccgtgcgggccgacgacgagcctgtgcgacgaccgggacaagcacgtgttctgggacccctaccaccccagcgaggccgccaacgtgctgctcgccaagtacatcgtcgacggcgacaccaagtacatctcgcccatcaacctcaggaagctctactcactctgatcatttcttttggccggccgtcgacgtcgagcctttgcatttccggcgtgcaatgcaactgttgtatgtaatctgtaatttttgggtgcgaggaaatcaatttagcatgtgattttcgagtgtacgtatattgtactgtagccaaactataattaacttttaataaagacatcgaaggacataaaaaaaagttcggagaa

SEQ ID NO: 10300 - DNA, 841 bp, Sorghum bicolor
  Clone ID: SORBI-28MAY03-CLUS77651_1
caagccaggtttgccaaaccagccagcttgacgaatccaaagccagcgttggtggaatgatgagctttagtggagcgccagctggcggcttccacaacgaggccaaccccgatgacagcttcatgagcctgatgctgaaggcccagagagcgggtgaaactgatggcagcggttttctccatgatgccgtcgcccatcactcggatgagagcgcgcggttcatggcttaccacatggcagagtttgggaggtacggaaacaacaacgtctcactgacgctgggtttgcagcacgccgagaacagcctttcagtcccaccaaacacccagccaggcttccccggcgtccgagaccaagacatctacaacgccacagctcctctcaacgtcgcctccacatcttcagagtatgattcggcaagccaaatagatcaacaacaacaacaacggcagcggtttgagccgtcacctctgatgcatgatttcgtggcctgaatttcagctcaccactggaaaacacggggaaaagatttgccatttgtagtgccaggacgaataacacgcctggactgaattttcaggcgtggaactgtagctgtagttgcaattggggtacagaaggggaggaggtatattatagcgtaaatgttatgtaaagttagcgggggcgggggtgatagcggtaaagaaatcctgtaaagatggaatacatttatacgtgtaaaatacttgtatttaagggccatgctgtaaaaataggtttacctgtaatgagcacttatgatccaggtaatatactgtgcaggctgttgaacaaaaaaagtggttgtaaataagttgca

SEQ ID NO: 10301 - DNA, 831 bp, Sorghum bicolor
  Clone ID: SORBI-28MAY03-CLUS77744_1
gcacgaggccaaattcttaccagggtgatgacaacagaatgaagaatatgcagtctgaggcctcacaggcaatccggaactctaagtatctgaaggcagcacaggagttgcttgatgagattgtcagtgtttggaagagtgttaaacagaaaacagataaaggccctgctgaagcaggaaaggcagatggaaaagagactgatggggggactaaaagtgatggagtatcttccgatccacaagagtctggtgccaatgcagcagctgagctttcaactgctgagaaacaagagctccagaataggatggcgaaacttatggcaatgttagacgaggtggatcgaaagtacaaacactattatcatcagatgcaacttgtaatgtcatcgttcgatatggttgctggttctggagctgccaagccttataccgcagttgccctccagacaatctcacggcatttccgatgtctaaaggatgctatcaatgatcaaattagtgttatccggaagaaacttggagaggatgacactacatctggcaaagagggcaaactaactcgccttcgttatatcgatcagcaaataaggcaacagcgagctttccaacagtatggtatgctacagcaaaatgcttggaggccacagaggggactacctgaaaattcagtctcgattctccgggcttggctttttgaacacttccttcacccgtatccaaaagattccgaaaagataatgttatcgagacaaactgggttaacaagaagtcagatttcaaattggttcatcaatgcccgtgtccggctgtggaagccaatgatcgaagaca

SEQ ID NO: 10302 - DNA, 910 bp, Sorghum bicolor
  Clone ID: SORBI-28MAY03-CLUS7791_1
attatcgccatccatagagaccctcgacaacatccgcaacttcgatcgcgtccaggaagttcctcatgaaggtccaatgtgtgatcttgtgtggtctgatccagatgatcgatgtggttggggtatttctccacgtggtgctgggtataccttcggacaggatatatcagagcagttcaaccataccaatagcctaaggctaattgctagagctcaccaattggttatggagggattcaattgggctcatgagcaaaaagttgtgactatatttagtgcacctaattattgctaccgctgtgggaacatggcatcaatcctagaagtggatgattgcagggagcatactttcatccagtttgagccagccccaagaaggggagagccagatgtaactcgtaggacacctgactatttcctgtgatgcaaaagtgatgtggatctgcagcaaaggtttgatagataggtgcagtttcctggttgcagataattttttttgctggaatccctccgtgtgctattcttattatttttgcccatggcgctttggctgtcgcgggctgctttgccgcatcatgattcaagtgtatacctactacagctggaaggactggattgtgttctcacttatctctaactggttgatgcttttggcttggtgggggctgcagtggtggggtttcaagcatcaagcagcaatctgtattatgggaggaaacttttcccgttgtattcattttgttcccctttcttcctcacctgattttcttctctttcttcttttttccttttttgtgattcttgtagaggtgaacactttgtatggttctatgttgggccattagttttttctgactcccttgatttgccgtatagaattactttttaagcgcaactagtcaacctgtag

SEQ ID NO: 10303 - DNA, 700 bp, Sorghum bicolor
  Clone ID: SORBI-28MAY03-CLUS77941_1
aaggtgcgtggtttcacatttgacatcagctcaggcgccatggagtctcttgagcttgactcatttgggctttcgattgtcccttctagcttggtaagcacatactgtttatttgtcgaagacgtgttggatatagtctctgatacaatcgtggtgcatgaagacgcggtctcacgggttcaacggttaacacagggcattttgggcacccaaaacatccacggccctggtggtgagattgacgagtacagtagaattggggggggggaggaggaggagagcaaacggccagggaaagtccggtggccgagaactccgcagggaagcgaggcaccaggaggatgactgggagctgccgatggactattgacacaccgtaccggttgctttcgtgcgggagcaggaggaggaaacttgccgtggtagcattctgttttgtgcaaatcttgtgtagttgtgtgccggaatagtcaataacgtgatatgctttagctgtagtatacatgtaccatatcggaggattacgaattcagaaaagacgaaagggcggtgcccctttcagcctggtcatagtttggtcgctttggcccggtgggttagtgaaaagcgagatggtaccccttttgacttccccaacactggatgaatgtagaggactactatctgtaatcattcagtgatgcaatacttactggtattc

SEQ ID NO: 10304 - DNA, 1145 bp, Sorghum bicolor
  Clone ID: SORBI-28MAY03-CLUS82253_1
tccaaaccacccggagcaagcggccgccgctaagcagtaagcacacacgacgcaggtcgggcgggaatgcaacgcgccttgctcctccgcccgctcgtcgggtcccctctcgtacccgcgggtccccttgctcagcctgccgtgcggcgccgctgccgcttccatgggggtgtccgcgtgaggtcctcaaccggggaggacgggagcgagcccggaggcggaagcgggggcggcggtgccgcggcgtcttggctgagctcagcggtgggggagaaagtggacgagcttctgcgccgcgaagagaaccgggccctgctcgagggcgtcgaggacgccgagcgccgcgttgagcgcgcgcgcgccgcgctcgccgacatcgagcgccaggaggccgccgcgcgcttcgcccgcgacgaggttcgccgcctcgagaagcggcgcgatgagattgcagagtcccagcgggaattgcttcaagcaagagaaatgattgatgaagctcagcgatccttgtcttctagtcttgaggaaggaagctttggagatatgtcaagtggtgatgttgatcaagatagtgagagaatagaatctgtaaaagctgctgcaatttcctctatagttggtgtcctggctagtttgcccatatctttctatgaagttgaagatctgccacaactattccttcggtcatcaattgttttcatatgttgtgctttgtttggtgtcacattccggtacgctgttagaagagatctggataatatccaactaaaaactggggctcctgctgcatttgcttttgttagaggccttgctctgctggaatctggtagaaccctcgagctgagtactgataccttaatatcagttactcttgatggtgcagtcagtgtggttgagaacattttcatatttctgcctgctgctgttgcattggactactgttttaagatgagatttttgagtccctttcctagaagaaaacaatagcttctgtgaggaatatgtacgatcaataacaatcttgattgctcagatggtcatatgtaacgcaaatgatatcttaaattcattaagaaaaaaaattcccccctgtgctcatagatctgtcaagtccaaataatatttttacttgtcttcttcct

SEQ ID NO: 10305 - DNA, 670 bp, Sorghum bicolor
  Clone ID: SORBI-28MAY03-CLUS82312_1
taattgttcagatctgccatggcaatgatgaatttggggaaagctttgttgaggttaaagtatctgaggcagacttgagcagaaatcctgtaagattaactgagatcgagagcttggatggcgactgcatcttcatgagcccaagcagcagcaagtcattccgttgtcattatggtggaggtggaggtgaaggtgatcttatctatatctttttgggtccctcccgattagtctacaacatgaaagatggtactatggcaccatttgctgcagacatcccagaggacaaacttagggaagcagatggtaaaccgatgaatccagtatggttatttccttatgaatgaacttctgcatatcaactctgttagtctgatcctgtaatgagtcttaacgttagaagcactgatgccaattggggctaggggccatgatgtcttatttctcagagctgaaacaagttttctgttgttttatatggtctgttctgatgattttttagtagtaaacttatgtgtacttcttctgttttcaagttccaatgtggatttttattgcatttgcactcttgccttgtgggggagtctactagttcctatctagatgagcatcggtttcagatttgctggacaatattatgctgatgttcctctataccaaaattctctgc

SEQ ID NO: 10306 - DNA, 494 bp, Sorghum bicolor
  Clone ID: SORBI-28MAY03-CLUS8237_1
gcacgaggtggaactagcaaatggcttaggagttttgatcagcgtgtacgcgagagcattgactacgcaatctgcttgaacagtgttggttcctggagcagtgacctctggatgcatgtatcaaagcctccagaaaatccctatatcaagcaaatctttgaagaattttctgatgtctctaaagaaatgggtgtttcagttggaatcaagcacaagaagattaatgtctcaaatcctagagtagcatgggaacacgaacagttctcaaggtttagagtgactgcacttactctttcagaaatgtctacccctcctgaatttttggaaagcactggtggtcttcacgacactagagaatctacagatgttgagtcagtaacccgaactgtgagattagtttctgagagtcttgcgagacacatctacggattgaaaggaaggaacatcgacgtttttgcagagaatagcagcttagcagtaatcctcactatatc

SEQ ID NO: 10307 - DNA, 1189 bp, Sorghum bicolor
  unsure (1)..(1189): unsure at all n locations
  Clone ID: SORBI-28MAY03-CLUS82675_1
ctggagatccagcgaccccacctgtcacagtggcacgtccgtcctcctctcctccgctctccccaagcccaaaactgcacgctgcacggccacttcgcatcgcctcacgtcacgcactcacgccttcttcaaatttaaaggccaaaaaccggatcacatcgatcaaatcaaaaaaaatcaaatccatccatccagcacgcacgagggtgagctcccctgcttctctggatttcctttcgctgccccccagactcctcgtgcgcctcgcgggtcgcgaccagacgacgacaagcggcgagaggggccgatcgcgatcgggcagccatgtcgacgtcgcggaggcggacactcctcaaggtcatcgtcctcggcgacagcggggtcgggaagacgtcgctgatgaaccaatatgtccacaaaaagttcagtcagcagtacaaagctacaattggtgcagatttcgtcacaaaggaggttctcatcgaagacaggctagtcacgttgcagatctgggacaccgcgggacaggagaggttccaaagtctcggggttgcattctacagaggggcagattgttgtgtgctcgtatatgatgtcaactctaacaggtcatttgatacactcaacacatggcatgatgagttcctcaaccaagctagcccatcagatcctaaaacttttcccttcatcttactcggtaataagattgatgtagatggtggaaaaagcagagtggtttctgataagaaagcaatggagtggtgtgcttctaaaggcaatatcccttattttgaaacttctgcaaaagaggactacaatgttgacaatgctttcctgactgttgccaagcttgctctagagcatgagcgtgatcaggacatttacttccagagtgtcacggatcctgtccctgagactgagcagagaagcggatgtgcatgctagtagttagtcatcatccttgtcccttgcagattttgcttattgatttcggcatacttttccagcgatgccgggcaggcattcttatcaaatgttgctgggcaggcattttttttttcatttttcgcaactgtacactaatgttccaactgtccaactccgttttttctatccaactntgtaagatagttagtgaccatggtttttttgtacacggtgtactgatgtggtggccagccctttttct

SEQ ID NO: 10308 - DNA, 1342 bp, Sorghum bicolor
  unsure (1)..(1342): unsure at all n locations
  Clone ID: SORBI-28MAY03-CLUS8274_1
ccctcgcccgcagccgctggaagaagaggaagccgacgggagtgcgggggtggcgtcgccgccagagcaccagctgtagctcgcggctaggccttcgtggtccgtgccgctctcctcgcccaacacgccgtcatgctcgcggcgtcggcgcggcggctgtccgccgccgcctcgtcttcgtcttcttccatgcgcgccagccagctcgccgccgcacggaacccacagaggtggatgcacgacaggaacaagaaggcgatggagctggtggccaagggatggagtgcgctccaggaggttgaccgcgtcatcgactacgccgaccgcaatgacaagcgcctcatcccgcttctaaggggtgctaaggaaaactttgagctggctttggagattgataatgataatacacatgcgaggtattggctgggcaaaatgcatttcaagtatcatgttcctggagcttgtaaggcagttggtgctgctttgttggttgaagctgcaaatatgggtgatccagatgcacagtatgaacttggatgtcgactaagaattgagaatgactatgttcagtcagatcaacaggctttccattacattgagcaagctgttgatcagctgcaccctggcgctttatatcttcttggtgctgtatatctaactggagactgtgttaagagagatatagcttccgcgttgtggtgttttcatagagcttcagaaaagggacatgctggtgctgctgtcgcatatggatccttgcttcttaaaggtgctgaaatacctgaagtgattacgagattcaactcaggcaagagtccatcaactgggaaaatgcggaaaaggcccctgcagcaggatccaataaagctagcgaaagagcagtttcaaatcgcagctgaggcaggctgtgatctcggtttgcggtggttgaagaggcttgaagattatgaaacccaagaagaaaagctaaagcagatccagcattgacatcccctgaaagaatctcattgcattcgcatccaagtatagtatatggcagcccggttgttgcacgcaggtataccaataactattttnccctgtctttcactactgtaggaggccgttcgattttaggatgttttggtcaactgaaattgcagggaactcatactgaaattttgatgtttcgactaactggttggactgtaggtgcttcaatgttcgctttttgtgatgtattagcgtgagaattactggaaggtctttagttgtttatagttttctcccctgcaacagtttcctgtcctaatcggtatgtcggtggcactttttttaaagctgtatgttgatggtccttgtt

SEQ ID NO: 10309 - DNA, 1263 bp, Sorghum bicolor
  Clone ID: SORBI-28MAY03-CLUS7893_1
ctgttggcctctggctcggctgcttctgcttgctcccccaacacgtcattccccctccgtccgccgcggctcccaccacctccactccaccgcgccccgctcccgctcccggacggatctcgagcctcccggggactgagcgccagccgcgaccgcgatggccgacgcgtactggaggtacgctgccgccgacccgcgccagcagcagcagcagcagccgcagccgccctctgccggcgggggcatcgggcaccccggcatgggcggcggcgcaccgcagatggcccccgccgtggggcagcagcagcagcagcccatgaagcgaccccgccccgccgacttctcagatgtacccggtgcacctgacatgactggctattatccacgtgatgaagaaagggcaggatatcgtcctgctagagatactgaggctcttaacgcgtcctacgaacgttttctgcgtactgggcaaattcaatcctttggtggtggacctgctggagaacctattaggcctgctgttggtggcaatgctggctacccagttgatgaccgttcgatgatggctgctaggggtatggatagcagaaatattggtttcggtggtggaatgccagagccaccccttccacctgatgcctcaaacaccttatatattgaaggcattccaactggctgtacacgtcgagaagtttcacacatcttccgaccatttgttggctttcgtgaggttaggcttgtaaacaaagaaccgaaacatcctggtggtgaccctattgtcctgtgttttgttgatttcgcggaacctacacaatctgctattgccatggaggctttgcaaggctataagtttgatgagcatgatcgcaattcacccaatttgcggctgcaatttgctcgatttacgggtccaagggggaattcaggacctggtggcggtcgtggtaggcgataagttcttggcgttccttttgccaggcctgttcacagcgaacacccatgtgggatcttgttagtttgatcaccgttccagagatattactctatacttccataggaataggattggtagcttggaccttgcggttccagctttgagaccctggtctcgccagatgttttctaggcagaatgcactagctgaacatattaggtccaaacatttgtaccatcccgcaggcgtaatgcctaatattgctgaagttgtttgtaatatgctgatttgtatcttgaggcagtttggctgtttaatccgtggacttg

SEQ ID NO: 10310 - DNA, 1346 bp, Sorghum bicolor
  Clone ID: SORBI-28MAY03-CLUS790_1
agggtttcaaaatgagtaaatcagtcggtaatgtagtggacccagagaaaatcattgttggtggcaaaaaccaaagggaagaacctggctatggagcagatgttctccgtctatgggtttctagtgttgattactctaccgatgtgttgattggtccacaaatcttgcgccagatgtctgacatgtatagaaaactacgaggcacgatgcgatttctgctgtcgaatctccatgattggaagccggataattctgtgccctacaatgacctgccaaaaattgacaagtatgcacttttccaactggagactgtcatggcttccatgaaggatagttatgaaagttaccaattctataaagtatatcagatgcttcaaagatttgctactgttggtttgtccaatttctatttggatgttgcaaaggatcggctctatgttggaggccgagttagcttcacaaggaaaagctgtgttctagtcctcatggcacatctgctctaccttgttagggccatttccccgattatgcctcacttagctgaggatgtctggcagaacctaccctttcaatacaccttgcaggatggatcccctgcaaactttgtttttgacctgaaatggccagaaaagaatgaagaatggctctcagccccaaaggatgatgttgatttcctgggtgttatcctggagctgaggtcagaggttaacaaaattttggagaatgctcgcactggaaagttgattggttcgagcttagatgcgaaggtctatctccataccgaaagttcagatacagtattaaagctgaaggagctatcttctgcatctaatgatgcagatgctctgcatcgcctcttcattacatctcaggtggatgttcttccaatcctaaatgaagaaattacatcatctgtaccatacacaggaaagttcagtaacccacacactggagacatatggattggtgtgactcgtgcggatggtgcaaagtgtgagaggtgttggaattacacccaggacgttggatctttccatgaccatcctactctttgcggtcggtgttatggtgtcattgatttgcagccacaacctgctgccgcagctgtcagttgaaaggagtgatgtcaacatacgctattgaaccttctctttctgaggatcatttggtggaattcattcttttggagagagcttaaacgctaccatgcaaaagacgtataggtgtggcaagtagcctgtgactccagcttgaatcaaagttttgcatgtagcaagttgtactttagattgtcgaactaatacataggtcatgagagtggagctttggaaatcgcttaattttcc

SEQ ID NO: 10311 - DNA, 703 bp, Sorghum bicolor
  Clone ID: SORBI-28MAY03-CLUS7923_1
cctccgctcacactccactggcgcgcatagtctctacactggcagcagctgagatgggcgtggaggagaacggcagcagccccagccccgccgacgcggcggcggcggtgaccgtgaccggagcgcgcaccgtggcgccggccaagaaccggtgcacgctggccaccttcgacctgccctacatcaccttctactacaaccagaagctgctcctgtaccgcaccaccgccgcgccggacttcctcccgttcccggacgccgtggcgcgcatgacggccgcgctcgccgacgcgctccgcgtcttctacccgctcgccggccgcatcgtcgtccagcgggaggaggacgacgacggcggcggcggcgcgggcccgggcgcgctcgccgtggagggcgacgacggcgccgaggtcttcgaggccgaggccctgggcgtcgccgtcgacgacctcgccggtggggactgcaccgacgaggcggagaaggtcatgcagcaactcgtgccctacactggcgtcatgaacctcgagggcctccgccgcccgctgctcgccgtccagttcacgaagctcaaggacggtctggcggtggggtgcgccttcaaccacgcggtgctagacggcacgtccacgtggcacttcatgtcgtcctgggccgagctctgccgcggcgcccccctgtctctccagcccatccacgaccg

SEQ ID NO: 10312 - DNA, 1111 bp, Sorghum bicolor
  Clone ID: SORBI-28MAY03-CLUS79243_1
tcggcgccgccgttgctcctcccccgtcgccctcccaccccacccctcccgctccccacacggcatggggacaccccgcccgcctccccgctgcccaccacatatccgcctttgccttgcccgcgccccacttctccccgccccactctgcttcgtcgccgcacgaggggggccgtcgcgcatcccgccccgtctactgccgatcagcgccagcgtaggagctccctcctcgtggacatacgattgtactcacacactagtagtacactactattgtacaacagctttacattattttctccacttgcctaattacatattacattttctcaggaagtgtggggcacaacaagtgtttggcttaagttcatggaaactggttctccacaacctggtggacgtgcttttgggttttcattttctattgtgtgcaccaaccttagtattatatctcaaacacaaactactatatattgcgcgggggggcccgtgccggtcggctcgtgacggagaggctgcgctccctggcgcggttccagccggggccctggcgggggtccgcggcggcggtggtgggcgccgggcgcttgtgcggggcagttgggcggccgcggccgccctgccgtgtcgaccggagcgcggcggacatgggccatcccgttgggatgtgcaatattggagactccttcctcaaagaccctaggtgcctaggtgaaagtgttgctgagctggcccattaaacccaatgatttgaagatctgctgcatcgacgtcctcttctcagttctcattggttgtagccaacaaattcaagtactgcaggaagtgtgaggcacaagtgtttggcttaagttcatggaaaatggttctccacaacctggtggaagtgcttttgggtttttatttcctactgtttgcaccaaccttagtattatatatcaaacacaaactactatatattgcttgctggtgtgcattcatgtaagcttttgttggagaatgtagtatgcaagacaagattgtatgcttgactttgttggatgatgtagtgttatgtaatgtgcaagataagattgtatggtacaatatatatgtatcgacctccatgtca

SEQ ID NO: 10313 - DNA, 695 bp, Sorghum bicolor
  Clone ID: SORBI-28MAY03-CLUS80403_1
ctggtttagtgttgactgcggtccggcagacgcgatgcaggctctgagtcgcactgggcggcatgcaccttgtttggagcacttccccgtcccgttctgcaggttctccactgtctatgactcgagctgggagatggaatctataatcatcatcctgcccactcacgattggaagtagcgccgtggtttggagcgggagctgctggagccaatctctgattttgatcacgagatagaactcaatgagctcgtctggtctcttgcctctagatctaccgttgccagtggaaatcttaacgaaattgacgtgcttcatgcgtatgctcttcatctctgcgttattccagtagtgctgcatgtctggataagctcggcccattgcaccgtgacagtcagggtattcgctatgttttgttccttggggccttctagttcgattgctctaccacttgtatatgttcgaaatgtgtatgtcaagttggcgtgcatagggcgtatggtcttcatttctgtgttactattgtgatgatgcataagttgatacgccaggaccaatttaccgttgcagtcatggtttgggtcaattttatgccgtctggggttcggtcgtcttttgaccttttgggggtcagtggtcgtttgtccttttctatgtaagtgttcgaaattttatttgctgccgttggatatgataa

SEQ ID NO: 10314 - DNA, 762 bp, Sorghum bicolor
  Clone ID: SORBI-28MAY03-CLUS84572_1
gcacgaggcacgcgcccgcgtgcgttctgactgtctctctcgccccccctctcgctctcagaggagagactcagacgactggtgggccgtcgccgccgccgcccagagccaggcgctgaggctttcgttggtcttttcgccggcgacgagcaaccccccagtggggttgtgtgaccccacaggacccaaaacaggtagctgccatcaaggatggaaggtctctccatcgatcccaagtggcttattgacccgaagcttctctttgttgggccacgcatcggcgagggcgctcatgcaaaggtctacgagggaaagtataagaaccaaagtgttgctatcaagattgtgcacaaaggggacacccctgaggagatgaccaagagggaggggagattcttgagagaggtgaccatgctgtcgagcgtgcagcacaagaacctcgtcaagtttataggggcttgcctagaacctgtcatggtggtggtgacagagctactagtggggggctcgttgcgcaagtatttggtcagtctccgacctaggagccttgagactcatgtagcagtggggtttgcattggacattgcccgagctatggaatgcttgcatgcacatgggatcattcatcgtgatcttaagcctgagaatttgttgctgactgcagaccagagaacagtaaaacttgttgatcttggtttggctagggaagaaacattaacagagatgatgactgctgagacaggaacataccgctggatggct

SEQ ID NO: 10315 - DNA, 859 bp, Sorghum bicolor
  unsure (1)..(859): unsure at all n locations
  Clone ID: SORBI-28MAY03-CLUS8464_1
gcacgagggagattcttcccctccttctccagatatacttatcagagcagcacagacagcaattctccacatatggcaagcaaaaggattcagaaggaactcatggatctgcagaaggacccaccgacatcatgcagtgcagggcctgctggagaggatctattccactggcaggccacaatcatgggccctagcgacagcccctatgcaggaggggttttctttgttaatatccattttcctcctgactacccctttaagcctccaaaagtgaacttccaaacaaaagtttatcacccaaacatcaactctaatgggagcatttgccttgatatcctcaaggagcaatggagccctgcactgaccatatcaaaagtcctcctctccatcagctcgctcctcactgaccccaaccccgacgacccccttgtccctgagatcgcgcacatgtacaagaaccagaggcagcgctatgaggaaactgcgcgggcctggacccagaagtacgcaatgggctgattctgtctcaccgaacaatattgccactgcaaaggtcgtcaggacattgtaagaattaagttggctgatttcctgtggtggccactgcaaagatcatcacaccgtcttaagagcccagatggctgtgtaaattatattagcttctcagaacaaagtttctctgtgtgtacagtacttttgaagctggataattcggggttctttgccgaaaccttggtttacactttgttccctgaattgcatatgtggccatggaatttcncatgtgtaaccttgccaagaaaccaatagcagtttgtatgttgtgaagatgttataattcagaatggtggtttgcttc

SEQ ID NO: 10316 - DNA, 876 bp, Sorghum bicolor
  Clone ID: SORBI-28MAY03-CLUS8465_1
ctactggacgtattccctgctcgtttgttcgtctccctcgcaccgcaccgtcgcacgagcgtttcgaccgcacgggtggaagcgaggacggaggagctagctgcctgccggcgcgcctacccagccggccgccgcccatcccgcccgtgctctctccctccaggtcgcacaggtgccgcgccggcggcccccgcccgccaggctccagctccaggtcactggccccgctcgcagcgcgcacgaaaacgcacgcccactcgccaccaccgcccccgcgcactgcgacgaccgctgcggcagaggagttagcagatggcgccgctcgtgccgatgtcgcagccatgggtggagaaataccggccgaggcaggtcaaggatgtggctcaccaggaggaggtgattcgggtgctcaccaataccctccagaccgccgacctgccgcacatgctgttctacggcccgccgggaacaggaaagaccaccaccgcactcgccatcgcctaccagctctacggtccagagctgtataagtcaagagttttggagctcaatgctagtgatgatcgtggaattaatgttgtgaggacgaaaatcaaggactttgctgctgttgccgttggtactgcacggaaagctggttatccctgtccaccttacaagattattatacttgatgaagcagattcaatgacagaagatgcccagaatgctttgaggcgtaccatggagacttactccaaagtgacccgattcttttttatatgcaactatatcagcaggataatagaaccacttgcatcgagatgtgccaagtttaggttcaagcctctttcagaagaagtgatgagcagccgcattatgcatatatgcaatgaa

SEQ ID NO: 10317 - DNA, 1007 bp, Sorghum bicolor
  Clone ID: SORBI-28MAY03-CLUS84898_1
ctactgacttcccattccgtgaaaggaactcctatccgcagccgccgcaaagcctagactagagagagcccctgtgcctgtgcggcggcctcgtcgtcgtcctcggcctcggcctcgtttcttccaccccgggcgggccgcggccatcagccaatccgccacggccgtgccagccaggcgaaaaggccgcctcctttttttccttcgcatttccctttcctcgccagcctttgaccgcagattcccgctccaaccttcgcttcccttccagcccgtcgctcgcgacctcgcgtcgcataaatatacacctctgtggaacaccatccgcgcgtcaaaggagagggagaggcgagctcgagctccccacgagcctcagccctctcaccctcaggataaattgacctgtagcagcggcggctgctagggccgttgctgttcgtggtcagcgttccgcgtggttggtcgcaatggcggcggtggcggagtctctgtccgtgtccgtgtccggttccagtttcctggacctccgcgcggcggcgccgttcctggtggcggcggtggccttctacttcctggtggagcagctgtcctaccaccggaagaaggggccgctccccggcccctcgctcgtggtgccgttcctcggcagcgtggcgcacatgattcgtgacccgacggggttctgggacgcgcaggcggcgcgcgcgaagcgctccggcgtgggcctcgccgccgacttcctggtgggtcggttcgtggtgttcatccgcgacacggagctgtcccaccgcgtgttcgccaacgtccgccccgacgcgttccacctcatcggccaccctttcggcaagaagctcttcggcgaccacaacctcatctacatgttcggcgaggaccacaaggacctgcggcgccggatcgcgcccaacttcaccccgcgcgcgctctccacctacgccgcgctccagcagcgcgtcatcctggcgcacctccgccggtggctggaccgg

SEQ ID NO: 10318 - DNA, 1032 bp, Sorghum bicolor
  unsure (1)..(1032): unsure at all n locations
  Clone ID: SORBI-28MAY03-CLUS8501_1
gcacgagggcctttggtcattgtgtgcaacaagactgacttgcagccgcttgaagggctttctgaggatgacatgaagctagtcatggagatgaatgcagaggctatgaagactataacccaagctggtggtcctaatggcgcgggggttttgttgactatgagcactttaactgatgatggtgtaatggctgtcaaaaatgctgcatgcgagaggctgcttgaacagagggtggatgtgaagatgaagtcaaagaagatgatggattgtgtgaataggtttcatgttgctgttccaaagcctcgtgacaacaaggagaggcctgtttgcatccctcaggctgttctggaagctagggcgaatgctgctgcaaaggaaaagaagaagcttgagaaggacattgagaatgagaatggaggtgctggggtgtattctgcaagtctcaagaaacattatatattggccaatgatgaatggaaggaggatattcttccagagatactggatggtcacaacgttgccgattttctggatccagatatcctagtaaggtgtgaagagttggaaagagaggaagggcttcgtctggaagaacaagctgcagaagatgctttccagattgatggtcatgaactaactcaggaacagaaggagattttggctcagattaggaagaagaaggcattactcatccaagaacatagaatgaagaagagaactgcagaaagccgtcctattgtccctagaaagtttgacaaagataggaaattcacaactgataggatgggacgtcagctttcctccatgggtgtggatcctagtgctgccatgaatagagctcgcagcaagtctaggggccgcaagcgcgagaggtcattgagcagagctgcagctgatggtgacagtatggagatagatggccagcaatccaacaagaaactgcgtcggacatcaaggtctaggtcgaggtcacggggctctgangaggtcattcctggagagggattcaaggactctgagcagaagaagaag

SEQ ID NO: 10319 - DNA, 814 bp, Sorghum bicolor
  Clone ID: SORBI-28MAY03-CLUS8148_1
gccggcctggccccgggaaaagtgtgctaccaggtctactgctcgaactaaccagaaagatggcggcggcggcggcgggcggcgggctctccggcgacgttccgatattccacgcggaaaacctcgtcagcaacgtcaaatcaatcaactacagccggacattcttgtcaatcattagtggagttgttgctggaatatgggggtttacaggcttgatgggatttgtgttctactttcttgtgatgatggttgcatctctaatgcttctggtgaaggccaaagtttcggtccatacatactttgacagttggaacaggattataattgaaggagttcttgggggcctgatgtctttcgtgttgttttggacatttgcctatgacattgtccacatcttctgatggatgaaacaagagctctcagaagaactggggaaccatgtgatccctccttgtatgagacagaatcaatgtgtaattgcgcctactctgccatctggggactatgttcagtggacaaccgtcctcaattggtttgttgctgtatactaaacctgaactttaggaagctgatagcctataaatgaactcaggttagcagagttccagactcatgtaactccacagctgtcagcaagctctgcaaaatggccatgcagtagagcacgcaatttgtaataaaatgggcattatggttgcccaggttactgaccagaacatatgaaacatataaccactcccttcattccaaactataagccgttctggattttttaggtatataactttattttatatataaatgtaacgtatat

SEQ ID NO: 10320 - DNA, 664 bp, Sorghum bicolor
  Clone ID: SORBI-28MAY03-CLUS81710_1
cctactggacaccccaaatccacatctatccattaatctcaattctcaccagcgagcagcagccgataacaataatggctttccagcaccgtcgtcgtcgtccatggcgcctcctagcggtaccggtggcagcagcagctctcctcctcctctcccagctgaccgcggcggcgaccgccggcggcggccctggcgacgtggccgtgtactggggccggcacaaggacgaaggcacgctgcgcgaggcgtgcaacaccagcgcgtacaccaccgtgatcatctccttcctcagcgccttcggccacggcacctacacgctggacctctcgggccacccggtggcggccgtcggcgacgacatcgactactgcaagtccatgggcaagcttgtcctcctctccatcggcgggcagggcggcgagtactggctgccctcggcgcagtccgccaccgacgtcgccgactacctgtggtacgcgttcctcgccgggaacagctccgctccggctccggcgccgccgtggcacggccattcggcggcgcgcaggtggacggcatcgacttcttcatcgaccagggcgcggcggagcactacgacgtgctggcacgccgcctgtacggctacaacaggtactaccgcggcggcgggatcacgctgacggcg

SEQ ID NO: 10321 - DNA, 787 bp, Sorghum bicolor
  Clone ID: SORBI-28MAY03-CLUS818_1
atgttgtggctactagtgaagtcagcatctcgttgactctagatccatcaaaactatggagccgtgaactgatccagcaggaacttgatcatgttgttgaagagcttgaaaaattttctgttgttcatctgctccagcgtagatcaatcatctcactgatagggaatgtacagagatcatcattggttcttgaaaaggcacgcaatgttctacgtagaaatggtgttaatgtccagatgatctcacaaggggcgtccaaggtgaacatttccttggtagtcaatgacagtgaggcaaaacagtgtgtacaagccctccattcggcattctttgagaatggcttcttgtcagaagtagagggagctgatgttccccagaacggctcctctctgaactcaaatggcgctatctatgcaaactagtcgactctgcaactgcattctcagatttatgtaccattgataggttaaatggcgattcatagctacttgtttaggtcacccagggccctgagcaaattccttgatgttttaagaacttactaggaactgtttgcatggtatgcaatcgtttaccgtgtgattgggtgctaccaagtagtagccaatgtcttggggatctgccacttgcattcccaagcttattatatgttgagttgtactgtatgtgaaagttataagagaattgcttgcgccctttgggtggtgataaagtttgtagtttcagactgaactcagtggatggaccattatcaggttgctcatgatatgtaagcgaatgtgatctg

SEQ ID NO: 10322 - DNA, 656 bp, Sorghum bicolor
  Clone ID: SORBI-28MAY03-CLUS81927_1
gtgtgactgatgagcttctcaagcaaactttcagtccatacggagagcttccccgtggcaaaatacctgtaggaaagcgttgtggatttgtccaatattctaacagggcttcagctgaggaggccataaggatgctaaatggaagccagctgggaggtcagagcataaggctctcatggggtcgtagccctgcaaacaagcagcctcagcaagagcagaaccaatggagtggtggtggctattatgggtatccccaaggatatgatccatatggttatgctcgcccccctcaagatcctgccatgtacgcctacacaccatatccagggtatggaaattaccagcagcagccaccacagcagcccccaccacaacagtaagaatgatgatggcccgagaggatcatttacaaactggtcgcaaagtagttggggaaactttggtgcattggcatgagaaattttgcgacggttgcttgtgttatattggcccaacgcccttgtacacgtagcctgtgttgtaacttaattttggcaaggcctagagtgactagtgtttcagctgtagtaactggattggacatttttccactgttcgagaagttttgtcgcaaggattttcttcaagctcttattgctggaatcttggagaaagtt

SEQ ID NO: 10323 - DNA, 1053 bp, Sorghum bicolor
  Clone ID: SORBI-28MAY03-CLUS8194_1
gcacgaggcgaagtctcagatcacttggagcaaaccaagtgcatcctaagaattggtaccccattcctctgatattctgccgtccatggggtaaacttccggaaaatgttccttgtcatccaaaacttcgcgtcttcgctaattgtatgaagaagaagggtcgtggtatgttcatttttgtctcgataattgatggtgattaccatgaactagctgaggatgcaaagactgcctgccaccaactggatgcttacattgactacaaacgctgtgagggtgttgcggagatcattgtagctcctactatgtctgatggcttccgtagcattgtgcagacaatgggcctaggaaatttgaagccaaacattgttgtgatgcggtaccctgagatctggcggcgtgagaatttgacacagataccgtcaacatttgtcagcataataaatgattgcattattgctaacaaggcagtagtcattgtgaagggactcgatgagtggcctaatgagtaccagcgacagtatgggactattgacctctactggattgtaagagatggaggattgatgcttcttctgtctcagctcctgctgacaaaggagagttttgagagctgtaagatccaagtcttctgcatatctgaagaggatactgacgcagaggagctgaaggctgatgtcaaaaagttcttgtatgatcttaggatgcaagctgaggtcattgttgtcactatgaaatcatgggagtcacacatggagagcagcagtagcggtgctcagcaggataactctcatgaggcttacacaagtgcacagcaaaggattagaacataccttgacgagatgaaggaaactgctcaaagagaaaggcagccactaatggagaatgggaggcaagttgttgtgaatgaacagaaggttgataaactcctttacacaatgttcaagttgaactccacgatactcaggtactccagaatggcagctgtagttcttgtgagccttcccacaccaccattaaatcatccttcatatttctacatggagtacatgg

SEQ ID NO: 10324 - DNA, 667 bp, Sorghum bicolor
  Clone ID: SORBI-28MAY03-CLUS82211_1
tccctcaatagtctttattgatgagattgacgcagttggaacaaagaggtatgatgctcattcaggaggagagcgtgagatccaaagaactatgttggagctgctgaatcagctagatggttttgactcacgtggagatgttaaagttattctagcaacaaaccgcattgaaagtcttgatcctgctttgcttcggccaggccgtatagaccggaagattgaatttcctctcccagatattaaaactaggcgacgcatcttccagattcacacggcaaaaatgacattagctgacgatgtgaacttggaagagtttgttatgaccaaagacgagttttcgggcgctgatattaaggcgatctgcacggaggctggattgctcgccttaagagaacgtagaatgaaggtgacccatgcagatttcaagaaggcaaaggagaaggtgatgtacaagaagaaggaaggtgttccggatggtctctacatgtagatgtagcgaattggagcctcgtgccttgtcagaacaagttatcctattgtactagcgcctctcgtcatcatgggagatatgttgggttggttgccacaattacttgttgcacattgagctaagtggtcggagaacgtgtattatcctttgattgtttctagtaaaatttccctttgg

SEQ ID NO: 10325 - DNA, 721 bp, Sorghum bicolor
  Clone ID: SORBI-28MAY03-CLUS8700_1
ctcactgctgccgactcccctctcccctcccctagacacagacacagacacagccagccagccagccaaaccgctcaccgcacacgccgaattgaagcacccagccagccaccatgtacgccgacgccgggttcggcttcgccgccgcctactcccccgccctcgcttcctcgcagccccagccaccgccgcccttcgactacgccttctcctccgcgcccgtgccagcgctaaccatgcccgccatggaccacgacgccttcgccgccgcctccgcccacctggggagcttggtacagccatccatggtatcagaatatgacctcggaggagaaggggacctgttcaaagctccagaagccatcatcgaggaaccgctgctcagccttgatcctgtcgcagctgcgttttcaatgatgactggcaatgaaagtgccatggatcaaactatcaaggatgcaggcatcggcaccatcccaaatgaccctctcctgagtgaagtgttatatgagtgcgagaaggaactcatggagaagtctgcaatcgaagagacaatttctgaacttatggatgttaagattcctatgctgcaagttgaagaaatcccaagccaagctgagcaagttcttatacagacccaactcccggccatggagaaagagaagcaatccattcctgaatgctcgctccagaaaagtgttagttctggatgcctcaactc

SEQ ID NO: 10326 - DNA, 928 bp, Sorghum bicolor
  Clone ID: SORBI-28MAY03-CLUS8723_1
attcagatgtgtgagcaagctgcagaggcacagaagtcaaaaggttcacttgggcggcgtggtagaacaagctctgatcctagtggaaatagcagggattctatatcagttgatgctattctgtctaagaatttatctacatcggttctgagtgccgaatcttcatccaaagtctacctcatcaactgcttgtcagctattcaggagccattgatgggccaggaggttgctacaagctatgtaaacaacctgcgctctatgattgaagcacatatttgtgcccttgtcgataaagaagttgacagcattcttaggaaatgtggactgtcaaataagatgccatacataaaggagtatggtagcaaggctgatgcaaagcctctggcagatattatcgagacgtcgccacaaatgcttctggaatgcttgaaggcgttctatggcattgtgactggaacagaaggttccttgcctgaatttgagcagctgcaggttccaaggttacgttcagatgcctgctatggtttggcaagagctctagcagaatcttatgagctcatttacagcgcagtgatggatccaaataatagttatcctgacccaaggtcgttggttaagcactctcctgaacagataagaactatactggaaatctgaagtctttgcaccatgccttctaatactatgttaagtagaggtgtttcatgcacgaaacattgctatgtaaatttccaactacaagctgtgggttcaattgattacagaaatattgaagtggtgactctttctgaactcttgtatcagtatctagtattctagtgtctcctctattcctttttactttttatatagttattgtttactcaagtgctgtaattttgatgtacagcttgaccgattaatatgatacaggtggtatcctaaagct

SEQ ID NO: 10327 - DNA, 1411 bp, Sorghum bicolor
  Clone ID: SORBI-28MAY03-CLUS8765_1
gcgaagcgggcggcggatggcgcgcgggctgcgcggcgtccgcgacgacctctccgagctggggcggcacctgctggacatcgcctgcttcctgcacccgctcctcaacccggcgcacaccgactcgccgccgccaaccccgacgggcccgggcccgcgccaccgccgcgcgcgccgctcaccgtccccgcacccgccgtcgtccccgtcgctcctcgcgggcatcctctccgacctcgccgagatcggcggctccttccgcggcggcttctctggcgcagccgccgccgccccgtcctcgccgccgccgcccgctgcggtcgagtcgcagcaggccgccgcgtccccgccttcgcctgcggctgctgccgaccagatcgcagttgatgtcgtgggagcagcgcgtgccctcgccgcgcgccccgaggcgtggatcgacttccccgtgctcgccctagatgaggattctgtaatctctgatatccaaagagatcatatggaatccattgaaaaacttgttccagatttagcatctctacggggtaggctctgtccttcttacatggatgaagacatattctggaagatttactttaggttgcttgagtcaaacataattgagcatagttctgaggaagatacccagagtgtgccaaattctgtacatcacaacaatgagatagagtcagattctccacctcacgtctgtgagatagaaagtgtgaaaagcaaccaagaagggtatcaatcgcacgagggtcgtgctttgcccaagacaagatccgagcgaagcattgaccaatgggtatttgcaaagtcgaaatctgaggaaagcatggatcagtggtctgaaataccttcagatgtggaatccttcagagaaggtaaaagatacctcagtagcgaggagctgagcgacgttgatagtgccaacgtcgttgtcatggacaaatacatggattcgcttctctcggaccggaggcacctcccctatgctagctcctcagtgcgccaggattcagtcagacgaaaacctgcttcatccactgattacagccatcggcctccacagccaactccacctgcatcactgtcaaagaaggaatcatgggatgtcattgaagactcggagtttgatatacttgacagttagtagttgagatctttgtgatctcaggtctgtttatccttctattttcttccatgtttccccacacttcacctggtttgtaaatgtggacgtgcaggtggcgtcagtgatagtgggaaaggattaatgatctttttaccaatatattacaacagtcagtgtgtgcatataaatcttctcagctcgcaagctgtaagcctgtaacctgagaaaattgtgatgaatctgtctggcatcacctagttaccaaatggggaatgg

SEQ ID NO: 10328 - DNA, 766 bp, Sorghum bicolor
  Clone ID: SORBI-28MAY03-CLUS87747_1
gcacgaggctcctcggcaccttgcacgaactctcgtcgtcggatgttaccgttactgcccctgtttgctgtttctctcttccctgggctttggtccccttcttcgcgtccagccaggatgaccaccatgaggccggccatcctgcttacgatctgcaccttgtccgcgctgcttctggtggcgcgcggcttggagaagccatcggtcgcgccggtggtggccgtgggggtggcggcggccagtgatctcatccgctccggtggtcaccgctacctggacgtcagaacggaggaggaattcaggaatgggcatgtggaggattctcttaacgtgccctatcttttcttcacttcacaaggaagggagaagaacccccggttcgttgcacaggtcgcagcagatttcgacaaagaggacaacatagttgtgggctgcaaaagtggagtaaggtctgaactagcatgtgctgatctcatggcagctggatttagaaatgtgaagaactttgaacgtggttacaccgcttgggtgggaattggtcttgctgggacgaaatctcaaggacaagatgaactatgatgtgccctattctctggttgtttttttctttgaacgtgaacctccgtatagataattgtaggattaaataaacaaaatttatatagtttgctttacacttttaatcatttggaaactttttaacagagcacatttgcgtcatgtaacttcttaatatagtttgtctaattgtagatttttttggggg

SEQ ID NO: 10329 - DNA, 784 bp, Sorghum bicolor
  unsure (1)..(784): unsure at all n locations
  Clone ID: SORBI-28MAY03-CLUS881_1
ctggatttgaaactctgttcctgtttccacacgtgaggccacgtcgtagggttttgcttgcttcgcccggcggtaaagcggagcgcggcgaccgccggcgcccggccatggagatcgggcagtaccccgtgagcagctgctccaaggagcaccagaagatctaccaggagtggttcgcgctcgcggacgcagatggggatggccgcatcacaggacccgacgcgatcaagtttttcggcatgtccaagctctcccgccccgacctcaagcaggtctgggctatctcggacaccagacggcaggggtacctgggtttccctgaattcgtcacggcgatgcagctagtctctctggcacaagcagggaatgagattactcaagatagccttaagcgagatgatttgataagtttgaatccacctgttatggaaggtttggatgccctacttgcgaaatctaagcatttggtgaagcgtgttgatccagaaatggatggatatcctcaagaacaatctactttaacgaacaaatggttcagctcaaagtcatcaaagaagatacctctgactgctgttacctctgtcatcgatggcttgaaaaaactttatatcgaaaaactgaagcctttggaagttacatacaagttcaatgattttgtctcccctttgctgacaagtagtgattttgatgcaaagccaatggttatgctcttaggtcaatattctactggtaaaacaacttttattaagcatctgctagggggggggtatccanntncccatat

SEQ ID NO: 10330 - DNA, 683 bp, Sorghum bicolor
  Clone ID: SORBI-28MAY03-CLUS8391_1
tactggactccacccacgcgtaccatccacagccgccagcccgcctcctctacctgcagactaccacgcccaaatccacctcaagcgcgagggagaagaccggatccgcgttcgggataggatggcgacgatccagcacaagccggctccgacggcgccgtcgacgacgacgggcggcggcctgcgcgccatggacctgtacgagaagctggagaaagtcggggagggcacgtacgggaaggtgtacaaggcccgggagaaggcgacgggccgcatcgtggcgctcaagaagacgcggctccccgaggacgacgagggcgtgcccccgaccgcgctgcgggaggtgtcgctgctgcggatgctgtcgcaggacccgcacgtggtgcgcctgctcgacctcaagcagggcgtcaacaaggaagggcagaccatcttgtacctcgtcttcgagtacatggacaccgacctcaagaagttcatccggggctaccgcgccaaccacgagaagatccccgcacaaaccgtcaagatcctgatgtaccaactgtgcaagggcgtggctttcgtccacggccgcggggtgctgcaccgtgatctcaaaccccacaacctgctcatggaccgcaagaccatggcgctcaagatcgctgacctcggactcagccgtgccatcaccgtcccta

SEQ ID NO: 10331 - DNA, 1211 bp, Sorghum bicolor
  Clone ID: SORBI-28MAY03-CLUS8412_1
ccgggttttcttttcttccccaagtcccatcccgggagaagaagaagaagaagggccgcgctgccaccaaaatcgcacgcgagacgcaagagatccccaaaccctacctacactcgcccgcccgccggcgcactcggggatcgtcgaatcgagcaggttgacggaggaggaagaaggggagcgtcgaagatgttccgcaaccagtacgacaccgacgtgacgacatggagcccccagggacggctgttccaggtggagtacgccatggaggccgtcaagcagggctccgcctgcgtcgggctctgctcccgcacccacgccgtcctcgccgccgtcaacaagcccgcctccgagctctcctcctaccagcggaaggtgttccgcgtcgctgagcacgccggggtcgcgctcgccgggctcaccgccgatgggcgcgtcctctcgcgattcctccgcaacgagtgcatcaaccactccttcgtctacgaggcgccgctccccatctccaggctcgcgctcaagctcgccgacaaggcgcaggtttgcacacagcggtcatggaagaggccctatggtgttggcctccttgttgctggactggatgagtcgggagctcatctgtattacaactgccccagcgggaactactttgagtaccaggcattcgccattggttctcgctctcaagccgccaagactttcctggagcgcaggttccagggctacaaggactacacccctgagcagctcatcaaggatgccctctctgccataaaggagacactgcaaggtgagaagctgtcgagctccaactgcaccgtggccattgtcggcaggaaggacgatggcaccatcgagccattcgagatgattggcgcggcaaggatccaagaacttatcgactccatggaggtcgctgaggaggcgcccgtggaggcctcttcctccatgcaggaggaggagaggggctcagaagatgctgctgcacccatggacatctaggcctgggattaggggccccatatgaacccacccttacactgcattccgagttcccaaagactagactgcttctttagaaaattgttattgtgttgtgactcttgtgtactctttgcttccaaaaaaactttgcgatggtctccccgacgaacagttgcagttgcttggatttggactgattatttatcatgtgatgcaaacataacgtt

SEQ ID NO: 10332 - DNA, 750 bp, Sorghum bicolor
  Clone ID: SORBI-28MAY03-CLUS8439_1
gccggccgggccggggtgcaaaagcagaagcagataagggaaggcacacgacgcaactatcctcccagcccccagggaagaagcctacgtttccacgctccctccccttgtccccactccaatggcgccctccctcctcgccgccgtgtccgcctcgcccttcctcctagccggcagcggcagcagccgcaggcccctgggcgccgcccccatccgccgggccgggctgcgcgtggctgcgcttaagtacgaccctgccaaggtggcgccgcagaacgaccgggtgcttgtccgtatccagcagatccctgagaaatctgctggtggtgtattgctaccgaaatctgctgttaagtttgagagatatctgatgggcgagattctatcggtcggtgctgatgttagtgaagttgaggctgggaagaaggttctcttctcagacatcgatgcttatgaggtggaccttggtaccgatgagaagcactgcttctgccgcgagtcagatctattggctttagttgaatgaaatttcataccatgaaaattacggacttacctatgctccaactgcatggacttatgtcactcctactttgttgtatgccatttgatatttgaatgttcgtgaattcagcttagcttctagatgagtgttagtcagcattgaattttggccgccataaactggaattatgttgatgcccaaattgctcagataccgaactggaaagtaaaaaaaaaaaaaaaaaa

SEQ ID NO: 10333 - DNA, 608 bp, Sorghum bicolor
  Clone ID: SORBI-28MAY03-CLUS84477_1
gcccccgcccggcggcgcctcgcgctccccctgctgccccgccgccgtcgacgccgccgccgccagtaataattaatccccacgccaccgccaccgccaccgcctagcgcctacacagaggctcgatcggggcctcttgcccgcggccgcggtgccgccgggtcgacccagcgagcgccttttgtcgtcgctgtcgacccacgccagccattgccacgctagtggaatggtgactggccttgtgtggcgcagagcggagcacgggcgaaacgcgcacgaaggaagaaaccgtgggtgcctcgacggtttcgcacgctttgggcgcaccacaaggcagaattcggcataggttgtgccgttttgccctttcgccgtgtcctctcgtcaatcgggagcaaggagagcgtttttttggttgttgtggcggctggagcgagtgagcgacgccgccgccgggcatttctgtttttggtgttggcggttccagtacgtaatgcatgtgaagatggtcgtctgaatgcctgatctagtagaggggctgttggtgtgggccggtccagtacgtaatgcatgtgaagatggtcgtctgaatgcctgatctagagggg

SEQ ID NO: 10334 - DNA, 773 bp, Sorghum bicolor
  unsure (1)..(773): unsure at all n locations
  Clone ID: SORBI-28MAY03-CLUS832_1
gccggccgggaagggatagcacaggagccccgagctgtttcttcgccgcaggaatgggcaaggatggcaccaagtacgcagtggtggacgccttcacagcggagccgttcaagggcaaccccgccgcggtgtgcctcctcgaggacgcctccaaggccgccgacgagcgctggatgcagtccgtcgccgccgagttcaacctctccgagaccgccttcctcctccgggacgactcctccgcggccggcgccgtcccgcggttccagctccgatggttcacccccgccactgaggtggacctctgcggccacgcgacgctggcctccgctcacttcctcttcacatccgttttcgcggagcacgaggcgctcatcgagttctcgaccaagtcggggattcttacggccaaaagggttcctgcgccggagagcacgggcgtgtcaggcgaggggaaactgttcattgagctggatttccccgtgattgaccttgttgattgccatccttccgagctgccgtccatccccgagaccctgaacggagcctccattatcagtgttcacaagtcaactggtgacctcatcgttgtggagctttcatcaggaaaagaggttgctgatatcactcctaatattcatganattaaaatgtgttctggcagcggaattattgttacagggccagcggcagctggatctggttatgacttcttcacacgttttttctgcccaaatttgggatagatgaggatcctgtttgtggcagcgcgcatt

SEQ ID NO: 10335 - DNA, 809 bp, Sorghum bicolor
  Clone ID: SORBI-28MAY03-CLUS90081_1
gcacgaggagcaaagccagagcaaaccgaagccggtttcatatgcacgagggctgctcctcctgtcctgccttcctccttccgcagctcgaataaagtcccctcctcttccggtcttcctcctccgcgctccaatctccccagcggcacgagttcgggttcttgcagagtagcacagaggaggaggaggcgcagagtgccggaggattcggttggttggattcccctgctgcggctgccggttcggtttcttctttggtttgccgtgagcgatttggtgcgcggcggattgttgtggggggggtgcgactgcagagacgagggccgtgtggagggagagtcgaggaggaggcaagggaaggcggggacatgggcgggcagtgggtggaggaggggatgcccccgtccaacctgcagtgcttcttggactgcaccacccccaccgtggagacgcacattctccccaagacgaatggacggtcgccgaccgatgcctggcaccacgctgagatggacagcgtcgagtacttcaatcttgccgacctctgggagcagtactacgagtggagcgcgtacggcgccggagctacggtgcagctcccaggaggggacagagtagttcagtactatgttccatacctgtcagggatgcagctatacaccaacaaggccctgactgcatccaggagctttggtgaagataatggcatggatttgtggagtgatgatgaggacaacgagaagatgtcgagatcctggagttcgacctctgatgaatcattgttcaactgtgatgtgctatggtccaat

SEQ ID NO: 10336 - DNA, 793 bp, Sorghum bicolor
  Clone ID: SORBI-28MAY03-CLUS9132_1
cttcactgggtgtggaggaaaactgtgattcagctgcactagccactgagatttgtgatgctgcgtctcacatgactgatttggctgttcctcaatcggatgaggatctccatcaagatcaacatctagaagaccaccctgaaatggaggagactatattgatggtggagcctaagtgtgaggagggcgatggttccagctttgtgctcccaccaagccctccagaactgatgctggaggaacaggacgacccagggttagtagccctaggtactgaatcatgtaccggacagcagagccttgaagtaggagaggctgaggatcaggaaaaccctagcacagctgagcatggcgtcatgatagtgaagcatacgggtgaggaaaacaacaattgcaatggtgtttattcttcctgcccaccgtcatctgccattgttgatcccatccaaatcgagcagtgattatctgtgttagttatgtaggaattagaagcatttttaaagatctgacatgagattgctagttcttttgttgctggtagcatggggttgatccttgtttcgtcgtgattatcctgataatttgagccacaagcccacaaggcatttgaggtcttgttattgacggagagtcctctcactcgtcatttcatccatttatcaggcaaatttgaaaattggggggcgttatacgccgacccagttggttttccagtaaaattgtttgtctcgggtagttgtgctgatgacaattgtctctctcaactctatcaaaccatcgcctattttgctcc

SEQ ID NO: 10337 - DNA, 609 bp, Sorghum bicolor
  Clone ID: SORBI-28MAY03-CLUS9077_1
gcacgagcgccgccgctccggcgctccacccgctcgagccccacgcgtccgggccatgaacatggagcagcaaatcaagcacagccatctcccgatccgaggcctcagcctccacgtggcccaagcaggcaaaggcgagctgggcacggtggtgttcctgcacgggttcccggagatatggtactcgtggcgccaccagatgctggccgtggccgccgccgggtaccgcgccgtcgcgccggactggcgagggtacgggctctcggaccagccgccggaggcggaggccgcgtcgtacgacgacctggtggaggatctcctcgcaatcctcgatgctctctccattcccaaggctttccttgtggcgaaggatttcggagccatgccagcctatgactttgctcttcgtcaccctagccgcacatgtggtgtcatgtgtttggggatccccttccttcacggtggctcatccttcaccagcttgccagaaggcttctacattttgcgctggcggggggtcctcgttcctgtaggatatatatataatcacctttgccaaattgagcagagtgacagaaaacaatgacaggggaaccttgttcttgtagg

SEQ ID NO: 10338 - DNA, 268 bp, Sorghum bicolor
  unsure (1)..(268): unsure at all n locations
  Clone ID: LIB3478-024-P1-K1-F2
aagcaggcgaagcagcaatggcgcatcaggagatcgagcacacccagctccccgtccgcgggatcaacctccacgtcgctcaggtcggcaaaggtgacctgngcacggtggtgttcctgcacggcttcccggagatatggtactcttggcgccaccagatgctggccgtggccgccgcggngtacctggccgtcgcgccggactggcgcgggtactggctgtccgaccagccgtcggtgaacgaggaggactcctgggtctgggacga

SEQ ID NO: 10339 - DNA, 733 bp, Sorghum bicolor
  Clone ID: SORBI-28MAY03-CLUS91574_1
ccaccgcggtctttttccgccggttccaccgcccgccgccggagccccggaagaaggaagatgagcgcgtccgtgggccggacccgggtggggcgctacgagcgcggccggtcccgcggcgaaggcaccttcgccaagggcacgtgcgccaggaacgtcgagaccggcgagaatgtcgccatcaagatcctcgacaaggagaaggtcctcaagcacaagatgatcgcccagataaagcgagagatctcgaccatgaagctcatcaggcaccccaacgtcatccggatgtacgaggtgatggccagcaagacaaagatatacatagtcatggagcttgtcaccggtggcgaacttttcgacaaaatcgcttctcgtggaaggttgaaagaggatgatgcaaggaagtatttccagcagctgatcaacgctgtcgattactgccatagcagaggcgtctaccaccgtgatctcaagcctgaaaatcttctgcttgatgctagtggcacactcaaggtttcagattttgggttgactgctctatctcagcatgtccgagaggctggtctgccgcattctacatgtggaactcccatttgtgttgctcccgaggttataaacaataaagggtatgatggagctaaggctgatctatggtcatgtggagtgattctctttgtcctcatggcagggtacctcccatttgaagattcgaacctaatgtcgctttacaaga

SEQ ID NO: 10340 - DNA, 1028 bp, Sorghum bicolor
  Clone ID: SORBI-28MAY03-CLUS92242_1
ctggaatgcgagcgtgattcctcttcctcccccctccttcctcgagcgagctgcacgaggggcagcaatggagaccctcctctccccctccacattgttcacgccatcactccgtggctctaggagaccgtctctgaccgctagcgtctcgtccaggtccaccgtcgtcgtctcctgcgcgctcaggaggccacaggccgccggcgccgccgtcgctgccaccacctcctcctccaatggagacggcggcatcgacgtcgtcggcaggagctggatgtcgttcctgcaccacggcctggcggcggccgcgctgtcgctcgccatcagcctggccccggcgcccgcgccggcggtggcgtcggagttcgacgtgctgaacgacgggccccccgtggactcgtacgtggtggacgacgccggcgtgctgagccgcgtcaccaagtccgacgtcaagcggctggcccgcgacctcgaggcccgcaagaacatccgcctcaacttcatcaccgtccgcaagctcacgagcaaagctgacgcgttcgagtacgcggaccaagtcctggagaagtggtaccccacgattgaggagggcaacaacaagggcatcgtcgtgctcgtcaccagccagaaggagggcgccgtcaccggaggccccgccttcatccaggccgtcggcgaccagattctcgacgccaccgtgtctgagaaccttccagtgctcgcgaccgacgagaagtacaacgaggcgatcttcagcacggcgaggcggctggcggcggcgatcgaagggctgccggacacgggtggcccgtcgttcaaggagaacaagcgtgagtccaacttcaagaccaaggaggagacggaggagaagcgcgggcagttcacgctcgtcgtcggcggcctgctcgtcatcgccttcgtcgtgcccatggcgcagtactacgcctacatttccaagaagtgagtcaaccatagcgtgctgtacagtaaatgttaaaactgaagagagatttttaaactcgcaggtt

SEQ ID NO: 10341 - DNA, 1090 bp, Sorghum bicolor
  Clone ID: SORBI-28MAY03-CLUS85451_1
aaaacccgcacttccactccgcctcgccaaactttcccctcgggcacgaggcgcacttccaccaccgcgtccacctcgcagatgccccagtaggctccaaaaatccaaagccatccctccccaaccctcccatcgaccccccacggcggcatgacgacccgatccaacggcgatggccacggccacggcggcgcggggtcctggtacccgcagcgccgcccgcactacgggtacggcggcgggtccgcctccttccgcggctgctgctgctgcctcttcctgctgctcaccttcctggcgctcctcgccctggccgtcgcgctcgtcgtcgtgctcgtggtgaagccccgcaagccgcagttcgacctcaaccaggtgtccgtgcagtacctcctcgtggcctcgcccacgtcccccgcggcgtcgtccccggccggcgtgccccccgccgccccgggcgccgcctacctctccctcaacatcacgctgctcttcaccgccgagaaccccaacaaggtgggcatccggtacggcgccaccgcgttcgacgtcatgtaccacggggtgccgctcggggtggcggcggtgcccgggttcgagcagcccgcgcacagcacccgcctgctccagacccgcgtcattgtcgaccgcttcaacgtgctccagaccgacgcgcaggatctcatccgcgacgccgcgatcaacgaccgcgtcgagctccgcatcaccggcgacgtcggtgcgaagatcctcgtgctcggcttctcctcgccaaaagtgcaggtgtcggtggattgcgcgatcgccatcagcccgaggagccagtcgctgaaatacaagcagtgcggcgttgacgggctaagcgtgtaggaaccaagccgccgccgccgcagaagctgtaatccagtggagacggttaaattaagtgggtggatctgtacgtcgattctaatttccctactctgtggggtttggtttcgttcatgtgcttaggtggtaaattttgagctcttactttagaggaggccgccgattttgtgaattattgctgcttgcaatcagtagttatcagtatgaccatggttatcct

SEQ ID NO: 10342 - DNA, 1214 bp, Sorghum bicolor
  Clone ID: SORBI-28MAY03-CLUS8549_1
ctgtgcggcgctgcaccggggttcctcctcttccgcccctccactgctccttctctcgcctctgcctcttgacctctccatcgttcgacctcgcaacgcggcaagtagggggtgcggcggtcttcaccgagatgaccaccatcgtgatcaccgtaggcgatctcccgcgacacttccccctctccgtgctttgctagacagagagatccgggttcttccttggtttgctaggtgaggacatcatgtggagctttgcatcaaatgccatagctggaagccttaagaaaaagggacaaccctcaaaatgcagcatatccaatccagattgttctgatgatgaagtttcttcatgtaccagcagagaggaaggccttgattgtccaatatgttgggaatccttcaaccttgtggagaatgttccctatgtcttgtggtgtggccacacaatgtgcaaaaactgcatccttggtcttcactgggcagttgtcaagtttccgtcccttcctatccagctgcctttgttcatctcatgcccctggtgcaacctgttgtctttccgtctggtttacaagggcaacctcaggttcccacgcaagaactactttctgctctggatggttgagagcatgaatggtgagagagcgaaattccattcctctaatcatgaagagcaccattcctcatggcattcaagtgccggcacaaattccagtcatcaacaccgaagaaatgctactgtacgatcagagagctcttctgccagagaaacaagtgtcgtcggtaacattttccacactgacaacattagtgcttctctgcagaagcttatggtatgcttcatgcagctgacagccaagtttccactcgtgataatcttcctgctgatagtcctttatgctgtccctgcaagtgctgctgttctggtcctgtatgcccttgtcacgtttttgtttgcactgccctcatttttgatcctctactttgcttatcccagcttggattggcttgtcagagagatcttcgcttaattcgtgttgtctgaaaatgtcagcgcagttcgtgaggctgtgacacatatattatgtatttcatggccacctgccctcgtgggccctgtatagtttctactgattctctgtccttccctgtccttctaagcaccctatttatgttgtagctatctatttattaaaaatgctctgcaatgctttaaa

SEQ ID NO: 10343 - DNA, 720 bp, Sorghum bicolor
  Clone ID: SORBI-28MAY03-CLUS85906_1
gtccagcgctccagagtccagagcagcagcgtcactactcactactactgcttggctgtagctagctagtgaactcctgcttggcacgacatggggagggcgccgaggggtgtgtggaacatggcgtttctggggctggccgtcgcggtggttcttgcggtggccgccgaggcgcggtccttggagaagcagaacctgtgcggtggtggttgcgggcttggtggtgggggagggtacggcggcggcggcggcggtggtgttgggcttggtggtggccttgggcacggtggagggcttggagttgggtttggaggagggaagggtggtggttttggtgggggtgcaggcggcggaggcggcctcggtggtggagctggaggtggcttaggcggaggcggagggcttggtggcggtgagggaggtggttatggtggtggtgccgacaccgaagccggcagcagccgccgcggagggtgccgctaccactgcgcagtagcctttgggcattggaagcctttcatcacagttcagcggcataataattaacttgcttgtgtttgggtctgctggtctccagacgatagcattggatgatctagcaaccgatatgatctcaagatcgttgtatggtccgacttgcattgggcctgtattttagattgttatatggactgaggtcatagttttccggcgcctttggctacaatcaagttcagtgat

SEQ ID NO: 10344 - DNA, 1019 bp, Sorghum bicolor
  Clone ID: SORBI-28MAY03-CLUS8601_1
gcagagaagaaccgaaaattgaatgaccttttagatgcgcttgacttcaaccaagttgtgatatttgttaaaagtgttagtagagctgcagaactcaacaaattgctctgcgagtgcaattttccctcaatctgcatacattctggaatgacacaggaagagaggttgacccggtacaagaacttcaaggaaggacacaagaggattcttgtggctactgatttggttggtaggggaattgatattgagcgtgtcaacattgttgtgaactacgacatgcccgattctgctgatacgtacttgcatagggttggtcgagctggacgttttggtaccaagggacttgcaataacatttgtttcttctgcatctgattctgatgttctcaatcaagtgcaggagaggtttgaggttgacataaaggagctgcctgagcagattgacacttcgacatacatgccatcttgatgatcggggtgaaatactcaacgtttagttggaactggaaaagagagttttgtttcaaatatacatcaccttggagggccgttggataacacattatttgaaagatgatctgtacttaatcagcagtttaggtgattaagcacgtaggcttcgcaacaaccatggttgttggtgttcatgctacctaggattttatttgcatctctattatgttttctatgctgaactgctagtctttctgtttgagactgccctctgggtccatgttttatttgctttagctttcgttatcaataggaatattaaactttatatcgtcattggccgtgtcatggggtcctgattaggcaaagtgatacgcctgtatttgattgtagttgtgaagactgcacagcgccggtcgagccagactcatacaagataagctttgttcgagtgctcgtattcatccatcggcgtagtagatatgttgtttggttgtgtataagactgttgcatacgatgaaatgtaaaatgtatacgacaaaagtagctattatatttacatattg

SEQ ID NO: 10345 - DNA, 707 bp, Sorghum bicolor
  Clone ID: SORBI-28MAY03-CLUS86378_1
tgggtgtatatctgcagctgctccaggcgtcgactagcgtcagtgtcagtccagagtccagaaggagcagcaaagcacgtacgtacaacgccacccacccatggcaaaggggacggatcaagagaaagtgcaggacgtcaagcaggcgtccgcgggtaagggcgccgccggcgatgtaccggcggccggggaggagcagcagcagctggtgataaaggcgcccgtgcactgcgacggctgcggcaggaagttgcgccgctcactgcagcgcatcgagggtgttggagaggtgacggtggacagccggaccaacacggtggttgtgaggggcggcagagcggtggtggagaacgcgacggaggtcgtgcaggtcgtcgagaggaggaccggggagaaggcggtgctggtgagcccgtcgccggagaagctgccgccaccgccgccgtcagcggcggccaagggtggagagaccaacaagaaaggcgacgcaaacacaaaggacatgggggaggatgagttactgcaagtgaacatggaaatggttaccgttctgaagatgaacttgcactgcgacgcctgcagcgaggagatcaagcggaggatactcaaggttacaggtgtggaggaagccgtgccgcacctgaaatcctcacaggtgatggtgaagggggaaagtggagccggcaacactggtcggcttcatccac

SEQ ID NO: 10346 - DNA, 1005 bp, Sorghum bicolor
  Clone ID: SORBI-28MAY03-CLUS8696_1
cggtttcagttcaaaaccattctccactgtagctcctgtcctctccctccgctccctctctctctcgtcgtctccccatctccggctagggtttgcccttcccaccgcgtccggcgtctacctcgcctccgccgctgcggggaccaaggatgccgcaagagcaaggtgtggaggagccgccgccgcaggcggaaggcgaggcacagccggccgccgatgtccccatgagcgaggccgcggcggcggaggatgaggaggaggaacccgtcatgggggagggggagggcggtgcaaacggggccgacgccgccgttggttccgtcaaggcttcagtgaagcccgaagcagagggcgcggaggagggggacagggaggagctgaatggtggcccgacggcaccaggggttggcgaggctgtgaaactggagaacggggatgggtccgtgacggtgggtggctcggcggatgaggctggagctggagatggcggtgatgataagggtctggttggtcagaatcagcctgctgtgaaccagcttgtgctggcgccggctgaggaggatccggcattgaccaagatctcaaataattccttcatgttcgattacaccactggtggtgatgactcggggactgaggaggagcaggctgccttcatgaaggagctcgagcgtttccacagggagaaaatgttggagttcaagccccccaagttttatggtgaaggattgaattgcctcaaattgtggagacaagttactggattgggtggctatgatcaggtgacatcatgcaagctgtggcgtcaagtgggagagtcattcaaacctccaaagacatgcacaactgtttcatggactttccgtaacttctatgagaaggcactccttgaatatgagaaacacaaaatcgaaacaggagagtttcaagtagcttcatctgctctaccagatcggattggttctgagagccaggtgggtggaagcaatgtatctggttctggaa

SEQ ID NO: 10347 - DNA, 1248 bp, Sorghum bicolor
  Clone ID: SORBI-28MAY03-CLUS9378_1
gcacgaggcgaggaccacaaggccatggggagagagaaatgttctagcagcagagataacaagaaacctgatgaggtgaagtatgaatcagatgatgatatgttgctgcaacgaaaagacaggcgcaaggtggagtttgccttcttgcgctcgttgaggatgatgctgccggtttacgcaccgggggctgtttgtttcttggcctgtcatattgcccgtgaagccatcctgccaaacgacatttacaggtgggcaatggaggggaatgtcccttatgtggctgcatttaccgaagtagacaggttccttgggagctctttccaagactgccctttggatgcaaggcagctgttcaggccggtgcgagttattggagcatggcaactggaagctgcagctggatccatagcacaaaaagtaggcttgaggcttccttcagttaacttctatgcaattgctcaccgttgtttgaaggacttgttactacctatagatagaatcctcccccacgcatgccgaatttatgagtgggcaatgcctgcagaattatggttgtctagtaatcctgctagagtccctacacgggtttgtgtgatggctatcctaattgtggccctacgacttctttataacatcaacggtcaagggatatgggagaagatttgtgaggaaggaagaaacacaagtgaatctcaccatgatacaaattcatcaactttcaggaagcttgaggctagtaacagtgaggagtttggcacaagagaactgttgtgtgctattgcagctgcctatgataaaatcatacgacacatggtaaatttggatttcattgccttgtctacacattatgtttatcttgtagtatacatggtagttcgcggcatgcttattctgactgtcggtagtttatattccacttgctatatacactaagcgtaagagttgttgattgcatattccacatctgctgaatccaagaccaacatatgtctttttctgtcaatcattctgtgtttcaaaacttaacaaaatatgcataactgtcctacactacatgattattacacctctagtaataccctaacatagagcaattagcatcaacttttgccatgcacaaacagggcaaactgatggagaacatcgagaagggtgagatggggaagcagcgactgcttgcgtgctacagtacctgcagagctacattacccgcgggtactgttcataccggatgttatggcggtggct

SEQ ID NO: 10348 - DNA, 1257 bp, Sorghum bicolor
  Clone ID: SORBI-28MAY03-CLUS94024_1
cgatcttgtgattgatgagctcgacaagccaaactctataatgagcgagagcatcgcgttgaacttattgttcttgctcctcttcgcaagccatgaaacgacgtcaatggggctgaccgtgatactcaagtttctaacggacaatccaaaatccttgcaagaattgaccgaggagcatgaaaaaatcatggaaagaagggtggatccagactctgatatcacctgggaggagtacaagtctatgaaattcacatctcacgtcatacatgaatctcttaggctcgcaaacatcgctccggtggtgttcagacaagcaaaccaggacgtacacataaagggatacactatcccagaaggatcaaagatcatgatttgtccatctgcagctcacctgaattcaaaggtttacgaggaccccttggcattcaatccatggagatggaaggatactcctgaaccagttggtggctctaaggattttatggcctttgggggtggtttgcggttatgtgttggtgctgagtttgccaagctgcaaatggctatgttcctccactacttggtcaccaattacagatggaaagccctcagcaaagggacgatgatgctttatcccggcctgcgatttccggacggctttcacatccagcttcataagaaaacatgaaggctccatttggaacgtgtaattttttttgttcctgtgttgtttctacaaaaaataaaataaatcctaaaaaaactatggaattccagtgaaattcctacgttccaaacgggtccaaatattgttagaaaagataactagcatgtggtattaaaagtatgctcattagtagctgtgatcaaataattaaagaccattcaatataagtaagttatggtcagtatatataaacaaatgtactatgaaacctcattagaaaagcaaacagaataaaactcttcaggatctcatcaacctattccaattgtaagctgctcggagcataagctataagttacaatgttgaagcgtcactgccaaatatgaagaaggggaataggaaagaagttcaaaactagaaaatgttgtagtatgtttttccatattttccaagattgtatacctttatactgaatgttgtacggtcatatgtgtaattgtttgcgcttttatattataataagtaaaatttcagctaaggtagtagtggtgaattgtaattttcctttttccaaataattggaacctcaaattgaacagtacaactttgt

SEQ ID NO: 10349 - DNA, 1341 bp, Sorghum bicolor
  Clone ID: SORBI-28MAY03-CLUS9381_1
gcacgaggtaagaatccagagcagcgccgtgtacctgtgtcaattgatgtcccagaccctgacttccatgattttgataaagatcgaacggagaagactttcgatagtgatcaagtatgggctacatatgacagtgaggatggcatgcctcgcctatatgtaatggttcagaaagttctttcagtgaggcctttccggatccgcatgagttttctcaactcaaagtcaaatattgaactggcacctataaactgggttgcctctggtttccagaagacatgtggcgatttcagggtcgggagatatcaggtcagcgaaacggtcaacatattttcacacaaagtgaactggactaaaggtccccgtggcatcatcagaattgttccccagaaaggggatacatgggccttgtaccgtaactggtctcctgattggaatgagctgacacctgatgatgtgatatacaagtatgagatagtagaagttattgatgatttcaccgaggagcaagggctgactgtcattccattgctgaaggttgccggattcaaagctgtcttccacagacacatggatcccaaggaggtcaggaggataccaaaggaagagctgttccggttctcgcatcgagttccttctcgtcttctgactggtgaagaaggcaacaatgccccgaaaggttgccatgagctggaccctgctgcaactccagtggaccttcttaaggttatcacggagctcaaggaagacacgatgacacagactgctaaataggagggggcaactattgaacactgaagataggtagctggatgtctgaatgatcaagtccccacttcgttaacgacaacgtgccagcgcatgatggtatctaaacctctactacggcatcttatttttggctgatgacttggacaatactgccagggcaagcagcctgtgtgacggacttctgacctttttaattcttaggcatttctaacatttgattttatcgctacacaaagcaccgcgtagattaaatggccattgggaggaggccacacacagcattggtgaggaggttagttgtcgtgaggtaggagaggagagtgaaggtgtttgcttgctgtgttgccactccgcgatgtaggaggcaagtctgagtctagggaaagagctgctaggcttggcttgcccatgtaccccgcatttgtgtacctgttttacttatgatgttgtatttccttcggtcttatagtaattcatcgcccatgatgttgaaccagactaattttagactctgaactctggtaaccatgtctgaaaatctggtgcttttatatagtggatgcttctgtc

SEQ ID NO: 10350 - DNA, 895 bp, Sorghum bicolor
  Clone ID: SORBI-28MAY03-CLUS94782_1
actcgactccatgcctcccctccccgccgcggccatggccaccgcgacgctgcccctccgcctcctcccctccaaaacgctgaccctctccactctcgcctccgcgcgccgctccctctccgtcgccgccgcgcggccccggcgctggcgcctccgagcggccgctgaggaggcgcctgaggccgtggaggttgagttcgtggaggccgaggaggaacccgcggtaccggagcccgtcgaggcgcagctcgccgccgcgggggccgggaaggacgccgacatcttcgctgttgtcatgattggttcaagacaatacattgtgatgccgggcaggtacatatacacacagaggctgaaaggcgccaatgtcaatgatcagatcatattaaacaaggtgctactggtgtcaactagagaaaaagcttacattggcatgccagtggtgaccaatgctgctgttcatgcagtggttgaagaacagggacgggatgataaagttatagtcttcaagtacaagaagaagaagaaataccagaggaaacttggtcatagacagccaaacacaaggttaagaatcacaggaataagtggatatgaagagtaccctgctgatccaatacttgaccctgctgcagcttaagctaaattgtaagttatgtagttacaaaaacggctggtagtacagtagcatgcaaaattttgttcttcttttttacttttctttggtcgggaaggaacacttttcagcaaaatgtaccttgtttttgtgttccaaatgctgccagtcaaccagtggttccatcctccatttgttccatctgctagttctttttcaaattgtgtatgctagcctattgtattacacgaccgctcctaaagaagagatttcttttct

SEQ ID NO: 10351 - DNA, 912 bp, Sorghum bicolor
  Clone ID: SORBI-28MAY03-CLUS94931_1
tcttcaaataaaatccattttataccccgtttttataatgtctcttcaaataaaaagcatgttatacatacccggttacgaactggcaagcttatctaaaggacatcagctgatgtctggtcgaaacatcttatttacggtgtaaccaggctaacatagttccaacgtccatatggctaagctcgtattgatgaccaattactagttctcagcaactccttatctcttgtttgatgccacgatgatccgttacaatatgtccgcaaggcgaagaaggttgtggataggaaaaagagttcactggaagtggtgttcactcatctagctgcagaggttattctcaaaatctttggactcaaggcagctagagctaccttccatcgtatgatatctcagacaaccatatcgttctccggcatgattggtccagttgagcaggtggagttttgtggacacccagttgtcttcatcgcccctggtggctatgggcctccagaagccctaaccgtgaacttccaaagttatgttaacactatgatggtaaatctagcagtggatgaggcacaatttccagattctcatgagctgctggatgactttgttgaatccctcaggctaattagagctgcagcttcaagccttggaaagaatcaaagaaatgattaagggactactcaaccagggtttcctttcattcctccagttctaataagaattgtagaattcagtactactaaattgcttaagcttttgtattataatgtgtacaatttaaccaaaaccaaattgatggagcatgtcagtgggttgagcaaaagattttatggagaaaataatcatcatttattctggaacaaaatgttgtacaattgtaatagtgaacagtactttaatatgcttcaccttttactc

SEQ ID NO: 10352 - DNA, 1211 bp, Sorghum bicolor
  unsure (1)..(1211): unsure at all n locations
  Clone ID: SORBI-28MAY03-CLUS9414_1
gagctcgcgtgggcgtctccgcatccacanngcccgccgcgggggcgttgcctggcgnnccctccgacggagaaccctccaagtacaagaactaaaatccagagtggaagagaatgtggtggnctgcagaagatgtcatgggatgatgatgatgacgaggatggtgcactggaagcgctcgtcgagcagctggaagaagatcttgagaatgatgatttatctgtggatgacgatgatgatggtatatcagaagaagatatggcaaggtttgaaaaggagttggcagaagcaattgaaggtgtcagtggtgttgatgaatcagcaggggattctttgatgagctctggggactatggtattgatgagcaaatagacagaagcgaacggccagagctgaaaacctggcaactccggagattggctcgtgcactgaaaattggtcggcgtaaaactagtataaagaatcttgcaggggagctaggtttagataggggtttggtcattgaaatgctccgcaatccaccaccgaagcttctactcatgtctgattctttgcctgatgaagccccttctaaatctgaagtgaaggaaatagaaccccctagttcgaccactgatgacgaggttgataccactgaaatcaaaccagagttggagcttccagtgcatgtcatgagtgcagaatggtctgcaagaaaaagattgaaaaaggtgcaacttgagaccttagaaagagtctacctgcgaagcaaacggcccacgaatgcaatgatcagcagcatcgttcaagtgacaaaccttccacgaaagaccattgttaagtggtttgaggatagaagggaacaagatggggtccctgaccatcgtgttgcattcaagagatccctatctgagattggttctatttcataacttcttcagataagactttgttatagtgttcacttggaacccttacaaacatgtaaatttgagcttttaaagtacgacaagttttgcaagctcaacatggagtatcttttagattgtagcaatactatcagatcagcctaccccaacttgcttgggagttgggactaaaaggctttgttgttgtaatactatcagatcagccaatgtgacaggtacaactcctaactgtcacttgcatttcaattggctccactcaggaccactattttgacaattggctaaggtaaatattaatttga

SEQ ID NO: 10353 - DNA, 442 bp, Sorghum bicolor
  unsure (1)..(442): unsure at all n locations
  Clone ID: LIB3478-001-P1-K1-E10
cccacgcgtccgattgagctatgggaaggtctcataattttagacctttgtatctaaggctcctcgtgttactacttcgaagaaaacttaatgttcaatatattcttgcaatgaatgcaactgcgacaactcaaaccttgaagagaatgtggtggctgcagaagatgtcatggatgatgatgatgacgaggatggtgcactggaagcacttttcaagcagctggaagaagatcttgagaatgatgatttatctgtggatgacgatgatgatggtatatcagaagaagatatggcaaggtttgaaaaggagttggcagaagcaattgaaggtgtcagtggtgttgatgaatcagcaggggattctttgatgagctctggggactatggtattgatgagcaaatagacagaagcgaacggncagagctgaaaacctggcaactc

SEQ ID NO: 10354 - DNA, 948 bp, Sorghum bicolor
  Clone ID: SORBI-28MAY03-CLUS88228_1
gtctgcttccccttccgtcggctgcccttccgtccgctgacctcctcctccttccctcctcctgtctctctctcgctacctctcgctccgaagacgactgttgggccgccgccgccgccctagcccaggtgctgaggctttccttggtctcttcgccggcgacgagcacccaccagaaatcctagctgcttcgagtatggaggtgctgtttggaagcaacaaccatggcggggacaaggccgctgatttggcctcgcttataattgcccaggctgccttggaggtgccaaggttagctcggggctttgctatgattctgcataatgaaatctttacatctggagatcagaatttgattaataggattcttagcaaaagcaaaaatgaaactgatcctgagaacaaagatgatggagaatctgatgatgataatgatgatgatgatggagacgatgaggatgctgaaaaccaagaagaagatgatggtggtgacgagggatcagatgacaatgggaatgaggaggaagatgacgacgacgacgatgatgacgatcctgaagctaatggtgaaggaggaagcgatgatgatgatgatggtggagaggatgaagaggaggatgacgacgatgacgacggggacggtgacaatgacgaagatgatgaggaagaagaggaagaggaggatgacgatgacgtcccccaaccacctactaagaagaggaaatgatcgatgcctgttcgcccctgcgcagcagtatactgtttagtgggtagggggtttttagcttggtcgtggacgattcatagcctagtttggaaacaaaaagaaacatttaattgtgcatgtactattaaaccattcctttaatcatgtatctcagattgctatctacccctgtgatactcagaatggtttctaaattgtgtttgcaagtttttattgcaatc

SEQ ID NO: 10355 - DNA, 666 bp, Sorghum bicolor
  unsure (1)..(666): unsure at all n locations
  Clone ID: SORBI-28MAY03-CLUS8795_2
gcacgagggccctctatggatttgaccctccccgctccaaggaacatggtggctgctgcagctgttgcttcccccagagacgcaagatcaaagcttcagctgctgcaccggaggagacccgggctctaaggatggcagactttgatgaggatgaaatgaacatgtcatcattccccaagaagtttggtaactcgaacttcctcatcaactccattccaattgcagaattccaagggcgtccgctagctgatcaccctggtgtcaagaatggccgtcctccgggtgctctcactgtcccccgtgaccttcttgatgcatccacagttgctgaggccatcagtgtcatctcatgctggtacgaagacaagaccgagtggggccaccgtgttggttggatctatggctcagtcacagaggatgtggtcactgggtaccggatgcacaaccgtggttggaagtctgtgtactgtgtcaccaagcgtgacgccttccgcggcaccgcacccatcaatctgactgaccgtctccaccaggtgctccgttgggctaccggttcagtggagatcttcttctcccgcaacaatgctctgctcgcaagccgcaggatgaagttcctccaaaggatcngcctacctaacgtcggcatctacccattcacgtccatct

SEQ ID NO: 10356 - DNA, 1070 bp, Sorghum bicolor
  Clone ID: SORBI-28MAY03-CLUS8795_1
gcacgaggacttaccaggtccagacatagcaaggattgacagactgagagctctttcttgattctatgggtggtggtgcatgaccgtctccaccaggtgctccgttgggctaccggttcagtggagatcttcttctcccgcaacaatgctctgctcgcaagccgcaggatgaagttcctccagaggatcgcctacctgaacgtcggcatctacccattcacgtccatcttcctgatcgtctactgcttcctgccggcactgtccctcttctcggggcagttcatcgtgaagactctcaatgtggcattcctaacctacctgctggtgatcacactgacgctgtgcctgctggcggtgctggagatcaagtggtcggggatcagcctggaagaatggtggcggaacgagcagttctggctgatcggcggcacgagcgcgcaccttgcggccgtgctgcagggcctgctgaaggtggtggcgggcatcgagatctccttcacgctgacgtccaagtccggaggcgacgacgtggacgacgagtttgcagacctgtacatcgtcaagtggacatcgctgatgatcccgcccatcgtgatcatgatggtgaacctgatcggcattgccgtgggcttcagccgcaccatctacagcgagatcccgcagtggagcaagctgctgggtggtgtcttcttcagcttctgggtgctggcgcacctgtacccgttcgccaagggcctgatggggcggagagggcgcacgcccaccatcgtcttcgtctgggcaggactcctctccatcaccatctccctgctgtgggtcgccatcaacccgccatctgggaaccagcagattggtggatccttcaccttcccctgaagctcttgccagtttcattgtcgcatggaatggaatggaatggaattcttgctttgtaccagctccagcagcgtttcatcctcagactcagagctgctgcgggaagtgggattctgactgtcgaaatggctagggcctttttgtcgaaagctgataactgttatgatgagctaaagtagttcttttgttctttt

SEQ ID NO: 10357 - DNA, 1053 bp, Sorghum bicolor
  Clone ID: SORBI-28MAY03-CLUS8852_1
ctactggtatcatggccaccatggtatcacgatatccacaggaagattgggcacaagagggtggtgatccgtgcttgccagcatcatggtcctgggtgcacggcggttcagatgcttctccaaggatattctcaatcacattgtcggggaagaacattacagggagtatccctgtggaactgacaaagttatcagggctggttgagctaaggcttgatggtaattcattttctggccaaattcctgatttcagcgaatgccataatttgcagtatattcaccttgagaacaatcaattaactggggaattgccatcttctttgggagacctacctaacctcaaagagttatatgttcaaaacaacaagttgtctgggcaggttccaaaggcacttttcaagagaagcattattttgaacttctcaggcaacagtggccttcacatagtaaccaatggcattagccacaccataattgttatatgtggggtgattggagccattgtcctactgggtattgctattggatgctatttcattacatgtaggagaaagaagaaatctcatgaagacactgttgttattgcagcaccagcaaaaaaacttggctcatattttagtgaagtagctacagaatcagcacacagattttctttatctgaaattgaagatgctactgacaaatttgagagaagaattggctctggaggctttggtattgtgtactatggaaagctggctgatgggagagagattgcggtcaaacttctcacaaatgactcctatcagggaatccgagaattcttgaatgaggtgacattgctatccaagatacatcatagacacctggttacattccttggttacagtcagcaagatggcaaaaacatactagtgtacgagttcatgcataatgggacacttaaagagcaccttcgtggaactgataatgtaaagataactagctggctggagcgtcttgagaatgcagaagattctgcgaaaggtatagagtatctcacacaggatgctcccgacatcatcatagagactg

SEQ ID NO: 10358 - DNA, 857 bp, Sorghum bicolor
  Clone ID: SORBI-28MAY03-CLUS8927_1
ctcagggaaaccctgacgaagttgctgcagcattgtgtagatactcagcaccagaagaggttgatactttaccatcaacatgtggggcctgtggaacagaatgtgtcacgcgattctttgctacaaaaatcccatatttccgggaggttattgttatggcaacaacatgtgacatgtgtggttatcgcaattcagagctgaagcctgggggtgaaattccagctaagggaaagaaaattacactgcgtgttcaaaacgcacgagaccttactcgcgatgtcataaagtcagattcagctagcgtgaaagtacctgaacttgagttggagctttcaagtggaacgttgggtggtatggtcacaactgttgaaggtttaattgtgaaaatatgtgaggctctggagagaatacatggattccaattgggcgatagcacactggaatggaaaaagaagaaatgggaggattttaaggagagattatccaagcttctgagtttacaagagccctggactctaataattgatgatggattggcggcttcgtttgtagccccggctactgattcgttagaagatgacagccagctaaccatggaggagtatcagaggagttgggagcagaatgaggaacttggcctgaatgacatggatacgtcctctgcagacgcggcttacaacacgaccagcacatgattttttttttaaagttttgttgtgctgaatgtatttgttatgctagcttgtatcattatctatttactttggtaaactcccagtgtgtatactaatatcaaccacttatatttcttctgacgataaacatcgagcggcaatgcgttgaacgatgtttagaac

SEQ ID NO: 10359 - DNA, 636 bp, Sorghum bicolor
  Clone ID: SORBI-28MAY03-CLUS89588_1
cgcacacgccccactcaggcactcacgcaggccgcagctttccccatccctagccccccagcaacctctccgccttccgccatcaccgccgacgccatggcctcctctccccgccacctcttcctcctccttcccctgcgcctcctcttgctcatcccgctgctcgccgcggccaaacccgtcctcgaggatggttacacggtgaccactttcgccaacttcaacccgctcccggcctctgggccgcacccctacgcgatcctcccgcggccccgcgccggggacctcctcctcctcgactccgccggatccgcgctctacaccctctccctctcctcctcccccggcgagccgcgcaggctagcgggtggcaagcggcgctccgggttcgacgacggcgacgccgccttcgaccgcccgcgcagcgtcgccgtcgatgccgccgacaacgtctacgtcgccgaccaacgccacggcgccgttcgcaaggtcgcgccctccggttatactactacagttgccggaggtctctcatcaggacctggtcacagggatggactggcacagaatgctactttctcggcagattttgagcttgtttatgtccccaaaatttgtgccctgttagtagctgac

SEQ ID NO: 10360 - DNA, 2074 bp, Sorghum bicolor
  Clone ID: SORBI-28MAY03-CLUS90_1
acttgcccgcttgctcgtggtaaaacactagcggaccagcgagcgcccaagctctcccacggtctctcctcgccctcgtcagtctccgtctctctctcccggtgggcgggcgtgtggtggccatagcttccctgcctccacttgtcttcttcgtttcctcggctgagcctggtagtaggctcagtccagttcctcgcggccggcctgctactgcgcgcaccatgaccgcgacgccggcgatgatcgggctgagcgccggcaaacgcctcctcgccacctcattcggcaacaccgacctcgcgcccccggacgcgcacccgtcgctgcagttcgcgcccgccgcgcccaagctcaccgtcgtcgcgcaccgcgcctccgcctcctcgtcgtcctcatcctcgtcccccgccggccacgcgcgcgcgcacgccatccgggcgctcaggaaccactccgcgcccgcgctcgccccgcctctgccgctgccgctgccgcctccacccgcggcggacccggctccggagctggactcggagttcgagttcgagctggagtcctcgctcgaggccatcgtgctgctgcagcgctccatgctcgagaagcagtggcagctccccttcgaggacgaggacgaggacgacgagaggcttaccaaggccgccgtggtggtggcgcggtccggcgtctcggcgcggcagcggcggatgagcggccgccggcggggacctggtcggaagagcgtcaccgtcagcccggagctgatgcagagccggaaccgcatctacctacggggcaccgtcagtaaagacctcctcacgcacaagcaggtcattcagctctccaggaagatcaaggacggcatctggcttcagcaccaaagatcaaagctcaaggagaaactggggaatgagccgtcatacaagcagctggcgcaatcactgcatatatcgccccctgaactgcgtgcaagaatgcgtgagtcatttcttgcgagggagatgctgacgatgagcaacatccgtctggtgatatccattgctcagaagtatgataacctaggtgtggagttggcagaccttattcagggtggtctgataggtctactccgtgggatcgaaaagtttgatgcctcaaggggatttaggatttccacctatgtgtattggtggattcgtcagggcgtttcaagagcattggctgataactcgaaggcgttcaggctccctacttatttgcatgagaggttgattgcaattcgtggtgcaaagtatgcgttggaagatcaaggaattgctccgacagtagagaacatagcagagtcactcaatatatcggaaaagaaagtgcacaatgctacagaggctgtgaacaaggttctttcactggatcaacaggcgttcccctccttaaatggcctacctggggacacactccatagttatatagaggatcagaacgtcgcaaatgatccatggcatggatttgaggaaaggtatctcaaggaggaagttaataatcttataaattcaaatctcaacgagcgtgagagggatattattcgattgtatcatggcataggaaaacagtgccatacatgggaggacatcagcagacaatttgggttgtcgagggagcgtgtgaggcaagtaggactcgttgcaatggagaagctgaagcatgctgcaaggaggaaacatttggatgcattgcttgaggaatattgaatgagatgtttttcatttgagtcggttccacagatgcagtggttgtatatactcggaagcatagggtacatcatccttgaaaaggcttttactgccactcactctgcagataactatacatgtacatttgtgagaattaataggcatgcatgattcagataactatggctgcacaatcatcaatgcgacccaacaaaaaagagaagctgttttttcttgggaagcttcataaattttctgtaatgtatgtatgtgcaatgtatcatttagcaccttaatcagtagagcaacatttaggccctggatctgtattcttatccagttacatctacatgaaaggaaaatgcttc

SEQ ID NO: 10361 - DNA, 1022 bp, Sorghum bicolor
  unsure (1)..(1022): unsure at all n locations
  Clone ID: SORBI-28MAY03-CLUS968_1
ccacctcgcgacctggttttttagtagacttggcaaagnnngaatttgacttaaaacaaagctaagtggcttagaatttgtaatagagggagtacctttataaaaaaaggataaagaaagagtgatataatgttcaattcaaattcaacttgacttgttttattactgcagagcatgaacctcatcttcttcactatttgaacattcttgctcttaaattcctttctagtgttcttcgagtctttggacggaatggtcacttttcatttactagagctgatacttgacactgcaggcctttttcagactcatccttcacaaacatgctttctatcatcgatcgatttgcatactcagtactcttaccaggttatgctaccagaggctgttgcaattgtggtcgcacccacagatccaaccaggagttatggaatattcaggctgactgatcctggagggatggatgtgcttagggagtgtgatgaaagtgggttccacactcaccgagagacaaccaatggcagtccaatctatgaaacctgctcgaaagtgcacttcaaccccaatttgcggtttgagattgttgacctgcgctctggtcaatgatcaatggagctaaagctatagcagcatgtgcttctttatgctccctctttggcagaattacataccatagagcttgttgaatgcctgataggtatagtggtagcaccaaaccggaaccaagatgctcatggtactttctgtcatatggtgatagcaccaaacctctggcatcgtcgctggtattcgtcagaagaaaggagtaattgaaaactagcactggttgtcttcaatctggctgttcggtctgcctttgagctggtattgtaagtagtactgtatataacatacaactggggctaaaatacactaattaacttggtctggagtctggactgaagtgtgattgtaacatagcggtcgactgtggcacagccaaattacttgctgatttgtcagtgatcgaagtagaaaaatac

SEQ ID NO: 10362 - DNA, 738 bp, Sorghum bicolor
  Clone ID: SORBI-28MAY03-CLUS9695_1
cccaaggcacgagggccgtagggcgacggcgccctcgcaggcggcgcgctggcacgagcaggccatggcggccctcctagatcctccgctgccggtgcccatactgaaggtcctcgccgccaccggcaccactcggacggccacggctgtggcccctgctgttggcggccccggtacggcgtggcgcaggcggtgcgccgttggtggccacggctgcccccttcccggcttccccctacccacactagcgagggctggtgccggtgttctacaccgctaggcgctctgcttgacctcccgtcgtctgatcgatagggccaacagggcaacggctgccagtacgggacaaaacggcaagagggcaaaggccgccgacacccacggggactgggacaatggaaaatgccatcgatcacggcctgtttttctccttggacaatctcctgcagatccggaacagatcgagaaggtgagttgcttcgctttctaggtgatttggaatttttctccacccttaggctgattcattagtttgttggttgtttgcagcctgaagaataattgattaattttgtagagttaggaaagaagcaagttttgctcgcttcctctctgttctgtaaaccatatattctttaacgatgtcagtttccatgtatttaaggtttgacacaaaatctgaattctaacccaccctaatatggacaaatataatatatggcaatagagaaattgcta

SEQ ID NO: 10363 - DNA, 686 bp, Sorghum bicolor
  Clone ID: SORBI-28MAY03-CLUS9677_1
tgactgctcttttggctgactttggcattgcaagtttctaccaacatccttcatcaacacccgctagttctaccgcttcatctgttggcgtctttctaactataggatatatttctccagagtatgcaggaggtggtcgccatgcagcaacttccgatgatgtttatggttttgggataatactgcttgaaatgatgactggaaggagaccaacagatcctatgttcaaggacggagtcagcattatcaactttgtggagggccacttcccacatgaaatatttcaggtccttgatgctcatctaacagaagaatacaagaactttgctgaagcaaagaaaatatcagaaaatgcggttcatcagtgcttggtatcggtcatacaagtagcattttcctgtacgaaaccaataccaagcgaccgcatgaacatgaaagaaatagccaccagaatgcatacaatccaatcgtcatatgtgtcaatgggaaagcaaagcaatatcgtacggcccctaggagtggagttacccgaaatgttgtacaacggcactgatcatacatgagttggttaggtttgctgtgatggaacctgtccatccgggttgaagttcccgacatgatatgggtgcttatattttcttggatttttgtccctcaccaacaaggtgtctgtggtgactttcgtc

SEQ ID NO: 10364 - DNA, 367 bp, Sorghum bicolor
  unsure (1)..(367): unsure at all n locations
  Clone ID: LIB3478-051-P1-K1-G9
gccatcgtttctcagctcggcaagatcttctgtcacaaagccttccgtgttgtgttctccggcacggcggagagtatgcaggaggtggtcgccatgcagcaacttccgatgatgtttatggttttgggataatactgcttgaaatgatgactggaaggagaccaacagatcctatgttcaaggacggagtcagcattatcaactttgtggagggccacttcccacatgaaatatttcaggtccttgatgctcatctaacagaagaatacaagaactntgctgaagcaaagaaaatatcagaaaatgcggttcatcagtgcttggtatcggtcatacaagtagcattttccttgacgaaaccaatacc

SEQ ID NO: 10365 - DNA, 1260 bp, Sorghum bicolor
  Clone ID: SORBI-28MAY03-CLUS9760_1
cacgcacaaaagagagaaaaaaaaactccacttccgtcctcccgcgccgcaatcgtccccatggcggctccgatgccgtcttccacgccgccgccggcagccgcaaaccccagccacaatccgaggcggaagcggaagcccaggccgaaaacagcgctcccctccgccctaaatcctaactgggcgcagctccagtcgaagctcccccaccgccccgcggcaacccacctgggcaagcgcaagcacgacgatgaccctccggcgcccgcggagccgtctccaccacccgcagtgcaggatatcaaactcgacccaacctctgacgacaccagcttgactaaggcggtggcgattgactgcgagatggtcggggtaggatctgatggcagcaaaagcgctctcggtagggttaccttggttaattcctttggcaatgttgtatatgatgaatatgttcgtactgtggagcgaattgtggactaccgtacccggattagtggggttagacctaagcacatgaacaaagccaaagaattctgggccgtgcagaaggaagtagctgagctgattaaaggaagagttcttgttggtcatgcactgcacaatgatctcaaggtcttgctactaagccaaccaaagaaggacatcagggatacatctgaatatgaggttttccgaagggagagaaagaggcgatccttgaaggatcttgctgctgaagtacttggtgctaaaatacaacagaatgaacactgccccattgaggacgcacgagctgcaatgttcatttacaacaagcacaagaaagcatgggagaagaacatgaaggaacaattcagattcaaaaagaagctcaagaagcgaggcaagaagaaaactaccgagtccaatgggaatgaccccaatgtccccactgttcttctatagagactaacgaaagaggactgggagccagtgcagacgatttacctatatatatggcaacatcatgaatataggaaatcatatattggacgggatatatctgccgagtcagtacgctaagccaagaccacagctgaatcatgagtttccatagaggaaagaaaaggagagatatttcgatggcaatgtcgtgatctgttcgttcgaccatcagtatctatttagcagttgtcctagttgggaaacagtatctgtaatgaaaattttgtagttccacattaatgtaatgtagtgtgaaaattttgaacggagatggtaattgcatcctacattcag

SEQ ID NO: 10366 - DNA, 862 bp, Sorghum bicolor
  Clone ID: SORBI-28MAY03-CLUS10110_1
agggaagcaagtggatggtctcagcttgagcatggaggagatcatacatgagtgcaagttgttcttcttcgccggccatgaaaacacagcccttctcctcacttggtcagtgtatctgctcagcatataccccgagtggcaagaacggctccggaaggaggtcttgagggagttcggtagggaagctcctaaccccaatgcactcaacaaactgaaagagatgacaatggtgttatttgagacattgaggctctactcgcctgccctcttcatgcaaaggaagaccctggccgacatgaccgtggggtcaacaaagctgcccaaaggcatagcaattgtgatacctattccgatcatgcatcgagacaaggaggcatggggcgacgacgcagacgaattcaatccgatgagatttgagaacgggatcacgagagccgcaaaagttcctcacggcctgctggcgttctcaatgggaccaaggaattgcatcggccagaacttttcgatgctggaggccaagtcgacgctggcactgatgctccagaagttctccttcgctctctcccctgactatgtgcatgcgcctgtggatctcttcactctcaaacctaagtttggtcttcccgtgattctgaggccactcaaaatatagattgctcaatcccatgtgtcttttaaacctccatccatatatgtcttttagacatcgtcttactcaatgagttatataattggtagcagaaatcaacaatggtacataatacaggtacacattatccaagttaggccctgtttagaagggcttttctcggctctggcactgtagcagtattatagcttagccaagataaccccctaaacc

SEQ ID NO: 10367 - DNA, 662 bp, Sorghum bicolor
  Clone ID: SORBI-28MAY03-CLUS19225_1
tctgcccggtcgcccactcggcccgctccctcttcgacgcccccgacgcccgcggcgggtactacatccgccctgtcgacaaatcggtgcggtcgcacatgaacgtgcccttcaccctggcgaaggggccggactttgagaagcagttcatcgcagaggcagccaaggagggcatggtgcagctcaaggggcacaggtcagtcggtggcgtccgtgcttccatctacaatgccatgccactcgccggcgtggagaagcttgtcgccttcatgaaggatttccaagctaggaacccttgagtggcttgtgcttgtgatcatttggtattgatgctctttagcagtatgtttcgttctttcttcacagcataagtgagctctgtgcaggagctgctttgctttgcgcatctgggatctatctgtagtattattagtaatagctactgtattttgcaataaacaatttaaaatttattacttgttcatggaatttcatttctatggatcaccactgtagttggaatgtgttttgctggaaataaggaataaggtggatggtcaattgcctcgcctccatcgagagcaggtggccacgctgctatatcatccagactggccatcaatctaaaacactaatctgaaggttgcttgtttttcctctcc

SEQ ID NO: 10368 - DNA, 865 bp, Sorghum bicolor
  unsure (1)..(865): unsure at all n locations
  Clone ID: SORBI-28MAY03-CLUS19317_1
gccggccgggtccggacagtacctgctccgtcaggttcaggccttcaccaaccgtcgtcgttgccgacgccggcgcccctcccccgagccgacgccatgccccccgtcaaatggttgatgcactggcatccgagccccggggcgacgatcaacagccagatcctctcggaggcgtgtggctgcgcggagtccctcggcggctccaaggacgggaagtggaagacctccatcttcttctaccgcgccatgacccgggacggctcggggggccccgcggggcagcagcaccccgacttgcctagggagctcctcggcgtcgcgctccacgagcgcccggggctctacttctccatcgtccgcgcccagcgtctcgtcctccaggccgatgcagcgttcccccaggtcatggagaagctccagtcctacagaatccgcgtcgccctcaactttgaggggtttcagtatcaactgggtgatttctgcctgaggataggaaaatgtgttcctaataattctgaagcactgagaggaatcatgatggaggtagagtattatcccttatcttccattgaaaaatccaaggcagtcatggaggacttctttgacatatggcaggaaacaattgggaagaagtcattacctggtcaattcattcatgtagactcgaacttttcagattatggtctttcagatcaatattcttttcaacatactgcagttcaatatgcaacttgcttgcagcagctcatggctgcagtaacagtcagggcctagctctagagagattctcaaaatcactctataacgtccttagntgattctgcctgggtgtatgntgtgtaatgacatgcaaatgattttaccc

SEQ ID NO: 10369 - DNA, 1408 bp, Sorghum bicolor
  Clone ID: SORBI-28MAY03-CLUS1942_1
caataaggtgcaaggaaatttcgacatggcggtctacaacatgaggataagttgaaagtaatgttcgactacatcaccagtaatggtgtggatcctcccacacctccgccggaaagcccgaagaatggggtggatcattcgccaccggccgcaactggtttgccggagcattcgcctgtgactgcacatgggttgccatctggtccagacagccacgtgaatggcacagatcatttgccactggccacacgtgatttgccacgtattcaagaaacccccatgaatggtgtgaacctcgatggatcggacaacactgaagataatgattacactcatcgagagcctgtgtttcattatccttcaaacaggaagaagataccgatccatttcagtgctgcaaagaagaagaagaaaaacaagtccgaaactgctctgctcatgcaagctcatttgtaccgcataactgagctggctcagaaagcacaggacactttcgaaaagttcagctcccaggctgactcagcgccatggcctagcatccaggatgttatgacactggtccgggagtgcggagcacggtgtgggagcaatgagcatttcattgcaactgaactttttgtcagtagagaacagagggagatgttcctgaccatggaaacggccgaggaacggttccagtggcttagaagaaagtacatcgtcaagtatttgtcaggtacaacaggtacaagtctgggtactaggtaaagtgatcctgggcgtttacattaggttttctcccaagtcttttaggctttgatatccaacatgacacattttgtattggatcctgatatagcatactctgcatcctgacaagtttggttgtatgaatgtgtagcttatcctctggtttcacctgttcctgtgtagtaacagttatcttttgcaaagcctctgattcttcctgcaatgggcacatgtgtttttgggcctgtgagaattcactgcagaaattaggcccatattcactttgttaagcaatggagcccacattgagaaaaccgcaggaaaggaaagggccgaagaggagtagtttgtccgtgccggcgcagcgcagggaaggcctggcccggcatcgctcgctgcactgctgatgccagctggcaccggatggggagggagagctccgcgctgatgagcatccacgcaagttcttttctggggcgctgttggatctttcctggtcttgctcatgctgcataaacccacttttatagctcgaactatcaatgaactatttaagagatcaatttggtgaatgcttggcttttatgtatgcaagttcatgaataatgaccattcaccaatattttgtataatgtcaaactatgatgattgtatgactgccagtgaattatataatttg

SEQ ID NO: 10370 - DNA, 1165 bp, Sorghum bicolor
  Clone ID: SORBI-28MAY03-CLUS19229_1
gccggcgaggagagaccgagaccctttaatcccttttccgctccgccggactccgagagagggcggcgggtgcgggacgcgaaggcgaagccctagctcccctccctgccgcggacgccgatggacccacctcgcgccgtcgccgttcttctcctcgtactccttcccgtgctcgccccggtggcctccggcgtgcccttcgtcgtcctgcacgggattggcgacgagtgcggcaacgatgggctggcatccttcaccgagatgcttggggagtggtccggctccaaaggttactgcattgaaattggaagaggagcatgggactcttggttgatgccacttcaagagcaggcaaatacggtttgcaagaaggtcaagaaactgtaatagctcattgaaggagacaatatagttggcctgtctcaggggaacttaattggcagggctgtaattgagtactgtgatggtggacctctggtcaagaattccatatcaattgggggtcctcatgctggtacagcttcagtgccactttgtggttctgggtttgtctgtattcttattgatgatctgattaaatcagagatatattcagattatgtgcaggcacatcttgcccctagtggctacctaaagatacccactgatatggaagattatttaaagggttgcagatttcttccaaagcttaacaatgagatcccaagtgcaagaaatactacctataaagaaagattcagcagcttggaaaacttggtactgatcatgtttgaggatgatgcagtattaatacctcgggaaacagcatggtttggttattaccctgatggagcctttagcccagttctgccccctcaagagacgaagctgtatacggaagattggattggcttgaggaccctggacgaggctgggcgcgttaaattcgtgtctgtgcctggaggtcacctgcgtatctccagaagcgacatgaagaagtacatcgtgccttacttgacgccggaggcgtcatccaagcagagcgtacaccggatgctgtcgctttgagcgagccacgtgcgtatctagcaaggtctgtatcgatggccactctgccctgacacgtggaccctgtgttgacgcccttgtaaatacgctgaacataagggaggaaataaagccggga

SEQ ID NO: 10371 - DNA, 777 bp, Sorghum bicolor
  unsure (1)..(777): unsure at all n locations
  Clone ID: LIB5051-004-A1-XP1-D6
gccggccggggtcccgaagagagacccaaatcccttttcctttccgccggactccgagagagggcggcgggtgcgggacgcgaaggcgaagccctagctcccctccctgccgcggacgccgatggacccacctcgcgccgtcgccgttcttctcctcgtactccttcccgtgctcgccccggtggcctccggcgtgcccttcgtcgtcctgcacgggattggcgacgagtgcggcaacgatgggctggcatccttcaccgagatgcttggggagtggtccggctccaaaggttactgcattgaaattggaagaggagcatgggactcttggttgatgccacttcaagagcaggtcaagaaaatgaaagagctcagtgaaggttacaatatagttggcctgtctcaggggaacttaattggcagggctgtaattgagtactgtgatggtggacctctggtcaagaatttcatatcaattgggggtcctcatgctggtacagcttcagtgccactttgtggttctgggtttgtctgtattcttattgatgatctgattanatcagagatatattcagattatgtgcaggcacatcttgcccctagtggctacctaaagatacccactgatatggaagattatttanagggttgcagatttcttcccaagcttnaacatgagatcccaagtggcagaaatactacctataaagaaagaatcagcagcttggaaaaacttggtactgatcatgtttgaggatgatgcagtattaatacctc

SEQ ID NO: 10372 - DNA, 698 bp, Sorghum bicolor
  Clone ID: SORBI-28MAY03-CLUS19672_1
gccggccgtgttgaggaaattgttggcccacctggtgttccagggtttgagccatctagctttgttaggcgtccaaggcggcctccaggcgggagcacccacccagacctcgagttcttccagcaaggcccagacttctgagactcacatcgcacagaggccggacctcgtcctaccttcacaaaataacatggcatgtttaaaatgctgagctctgagctagatatctccggcttggtgtgattgcaactgctgtatcacgggttagtcctagtgcagtttggctgtaaagatgatgtgaacatctgtgttatttacccttagttccaaaccatcgtttgtcatagccttaatgtaatacacttttgtgtacatatcgggtacccgaactgaaagcgaaacatgtcgacaagtattgcgaaagcatgcgagggaaaggagaagagtagacccccttgtcttccaaaaaaacccagacttctgagactcacatcgcacagaggccggacctcgtcgttctaccctcacgaaataacatggcatgtttaaaatgctgagccctgagctagatatccccggcttggtgtgattgcaactgctgtatcgcgggttagtcctagtgcagtttggctgtaaagatggatgtgaacatctgtgtatttacccttagttccaaaccatcgtttgtcatagcccta

SEQ ID NO: 10373 - DNA, 792 bp, Sorghum bicolor
  Clone ID: SORBI-28MAY03-CLUS19571_1
gcgtgcggctttcacccctcggttgcgggtcgtcgccgcgggtcgtctcattctcgcggcgctcgtcaatctcgctcccgcagtgccgcgcggctgcgccgccggcgtcggccattcgcttcccaccgcagggtaggacagatcggcgattcgcctggcttgcaaacatgtatatccgagtgaagcgcaacaagactacctaatacattcaatttgaaccaacagaaacggctttgagaaacgaccttgagcttcatacagagatagactacgctcctagacaaacctcctattaattgtcagtcgcccttgtggcgcttcagggatgtactagacgagccgatcaaaagggcagataaaaaggtgtaaatcgattccatcgttgctttgatgacgataagtttgaggaagaccaaatcgtcttgttagtggatttctgctttccatagtagtaaatattactttgtcattccaccatagctaccgatttaatcaataagaacgtatgatgtcctcgtggttgatcctagcagaatcgcagatgacgctgagttttaggatgtggtcaacgccaggcttgtgatgaacatgtcatcatcatgatgaggatgatattatgatgtgatttgaggcaccaactgatgccgtgctcttgtacctactggtctctgtcttgatgttgggatcaagcgcacctaattgtccttttgtaccagctctaggaaatttgttatgaagatcccaaacaccattgcggatgatattaagctgtgaattgacgcaccaactgat

SEQ ID NO: 10374 - DNA, 1017 bp, Sorghum bicolor
  Clone ID: SORBI-28MAY03-CLUS9897_1
gaaacgggacactagtgctatgcctcttaatgtgtcatcggctggaagcgtgaatgatagcttgaagcaatcatatactgttggcactccagagctacaatcaactgcaacgtcacgtgtcaagtggcaaagggctgaggtaaaccatgctctgatggaggagattcaggagataaaccagcagcttatagatacagagctccatgtctctgaggatgatgccgagtccttcactgcatctgaggggggtgaagggacagtcattagatgcacattcactgctgttgctgttagccccagcttgaaatccatgtttgcttcagcgcagatgagtccgattttgccgttgaggctgcttgttcctgctagctacccaaaatgctctccggtgctcctagacaagtttcctgatgaacaatgcaggaactcagacgacctgtctacgaaggccaagtcaaagttcagtgtgttgctccggggtctagcagagcccatgtcactgcgagaaatcgcaagaacatgggatgcttgcgcccgcaaagtgatcgcagagtatgcccagcaaactggaggaggcagtttcagctcgagctatggttgctgggaaagctgcgtaggcgcttcataagtatgttgtatctattattattattattatttattacactataaggatttatgtgttgactaaaagaaagaaacagtttatctgttgtatatacctccttccttttggtattgagtcgctgttagcttgataagtatgatcgtgtaaagtacagtgtattgagcaaacttgggtgcttcagctcggttactatttagtactctctccatctgacttttggtatataaattttgttatgtatctaggtatactttccctaaaaaaaaaaacaatatacctaacaactaaaactatattgagggctgggggtggattcactcccctaactaagatattgtcaaaagggaggatgtctctttgccattccgttttccatcgctccttgctgg

SEQ ID NO: 10375 - DNA, 1119 bp, Sorghum bicolor
  Clone ID: SORBI-28MAY03-CLUS9900_1
gtgctcgcccctcccgcccgctgatatgatatccatccattccaatcccacctctcccgctccgcctccctcttcgtcctcgtctccctctcgcagccgtccggcgtcctcgtctcgtcccccccaaaagaatccggacgtggactgaccactccttttctgggcatttacatctctaagctcaaagaggaaggattatgaaaatggcgcacctgatcactaactgtagtttcagtacatctcctgctgttccgacattctccagttctcctaattactgccgcagtgttggccaattacgaactcaaaatcttcaaatttatccctcaaatcttgttccaggagacaaaagaagtcatatgtttcctgtgctagtgcagccgtacaaggacagacacaaacacctcttactggtagccagcaagcttatgagcattcatcctccaaacctaaaaaggtaatggttattggtggagatggatactgtgggtcggcaacagctcttcatctctcaaacaaaggttatgaggttgctattgttgataatcttgttcgccgtctttttgatcaccaacttggtcttgattccctggacgcgtgggcttcaatccaaaatcgtgtccgtagatggaagtctctcactggtaagacaattcagctctttatcggtgacatatgtgattttgaattcctctcggaagctttcaagtcttttgagccggatgctgctgttcactttggtgagcaaagatccgcaccatactctatgattgatcgttcgcgggcagtctacacgcagcataacaatgtcattgggacacttaatgtcttgtttgccataaaggaatacagtgacgagtgccatttggttaagctaggaactatgggtgagtatggaacaccaaacattgacattgaagaggggtttatcactattactcacaatggaagaacagacaccttgccttatccaaaacaagcgagttctttctaccatctaagcaaagtgcatgactcccacaacatagcatttacctgcaaggcttggggtataagggccacagatcttaaccaaggtgtggtctatggggtcagaacagatgaaactgcactgcatga

SEQ ID NO: 10376 - DNA, 938 bp, Sorghum bicolor
  Clone ID: SORBI-28MAY03-CLUS9966_1
ccgggatggtctattcaatttcaagcctagtgtgaggcctgtacctcttgaagtgcatatccagggatatcctgggaaattctattggccaagaatgaatagcatgaacaaaccagcttatgcagccatatgcactcattcacccaataaacccgttctcatttttgtgtcatcacgtcgacagacaagacttacagctcttgatattattcagcttgcagcatcagatgaaaaaccaaggcagttcctgagcatcgcggacaactctctagacatggttctttcacaagtttctgacagtaatttgaggcatactctgcaatttggcataggtctgcatcatgcaggtttaaatgacagagacagaaccttggttgaggagcttttttcaaacaataagattcaggtgctggtatgtaccagcacattggcgtggggtgtcaatcttccagctcacctggtcataatcaagggaactgaatactatgatgggaaaacaaaaagatacatagattatgatatcacagatattctgcaaatgatgggtcgtgcaggtcggccgcaatatgaccagcatggcaaagctgttattcttgttcatgaaccaaaaaagagcttttacaagaagttcctctacgaaccatttcctgtggaaagtaatctgagggagcacttgcatgaccacataaatgcagaaattgtttctggcaccatcagcaacaaggaggaggcgattatttatctcacctggacttacctatatcgcagattggttgttaatccggcctattatggattggaggatactgaaacaaacacattgaattcttatctatcaaggttagtcgaaactacatttgaagatcttgaggacagtggatgcaataaagtggatgaccactcttgtaaagtactgattttggggaaaatagcttcac

SEQ ID NO: 10377 - DNA, 618 bp, Sorghum bicolor
  Clone ID: SORBI-28MAY03-CLUS10090_1
gtgccagaaacacttgcatcatgctcgtcagcagatgaattcatgcaaaagctaccaacctttgatgaggactgggccaggcaacgcagtgatgctgaagctgcagacgaagtcctgcgttacgttggagtggtggacacggtgaacaagaaaggacaggtggagctacgtagatacaagagggatcacccgttcgcgcagctctccggctccgacaacatcatcgccttcaccacctctaggtacaaggagcagccactgatcgtgcggggtccaggcgcgggcgcggaggtgactgcgggtggcgtcttctgcgaccttctgcggctggcgtcttacctcggcgctccttcgtagagcttccagctacagttgtcaatttcaagaggcagacggacacactgttctgcatgatgcctccggattgatcttatggacttgttcatatgttgttgtttctgaataagtgccaggaaataaggcctctatcttatgtagggagagagaggttcggctttgggatagccgactatgtgttgtttttgctcagaatccagaatcctgtgaattgaaatgaattataccaatggaacaaggtctactggaggtgtgaggagt

SEQ ID NO: 10378 - DNA, 1064 bp, Sorghum bicolor
  Clone ID: SORBI-28MAY03-CLUS100980_1
gcacgaggctgaagttttagaacctcttgtcaggaaaatcagggatgaaaagtatggatggaaatatggctgtggagccaagggctgtacaaaactttttcatgctcctgagtttgttcacaagcatttgaggctcaagcatccagaccttgtattggagtcaacatcaaaagttcgagaggatctttatttccaaaactacatgaatgatcctaatgcaccaggtggaaccccagtgatgcaacagtctgcaccagacagaggaagacggagacctagcatggacaatcgtctgaaatttgaccgtggcagtaacagagaacatgatagatctgagagagatggaggcagatatggtagaggtgatcagtctccaagccgtgatgggcctgatgatcagatgtttgatggtttccgtggacggtcctctaatggtccttttgttgctgagttcccccctccaccgatattgatgccagtacctggtgctggtcccttgggaccatttgttcctgcacctccagagatagcgatgcatatgctgagagagcaagggccacctcctccgtttgaaccaaatggcccaccacatggcaacacaggaatgcttggaccaatgatgggtggcccagcaccgattatagctatgcctccaaatttccgccatgaccctcgtcgtctgagaagttataacgacctcgatgcccctgatgaggaagttactgtccttgactacagaagcttgtaggttcgtaaagtttcctccgtgctcccattggagaatcgggttgccttctcttatgaagacagagatggaaggttacgtacaagtaaaccaatttttgggtcaccctgtagtctgttagattttgttgtaacttgaatggctggaacttcaatatttgctcttgctcctgtcgaaccatatactccgtgaatgcactgctgttactacagttgttagccaacttttttttgacaacaatgctgtaatattcatttccaaacatttttttaatttccgattgctgattcgagctgaataaatataggcctctgtttgg

SEQ ID NO: 10379 - DNA, 665 bp, Sorghum bicolor
  Clone ID: SORBI-28MAY03-CLUS9479_1
gcccgaggcctcgcgccaggccccgccgccaccgcctccacgcgtccccaagaactaccagataggcaaacggaacggaagaatcacagagagctcacaaacacatcttgcgtcagagatgagcagcagcacaacactgctgttctccccgagctcctcctccctgttcctcaccaaaccgtctcccgtcgccaaggggagggcggcggcggcggcggctgtgaggtgcagcagtgagccctccgtgtcagtgggacatgaagaggagagggagggtgtaacaatgggtggggaggaggcgagcattggcttctgcagctgctgctgtctgtagcgctcccagtgcttgggtttgcaggccttggtctggcagccactcagggcctgctggcagggaggatccctggcttgtctgaacctgatgaaaatggttggagaacataccgcaggccaggcgtctggtccggtggccacggtcttggcgggtcccccagcgtccccttcgcctccacttttttacagcgcctggctcttgttaatatgattagaggacatgagggattgtattatggagagaggataagtgaacatcacttttgatgatcactctaaaattagaaagctgcagaagctccactgtatgtgtaaacttgctcattaaaggc

SEQ ID NO: 10380 - DNA, 390 bp, Sorghum bicolor
  Clone ID: LIB3478-010-P1-K1-D11
cggagatcgacctgcgcttcgcaaacccaaaggagggccggtgtttcgtcatcgttgccccggttcgccggttcgcaggtggggaactgaaacctgaacctcaagaaatgtgaggtcttcaatttcatagggcagatatggtaactatatggctgcactctaacaatatatgatgttcactgcccattgtgtcccccagatgatctggatgatgcgaccatcgagaagatcggcaacccagagaaggtgattagcgccttcggtccagaggtcatcggagagaatgtggaagggaaggtcctgtcctcggcaactgcagagtattcaggaagaacatactaccagtttgagctggagccaccccatgtgttcattaccgccacagcagct

SEQ ID NO: 10381 - DNA, 732 bp, Sorghum bicolor
  Clone ID: SORBI-28MAY03-CLUS95006_1
gcacgaggcaaagaacaagaacgcggcgaggtccaggtccacctctagctctgacctgcccggcggccccgtcttcttcttccttaatctcaaattcccaatcctcctccgacgcctcgttttcctggatcatccaggcgggggacgccggtgtcttgctcgcttctcctccctggttgctcgaggcagccgtgctggaggcggcggtggcggggggaccatgtacagatcggcaggggtcgcgatggcgtggaacgtgttccggttctgcacggctctccgtgggctgggttccatcatgatcctgctcgttctcgccatcgtcggcgtcacctactacgctgtcgtcctctgcaactacggccccgccctcctcaccggcggcggcaccactctcgccgcgtttgccgtcctgctcctcttccacttcctgcttgctatgcttttatggagttatttttctgtcgtgttcaccgaccctggttctgttccaccaaattggaatcttgattttgatgtggagaggggagaaactgctcctctcgctacctcagagttcagtagccagatgaactcacaacaatcggtggctcttggcaatacggcaaatccaagggttaggtactgtaggaagtgcaaccagttgaagccacctcggtgccaccattgctctgtttgtggaagatgtgttggggcactgaactacaaatactttcttctcttcctgtttta

SEQ ID NO: 10382 - DNA, 828 bp, Sorghum bicolor
  unsure (1)..(828): unsure at all n locations
  Clone ID: SORBI-28MAY03-CLUS9498_1
caaccggcaagaactcatcagctnttggttcagctgatattgaataagctagaaagcaatattgagaagtttgcttttgtatgtggttatctaggattaccaagtttacattgattntgtattctacctgtttgcttcatctctatccactaaccccctatttccatacaaatgtcgattctataacttttcaattagtttgcaagtgtgctgatatagcagaacaactaactgagatgccatttgcagagtctataatttttccatatctctatgccacaacatactgatatagcagagtctgctggaggtctagctgtagatgccatttgcaagtgtgacatgtgccgcattaagcagagcagttgctaggctagcctgactaaggcatggttcagggaagttatagaagaagagtcctcgatgacctcttcccttgagcaagtgcttcaatgcaattctgaaggggagttccttgagcttgtgactatggccttggatttttgccactgaactgaatattgaaatatgaattggcaagaaggaaacaagggtagcaaaagaaggtcgccaagagctttgttctctgtttggagttcaatatcactaactgaaaatatttgaaagcgttgttattaattcatagctaccttgtgaggttatgatgagtgaatgcttatctccctttttgcaaactgaaagctattacttagtggtgcatgctgttgtagttctacacattctgaattgtaaacatggatgttttgtaacttgttgatttagttatcatgatgtcgtaaaacttccttaaaaatgtctcattttgtg

SEQ ID NO: 10383 - DNA, 378 bp, Sorghum bicolor
  Clone ID: LIB3478-002-P1-K1-G11
gcttcataattattgattatccaagttccaagcttgcagggaactagcaaaaaacatacgggcaagttatctagtctataatttttccatatctctatgccacaacatactgatatagcagagtctgctggaggtctagctgtagatgccatttgcaagtgtgacatgtaagtgttattcttgcaggcattaagcagagcagttgctaggctagcctgactaaggcatggttcagggaagttatagaagaagagtcctcgatgacctcttcccttgagcaagtgcttcaatgcaattctgaaggggagttccttgagcttgtgactatggccttggatttttgccactgaactgaatattgaaatatgaattggcaag

SEQ ID NO: 10384 - DNA, 894 bp, Sorghum bicolor
  Clone ID: SORBI-28MAY03-CLUS95608_1
ctgttggcctctggaccataccgcgcgcgcccccggcagagagctcgtcggcgtcttcgacggtgaaaccacgcggaggatagacatggccgccttactccaccaccaagcggctgccccgaccgcaaaaccaccccacccatgggctcttcactccaccacatccagcctctcgccgctctccagacgacgacgatgcgcctcaaccatccgctcggcggccacggacagcagcttcgggaccggcggcgacgcggcgccgtccaagaagaccacccggaaggagaagcagcaggagcggcggcggcagcaggacctgcaggaccggcagcagcagctcctgatgatggaagaaaaaacgtccctcgcgaagcgagacggcggcaccggcagcagcagcagcggcggcggcgaggtcgacggcgacgacgacgagcttccgcagcccgtgttcgaccgcatcctgcgccggatcgcgttcacggtgggccttcccatggcgacgggcgtcgcgctgctcaacgtgtacgacgcgctcaagcgcggccagggggtggtggtgccttcgtgggtgccgctgctcaccatcctcgtcgccttcggcacgtcggcgctcggcatcgcctacggcacgctgtcggcgagctgggaccccgacagggaaggctcgctgctcggcatcgacgaggcccgggccaactggcccgtgctgtggcaggaagagatccagaaggagaaggagaagaaggccaagcagatgaagaaatgactggctggacagggctgaaaatcctgtgcaacttgctactgatcatgtaatatttcattggggtattacattgatcttacctttgaataaaaaaggcaatataaattagctaaaaaaaaaaaaaa

SEQ ID NO: 10385 - DNA, 1227 bp, Sorghum bicolor
  Clone ID: SORBI-28MAY03-CLUS9564_1
cctactgcagcagccagcagccgcagccgcagccgcgcggcgccactgccctcacccgaacgcctcgccttggccgccccctcgccgcacccccacacggccacacccctcaagcatctccactccccgaccgcgccgagcagagagaggatcacatggcatccgccgtttcgcttctcctcctctcgcccccgcgccatctccaccgcgacgtcgcatcccgcctcctcagcaccccgcaccggcgggtcctcctcgccgcccccaccagcgcgacccctcgtcggctcctcgctgcgccgccgccacgcgcctccaacaacaacgacgacagcggggccgtggaggcgcccgaccgcctcgtggccgcggacgcctacctctacccgttcctcgacggcgcgcaccacggccgcttcctcctcgcgcagttccccttcttcaacgcgctgctccgcccgctgggccccgcggctcggctcttccactcgtcgccgctcacgcccttcctcctcttcctcacgctctacttcgccgtcgtgcggaaccagcaggccttctcccgcttcgtccgcttcaatgcgatgcaggccgtcgtgctcgacgtgctgctcatcttccccgacctgctcgcgcagtcgttcgcgccctctggtggggttgggttcgaggtcttccagagcatggagagcacggtcttcctcttcctgctcgtctccttggtctatggcagcggcgcctgcctgctcgggaagacgccgcggctgcccattgtcgcagatgcagccgagcgccaggtgatgtgactacaattcctttccctcgaatcatgctgatggaaaggggatctgatgattatgcagaaacatcggaatggctcgttggtgcttgcagcaaatcacaagcttagtatagtttacaattgccttgctgtttatataggtctagttaccacttcaatggatgaactgtgcaaggttgatacaatgacgttgcagcctagtgtactaccatatttgttgaattgacaaattttgggagagcaatacatgtacactgttttacaatccgaatcgcatttacaaatgaggaggattgaggaatgtctgaatcggggagctttctgactaccccctccccaagcagcttcccttgtatccgaatggaagcttaggtcagtaatttaattgtgattgcaatataaataaaagaattgcatcgattgtg

SEQ ID NO: 10386 - DNA, 733 bp, Sorghum bicolor
  Clone ID: SORBI-28MAY03-CLUS95975_1
cttcattacaggaaagatggttgaggctgaacatgtttttttagggaagctatatcctctgcctcattcactgcagttgctgttcttcattgaagacagtggagaaatactttacttctctgatctttggccccttgtttgagtaaaatttatctgaaatttcgtcaacaatgcatatcgagtcaagcaatatgttttttacttcagctttgttatttgtcccattgtgcaaatgaagactgtagtaaattgaaatgtggacttcatgtagctgcgagtgaatctgcatatttctttttttgctttagccttcatagtcagggcggtaagtgtgatatgaatgttccttagaactaccatttggctgatgatgtgtacatcttcatcgcaggatgggctagttgaacatcttgtgcaactcatcaacggacaatgccggattgaagcgcagttgctgcctctggagccttattatttccttttgctttagtcctggttatttggcctttagttgagggttcccgagtttttagaatggaagcttctgacttagagagaagttagaactactgcgtgttgtatgagcttgcacatgtgattaagatgtcagcattctcctgaatgatcataccatttaccttaatgcttcggcatattggcagctggaaatatgcattgttcataaactattacatatggccgttggccccaaatacaaggttgacatttggcc

SEQ ID NO: 10387 - DNA, 866 bp, Sorghum bicolor
  Clone ID: SORBI-28MAY03-CLUS10414_1
aaatatacgaggggcagggccctcctcttcccttctttgcattcctccacaccgatcactcgctgctcccctctctcgccggagccccgggccggatggcggcggcagcagcagctcctcccgcctccgcgatcgcgtgatggacgcacacgccgccgcgctccgccgatggacgacgccggaagggcaccaccacccgctcccgcggcggtgaccgtatccgccaccgccgcacccgcgcctcccccgccctccgccacggccgccgccgacaagtcctcgctcgaccccgaagcgctctatgaagaggggatgtggcaacagatggccatgaacagcggtgccactatgcaacctgggtcatatcctgagcgaccaggtgaacctgactgcacttactacctcaggactggattgtgtcgatttggcatgagctgcaggttcaatcatcctccggataggaatctggctattgcctctgccagaatgaaaggagaatatcctgagagagtgggacagccagagtgtcagtattatctgaagactggaacatgcaagtttggccctacatgcaaatttcaccatcccagggaaaaggctggaattgcagggagggtgcagctaaacacattaggatatccactccgcccgaatgaaaaggagtgcgcatattatttaaaaacaggacaatgtaaatatgcaaatacttgtaaatttcaccatccggagcttttcaatgtggtgccttcgtcacgtggttctcctatttatacttccgtacattcctctgcaagcgctggtccacagtcctatactggaactatgccaagctgggcttttccacgagcttcttttataccaagccc

SEQ ID NO: 10388 - DNA, 654 bp, Sorghum bicolor
  Clone ID: SORBI-28MAY03-CLUS1033_1
cccacgcgtccggttgatgaactaagcagaaaaactatagtttgatatattttgtgaaatgtcatgcttcttttgagtcttggatataatacgttttttttggcccttttctcaattattgcaaagagtaaaatgtatggaccgtctctaaacttgtcctggagtaccatccaggtccctggactctcaaaatgcatttttaggtcaccaaacttgttccgggacaagttcaaccgctcatgtattttattctataattgcaaatatgctctcacaatgttctgtttctaatccaggccaacgatgatcctttatggtatcgacaacataagggacctgtttggaccaaaggttgatttcaacctcatcaagagcaacccactatgccggttgggactgtagtgactagtgaggtagagggattccaaagcttgatcagaatgggccaaagattttgttttcctttttgttgttgtactcccttgagtaaacactggttcatgtacttttaacagagtccaaaatgcaatgtagtattttgtgagatcataggggaagcatgtttatcccaaactttcgtttggtatatttcagtttattattgctagcaaaatagaatgctaaatgtttttgtaattgttgtaccatggatct

SEQ ID NO: 10389 - DNA, 464 bp, Sorghum bicolor
  Clone ID: SORBI-28MAY03-CLUS104290_1
gcacgaggccgccgcggggtcggcggcgaggtcgctcgcgaacctcgacaggctcatcaacgatgtgctgctctctccggcacgattgggcggctcactcaaaatggcttgaatgatggatggccctgatcaaactttgacgatgctgagcgatggatgaacgatgatgagatcatctaccggctgtagcgagagtctggaaatgaaatggttgtgtttttttggggggtagcgccaatttcgcgacttttgtgaccgagtgatgtatgcctttggaaagatagcgttcccctttcgtcgccttgcacggtagttagaccatttccaagagctccttaaaacaagagtttaatttgtttttctctaaaaaaagggtctcaaacattatttgttaagaaacaagactttaaaaacattattaatgcatttcgatttatccctcctgcaaaaaaaaaaaaaaaaaa

SEQ ID NO: 10390 - DNA, 932 bp, Sorghum bicolor
  Clone ID: SORBI-28MAY03-CLUS10462_1
gccggccgggccggggcgtcgcttcggttctgctcgtctgcccgcctgcgagtcggttaataattagcatagccacggtcgacggtcgtcgtcctcgcgggttcccccacgccggagcgcggcgagcccggaggcaagagatggagaacgcggtggtgctccgggagtggttcgaccgcgtggacgccggccgcaccggcaacatcaccgctgcccagctccagggcgcgctcgctgtcggcaacctcaacttccccatctccgtcgtgcagcagatgattaggatgtatgactttgatcggaatggcaccatgagcttcgaagagtttctggctctcaacaaatttcttcagaaggtgcaaagtgtgttctccaccctggaaaggggtcgtggatttctaagtcttgaggaggtgtatgaggcattaatcaaacttggtttctcgttggattcaccagccttctacacagtttgtgagagcttcgacaagagcaagaaggggatgattcaattggatgagtttatatcactctgcatttttgtgcagtcagctcgtaacctgttcaattcattcgatacaagtaagcaaggaagagtgactttggattttaaccaattcgtgtactgcacggcaaactgcaggatataacgtggttgtacatggacgcccaaacaaaagttagcagtgtgaagtgcgaacggttagccaaacaaactttagttctgaaccggcagctggatggtattgcaattcattgtttgccatccaaggcttgttgtaccatcattttgcctgaatatattcttggtcacctattggtcaattcgtgtccagttttctaacgtcctgggctgtatatacagaataagccattgcaatttgtggctgtatttatttgtatcaaatatagcaagtaacaagtaagccaga

SEQ ID NO: 10391 - DNA, 611 bp, Sorghum bicolor
  Clone ID: SORBI-28MAY03-CLUS9779_1
cctactgggttctctcttccgcacgcggcaggaaaccacttgcagctccgctcgcgtcgcggcgcgaccgcgcgaccgccacatccgcccgtcgcgggaccgacggccgccggatcctggagccttgcggcaacaatctccagcggttggaggggcaccgaagggagggttggcgacggcggtcgagtactgagcgcctgacttcccatcgattgctcatcccggcaatccacggtgtacaagggtaaagtggtgcacctggaccattccggctctagctttgcccttgcattgagatcgaaagctcaagatcctatccatgcaatgcgaagctgagaacaatcatgtccttgtggtggtgagagcgcagatgatgcacccggaaccaacaatgaagcgtgcaggtggcccaaccaatgccgtggaccggctcagtgccctgccggatgagctcctccatgtcatcctgtccttcctcccggcaccgctggttgttcagacgagcttgctgtcacggcggtggaggcgcctctggcggtccacccctctcatcaaaatccacgaacaagaatttgtgatctcttcaaagatcaggaccaacaccctggagg

SEQ ID NO: 10392 - DNA, 926 bp, Sorghum bicolor
  Clone ID: SORBI-28MAY03-CLUS97969_1
aagagagagactgcacgaggcaagaagcgcaatagagtaatcttctgctgctagacgccgtcgtcgtcgtcgtcgtcgaccatgggagagagccgcggcagcatcgcctttttcgccacgtaccggccgccgatgccgctggacatcttctccgtgcccaacccgccgtcttcgatccgcgacgaggtacacctcaccgacggcgtctcctacaactacaactgccgccccatccccaaggacgcgctcaagtccctgctcaagcgcccgaagctcgtcgccgagggcggcgccaccgacgccgacgtcgacagcggccgcgtctccggcctgctcttcgtctccgagcgggacggcgggctggagacgctccgcgttgccctccgtttcgacgactccggcggcaagcagacctgcaaggtgttctcccttgctgacgtcttcggcgccgccgacttcaccggcgctcgcctcgaggacagcggctgcatcggcggcggctataagatgggctctcgctccgtcgaccactcgctcatctacgtctccaccaaggagccggtggaagagcggcggagcccatggaccgtcgtgtacaagaccaacctcaggaccggcaagaccgagcgcctgactcccaaaggtcaatttgacctgagcccagccgtgtcgccgtcggggaagaaggtggcgatggcgacgttccggccggaaggctgggaaggcgagatcgaggaccttcagacggacatcttcgtgatgaacgtcgagaggccgccgatgaggaaacggctgatcaagaacggcgggtggccgtcgtgggccagcgacgacgtcatcttcttccaccggaaggtgggcgacacctggggcgtgttccgccacgacacgaggacgaacgagacggtgcgagtgacgccggaggc

SEQ ID NO: 10393 - DNA, 587 bp, Sorghum bicolor
  Clone ID: SORBI-28MAY03-CLUS9833_1
ggaaaaaaaaaacccacaagaaaaaggaaacaaaagggaaggaaacgcgaggctaaaacaaggttggcggcttcccgaagaaacctcccgttcctccgcgacccagcgaccgacgcctgcgccgccgtccgatccccgaatcgccgccgtccgattccggcaggggagcagacggttcgagcaaattggcccaataattttgggggcagggcagccaggtttgagctccgggatctcgattcttcgtagctaggtgggggagggcgccggatccagcggccgtcatggttgtcgatacggtcagcgcgagcacctccataattgccccccacctgttcgaccacaggtccaggggcgccggcgcctcccaccaccaccacctccgccatgtcgtcgcctgccgccccctgcccaccgccttcgccggccgccgcctcgtgtcccgggtcaacaagcagccgtcgccgcgcctcgccgattggccggtcagggcgctggctatgggtatcacaaaggaggccagccctcgcagggagtaccgggggatccccggggacggtggcgacatgggggatgttggggtcacc

SEQ ID NO: 10394 - DNA, 762 bp, Sorghum bicolor
  Clone ID: SORBI-28MAY03-CLUS9851_1
cggcacattcctcttgttctagagcctcgctatgttccaccggccctagatcatcaccatgggcctactgtgccagagcttcgacatgtccctgctgcatattatcgcactttggctccatctggtgattcatactatcggcctgttgagaatctggtgcctgagcgatatgcaactgtggctgacataaccactagagatccaatcattagggatcacacagcactgccaggagaggcatctgctcgagcagaccgcttggatgatctttaccggactcgtggtgctcatgtggaggatctgtaccgtccaggggaaattgctgctcgtgctgatcgtgtggggatcaccactagagctgatcgtgtggaggaactctaccgttctgatcgacttgttaaccgtgctgtggacccccctcattcagcctaccttacagctggttatgagactaaccctgcttatgctgaaacgagcatcaggcctgtctctgcaagggttagtggacctggtgcgccggtttcgtcacactattccttcactggtggtccagtatatcggtgatgagtgatcatggctctgctgaaagccgtagccagactaagaagacagctctataactgcaatttttttccctcaaaaaaaaaaaaaaaagaactgcaacttttatttaccttagcttctattctagattttcttaaatatccttacctggatgaatgacattcgttgtaaagacttgctggtttaaactgttgaatt

SEQ ID NO: 10395 - DNA, 967 bp, Sorghum bicolor
  Clone ID: SORBI-28MAY03-CLUS98564_1
gcacgaggatcctgtgcaagtgcagcattatcggttttgacgagggatgattccaggatgcatgcagaaggcattgatgctatgggtcatgctactcatctgaactacggaccctcatcatccatttcttctgaaactgtgaaaaatgctgcaatctgtggcttgtcagcagcagcaacgaagtccaagctttttgcagaccaggaggagcgtgaaattcagagattatctgccaccatcataaatcatcagttaaagagactggagttgaaattgaagcagtttgcagaggttgagacaatgctcttgaaggaaagtgagcggttagaggtgatgaggcagcagatggtaactcagcgtgtccggttgttatcaacccggttcacttccacaggtggtacaatacctggaggcagcagcagtatggttgcaaacccaatgaatcaggccaccggccttagaccactgatgatgccaggcacggtgtcccagtccagcgtgccggcaatgtatgcaaataacatgcaggggcatcctcagatggctctgctgcaacagcggcaacagatgctctcatttggacctcgcttgcctctctcggccatcaaccctggctcgtcctcgtcggcacccaacatgatgttcaaccctggcatgcccaactcggcagctcctaatcatcaccctttgttgagatcaccctcagggaacaattcaaatgtaggttagtgagatgagtttttcttttttgggtcttagatgcctgagttgtagcccctgattcgtgatcgttaaccatcaattgcacaatcacatatagagatagttgttatcagcgataggttctcattttctctaggctgtggaccgtgtggtgtgtgttttgataagactggtgttgctagtggctcaggcaatgcatagaggatgtagagtttcaccctgattaattattattactgcccca

SEQ ID NO: 10396 - DNA, 487 bp, Sorghum bicolor
  Clone ID: SORBI-28MAY03-CLUS98761_1
tgcaggactagtcattcagcgacgtcgatcgaccaccatccaaccaattgtcactgctcacgcgcactggaggcagcaactcgcggaattacggcgactgcttgatgaaaatcaatgcccagaagcgaaggaccttttagaagacctgattgtccaagctcgcgaaaattggcggcgaccagattggcgtggaaatctcgccgctgctcaattcggaggccttttctcgtttctcggtacacagccagtctcagttggtaatttcgttcgaaaccgtctgcccgatggagcctacgaacaagcattccaactgaggacctacggacgactttggtcgttgtatcccctcattgctgcttgtgatatcagatacaacagattttctgttgacaccgcccgtgctttccatcagtttctcaccaacaatccgatggaaagagcattttgggtcaatatcgtgattgaatagaaagtgtcagtaaaagag

SEQ ID NO: 10397 - DNA, 936 bp, Sorghum bicolor
  Clone ID: SORBI-28MAY03-CLUS10667_1
ccggtgcaaatctcatgcacggttgagtgggatgtttccacccacgacccaccaatcccacgtcagccttatctccatgcgaccatgctatttcgaaatcccctctcctctctctcgtcgttgtggccccgtcgctcagatctagaccggctggttgctggagcctggaggtggagggcttcagtcggcggcgatccgtgccaccgtggcctcctcatccccaccagcggtggcgcctccttcatcaccacaggcgtccacggctgctactcccctaccagcgaccgcggtgctcctagggggccgcacggccaggccctcgaggcgaaggctacggcagcgcgacgcaccatcagcacggcggcaaccctatgcagcaacggcgcgtccaatcctggtggccgcacggccaggcaccatcagcacggcggcaaccctgtctatcagcccggcggcaaccctgtgcagcaacgcaccatcagcacggcggcgtcggccccttcccttcctcaggccaaagacagctcctctgtctgggccgtgtcatactgaagcagacccagatcttatttatggatcaggcaactgcttcagttgattcccaaactgatgccacaattcagaagatcacgcgacaggagttttcatcatgtacaataattagcatcgcacacagaataccaacagtcatggtctgggatagagttttggtgttggatgcaggtctggtaaaagaatttgattcaccgtcgaggttaatcgaacaaccgtccctcttcggtgcgatggttcaggagtatgccaatcgctcgtcgagcctgtaaccgtgccatgatactgtgagttttttaaaaaataagtagaagttggtagcttgactttagtgtacagcatgtggaggaatgtgcagggaatgcaactatagaaagtttgcaa

SEQ ID NO: 10398 - DNA, 376 bp, Sorghum bicolor
  Clone ID: LIB3478-017-P1-K1-A7
accctatgcagcaacggcgcgtccaatcctggtggccgcacggccaggcaccatcagcacggcggcaaccctgtctatcagccgggcggcaaccctgtgcagcaacgcaccatcagcacggcggcgtcggccccttcccttcctcaggtctggtaaaagaatttgattcaccgtcgaggttaatcgaacaaccgtccctcttcagtgcgatgattcaggagtatgccaatcgctcgtcgagcctgtaaccgtgccatgatactcatgtatcaagaatgcacagcatgtatcaagcctgctagaaatccaagaatgcacagaggcccctggctgcagtgcatcccacacggatggcaccccagcagcacgtcacaat

SEQ ID NO: 10399 - DNA, 697 bp, Sorghum bicolor
  Clone ID: SORBI-28MAY03-CLUS110326_1
gcacgaggcacaatctctctctctctctcttaccaaatccatccacaaattaactggcacaacacaggggaggtaggccggtatatggcgccatcacggcgtaggaacaactcctccctgttcgagtcctccaccatcatcacggcgaacctcatcatggcctcctcgtcgttcctcctatcgaggatcgcaccccgtgtggcaaccgcatcgccgccgccgccgccgacgactaggatggtagcgaccagcagggcttcggcggcaacatccacccgttctgtggagcccatggccgggtgcaagacgatcctcatgaagcccgtcgatgggcaggatggcaaagtagaccaacgagcggaaatgttcatcaggagtttccgggagaggacactgtcggagacagctcacttcgaaacagctaatgcaggagctcgcccgcagccgcaagcgcgcagatgcccacgttagaggtgcaggatatctctagatgtaagcatttgaggagccatgtgggctgtttcttgcaaaactgctggctagctagtcctccgaaccaggttcaggaaatcatatggatttgtgtcgtaaacggtttacttctaacagaataagatcatcacatcctgtataaataaaaggtcacgacagattacgggtatgtaatcaatcaaaatgaattatcatttcccttttc

SEQ ID NO: 10400 - DNA, 827 bp, Sorghum bicolor
  unsure (1)..(827): unsure at all n locations
  Clone ID: SORBI-28MAY03-CLUS108420_1
gcacgaggcagaagcgaaggcgaagaagctaaaatcaagaaagcacaggaggagaggagattcttcctcggactctgacagtgactatgacagcgatattgatcggaaacataggaagaggaaggaccgcagaaggaacaagaagcatgaacattctgactctgatgccaggagacgcaagcgtaggtccagaaggagcacagactcaagtgacgagagcaacagtgaatatgagagcaggtctgaagaagaacgtccaaggaagaagcgctcgcacagaagaaggcatcaccgacactcttcaaggtcagactctgaagactacagcagtgacgaggaagaacagagatctgccaaggaccattctcagagccgcagacgccaccataggtcatccgatgatgactcggacaaggacaaggtcaagtcgagacatgggaagcgtctgagatcaagtgacgaggatgcaaggtcagattccaacagccataagcatctcaggagccaatccttggaggagtcatcagacgatagagatgctgctgaatcagagaagatgagaaatggcaaaaggtctcacaagaatggccaccatcaccaccatcaccgtcaccatcggcaccaccatgaaagacatcgtaactctgcagaacctaatgacaagaggcaagtattgaaagatggccagagggccattggaagtgacagcgcaaactgaagatacactggaaagatcgatttttcatttgtgatgttctcagttaataattgatgttgttaaggacagaaagatcaattttttgttcctgatgctgatgttctncgtt

SEQ ID NO: 10401 - DNA, 730 bp, Sorghum bicolor
  Clone ID: SORBI-28MAY03-CLUS110388_1
ggggagcaagacggcccggggtatgcacgagtaccggctcgcgggcgccgggctcgccccgtgccgccgcgcgacagcgcagcaggacggcgacggcgacgcggcggtgtcgcggccggccgagggctgggtgctgtgccgcgtgttccggaagaagaagggctccgccgccgccgcgaggcctggcgaccggagcgacggcgacggcgatgagggcgaggaggccggcgagagcgagagcgcgggcgctggcgggccggggttcatcgacttcttcgcgcgcgcggacgcggcggggcggcggcgtcgcgcggcgtcgcccgtggtgtcgagcagctgcctgacggacgcgtcgcccgagcggcagcaggggcgggagcaggagaccaccagcagaggcgcgtgatgacaaagacaagcgtcggctggcgtggcgtgaagcaaggcgggcaggcaggcaggcatccaagcagagcaagcaagctagagaaagaggaaagcttttgttggcctgcatgagcaagcagagaaactgttgcagtgcctaatctgggcgtcagtaggagtaagtaaagtcattagcaacgagagagcagcagggagaggagaggcctgagagtcttgagcgtagatgcttgctgaaactaatgtagcagcagttcagttgtactccgtagtaatgtatacctaccgtatcgccaccacccggatcaatcaaaagttttccgtc

SEQ ID NO: 10402 - DNA, 795 bp, Sorghum bicolor
  Clone ID: SORBI-28MAY03-CLUS10182_1
catccgatagacttggggaggacttctctgagcattacaaagattttacggagaggttaattggaacagaagagacggtacgagcagcctcaaagcgactaactcaggggatggcagatttcagcaaggcaatatcttcagcaaaaactgaaggggaaaagactaaaattaaaggcgatcagcaaacttcaacaaggacaatgaggtcatataacaatatattgtcaatggcacagttgttgcatttgaaatcccctttatttattggtgataagaaaatcactctatcatggatggagcagcccaagaaaccagaagctacaacagcaagggggaagaggtcacaacctgctacaaatgggaatggccctgcaaataagaaggggagaggaggaatgcaaaaccagcttgtgaacagagcttttgaaggattgtctcgtggtggtagaggcagtggaagggggcaggtcaggggtggccgaggaagaggaagaggatggggtggctaccgctgagatgacctggaaactctgttcaaacctgacaagggatgagctttctgcttccacttgagagtaaatgcaaaggtcgatgtttatttgtgtgcattatcgcaatgagttcaaattgatcaaggcacacaacagcagaatgcctgagaaatgtcagcaagagttcatctttcctattcatttaccatctcattgtgttctttgccaccgtaactgctgtttcacctgtgttggccgtttgatgaaatgtcggcaagatctgtgcatctttcatattcattac

SEQ ID NO: 10403 - DNA, 776 bp, Sorghum bicolor
  unsure (1)..(776): unsure at all n locations
  Clone ID: SORBI-28MAY03-CLUS10218_1
gctcgagccggccgggccgacggtgcccaccgcttcaccgggaagtcgctccaacaatccacagcaccaacgcccggcccaacgctgcgccaccggcgacccgaatcccccctcctcccttgagatccgcggcgccgaattaaagagcgatggcgacggagctgacggcggcgcagctgcgggcgtacgacggcaccgacccgtccaagcccatctacgtctccatccgaggcaaggtctacgacgtcacctccggccgcggattctacggccccggcggctcctacgccgtcttcgcgggccgcgaggccagccgcgccctcggcaagatgtccaaggacgaggccgacgtctcaggggacctctccgggctcaccgacaaggagctcggcgtcctcgccgactgggagaccaagttccaggccaagtaccccgtcgtcgcccgcctcgccgacgcctgaactcggcagtctcaggctcaaccacccccaatcagccgcgaggagcagctctctgctgcggccaagtgtcagtgtaaactctgtcctgcctcttgcagtgttgttcactgttgtgcttgcttgtttgttgctacccaataatctgtgaatggaaggatgtatgtggctgtgaattattcctagtccttgcatacagtgctaccacatgccatgatttatgtgctttggttgttgtgtaattccatgaccaataatctgtatgaaggatatgncgttgcgcttataattatgtcattgagctgagtggccttgtat

SEQ ID NO: 10404 - DNA, 723 bp, Sorghum bicolor
  Clone ID: SORBI-28MAY03-CLUS10244_1
gatcggcacgaggccgcaatcctcagttgaagcgcctgcgctgacgccttccacttccactgcggcgggagccttctcctccgcttagccttagcgcccagccaaaggacaagtctgcgggcgagcgcgatagatagaccgagcgaaaccgatccgagacaccatcaaaacgagcggaaaaatcagtccagacgcgcgttagagtcgccaaagcttatcgctccactccactcccctccccgccgcaacccgcagcctttggttccggttatataacgcggctgcgtgctctgcttcctccggtttgctctgcatcctcctgtgctcgtccacaagattaacaagcaagccacgcgaaatataaacacacgcgctctagaacctgtagctagctgcaccaacgtagacgctagcgccgtcactcgtagtcgtgccgcttttttgtggtaatctgcagcacttgctgagacaggtagctttgcttgctataggctagtgtcacttgcccaggacaagcaggggagacatggcactgacagtgttcgagaccaccgagcagcagctcctcccgtgccagcaggccgtcgagcagggcgctggagatggtggcaacggcaaggccgtagctgctggcgccgagaaggctgctgccgtcatgctcaaggagacggaccacggcggcgacggcgaccggccggagagggacgacatatggaacatgat

SEQ ID NO: 10405 - DNA, 1094 bp, Sorghum bicolor
  unsure (1)..(1094): unsure at all n locations
  Clone ID: SORBI-28MAY03-CLUS10270_1
cggccttttctcctgtcctgggccattagaaatccaagtttgttaaaagggctcagcccaaccagagcgcccgcggcccagttgcaggcttccagctcgcagctcatcccgttcccctctggccgctctcggactctcccctcctgtcctcttctcgctgcgtttggtttgcagcagaatcgcagcgaccgcgtcgtccccacgcggcgctgccgctgccgctgcccaggcagggagagagatcggaggggaggagatggaaacgatgaagagccttctgaagccgaagccgacgccgcagcagcagctgcgcgagtggcagcgccgcctccgcaacgagggccgcaacatcgaccggcagatccgagatgtgcagagggaggagaagaaggtggagaaggccatcagggaggccgccaagcgcaacgacatgggatccgccaaggcgctggccaaggaggtggtgcagtcgaggaaggccgtcaaccgcctctacgagaacaaggcccagctcaactccatctccatgcaccttggcgaaatcgttgctactgctaggacagtaggccacttgtccaagagcaccgaagtgatgaaacttgtcaacaatctcatgaaagccccggacgttgcagccacaatgcaggaattcagcaaagagatgacaaaggctggtgtaatggaagaaatggtcaacgatgctttagattcgacgctggacaatgaggacatcgaggaggaaattgaagaggaggttgacaaggtcctcaccgcaatcgctggggagactgcctctgagctcccggatgctgttaggaaggaaaaggagaagatgaggcagccttcaacaagtgtacctgcggagagaactgctatagcagaggctgtcgatgatgatgatgagctagaccagataagggaaaggcttgccaaagtgaggtcatagaagatagctgaacaaggtcacctcattgaggtgttatggcgcatgacatttcacttgataatgtatacacgtatcacacacaatcacagatggcacctttactgtgattaacaaactgatttagcaacgtgatgttgtttcccaggnc

SEQ ID NO: 10406 - DNA, 583 bp, Sorghum bicolor
  Clone ID: SORBI-28MAY03-CLUS103488_1
accttgaccactgccaggctgagctcagcaccctcagcaaggtccaggctgagtacctcggcctcaccgtcgaaggtcccttcaaggccgatatctaccgctactaagcgtgtgtaatcaatacccaggatccttcaactggattcctacgtgtaacgaacttttccctcttctgtcgacatgacaatcggcaaaattctagtttcaacagcatgaacttgcgtggcatatgggttgggagagttacaaggacatctgcggttttctgattttttttctcttctcttctttgtttcggcttatttgggttacttctctaaatcatcaaagagaagactcctcgcagggtgcagggaggggcaaaaagatcttgctttttcaacaaaatggcgttggcttttttgctaatcatgattccccccttcgagattataaaaatggatgatgaatggaatgatatggacggatatgaccaagacgagacctcccccatagggatggatgagatggtaactcgatacaggcaggcccgtcaaccgtggccaggatagagtagaacttcaaaaagagatattctgactct

SEQ ID NO: 10407 - DNA, 1072 bp, Sorghum bicolor
  Clone ID: SORBI-28MAY03-CLUS11171_1
acaaacccccacacatggtacaaaagactccggagttcacaagggaacaagaacacactatactgtcagcgtcaggtaacttgatacattataaatatagctgctgccgacgcactgttgttgtaaattcagcatggcaatatacaggaccaaaagcaaaaataaacccacacaacaaagcttatcactttacgcaataaatttatcgtccacacgagggcgcaaaattagcatgacaaaagcatgttaacagcagctgcttgccgccgcgtcagcttccggaggcttctgcttgaagatgttcttcttggcccccgaggaagcatccccgaggaggcttggcgtgtctaatatctttagaacgagttcctcaaagcactgttctacatttacttttgtttttgcactgcattctagaaataaacatccgtattccctggcaaattcaatcccctctttttttgtgacacatctctcactttccttgtctactttatttccaacaagcatctttatacagtcctggttggttgaatacaggtcaatttccttcgcccatatatcagaaagattggtaaatgtttcccgtcgagtgacatcatacaccataatgatcccctgtgcccctctgtagtaagagctggtcaaggtcctaaatctctcttgtccagctgtgtcccagatggcaagcttgagttttttgccaccaatgctaaccatcttcaccttgaagtcaacacctattgtgggggagagatcctcgaaggagtcggcggtgaaacggaggaggaggctgctcttgccgacgccggagtcgccgatcaggaggagcttgaaaaggtagtcgaactcgggctgctggctcaggctggacgaggaggaggaggaatccatgagagggatgggatcagagggacggggaggctagacgagatctagggtttgatttgatccgctttgggttgcgggcaacgcaagacaaggtgaagccgaagggaacagagagaaggtgcgggcaacgacgagctctaggcgtgcgaactgtgaatctgaagcccccaacccggccggc

SEQ ID NO: 10408 - DNA, 1282 bp, Sorghum bicolor
  Clone ID: SORBI-28MAY03-CLUS1122_1
gaaacctagctaatgagatggaggatctctcggatcttggaggtcgcggccaccttggtgctgccaccagcaggcggcccgcgccgccatcattgccgtcgtcctcttcttctaaggtctcggtgcaagtctacaccgtcccaagcagctcagctgccggcggtggcggtgaagcagccgcccgagctcaaggcggtgttgcaccactgatccatgcgtcgtctagcgtcggtggccatggcggccgcgttgctgatcttctagatcccatcaaggccaagatcgtctcccaccctcgctaccaccgcctgctcgccgccttcttggactgccacaaggtcggctgcccgccggaagcggccgaggagatcgcggcggcggcgagggagcgcgaggcgtggcagcgcgcagccgtgggcgacgcgcacaatacaaggccggacccggagctcgaccagttcatggagtcctacagcgagctgctcgtggcgtggaaggaggagctgacccggccgcttcgggaggccaaggagttcctgacgacggtggagttgcagcttaacttcattaccaacaccgggccacccatgggagctctcatctcttcagctgcagaagataacactggactcgacatgtccgacgatgaccaagaagaaggcagcggcggcatggaggcagaagcagccctggggatcgacccttgctccgatgacaaggagctcaagaagcagctcctcaggaaatacagcgggtgtttgggcaacctgagaaaggagctgtgcaagaagaggaagaaaggcaagctccccaaggaggcccgtcagaagctgctcagctggtgggagctgcactatcgatggccctacccctcggagatggagaagatcgcactggcggagtcgacggggctggagcagaagcagatcaacaactggttcatcaaccagcggaagaggcactggaagccgtcggaggagatgcagttcgccgtcatggatgggttccacccaggggcgccgccgaacgccgccgcgttctacgtcgacgcacgcctcgtgggagcaacgccggcgatgttctatgcccggccggagcatggggctcatcatggcctctggcacaataattgattattaagccatgctaccatgcagtagtattgcagtgtgcgcctgcaacctgcatgccgcatcttagcctaaatatgaaggatatgcgactgaactgaagatcaaggaagacacacacttgctactgcaatgcattaaatactgtaccg

SEQ ID NO: 10409 - DNA, 1212 bp, Sorghum bicolor
  Clone ID: SORBI-28MAY03-CLUS1126_1
agtagcaggagcccattacccccacggtcccctctccgccacggagcagcagcccgcaaccaagcagcgtggtaaggtaagtgacgagacaagatggtgcaccagggcgaggagctgccgcaggcatggtggttcgacagccacaacctcgcgaggccatctccatggctgaacagcacgctttcagagctggatgacaagacgaagcaaatgctgaagctgatcgaccaagacgcggactcctttgcccagcgcgctgagatgtactacaagaagcggccggtgctggtggacatgctgggcgacctgtaccgcacgcaccgctccctggcggagcagtacgacctgctgaagcacagcagcggcacgcggcacacggtgttcggcctgtcctcctgcacgcagagccggtcccaggcgtcgtcgacgaatggcaagtccacgcctcgctcttcctgctcggcctccatgtacgattcggagtctgaagtggatgaccccgagcaagaagacgaggaagagcaggcagcagagccgacgcgtgcggggaccatcaagacagaaccgtcgtcgcaacagcaagagcgtgagcaggcggagcagcagatgcgtgcggagatcgagagtctcaaggcgcagaacgcggcgctgcagaaggcggccgaggagaacgcggcggcgctcagggcggagctggccgggaaggacgaggagaagagggaggtgatcaggcagctggcgtcgtccatggacgtgatgaggcaggagaacctgacgctgcgcgagcacatcgccagggggtcatcgtccaagcattcctcatctgcgccccgcgcggcggcgttcgatctcaggaaggtggccaggagcctcttctccccgaggctcttcaccgcacactgcaggcatacgggccccatcgtcgcgctctgagcctcagattgtgtcacctgatgacaaggcgctgcaggatggaatcgtgaagtgagacagcataacagcatgtagttgatcatgatatatgcatttgtagtaggtgagtaatgtgcatataggatagcatcggtgaccctccccagtctgatttctcaggtttatagcagctaaattggagggagcactcgttttgactggtggtgctttgcacctgtatttaccgctaccgccgtagtagttaattgtagttaaatatttattagccaatatggatgc

SEQ ID NO: 10410 - DNA, 1029 bp, Sorghum bicolor
  Clone ID: SORBI-28MAY03-CLUS112761_1
gcacgagggaggaatccatcgagtcgagtcgacctcgaccaccgggcagggcggcggggctcgccgtggccacagctcaggaatccaatccccccaccactcctcaccggcgcccgcgcttataaatagattcccccgtcactatcgcggtcgtcgcggcttggatcggattcaactcacctaccccaccccctcgattccttccccagctctgcctacttcctacgccaccaccgcccgcccactccggctcctcaagcagagcaagcaagctgccatggcggccgccgcgctgagggagcagctcaacgccctcctctcctccatgttctcctcgggtctggtggacgaccagttccagcagctgcagatgctgcaggaagacgggggcacgccgggcttcgtcgccgaggtcgtcaccctcttctgcgacgacgccgacaggatcatctccgagctcgccgccctgctggagcagcccatcgtggactttgataaggtggacgcctacgtgcatcagctcaaagggagcagcgccagtgttggtgctcagaaagtgaagtttacttgcatgcagttccgtcagttatgtcaggataagaacagagacgggtgcatcatggcattggctgttgtgagaaacgagttctatgatctgcgcaataaatttcagactatgcttcagcttgagcagcaaatccaggctcaacaataaattgaagcagaaagagcgtagctgcatgtgatctcacatgataagtgtatctttgaagatgtagtccatgttcgctgtgttcccgtgcacaatcgtgtgaaattgtcgtcattgaggttggctcacaagcctgtaactgttagctataacaatgactgtttaacgttgcccctgttactccacccgtttgtgttggattgccatcgaccatcgtatgaaaacttttatcggtttcctgctggtaagtggcaactggtaaccctgcgaacaaatttttgggttttggaagcatatgatgaagtatgattaatttg

SEQ ID NO: 10411 - DNA, 926 bp, Sorghum bicolor
  Clone ID: SORBI-28MAY03-CLUS106170_1
gcacgaggcccaaaactaccaaccaacccaaagctttcttggctgcctgccgcggcgggggcgcaacccgggccgccaagatagggtcggacagccccgccgccgacggcgtcggcgacgccgcgcgcaagcggcccagcggcggcgatggccccaccccggcgcccgccgacaagcgccgccgcccggagcacccctcctcctcttccgcgggctcccgcgaccgccaccaggcccaccaccaccaaccccacggccgccgtccgccgtcgtcctcggccgaggagaaggtgcgcgcctcccacatcctgatcaagcacgagggctcccgccgcaaggcctcgtggcgggatcccgaaggcgtcgccatctcagccacgacccgcgacgacgcggccgacctcgtgcgcgcgctccgcgaccagatcgtctccggggaccgcaagttcgaggacatcgccgccgagaactccgactgcagctcggccaagcgcggcggtgacctcggttcatttgggaggggtaagatgcagaaggcttttgagaaggctgcgtttgctctgaaggtgggggagataagtgacgtagttgatacagaaagcggggtgcacatcatcaagaggactggctgattgcatctgcgacattatccatatacggtgcaaacgggggatgccttcgagaggctttatggtttcttgcttcattggtgaacttgtgcgtgtttgtttttttctcgtatgcgcttgagaaaatgagatgtttgtaaactttgctggagacctccgtgctctcggctacgatgggttcagattgttttgagtatgacacgattatatgtagattttttctgtcatcttgtgtcattcttgcctccgagaatttgactctttcccccgagattagaatgccttgaattcagggtc

SEQ ID NO: 10412 - DNA, 616 bp, Sorghum bicolor
  Clone ID: SORBI-28MAY03-CLUS1056_1
atcaagcgaagaaaaaataataaaaagctcgggggtgattcgaggagagagagaggcatccggaattcgtcgccagccacatccgccgccggcgatgtctccgtccgccgacgccgccgggccggcttcctttgcctcggcgcccccgctcgcacccctcatcgccgcgcagctcaactacctcctctcgcactccaagcttcccatcagggtggggcagatctggtccggctgccgcaacggcagccccgccgatcggttcacgctcgccatccctttctgcctcgactacgtccactgggatttcgtgtacaatgcgctgtctcccaaggtggcgccagacgtggtgttcgggccggaggacgagaggttccagccgctggtcgattacgctgtggctggaaatggcgataagagctgcttggcgcgttgggattgccgcgcccccgagggactccttgccctcgtacaggagctccgagaattgtacattgaataccaaaagaagcgggttcacatggtggatgatgcaagagtggcgtttgaactaagcactgttctctctaaggagggaatcgaagtctgcatggtaccttctgctgataggccagatgag

SEQ ID NO: 10413 - DNA, 1500 bp, Sorghum bicolor
  unsure (1)..(1500): unsure at all n locations
  Clone ID: SORBI-28MAY03-CLUS10431_1
gcacgggggcggctcgtggcccgcggccccctccgcccgccgccgccccccgcgcggccgtcctcccccatgccctgcgccagccgcaccccgcgccccatctccccgttcggagcccccgtgccgcggtgcctcctccgccgccccccggggcgctcctgctctccggcgcgcccctcggggtccccggtcgcggcatcccgcgccccgatgagccgccggaggcggtccgggtcgtccggccccgcgccccccctatgcaggctcccgcccagccgccctcgcctccgggcgtgctgcctgcgaagcgccaagtggttgcgccgcgaagccttgcaaccgccctgccagctcccggcccgccggcaccacaccggcgtacatggcggagggcgtggtggcggcagatatccaataggatgcatacctcggggcttgtcagttgtcacacaatcaacatgatcgaatttgagccagagtaccatgtgaattttggtaatcctgatattgatgagaaaccaccaaatgtcattggaggagatgcttcagaatgtgaagcccttcatagttgcttccagaaccaggaaggatttgtgatacatttaatggctagagcaccccggatgctggtgcgcttagttatgtaccgtgaacctgatgttgtgactgcaaaacaacaagaagaggagctacaaagagtgtattgctctgggaatggaagcaagataccagaatcataaggtgaaactccaacacataccaatatggcagtaccaaattcttcgtacggtttgtctactgtacaatgtgtacatgtataacagctcgtataggccttctctaaatgctgtgtgtgtactttacacggctcttgatccacaggactacaaaagagccaaaatgcctacctgtctaaactcactagagctcaactctgtgctctgtgcaaaccgtcctcttttttctacgctatacaaanagcgaagcanaatatcgtcgaaatcacagcagattatctgttgaaatcatgtgtgcagcttggtgccctgcagcaactccttgccggaggaaacctaaggtttactgtgcagattctccatgcaaacgtcacagggaagtcaggccagccctttcagtgcctcagagcttccgagtcgtgctgccgcagaggctggttctcgttgttctggctgtccagcggcatgtactgggacatgatggacatgatctccgagtccatgtacgacctgagcctgtacttgtagaagacgtagccggcaaccccgatgcctacgacgcacgccacggccgcgatggtgatgaaccagcccagcttcgacatgctgttagctatgcagacgtcctcgccgcggatgtagagctggttgcccttgcacttgcactcgtagttgccccacgtgttcttgcactggcagcccgggcatgtgcacgccagcttctccctgcactcgtccaggtcttcacatttgtgcctcgtgc

SEQ ID NO: 10414 - DNA, 399 bp, Sorghum bicolor
  Clone ID: LIB3478-014-P1-K1-C5
gactagttctagatcgcgagtgccgccctttttttttcttcctacttattgccactcccctttttcttccttttacaatagggttgctgatgtcataatattatgattgtttttaaaatttctgttcattgcagaacaatcctggctggggttttgacaagaaatgccaattcatggacaagtttactcgcatagtttcagagcaatacaagtagaaaggcctcttatactctgttgcagtaaccaccttatttatcctcaaaggagatttgaagggtgctctttgttttgagagaagatgtgatgcccatatctaatccatgcaatgattttttttcttgttcactgggatgctagtttgataaataaaattgctgataaacatggtttttttgcgtg

SEQ ID NO: 10415 - DNA, 657 bp, Sorghum bicolor
  Clone ID: SORBI-28MAY03-CLUS10696_1
ctactgggcaaccagaggcggcactgccatcatcagccccccatcactgctgctcacagtcgtcacccaccccaccccagccataccagaagggagcaagaagacgacgagatgatggcggacgagcgcttgcctcaaatggccggcgcccgcatggttctcgctagagcggctggatcctccgcacggaaacgcgcccgcggttgattaggtccgctgtgggcccccctggctcgccgcgtccgcgcgaggcgtcgtcgtctgctgcggcggcggcttgtggttatagtggactgtggagtactgagaggacagcaggcaggcgtcacctgcgtgaatggtcatcatggctgggatgctccccggcgtggagtgcgcgcggcggcggcggctccggcagggtgcggaggcggccggaggaggcacgaggcggtcctccttctgcctgtacgcggccggccacggcggtgctggtggccttggcggcggcggcaattctggcaagcagcagcggagcggcgtgatggagatgatccacgggtggacgctggacagcaatgcccgggaggccaaggagcggctggaccagaagctgcggagcaagagggaggccgccatcaagaggcatcacagcacggggagcataaagctgagcag

SEQ ID NO: 10416 - DNA, 843 bp, Sorghum bicolor
  Clone ID: SORBI-28MAY03-CLUS1074_1
ccccggtaagtgagctttggaggattttgctattgctcacatcatgggatgagcctatgaagtccatggtgttttgctttctattctcttacattatcatcagggggtgggtagtctattttattgtcacggtgctattgttttcagcaacgtttatgtttctcacaagattaactactcaaggaaagcaaatgagtgaggtaaaggtggtatccccacctccattgaacacaatggagcagctcctagctgttcagaatgccatttctaaaattgaggagctcgtccaggatgcaaatattgttcttctgaagataagagctctattgttggcttttccatcccaggcgacggacaaagctattctggcactggtactgatggctctgtgccttgccatcgttcccacaagagtgcttctgctgctggtgtttgtggaggtatccacgaaccactcaccactacgaaaagcaaccacagaaaggtgtaccagaaggttgagagagtggtggttcagcatacctgcagctccagtggtggtggagaaggagaaagaagacaagaagacaagatgagatctgtgtatatatatccaatgtaatcttgtgtctcctgcttggctgatgcattgtgtgatgtatcagccactgcccacctctgtacaaagactgctatatcaacagcgagggcaaattcaatggagatttgctctcacttatctcagttgccctgtttgcatgaatcataggctagtctcaatggtgagtttttttctcacttcggccccccaatgttttgttggaaaatggaaattgactagagccgatgccaatgtgagtcgcc

SEQ ID NO: 10417 - DNA, 1203 bp, Sorghum bicolor
  Clone ID: SORBI-28MAY03-CLUS10769_1
gcacaaaggaggctggcaaaaaggaataaagattagatgactccaaaagctggagttggtaacgaaggttcataaaccaacattcaggaggtctacaaatcaacattcaggccatcaagcatcaaccttgacggcggtactgcgctgcacattgccgcctgtgagggccactgtgacattgtccgagttgctgctctactggatggttgatatcgctgccaataaaacctggggaagcatgatgcagttttagcatatataaaattagaaaactgatgaagacagtcaaaagtttggtagtattataggactgggccagctcatccacctggtgcttactaggaagagtctttccgctatgttcaaacttcaacccttgcagatgggttgaaatgcaacgcagtgttaacgcttacttgtgttatttcattggggaagtttggctgaaaaaaccaacctaactggagaattaaatgctgtatgatgttgtggattatatcttctctagtttagtttagttagttttctttctacatggctcatatattttatctttgctttcatgggacaacactcttatctgtcccgggcatctcgatcgatgctggctgcaagggtagctcacccatgcatggattgatagaggattttaaacccacaattcacaccctcagctatcgtgtgttatttcattggagttcttgtgctgtaaaaacctatctattcctttatgtgcttgctgcttaatgttgttgtttagatcttgggaggtatcggcagtacactgaggaggcagaatggatcatatatatgacagatgttggtcagcaacatcactttgacatgtttttcagtgtaagtgctgagggcaccaagatcttttcctttactgtgtttttgttgaatcttttcttgcctttctacaggctgcaaggatggccagttggctcccaaatccaactgaaaggatagatcaaagcctctttaacctgttgtagtttaccttctctatttcagtttagttagttttctttctactttcctgacttcttttttcttttctttcatgtgtttaccaacttatgttcagagggcatctctgtcgtagcaagctgcaagggtagctcacctatgcatggattgatagtggattttaacaaccatgaaaacattgtctacttatgagtacaatactaatggatg

SEQ ID NO: 10418 - DNA, 671 bp, Sorghum bicolor
  Clone ID: SORBI-28MAY03-CLUS11467_1
gttgcaagaatggtagaacttcatggtgcacatctagtgagccatgaaagaccagatgaggtgaacaatgcacttatggatttgataaaggccaccaaatctgcgatgaaacctgaagagtggtcagcccagcctgagaacatatcggaaaccggggcactcatttctgcgagacccattaccgtcacgatgcaaacagatgaaggtgcaaatgctgccgtagcaatctataacttgcttggcaagctgcaactaagctttctttatctcataggggtgatagtcatggggtttgagcacatgaggaacattgtaaaggtaatgaagccagtaagggttgcagcagttgagtcataagatccgaaggcatgtaaactattctcgagaccttgtgggagtcgagatgatactttcacttctccccggtacctcggagatgatgattttagagtaccatctccaacagatataaactgttctgacgaaaggcctgctcctgatagcagaataatacgagacagaaacattgagaaaaacagtgcgcgcctggacagaagtgtctaagggcacggttggtgttgctgcccgggcccggtccaccacccgcctcttgctgcccgggtgctctccaccatgctcctgtatcataccgagatttcaaatcgattctt

SEQ ID NO: 10419 - DNA, 737 bp, Sorghum bicolor
  Clone ID: SORBI-28MAY03-CLUS114935_1
gcacgagggaagaggcggctgcagcgagtgcgcgacaagccgtcaagacgacgaaggcggcaaggccagcggccaggcacgagggcatgcttaagttcctgtccaaggtggtggtggagtactgccctctggacccgcggaaggcggcggcagtggagctcctcgcgcagtgcaacggccgcaaggccaaggactccaacccggcctgctccgtcgagctccgccgcctcccctccccgcctctgtccacggaccccaagtcgcagccgactctcccgcctccgcgggtcctcgtgacctacctcaacggagccgaggaggccatcatggccgctgagggcgctacggcgcagggcatccgtgaccagatcctcgcacggggccggctcatcgacacggagcagatgttccgcgacggcggggagaagtggcccgtcgtcatccccgaggaggagctcggcatgtcgttccctggcatcaagccaaagaaagccgaggacaagccccaggcctagtgaccaagtcagagttttctatttgatgcatggttaactatggacatttgtacacccacgaatgtgggataaaaaattctctgaccactgccacttagaatgtgcgttacctgttgcttgaagaccaggtctggttcaatttttgttttcccacattgaggtatgctttcagttggtgctctgtactcgtatatcattttggctcctgtgcgcatcataagc

SEQ ID NO: 10420 - DNA, 870 bp, Sorghum bicolor
  Clone ID: SORBI-28MAY03-CLUS115151_1
gcacgaggagcaattaaagctagcacagccagcaccaccgactcgatcgaccacttgaccatcgcataatatatctcagcaaagacacaccgatcgtcgaggatggttgtcgccgcgccgccgtcgtcttgcagcatcagcatcagcatcggcagccgcagcgagctggggtcgttgttcgcggcgttcgacgcggacgcggacgggcggatctcggcgtccgagctacgcgagtgcatgcgggcgacgctgggggccgaggcggcggtgtcggcggaggaagccgaggcgctggtggcggaggcggacgcggacggcgacgggctgctggacgccgccgagttcgcggggctcgtggcgcgcctgcagcaggacgccggcgaggaggaccggcaccggggcctgcgccaggcgttcggcatgtactccgagaccgagaataatgtggaggccgggtgtatcacacccgctagcctccggcggatgctcgctaggctcggcgagcaccaggacgtcgacgagtgccgcgccatgatctgcaggtttgacctcgatggtgacggcgtgctcagcttcgacgagttcaagatcatgatgaacgccgcgtgatggtgcttgatgatgatcgcagggtgttcataacatatggggttgcttcatcgatcattcattcattatttatttggttaattcgttgtttgcgtatgaaattctgtaagttattagtgttgcagctagctaggattgttgttagctatgtgatgtgcatacttgttattcgttcgtatatatgttcagcgtgcactgccgttccttgtcgtactatttgtaccggttagcagtgtttttctctcataataaatcggcagc

SEQ ID NO: 10421 - DNA, 1372 bp, Sorghum bicolor
  Clone ID: SORBI-28MAY03-CLUS11534_1
gcacgaggcctcctcctccgccgccgccgccgccatgatgccgcggcggcagcccggcgtggccccgcctccaccccaggccgctcccggcgcgccgccgcactggggaggcatcccgccgcccatggcgcctcagcatcagtacgggccaccacccccgacccagcaggccccacccccgccgcagatgtggggccaggcgcctccgcccccgacccaggccgcgtacggccaggcgcccccgccgccccaggctgcgtacggccaggcgcccccgccgccccaggccgcgtacggccagccgcctccccagccacaggccgcctactacggggcgccaccagcgccggcgcccgcggcgatggccgcggcgcctactgggcccagcgaggtcaggacgctccgcgtcggggatctgcagtactggatggatgagaattacgtctacgggtgcttcgcatccacgggggaggtgcaaaatgtgaagctaattcgtgacaagcatactggacaacttcagggctatggttttattgaattcataagccgtgctgctgctgaaagagttcttcagacttacaatgggacaatgatgccaaatgttgagttgccattccggttaaattgggccagtgctggtgaaaaacgtgatgacacccctgactatacaatatttgttggtgacttggctgctgatgttacagactacgtattacaagagacatttagggcacattacccttctgtgaaaggtgcaaaagttgtaacagacaagctgacaatgcgctcaaagggttatggctttgtgaaatttggtgatcctaatgagcaagctcgtgcaatgactgagatgaatgggatgctatgttcttctaggcctatgcgtattggacccgctgctaacaagaaagctactggtgttcaagagaaagtataccgtgcggctcttgatcagtctgtcaatgatcgttgcgtgtcttgtgttttgcatgacctctgttaggtcagtgttaattgtttatgtcctataatatgatcttggtcctttcagtacctactttatttcgtagttttccccttcctgccacagttcaattatttccttctgcatcgttatgaatctattacccaaggtcaagaacctttgcctcttatttccttcctgccacagtccatttatttcttctgttctattaaagctattgctcgaggtgaagaacctttacctttaccattcaaaagccactagtggaatgtgtgtatgtactgtctataaccttccttactagtaattgagagcctgttcttgttttagtataagttctcgttttccattttttatccttccactttctacatttaccattttgta

SEQ ID NO: 10422 - DNA, 661 bp, Sorghum bicolor
  Clone ID: SORBI-28MAY03-CLUS115674_1
ggcgaggtcacgctcgagcagctcagtgcgtacgacggcaaggaccccgccaagcagatcctcatcgccatccgcggccaggtctacgacgtctcccgcgggaggctcttttatggccctcagggaccatattccttgtttgctgggagggatgcaacccgggccctggcattgatgtcatttgacccaaatgacctcaccggggatttggacggcctaagccccgatgagctggaggtgttgcaagattgggaggaaaaattcaaggagaggtatccgagggtggggcaccttgcctgtcaagacgcagcaagcagcggtcagaacactgctgggcttcatcacgaggaaggggacgcctaactctactggtttgtctcgtcctctgttttttttacttgctgctggatatcaccctgtagatctgatgcgctcacttgtgggtgacgccgctgtcgtcatcgtttgctgtatatgtatgtgcgattatatatactgactaatgtactctgctatgtcccatttcttttgggtctgtagcggctaaggaaattttgagtgtcaaaaaaactggagacttgaggcgacagcccatgttcggctctttgttgtacatgcgtgatttgcgtcatgattcctggctttgttgttcattacttat

SEQ ID NO: 10423 - DNA, 963 bp, Sorghum bicolor
  Clone ID: SORBI-28MAY03-CLUS11043_1
ccgactgcaggtagtagtaagcatctctctctctcttcttcgtctcgatcagtgtagagcaagaggtgtggcgggggaagtaataatgaagacctcctccttagtcgtcgttgctctagcagcggtagtgctgttcgcagcgcatgatgcctccctcgcgggcgcctcctccagctccagccccagggtcatcatcgtcggcgccggcatgtccgggatctcggcggggaagcagctgtgggagtcgggggtgcgggatctgctgatcctggaggcgacggagcgcgtgggcgggcggatgcacaatcacaacttcggcggcatcaacgtggagatcggggccaactgggtggagggcctcggcggcgacaacctcaaccccatctggcccatcgtcaacgacacgctcaagctcaggaccttctactccgacttcgacagcgtcgtcggctgcgtctacaaggagaacggcggtggcctgtacgacgaggagtacgtgcagaagaaaatggaccgtgcctacgaggtgcaagaactgggtgccaaccttaccaaaaagatgcgccccaatggccaggacgacatctccctcttagccatgcaacggctgttcaaccaccagccgaacgggccggcaacgccggtggacatggcgttggactactttatctacgactacgagttcgcggagccgccgcgcgtgacgagcctgcagaacacgcagccgacgcccaccaacgccgacttcggcgaggacaactacttcgtcgcggaccagcgtgggttcgagtccatcatccacgccatcggcagctcctacctctccaccgacgccaacggcaagctctcagaccgcaggatcctgctcaacaaggtggtgcggcagatcgcgtacaacaaagaaggtgtggtcgtgaagacggaggacgggtcgtcgtacagcgcagactacgtggtggtctc

SEQ ID NO: 10424 - DNA, 584 bp, Sorghum bicolor
  Clone ID: SORBI-28MAY03-CLUS111122_1
gcacgagggttgttatgcgacagcctgctgagggtatcatccacggttccttctccgctgaccaggctgccgatgcccctcagcttcttgctgcctgctctcctaccaaggttgccgatgccgtcaccagcggcctccaggttgagattgtcaagctcgacggctccaagattgacatcagcaccgtccccagcttgaagctcagcctcgacgatgttgcctacactcctcctgcctctgaggatgacctccccgtctacggtactcctcgcacccagcccgccaaggctgttgccctcaccaacgctaaggccctcaaggctgtcgccgcttgtgccaacaagcttccttctttcaaccctcctgtctaaatacccggccatcatcggcgtttcattttatcatacctgccgtcggcgggctggcatgctcgaccgcggctcatcataagggaccactagcaaaccgcacaaattcttttaagtaattttaatccctggcagactcggggagtcatgattgtatttttttcgccagactaggtctatagttgccatatagcgggcccctgtgttcttgtacat

SEQ ID NO: 10425 - DNA, 862 bp, Sorghum bicolor
  Clone ID: SORBI-28MAY03-CLUS11117_1
ccgctgcagctctgccagccttcttgacttgatgtcttgtcatctaaggttgtctcaagtgaagttggcaaaccatgcctgccgtctcggccgccgcctgctgcgccgccgcggcgccggctaacgaggtcgccgaggacctcttcggcttcctgcgcgtgctcagcgacggcaccgtgctccggtcgccggcaggcccggtgttctgcccgaccaccttccccggcagccacccgtcggtgcagtggaaggaggccgtctacgacaaggccaagaacctccgcgtgcgcatgtacaagccgacgaccaccgcgttcgccgccgtcgggaagaagcttcccgtgctcgtccacttccacggtggtggcttctgcctggggtcgtgcacgtgggcgaacgttcacgagttctgccccccccccgccgcgggcgccgccgccgccgcccgcgccgccgcggtccgcgcgccccccgcccgccgccgccccgccccctgcgccgcccgccccccctccccgcccgccccccggcgccgctccgggggcgccgccgccgcctcgcgcccggcggccgccgccgccgcctgtacaagccgcggcccccgcgccggcggcggcggcggcgaggccggcaagaagctgccggtgctcgtccacttccacggcggcggcttctgccttggttcgtgcacctgggcgaatgtgcacgcgtactgcctccgcctttccgcggaggccggcgccgtcgtgctctccgcggggtaccgcctcgcgcccgagcaccgcctccccacggcggtcgacgacggcgtgggtttcctgcggtggctccgtgcgcagtccaccatggacgccgccgccgc

SEQ ID NO: 10426 - DNA, 678 bp, Sorghum bicolor
  Clone ID: SORBI-28MAY03-CLUS111228_1
gcacgagggcgcccgcacgccgctgctcctgccgcccatccgtgttcctcccttcgtcgtgtgctctccacgccacgatggccatgagccatccctccctcccttccttttctccctcacctctgcaacctccatgtcctctatgtcgccggagtgggaacgatggcgttggcttccgacgagccacacacctccctctgccctctcttcctcgctgcgacctccatgcatccggagagaagagcaacaacggcgacctctcttcctcgctgcgacctccatgcatccggagagaagagcaacaacggcgactttcggcaaggtaggtggggtcctcatctggatctcaactttttcctctttttcctccctctagactaagcactcctctaccttctcctcgtcctcgtcgtccacctccttctactcctcatctggatctggatctaagggatacgacagtggctagggttttgatgagctcttgggtacagatctcgtcgtgttgcaatggttctctcttgatgttgcagtaggttttaatcgatgttgtagtactgcttttttagatgttttgcagtatgttttcagttgctttaatctgcatgttgcagtagttgttgcatgtgtgtttcaacagttattcggtgttattgtaataattcttcttggtgtttc

SEQ ID NO: 10427 - DNA, 836 bp, Sorghum bicolor
  unsure (1)..(836): unsure at all n locations
  Clone ID: SORBI-28MAY03-CLUS11129_1
cagaatagttcactcaccagctgtcttaagaacttcagctcaacagagactttgaatgctgaggacaagttcttctgtgacaaatgctgcagtttacaggaagcacaaaaaaggatgaagataaaaaaaccaccaaacatcctagtaattcatctcaaacggttcaagtatattgagcagcttcagcgctacaaaaaaactatcataccgagtggttttcccactggagcttaaacttcttaacacagttgataattcggacttggaatactcccttttcgctgtggtagttcatgttggaagtgggccaaatcatggccactatatcagtttggttaagagccacaatcattggttattctttgatgacgagaacgttgagatgactgatgagtccatggtacaggcattctttggctcaccgcaagagttcagtggtaacactgataatggctacatactcttctacgaaagccttgctgaaagaagttgatgtccttctcataccaagtgattagctatacacttttcttttccttccatttctgctggggatatatagaatattcagtgaaaactagaataagctgaatgagaggccttcagcttcagatgttgtagtacaatcaatacctggcaataaaacaagttaccttgaggggctataggctatagctgaagacgccgactagtttgtagttccaactttatctgtttttatgcacatacaggttgtatcaattccggaataatgtttgttgaagacctttattatcatgtaatattttatctaggaagccttttttggtttcgagttaaangattttgtttcttag

SEQ ID NO: 10428 - DNA, 758 bp, Sorghum bicolor
  Clone ID: SORBI-28MAY03-CLUS11157_1
gccggccatttccgatgccacataaccgacacaaccatgcggcgcgcggtggcgaagctacgttgtccccgcgagccgcgcggctgcagcaaccttcgtcgccgccgacgacgaccgtcggaacccttctccgttcccctgcggctggcccttcccctcgtcctctgcactgcagtggctgaagaggcaggagtgagggcttgatcagagatgaatgccccagatcgctatgagcgctttgtcgtgcctgagggcaccaagaaggtgtcatatgagagggacacaaagatcgtgaatgcagcatctttcactatcgagcgcgaggaccacaccatcggcaacattgtccgcatgcagctgcacagagacccaaatgtgctctttgctggctataagctccctcatccacttcagtacaagatcatcgtcaggatccatactaccagccagtcctccccaacacaggcctactcccaggcagtcaatgatctagacaaggagcttgagtacctcaagcaagcttttgaggacgagaagaacaggtttgagatggcgagactttaggtgcaaagaagactcgaaggttatgtatgtagatgatgatgatgacctcagactgttgttccccgaactagtaccagcacctttgaccttggttggtgtaatccttgaacatgtgccaagactccaaacactcatgctgtgttagctatgtcgttgtggcactcaaaaaaaaaaaaaaaagtttcattgctgtg

SEQ ID NO: 10429 - DNA, 723 bp, Sorghum bicolor
  Clone ID: SORBI-28MAY03-CLUS1116_1
caccgtggtgctttgactgcgcgtcccgcaggcggaaggtcatggaagcaacactctggtggtgatggggggtcaagaggacatagagtccctgcaggtccacgtggagtctgctggacataccttgaaaaagggaactgccggaaagttgactgcagattcgaacatccaacaaacacagagggatatccatccaggcctgatcggcactacggtaggcagcattcgggcaacgagaggcgatatgagaatcacaatgagagaaatgatcgacagtttgataggcagccttcggataatgaaaggcaccatgataggcctgatgacatgcatggtggcagggatgacgataggcatgatgacaggcaggctgataggtctcagtcaggagagccgcgttagaactggtttctgtttcttaccttcgttttgttgtatgtgcagtagccaactagcatagtagcttccgtgcatgttttgaactttatgccctgtagcgagctgcatacatgtgcaaatcatcgtgtacaacatttgtagtttaatgctgtgtgcatcctagtttcgaatttaataatttacttgaataaatcgtgttgtctgatttctgatgtatagcaggggctacacacccaggttatggtggaggctatcgagtgtcttttataagcttaagattaagattgtaagtgaaagtgttttttgaaatctaaagcctcgtgc

SEQ ID NO: 10430 - DNA, 1042 bp, Sorghum bicolor
  Clone ID: SORBI-28MAY03-CLUS117941_1
gaagtctcctccaattcattccaccctctctgtctgccacttttctccggaacgcccgaaaacttgcatcttcaaactcggtcggactcaatcaaacatcagaggaatgacgtctctcgtggatcaccccggtcgggagactgttggattctccttctcagaggctacagctgctggtcctaagcaacatggattctacccatacacagacaatggtggttccacccttggtatcacaggttctgatttcgccatcttggccggcgatactcgctctacctccggctacaacatcaactcccgcatggtccccaaggtcttcaagatcggcggggacgaggaaacgggcgagggtgctaagattatgctttccgtggtcggatttgccgcggatggcacagccctcaaggaacggctcgacgccatggtgaagatgtacaagtacaagcacgggaaaccgatgtctgttgccgcctgtgcccagcgactgtccactatcctatacgaaaagcgattcttcccatactacgtacacgcaatcttggccgggttggacgaggagggcaagggcgcactgtacagctacgaccccgttggctcatacgagcgagagcaatgccgtgctgctggtgccgcttccagcttgatcatgcccttcctggacaatcaggtcaacttcaagaatcaatacatccccggaagtggggagggtcatgctcttgtggctaaaaagcccgagccgcttccattagagaccgtcaagggtcttgtacgggacgctttcacaagtgcggtggagcgacacatcgaggttggtgacaatttgcaaatgcttattatcacaaaggatggaattcaggagactttccaccctctgaagaaggactaggtgatgcatcaatgctctgtctacgatagtttctaatgtgataaccttcaacgttcaaaaatggctgcgcaaccatcattggaaactttgctcggacgaatgttcaagacaagattgaaatcttgatgtcatcacgcatagcaaattatcagt

SEQ ID NO: 10431 - DNA, 643 bp, Sorghum bicolor
  Clone ID: SORBI-28MAY03-CLUS11825_1
gggcttggaagttacatggtccagtgtggtaaagattggacaatcgttgtaccgcgaggctcctggaagtgatccattcagacctgatcagaagacgcctgttaaaaacttcttcctctccggatcttacacaaaacaggactacattgacagcatggaaggagcaactctctctggcaggcgaacagctgcctacatctgcggcgccggagaggagctgctggccctccgaaaaaagctagtcatcgacgacagcgagaaggcgctggggaacgtccaagtcctgcagactagctgaacaaccaccccctgcagacaagtttaacctttccaaccacacatgctggaatggccaaatcatgtcttttctcgcttcagggtgctggcgattcccgcagcgacctcctgtatatccaatttgagcattagatctgtccccctgcaggcgtttcctatccctgaattcgaaaagcagggtgtctaggtggcatacgggattacatcaggcagtgtgtaagttgttgagctggaactcgattggtcattgggacgattgattggtgatatgatacatacatagcgcacactgttcttgcgtcttgcaaagaaatatagcaagcgatgatccggggtcaattgccgg

SEQ ID NO: 10432 - DNA, 949 bp, Sorghum bicolor
  Clone ID: SORBI-28MAY03-CLUS118495_1
gcacgagcagcacgccggcacacgcccaagcacatctcggtgtcggtggcaggcacacgccgccaagaatccgaccaccgaccgccgccgtcgtcatggctacctccgaagacgccgatcatcaggtgacggtcgtcgacttctgggcgaacggcttcgggatgcgtgcccggatcgcgctgcgggagctcggtgtcgccttccgctacgtcgaggaggacctccgcgtccgcgagcggagcgagctggttcgccgcatgaaccccgtccaccgctccgtccccatcctcatccacggcggacgtccggtctgcggctccgtcaacattctccagtacgtcgacgaggtctgggggcccaccttgttcccgcgcgacccactccagagggcccacgcccgcttctgggctgactttgttgaccaaaaggtgtttagcacacagacgaggttcctgaagagcaaaggcgatgaaaaggaggcagcaaagggagagctcctggagcaactcaagcgcctggaggaggtgctaggggacaagaccttcttcgccggcgacgagttcgggttcctcgacgccgtcctcatcccgttctcgagcatgttccatgggtacgagcagcatggaggatttgatcttgacgtggagtgcccgagcttgatgagttgggtgaggagatgcaaggaaaggaagagcgtcaagggagtcctgcctgacgaggataagatgtatgagctacacaagaagtggtatggcattgagtgaagcaatgaacaagcgagatggaatgatgccggttgcaaagaacgcaagagggctttctgttacatctattcagtttcttgtattattatcttttatttttacttgtgattgaactttactattgttagtttgcttaattggtttttgttagcccatctccttgaaaaaaaaaaaaaaaaaaaaaa

SEQ ID NO: 10433 - DNA, 1636 bp, Sorghum bicolor
  Clone ID: SORBI-28MAY03-CLUS11882_1
gcacgagggcagcgcgggagcggcaactgacgagggctctccaattcggatccagcgccgtgtggattcgtgctctccctcccgccgcgccggaggagagggagtgctgggacgccgtggaggagaaggaaaggtggggcgacgccgacagcggaggctcaccgtcactgaactctgcctcggaggttgattttacgaagtacatgccactgtagaacaaaatttcataatgctttggcaaacgagttgtaggctatggcaagccgtatcctgtcgcgtcaaaatctgagaaagttggcttcgttcactctccagaatatatcccagaggcaactaatttctccgtaccctccagctcttagatctactattgcgccccccggcaaattcctgagccccctttacctgtctgggcattcattggctgtgagatgggcaacctatggatcagtgaatcttgttttgtctgatgatggaaaacccaagtttcaaattgaggaagtggagccctccacaaagagaaggtatttgacaaagaagcgcttgaaggttcagaggaagaaggaaaagaagaagaggaaggaggcaaataaaaatgatccacggcgcatcaggcccaagggaaagaagataaaacaaaaatttcccacaccagaagctaggctcaaatataagatcgagaaggccaaactaaaggaagttaggttggtcgaaaaactaaagaagtatgaggttgccaaagctcaaggccctatggctaaaccagatgatctcagtggcgaggaaaggttttacttgaagaaggtttcacagaaaaaatcaaattatgtccctgttggaaggcgaggagtgtttggaggcgtaattctgaacatgcatttgcattggaaaaaacatgaaactgtgaaggtcatatgtaagccctgcaaaccagggcagatccaggaatatgcaaatgagatagcacgactgagtggcggtatccctgtcaacatcattggagatgacaccatagtcttctaccgaggaaagaactatgttcagccagaagttatgtcgcctattgatacgctgtcaaagaaaaaggcacttgaaaaatcaaaatatgaacagtcgctggagacagttcggcgtttcattgcaatatctgaaaaggagcttgagctttattatcggcatgttgcactttatggaaatccacaatcccagaaagctgatcttgtttgtggtgatgatagagaaacttctttgcttaaaatgggaggattggatcaagggaaggaccaagagcctcatctggctaccaatcatttttctgatcaccacgtcagtgatgtttctgaatccgatgaagaagatagttccggtagtgaatatgatgttaatgacgatgagactgaaagcataaccagcatttctgaagactctattgtttctgatcatggcgatttagccaactggggcgaagcgtgattaccttgtctcacataattaccttgtttggctaagaaatttaccttacaccaagccacctcatcataacatgggtgttcctcatcactcagtttgaatgatataaatgttagattttgctgtacgaattgtcatattatgctgattagtggttacagctttc

SEQ ID NO: 10434 - DNA, 1203 bp, Sorghum bicolor
  Clone ID: SORBI-28MAY03-CLUS12042_1
gcacggcacctacccctccccgcacggccgcacaccaccgcgcaaatctccttgccgtctcgcctcctcgtcgagttattagtgggcgggggaaaaaagatcaacgccgacgggcgggtggcggcaacctaccctaccaccacgcggcgagggcgagggcgatggcggcgtccccgccgcggaggcgcctccctgctgcgcgcctcctcttggtgctccccgtcctgccgcgccaggtggcgtggcccgtcatgaacacgctccacagcgccgtcgacctgctgccgtccttcgtcgccgccgtggcgcccggggcgccggcgcccgcggcctggagcggcgcgtgcttcgcggagaacgaggccgctatcgagctcacgcccggggaccgcaacggcaccggcgtcggcggcgccgtcctgcgcctcaagactgcttcagctcatagttggacatgcatggatctctatgtttttgcaacaccatataggataacatgggactattattttgctgctcaggagcacactttggagattaaatcatgggaggaacaagcggaattggaatatgtgaaggagcatggcatttctgtttttctcatgccatctggaatgcttggaactttgctatctttgattgatgtcctgcctttgttttcaaacactgcctggggccaacattccaacttagcctttttaaagaagcatatgggagcctcatttgagaaacgttcccaaccttgggttgctaatattagaaaggaggatatacaatctggtgactttttggctctatcaaagattcgaggacgatggggcgggttcgagacattagagaaatgggtgactggtgcatttgctgggcatacctcggtttgcttaaaagacgagaagggtgatctttgggttgcagagtcaggctatgaaaacgagaagggagaagaaatcattgcaatagttccttgggatgaatggtgggccatggccctaaaggatgaatcaaatcctcagatagccctgcttcctttgcaccctgatgtacgtgccagattcaacgaaagtgctgcatgggaatatgcccagagcatggttggacaaccttatggctatcataacatgatatttagctggatcgatacaataggagataattatccacctcctcttgatgctaacctggtaatggcagttatgtcaatgt

SEQ ID NO: 10435 - DNA, 772 bp, Sorghum bicolor
  Clone ID: SORBI-28MAY03-CLUS11321_1
tactggacaaactcatgaaccgcccgccgtccggaacatcggatccacgccctctgcgccgccgggccggttcctcctcctcctcctagatggcggcggcagcgccagagaagaggccccctcgctcgctctttgaactcgcctctgacttctttgattcatccgtcctccttcgggctcacccatccacggccccctctgcggtggaaccatccgaaccctcccggtcaccgccgccgccgacgactcagcagcagcagcagcagctttcagaggcttcgggatccaggtggacgtgcaacacctgtgccgccgagttcgagtcgctacaggagcagcgcgagcacttcaagtccgacctacaccgcctcaacgttaagttgagcattgctggtaaaactattataaaggaagaggacctagacaaagcagattctgattctctgtttgatgatttggagatatctagtgtctctggttcagaggacgaacaagaaaatggacctgcatcagaacgtttgctctcagttaaaggcaaggaagaattcaggaagaaactctactttcgtcgtgcatcgggtgacacaatttctatctatagatgcatgctcttgaaagaacatgaagaaccattaattgattgtaagtctggtcagatggaaaatgcatcttgtgtaccggaggaggagatgataaatagggtgaagcatttgacttgtgaacctcgtgatgcgtcacatttgagaattgttatactaacaagcggtggaca

SEQ ID NO: 10436 - DNA, 1461 bp, Sorghum bicolor
  unsure (1)..(1461): unsure at all n locations
  Clone ID: SORBI-28MAY03-CLUS11382_1
aatgaatgctagccctaagaacagaggtactaaaacttttgcacatccataaaaataaatttctgaataattagagctttaccagttgccacatccctatataaatgatcagtacatcgacctgatcttataatattggcttcaaatctattagcagtcctaaatattattatagccaaaagaatgatacagttcatgaaactaataattgttgatacatctgcaaaagaggcccattaattccatcatctttgtacagctactcacaagagattattcggtttcatagagtttgatatttgctcctactcttatgtatttaataggtgagatgtggataagtgtttgttgattgtcttaattcttatgcttcataacctgtggtgattatttcttatgtgtctgcaatactttgtctttcactgaaaatttaagtctgtattctctgttaagatttcagttataagtttctgggaagcttatgaatctcatataaatttcattatccatttatacatctgttgaaatctagaactaggttcttcttgtgttatttttcttacaagaaagttcagaggttcacttccttttcatgactcangagactagcgagatttcagagccaccagtcatacctttgttgttatgctggttatatgatgcataatttctttatttgcatcaattaagatcaccctttaatgcacactttacttttatctaaacccactgcaatcttatttgatacatgaatgtgagatgtttatgcagttgttatttcttatttactaatgctcctcttgactgaaatttagaccagattacttggcagactgtagttggcatgctcctggtgagaccctgccgtcatgtaagccagcgtgcaagcgtaggactcatggtgccaaggtccacaacatgaggctccaaattttcttcatattttatttatgctattattgatatttattaagaagctgcgatgcatgtccatccagacaatttatttcaattcattttgccatttgattaagtgtcatcctctatttgtccaaactgcaagaaagggagctgatttagtgaaccttggaggatactggagaccacaactatgggacctcagccttgctataatcgggatgtgaacatttggctctttttagttgtggtactttcagttcggttctcggtaatttgtgcccaaagtgacatttgaagctgacagtggtttcttcagcctcgcacaagcattttgtttggtggtccaagcaagttaagctgagcactagaccaatttggcctctcttgagctgtgagtatataatctcatgatgatcactgctacggtttgatgtatccgaagttatacgttgcataaagagtaggtatatagaaatggcttgagcttttgtaattaacttaatcgcataatgtaataatcaagacaattttatttgagtc

SEQ ID NO: 10437 - DNA, 675 bp, Sorghum bicolor
  Clone ID: SORBI-28MAY03-CLUS11401_1
taaaagagtttgaaatgtggttaggttttgatcaaaatcctctttatgccctcctgcatgagtctatctactgtgagggctcttcatcaaaatggtctgctgaaaagattcatggtgaatatggaagtttgtttgatcctattaaagctacagaagaaggccgtgctgtgtattttactggagagatggtgtttccttgcttgtttgatgagatccctgctctacgagacctaaaagaggctgcccatttgttggctgagaaggaagactggcctcccctatatgatgtcagcgtgttgaacaataataaggttccagtcgcggctgcagtatactacgaggacatgtacgttaacttcaacatcgccaaggagaccgcctcccagataagggggatccggctctgggtgaccaacgagtacatgcactcgggcatccgcgacggcggctcacatgtcttcgagcatctcatgggtcttctgaacggcaagaagcctttgttttagctgtttctcgaaaccctactatgtaggttcgagtcagttgagctgaacttactatgattgaaatgagcaaataatgaggtccttttgatttcttgtaaattaaagtgaacaaatgaataatgtttacgacatcccttgtaaacgtttcacgaataatgtttaacatttg

SEQ ID NO: 10438 - DNA, 1016 bp, Sorghum bicolor
  Clone ID: SORBI-28MAY03-CLUS114194_1
ccgagcaccaccccagggagcgcgtccatccccttcctccgatcgagccagggccaggcaacaacctggtgctccgccccgtctccgttaccgcgacgcctcggcctcccgctccaccgcctgcctgccagcctccgcggccctgtgaccgtgaggcgacacgacgccgagaggtcacccgccccacgcaccgaggctgccccgcttgggattgagaggtaaagagtgatggcagcgccgccggcgagggctcgagccgactacgactacctcatcaaactgctcctcatcggagacagcggtgttggaaaaagttgtctcctgttacggttttcagatggatcattcaccactagcttcattaccactattggtattgacttcaagataaggactgtcgagttggatggcaaacggattaagttgcagatctgggatactgcaggccaagaacgtttccgcactattacaactgcctactacaggggagcaatgggcattttacttgtgtacgatgtcacagacgagtcatctttcaataacataagaaattggatcagaaacattgagcaacatgcttcggataatgtgaacaaagttctggtggggaataaagctgatatggatgaaagcaaacgggctgtgcccacttcaaaggggcaagctctcgctgacgaatatgggatcaagttctttgaaacgagtgcaaagacaaacctgaatgtcgagcaggttttcttttcgatagcaagggatatcaaacagagactttcagagactgattccaagcctgaggatcgaactatcaagatcaaggctgaaggggaagctgatgcagcagcggcacagaaatcagcttgctgcggctcctgaacagttgtgacggcaagatagtggcgttttcgcgcatgtaattttcatcattttattctttggcagctactctctccttgtgcttcttgagttattgcaattgttgtgatttggtacaaatggagtgttaagtcagaacaatt

SEQ ID NO: 10439 - DNA, 754 bp, Sorghum bicolor
  Clone ID: SORBI-28MAY03-CLUS114578_1
cacaggagattcgcaagataccggctgatggtgttgtcaattatgttggaggtgacatgttcaagtccatcccacctgctcaaatggtgacacttaagatggtgctgcaccactggagtgatgaggactgcgtgaagatccttgccaattgcaagaaggcaataccttcaaaggaagatggagggaaagttgtcatcgctgatattattcttgaccctgcctcaggaccagtaatgtttgaaactcacctcctaatggacgtctgcatgatgctgatgaaaggaggccggcagcgggacttgaatgactggcgtgacctcatcctgaaagcagggttcagtgactataagctgctcaagaactttggagctcgtggtgtcctggagatctatccctaagacctacattatcctcgacgatcggcgcatctttatattgtggtttggcgcgaagaaacctacatatagtactaaaataaagggagtgtgtcatagttttctgaatgatcgtttcatggaacactgactagcagcttagctgtgacaagcttggttgctccatgatctgtttaactttcatttggagaagtatcttggcacatcatgagatgctacgtgcatcatgttaatacatacccaccgtccaggagtgttggaaaatgtgtgtactatcttgtaattggtcttgtatatcggaaagcaggagcaactattttaccgataccagatacatatcaataaaaaaaaacagggag

SEQ ID NO: 10440 - DNA, 883 bp, Sorghum bicolor
  Clone ID: SORBI-28MAY03-CLUS127678_1
gcacgagggaacttctaaggttcgcatcgcagcaatggcaactcctcggtttgcgaaggccacagcagtcctcagctgccttgttgctcttgcaacacttgcaagctgcaacactgaagttgacatactgtacgagcaaaggcagacatggaaggacccaaacgatgtgctggtgagctgggatccgactcttgtcaatccctgcacctggctccatatcacttgcaacaacgacaactctgtcatccgtgtggatttggggaacgcaggtctatcaggctatctggttccagatctgggaggactgaagaacctccagtacctgaacttgtatgggaataacctgacagggtctatacctgaatctttgggcaatctgacgcgtcttgaggggctggagcttcagaagaatgcgctgagcggtgcaattccatcctcactcgggaacatcaaaacattgcagttcctgaagctgaacgcgaacatactgaccggcacggttccattggaagtcctctctcttgtcattgctgggaatctgaccgagctaaatattgcaaacaacgacttggccggcacagtcagatcatctggtttgagagtgactgcaatcattcaggacaagctgaagactgcatgatgatgagtccctggatcaggacattggctttcttcatgtgtatattggcaagaaataaaaaggataaatccaatgacatggattgatctagacatcttgtagtatgatatggctgctgaatatattatattcttctcagattgtccccttgagtagcattagttaatgagaatatatggggcatctctagtcctcgagaaaaaaaataagtcttcccaatttcctagcatgtagaaggtacgt

SEQ ID NO: 10441 - DNA, 895 bp, Sorghum bicolor
  Clone ID: SORBI-28MAY03-CLUS12781_1
actaggggattagattctcaccctcctggtggtctcctaaatattttgaagagcacaccacaagctgcaagcaatgggagttcgtcacacgcaatacatattgatgttgacaacaatactaggactgaaaaacgcttgacatggacaaaaaaggaggatcttagattggtcgctgcttgggtgaataattcaaatgatccagtccaagccaattataagaagaatgatcagtactggaaaggtgttgctgatgtatttaatagcaccactccaaaagatcgagtcaggacagccaagcaaataaaggatcactttggaagaattaagaaaagggttgcttgtttttgcggtaattggaaggaggccaatgctatgtgggctagtggtgaatctgatgaggacgtaatgaacagggcactggaaagttacgcagaagaccacaaaaaggatgggccattcatgtttaggcattgttgggaagttcttagtaaggagccaaaatgggacgcctatctggaacgcctcgaggatcttgaaccaggcaagagaaagtttgttgaggatgatgaggagcaacatttctctctagatgatgatgaacggccaatagggggaaagaaagctaaggagcagaaaaagaaaaaaaacagcagcattgtataatagatcttgaagatgagcttaacaactttttagatgctcaaaaagcagcaaatgaagggcgtgcagagatgctagaaacacaaaggcgtgtgtccagtgagaagcttgaatctcggagacttgctcaccttgcagcaaaagagcacaaggaggcagttatgctagaaacatatagatcattattgatgcaaaacttcctcaaatagagaagcaccagttgtttgcggagcat

SEQ ID NO: 10442 - DNA, 843 bp, Sorghum bicolor
  unsure (1)..(843): unsure at all n locations
  Clone ID: SORBI-28MAY03-CLUS1280_1
ttgcttggcgaatgcgaacgtcagacctaggaggcaaggaggctcgacccggcatgtgattgaaaagaacagtatggctccaattcggcgaccatctgttgagttctccaaagccgccctgggtatttattccaaagccgatgtggggaaccctgatggcggtaagcccgcccaggaggacctgatgaaccccagggcccacaaaagaaaggtccccaatggtctctcaaacggaacatactatgccaatggcaatggtgtgcatgcttagagcagcaggggatgatggatcaaggatttgcaactatttacttgaaaaagttcagttttgtcttggcggttcctaatgcatcagttttgtcttggctggcttgactatcatcatggtcgctcgaggaagaaaaagttcttgtgctcgatgcggactgtctgctggggatggtgctcgttcggtggtttttagttaaggaaccgagctgatctctttgaaggcgcgagatagtggtttctgcgttcgtctctaccctcctctgtaagcaaatggagcagatttgggtcagaagagtttacatgctgtatatcttaaagaaaagctgtatgttttggttacttaaattaggttttcagtgaggtctagagctgatgcttaaaaaagcgcagcagtgcaagagagtatttcgaaattaggtactttgatttgggacagttttttttgtgcttgtgcgcaaataagttgatgctctgctgcatgatcataccagttgccatcagaacgcatgtcatacttctaaatttatggattacttattccanaaatgtaaatacacaatagcaaccagtacc

SEQ ID NO: 10443 - DNA, 1000 bp, Sorghum bicolor
  Clone ID: SORBI-28MAY03-CLUS1296_1
ccggtcgaccacgcgtggcgatgcagacattcaaactgcggttgcagcaaaagaagcactagaaggacacagtatctatgaaggtggctactgcaaactgcacctgacattttcacgccatactgagcttaatgttaaggttaacaatgagcgaggtagagattataccaaggggaatgtcactccaagcagtgatcgaccttccattcttggtcctcagccaataccaaacgttggtgctgccattccaccagctccgggtagtgttgccaccaattcagtaatgcaaccaggagatccatcagttgctgtaccttctaatccttccagtgagccactcctgcaagcacctgttgtttcctcgggtggacctgcacagtaccctaaccaggccatcctacaagccccacctggtgttgctccacagttcccaggctatggtgccctgcagtttgctcagggctcagctcaagcacaaatggtgcagccttcaggccaaggaagtcaacagatgtcaagtcatgtaaactatcagctacctcccggtgcagcccaattcatgcagtatctcggcaatggaagccatccacttccaaacgcccctgggccacaaacaatgccttaccctgccctcggtgggcagcagctacctccgggtcctcagatgatgcaagctccaggatttggaggcctgcctttttcacaaggtcctggacaaccaatgccacagttcccaatgtatggtactcagcagtttcctccgggtatggagccccagatgatgcagggaggccagcagttcacatttgcacctcggggtccatatggtcgttagcaatttgaactctgcaatgttagatcgttggtactcctgatggtctgtccttctctgttgccattttcttggaggcgaataccgatgttgttccaatttagtaaggtctatacttggtttatctcttgtaatgtggtgaaaataaatgactaatctagggttatc

SEQ ID NO: 10444 - DNA, 1082 bp, Sorghum bicolor
  Clone ID: SORBI-28MAY03-CLUS12950_1
gcacgaggccgaggctgacgccgacgatggccagaagggcaaggacggcgacgacgtcaaggagaagagatggaaggtgctcgtgtggagcacggccgtgtatctcaccacacttgggatgctcgtcgcgcttctcatgggactcaacatgtcctggtctgccatcactgctgctctcgtcctcctcgcacttgatttcactgacgcacaggcttgcctggagaaggtgtcatactctttgttgatcttcttctgtgggatgttcataacggtcgacggcttcaacaggactggcatacccaatgcgctctgggagctggtcgaaccgcactcgagaatcgacagtgccaaaggcacggcgcttctcgcggttgtgattcttgttctttcaaatgtcgcctcaaatgttccaactgttctgctgctgggttcaagagtggcagcatcagcagctgcaatctcaccagaatcacagaagaaagcctggctcattctagcatgggtcagcacggtggccggcaacctgacactcttgggctcagccgcgaacctgatcgtctgcgagcaggcgcggcgggcacagttcttcgggtacaatctcaccttctggagccacctccgcttcggcttgccgtcaaccatcatcgtcaccgccatcggcctgctcatcgtcgtcagttactgaacccacgcaaggatgtgtagctggtagcagccaggcagaacgctgcaggaaacaagtaaaccagaaggaatggaaacagctagcagtgcaaatggtaatgtacctgagaaggagatgttgtaccgtaccgataggtcttttgttgtacgttgtaacagtttttatgtttgtgtaagtttggttaatttcgcgcaaccgatgcctaaaggcgtcgggttgcccatctgctaaggcaaaataatgggcaagacaagattatagatggcatgaagtagaggccggcacccctgttctagttaaaaaggcgaaaacttggtctagctagttcaggtaggagggctggcgaaatttgtatggtgagtttcttaattggaaggtgaatggtgatgtcaaaggg

SEQ ID NO: 10445 - DNA, 1136 bp, Sorghum bicolor
  Clone ID: SORBI-28MAY03-CLUS11571_1
ggagccactcaggtactaccacaacataacatcaaacacattgacagttcttgaggcaatggcagcacacaatgtaaatactctgatttactcgagtacatgtgcaacctacggtgaacctgatacgatgcctattgtagaaacaactcctcagaatcctatcaatccatatggtaaggcaaagaagatggcagaggacatcatcttagattttacaaaatcaaagaaacaatcaaacatggctgtcatgattttaagatacttcaatgtgattggatcagacccagagggacgtctaggagaagctccaaggccagagcttcgtgagcatggacggatatctggtgcttgctttgatgcagctctgggaatcattccagggctaaaggttcgtggaactgattaccccactgcagatggaacttgcattagggactacatcgatgtcacagatcttgtagatgcccatgtcaaagctcttggtaaagctgagccaggcaaagttggaatctacaatgtcggaacaggacaaggtagatcagtgaatgagtttgtgaaagcttgcatgaaggcaacaggagcttccatcaaggttgaatatcttgcccgtagacccggagattatgctgaggtatacagtgatccatcgaaaatctacaaggacctcaactggacagcccaatacactgatcttggccaaagccttgcccaggcatggaaatggcagaaagcgcacccaaacggatatggatcagcctgattcagagttcaaaggttgagagactcatcacgcagatccaaggggtctatgtgcagtgatatagccttcagataattggttcttcaacatagaaacatagcaaacagcaacacaaaagtcgtgattcttttattgcagtgctggaagaagacaaaagtatcacagagagaatgcactacctgttccttgattagtttcatatatataggtcctctttttgttgttgacattttaatatattttgatgtgtgctgaggcactatataataacacaaatgaaattgtgttgtagacagggttagatcaatctcgtgtatcaaccttcgttgtggtagaatgaaaggatagttgttggtggttgtagtttttgtttacc

SEQ ID NO: 10446 - DNA, 758 bp, Sorghum bicolor
  Clone ID: SORBI-28MAY03-CLUS117121_1
agctgtcgccttctggcctcccggtccgcgagatcccgggaagctacggcgtgcctttcttctcgccgctgcgcgaccgcctggactacttctacttccagggcgcggaggagtacttccgctcccgcatcgccaagcacggcggcgccaccgtcctgcgcgtcaacatgccgccgggccctttcctctccggcgactcccgcgtcgtcgccgtcctcgacgcccgcagcttccgcgtcctcctcgacgactcccgcgtcgacaaggacggcacgctcgacggcaccttcatgccctccctcgcgctcttcggcggccaccgcccgctcgcgttcctcgacggcgccgacccgcgccacgccgcgctcaagcgcgtcatgatccgcctcgccgccgcgcggatgcaccacgtcgcgcctgcgttcggcgtcgccttcgccgccacgttcgacgccgtcgaagccgagctcgcgtcgtgcgccggcgccgcctcggagttcaacaagcacaacatgcgccacatgctggacttcacctgcgccgcgctgttcggcggcaagccgccgagcaaggccatcggcgacggcgcggcggcgaaggcgtacaagtggctggccttccagctccacccgctcgccagcaaggccatcaggccgtggctgctggaggagctgctcctccacaccttccgcctgccgcccttcctggtgcgccgcgactacgccgagctgacggcctacttcgccgacgtcgcgggg

SEQ ID NO: 10447 - DNA, 737 bp, Sorghum bicolor
  Clone ID: SORBI-28MAY03-CLUS11746_1
gccggccgggcctggattccattctgtccgtccgtccgtccatccgccatggcgaccgccacgctgctgagctcctccttcgccatgcccgccgccgccgccgcccggagggccacctcctcctcttcctccgccacctccttgggcttcgccacgtcgcagctcgccggcctctccctctccgccggcgccgcaactccaaccgccgtcgccctcctccccaagaggcagcagctccagcccattgtcgcgcggcgggtgtgcccgttcacggacaagaagacgaaccgggccaacaaggtgtccttctccaaccacaagaccaagaagcagcagttcgtgaacctgcagtacaagaagctgtggtgggaggccggcaagcgcttcgtcaagctgcgcctctccaccaaggcgctcaagaccatcgagaagcacggcctcgacgccgttgcccgcaaggccggcatcgacctcaacaagaagtgatgagagcagccaaacaaaactagcggtgtgtcactagcttagcattcacattcacggggtcgtctcgactgtctgcctgcctgcctgcctgcctgcctcctgctgttatttcacaatcatattacagcattatatttcctttatttactttcctccccagtttgatgtgtgtaccataccaaccagtgtaggcagatcgaggttgcacatatatatgtttttttgggtctcgtaaaaaaaaaaaaaaaaaa

SEQ ID NO: 10448 - DNA, 846 bp, Sorghum bicolor
  Clone ID: SORBI-28MAY03-CLUS1169_1
gcacgagggtcatatgcttgtctcaaagattaagccatgcacgtgcccggtcgcgccgccgcgatccccggcgccgcgccgcccccatccaaccgccgcgagttggtgtggcggtgcggccccctccgacggcacccccgcgtgcggagcgtgcttgcctcgcactgtcacagtcgcgcacggtccctgtttcatctgtcggtggtgacccgccccgcttcatctatcatctgtcatctccccactcccccagtgcagtcccgggtcctcctgtccgccccactctctccagtctccttctcgcgtcggcggtcggcttggcagggcggaaccaatggcggtcgacccgcggcaggtggtggcgggcttcctcaccctctccatgttcgtcatgctcggcaacatgatcaagcacgaccatttctcctcccccgtcaccgaggagctggccttggaggcaacaggtgtggagtcgaacacagtgaagcttgacaacaatgctgaaatgaacagcgtcgatatggctggagtggaggacctgatggacgctatcgaggacgttaaaccttgctggaccaaaccaagtcaaaaaaatcagccatctaatggttttgttacattctccttgactatgggccctgaatatcacatctcacagatcacagatgctgtggttgttgcaaggtatctaggtgcaacacttgtgctcccagacatcagaggaaatgaattaggaaataagcgaaaattccaagacatgtacaatgtggataaattcgtgaggagcctggatggtgttgtcgaagtaatagaagaaatacctgatgaagtaagtgctaagaatcc

SEQ ID NO: 10449 - DNA, 1204 bp, Sorghum bicolor
  Clone ID: SORBI-28MAY03-CLUS11777_1
gcacgaggctcatctgttgtctagcatatggtctatttactgaacactgaaaataccatcactatgctgctagattattaggcagcgtgaagctaaaaggggttcaccaaagactgaagctcaagacaaagctctaaatcttttacgtgtgcgacttgcacaaagctattgacagtgaaaactatgctttggcagctggtctccgtgatgacattgccaaacttgaggccgagtctcttgcagtatctgctaaagctcttgcttatcaaaatgtgaaatatgcatttcgattagggcagaaagtacgtcacaatatacatggatatagaggcgtgatatgtggcatggacccggtgtgctgtgaatccaagtcctggatggagacagcaaacgtggagaagctgtctaagggtccaaatcaacctttttatcaggtcctggttgatgtatacgttgatccagaactgctggttgcatatgtcgcggaagaaaatctttctgcagctgaagaatcagaaaaaggaaggtttgatcacccctacattgaattcctcttttacggtgaggacacagctggggatttcatccctatcaagcagctccgtgagaagtatgaccagccacgttatgaagcttctggagatgaaagtgacaacgatgacaacacaaatagctgaagggcaagtgccttcatgttgctagagttgtgttggaaccattttgattcaccaccaccaactgagatgcgaagtgatgaactatctggtacagcttcagacggcagatgtaagacaaggcaaccattggcgaactgtgcatcctcagtaacctgcagttatcctctgcatatgccggccaaccttgcagatcggagattacccttttagagttttaccctcaccaatcgattaagccatgcttgagagaagctgcatgtgcctcgcttttacgttatgccatcgataaatgtaaacaaaaaagaaaagaaaggaagaaataaaaatatcctatggatgttctgtgcatagttctccgagatctatctagttctgtactgtaccctctgacggacaattgtgtatatgtaatactggcaacttctgtggagtctcgaatgacttacgcgaaggcttcaaatgtacgtagttgtttggactctgctatcatggaacatggaatgatgtggaaataacaatttccgtga

SEQ ID NO: 10450 - DNA, 826 bp, Sorghum bicolor
  Clone ID: SORBI-28MAY03-CLUS13469_1
cataatctgagacaactacagttcatcatcaagaatagctccaaacttcgcaggaggctgatggacaaggagcttgatcctgcagttcttttaaccatgtccgccgatgaattaaaggctggcttgacttcagcagagaaaacatctgaaccagaagaatcaaggaaattgcagatgactgataaaagatgtgaaagatgcagtgaaaagaaagttgtcatatctaatattatccatgcaggtcatggagaccgctatcagttggaatgtacttcctgtggctgcacatgtttttcgtccagagatgccattacaacactgacagaggatgccccaaccactgctgggaatgtgggtaccgcccccttggcaacagcaaagtttgaggtcgttgagaagcagctcacgagcccacgggaccaatcgggcaagcctgcttccgatgccctccggaagagcactgcagcttacatgccaactatggagaggcagaagtcgtttgttaagcccaaggatgaaccctcccctgcaccgaaacagggttagagccttatgaatgctgcagattggtctttgaaattaggaagctcaggattccgagatacagacttgtacatagaggcgcatcgtttccgttttcttgacatgccactaactagtactggttgaagtttccagtagatatcttcccttcggtagtctatttcgcagtgcctcttatactgtcggctgtcgtacatagcctacctcttttgttctatttttcacttattgtagcaatcaccaattgacatgaggacataggtttgtggcgattgccagattg

SEQ ID NO: 10451 - DNA, 751 bp, Sorghum bicolor
  Clone ID: SORBI-28MAY03-CLUS13531_1
gcgttccccttgccctccgcaaagcctcctcctttacatttgcaaagccagccggcctcctcgtcctggctcgcaagcaaagcaaagcaaagcaaacgaagcagaagcagggaagaagaagaaggcgagagccgagaggtgaggagctaggccagtggcgcctgcagcagcaatggcgacgacggacctggggttcgaggagacggagctccgtctgggcctgcccggcggcgggggagaggtggtcggcgaagggaggagctctgtcgtctcctccgggaagaggggcttcgcagagaccatcgacctcaagctgaagctggagccggcgactcccgcggccgtattgaaggcggcggaggcggacgagcatcaggacggtgttgccgccgccgccgccgccaaggaagacgccggctgcgtggccgccgcggaggaggccgccgtcggcgggaagatgaagaggtccccgagccagagcagcgtcgtcaccgccgccgccgtgcaggctgaccccgccgagaagccgcgcgcccccaaggctcaggtggtgggatggccaccggtccggtcgttccggaagaacatcatgtccgtgcagtccgacaagggcgccggcggcagcaaagacgccgacaagtcctcgccggcggcggcagctggcggtggtgcggcgttcgtgaaggtgagcttggacggcgcgccgtacctgcgcaaggtggacctcaagatgtacaagagctaccaggag

SEQ ID NO: 10452 - DNA, 1235 bp, Sorghum bicolor
  unsure (1)..(1235): unsure at all n locations
  Clone ID: SORBI-28MAY03-CLUS13613_1
gcataagatagatctcctcttctcaccctcgaagtaacattgaccgcaaagggccatccgctgcggtcagtgtaagtttctgaatcatattttggcaatgcctaaggctagacaatattgagctagcctttacaaagaaagagactgagagaggagaagaatggcactggcgcattgaggaaggttgagaaccagttaacaagaattgccagcatttggacaatcttgttaacagtgttttaaggttcccagcagacaatttgcgagttcaagaagagtgcgtgcatccacattgatataagcaaggtttaataataagagaagaaacatgggcacaaagatgaagaaggggatcctgaagccgttccgctatatctcaaacatgatggatggtaaggagcctgaaatgcaaattgggttcccaacggatgtaaaacatgtggcacacatcggttgggatggtcctggctccaacaacaataacagcaacaataatgctggaggagcacctagctggatgaaggattaccactcggcaccgcttgactcgtcctcttttaggagcgagagtgggggcaccgctgctgcaaatccctgggcttctcaagagatagtgatggatggaggcaacagcatcggagacacctccttcagggacacgaaaagcgaggcaggcggcgccgacgtcggcggcggcgattccccaccgacccccggctcgcgccgggcgagacgacaccgctcccggggctccgccacctcgtccatggacgtcagcaccggcgctgagggcggcgccgaggagaggaagaaggagaagggcaagaagggcacccgcaagaaccgcaagaaggacaagtcggccggcgacgacgccgcctcggccacctgccaggacctccccgccgttcccaagaagtccaaccgccggaaaaacaagggcagcagcgacggtggcgccgcggccaaggacagcgccacggccgcgccggagagggggcggcggcgaccccaccaaggtgtgtggcaagatcattctcacctncgaccccaagctccctttcaaagtgttcagcgtgcctgaggcggtgctcttcaccgcggtgctcaagtacgctctggaggagttcaaggttccgccccagacaagcgccatcatctccaacgatggagttggcattaacccccagcatagggcaggcatcttgtttttaaacatggttcggagttgcgcc

SEQ ID NO: 10453 - DNA, 781 bp, Sorghum bicolor
  Clone ID: SORBI-28MAY03-CLUS13497_1
cggaactgatgccgatgcaagtgtttccggtggaggatccggtggcgccgatgctgccgtgagtggtggtgtctccggaggtgccaaagttagcggtggcgtcaaaggagatgcaggagggagtggcaaggcctataccggaactgatggcgatgcaagtgtttccggtggaggatctggtggcgccgatgctgccgtgagtggtggtgtctccggaggtgccaaagttagcggtggcgtcaaaggagatgctggagggagtgacaaggcctatactggaactgatggggatgcaagtgtttccggtggagggtctggtggcgccaaagctgatattggtggtaccgtgggtggtggtgtctccggaggcgccaaaattggtggtggcgtcaaaggagatgcaggaggaagtggtgatgccgctgcaagtacttctgcagaagctaaggctggagggagcaaatcatctgggggtgggtcggattttggctatggtgcatcgagcaaggaattatagatgagcaaggaattttggccaccgtaagaatgatgcattcagtatgctcggtcccaaagaatttattcctattatttttgtaaccaagtgttgttttaccatgcaccggtcaatagtgtggaggcaatatggtaactccccttgactggacaataccaataaccttttgtatatttttctttgcttattaattgacattgtcatgtaaaccagaacagcctgagaggctgattctcatgagaaatatgacatttctaatttaaa

SEQ ID NO: 10454 - DNA, 250 bp, Sorghum bicolor
  Clone ID: LIB3480-022-P1-K1-B9
cgccggtggaggtgtttcaggtggaggatctggtggtgccaaagctgatattggtggtaccgtgggtggtggtgtctctggaggtgccaaaattggtggtggcgtcaagggagatgcatgaggcagtgctggaactagtgccgatgcaagtgtttccggtggaggatctggcggcgccgatgctaccgtgagtggtggtgtcttcggaggtgccaaagttagcggtggcgtcaatggatatgcatgatgg

SEQ ID NO: 10455 - DNA, 819 bp, Sorghum bicolor
  Clone ID: SORBI-28MAY03-CLUS13539_1
atccgttcatcagcgtgagggctgagggggagttgccttttctctctcccgtcatcccgtctcctcttcttcgtgaactctcttttccagatcagaagaagctcggaccggcggcggcgggtgacgcaggatctgttctggtggcgacgtcgaacagcacgcggatggacggcggcggcggcggcgacctgcggagcgccatcaagaagtggaacgtcatctaccctgtctacctcaactccaagaagacggtcgccgagggccgccgcatcgccgccgccaaggcctgcccggaccccacctgcgtcgagatcgccgactgctgttcgcacctcaagatcccccacgccatcgagttggataaggcgtacccaagggatttcttccaggtggggagggtcagggtgcagctcaagaaagatgacggctcccccgtcaatcctgctattaaaacaaagaagcagctgatgatccaaatagcagagctagttcccaagcaccacggaaggacaaagaagcaggaggcagcaaccagttcttcagccggtggcagttcaaagaactcaaaaggcgggaaaaagaaaaagtgatggcagtatcatttggtgttttttttttccttctgttcgtcctcatactaagcgtctgtggaagttgtctttctgaggcctgaaaatcattgtgagttttggtgggattttggtccatttgaaaatttatgtacccatctgtcatgttatcttcagattcagaagtccacctaacctgaggcagctgcttgatagaactttgactaatcctgcgtagattcttcatttc

SEQ ID NO: 10456 - DNA, 616 bp, Sorghum bicolor
  unsure (1)..(616): unsure at all n locations
  Clone ID: SORBI-28MAY03-CLUS26796_1
tcctcaccgaccccaccgccgacccccccgccgcggtgagcataggcctcgtcctcgtcctcctgcacgccgcgctgcacaaggccgacgacaacgccgcagacgaggtcgaccgctggtacgcgccggtgtcacagcagccgtcgcactaggttctgaatgtggccattctgcgccttgttgtgatcctgttcctgtcctggactccctgtttccaagtattcctccagctgtgcaagttgggccatccccatctcatctgcgatgaagaacctgccccctgttgattgtgattcacctgctgccggttccattggaagttttggatccagccacgatgcagggctgttaaacctgttctccacgcccacttctgtgacccgtttaaagcgtctcattcacgtgtatcaaatccgaactgaagtttagtgtacattttgagttggagaaatgtgatgccagggacctgtgttcagattttatcgacgccatgtatgtaggcaagcaatgttgatatttcaaaacatggttttattgtacgtggtgtctttcaaacatggttttcagcatcggaaccccggtgggcagcttttatcgacgccatgtatgtaggnca

SEQ ID NO: 10457 - DNA, 810 bp, Sorghum bicolor
  Clone ID: SORBI-28MAY03-CLUS26834_1
aacctgttccaccgccttccacgcgtgcggcgtgtgccatcaaccaagcttgaacgaaacttcttccctttccctttccctttccccctctccgcccggccccgcgctctcgcttcctctccgccaccaccgacaccgccacctccacctcctgccaccaccttgcgcggtggggggcaacggcgaggtgagggcgaggcggggcgatgctggcgtggaaggagaaggtggcggaccgcctcgctcgcctcctcgccgactcccctgtctccccctccccggcacaggccgccgtcgcgccaccgcaggcaaaatctttcccagcagaaccttttattccccccaagacatcatcattatcttcgtatgtattttccctcctaccaacctcaaacttggggcatgagcagaattcaccttgttctgagactttgagaccattacctcctgaatcacttcctaagaaatggagagggagtaatttaacatggaaagatcctcccctggaattgagtgaggagtctgggtctgaaagtgagagagatgaaaggaatgggaatttcggtagcgaccaggtccttcagtcatacaggtccataaataactcaaatggaaatgaggaaacatcgacttcagattgtgcgggcactcttcgttatctgactgaaaagtctatgtttgtgtctccaaaactatttgcattctttcaatcttctctccctgagaccttgaaggggtgccactgggtattgctatatagcacctggaagcatgggatatctctaagaacacttcttcgtagaagtgaga

SEQ ID NO: 10458 - DNA, 675 bp, Sorghum bicolor
  Clone ID: SORBI-28MAY03-CLUS26817_1
tgccaggtaatgcttcgagtgggagatcttgatcgtgctataaatttctatgagaaggcatttggcatggaacttcttcgcaagcgagacaatcctgagtacaagtatacaattgcgatgatgggatatggtccagaagacaaaaatgctgtactggagttgacctacaactatggggtgaaggaatatgacaagggaaatgcttatgcacagattgctattagtactgatgatgtctacaagactgcggaagcaattagagtaaatggtggacgaattactcgtgagcctggtccattacctggcattaacaccaagataactgcatgcacagatcctgatggctggaaaacagtgtttgtcgataacatagattttctgaaggagttggaagaatgagctgtgctagagatctcaacttggtacatcaagctccgtaggggttgccccccgtgagttgcaagcatgacccgcaaaatctttgtaaaagccaccacctcaaacagaggtttgtagataggtcctccaatctacggcatcacaattgatactagttgatagagcattagatttgccttgcagatctatatagatgcgcaatccgtttttgtcagtaaaatcatatgtacaactttccagttacacacaaaatagtcattaattgctccgtctcaa

SEQ ID NO: 10459 - DNA, 1485 bp, Sorghum bicolor
  Clone ID: SORBI-28MAY03-CLUS26890_1
gcacgaggctcctgatgagccagtatatggacttttggtcgatctttggggcaaagccggcaatgttgacaaagcactaggatggtaccaagcaatgcttcaggatggtttgcagcctaacgtgcctacctgcaattcgctcttgagcgcttttctgaagatgaacagatttcaagatgcctacatcgtgctccagaacatgcttgctcaagggcttgttccatctgtgcagacttataccttgctgctcagctgctgcaccgaggctcaggcacagatgggtttgtgcggccagctcatggccataactggacatccagctcacatgttcctgctttacttgcctgatgcagaacctggtggccagaacgtcagggatcacaccgggtatttcttggacatgatgcacagtgaggacagagagagtaaaaggggtctaatggatgctgtcatagacttcttgcacaagtctggtctcaaggaggaagcgggccttatatgggaggttgctgcacagaagaacgtgtacccagattctgtgagggagaagagctcatcgtattggctcatcaaccttcacttgatgtctgagggcacagcagtgactgctctgtccaggacacttgcctggttccataggcagattttgacattgggcactggccctgaaagaattgacattgtcactggctggggcaggaggagcagggtaactggatcttcgttggttagacaatcggttcaaaagcttctaaacctctttgaattcccattcttcaccacccgtggaaatactggctgctttgtcggctgcggggagccacttaacaaatggttgcacaatccttatgttgaacgcatgcatttattgtaagcttgcagtgaggtcattggccaggccagaaataaggcacctatttaagcaggcacagttttgtggaaggatcagcttgggatgaataaagatgtgcaccatatatagttctttccatagggtgatttagtcaggtcaggtgtagtttggtagccaaatagtctatgcttggaaactatttagtgtgattgtggtaacatttagagatggcattgttcgtttagcataaatccctagagtaatttctctcaattagccagtgaggattacccaatcaagtgttccatgttccaattcttcattttaacttgagtgacaggttgacagctgctgctgacaggtaatgttgttgatgaacaagtattgattattgagagttgagacagaagaatcatggctggatgcacattttgatcggtcaagtgcaatcacaacttgatcaacaagaccgtaactattatcattccagattgcactttgtacacctagattgtaactactcatgctatatgtaccccatcttaggttagtgttacaattcagtagcaaatgtagctccctgatcatggccatcttggaatatccttatcttgattgcacattgttggttt

SEQ ID NO: 10460 - DNA, 939 bp, Sorghum bicolor
  Clone ID: SORBI-28MAY03-CLUS26932_1
gtgaagggaagctgcacgaggcttgaccctgagtacttccgacggcagcagctcactgagaaatctgatgtctactcatttggagtcgtgctgtttgaggtcctctgtgcacgccctgccctgagcccctcgcttccaaaggagcaagtgagcctcgccgactgggcactgcactcccagaagaaaggcattcttgggcagatcatcgacccatatctgcaagggaaaatctctccccaatgtttcatgaagttcgcggagaccgcagagaagtgtgtggctgatcacagcatcgatagaccatctatggccgatgtcctctggaaccttgaatttgcactccagctgcaggagagtgcggaggacagtagcagcgtcaccgacgggacatcttcaaacacgtctccacttaccatcctcaggcttcactcggatgaaccaacgacagacaccaccaccaccacatcaacgagtatgagcatgacaggacggagcctcgcaagtgtggattcagatgggctgaccccaagcagtgtcttctcgcagctcatgcatccaggtggcagatgaaaaccgaaaatagaactgcagcctgcagttaatctcttctgatctgctatatgtttctagtttcatggtatatatatatatgacctactagtatagttatcctatatacatatatattcagcatatagttgcttcatcttaataaaaagtagttcatcctatatgtatgtattgtgccagagcctgcagaaatcactgtaatggcaaggtacttccctttaaattatctgcttaaacatgtacctgaggtatgtttctcacttcaaggccgatttgtaatattcacatatatatgaaagtaaggtgtcaccctttgatttccttgattgtaatctccttaactagtaaatgaattgggagacccagaag

SEQ ID NO: 10461 - DNA, 836 bp, Sorghum bicolor
  Clone ID: SORBI-28MAY03-CLUS26964_1
tcctggacgtgggcggggacattttaatgattatcaaaaccaaggcaagttgttcatggcacattcatgtgcacgaggtaaagatcttgctggaatggttgtaactgccgcccactcaggaaaaaggttctatgtggacagtatttgcgacaacatgaatgcagaaaattcgttccctaggaaagagggttatctgggtcccttggagtacagctcgttcgctgattactacaagcagaagtatggtgtggagttaatttagaagaaacaacctcttatacgggcacgtggtgtttcatactgcaaaaatctactttctcctagatttgagcattctgaagctggcaatggagagttctcagagaatcttgacaaaacatactatgtgtatttaccacccgaattgtgccttgtgcatcctcttcccggatcacttgttcgtggagctcagaggttaccctcaataatgagaagggtggagagcatgcttcttgcaattcaactgaaggacataattggttatccagttcctgcaaataagatattggaagccttgactgctgcgtcatgccaggagacattctgctatgaaagagcagagctgctgggcgatgcatacttgaaatgggttgtgagtagattccttttcctaaaatatcctcaaaagcacgagggacagctcacaaggatgcggcagcacatggttagcaacatgatcctgtatcaatacgctttggataaaaacctccaatcttatatcctagcagatcggtttgctccatcaagatgggcagctccaggagtgttacctgtatttgatgaagaaacaagagatt

SEQ ID NO: 10462 - DNA, 1304 bp, Sorghum bicolor
  Clone ID: SORBI-28MAY03-CLUS14026_1
cccacgcgtccgggaaaaccagagctcctgcccgttcctctctccctcctcacggcgggctacgctgactgttccgtccatccaccgccccggtcgtttctctcccgtccagatccctctcctgcaaggtttctttgagagtgggcggacaagatgatgggcgggttcctctccagggtcctcctgttggcttttggctatgcctatcctgcctatgaatgctacaagactgttgaactgaacaaaccagagattgagcagctcatattttggtgtcagtattggattttagttgccctgttgacagttttggagagatttggagattttacaatatcatggctaccgttttactcggaagcaaagctgatgttctttgtatacttgtggtaccctaagacaaagggaactacatatgtttatgggactttctttaagccatatatttctcagcatgagaatgaaatcgaccggaatctccttgagctgagagctcgagccaccgatatggttgtcatttatttccagaaggctgcttcggtaggacaaaatactttctttgacgttttaaaatatgttgctgcccagtcaccttctcagaaatcaaggcagcgccctcagcaggaatcacagcaaccacaacagcagcaaccacaggtgcaggtgcaggtgcagctgcagcagccgcaacctcaaaaacaagcagcacctgttatgcgcagagcagcatctattgctgctcggcaagcagcaatggcacagcaatctcaggagactaaacccgttccttcatcgcccaagatcaagcgtcaaacatcagggaaatctggttcagtggcatccacaaagcctgcagcagctgcatccacaccaaaacctgccggtagcccaaagaaaggtgaggtcaaacctgctgctgatccagttcaaactccagccacaagtgccaattcaccgaagtccgagcctaatgccccaccactccctgaagccgaaggagtagacaaaatggccattgatgaggtcagtggtgatgctgcagagggcgcagaagagcttgaccctgcgctcgaggagacgccaatggaggagacgatccgtgtgacgcgcgccaagctaaggaggcgcacagccactgaggatcctgctgggaattaactgcaggccgttgttttccctgcacattgtgttgatcttttttttcttttttgagttttaggctgtcatgtttggtggaatggagatatgttgttgttcacttggttcttgtgacacagttaattatcttatttctgtgctttctt

SEQ ID NO: 10463 - DNA, 730 bp, Sorghum bicolor
  Clone ID: SORBI-28MAY03-CLUS14150_1
cttcctcacccactgcggctggaactccatcctggagagcgtgtgggcgggcgtgcccatgctgtgcttcccgctgctcacggaccagatcaccaaccgccgcctcgtcgcgcgggagtggcgcgccggcgtgtccatcggggaccgcggcgcggtgcgcgcagacgaggtgagggcacggatcgaggggctcatgggcggggaagacggcgtcatgctcagggagcaggtgaagaagctgaggggcacactcgaggctgccgtggcgcccggtggctcgtcgcggcgcagcttcgacgagttcgtcgacgagctcaagcgcaggtgcggaggcagccactgatccgcgcagtttctcggcgagctcaagcgccggtgctgatgaggcagccactgatccgaagctcgcggacaggagcttgaggtgggcctcagaaagtcagaatacgtgtgcgatgtaggccttgtatcgtagcgtcagcttgtaccgttttgtattgtaaactggcttcatcatcgaagcgtgtacggagtatgtatgctgtgtacggagtacggtggggtattactgttgtgcaggtttgatgtgatgtctacctagtacataggtcttgtttagttggtaaaaattttcaagatttccggtcacatcgaatctttggtcgtatgcataaagaattaaatatagacgaaaataaaaactaattacacagtttatctgtaatttgtg

SEQ ID NO: 10464 - DNA, 1032 bp, Sorghum bicolor
  Clone ID: SORBI-28MAY03-CLUS14220_1
gtacgagggcaatgattgtggcatatgcagggttggtggcaaggaaaaattcttccactgtgtaaagtgtgggtcttgctattcggttgaactgcgtgataaccatcggtgcgtggagaactcaatgaggcagaattgcccaatctgttatgagtatctatttgactcattacaaggaacacgagttcttaactgtggacacacaatgcacttgacatgttttggagggaaggtggtggctaggagatacacttgtccaatatgctctaaaacagctcttgatatgacacgtcattggggggtgttggatcaagagatcgaagccacaatcatgcctgttatatatccatatttgatttgggtgctttacaacgactgcaacaagattgcagtgatcaactcccatgcagtcgccctggccagcacccactgtagctcgcccaacacccgatcaacatcgcgccctgcggattcatcgggaagcagctctccttcgacagactcatccgacaacaacatgtagagaagagaaaaccagtggtgccagaaccaatacgacagaagaaatgaagaaggaacattgttttgcggcgtgcgtgcctgccaaacttgaagactcccagccatttatttgccctcgttttgtcaagattcgactcaatccatgagtcttggctgtcgtgggaaattccagcttcggcattgctgggttaacccacatggccagcgtagatgtttgttggatcttggtcgcagccagtcgtgattgtatcaccgtgggtgaaaacccagcatgttatgaatcgcatacttactgtaagctatatagcagaagatgggtacggggtacccctccctgatgatgcctggtctgtgtgtatgtgcgtgtggtgaactgttcctgaattgccgtgctgctcagtagcactaaatattgcgtttgggttttctgatgatctgtcagggacccccaaagtgtgcagtgaaattgtaatggcattacacacttgcaatgaataaataaaatcttat

SEQ ID NO: 10465 - DNA, 762 bp, Sorghum bicolor
  Clone ID: SORBI-28MAY03-CLUS1462_1
ccggaattcgcacgccacgctccgctacaagaacatcaagagaagggctcagaaagcagaggttggcggtggcatgactggtcctgcttggagatcgactctgtggagcattgtcgggacggtgaaatggtatggaataggagtggctctcatctacgccgtcacactgtccattttcccagggtacatcacagaggacgtgcactctgaggcgctcaaggactggtaccccatcctcctcatcagcgcctacaatgtgtttgatcttgttggcaaggccctgcccgctgtctacctcctccagaatggcaatgtttcagtcgcgggatcctttgcacggctcctgttctacccgctcttctacggctgcctgcacggaccaagttttttccgcactgagatcccagtcaccgtgctgacatgcctcctggggcttaccaatgggtacctgacctccgtcctcatgatcctcgcgcccaaggctgtgcccatccaccactcggagactgctgggattgtcatagtgctgttcctcgtagttggtcttgtcattggttcgtttgtgtcttggttctgggtcatctgatactggggacctctctctgtcacgtcgatgtatcatagcaccatgttcgtgttctctgcttttgatttgccacacagtgacaacttgttagtgtactgtaaacccaggtgaaaagatctgggaaatctgtaatttattacaactcatggaattgatggtgaccaaatgttaatgtg

SEQ ID NO: 10466 - DNA, 1532 bp, Sorghum bicolor
  Clone ID: SORBI-28MAY03-CLUS12960_1
ccagttggtgctttttcacgacacgccttcgtttaccctgcaacttgaacagctggaagcttgccctttcatactgtgatacttagataagtgtgtagcgaccctttattactagagtttcagggataacaccctggtccatttgcattgcatcaggattaaaagtcacaatcagttgcagcccaaacttgccattttggttggtcaaaaccacctgctcatggattttgtccaaactactcacagggttgtcgttcacatgtgtaacctcttcgacatactagattttctatagaactaggtagaaaggttatctagcaagatgatagtatcgttcagaacttgatgctttccactctactacccttgctattagtttggatacgaccaatctacactataaaaggcctccacatatttattcccttttgctgcatgcacaatttggttgcctggttgcaaatgaatttgctacagatttattcccttttcaaaattacatgacatattttacgttgctcaacgacaagaaatcattctaagatgatttgcactgcctatttattttctttgattggaatggggttggctaccatgatgacttacgaattggaatcccaaactctgggttcatctatggtgggtaataatgaaaacatgtaagttccactcagtttttgacccatagactgatctggtattaattgcctgaagctgaggttagtagactatgctaaatacaagcatttttgtagtacatattctaaggatccagccaaaaagtctgttttcttgaatcttggatttttctcctatttagctctgaatgaattttagaatcactggtgctggtgccatttgtcactagtgtcaatagtaaaaggaaacgaaatgttgcagcgtgatagtattataccactattatcaatcggattgctgttacaatagtaacttgcagtgcagtatattcaatttgctagtaattagcaacttggtgacattatttgctgtttgtgcttgtcataatgtagacgatctgtgtttcttgcctctgttttctgtgtttctttgggattcttgtagatggtggatgtgcctgggtgccgactactgtttgaacgaactgaccacgccctcattttctgccagcatcggatgtttttgactgactccagtatgtactgttgctgaggtttaaattgtaaaattcccatcccgtagttcgttccttaccaactaatgcacatgcacccaaggtgtaaaagaaaattcttgtaatttattcacaaatatttctatacaagtttgcagtgtaaataaatataacaatgttcgtttcaatagagtgcacctactaattaatgtacctgctccttgtaaataaactcttgtattcgtaaaactttttttaataaaagtttcagtgcgagaaaccgatgtaacattcagtgtatgacgactaattaacctactcgaatgtaaattattgtagtatattcttaagggcatggatgaagtttctggtaaaaaaa

SEQ ID NO: 10467 - DNA, 1217 bp, Sorghum bicolor
  Clone ID: SORBI-28MAY03-CLUS13148_1
atgcaaatggggatgtggatacccttactttgctgtagtcctgaacttcagtcaatattgggccctatactgtttagtggaatggtacacagctactaaggatgaattggcacatattaagccattggctaaattcctttccttcaagtctatagtgttcctgacctggtggcagggtgtgataattgccatcatgtattctttgggcttggttagaagcccgttggcacagagcttggagttaaaaacaagtattcaggatttcatcatttgtatagagatgggcgtagcatcagttgttcacctgtacgtgttccctgcaaaaccttatgagctattaggtaaacaatattcgcctacaaacatttcagtactcggggactacgctgcctctgatcctgtggatcctgatgagataaaggatatcagtcgacctaccaaagtgaggcttccgcagttggaaccagatgaaatagttgcaactaatacgggggcgccggtgcgagaccttgtgatcggcagccgcgtttatgtggtaaaagattttaagttcactgttaaccaagcagtacgaccagtggagaagcgctttgacaaaatgaagaagaacatcaagtttaggcaaagccgggatgacaattgggtgagcgcatccacaccagagagaacaattcgtggtattgatgatcctctcataagtgggagcgccagtgacagtgggatcgttggtaaagggaagaggcatcgaagggattcgagctcagctgccgccgttgacagttgggaaggcactgagcaggcacctgatagctttgtcatacggggtcgccggtgggaaatcaaaaaatcgtgatcctctttatgtacccttccgttcaaaccttggttattgaagatacgctactgccgttgacttgctgggttgctggtgaattttgcaactagcatgaagcttggtcgtgccatacactacattgctgaaccttctgtgtggtaaaagtggtagattgtgcacgtagcacgcaattgtcttgttgattcctgctgacatccccgcacaaggaactgtacgtgctgacattagccttagccactgactaaagagtacgcttaataagttgtaaagtctacggtacattaagttcatgtattgtctgtatataagtttggtctcgcatatatgtagatttgacagtttttttccttcgttacttaat

SEQ ID NO: 10468 - DNA, 1342 bp, Sorghum bicolor
  Clone ID: SORBI-28MAY03-CLUS1327_1
gcacgaggggaaaaggaaagctggttgggttgggcggcccgctccccttcgagaacgccgccgccgcccgctccccccatatccatctctgtctcctctcctgttgatctcttctctcgcggaagagctcgcactcagaggacagagaagagaggaggagatgaggaagctagtctcctcgcgcctggcggcgctgtcgtcgccagaggtggcgtcggccgcggccgcggcgggaggcgccgcgctggcgctgcggggctggtgggaggaggtgaacgactcgccggcgtggcaggacggggccttcttctccctctccgccgcctacgccctcgtgtccgctgtcgccctgattcaattaatcagaattcaattgcgggtgccggaaattggttggaccacacaaaaggtttttcatctcatgaatttcattgcgaatggagttcgttcaattatatttggatttcatgcatatgtgttccttcttcaaagaaaggtgtatactttagtgctgttagatcttcctggtctcttgtttttctcgacctacacattgcttgtgctattctgggcagagatataccatcaggctaagcatcttcccactgacaagctaaggactatatacattgcagttaacagtgtcatatatgtaattcaggtttgtatttgggtataccttggaataaatgacaatcctctcgtggagcttgtgagcaaagtattcatatcagctgtctcatttatagctcttctaggattcttaatctatggtggaaggttatttgtcatgctgagacacttcccaattgaatcgaaggggcggagaaagaagctgattgaggttgggaccgtgacagcaatttgctttacctgcttcttgataagatgcattgtggtggcattttcatcctttgatcccgatctatctcttgaggttttggatcatccagttttggatttcttctactacatgttgacagagatactgccctctgcccttgtactattcgtcttgcggaaacttcctcccaagcgtgtatcagggcaatacaactctattcgctagaagattttggcatgttatgctgagaaatcctgaaagaccaaattttcctagaattatgtttgtcacagagcgaactgtgttatttgagcatggcctctgagaggtattttgtcatcttagcgccatggctatatgatataagagtaccccggtgctaaagggccaatttctggggggcattatatatattatattaatctccctgtacaagtgacttgtctaatttttattaactgtctaacggaaagaacagtttcagttgattgattattt

SEQ ID NO: 10469 - DNA, 726 bp, Sorghum bicolor
  Clone ID: SORBI-28MAY03-CLUS13325_1
gcggcgaagatttgacaagcgtatctacattccgctacctgacttgaaagcaaggcagcatatgtttaaggtccatctcggggatacaccacatagcttaactgaaagtgatttcgagagcttggcccgtcgaacagatgggttttctggttctgatattgctgtttgtgttaaggacgtgttatttgaacctgtgcgcaaaacacaggatgccatgttcttcttcaaggcggacggtgacatgtggatgccatgtggaccaaagcaacccggcgctgtacagaccaccatgcaggagcttgcatccaaaggccttgctgcaaagattcttccaccacctatctcaaggacggattttgagaaggtcctgtcgaggcagaggccgacagttagcaagaaggacctggaggtgcacgagaggttcacaaaggagttcggcgaggagggctgatacatcgctcgaggacgcacacccatgcacagctgcaccacacaaatgtatattgtttatgacgactttgattgttctgcttggaagttgcattcacaggattgtacatttggtagcccaactacgactaatcatgtcagctgctttctcgtgttgggctatcgatgggcctctgttgtcaacttatttcatttttattattacacatggaaattttccacaggtgtattatggaataataattcttaacgtggagtccttgtggtgcatcccgt

SEQ ID NO: 10470 - DNA, 766 bp, Sorghum bicolor
  unsure (1)..(766): unsure at all n locations
  Clone ID: SORBI-28MAY03-CLUS13413_1
nnnnttactgcgtgggcctgctggccgccggctactgcatgttctcgagctcggtgatcttcgtgctcaccggcggcacgggggtgtacgtgttcacgctggaccccatgtacggcgagttcgtgctgacgcaggagaagctgcagatccccaaggccggcaagatctacgccttcaacgagggcaactatgcgctctgggacgacaagctcaagaagtacatggacagcctcaaggagcccggcgactcagggaagccttactccgcgcgctacatcggcagcctcgtcggcgatttccaccgcactctgctttacggaggcatctacgggtaccccagggacaaaaagagcaagaacggcaagctgcggcttctctacgagtgcgcgcccatgagcttcatcgtcgagcaggccggtggcaagggctttgatggccaccagaggattcttgacatcacacctacagaggtccaccaaagagtgcctctgtacatcgggagcgtggaggaagtggagaaggtggagaaattcctggcttgaatgtccctgctcgatgccagagctatctgatcagatgaactcccgaagacaaacaatgcagtatatattgtagatttttcttttgtgatggggaaaaatccattttgaagaaattacgttctggagttgtgatttgttaagtctatgtctaactagatcaagttataaggggatgtgtgtttcctccgtcccaaaataagtcttcatctcgtatttgggaaatc

SEQ ID NO: 10471 - DNA, 928 bp, Sorghum bicolor
  Clone ID: SORBI-28MAY03-CLUS15051_1
ttggaggatcatatccaccctacatagcccttgatccgagtttttactccagatcttcaggacagacatcatcatcagttccatccagggaaactagtgctaatagagggtctaaatctcctcctcgaaatgatatggggaatgaggagcttgatcagcgccagaacaagcctaggagatactcagagatgaacttcagccagtgaagcatcttgtaaggtggactgcatctgaataagcttcttatggccctatttaggccctttgtgatctccagttctgatctggagcactttgggtggctttggtacccttaattatgttaggtcttatgcctgttcgtgctgggagttatctgatggggtcacttcacagagagcaggggtggcattcgttacttgaattgttgtattgcccggttgtgctgtgtcaggaaatgtcaaatttgttggtgcgtctgaagatgtggacggttgttgaagagagcttgaaaataatggtttgcgttggttgataaagtttaagagttttttttttaagtacatcttgttagtgactccagttggtgtcattctactgtgatgtaccggtccgcatatagtggctgcttaagaccaagcggcttcattgccgcagcttgtatcttttggaatccgttgaaatgtgggtgcggtttgtgactttccagcttgaatgagcgtgtccaacatgatttttcggttacctgcttgaaaagccaacaagaagaatccgcccgtcctttttaccccgggggatggaaatttctatttcatggtgaaagttccaaagaacagtgttcaattctgtaattggggaatgaaccgcatgtcatcttactgaagctagaaacgagcagcaagttttaatcaaaacctgcttgaaaatttgttagaaggccattgttgtt

SEQ ID NO: 10472 - DNA, 962 bp, Sorghum bicolor
  Clone ID: SORBI-28MAY03-CLUS15207_1
acttcacccagttccttcttgacagcgaggatgattcggatgcctttgaaccaccagctttctgcaagtttggtagcatgaaggcaagttccaggaatccactatccaagctagatgagtgtgatgaggaggatgaagatgagaccgaggacgacgaagatgatgacatcttgaccagtgcattgccccagaagattccttctatctccaagctgtcgtcgtccatgaaggggcttggcttcatcgggaaatctaaactctaccgtagaggagttccaaagggtaaagtgacaggtagaactaactacagtggcaaagctagtgagcatcagtccgggagcaggagcgccaacgagctgctcccgcccagcgccagttttgtgaagctgtcggacatgagccctaaagagtggagtgcattccttgagaagttccaggagctgctcccaggtgccttccacacccggaagcacactgctggtgttggccagcgtccgatgccgaggctgggcacgtcttgccagttttgaaagtagtagaagagaagtcaccaaggtaatgaatgtacaacttctgttcgagctctggcgtggtgtgcagcagctgcagcagccagcaggtatattatatatgcttgttttaggtgtatggagccggtagaggtggtccgagaataagatcgtccatggcgggcatatgagatgagctcgcattgcaggtgaagagtggtgtgtttgtgcatagtgtttgacatgtgagatgcgttgttcttttcttctttgtatatagtaagaagtactcctactgcctcgcagcaccgggctcgggctcgatctcggccgtcgttacctgatggtggtggtgagtgtgctggcatcgttgccgctgtaccattttggagacgcttaccataatatgaactatgatatgatattgctacagatatatatgcataaatgttc

SEQ ID NO: 10473 - DNA, 668 bp, Sorghum bicolor
  Clone ID: SORBI-28MAY03-CLUS15276_1
gcacgaggatgacatcctacagggagctctcaaagaaagcacagaaagcgaacaacatctggtggaggctgagcggactgctgggtgaccggaaccggcaggtcatgtacatactactccaggcgctgttcacagtggcaacaatggccctgaccgtccctatattcctgtcgtaccggatgcacgtggtgttcctgatactcaaggtgtgcgcgtcgacatggaatggtggcagcttcatcttggaggtgatgcctcgacaagtagtacagaagcagcagaagaagaagctggacatgaagcccatcgaacaggggagctcgacacaaagtgcgccaggtgatgatggtacattgggtaaccaccaccatcacacatccgaggagcaaatccaggagtgaggaaattgaagctggatgtaagattagattttgctgtttactgatgcaacctttgtttttactgagtgttctttgtgttgtttttctttagctctgcccaagttgtgatatctataggtttaggttgaatgatatggggctgggaatatgatgcgtgcccatgtttgtcaggcttgggcaaagataacttcttcttctcgctgtggcagttgtgaattgcgtgaagctgttgcattgttcgtttgaagatgatgattcgatgatccc

SEQ ID NO: 10474 - DNA, 1382 bp, Sorghum bicolor
  Clone ID: SORBI-28MAY03-CLUS15283_1
gcacgagggtccttcagactataacagaacttgaagagaacatacaggaagggttatcagttgccaaaaagaaagagaggaaaattttatcccatgccaaggttgttggtacagcttgtgatgtctgtaaacctgaagatgtgaagaaattagtgaattttgctattaatgagcttggctcagttgacatttggataaataatgctggcacaaataaaggttttaggccactggtaaccttttcagatgatgacattactcagatcgtctcaacaaacctagttggctctctactgtgcactagagaagccatgaatgtcatgcaataccaagagaaaggaggccatatatttaacatggatggagcaggttctggaggatcaagcacaccactgacagctgtctatggttcaactaaatgtggactagcgcggggccaaggatcacttctgaaggaaagcagaagatcaaaagttggagtgcacactgcctcacctggtatggtcctcacagaccttcttttaagtggttcatccatcagaaataaacaaatgttcaatttaatatgtgagcttccagaaacagtagccagaacattggttccaaggatgagagttgtaaaaggaagtggaaaggcaatcaactacttaacaccaccgaggatcttgcttgctttggttactgcatgggttcgacggggccgatggtttgatgatgaggggagagcggtgtatgcagctgaagctgacagaattcgcaactgggctgaaagtcgagcacggttctctttcaccgatgccatggagatgtacacggaaaacacatgggtttctgtattctcactctccgtggtttgtgcgttcataattctttccagctcaggtggacctcttccaggcacatgatttccagagttgccaaactagtagatggtcatacatatactcaattttgtcaacaccaaaggcattctactatgggaaggtatatgacacaacacttatgaatggggaagaagagaacccccacaaatgtagataggtgcaagggagattagctgctgcttcctcgcaccatttaaggtttggctaaccatgtgctcagagaagggtaaatagaatttgttgcgtgggcatccactgccgtaagttagactatgatctgtgactttttttaagaacatgtatgcaaagttaactgagcaggatcagattgcctcgtgtacatgcatgtagtaatgataatcactgtaacttctggtctcggttgtacccttcaaaactctaaatagcgctacattatatgtgagtcgaagaagcgaagtagcatgcaccatatatgtatactgttcatcataagaaaccctgggggtgttatgtggt

SEQ ID NO: 10475 - DNA, 783 bp, Sorghum bicolor
  Clone ID: SORBI-28MAY03-CLUS13624_1
tcaaagaatgggagattagaagttctgctgttagtcgactggtatactgcatcaatagcttcagagaagctgcactgtctaatgaccagaagtttgaacacatagacgtgtcagaaaagcaaacgcgtattaatgagtgttcggaagcagagacttggctaatagagaaaaagcagcagcaggatgctctgccaaagcatgctaatccggtccttcttgccgctgaccttaagaagaaagctgaaacacttgacaggttctgcaagccgattatgacgaaaccgaagccagctcctaagccacagactccgcctccggtagaaacccaggctcctgagcctcagacaccagagcagcagcaatcaaatggcgaaagcgcagccagcgagggagctgcagaggagcctccagccgagcagatggacacagacaaacctgagggagccacagatccctcggcctagctttgccgttgatcaaacatttgtgtgattgaccctgttcacctgctgttatagtcggtagggttgtgaactaagcgagatggttgttcggtcacatttgaggatgtgtgttgggacgttttatgttattctgtttcttgtttcttgacaaaggaggtggttggatggttaaggattaagagcagtggggtacacattctcaggtttttcccccatgcgctcgatgtaatctttattgatgatggtccgtaagaccgtgggtaaatgtcgaatccgaatttttcgtgtttttttttgtaaaggtttttttttttttttg

SEQ ID NO: 10476 - DNA, 1080 bp, Sorghum bicolor
  Clone ID: SORBI-28MAY03-CLUS13847_1
gattgttattgcttaatccaaatgaaggctgagtacatggaagcacttggtcttctaaataaaaggaaataaactccataagtcccctaattcttgccctcttcaatcctcttaactctttgccttcatgctgatacctggatggtgctgctgctggcgccattcatggtgatccctgcaatattgttgccgctggcgccatctatggagtaataatggtggcctcacatgacatctttattcactgctttgttattaagatgtaagccaatattgctaacagtgcacacaaaattcttggcaggctctatgcattcgatgttcactgtaactcgttctttcctgcgtttgtcatcctatatgtcgcgtccgattttctgtcgcctctgttggtcgcacatggcttctttccagctttgttatctaatctactcttcgtggtggcgatttcttattatcactacctgaactttctaggatatgatgttcttccatttctggacagaacaacattcttcctgtacccgattggtctcgtcatcatcctgtctccacttatgatactgatagggttcaatccgacaagatactttctaagcttgtacttcggttaaagtctacggctagaatgccaagtacgagaaaaatatggtgattggtgacagagctaatggcagatctggatacatactctgtagtaaagcattttagatctcttgtgttaacgggggcgagtgaggttcagaaaagctcggagcattcattctttggatgtatcaggtgcctgtggcaggctaccaatagaggacaaaagccttttgattggtatcaaatatccctttttggtgtcaatttgtttataatatgagccgttttctttagtttgggccaccggcccagtgatcagtgtatacttgtagtgggtattgctacgtatagtctattgtaacattggcatcagaattgcatcacgttctactaccatcagtcatctcttgccaggtttattgtaaggacatgctcgttgtcgccaaagctcaatttctcgccgggcaaacacaacagtccggtaatcatcgc

SEQ ID NO: 10477 - DNA, 727 bp, Sorghum bicolor
  Clone ID: SORBI-28MAY03-CLUS13873_1
gcgcgtcgcttcaattgttggtcgtaacaatggtggtgtgatcgctggcctcgtctcatgtgggattgtgatggggagcatgtctaatagcaacaacctgatgcaagacctaaagacagggtacttaacactaacctcaccacacgccgtgttcatcagccaggcaatcggcacggcactagggtgcatcatcaacccaatcatgttttggatcttctacaaagtgcaaaatggcaacgctgacatttttgacgcgccctatgcccgagtgtaccgcggcatcgccatgctgagtgctggccagaacgggctacctatgcactgcttgtggctatgcaagatcttcttcacactagcgctagtgcttagcatgtttcgagagatggccacatgtaagcagtggcgcgtggcacaatacattccgagcaccatctgcatggccatcgccattgtaatgccagcacgcatacccattgacatgtttgtagggagcttgctactgtacttgtggaggtgcgccaaccctagcaaggcaccagcgtactcaatggcggtggcatcagggatggtctgtggggatgggttggggatgctactaacatcggcaatggcacttacacaagtgcacgcacccatttgcatcaagttcttgtctcgtaccgataatgtaaaaatggatgccttcttagctacactgcctatgacatagcttcatgggtgcatattg

SEQ ID NO: 10478 - DNA, 1013 bp, Sorghum bicolor
  Clone ID: SORBI-28MAY03-CLUS13680_1
atgaagctggaggaggcgcgtcggctggaggaggccaggcacgccgaggaggctgctctggcactggccgagatggagaaggccaagtgccgcgcggccatggaggcggccgaggcggcgcagaggctggccgacctggaggcgcagcggcgacgcaacgccgaggtgcgcgcgcgccgggaggccgacgagaaggtgcgcgctctggatgccatctccaaccatgacttccggtaccgcaagtaccacatcgacgagatcgagatggccacggagcgcttctccgacgagctcaagatcggcgagggcggctacggccccgtctaccgcgcctccctggaccacacccccgtcgccatcaaggtgctccggccggacgcgcaccaggggaggaagcagttccagcaggaggtggaggtgctcagctgcatccgccaccccaacatggtgctcctcctcggcgcgtgcccggagtacggctgcctcgtgtacgagtacatggagcacggcagcctggaggaccggctgttccgtcggggcggcacgccgacgatcccgtggccgcagcggttccggatcgcggcggagatcgcgacggcgctgctgttcctgcaccagacgaagccggagccgctggtgcaccgggacctgaagccggccaacatcctgctggaccgcaactacgtgagcaagatcagcgacgtcgggctggcgcgcctggtgccgccgtcggtggcggacagcgtgacgcagtaccggctgacggcgacggcgggcaccttctgctacatcgacccggagtaccagcagacggggaagctgggggtcaagtcggacatctactccctcggcgtgctcctgctgcaggtggtcaccgcgcggccacccatggggctcacgcaccacgtctagaaggccatcgacgccggcaccttcgcgcagatgctcgacatcaccgtcaaggactggcccgtcgaggaggcgctcggctacgccaagctcgcgctcaagtg

SEQ ID NO: 10479 - DNA, 417 bp, Sorghum bicolor
  Clone ID: LIB3480-011-P1-K1-F2
actagttctaggccgctcgcgatctagaactagcggctgcctcgtgtacgagtacatgggcaacggcagcctggacgactgcctgttccaccgcggcggcggcgggcaggtgctcccgtggcagcaccggttccgcatcgcggcggagatcgcgacgggcctgctgttcctgcaccaggcgaagccggagccgctggtgcaccgcgacctcaagccgggcaacatcctgctggaccgcaactacgtgagcaagatcagcgacgtcgggctggcgcgcctggtgccgccgtcggtggccgacaacgtcacgcagtgccacatgacgtcggcggcgggcaccttctgctacatcgacccggagtaccagcagacggggatgcttggggggaagtcgacgtctactcgcttggcgtgacg

SEQ ID NO: 10480 - DNA, 632 bp, Sorghum bicolor
  Clone ID: SORBI-28MAY03-CLUS13876_1
ccgggccctttgcctctcgcgcgtcgtcctcgcgtgtcgcggcacacgctcgcctaacttcccttcctcttcctgtgagactgtgacctcctccactcctcactccctccctgctcgtcttctcttctcggccgtcgcctgacccgccgcgtcgagacatgtccaactccaagaaaatcgtggtgaagctggacttgcatgacaacaaggacaagcagaaggcgctcaaggccgtctccgtgctcgtcggcatcgacgccatatcggtggacatggcggcgcacaagatgacggtgatcgggacggtggacccggtgcaggtggtgagcaagctgcgcagcaagtcgtgggcggcgcacctcgactccatcggcccggccaaggagcccgagaagaaggaggagaagaaggaggagaagaaagaggagaagaaggacggcgacgggaagaaggaggaaggggacggcaagaaggacggcggcgacgggaagaaggaggaaggcggcgagggaaagaaggaggaagcaggtgatggcaagaaggacggcggcgagggaaagaaggaggacggagatggcaagaaggaggaggacggcaagaaggaggaaggcaagaaggaggacgagaaagag

SEQ ID NO: 10481 - DNA, 977 bp, Sorghum bicolor
  Clone ID: SORBI-28MAY03-CLUS13746_1
gctcgcgcctgcccgccgctccctgtcgtctttcgcccccccccccccccgtcccgcgtccgctgccttccttcccctcttcgccggcgacccgcacccccggctttcctccctcgtgcccctctcgcccccggcccacgcttgcgccccccgcctccttctccagccgctccgcatccctcacgccccccaccagcgacgagcacaacttggccttcttcttgccctcaatctactcgtgaagccatagcgctcgcgtgagataactcgtattgatacacacattgtgtttcgcctccttcctccactggcctaagtattacgcggaccgacagtgcggttgacttccctccgccactggcctactaccaacccgggccagtaaaaactgctggtcctccgagccctgagccttctacccaggcgcctggatgggaagccttccaaagataaagatgtgcaggcctcatcccctgcaaagcgacaagctaatgcaactaatggtgtgcagccctcaacagccaccacctcacagggcagttcatcacgtaagaccacaggaaaacttgtctttggctctggctctggtggaagccgcactgaaaaggcacctgaaaaggaagcaaaggaggagccaaagaaagaagacccaaaattcacagcattcacaggaaagaaatactcattgaagggctgaataaataggaagataatgtattatcagtatttccagtgacatacatggtcagggaaaacctttttctgtgggagggccttctttgggtagattactgtctgtttctcctgaactgtttacccctgtgtcagccacaccggaagcaactgatgtataaagccattcttgtccgaaatggatttctgctgagcttgcatgtacatattatcgtcttatactagcaaaaatgctgtgaaacatatagcttgtgcaatcatatggacggcttgggttcagagat

SEQ ID NO: 10482 - DNA, 439 bp, Sorghum bicolor
  Clone ID: LIB3480-006-P1-K1-C6
cgaacttcacattgtggtgttctggagttcattgcggaagaaggcatgatctacatgccatattggatgatgcaaaatcttcttctgcaagagggagatatggtgttcataaaaaatgccaacctccccaagggcacatatgtgaagttgcagcctcatacaacagactttctagatatttcaaaccccaaagcaatcttggagaaaactttgcggaacttttcttgtctaactacaggtgacagcattatggtagcgtataataacaagaagtactacattgatatagtggagacaaagccctccaatgctataagtattattgagaccgactgtgaggttgactttgctccaccacttgactacaaagaacccgagccagtaaaacctgctgttcctgcaagcacagagcctactaccgaggctccagcttaagaag

SEQ ID NO: 10483 - DNA, 875 bp, Sorghum bicolor
  unsure (1)..(875): unsure at all n locations
  Clone ID: SORBI-28MAY03-CLUS15974_1
nnggccgggcccgggaaaaaaaaaaaaaaaaaaaaaatcccatcagacggcgcacggcccagcccaacagaccccccgcttcctctccgacccaccccgcgggtgcggaagcttcttcgtcccatcctccccggcggtccgggcatctcccccatttcgccgccccctccgacctcgccgctctcctctcgctccgttggattaggctcttcatctgctcgccgcagttcgtccgtcgcccatggcggatgaggaggtaactgatccaaaggcgctcctagaggaacgctcaaaggctaagtgtgtgtcgcagtggtatgaatatcagaaatgtgttaagaggattgagaatgacgagactgggcacaagcactgtaccggccagtactttgattactggaaatgtgttgacaagaatgttgcagagaaactctttgagatgttaaaatgacaaggaaagttttccctccagttattatccacccaaagttggtaataattgtatcacttgtgcgccctatagactattaaggcacttaatatttgtcagagaagttttgcctcttgggtaacacaaattttccactgccagtttgcatttcatttctgctactagtattgaaccagcaggtttcctcctgcattgttggataaaaatcaatggaatatttccaagattgtggctgagcattaaatgctgttatatacattaattgcttttatggtttacggtgtattttgacgagcacataaaaaatcattcgggtcctaaacttggatgagatggaataacatgtgtacattacttctagctggtggtaatgatttgtcatgaacagaagtttgtagtactgcactggaatgaaacattgtca

SEQ ID NO: 10484 - DNA, 1082 bp, Sorghum bicolor
  unsure (1)..(1082): unsure at all n locations
  Clone ID: SORBI-28MAY03-CLUS15993_1
gccggccgggccgggccgttgccagctctctctctctctctatcgcattgctcgagctcagaaggcaggcacaagcagcacagccatggcgaactctgcgtccggcctggcggtgaacgacgagtgcaaggtgaagttcagggagctgaaggcgcggcggagcttccggttcatcgtcttcaggatcgacgacaaggacatggagatcaaggtggaccgcctcggcgagccaaaccagggctacggcgacttcaccgacagcctccccgccgacgagtgccgctacgcaatctacgacctcgacttcaccaccgtcgagaactgccagaagagcaagatcttcttcttctcctggtcccctgacactgcacgtacccggagcaagatgctgtacgccagctccaaggacaggttcaggagggagctggacggcatccagtgcgagatccaggccaccgaccccagcgagatgagcctcgacatcgtcaggagccggaccaactgatgatcatctttccatccatcaccaagcaacaacaacaacacacaacacaaccacctccattatatattatcatttattaatttcagacccacccactgctaatcgtccatgagagattcatccgtggactagctatgctccatctctttcgtacgacacacaatttgaaacctttctattttactaatttggactatgctcgatctctttcgtacgatacacaatttgaaacctttctattctactaactattatgtattccaggttcattttacttgtaaccattcctcaattctttctgtaaggatcgaccggagcatgtacgtggctatgcaaattgttgggcataagaatgcattttgtttatgtaatatagaaatttatatattttgagcaacaagttcttgagaacaaagaggaaaaaaaaaaaaaaaaaaaaaaaacaaaaagaaaaaaaaaaaaaaaaaaaaaattttttnnaaaaaaaaaaaaaaaaaaaaaaaataaaaaaaaaaaggggggggcccttttaagggatcaaagtttacttccccgggtttgcaaggttataattttt

SEQ ID NO: 10485 - DNA, 829 bp, Sorghum bicolor
  Clone ID: SORBI-28MAY03-CLUS16079_1
gcacgaggagggcggcggcggtggcggcggtggcatgccgggcctggggtgcacgaggggaggtgccaacggcggcggcggtggcggtggcatgcattctggggcagagatgcttcaggccgccgcggcagccgggaaccccatggcgcagcagcagtacatggccctgatgcagcagcagcagcaacagcagcagatgatgatgcagcacgggcacggcggagcagggtacccggcggcgatggggtacggctatggccggccaccgatgcattacccaatggggtacccaatggcgccgcactcgcatgctgacaattacaacatcttcagcgacgagaaccccaacagctgctcggtgatgtgatcagcatgggatcgatggtgccggcaagttgctccctcttgctgctctgttccaagtgaaacaaccatctgaaggagctcaatggccactgctgatcactgatggacatcgccatggttggaacgccgtgaagcaatcaatcgtcaatcaggatacttggggatgatgagtcttcctagctagaatctatctactatctatctttttttttttctcattttcgccttttctttcaaaaaaggaacttccttgaatgcgaagttaggtatagtaattatgaatagttttcatcatcataagagaagaggaggaagatggggccttgatagccacccacccaataggggtggttcgcttgtggcttcgtcccttctggcttcataaaggtggactgatggtagaacaatgttgtcaatctcagtaaatcagtgtgtggaaaaaaaaaaaaaaaaaaggccccta

SEQ ID NO: 10486 - DNA, 780 bp, Sorghum bicolor
  Clone ID: SORBI-28MAY03-CLUS16344_1
tggcggctgatcccaaacatggcacagggccttaatggtggaaacggtgctcctcctcttgttgctgttgtgaaaaatgaactttatgctgctgactatgcaacgaaggaggttagaaaatacgacaaggaaaataatgcctggatcacttttggactgttacctgggaggtatacatcagttcatggctggggcattgctttccgtagttgtgggaaaatgctcattgtaattggtgcaataagtgttggtggtggtggggtgattgaaatttgttcctgggtacccaataatgagccgccagattggaagatcattggccccccccgttccggaagctttgtgtacaattgtgctgtgatgagttgttgacataccagggctattacattatcaactgtacatcttgaccaaaaggaaggataaagaaggcaaattctgctgagtctgtttactccttgatgggtaacttctgcccactggcattttaggctaagctgaagatccaatagaacttctcatgtagcttcttacttgcttatgtctaatctcttcattttaattccatttggagggcctgctttccggaaagtgggacatgcagtgcagtattagatttaataatttggtgcagcctcaaacattttgatcttccctgggtaccttgatcaaagttttttcttctttttagctccagagaatagccttacattggcaaatcatttgcccatagattgtaagaaataataaaggaaggaagaaagaaatatgtctctgttg

SEQ ID NO: 10487 - DNA, 797 bp, Sorghum bicolor
  Clone ID: SORBI-28MAY03-CLUS1609_1
cttcactcgtccggttcgtgcttatgttggtagtaaattgtgcatcttttctgaagaatactttctcggtaactaccattaccgtgttcaacattttgatgaatgaagctgtgactcaggatgtaagagctgcagccaatggcatagctgtaacactaatgtccatctcaaaagctgttgctccagctgttgcaggaattatattttcatgggcccagaggcgtcaaacagcttcgtttcttccaggcgaccacttggtgttcttcatactgaacatcttcacgctcaccggtctcatcttcaccttcagaccgttttttgttcgaggcagcgcgaagcactgaaacatgaatgaagcagacccatggtaataggtatcctatccaggggcaatgaaatataaattttcttccggcgtggccgagggaggtgccgagcctgtacgactgaggcaagagcacaagcgtatggtacacagcaaggctgtgttgttgtaagttttgtaatttctgtttattcttctcggcttcgcagcatgcatcagttgctgtatatgatggaacaacgtctgttactgggcatgttgctcggttttcacgcgtgtaagtaatgtagaaatcgttatggtaggtatttccatactgtcattagtggagcattgattttttgtaaggaagttatcacaatgcctttttttccgggcatgaataagaaaagggaaatatgcttatatgcatactatgaataagtgagcaatggacttgtactgtattcgtgatctatttaaatcagatttg

SEQ ID NO: 10488 - DNA, 546 bp, Sorghum bicolor
  Clone ID: SORBI-28MAY03-CLUS14595_1
gccggccgggttccgggtttctcttctcccgttcaacaccccgccagcgcgtcctctctctcgtggggacaacttggcgaccgtcgccgccgccctaggccaggtgcccaggctttcgtcggtcccttcaacagcccttcgccggcgacgagcaaccactaagagcgtagcatggcaaagattaagccaaaggccttgctggcacaaagcaaagtgaagaaggctcctagccaaatcagcgtggctactatcgttacctacatgatcctcggcatcctggttgtatcctctgtttatgctgcctacaaatactggataggcaaaggaccagtggaggcagtgggcatcgaggggaattaatccccaactatgtaactggttttgttgttgtatcatccagttggatagttttggttgttgcagtgcagtggtaaatggtttgatggaacatgcgtagaatgtatgttgctgcaattttactgtaacccttggaacatgcagtgccgtttccttgttttgaatgtgctgaatttctttagtgttacg

SEQ ID NO: 10489 - DNA, 602 bp, Sorghum bicolor
  Clone ID: LIB5048-011-R1-XP1-G6
ccggggaaaatcccaactttttctccagtattgccccctgctttcccttctccggttcaacccccgccagcgcgccctctctcgtggggacaacttggcgaccgtcgccgccgccctaggccaggtgcccacgctttcgtcggtcccttcaacagcccttcgccggcgacgagcaaccactaagagcgtaggatggcaaagattaagccaaaggccttgctggcacaaagcaaagtgaagaaggctcctagccagatcagcgtggctactatcgttacctacatgatcctcggcatcctggttgtatcctctgtttatgctgcctacaaatactggataggcaaaggaccagtggaggcagtgggcatcgaggggaattagtccccaactatgtaactgggttttgttgttgtatcatccagttggatagttttggttgttgcagtgcagtggtaaatggtttgatggaacatgataggattacggatcctaccaggcacactgcgcaggttgtatgggtgagagcagtggcggagccagcagttttaaagagcctgggcaaacccattatcctctatgctatgtacacatgctgacttgcg

SEQ ID NO: 10490 - DNA, 1267 bp, Sorghum bicolor
  Clone ID: SORBI-28MAY03-CLUS14668_1
gcacgagggtgattgggactggttcatcaacctctccgcctccgactatccgctcgtcacccaggacgatctgttgcatgtgctctccgagttgcccaggcagcttaacttcattgagcataccagtgacatcggatggaaggagtaccagagggcgaagccagtgatcatcgaccctgggctatacagcctgcagaagtctgacgttttctggataacagagaaaaggagtgtaccaactgcgttcaagctattcactggctcagcatggatgatgcttacccatcagtttattgaatactgcatatggggatggggcacgcgcccaaggacagtcttgatgtattacgccaattttctttcttcaccagaaggttacttccacacagtcatctgcaatgtccccgagttccggaacaccacagtcaaccatgatctacatttcatttcttgggacaacccaccaaagcaacaccctcattatctcacacttgctgactatgatggtatggttaacagtaacgcaccctttgcaaggaagtttggaagagaagatcctgtgctggacaagattgaccaggaactattgggccgccaacctgatggatttgtgcctggtggatggacagatgtactgaatacaactgagaaaggtaaacccttcactgttgagcgtgtgcaagatctccgccccgggcctggtgtggacagattaaagaaacttgtcacaggcttgctcacacaagaaggttttgatgacaagcattgcttgtgaaactcccagtaagacaattctggggcagtagtttacacggtcaaatttgagggcattgagccatttgctaggaatgcctactagctgaagcagcagcacatagcatcatgtacgcgtggatgcaatgataagataggtgctcttatagacaaccgcttgagttgagttaccgtacagcaggagaccacggatgtagcaggcggagattatacagaactagtagctcactaggttatgttagatgattatatcagcccccaaccatcaataatgttggaatttttgacatctctgcgctgcgggttgtgcaaggtagtccattatttgttcggaagccaatggcacctggtgtaccaactggtagcgtgtgagacttcgttgtattgactagtggatatttttgggcaaactgatacatttgattgcacacaggtattcatttatttctctttctctttgatgagaaaagcaaaatgatcgtgctgttttctt

SEQ ID NO: 10491 - DNA, 815 bp, Sorghum bicolor
  Clone ID: SORBI-28MAY03-CLUS14719_1
ctagccatagtatgtctgcgtcagaacaatctgcaagggattggttcttaaatggcgcatctggtgtggatatgatgttgaatgggggcttaggtcatggactaaggaatatgagtttggacagtgttagttctgccaggtcgtttggacatgcaaaccatcaacaaagttttgtttctaatcctatagagctggctgccaatggttggggtggcacatggagttctggaagtacatcatcttcccgttctgtggcgtcatcactgggggcatttagagggtggaattcatctgagtcgtcctctgcaatgcctcattctgattggagaaccaatgggccagcaccttatgactacacctcagtagattggagcgtcgacacaacgttattgaacccagcagcaaagagcgagcggctgtcggacacatggtcaaccatgttcatgggtggcagatcaacaaggacacctgggaacctcagtgctgcaggcatcgcagggttgcatgacagtaaccatccgatggatcctgctccatcacctcgtccatatgagtggcctactttctgcaggggaggatcttcctagtttcccctaccctgtaggtaagaggccattgaataaaaaaaaagtaaaagctgtcatttgtttcttttcttgttttggtctcagttgcagttggttgaaaaagttttactttgtgtatcgaaccgtgcttgtgtaccttgactgttggccgagataagtcatctttctgtgaaatcgttgtgcatgaaaaatgaagggagaaaattgaatctatcatggttgaaatgc

SEQ ID NO: 10492 - DNA, 1535 bp, Sorghum bicolor
  Clone ID: SORBI-28MAY03-CLUS14946_1
ctactgacccctacccgccggctcggctcggacggagcgggcgcccgccccacccgaatcacacagatcgggacgccggacgaggaggaggtgccacgccgttccgcatcgccggagcaacagccgcgggcgcggagaggcccgccaccgccaccgcaggcgcagttcaagctttggattcccggatcctgtgccatcggtctttacggagagcgtaatccagcgagcgtagagttgaaagctgtgaaagtggagatgagtactctgaagaaatccgacaagaaagctgccctcgacttcgcagcgtggagtttcaatgtcaccacatcggttggaatcatcatggttaacaaggcgctgatggctacgtagcgcgtcggtttcgccacgacattaactgggcttcattttgtgactactaccttgatgactatcgtatttcgatggttaggcctgagccagccatcccacttacccctagcagatctagttaaatttgtgacattttcaaacttgtcaattgttgggatgaatgtgagcttgatgtggaactctgtgggcttttatcagatagcaaagctgtgcatgatacctgcatcatgtcttctggaggttgtctttgatcatgtacattattcccgggacacaaagctgagcataatggtcgtgcttataggagttgcagtctgcacggttactgatgtcagtgtgaatgcaagaggtctaatcgcagctgttatagctgtttggagcacagctttgcaacaatactatgtccattttctccaacgcaagtactctctgaactcattcaacctcctgggccacactgctccagcccaagctgggtcactcctgctagtgggaccatttgtagattacttgttgacaggcaaaagggtggatcacttcagtttctcatcacttgctctgtttttcctggcactctcatgcttcattgccattggcgttaatctgagccaattcatctgcattgggcggttctctgctgtatccttccaagtcctaggccacatgaagaccgtacttgtctgtcccttgggtttcttttctttggcaaggagggcctgatcttcaggtagtccttgggatggttctggccgttcttggaatgatatggtatggcaacgcatctgctaaaccaggcggcaaagagcggcgcagcatcctgccggtgaggtctgcaagtctcaagggaagttcagaagaaaaggccggtgctgagaaatagtcttgctattatctaactgcaacttagatggggaatttttcgttccgaggttaaatttctggtgaggtgacgcaagtatcacagattgggaactctgccgccttatgtttgacgcagaggacaaacccgtcccatctagaaactcaggattgttatagttacaggtatactgtaaagcttcattttttggcgctctgaatcatttgcagtgaggagaaagacaaacatggtttaggaggcttcaagacagtttttaccgaatatatagtgcagttgtttgcgg

SEQ ID NO: 10493 - DNA, 1134 bp, Sorghum bicolor
  Clone ID: SORBI-28MAY03-CLUS15009_1
gcacgaggcgcagtccccgatccattcggtacccctctacgcacgtctccgagaagacttcccgagcgagttcgcgaatccaatcctcccatcgtgggcaagtcatggttgtgatcgagctggagcccgaggagccgacgcgcccctcgtcgccggcggcggaggagcaggcggccgccgcggccgccggggaggcggcgcgcccctcgtcttcagcggcgcccgaggaggtggccgccgccgccgccgctggcggggaggcgtcgagggccgcggaagaagacgaggaggccttcgaggacgcgctcaccgacgagcagctgcgagagaaagctagaagccaagcaaatgatgcaaaagcagaaggaaacaagctttttggtgctggacaatatgaggaagcattatctcaatatgaaatggcattgcaaattgctgctgagctcgaatcttctgaggatatacgcgccgcatgccattcaaatcgtgctgtgtgcttcctgaaattgggaaaacatgatgagacgattaaagaatgcacaaaagcacttgaactcaacccaacatacctgaaagccttgcttcggagggcagaagcacatgaaaagcttgaacactatgatgaagctattgctgatatgaaaaaggttattgaaatggatccttcaaatcaacaagctacaaggtctcttttccgacttgagcccctggcagctgagaagagggaaaagatgaaggaagaaatgattggaaagctaaaagatctggggaactctgtgcggacgcgtgggcggacgcgtggggacaatttcaaagccgttaaggacccaaacactggttcttacagcattcaattccagaagtaacacgtgaagaaagacgatggatgaatatggctgggtggcatatttcagttgtaattgttcaaggcacttgtgcatcacatacccggaccatatccaaatagattggcatggaagaggaactggattattgcgttgcgtttgcacttgttgcacgttagactgttagatagattgagatgctttcccaagtgcgaacttgcatgatcattttgaactctggtattttcctcaatacaaagtcgtttcaaaaagactggttccatgcgtt

SEQ ID NO: 10494 - DNA, 822 bp, Sorghum bicolor
  Clone ID: SORBI-28MAY03-CLUS15019_1
caacttcgtgttgaataagcaaattcagagttcaacatgaaatgcacgagcactagtctcgggaggaaaagtcgccaagtccaggagaggggtgaagaaacataaatatgtgaatcttgaccacccctaaatttaatcatcacaaaggctaggacttggccctaacgcaacaacaacagctgcaacacgcacacatttaacaacgaattattgctatctatgaagcaatggtacaacagaccggagcactatgaaattatgggatgccccaggggaactgttgacgaataggtgatattctgtcatttacagagtcgcaaacaagcattcttcccttctctcggatgcccgctttcttccttcccactatttccttttaccaccaccgagggacagaagctccaggctgcggtggagtggctcgtcgcgggagcctctcgcaactgcagcccgtgaaagggaggtagcccttgactcgcctggcgatggattaactctctgggtgctagatggacgactgccactgttgctagagaacaatctgcttgtccggttatactgctcacttggttccacagatgaggctggcctgctgcttgatgcaacagctctacgggatgcactgcctgtacgtgaggatgtacgtggtctctccacagtcctttccccagaccggtcagtgctatgcataatttcctttaatgacatagatacggtctcacgtggccgttgtgcataattgtcactcggattcacagaaccactaggattccttctaccggacgcttctcctggggtcttctcaatcttatccattgaggg

SEQ ID NO: 10495 - DNA, 701 bp, Sorghum bicolor
  Clone ID: SORBI-28MAY03-CLUS17075_1
gccggctcgaggccgccggccgggccgggaaggctccatttctcaaccttgctccgcgcccggccgcctttgcctgccttccccatctccttttcccttccgccatggcccagcccgccttcctctcctctctccgctcccgcctccgctccgcgccgccgccgccgcaccatcgcctccagcccagccgcggctaccacgccgagctcggcgctcgcgagaaagcgcttttggaggaggatgttgctttgaagaggttcaaatcatacaagaacagtgtgaaacaggtctccaagattgggaatgctctcacttttgctgttgtgcttgcttgcagctatgagcttgctgtgttcacgataaacagaaaatgatggaaaacacaatcatgtgggagggcacagctattccgggaagcataaacgcattctatcacttcgtgtttttagcttcgtttgttgttcgctcgtaccatgtaaaataaaagaaactaggttaaccttgattggcaaataacatttctgtttttatggcctagccgcaaacaaagtggcacaagcgttccatggtgaatcgtgatgaatgagcttcgcctgcttttatttaccgcctgggagtgcattctgctgcgcattataacagacgtggcatttgttgaggccttgtgttgccgaaatgaaaagtttttggatattgtaacg

SEQ ID NO: 10496 - DNA, 619 bp, Sorghum bicolor
  Clone ID: SORBI-28MAY03-CLUS17228_1
gccggcctggccggggagcactcgtcagcccatgctaggctaagagagtcccacactatccccccatggacccagcgaagctcgccgctttccttgccgtcgccgtcgtcgtctgcgctgttgccgccgcaccggctacggcggattattactccggcggcggcggcggcggcggcgcgcccgccccagagagctgccagacgcaaatcacgtacttcaccaactgcctggcccgttcggagatccgcgggcagtgctgcagcgtggtcgagagccgcaagtgcctctgccagctgaagcgggaggtggcgctgccctgtagtctgcatcgccaccatggacgcaaatgctccaaggatgagcaggctccaccgtcggtgaagctggccgagctgcagcgcctcccatgcttcaagacactcaagtgctagtagcaaccgcgcgtttccagctcgtatttttttgttttcgtgtacgtgtgtgctttttgtttcacattgttcacttgttactgttctatcctttcggcttgccatggatatgatgtacctgagtttggttcgttgagacaatttcttatggcgtgtttggccaaaaaaaaaaaaaaaaaaggccccta

SEQ ID NO: 10497 - DNA, 592 bp, Sorghum bicolor
  Clone ID: SORBI-28MAY03-CLUS17288_1
gccggccgggccggggaaacaccgaggacatgggtttcaggggcaagctgaagctctccaggaaggagcagcacggtgtgtccatgaagttccgagtccgtgatccgaggccagcgcagacaatccaagatggactccgcttcgtgaagaacatgaagcacgggctcgccggccagccagacaagtacgatgaggtcgtcgccaccatgcgccagttcatgtccgggagcatttgtactgctgatgtggttgagcgtgtgaaggtgcttctagaaggtcaccctgatctcctccgtcacttcaacgagttcctgccatgggggtacataagggctcatggaccactcggaaggctcagcgtctgatccagccagggcagtgaagcatggatacctagctatatatgccaaagcctagctgttgctttcctttgcatgcatgaatgagatatgaatatctctaagctgcagtggttggccctacatcactgctactctgcattatattggcagtacgcgtcctatgaagaatatataatgctaaatatcagaccgtatctgtcttgcactaaaaaaaaaaaaggcccctaaaa

SEQ ID NO: 10498 - DNA, 883 bp, Sorghum bicolor
  Clone ID: SORBI-28MAY03-CLUS17291_1
gccggccgggccgggagaccagcgttgcaattgcagccgaactccgccgccctgtcgttctcacctctgcctaccattaccggaagagacgacgagggtggccgccgccttctcccgctcccgctctgcctctctccatgggccaggtcgagagccaggccactcctccggcggaggagccttctccagccgccgtggagccgtcgccgccgtctcctgccccgcctccctcctcccttgaggcgcttgccgcagaggcaatgtcatttgatgaggatggcactgaggagtcaatcgatgtgaaggtacagaaagctctggactgtccgtgtgttgctgatttgaaaaatggtccttgtggaggtcaattcgtcgatgcattttcctgctttctcaggagcacagaagaagagaagggatcagattgcgtgaaacccttcatcgcattgcaggactgcatcaaagcaaatccagaggcgttctctaaggagattctggaggaagaggagaatgatgaggaggcagataagtccaacctgaaagtcagagctccatcatggtccagagaatccaagcctaaggtttgagattgcttggtattgactgatacggagtgatattcatccagtctgcaggttcacctcattcaactataagttcgccagtagtagactgattccagagagcacagaggcatcatattattggcagaaatacccatattttgtgtggtagaaatgcctctcggtattcactttgagaatgtacacgtcatttcaagtatcattcgagaaccgacgaacttgtaatttgattcatagccatacagggaaagtttgatcatcgctgtattattataaatatgaatatgaaatatacatag

SEQ ID NO: 10499 - DNA, 651 bp, Sorghum bicolor
  Clone ID: SORBI-28MAY03-CLUS17194_1
ccgggggcgccctgcctgtgcctgcctgtatttctctccctcccggcggcgccgccgggccacagatcccccgtcctccgctgcttcttctccctgcgcggactcgctctcgccatcaggagatttcgccctcgaccccgatcctgctcccctctcgcgctatggcggcccagactgtcgtactcaaggttggcatgtcctgccaaggctgtgttggagctgttaagcgggttctgggcaagatggaaggtgttgaatctttcgatgtagacatcaaggaacagaaggtcacagtgaagggtaatgtaacacctgatgctgttctgcaaactgtttccaagacgggcaagaagactgagttctgggaggctgagcccgtgacaactgaatctgcagccgctcctgctgatgctactactgcctgacaagttcgatgtaaacaatcccatgtggaaagtgtccagcaaaaatgtgaatgggtctgcccttattgtatttagcttggagatctatattacaaataattgcaaactgctagctcgatctgtacattttacagatgctgttcctgtactgtgatgtttccgtaagtttggggaaatgatataccaatacttgtatgacgaaaaaaaaaaaaaaaaaaggccccta

SEQ ID NO: 10500 - DNA, 835 bp, Sorghum bicolor
  Clone ID: SORBI-28MAY03-CLUS15351_1
gccggccgggtcgggatcgacctcgtctctctctcggtctccccagatctcccaccggaaccctacccgagcacaccagccatggcgatcgcggcgcgcgccctgcgccgcctcccgctccacctctccccctcgatctcccgctccttctgcgcagtttccccggccgccgccccagcccccgccgcggcgtccgccaaggtcgccgaccgcatcgtgcgcgtcctcgccatcgatcccgacggggcgcgccgtgaggtggtcggcctcacggggcagacactcctccgcgcgctggccaacgcggggctcatcgagccggcctcccaccgcctcgaggagatcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgggctgccaggtcgtcctcgcgccggagctgcaggggatggtcgtcgctgtccccgagcctaagccgtgggacatcccgtaatggcctgccgcgacgaaaggcaaggcacatacgtgcggcttttgacgctgtgagccttccttcattcccctggctcggtcaagctgtgccatccccttttatgttacggatttgatcaagaataatgattgatgagcaaaaccttggcattagttaacttttgttcctttgaatgtggagtatatgaatgctgtaatgtggaatccctttgcaattaccgcagtttaatgtttcatggtaaaaaataagaaaaaaaaaaaaaaaaagggcccta

SEQ ID NO: 10501 - DNA, 836 bp, Sorghum bicolor
  Clone ID: SORBI-28MAY03-CLUS15365_1
gattgatggtgcatcactcataggttctgcaggcgaatgggatcagccacttacaatgcgcatccctggaaattatggtgcagtttacataactttatcacgttttaattcagcagttgaggcgactgtagaggttctgatatcagaagtacaatgcagtttcaatttgtcgctcacttgtttaactagtcagctgagtaaggaaatccggctctttcatggtgccatagctgggtcacgaggcttacagaggtctgtggttgccataccatggaattcttcgataaatttgaacttcaaagttggcgcattgtcatccagttccaaccaacactactgttccttcatggccaaagtacatgggcatgatactcaagaaataaagactctttttgctttaatctcagtgaaggtgacttggtcgatgttgcccattgcactggactgcctttattaggctgataactttctgtttctgttatgtaaaaagtgagtccaatagatcaactttactaaacataggtgtggtaaacttagactctgaactcatgtaataaggtagtattagtacactccagtaccagtcaatcagtcagtcagtcatatacattttattcggtccagcggccatggttgacactccgcagttgtttcacattttatttctgctctccattatttttatataggaatttcccaggcatatagagtggcttccctgcaactttggtggacaagaattagtagaacgtgtggcaacttcggtggatatgtatgaccattttctgagtgaatgtttatcctgaatctgattggatgtttgtctctattttttt

SEQ ID NO: 10502 - DNA, 1056 bp, Sorghum bicolor
  Clone ID: SORBI-28MAY03-CLUS15870_1
cggcacgaggattggtcgaaagaaaatgaatcacagtacaggaaaaagatcacgagcttgtccaaagtaagtcacaaaaattttatgaacttgcttggctactgtgaggaagagcatccctttaccagggtgatggtatttgaatatgctccaaatgggacactttttgagcatctccatgtcagggaagcagagaagcttgactggatggcacggctcaggatatccatgggcattgcttattgtcttgagcacatgcatcagctgaaaacaccacttgtgctgaggaactttgattcaactacagtataccttactgatgacttcgctgcaaaagtctcagatcttgaattttggaatgatgcaaagggatataattcaaccaacaatgaactggctttctccctggacctggagaacattgtgcacaagtacggcatggtgttgctggagatattgacaggaagagttccttgttctgaggatgatgggccactggaaaactgggcgtctcgctattttgaaggtgagatgcgtcttgaggagttgattgactctagcatcggtttcttccccgaagacactgcacgtgccctttgtgaggttgtaagatcctgcattgatcgggatccaaagaagagaccgcagatgcaagaggttgcagctcggatgagagagatcaccgcgttggggcctgatggggcgactccgaaggtgtcaccgctctggtgggctgagcttgagatcatgtcttctgagagctgagtttggacgcatgccagatgatattgtttctcctagtgtgactgagaattctttgagctattggttgctgctaatcttgtttgtggaattggtgattaggtagaagaagttgagaatttgttatgtgtgcaaaattgcatatagggagtggtattgtacttgtacatgtcaggaaggttaacattacaacatactgatatgcaggcattctagccgagtgagcaatagaaagcatgtgtggcttgtttttgctgcaatagcttttttgtcaagcaattggtactggtatcg

SEQ ID NO: 10503 - DNA, 747 bp, Sorghum bicolor
  Clone ID: SORBI-28MAY03-CLUS15815_1
cgctttgcaagcaagcagataagcccacaggtttcaggtggcaattttgaagttggacaagtgacctataagttcaacttcatgaaatcaagagggccaaggcgaatgcagtgcaatatccagtgccctgtaagtcagggcactatgtcagatccatccaaggagaaaacaccctcgtcaagttccttagatctaaagaacaaagctccaagatggcacgaccatcttcagtgttggtgcttaaatttccatggccgggtgactgtcgcctccgtgaagaacttccagcttgtggccacagccggctctggtggtccatggggcgttggagacgaggaaacggtgatcctgcagtttgggaagatcgaggatgatgcgtttacaatggactaccggcagcctctgtctgctttccaggcgttcgccatctgcctcaccagctttggcacgaagctggcttgtgaataagtgattgccttgtttaccaattatatgttggggatcaaattgtaggggatagtctgaactagttgccctgagcccctgagatgggagaaaactggcgacaagaaacgggcagacgttgcccctagcttggcttcttgtgatcgcctaaacgattgatttatatgatgtgcgtctatgtgatttatatgatgtgcgtctatgttgttgaagagatgacgatgacttattgttgtaaatgacactccctttcgtttggtgacattcactgcataatgcctt

SEQ ID NO: 10504 - DNA, 716 bp, Sorghum bicolor
  Clone ID: SORBI-28MAY03-CLUS15930_1
aagcccggccaggagcagagcctctcggcgagcgccgggttcccgacattctccagctacggcgacccgcccgtgtacggcacgccgtcgctggaggtcccggggctcatcaagatcagctgcgacggtggcccgccgtgcgacccggacgcgcgcgactggctggccggagacccggaggtcacggaccgggtggccaggtgggtccaggaggccatgccgggccacgtcgacgcctccggcgggccggtcatccggcagtcgtgcatgtgctccatgacgcccgacttcgacttcgtcatggacttcctcggcggggagctcgggcgggacgtggtggtcggtgtcgggttctcggggcatggattcaagatgggcccggccgtggggaagatcctggcggagatggccattgatggcgactccccgacggcggcagaggccgacctcgacctcggcttcttccggatcggccgcttcgatgggaacccagtgggaaatgccaacaaggatcagtagtgagctcctgctgcctatccacggaattctcctcgaccgtagtcgtagtcgtagatgcattggaattggaataaaataaaaatggatgggaatgggatgaattgcactagcatgtaacggaacttcttcgtaggccaaatattactttggcattgaacaatggtgaaacttcaaacaaagttgctaatcttgcgctg

SEQ ID NO: 10505 - DNA, 1065 bp, Sorghum bicolor
  Clone ID: SORBI-28MAY03-CLUS15964_1
gcacgaggctccctctctcccgctcgtcagtgggagtgtgcgtgcggggctagcgccgctagggtttcttccgcgagcccaccatcgccggccggccgcgggcgatctgggtctcgatccggcgcccgccctaactcgggttcgcggggcgcaaggccaagggcgcgaggacatgaagtcgtcgctgcggaagctgcggggcttcgcgctgcagcgccacgagcagcgggtggaccgggaccgcggtggccggggccactccaccgccgccgccgccacggcggcggacgagctcctcgcggctgcccaggatatggctgatatgaggagctgttatgataacttgctttctgttgctgcagcaattgcaaatagtgcatatgagttctctgaagcacttcaagaaatgggaacttgtttgcttaaaagagttacgccaaataaggatggaataaatgataaagttttgctgttgcttgggaaatcacaatttgaacttcggaaacttgtagatagttatcgtgtgcatgttcttaataccatcaccactccatcgctgtcgcttcttaatgagcttcaaactgtggaggaaatgaagcgccaatgtgatgaaaaaagagaattgtacgaattcatgctaaatgcgcagaaagaaaaggggaggtctaagaatgctaaaggtgataatggagcatcagagcaattgaaacaagctcaggaagattatcaagaggaagcaactctttttctattccggttgaagtcattgaagcaaggacagttccgaagtcttttcacacaagctgctcgccatcatgctgcacagctaaatttgttcagaaagggtgtcaagtcccttgaggctgtagagccacatgttaggcttgctgctgagcagcaacacattgatcatcagttcagcgcacttgaggaagaagattaccttgttgaggatgagaatgatgatgattacaatgacagtcatgatggagagttgtcttttgattatggagaaaataaggaagctgaggaatctggcaatgtttctaggaatcatacagagga

SEQ ID NO: 10506 - DNA, 820 bp, Sorghum bicolor
  Clone ID: SORBI-28MAY03-CLUS17709_1
tgtgccacgatcgtgccgcccgagtgcgggccgattgtgccgtctctatcgcctcgtctccgcatccgcctccgcctccgccgccccgagacctcaccacctccccttcgccgtgaaccctagccccgcgcccctcgccccctcctcgtcggcatcgtcgccgcccggttttgccgctccctatcgcctcttctcttcagcgagtggttccagcatggtggtcgtgggctccgcggattccttcaacagcatcctttccaaggtgcaagatgagaagctaccagccgtgttctactacacggccgtgtggtgtggaccatgtagggcgattgcacctcttgtatctaaattgagcagccagtatcctaagatacctgtatacaaagttgacattgaattggaaggactgggaaacaaactccatggtctaaatatatgttcagtgcctacgtttcacttctatcacaaggggcagaagattgatgaaattgtgggtgctgatggaaagaaacttcaagctggcatggaaagtctccacaagcagcagtagaagcttcagagaagggttggaaatcgacttgagaagggaatggtttctttcatctacatcgcatgagaagggtcgcacacttctgaattcgtattttcttatgtcatagcgttaatgccagtgtttcatgtgagggcatcagatgcttgtgatccagcttgttttcacttttggatcttgagataggcaacttgtccagaactcctaagatcactcatgcagggaaatgggttgaaaatggaccccccaaaaaaaaaaaaaaaaggcccc

SEQ ID NO: 10507 - DNA, 1157 bp, Sorghum bicolor
  Clone ID: SORBI-28MAY03-CLUS17882_1
ggcacgagggtccaacgcctgctcttttcttctcgattcgattcgaatcgaaacagccccctgcgtccgaatgttctagagccttccggccgggcctagggttcccgatggggcccgaggaggcggaggccgtgctggagaccatctgggacctccacgacaaggtcagcgacgccatccacgccctctcccgcgcccacttcctgcgcgccgtccgccgccgcgcctccgccgcggacaagcccgccgccggcctcgtgtacgtcaagggcgggggtctgggcctcggcgcgcgcggcggagacgaggtcgccgcgctggcggccctcgctgaggaggccaggagcctgcacgccatccgcgccgcgctcgaggacctcgaggaccagttcgagtgctttctcgctgtgcagtcacagcaacaggcagaacgggactttgcgttagcaaggttggagcaaagccgcatcatgcttgcaataagactaaaagagcatcatgggaaaaatcacgaagtcatagatgaggcatccaactttgtccgcaatgtctaccaggatgtttggccttctctgtcaactaccaagcctgagaagtgcgctgacagttccagtaacactgcaaagggtccaccgggctttgtgcggatggtatcgtctagtcttgctgttgcagggagcagtttcaatctcaaaagtttgggtggtgcattagggaacagtgcagctttagctcttggcattgtttcggtgctgcagctgcggtggttagcttcaggggcacacagctcaggagctggtaactacagctacaggaagatcagtgagaagaactcatcgtcgcggttggggatatctccaagtggcagcagaacggctcgtcttgatgtgtcactagccaggggttgaggccttgagggattttgcgtcacaatatttgttgcttgtacatgattcgctaggacatagtatcgcagtaggaggttgttctcgcttgttgtcttctaggtaatattgcagatcggttcagtttagttgatgtctgttgtcatttcgatggattttgatcgtgaactgcatccctttaggcaggagaacctttgttgatactgttacgtttgctctgcttggagttggttgcttgcttgatagtgcaca

SEQ ID NO: 10508 - DNA, 1013 bp, Sorghum bicolor
  Clone ID: SORBI-28MAY03-CLUS17890_1
gccggccgggttgcggcactaagaaaacttatccatccaccccacagccttcgtgggccaccgtccggctccccggtatacggccgccacctccacctgtccttccgcccgtccccgtcggccatcgtccacggaccctctcggtctctcctctgtcctcttcagtctccacgccgttccagaagtcgccaacctttcctcgccgccgcgccgccgcagccgcatccaaggttagcgcaatcgaaaccgcccgacggaccaccatggcctttgccagctcgctgctccccgtgccggcctcccgcgtctgcgcgagccccgcgccggagctcgccgccttctcgacggccaagaagagcgtctcgctcgccgctgcgagccggcgccgaggaccccgtcacggagtcagggcggaagtgaatgaatctggaagtgctttggctgttgatgccctctcgcaagttaaacatgttctgcttccagtccttgatcgcaacccttacctttctgagggcacaagacaggctgcagcaacaactgcttctctagcaaagaagtatggagcagacattactgtagttgttattgacgataaaccaaaggagtctgtcccagatcatgatactcaaatgtcaagcattagatggcatctctcagaaggcggattttcggagtttaaattgatggagcgtcttggggaagggcagaaaccaacagctatcatcggggaagtcgctgatgagtggaacttggacctggttgtgctaagcatggaggcaatacactcgaagcatgtcgatgggaatttgcttgctgaattcatacccttgtacctgttctaccgctcccgctctgacatgggcatggagctgatctgcatatgtcatgtttttttgagccaaatggtttgtttttctttgaagatgtaattcccacaaattccctggatatgaagggtttgcgtcagctgagattactattatgttgatgcagtttttttcgaatttgtgtga

SEQ ID NO: 10509 - DNA, 998 bp, Sorghum bicolor
  Clone ID: SORBI-28MAY03-CLUS17960_1
gccggccgggttgggctcgagtataataaacgcgaggccaccttatcgccggtcacccaccccaccccaagaccctcccaaagtcccaaaggccgccgccgcccgccagcctgccatggccgcgcagtccttcctcctcgcagccacggccacggccacgaccgccgcgctcttcgcggctccctattcctccgcacgccctttccactcggcccacttcgtcgccggcccggggggcgccgccgccgccagggcactcgtcgtcgccgacgcgtctaagaaggccgtagccgtcctcaagggcacgtccgaggtcgagggcgtcgtcacgctcacgcaggacgacgacggacctacaactgtgaacgtccgtatcactggacttactcctggacttcatggcttccacctccacgagtttggtgatactaccaatgggtgcatatcgacaggaccacattttaatccaaacaatctgacacacggtgcaccagaagacgaagtccgtcatgcgggtgacctgggaaacattgttgccaatgctgagggcgtagctgaggcaaccattgttgatacccagattccattgagtggcccaaattcagttgttgggagagcatttgtggttcatgagcttgaagatgatttggggaaaggtggccatgagctcagcctctctactggaaatgctggtggaagactggcatgtggtgttgttggcctgactccattgtaggttgctcgccgggtgcccgggttgcagttgcagcttcgctgttacatccttggtggcctgttgtcttcaatagtgttattgggacagtgccttttttttgtattacttggattcatgccatgcatggtatggtgggtaatatcctttgcagttcggttgtataaaaaataatatttagctgaggaaataagtgttgtcacatatccaaatcgatttatgaagcactatgaacatcaactatttactgctacgttgttttcgt

SEQ ID NO: 10510 - DNA, 855 bp, Sorghum bicolor
  unsure (1)..(855): unsure at all n locations
  Clone ID: SORBI-28MAY03-CLUS17968_1
gtggcggccgcatcgaggnnccggccgggctcgcgatcacacaacaacacaaggcacacacattacacaataagcagaggcggtagctagctagctagcaaatggcgatgaaccctccgagtagcatagtggcttccatggctgcacctgtaccagccaagttcaccaagttcaccttccgtaccttatatattcgtcggacggatccaggcagtaaggagatgtctcaggctggaagaccatctgatcagctgggcagaagaaacatcagtgactgccccatatatgacggccgtggctccaacgccagcctagttggtcgcatacagggaatcacagtccaaattggcaatgcacatcaattagtcaccatcgtttttgagacccagaggcttaagggctctacgctccttaccaatggaatggtaacggctgggtctgatgaatgggcaatctacggtggaaccggagtgtttgctatggcgacaggtatcataaaaaggaaaaatctcgccgataggactggtggcaacactgatgaactcagcatggaagttttctgcccagtgtttggctaatcaaagtagccaatttaatttgaacagcttgctacctggcctgctactactacctacttgatcgattatgctttcatctggtcgtcatcatcctgtgtgaaataaaggaggtcttgcatctctctctatatatatggccgtcatcgtctggttgtatctttatagtgtccgtatatatgggcactatatataggtctgtatgtgtcaaataaaggttgatatcgtcttggtataaatcatttcttttatttacgcaaaaaaaaaaaaaaaagggccc

SEQ ID NO: 10511 - DNA, 667 bp, Sorghum bicolor
  Clone ID: SORBI-28MAY03-CLUS16399_1
gagtagaactgaataaaagagctcgtcggaaggagaggttaagagcagaagcggaagcaaagaaaatggaaaatatttcaaaagaaattgacagcttgccaaatataatgaatgagatagctaaagaggacaaggaaaaggagaagaggcgcatacggcgaactgtggttaaagaggagaggcgtaaattgggcccacctcgtctgggcagacacaaatttgaaccagctcctgttcaagttctattgacagaagagattagtggctctcttagaaagctaaaggggtgttgtaatcttgcaagggatcgctacaagagcattgagaaacgtggaatacttgcaccaagcaagagaataagcaaacatcggtagtgatatcaagcaggtgatttggtgatcataaccttgtcccccaacaatatcgaggacaagacagagggattgaagaggctttacgatgagaagtccctgttataagcaaatagcttgttttacggcatttacatctcccgttgcattttcagtgcctagtagggcagggaatgtttctccctttcgatgcttcttttctttgccacatggatcctaggagttgtttagtacttaatggatgtgacatgaatacatgatagtaagagggcttatttatttgtgttgattcctgt

SEQ ID NO: 10512 - DNA, 1135 bp, Sorghum bicolor
  unsure (1)..(1135): unsure at all n locations
  Clone ID: SORBI-28MAY03-CLUS16519_1
gccggccgggcctcgcttattcagagagatatacatttgatgatgcaatcgacattgtacagtatgctgaaaaacgaggcgtgaatgtcttggcggagatcgatgtacctggccatgctctttcatggggtgttggatatccatcattgtggccatcagctacatgcaaagaaccgcttgatgtcagcaatgagtttacatttcaagtgattaatggaattctttcagatttcagcaagatttttaagttcaagtttgtccatttggggggagatgaagtaaacacaagttgctggagtaccacaccacacattaagtcatggctgatgcaacatggcatgaatgaatctgatgcctacagatattttgtactgcgagctcaaaagatagcaatatcacacggttatgacatcattaattgggaagagacatttaacaactttggagacaagctggatcgtaaaactgtggtgcataactggcttggaagtggagttgctgagaaagtggttgctgctggtttgagatgcatcgtaagcaaccaggataagtggtacctagatcacttggatgctacatgggaaggattttacacgaatgaaccactgacaaatatctataacccggagcagcagaaattagtacttggtggtgaggtatgcatgtggggtgaacacatcgatgcatcagacattcagcagaccatttggccacgtgctgcagcagctgcagagcggttatggacaccaattgagaagcttgcgaaggacacaagatcggtcactgcaagattggcacgcttcaggtgcttgctgaatcaaagaggggttgctgctgcaccactagctggttatggccgctcagcaccatcagaaccaggttcctgcctaaggcagtagatattcatatcaggcgcatatattattcatagaggagaataaatagaattccaggcatccaatttacttctctgagaaatcaaaaatagctcagatcaatgtaaggcgaacccgcagaatgtcctattttctatatatctgatgcggtgtattcatttggagatatctggccctgttttactttcagtgtacggtcatgaatatcaagattggtntccataccaccaataaacaca

SEQ ID NO: 10513 - DNA, 843 bp, Sorghum bicolor
  Clone ID: SORBI-28MAY03-CLUS16667_1
tcttcatcacatcagagcagtcttgaaagatgcggaattccagatagtgaactgttgcaatatgaggaaaaaagttcctggaagggatttttgcttgttgctcatgagccaggcactacagttggtggttcccacataagaggaagcatggttagagcatcggaagctggttatgaagaagttgatcttgttttaccaggcactggacggtttcgtgtgcagttaggggtgaatatgccagctcgagcccggaaagtgcatgagtacatgaacacggaacttgaaaacccaaataccattgaggagtacgatgttgttctttaccttggtattatagacatattacaggagtacaatatgtcaaaaagggtcgagcatgcagtcaaatcactcaagttcgatcccctttcaatatcagctgttgatccgaattcgtactcaaaacgatttgtaaagttccttgagagtgttttccctgaacaagactgagtagacataataaataatacattgtagcacttctgccctcattttttcttgtaaaaagctaacatgttctcaattattcacgctggcttctacgcacctgtaagtgttatttgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggctttaaaagaacaaaacttaaagtccacttaaatggggaagaaaaagtacattttttggggccggcaaaaacaaaagaagagggcggggttaataaaattgggggacagggaaaaacccggggttgcccaaat

SEQ ID NO: 10514 - DNA, 877 bp, Sorghum bicolor
  Clone ID: SORBI-28MAY03-CLUS16910_1
aaaatcatgtgaaaccatacacgtgccaaagcaaacccgttgcggtgttgcctgtcgcctgtgcctggctggggattgcgcagtcgcgagtgagctgacttgctcgcccgggcccgttccggtgtctcttgccctgtcgcgcccgctccgtcccgctccggcgcccgtttctccccgccctcctctcgtcacggccctgcccggacacagagattcgcacgttctcgcgatgggagcggaagccgagggtactcccccgtcgcagcccgccgccggcgagcccgcgaccacggcaagggcgcagcccatctccgcagcgcagttccgctcctggaagcagcgcaaggatgaagaggaagctgcaaggaaagctgaagcagctcagaagcgagctgctgatatcgcttcgggagcggtgcagatgaacggccgcgagctgttccaacatgagccctgggtgttcgacaacaacatttactgagataccgagagcatggtggtgtcgggctactgttcctgtcttgtggataactgtagaatgccttgagatctgataaactcgagaacataatgcactatggcattactgtatatcagcacatgattgttggtaatccgtggatgtggttattggcaaaaaaaaaaaaaaaaagtctttgaaggcatctagactttagcgagaaggcaaaaaaggtctcgtcccaggtccagcagccaactgactgcccatccaacagattcgcaccgcggacaagctacagtgccatgttttttgcgggaaaggccccaaacctatgtgatgaccttgtaatttttgttcctacgaaaatccaccaccccaaagggcacaagaggtcacttgttagggacacattct

SEQ ID NO: 10515 - DNA, 643 bp, Sorghum bicolor
  Clone ID: SORBI-28MAY03-CLUS1695_1
gcacgaggcggtgaccagccacacacggacacggcacggcacgggcaccacgccccacggcaagtcgtacgtggcacgcgctcgtccatctccatggcggtgccggcctccgcctccgcgtgcgtgcgcgccggcccgccgccgtcacgccgcgcgtgtaccagtaccactggcggcacggggaccgcggcgttctcgctgatctgccgcaagagactaccgccgccgacacggcagccgatccacctccagctccagggccgtgccagctccgacctccgctgccgccggcgtctcctcacggcgcgaggcgagcgcccggccccggatgaggacgaggaggaggcggcgggtgcaggcggtggttcgttcgacgcggcggtggcgctgttcaaccgcggggagtaccacgcgtgccacgacgtggtggaggagctgtggtacggcgccgaggaccccgcgcggacgctcctccacggcgtcctccagtgcgccgtcggcttccaccacctcttcaaccagaaccaccgcggcgcgatgatggagctcggcgagggcctctgcaagctccgcaagctgcagctagacagcgacggcgacagcggcggcggcggccctttctcccggttccgggacgaggtcc

SEQ ID NO: 10516 - DNA, 572 bp, Sorghum bicolor
  Clone ID: SORBI-28MAY03-CLUS1663_1
gcaccaggcccctttgcccattcgacaaacagctcactccctcctagcttcgtcagctcataaaccaaacagaaagagagctcgattccaggaaggaaaggatgctgctgaacccggcgtcggaggcgttggtgctggacaccatccggcagcacctgctggaggagccagcggcggcggcggcgggggacgagagcttcgggagcctggtggcggaccagtggagcggctcgctcccgttccgcaccgacgacgccgacgacatggtggtgttcggcgcgctgcaggacgccttcgcctacggctggctgcccgacggctccttcgcgcacgtcaagcccgagccggcgctgtccccggactcccactcctactcctactcctacgacggctcctcctgctgcttcggcggcctcctcctggacccggcggagccgctgacgcccagcagcgaggcggccgccacgcccaggcggggggccgccgccgccgcccgggccggcggcgagcacgcccggggccgcgagcgaggaggaggcggcggtggcggtggccggcagggggaagcacta

SEQ ID NO: 10517 - DNA, 867 bp, Sorghum bicolor
  Clone ID: SORBI-28MAY03-CLUS18862_1
gccggccgggccgggaacgttgccaaggagactgcggctgcggcggcggcggcggtggagaagccagagagctcggtggagaaggacagcatggaagtggataagaaggaggaaggcaacgtgagacaaccaaatgctggaaatggtcttgatttggagaagtactcgtggactcaacagttgccagaggttaacatcaccattcctgttcctcaaggaacaaaatcaagatttgtggtctttgatataaagaagaatcatctgaaggttggtctgaagggccagccacctatcattgatggcgagctccataagccagttaaggttgatgactgcttctggagcatagaggatggaaaaactctatccatattgcttacaaagcacaaccaaatggagtggtggaagtctgttataaaggcttaccctgaactagatacccaaatggtggaacccgagagcagcaaactctctgataggtgttatgcgaaaggtggaaccgtggagaagatgatgtttgaccagcgccagaagcagatgggccttccaactagtgatgaaatgcaaaagccggcagatctaaaggggcctatgtctgagtgaccaaatatggacttctctagagcaaaattagcttgaggatttgttccgggcttctaccagtctgcattaggttgtctttgagttcgttattagtgcgaacctatctttgatcagttctttttgaatgtctcaaaacgggcatttagtactctgaaacataattagcatcagccttcttgcgggcttctaccaatcttcgttcgctctgtgccgcttgccttgcctgttaaatgaagttacactgctgtagcgtgctcacgatag

SEQ ID NO: 10518 - DNA, 519 bp, Sorghum bicolor
  Clone ID: SORBI-28MAY03-CLUS19085_1
gcgtcgccgaacgggcgggccggcccggcgcgcggagcgcattcttccgcacgcacacccatcggccatcgcccacaagcgctcgcaggagaggacgaaaccctagcttttgcggcggcggcggcgaagacaatgatctacgacgtgaactctcccctcttccgctccttcctcagccagaagggcggcgccgacaagaggaaaatggaggagcataaaccaaaggagcagaggcccaaggccagcgagaacaagcctgtgatgaacgaatgaatatctccagaaactgcgttcaatgcgcaaccaaattcgatgtctgcttgctctgtttagcttaaaaccaaagcttccaataatcttagtggtgtcttagtttctccttagtgtgttaattgctcagcttgaacatggcaacagtgcaacagacatgaaacttgaactacctattagactattatcaatttgagacgcccatgattggcaacttttgagtaaaaaaaaaaaaaaaaaaggccccta

SEQ ID NO: 10519 - DNA, 1219 bp, Sorghum bicolor
  Clone ID: SORBI-28MAY03-CLUS19159_1
gcacgaggctccatcgacgcctggaggtggtggcggctactacggccccccctcgccgtcctctgacaccacgcctggcggtggtggtggcgggtacagtgctcccccttcgcccgccggtgacacctctccatcgacgcctggaggtggcggcgggtactatgggcccccttcgccgtcttctggcacctctccgaccacgccatcggcgcctagtggcggctactacggccctccatcgccgtccagtgacacttcaccgacaactcccggaggcggtggcggctactacggccctccctcgccgtccagtgacacttcgccgaccactccaggcagcggtggcggctactacggccctccctcgccgtcctctgacacctccccggccactccagacgtgccattaccgcctatcagcacatcgccgccgttctctccgctgacgccaacaccgactaccccgacgccctacgaccccaacacgccgccctttacgggcccgtgcacgtactggatcatgcacccgggcgtggtgtggggcctgttcggcttctggtgcccgctggtgcggctgttcgggccgagcgcggcggtgccgttcgggcacgacctgaccgtgccggaggcgctggcgaacacgcgccaggacggcgtgggcgcgctcttccgcgagggcacggcgtcgctgctcaactccatggtgaacagcgggttccccttcacgacgcaggaggtgaaggacgcgttcggcgccgcgcttagctctggcgatgacggcgccgccgcggcacaggcgcagctcttcaagaaagcaaacgagggacacgtcaagcgcaactaggcggccgccggccgccgccgtatgttatgcactgtgtgtccgttaggcgtgcaaactgcagtgcagctatatatgtgcgtggcgactagcgagcatggaggggttggttaggatctgcacgtacgtgtttgctgctgctgctgatgatggggttgaagttatcagtacctctttggctttatcttgtattaggtgtgcatgtggtctaaagttgatgggagtaggatctgttgctaagttgccatctttccatttgtttgcagaatgagagtatgcaggcttctttgagtcttccagttccatggttccacctgtcccttaattttctgatgtaccccctaaaccagtactgcagacataatcaagtggaaactg

SEQ ID NO: 10520 - DNA, 650 bp, Sorghum bicolor
  Clone ID: SORBI-28MAY03-CLUS19179_1
tatgcgcaacggtgaagaaagcaatggtgagccggccaacttggtgatgtctcctatgcgcaacggtgaagaaggcaatggtgacttgaataacttggacttggaatcggaaaattcacctgatggtatttctattgctctgaacctgggagagcgggagccaaaaaggctccgcactgattcgatgctggacatagacttgcagaaatgaggcttctatgctgcagacgtattccacattattcagcttttgtattgataggtatgggcacaaaggaaataatctctttctggacgactggacctgttgtcctgcttagaaccggtttgggttaagctgtgaagctcctgaagccggttgctcctgcagttttgcgtcaagcgtctagtgtctagtactctagtgtatgtagtgttgcgtaagatgtcggcccctcaattagacacaggtgccatattccttgcccatgtaatgttgtcatttgttgtatgctcatgtttatgtactacatgaagcattattgtaaaattgagctacagcaaccagagctcgagaatcttaggcgcaaccaaccaaccccgtacctgatgaattgataataaagctgaatattttaggtgttggaaaaaaaaaaaaaaaaaggccccta

SEQ ID NO: 10521 - DNA, 2073 bp, Sorghum bicolor
  Clone ID: SORBI-28MAY03-CLUS17467_1
gccggccgggccgggtttggccactataggagcaactgttcatggtcattatggaaaaatcctttacaaaggagataggttagttacgtttatatatgaaaaatcgagatccagtgatataacgcaaggtcttccaaaagtagaacaaatcttcgaagcgcgttcaattgattcactatcgccgaatctcgaaaggagaattgaggattggaatgaacgtataccaagaattcttggggttccctggggattcttgattggagctgagctaaccatagcccaaagtcgtatctctttggttaataagatccaaaaggtttatcgatcccaaggggtacagatccataatagacatatagagattattatacgccaagtaacatcaaaagtaagggtttccgaagatggaatgtctaatgtttttttacctggggaattaataggactattgcgagcggaacgagcagggcgggctttagatgaatcgatctattatcgggcaatctcattgggaataacaagggcttccctgaatacccaaagtttcatatctgaagcaagttttcaagaaactgctcgagttttagcaaaagctgccctacgaggtcgtattaaaaagttgaaaggcctgaaagaaaacgtagttctgggggggattatacctgttggtaccggattccaaaaatttgtgcatcgttccccacaagacaagaacctttatttcgaaattaaaaaaaaaaatctattcgcgtcggaaatgagagatattttgtttctccatacagaattagtttcttctgattctgacgtaacaaacaatttctatgaaacatcagagaccccgtttacccctatttatacgatttaagtatacataaagcaatttttttttacttaaatttaaactatacttttgaccttagaatgctaacaggtctgattttcgattttgtatttgaatttgaattgtatttgaattgtatttgaataagtaaaagaagtcagttaattcattaaggctatgtttataccgtgtatcaatggtcaattatgagtagaaggttccatcggaacaattattatttatttcaagctatttcggctctttcttaatcttcaaaaagaacttaattccgtaatggtaagacgaaaaaagaaaaaataaaaaggaagtgtggaaaaaatgacaagaagatattggaacatcaatttgaaagagacgatagaagcgggagttcattttggtcatggtattaagaaatggaatcccaaaatggccccttacatctcggcaaagcgtaaaggtactcatattataaatcttgctagaacagctcgttttttatcagaagcttgtgatttagtttttgatgcagcaagtcagggaaaaagcttcttaattgttggtaccaaaaaaagagcagcggatttagtagcatcagctgcaataaggtctcgttgtcattatgttaataaaaagtggttcagccgcgtggtaacgaattggtcgattaccaaaactagactttctcaatttagagacttaagagcagaagaaaaaatgggaaaattccaccatctcccaaaaagagatgcggcaatcttaaagagaaaattatctaccttgcaaagatatctcggcgggatcaaatatatgacgaggttgcctgacattgtgatcgtccttgatcagcaaaaagagtatatagctcttcgggaatgtgccattttggggattcctactatttctttagtcgatacaaattgtgacccagatcttgcgaatctatcgattcctgccaacgatgacactatgacttcaattcgattaattcttaacaaattagtatttgcaatttctgagggccgttctctctatataagaaatcgttgattaagaagaatagttaattcttgagcaactgcgtagatttataggattaattactattattttttgttttgcatagataaaagaaggggaatattgatatatattagagggtattgatatatattatgatctgatgtgatttcttggtatattaaatataagattaatacttcaagttg

SEQ ID NO: 10522 - DNA, 1037 bp, Sorghum bicolor
  Clone ID: SORBI-28MAY03-CLUS17519_1
gccggccgggttccgggaaccccagctcaccatgccaggctcctccaccaacgcacacacaccagccagctccgagctcaccaccagccagccatgggcaaggactgcggcaaccacgcggacgacgacttccgccagtcctgccgccgcctgctcctcatcctcctcaccctcgcgctcctcaccggcgtgatcgcgctcatcatctacctggtcctccgccccacccacccgcgcttctacctgcaggacgcctcgctccggcagctcgacctgaccaacggcacggcgccgctgctctccacgacggcgcaggtgacgctcgcctcccgcaacccgaacggccgcgtcggcgtctactacgaccgcctcgacgtctcggcgtcctacaagtaccagcagatcacgctggcgtccaggctgccgcaggtgtaccagggccacggcgacgtcgacgtctggtcgccggtcctgtcgggccccggcgtccccttcgcgccgttcctcgccgacgcgttgagcaaggatattgcagctgggtacctcatcttgcaggtcaggatcgatggcagggtcaggtggaaggtcgggagctgggtctccgggcactaccacatcttcgtcacctgcccggcgtacttcatcaacgccggcgccggcagcgggtaccgcggtggcacggtgggcgcgcatgggctcaggttccagaccgccacgtactgccgtgtcgaggtctagcgacgacgtcggggcgaccttgctttccttcacgtggctctctgcttttgctctgcttcctctgctccggccggccggccggcgaggtaggccagcttgtcgtcacatgtgtcgtgtctgtctgtctgtccatactgaaaagcaggtggtgaattgtaataaatggagggatacagaggtaaaaaaagaaaaagaaccagaggtgtgaggtaatttagagagggttaagttaactagtgtttcttggtggatacaatacatatgtttttttgtgtcgtatctttgttcggttattaagc

SEQ ID NO: 10523 - DNA, 667 bp, Sorghum bicolor
  Clone ID: SORBI-28MAY03-CLUS17314_1
tgccgccgaaaccttcacgttcccttcccagttcccactccatctctcttctagttttcttcctcctcttctttcttcctgcaccctttggtactagccatcgctcccatccaagctcatcgtcctcacagatcgaccgacggatcaggccacacgcccccaatcaatactcactcaggactactagctagcttcgagtaagcaaacaaacatggcgtcgtcttctccgtcctgccgtggcggcggcaataaggcggacgtggaccggatcaagggcccctggagccccgaggaggacgaggccctgcagcggctggtggcccgccacggcgcccgcaactggtcactcatcagccgctccatcccgggtcgctccggcaagtcgtgccgcctccggtggtgcaaccagctgtcgccgcaggtggagcaccgccccttcacgcccgaggaggacgacaccatcctccgcgcgcacgcaaggttcggcaacaagtgggccaccatcgcgcgcctcctctccggccgcaccgaccacgccatcaagaaccactggaactccacgctcaagcgcaagtactacgccgcttccgccgccgacggcgatgcggcaaacggaggtgcagcggatgccgacgacgagcgcccgctcaagcgcaccagcagcgac

SEQ ID NO: 10524 - DNA, 736 bp, Sorghum bicolor
  Clone ID: LIB5049-002-R1-XP1-C8
gccggccgggccgggaaaatctacagccgctccccttccgtctcgtctcgtctcgtctcgtcttctccactaccagtctaccaccaccaccgctgctcgcgagacagaaaccgcaaggaaccaaacgcctttccgctccgccgctaaccaaccacccactcgtccgcgacaagccgtcgtgttttttgtcttcttcgttctttcatccatccaaccatccgtccgtccgtcgagggatcggatcggagatgggcgcggaggcggagtgcgacaggatcagggggccgtggagccccgaggaggacgacgcgctgcggcggctggtggagcggcacggcgcgcgcaactggacggcgatcgggcgcgagatccctggccggtcgggcaagtcgtgccgcctgcggtggagcaaccagctgtcgccgcaggtggagcgccggcccttcacgcccgaggaggacgccgccatcgtccgcgcccacgcgcggctcggcaaccgctgggccgccatcgcgcgcctcctcccagggcgcaccgacaacgccgtcaagaaccactggaactgctccctcaagcgcaagctcgccgtcgccaccaccgccgccgccgtgtccggttcgggagtggtctccgctgacgccgccgccgagatcgaggcgacgcgcccgatcaagcgcgtcagcctctcgcccgacagcccgtcgggtttccgggtcgggggtccgggttctaggtc

SEQ ID NO: 10525 - DNA, 650 bp, Sorghum bicolor
  Clone ID: SORBI-28MAY03-CLUS17520_1
ggccgcccgaggccggcccgctccggatcgcttctctagctcgcccataccatagctgctggtaccggctgcctgaaagctccctctgtttccttgtcttctccggttgtccggcttcgtctccctccgcctctccgcactcagtcgatggcctcacccggagcagcaaagttcacgcagatggaagccgcgcggcagtccctcatcgccatctcccagtcggtgccggagatcggggcgcccgtcatcaggcctcctagcggcggcgtaggcggatgcggcatggatgagaacgggcacgaggacgtggcggagcagaggtacagggcgaagctcatctccatctccaaccagtcgcccgacgcccggcctacgccgtgccctcccaagaccggcgccgcctaaagagccgtgtgtgtgtgtaacgttgccgcatataggtgtacgtggtgtaccggaactaccggttgtgtgttctgctaatccactcgtggcccaggaaccaggacactgggccttaataatcgccttgaactgccaaagggaatacttgtgttcgagtgtgaactggaattgtgaaagaactatatgcaaataagtataacaccgttgatcgttgactcaaaaaaaaaaaaaaaaaaggcccctaa

SEQ ID NO: 10526 - DNA, 566 bp, Sorghum bicolor
  unsure (1)..(566): unsure at all n locations
  Clone ID: SORBI-28MAY03-CLUS17688_1
gccggccgggccgggatatctctacatcatctcatcacaaacttgcaaatccgcaacaaaatcatggcaagctcaaccatgagaaccggtctcctatttgttgttgttgttgcagctattcacgctttcgcaacgtccaccatggcagagacaactcccataaacgtcaatgatccagtataccaaaagattgccaggtgggcggtgacggagcacgtcatgctggccaacgacgggctcaagttcaacaaattggtgagtggtgaggtctatgtttcactaggctatttgtatcacctcatcatcgacgcatcggaccgcgatggcaaggatgccaggtacacggcggtggtgcgccagagtaccctgggaggggaactctctctttggtcctttaagccagctaattaaggcctaagcgagtgataattggcatgatgtgattgtctgaaatgatatgtcaaggttccttttttatgcatgtaaaaaaaagtcaaccttgaatcnnnnnnnnnnnnnnnnnnnnnnnnnnnnnnnnnnnnnnnnnnnnnnnnnnnnnnnnnnnn

SEQ ID NO: 10527 - DNA, 1458 bp, Sorghum bicolor
  Clone ID: SORBI-28MAY03-CLUS1977_1
agcgtccgcccagcacgactcctagatccaatccaatccacacgtcagctcgtgacgatcatcagcagccatgtccggcgacgcggcgccgcacgtcgtggaggacttcttcggggccgtccagctcctcagcgacggcaccgtcgtccgcggcgacgaggcgcttctgatgccggcggagccgttcccggacgttccgggggttgagtggaaggacgccgtgtacgacacggcacgcggcctcaaggtccgcctgtacaggccggcggcggcagacgccggcgacggaggtagcaacatcaagctgccggtgctggtgcacttccacggaggcggctactgcatcggctcctacaaccagctcggagggggcgaccacctccggcgccgcctcgcggacgacctccccgcgctcgtcctctccgtccagtacaggctcgcccccgagcaccgcctcccggcggcgatcgaggacggcgcgacgttcctgtcctggctgcgcgggcaagcgtcgctcgccgccgcaggcggtgtcggtgccggtgccgaggccgagccgtggctcgcggagtcggccgacttcgcccggacgttcctgtcgggcgtctcggccggcgccaacctgacccaccacctggcggtccgtgccggctccggacaggtcgacctcgccccggtgcgcctcgccgggcacgtcctcctgtccttgttcctcggcggcgtccagcggacggcgaccgagtcggaccctccggacggcgtctcgctgacggtcgccatgtcggaccagctctggcgcatggcgctgccggtcggggcgagcttggaccacccgctggccaacccgttcggccccgacagtccaggcctggagaacgtggcgctgccgccggtgctcgtcgaggcgcccgaggtcgacgtgctccgcgaccgcgtgctgctctacgcggcgcggctcagggagatggggaaggacgtggagctcgccgagttcgagggggagcagcacggcttctccgtccggcggtggggccaggcgaacgaggagttgatcaggatcttgaagcaggtttgtacacctggtgttccaacttgaagtgaccggcgctgacgccggcggcccggcctacggttgaagtgtcgtcctcgtcgagttggtgctggtcgcctttccgttcttgttcgcgttgtgtttttcgctccgcattcgtcaagtcgctgtcgttgtttttgccaagttttaataatggccatgctccaataaccgacgatgctatcggggaattggctaaaaatccagcgaaatcacgatcagatgcgagctgccgtcgggcgggcgttgggttctgggttactggatccggttctagccgaactaattggtttttttcagcaaaggttaatacaatagggccttgtttagtttacctgaaaaccaaaaagttatcaagatttcct

SEQ ID NO: 10528 - DNA, 754 bp, Sorghum bicolor
  Clone ID: SORBI-28MAY03-CLUS19960_1
gcgggatgcatgtggactttttcccgtcgtctctctccttgcgcgtcgataaaccacgcacactcctctcgcagtcccccccttctccacgccccctgctcgactgctcccgtgatctgatctgatcggcgatcaactcggcatggcggactggggccccgtggtggtgggcgtggtgctcttcgtgctgctgtcgcctggcctgctctgcgagctcccgggcacgcaccgccacgtcgacttcggcggcttccacaccaacggcaaggccatcttcgtgcacaccctcatcttcttcgccgccttcaccatcctcacgctcgcgctccacgtccacatctacaccggctagtactagtctatatgtatgtgtggtggtcgatctgggacttgcagaggtcagatcagaatcagatcggatcatggccgtcgttgctgctcttgttcctcttcaactcgatcgattcgacaagtgcttgtactgccttcctcattcctagctatcactcgtatctatatcatgtaaaggccatatggccgtcggtctgtagctaacgcttgcaggaactagtgcctgcccttttaatcgaatctgttggttggttggttggagcaaaaaaaaaaaaaaaaaaggcccctaagctaacgcttgcaggaactagtgcctgcccttttaatcgaatctgttggttggttggttggagcaaatctattagtatttgctggttaaaaaaaaaaaaaaaaaaaaaaaaaa

SEQ ID NO: 10529 - DNA, 993 bp, Sorghum bicolor
  unsure (1)..(993): unsure at all n locations
  Clone ID: SORBI-28MAY03-CLUS19973_1
gcacgagggcctcctggctgttccagtaagctttgtgagtgagcacattgagacattggaagaaatcgacatggagtacaaggagttggctctagaatcaggcattgagaactggggtcgggttcctgctcttggatgcacttcaacgttcatctccgaccttgcagatgctgttgtcgaagccctgccctctgcttcagcacttgctgccagaaaggtagtcgacactgtgccctctgcggacctactagcaaacctgaccaagatgttctttggctccagcatggcatttatgcattacttatcaaagatgttattttctgcgatcttggcatttgtcctgctgttatcaccaagactagtttcagctttccggaacaccatgctttaggttggctaggtaagcagaaatggtgtgacagatagttttccaaagcactagatttgagattgataatggaataactgcaaggaatttggtgatcgtaactagtgatcgtataggccacaagatagtagctgcaatttgcagttcgtgatatggtttagaggcaacattgatctgatgaagctatgaaagcacggaacattacagctcaaagatcttttgtgtcttgtataattttgtttggcacacccgtaatacgggaggttgttacagacaaaaaaaaaaaaaaaaaagaatcctggaggctattgctacaattgctttatgcttgccaaggtgactgcattactcctatgcataggtgatgtaatactgattattcccttcatccctccatcctagaagtttttgtgacgatttaagcgagatgagaaatgatgcatgttagcatgtaccatttgctaaagctaacttcatttttgacgttatacagtataaaattctacctatgcaccgtactgtaagtatgaagcatgagggtgttttttagagtgtcaaaattttgcacggatgcctcgagaagttgatcaactgtcacaagtgng

SEQ ID NO: 10530 - DNA, 806 bp, Sorghum bicolor
  Clone ID: SORBI-28MAY03-CLUS20230_1
gtgcgaggctcgacccggcggaacctgaacagctactacatacatacgtcctccattagcagcagcaaaagctagcaacaagaatcagagtaacctgatcaaacatctcagccatggcggggatgacagcagtcggcaagaagctggcccttgcggcggcgctgctgtgcgcggcggcggccatggcggcggcgcagcaggcgtccggcgtgcgcgccacgtacaactactacaacccggcgcagaacaactggaacctagctgggacgtactgcgccacgtgggacgccagcaagccgctgtcgtggcgcagcaagtacggctggaccgccttctgcgggcccgccggtcccactggacaggcctcatgcgggcagtgtctcctggtgacgaactcggcgacgggggcgtcgctgacggtgaggatcgtggaccagtgcagcaacggcgggctggacctggactacgacacggcgttcaagccgctggacaccaacggtgcgggcctcaatgctggccacctcaccgtcagctaccagttcgtcaactgcggcgacaactgatgctgtcatgaacatgattcttccaagaattaattatatgtatgtatgtatgtgattccacacgttacctgtcaataagtgggcgtctagttgcaaccattgctattgaatcatgcgtgtctgagttgtacaccataaaacatatatacgcaaagtggaataaaaactgagttacgtgagtacttgactactcgtgtaaaaaaaaaaaaaaaaaaaactcgagactagttctctccctcgtgc

SEQ ID NO: 10531 - DNA, 1416 bp, Sorghum bicolor
  Clone ID: SORBI-28MAY03-CLUS20322_1
gcacgaggccagagctctcgccgtccaccgcacgctgaggcctggtggttcgctctggcgccctagcccgagctcgcaaccatggcgaggggattgaagaagcatctgaagaggctcaatgcacccaagcactggatgctagacaagctcggtggagcctttgctcccaagccatcatctgggcctcacaagtccagggagtgcctgcccctgattctgatcatcaggaaccggctcaagtatgccttgacataccgtgagggccgatccatcttgaaaaaaaaaaaaaaaaaaaaaaagggcaggcacgaagcagagcgaaccaccaggcgtcagcgtgcggtggacggcgagagctccggcgccctagcccgagctcgcaaccatggcgaggggattgaagaagcatctgaagaggctcaatgcacccaagcactggatgctagacaagctcggtggagcctttgctcccaagccatcatctgggcctcacaagtccagggagtgcctgcccctgattctgatcatcaggaaccggctcaagtatgccttgacataccgtgaggtgatatccatcttgatgcagcgccatgtgttggttgatggcaaggtcaggactgacaagacctacccttctggattcatggatgtcatttccattccaaagactggtgagaactacagacttctctatgacaccaagggtcgcttccgccttcactctgttagggatgaggacgcaaagttcaagctttgcaaggtccgttctgtccagtttggtcagaagggcattccgtatctgaacacatatgatgggcgcaccatccgctatcctgatcctcttattaaggcaaatgacacaatcaagattgatctggagacaaataagatcgttgatttcatcaagtttgacgtgggcaatgtcgttatggtcactggagggaggaacactggtcgtgttggtgtgataaagaacagggagaagcacaagggaagctttgagaccattcatgtggaggatgccttgggccatgccttcgccacccgtatgggcaatgtgttcacaattggcaagggcaacaaaccatgggtgagtctccccaagggcaagggtattaagctcagcatcattgaggagcagagaaagcgggatgctgctgctcaggctgctgcgaatgcttaagtagtttgcataaagtttgctgaaacattcaatgaaaatatgccttgcatccgagtttgggactgaaatgtaacccttttaggctagtagttattagtattttgaaatactctagacatctatctatcaggttagcattatctcatggcaagtcattacagaatgtttaatttggttccattctagattttgttgtgctaaaaaaaaaaaaaaaaattcgagggggggcccgg

SEQ ID NO: 10532 - DNA, 1348 bp, Sorghum bicolor
  Clone ID: SORBI-28MAY03-CLUS1822_1
gcacgcccctctctccctcctcctcatcgattctttcacacccccaccagccgcagcagcaatcgcgctaatcgcccccgttaatccccttccaaatccgcgatattcccaagcatcttctcttcccctccccctcccgcgctatatctctcctcccattgcgccgcactgctcccacacgctcggattcctgctcgctttctccgcctccgcctcggattccatcgccgccccttttccttccttcttccgttgcccgcccgcccaggactctccttcgcgcttcttagccagctccccgcccgcccaggactctccttcgcgcttcttagccagctccgtccttcgcaattcttcgccagccgtcggcgagagagagggaagggatcgctcgtgacttcgctcactcgggactcgggatcgcgcggcgccaccgtaccccgcctggacatgtgcgtggaggagctggacgacgcagcagggaggctcggcttcggagaccaggagatcgacaggcgcgcaggtgccgcgatggagagagtttgtgagaacacggtgtctgttgagttcaagcagactaagctgaacaactttgttccgttcatccggtcaggggattggtctgatattggaagtcgcgattacatggaagatgcccatgtgtgcatctctgatctggcaaagaattttggctataactcggtggatgatgaagtaatttccttctatggggtgtttgatggccataatggcaaagatgctgcccattatgtccgtgataacttgccacgggtcatcgttgaagatgctgattttcctcttgagcttgaaaaggttgtcaagaggtcatttgtgcaaactgatagtaagtttgcagagaaattctctcatcagaagggactttcttctggaacgacagcacttacagcaatgatttttggaagatcccttctggtggccaatgccggtgactgcagagcggtgctctcaccgcgtggcactgccatggaaatgtccaaggaccacaggccttgctgcatcaatgaaaggaagcgtgtcgagtcacttggtggctatgttgatgatggttatctaaatggtcagctggctgtcaccagagcacttggcgactggcatctcgagggcatgaaagaaatgggtgcgccaggagggcccttgagcgctgaaccagagctcaagatggtcacgctgacaaaagacgactagttcttgatcattcggagggactgcatctgggactttttatgaagccacaacgctgtggacttttcgcggtggaaggtccaaaaccccaacaaccctggggtgtgctggaaggagatttgtc

SEQ ID NO: 10533 - DNA, 959 bp, Sorghum bicolor
  Clone ID: SORBI-28MAY03-CLUS18563_1
gccggccgggtcgggacttcacttcgctcttcctcctcacgaaaccagagcaaatccggcgagccggtgcggcggcagcgggcggaggagggagacgccggcgcgagcaggagcatcaggaggaggcggcggagatggatccggacgcggtgaagtcgacgctctctaacctcgccttcggcaacgtcatcgccgccgccgcccgcgacctccagaaggaaatggtggctaaagacaaggctcaagcagcacctgcaagccatgatgaagttgatcttgatgagttgttggatgaccctgaacttgagaagttgcatgcggagagaattgctgcccttaagaaagaggctgagaagcgtgaagtgctaaaaaggcaaggtcatggtgaatacagggagataactgaaggggacttccttggggaggttactggcagtgaaaaagtcatatgccatttctatcaccgtgaattttaccgttgcaagatcatggataagcatttgaaggcccttgccccaatctatgtgggaacaaaattcgtcaagcttgatgctgaaaatgctccattctttgtgtccaaactggcaatcaaaacattgccatgtgtaatactgttcaagaagggtattgctgttgaccggttagtcgggttccaagatcttggaagtaaagtcgatttttcaacaagagcattggaaaatattctaaagatgaaagggataattgatgagaagaagaaagatgatgatgatgacgatgaagaaagtgagtctaagaataggagggttagatcttcaactgcccaagattctgactcagactgaacatgagatgaggattgaggattcgcccttttttgcactttagattttgtttgtttgttctgtactgtaattgatttgtgtgacccatgtatcgataccagataccagtaacaagagcatgtacaagagattatt

SEQ ID NO: 10534 - DNA, 969 bp, Sorghum bicolor
  Clone ID: SORBI-28MAY03-CLUS18167_1
gcacgagggtttcatatatccatccattatctgaaaacggaaaacctgtagacttgtccaccccttctttctaccggaacgccaataaatccaagcccatgcgccggccgctctacccatacgcttcatcgtcgttctcacccaccagaggagaaaattgcagcagcacataattgactactgcatccatggcgtccacttccatgtccttggttctcttcctcctcctcgcaaccttcgccgccggtgccagcgccgccaccttcaccgtcaaaaacaactgcaactacacggtgtggcccgccgccatcccggtcggcggaggcacgcagctggacccaggacagacatggactgtcgatgtgcctgcaggcaccaccggccggttctggggacgcacgggctgttccttcagcggcggaagcggccactgcgacaccggcgactgcgccggcgccctcaactgcaccgtctccgggcagccaccggcgacgctggccgagttcagcatcggcggcaccgaggattactacgacatctccgtgattgacggctacaacctcgccatggccttctcctgcagcaccggcgttactctggtgtgcaggagcccgacttgcccgcaggcgtacccgtttgcgagcgaggatcccaagacccatggatgcagcaccaacagcaactaccagctcaccttctgtccatgaaacggcaggaggattattgtggtcacgtacgtacaccacatatatgcatgaaatatctgtggaaaacgaacgtgcgttaccgcgttattagtgttctacccgccatatatgtaagtagatagtacataaaaaccttctaaataaatctgaaaatgttttcagcaaacaaaggtcaaaggtgtgtatttgctaataaaagctagctagcgccccatgattgtgctacacctggttcgtgcgttcttgattacaatatcaataa

SEQ ID NO: 10535 - DNA, 924 bp, Sorghum bicolor
  Clone ID: SORBI-28MAY03-CLUS18658_1
tgtgcggcgctcgagccggccgggtcggggctcctccgccgcctcctcctctctctctctctctctcgctctcgctgccagacgactgttgggccgccgccgccgccgccgccctaggccaggtgctgaggggtctcttcgccggcgacgagcacccaccaggtactaccaccccttcaccagacatacggtgaatgatggcaactctgaaagatgcagcagcaaggaagcctgtactggcaacaatccgtcttattgtcccagctggtgcagcccgtcctgcacctccagttggcccagcacttggtttctatcggctcaatttgatggctttctgcaaggatttcaatgccaggacccagaaatacaaggcagacactccaatgcaagtcaccttgactgcctacaaggatagcaccttcgagtttgtggtcaagtcgccctcagtatcatggttcctcaagaaggctgcaggaatagaaactgccagcagtcgcccagggcacagcaatgtgtcatccctcactctgcgccacgtgtatgagattgcaaagttgaagcaggctgaccccttctgcaagcacatgtcgcttgaggcactgtgcaagtccatcattggcacagccaactccatgggtattgcaattgttaaagatctatgagcagcatggtcagccttttagtcatgaagaattctgtgacatttgtgtgttcctagtttttagttggtgctggagagggtagaactcttctgtctcacagatctttctgccagtgtcatgcctttctaggagtatgaaactctattatgcagttcctggcatagccttcggctcagcctttttctcttcctttgttcattttgtgacttaactgatactatgtggttttacgttggtgctttaagtaataaattatagtttc

SEQ ID NO: 10536 - DNA, 894 bp, Sorghum bicolor
  Clone ID: SORBI-28MAY03-CLUS18586_1
gccggccgggccgggaaactccaaactccaaagtcccagctcccaacacaacacccatcctcatcatcctctgttccagtccagcagctagctatagctagctagcagagcttctccctcctcctctttctcttcgctcacaacgctacgctagctccatagtttcagtcgcaagaccgagtgaccgacagagatgaggcgctgcagcagcaagatctcctcatcaccgccccttgtcgctctcgctctcctcttcctcctcgtcgtcgtctgctcctcctcctcctccttccatggcgcggcagctgctcgccccctgcagcctgctgttcctcttcctcctctgattgctcaccatgaggatggtgccaaggcggcggcgacggcgacggcggcggcttcttctgcatctgacggcctagtgcttgatgagagtgctgccgtggtcagcggcgacgacgagctttcactttcagtctcatccgaggtgatgggagcagatcagtcggagttggaggaggaggagggtggagtggcgtgcgaggaggcgggcaacgacgacgagtactgcatgcagaggcggctgctccacgacgcgcacctcgactacatctacacgcagcacaagggcaagccatgaggcacgaggaggaggatgcagatggaggagcgaggagcttgcagttccgagctcttcgtctcggttgctacggcctgcttgttgcattggagtcgtcgtacgttcatgctggaaagttcgttgaagggaatataatcacttgctagcttaatttaatgtaatgctgttactaattaacatccgtacgtcttctccgtgtaggcctcgtgcagtatatactagtactagtatgcttgtgtactacgtgtacgtac

SEQ ID NO: 10537 - DNA, 1243 bp, Sorghum bicolor
  Clone ID: SORBI-28MAY03-CLUS1874_1
atactactagttttttttccgaaacattcacacattcatatatactgttatacatagtgaaagctgcagattaattaacatcgtctcgtcgaatcacagaatcatagcagctatgcatggttaatcgaggtgtttttcttcctcggttacagattttacaaccgaaaattcattcttgagatgaaaacgcaatgcaagcatgcatgcacgcaccgcgtgtgtgcacgtacgcctgcacacggccacctcctcccttctcccttctccgatccctttctagcgatggatggcggcgccgatggagaggaggttgctggcgagcttctggagctcctggtcatggtcggtcatcaccgacgggatgccgtgctcctggaagccgtcgtcgcaggtggtgaggtccgtctccaccgagtcgaggttggtgtgcgccgtgtcgacgtcgccgcgcttgagcgcgtcgtccaccgagtccaagctcgtcttgatgtcgctgtacgacgacgtgcacgagtccagcgcgtccttggtcgtcccgtccacgcccggcgcgttcatccggtccgtcgccgcgttcatcgccacgatcaccttctgccgcaccgcctccatggccagcttcagcacccccacgctgtccgtcgccgccgccgacgccgccccggggagcccgccgatcgacgcctcgcagtccaccgggtactccgtcttggcgcacacgctcttgatcaccgggctcaggaacttggcgatcggcttcttgatcatccccgataacgtctccatcgacagcttcggcttattccccgccgccggcaagttcggctgcccgttggcggccacgttcggcggaacctcgtcgggagcgccaccggccatgggctggctgctgacgacctgatgctttgaagataagtacgggtcgggggtggcggagctcttcgccgccggtggaagctcgtccggagaaccaccggctatgggctgcctgctgctgacgacctgttgctttggaggtgcgtatgcatcggaggtggcggagctcttggccgccggaggaagctcgtcgggagacgtgtatgcatccgtaggggtggagaccggacgcgcgggtaccttggacttcagagaagacacatattggccggtggtggtggagacctctaccggcatggcttcatcctcgtcggattggtccttactgggagagggagacacatattggccagccatggagacctcg

SEQ ID NO: 10538 - DNA, 807 bp, Sorghum bicolor
  Clone ID: SORBI-28MAY03-CLUS20685_1
gggcaatgcagctgaacatgcaagcgcaataatgtttgccatgaaagataaacttgacataacactcggtgttccctctggtcccgccactcagctggcaatgtttgtgattccattttgtgttgttattggttggatgatgggacataagatggacttgaattttcaactatttgcgacagcaactctcttcataacagtacttgtggtggcatttatgctacaggatggcacggcgaactacttgaaaggacttatgctgattctgtgttatctaatagttgctgccagtttctttgttcatgttgatccacaatcgagtgatggctgatgccatagctgctgtaagtaatgcgccaaataccttttgaagactcgctgatcttgttttgtggaggtgctactccatagcaacgttccacctgtctcgagcagaatgttagcaaaaaacaaggggggtgcgaagatcacacatcatcggttccctcatgaactggagaaggaattgtattgtgtggatactgaggctttgaggtgtactaggggtagtctcaatgtatacagaaacaagaaacgccagcaagttacattcgattaattgagtggctgcggccctttttttgttttccttgctatttatctatcaggtctcaagaatgtaaatttgggtatatgatttgatgctagcagaggctaggtcttccaaaaaaaaaaaaaaaaaaggcccctgcatagccatggttccgcatccatgttatttttgtcctagtgatcgtgtgtacatttgatggcaaatcaatttatatg

SEQ ID NO: 10539 - DNA, 567 bp, Sorghum bicolor
  Clone ID: SORBI-28MAY03-CLUS20841_1
ccttcgatggtaggtgaaagggggaaaaggcacttctctctgcctgtgtgtccattggctgacgccgcgaccgcccccaatccacctgcccctcttcggagatctcaccgccgccgtcgacctccgtcgttccccctcctactcagcgtccggcttacccgatggcgcggctgcactggctcgaggccgtcctgccgctgggaatcatcggcggcatgctctgcatcatgggcaacgcccagtatttcatccacaaggccgcgcacggcaggccgaagcacatcgggaacgatatgtgggacgtcgccatggagcgccgcgacaagaagctcatggagcagtcctccggcaattagggtattgatcaacctcaaacttttctggatgttgacgaacctctttcaaaagcacagaagtactgctctttagtttcctgtacaatgggaaccaaggcttaattgttttgctttgaaatatcaacagtttggagaataatctgtatctgacatctgtttaattgaacaaagccaaatcctttgtcaattgaaaaaaaaaaaaaggccccta

SEQ ID NO: 10540 - DNA, 947 bp, Sorghum bicolor
  Clone ID: SORBI-28MAY03-CLUS20859_1
gtcaaagacaacacagcaccagccaccagcgacagcagcgaggtttcccccaattccccatctctcccgtaggccgtagcagagcacgcgcgattctgaatcccccgtcgccatggcctccgcaccgacgccgccgcccctcctcccggtgaccaacccggcccccggatcgtccccggccaccaccggaggctccgatgcgccgatcgccacgccggctttccggctcttcctgagccggctctccgactcggcgcggcgctcgctgtccgatcgccggccgtggggggagctcctcgaccgctcggcgttctcgaagccggactccgtctccgacgccacctcccgcctgcgccgcaacctcgcctacttccgcgtcaactacgccgccgtggtagccttcgcgctgggggcctccctcctggcgcaccccttctcgctcctcatcctcctgggcctcctcgccgcctggtgcttcctctacctcttccgcgcctccgaccagcccgtcgtcctcttcggccggaccttctccgaccgcgagacgctgctggggctcgtcggcgcctccttcgtcctgctcttcttcacctccgtcgcgtcgctcatcatctccggcctgctcgtcggcggggccctcgtcgcggcgcacggcgcgttccgggtgcccgaggacctcttcctcgacgagcccaacgcggccaccggcaacagcgcggcccaagggctgctgtcattccttggcgcacccggatctggggtttgaggcggcggacggcaagatccgatctactggtcttagtgatggtttcgattgatgcaccggcttctgcgcagatcagcaaatttatcgagaatttcaccctgtggttgagtttagtgccaagtatttgagtaatatgagtttgtggtgtcagacttttaatatggattgtattgtatcttca

SEQ ID NO: 10541 - DNA, 808 bp, Sorghum bicolor
  Clone ID: SORBI-28MAY03-CLUS20889_1
gccggccgggttccgagctctgaaactactctgccttgtagagtcgtccaccccccacaccaccagggcaccacccagaaacgcagcagaccatggccacttcgctcgcctgtgccggattcttcttcgacaccgagccggtcggggagccccgcctggccgcgctgaacgcgtgcgcgctctgctccaaaccgctggcccgcgacagcgacatcttcatgtacagaggggacacgcccttctgcagccaggagtgccgctacgagcagatgcagcacgacgccgtccgcggcgccaggcccaggcaggcggccaggtccgctgcccggcggcagccgtagtcctgtcctgcatggaggtgtcccctgtcccgtgtccgagtctccgagacgagttgaccacgccagaaaggagagcctggctgtggtgttcgtttcgttccacgatgaatcgatcgccggactttaattcctgcaggttctgatcgatggaacgaaagatgagagcagctacaggaacatttctacgtcacgacctgtgaattgtgagggtggactgtggagcaaggcgatgatgtccgtcaacgccatcatctgttcgctagcacgaggcttcgatgatcggccgtgctatcatgtgctcgtgcgtgtttgagccaggttgtaacactacgttgtaaactggagcattttggcagctttgcttccaacagctgatcgtcatgtgtcatatgtgtacaaatttgcttccaatataatggagcacgctagggacaatagtaacattcgtcatgtgtacaagtttctct

SEQ ID NO: 10542 - DNA, 832 bp, Sorghum bicolor
  unsure (1)..(832): unsure at all n locations
  Clone ID: SORBI-28MAY03-CLUS21278_1
gcacgaggccctcctcacctcctccccccgggacggaggcttttctggcggcggcggcggcggctcggcgagcaaacgccggcgacgtgcagcacctggaaagctcaggcaaagagcagggtagcaggaaatggcagcattcctgaggtcaaaatgtccatcagttgggcgtactttgatgggaagccttggaaatagtttgtttggagccgccaactcttctgttggggcagtaacaagaccttctcattgtgatgctatcagtcagcaaatcagaacattcatccagatgaggaccaacctcaaggtcgtggataactctggggccaagcgggttatgtgcatacaatccttgagggggaagaaaggggcaagactcggggacacgatcatcggatctgtcaaggaggcccagcctcgtggcaaggtcaagaaaggggacgttgtctatggtgtggtcgtccgcgctgccatgaagaaaggacgcagcgacggcagtgagatccagttcgacgacaacgcgatagtcctcgtgaacaacaagggcgagctgatcggcacccgcgtcttcggtcccgtgccccatgagctgagaaagaagaagcacctcaagatcctggcactggctgagcacatcgtttgaggccgtgttgtcatggttcttaggtgtctgcctgttagttctgcagagcgaaatgtttgtgggaatgtttccgttctctgtttgaataatgcattctgaaatgatagcatgaaccatttgaactccatttgagtccctggcaaattcatggtctcgacttgcatctgacgtaaacagntctattgcccg

SEQ ID NO: 10543 - DNA, 1011 bp, Sorghum bicolor
  Clone ID: SORBI-28MAY03-CLUS22400_1
ccgggatgcttgcggacatgatgcacacacaacaatgcttccgggggctgctaggatacttcaagatcgcaagaatgacctaaagggcactgtaaagcttatattccagccggcagaggagggtcagggtggtgcatattatgtgttacaggaaggtgttcttgacgatgtgtcagccatatttggcttgcatgttgacccagcccttcctgtaggtgttgtttcatctaggccaggaccctttgcagcaacatcaggtcgattcctagcaacggttactggtaaaggtgggcatgctgcaatgccccatgattccatcgaccctgttgtagctgcagccactactatcgtcagccttcaacaaattatcgctcgggaaatagatcccctgcagggtgcagttgtatccatcacttttatgaaaggaggagaagcttacaatgttattccagagtctgtggcctttggtggcaccttgaggagcatgacaaatgaaggtttatcatatctcaagaagaggatcaaagagatcgtagaaggacagtcactggtacatcattgcactgcctctgtggacttcatggaggacacgatgaggacatatccggctgtgatcaatgatgaaaggatgtatgctcacgcaaaggaagtggctgagagcctccttggggacaagaacgtcaagcttggtccccaggtaatgggtgcagaggatttcgggttctatgcgcagagaatggcgggcgccttcttcaccattggagttggcaacaaaagcaccatggagacaatccattccactcactcaccctactttgtgatcgatgaggatgtgcttcccatcggagctgcgttccatgccggtgtggcaattgaatatgtgaagaagaatcatgcatcaatctaaactgaataatgggaaaaacaaaagccttgttggaatagtttgggcattctccagttatgcttttatgaattgtggtgggtggagggagggttgaattttagcac

SEQ ID NO: 10544 - DNA, 610 bp, Sorghum bicolor
  Clone ID: SORBI-28MAY03-CLUS33164_1
tctggatctctcttctcccgccgcccagctccgcgccccttctctctcctcggcggcgccgcggcgatcaagtgcgaatcgagtgcgagacgggcctaaccggagagtccactatgggcggcgagaaagaaacctttgacatctccgacctcaacgcctccctccccgcggccgctgcagccctcagcgccgaggaccgcgctggcctcgtcaatgcccttaaggataagctgcagagcctggcgggccagcacgccgatgtgctagagtcgctttcgcccaatgttaggaagcgtgttgagtttttgagagagatccagagccaacatgatgaaattgaggccaagttttttgaagagcgagctgcacttgaggcaaagtaccagaagctttatgaacctttatacacaaagaggtatgacattgtaaatggagtagtggaggtagatggtgtcagtgatgaaccgaccagtgagaatgctgctgagggaaaagaaccagatgctaaaggagttccagatttttggcttactgctttgaaaacaaatgaagttttgtctgaggagatccaagagcgtgatgaacctgcgctgaaatatctaaaagatat

SEQ ID NO: 10545 - DNA, 791 bp, Sorghum bicolor
  Clone ID: SORBI-28MAY03-CLUS33177_1
accacaccttgttccttcgcctcctcttcctcctcccccgcccgtcgggtcgcctccctcctcttcctccccctttcctctctcccccccaccccacctcgcctcctccccggatccgcatggcgcatccgcagtccgtcccgtagcagcggctcgccccaccgcccgctcgctgccccgtcccaggctcatctttccacagtcattggaggacctttgatgtttcagcacttgtgacgtttagtagatgtctttccgcagcattgtgcgtgatgtaagggatggctttgggagcttgtctcgaagagggtttgaggtgaagattctgggccaccgcagagggagatctcatggtgctgtccatgagctgcatgatccagccccagtgatccagagcagctgttgggctaatttgcccccggaattgcttcgggatgtgattgagaggttggaagccagtgaagccacttggcctaacaggaagaatgtagtttcttgtgcagctgtttgtcgaacctggagagagatctgcaaagagattgttaagaatccagagttttctggaaaaatcacttttcctgtgtccttaaagcagcctgggcctcgagatgtaaccatccagtgcttcatcaaaagggataaatctactcaaacttactacttgtatctgtgccttagcaccgctgtgcttgttgaaagtggcaagttcctcctatgtgcgaaacgaacctcccgtccaacttgtacagaatatacaatatttatgaattctgaaaatttatctaggtcaa

SEQ ID NO: 10546 - DNA, 1221 bp, Sorghum bicolor
  Clone ID: SORBI-28MAY03-CLUS33221_1
aaaagctcggaatcaatcgtgttcctcttccgcacgccgagaccaatcccccaatccagccgccgccgccgcctccgccgcttcgccttagcctccgccctccggcctcccctctgattcgaggcatccgatggagtgcatcgccgagatgccccgcgcgccgctggacagccgcccgcgcaagcggcagcggctcgggtgggacgtcggtcccgccgagatgtaccaggttacgcggccgcggctcggctgggacgtcggccccgccgagatgtatcagctaggactttgtggacaagaagttgtgaatgccatcagtgctgcggcattgggcctctcttcaggatgtgtttcttctcaagttaaccaagagcagcctcgtgatggttcccctcctctgagggaagatgacaaggatgggcattatgtttttgctgttggagataacctcacatctcgctataagatcattgcaaaaatgggagaaggtacctttggtcaggtgttggagtgttgggataaggaaaggaaagaaatggtggctatcaagatcatcaggggcattaagaagtacagagatgctgcaatgattgaaattggcatgcttgagcagcttggtaaatatgatgaaagtagatccaggtgagtctgctggttcagttagcactcgctgtgtgctttacattcataagattgcttgtatatataagctggtctattttgcagttgtgttcaaattcggaactggtttgactatcgtaaccatatctgtattgtaagtacattgttagattatggcaattatgaactgacccaaaaagataaccatgtggtgcttaaacgttggtgaatttggattaatggtgagcaggtctttgagaggcttggaccaagcttatatgattttctgaagaaaaacaattaccgctcattcccaattgccctagttcgggagattgccaaacaactgttggaatgtatagcatgtgtgtgcacagttctttctattacccctcctgcactataatgcatatacattagttttgtgcactatctgtgtgcagcctgtcataatccattactcctgctcatactaaggaatatctaacatcttgggatgtttatgtatttaccctctctgtaatgtgttgcagttatgcatgaattgcgcctcatacacactgatttaaagcctgagaacattctccttgtttctccgga

SEQ ID NO: 10547 - DNA, 1391 bp, Sorghum bicolor
  unsure (1)..(1391): unsure at all n locations
  Clone ID: SORBI-28MAY03-CLUS33227_1
gcacgagggttttcatctgtatagatttgcacaacggtacttataagaggaaaggaaggggcatcaccacaatgaatgacatattctcaaggacagctgatatgcctaaaattaaaataattctcaatcaatatggtcagcctgtaggagatgattataggaagtttgctagtgccattggctgtcaagtgagaaagaaattaccagttggatttaacgattggagggctgttccccttggaaagaagcttgaagtttgggataacttgtaggcattctatgatgtggatgctgctgccaagaaatggtttatggatacagctgcaaagaagtggaaggactacaaggcagacttaaaagacaagtattttgatgaaatattaacagatgaacaaatgaaggaaagacttanaaatatattagatgatgaagacttgaataatcttattatgttgcacgaggctcctgaatgtcaagctcgcactgaaagaggaaaagcaaatcgtgcgaagttgagggttcatcatacatctggaagcattagccatgcttgtcgtagttataatttgggtaaagcacttggacgtcgccctcgaagagatgaagtgtatattaatacacataccagaaggaatggtgtgcctttaagggaggcagcaggaacgattgatgagcttaaagccattgttgaagctcaaccagagttgaaggataaaacaattcaagaaggcgatgcgtatgctgctgtttgcggagcaaaggagccaagaggacgtgttcgtgttttgggtctgggaccaactcccaagaggttggtacccctaggctcaaagcactcatgtcaacaagaatgcaaatggaaattgttgctcgacagaatgctgaaagtaagaacagagctcttgagcaacgtattttggaattggaagaggaaaggttggcacaaggaaggacaaatgttgaagtcctatcacagcatggttctaattcaagacaatatgcgattctgacacctgaagaacatatcgatgaggcacataatgatcctcagcctgaaaattatgataattatgtacaagatgaagaaaatgaacggtatggcgaggaggacgaggacctgcttccatgtaggcatggtgcaacccgatcagctatgaacataacaacaccaaatgttcaaattgaagagaacttgacccccattaggcctgctgtagctgtccgttcagctgtgcacatgaatactgcaccaagcgatatccacccttgccttgcaaacgattcacatgttgcggtacaagagagcttgctgccccctaggactgttgcagcccgatcaactattaacatgacttgtggacactatattaagattttgataacgtttttat

SEQ ID NO: 10548 - DNA, 1185 bp, Sorghum bicolor
  Clone ID: SORBI-28MAY03-CLUS33239_1
gcacagggagccgccggcgctccaccaaaactaaagtacgtagtagatagcgcgagccccgcccccctcgcccccccttcctcggcctccgtgtcgctggtgcgccgtcccgcgctggcccgagttttttttttcgattcttatcgtagatagatcgaatccatcgattcgattcatcgctccatcgactggtggtagatagagatagggttcatacgcccattgattcgacgatgttccgccgcgactgcgtgggaccgccgccgccatgccccacggccgccgccctccaccttcgcagcccgccgtcttgaccaaacccaaaccctgactccgaccccggttccccgcgggaagattatataagagccagaacacaagcggcggcccgtgtgcaccaactaccaccaccaccaccggagcaacaggatggccgatagcggcggactcagcgccaacaacgccgccgccgccaaccacgacgacgacgccaacactgcgcctttccccgacacggtccaggtcggaggatctcccgagtacaaggtcgagaggaagctgggcaaaggtggcttcggccatgtctttcttggccgacgtctgactgctgcccatgctggacgctctgcggcgtctgctgcccaagaggttgccatcaaatttgagcacactaccagcaagggctgtacctacgggcacgaggctgaatggcaagtctacaccgctctaggaggcacgcacggtgtgcccaaggtgcattataaaggtcgccagggtgactactatgtcatgattatggatatgctggggcctagcttgtgggattcatggaattcattaggccaatccatgtcatcggaaatggtggcttgcattgccatggagtccatttccatcttggaaagcatgcattctaaaggatatgtgcatggagacgtcaaacctgagaactttcttctggggcagccttcaacgcctcaagaaaagaaactttatcttgtggatcttggattagcaacaaagtggagagatactgccagtggacaacatgttggttatgatcaacgtcctgatgcctttagaggaacagtcagatatgctagtgtccatgcacatttaggaagaaccgctagcaggagagatgatttggagtcacttgcctatacactagtattccttcaccgg

SEQ ID NO: 10549 - DNA, 931 bp, Sorghum bicolor
  Clone ID: SORBI-28MAY03-CLUS2202_1
ccggctccagccaatcccactcgcccagctcgccggctctcctcctccctccgccatggcggccttcccctccgcctccccgtcgccggcgatctccgcctcgacctggcgcatggcgtccctccgcgctgcccttcccgcgctccgcccctcccccggaggcaggctccggtcgtcgttcgcgcccgcggcggcggccacggcagcctcggtcggctgcctcggctccttctccggcctcgcgcccgtatcgaatctcctctccttcggtgctgagaactcaaactttgagcatcggttgtttggtattgatgctcgtggaaggatagttgcgatgcgacatgggagacgtgttcctaaacttaacaggcctccggatcagaggaaagcattgctgcgcgggcttaccacacagctgctcaagcatggaaggataaagactacgaagccaagggcaaaggcaatgaggaagtatgttgagaagatgatcacgttggcaaaggatggatctcttcacaagaggagacaggctctggcatttatctatgagaagcatatcgtccatgcattgtttgctgaggttgcagacaggtacggggacagagaaggtggttacacaaggatcatcccgacatttccgaggcggggagataatgcacctatggcgtacattgagcttgtctaggatcttccatcagttgatgtggtttcatgggcgacttgcaggctgagtggtcatgtctgtgaattgccctttggatgtctgtttttccttattaagttcttctgtaacaaagtgtagatcacgcgtgaaattttgaactggtcaagcttcatcatcctgtaattgacaaagagctacgctataatctggaaaaaaagtttctggcagcgcatataaaaaattcagcatgtcgaatgccctctgtcc

SEQ ID NO: 10550 - DNA, 631 bp, Sorghum bicolor
  Clone ID: SORBI-28MAY03-CLUS22272_1
ttccgatcacttcatccgagccttcagagtccagtgtagtgcagtgaaggcagcagcagagcgtgaggtgcagtgcactaccaggcatcaagaaatggagctccaggcgaggtgcctctgcgtcgtcgcgatgctcctggtggccggcctcgccgggctggagacggcgcacggtgcgggggagtgcggccgcgtcccggtggaccaggtggcgctcaagcttgccccgtgcgcggcggccacgcagaacccgcgcgccgcggtgccgccgagctgctgcgcgcaggtgcgcgccatcgggagaagccccaagtgcctgtgcgccgtcatgctgtccgacaccgcgcggaaggccggcgtcaagcctgccgtcgccatgaccatccccaagcgctgcgccatagccaaccgccccgtcggctacaagtgcggcccatatactctgccatgaagtgatcacgaggagcaaagtgatggctggcagagtggcactggcacctgaaggactccaaactctgactagcaatatgccgttacctgcgtcatatcttacttttcacagatccccagaataatgtggctgtaataatgcctgaactttggaataaaagtatttcttttccccgaagtc

SEQ ID NO: 10551 - DNA, 813 bp, Sorghum bicolor
  Clone ID: SORBI-28MAY03-CLUS22344_1
gctgatgcaccaaacttgtacaggttgtgcattgtgttcctcactttcagttgcattgggtatgccatgccgttcatcctctgtgcaatgatatgctgttgtcttccctgcattatatctgttatgggttttagagaagatacaaacaatacaaggggtgctacctcagaatctatcaatgctttgcctacatataaattcaaaaccaagaaacgccgccatggttcaggaagtgaagctgaaggacaagaaggagggatagtggctgcagggactgacaaggagcgatcgctttctgctgaagacgctgtttgctgcatttgtcttgcaaagtatgcgcacaatgatgagctccgtgaacttccatgtgcacactgtttccacaaggattgtgttgataaatggcttaagataaatgcactttgccctctatgcaaatctgagatagcgggctcgtctggtacttctgatgctcgtcaattagatcagaacgccattcctgtgcaggagatcgaaatgcattaggttggtctgctctctcagcttttcacataagaatacatctgattgtggctccccgtcttcatgtataaagttggagattgatgtatggaatgtagtgacacatagttttttttaatcactgctatcttggagaagttacagctattctcgctgtcatccaacaagccaatactacccaggttttcccaacatcgtggattgcaccttatgttctgttctgttgacgacattgcgtgacttcttttgagtccctactttcaagtgtgaagcaggcaggcgagattcttt

SEQ ID NO: 10552 - DNA, 879 bp, Sorghum bicolor
  Clone ID: SORBI-28MAY03-CLUS22194_1
ccgggagcaagctgcaagaagcaaaaatggccatggccattgccaagggctcagtgctgttgctcgtcttcacattcctctgtttctacgacgccatcatccgatcccacgcttcacctgatgacttccctcaatgcctctcagcggcgagcatccccagccagctcgtcttcacgcagagctcgccgtcgttcacctcggtcctggtgtcatccatcaggaaccccaggttcttcacgccatcaacggtgaggccgcagtggatcctcacgccgacgaacgcctcccacatacaggccgccgtggtctgcggccgccggcacggcgtccgcctccgcgtccgcagcggcggtcacgactacgagggcctatcctacaggtctcagcgcccggaggtgttcgccgtgctcgacctgtccaacctccgcgccgtccgtatcgacacgcggagctctaccgcgtgggtggactccggcgcgacgctcggcgagctctactatgccgtcgcgcaggccagcgaccggctcgcgttcccggccggcctgtgcccgaccatcggcgtcgggggccatctcagcggcggcggcttcggcacgctgctgcgcaagtacggcctggccagcgacaacgtcctggacgccgtgctggtggacgccgcacgggaggctcctggacaggaccgccatggggagtgacgtcttctgggcgcttcgaggcggcggcggggaaagcttcggcatcgtgctgtcgtggcaggtgaggctcgtgcccgttccgccgacggtcacggcgttcaggatcccggtcgccgccgccggcgacggcgagcgcgccgtggacgtggtgaccagatggcaggaggtggcgccagcgctcccg

SEQ ID NO: 10553 - DNA, 860 bp, Sorghum bicolor
  unsure (1)..(860): unsure at all n locations
  Clone ID: SORBI-28MAY03-CLUS19874_1
gccnnggccgggccggggagaaaagcccaaaccccaggcgtggcccgtattctctcttcccccacaaggcgcgatgccccctagatcggatcacgccggcggcagcgccgccgccgcggcggccacgcatgccgacttcgactccatcgatcccctcttccacgtcctccgcgtgctccccttctccttcctccggccgccgcgcacccgcctgaggctgccgtcgaacctggcgctcccgtcgcccatgaccgtcttctccctcatcctactcacctacttcgccgtcgtctccggcctcgtctacgacgtcatcgtcgagccccccggcatcggcagcgcccaggaccccggcaccggcgccgtccgccccgtcgtcttcctcccgggccgcgtcaacggtcagtacatcatcgaggggctctcctccgggttcatgttcctccttggcggcgtcggcatcatcctcctcgacctcgccgtcgaccgcaccaggccccgcagcctccgcgtctcgtttggaagcgccggcgcggtcgccgtcgtcatcgcctacgccatggccatgctctttctccgcatcaagatccccggctacctttggtgaggctgataaaatcttgcctgttaattaactagaccagatccgctgcaagatctcgctacatctaaatagatctgcgtgctgtggagtgtggactagcggactcctcttttaattttgtcaattgatgttgcatcgcacaatgttgtatgatatcaactcagaattgcttggtgaggattctcattttgcagtggtactattatcaacctgttcgaaaaaaaaaaaaaaaggcccctanggccgcggccgctct

SEQ ID NO: 10554 - DNA, 896 bp, Sorghum bicolor
  Clone ID: SORBI-28MAY03-CLUS2033_1
gcacgaggccggcatgagcacccggtcccccaccacaacttgccgccggcgagccgcggtgagttccttccccccctttcccctccaggctactcaagtcccgcctcctggccgcgctccacgaccacctcttcgcccgcggcgcctccgccgtccggctgccgcccccgcgccccccccccgccttgccgcccccccgccccgatgtccggggcgattcccttcctctccgcgtgggcgaaaggatccagtgaactacttccacacactcgctgcttctcccctgcccatggctacgccgcttatagcaggacttgcagttgcagcagctgctcttgccggtagatatagcatccaagcttggaatgcttataaggcacggcctgtagttccaaggatgcgcaaattctatgaaggtggctttcaacctacgatgacacgaagggaagctgctttaatccttggtgtcagggaaactgccaatgcagagaaggtcaaagaagcacacaagagggtgatggtggccaatcatccagatgcgggtggaagtcattaccttgcttcaaagattaacgaggcgaaggatatattgacagggaaaacaaaaggaggtggatcggccttttgattggaaaatggacatgtccttccactgaaaggacaattttgtacctccagactcgcgttttagaagatagacagaaatctttctgctacaaaaatttgtggacaaaaacgtagtggacctttttggagtaggctattcactgcttaataaagctcggttcaagcctgaatcaatgatgtaactgctgtacatggtaaagtgtcctttgtcacttgtattttgagagacatcactacacgcttctttcagaactaacagcctcagtcgt

SEQ ID NO: 10555 - DNA, 1124 bp, Sorghum bicolor
  Clone ID: SORBI-28MAY03-CLUS20350_1
gcacgaggaggcaatggtctgctgtgcctgcttgcggctctagggaagcgataagccacacctatttggctttcgatccggttgtatcctctcactttcacttggtccagctccagattcctgatgtgcaagagaatgtagtgtcgttgcatgtttactcgtctgaaactgggacttggagtcacaaccaaattgacaaacaaaaagagcaaggacaattggaagggtggcatcatcagtttacactagaccctcttcagcatcagtgtgcctttgttaatggcttcctacatctgatagtttggggctcaaatgtacatcacatacttgctgtagatgtacaagggaaggcaagaaggatgatcacggtgccattgccaggtctggctgatgggaggcacgggcacgcctttgtttgttatttcggtcaatcccaagggcacctacattgcatgattctagagtctgctgataaaaagaatgtggaactatccacctgggttcttcaggattatgatacacaagaatgggtgttgaaaaacactgtgaactctttggatgtctttggagatatgggtggagtgctagactttcaagtggttgacattcatcaagattgtaatgtggttttcatttttgatcagttgaactatgagctggtagcatacgacatggaccgtaaggaagcgagtgttattgccactttggaagatgacaaaacccaatctgattttgctcgttacattccctatttctcagaatcaccagctctcacaaataagtactgagtgtgtgctctaagtatgagctagcggcttggttaaataacagtagactcatgtgaaatgttctgcttgtgcttggatgtatgccttcttaattagtactgcaagcctgttgagacattggatgtatgcctttcatgcttttgatctaattagtactgcaagcttgttgaaacatttatatagtgtacctttagggatgctaattatattaatgaatattgttgcacaagttgaacaatttcgacttttggtgataagttttatgattagcatgtcttttttggctgtattaatgatcaattatttattggaaaaaaaaaaaaaaaaaggccccta

SEQ ID NO: 10556 - DNA, 1360 bp, Sorghum bicolor
  Clone ID: SORBI-28MAY03-CLUS2037_1
ctgctgagggccagttcgtcgcttcggtccagtcagagttcccgcgtccacggctgcgtgggcggccgcgtgggctccactcccacccgcctgcctccgcgtccgcctgcaccgggcgggccccctcccatcgccatgcctccggccgccgccgccgccgccttcctcttcccggccgtcgctgtcccctgccgcgtgcttcctcaacggcgggcgaggagcctcgccgtccgcgccgtcgcctcccctccagcctccacggtcaagcccgccccggcgccctccaagactgggaagtgggagtggaaattcgagaataagccggtaaacatatactatgaggaacatgagcaggaggttgctgagaatgtgaagaacattatcatgatccctacgatctctgatgttagcacagtggaggagtggagggtggttgccaaagatattgtcgggcgaaaaggagaacttggctaccgtgctactattgtcgattggcctggtcttggttattcagacaggccatcactgaactacaatgctgatgtgatggagagctttctagttgaactaataaattcaccaaacagtccagtggcaaatgcagatgatgaactggtcattgttggaggtggtcatgcagcaacaatagcaattcgtgcagctggtaagggccttataagaccatctgctgttgctgctgttgcacctacttgggctggaccccttcccatcgtatttggccgaggttctgatatggaaacaaggtatgggcttctacgaggaaccctcagggctccagctctgggctggatgatgtacaatgttctggtgagcaatgaaaagtcgatccaatctcagtacaagtcccacgtctatgccaattcggacaacgtgacgcctgatatcatcgagagccgatacgagttaaccaaaagaaaaggcgcacggttcgtccctgcagccttcctgacaggcctcctcgaccctgtccaatcaagggaggaatttctgcagttatttgccaagttagatggagatataccagttctggtggtgtcaacactcaatgctcccaagagatccaaggctgagatggaggctcttaagggctctaaaggcgtgacaaaattcgtggaggttgccggcgctcttctaccgcaggaagaataccccttggcagttgcggaggaactctacagcttcctacaggaatcattcgcagcaagaagatgaatgtgcgtgcttacaattgcgcccgaaagccaggttcaagtcccccacactttgtgagtaaattcgttaacctgctaccgtgtattggaggttatagcatcaataaagcagcatcacttatcccctc

SEQ ID NO: 10557 - DNA, 1053 bp, Sorghum bicolor
  Clone ID: SORBI-28MAY03-CLUS2038_1
gcgttcttcgcgcgtgccatccgtgatgtgggggatgaggagcttcgcagcttcttctatggcatgtcaccatggcagttcattctcatcgtggctgctagctcaattggtgaggagctcttctgccgtccagctatgtagggagcattggctgatattttcctgagaagcacagagctaatgaaagatgctcgagggattgcatccctgagtggtattgttcctcctttggttccatttgctcaaacgtttgcagcagtcatcactgcagccctcacaggaaccctctactatattgccacagctcccaaagaccctacatatgttgtgacaccagcaatgcgttcgcgcacagggcgggagaacctcaagaaactatttgcagcttggtacgagaggaggcaaatgaggaagatatactccccgcttctagaaggaatcttggctttctaccttggcttcgaatggatccagaccgacaatatcctagcacctatgatcacccacggcatatactccaccgttgtccttggccatgggctctggaaaatccacgaccaccggagaaggctacggcagcggattcagcaggtcagaagtcaagagagcacgtcagacacattgtaactgcaagatgtggcggatagatcagcgtggtgtactactggatagctagctatgctgattgcacgtagtactggatgatcgatcgaccgatcaatcagaagaccagaggcgtctgacaagttttgatctagttaattaaccatcaagataggtaaaagattggggaaaaaaatataatgcatgtagtcatgtaaagtgatgtagatataatctgtacatacatatatggataaatatatgcaggctgtaatcaatataggaagtatagtatacaatagcaacttccaggtatgtaataatcctagtatatcacgtgcgtgcaaggaagatagcagcccactcttttttcccaaacaaaaaaaatataaaaaaaacaataaggaaaaatgagaaaataagaaaaaaaaaaaaaaaaaaggggcggcc

SEQ ID NO: 10558 - DNA, 739 bp, Sorghum bicolor
  Clone ID: SORBI-28MAY03-CLUS23063_1
tttgcaagacagtatcgctcaccttctgctgatcgctcgcatcgttatggcggaagaaatgaccgtgacagatacatgggttaccggggttcccgccatcgatcacctcctcgacgttatagaagcccacccagaggcagaatgccatcgccaagtaggtacaggaggaggagccgaagcgcctcccgccgccctgtccacagagaaagaggaaggggaggtggatacagcaaaagccctgtacggagcctttcaccccctcccagaccaaggtcacatggtgatcgtgcacggtcagtttccaggagccacctttctgggtcaaggtcaaggtctccaccagcgctccatccctccccacctgattccccatctctgaagcgtgcaagtgttgagaaatctcagtccccgtcccggtctccgtcactgtctggtagccctagtcgtggaggcaagaaaggtttggtttcctacggggatggctctcctgattcagctggaaagtaggtttccaccggggcattgaaatgtattttactaccggccattggctgttgatcggtccttcagcactttgtgttacattgctactgtagaaaagagatgcggttttggtccttgaggcgcgcccccctggcctggtgttatcgttgtagaactgttacctatgttgtttgggatgatcagccatgtcctcttgttatcgaaggactcaacttaggttatgcttttgctgaac

SEQ ID NO: 10559 - DNA, 783 bp, Sorghum bicolor
  unsure (1)..(783): unsure at all n locations
  Clone ID: SORBI-28MAY03-CLUS235_1
tgtgcatgctggaaacctatggttgctccgtgatgggcgaattggttttattgatttcgggattgttggtcgaatatctccaaggacttgggcagctatggaggtctttttggcttcttttgcaactgaggattatgatgctatggctcgccttctgaaaggaatgggtgctacagggaatgatataaatatcaatgaatttgcaaaggacctgcagaagatattctcatcaatacaggacttggatactgaaatcatagttgcaacagcaaggacccctgatgctacagcagtatctgctaatgttgtccttgatgagagacagatgaatgctctatttcttgatctggttagggtaagcgagtcttatgggctgaaatttcctcgagagtttgctcttctcatgaagcagcttctgtattttgatcgctacacaagactgttggctcccagcatgaacatgctgcgagacgagcggatcaacatctccaccaatcggcaactgagaagaactgatagattttagtgacaccattttattagtcaccagacatactagaggagttgtgatgggcgataatagcaaagctcatgtgacccaatactgtatatagttttgccagaccagcatagaaatgaaccacactagaaattgtactcttattcgtattctggaattcggcgttatatatgtcgtactagctactaggcaacatgtaaaaactgtatgtaaactgtcaagtaaattttagtagacaaatcaagttaagatgcagctgtnct

SEQ ID NO: 10560 - DNA, 783 bp, Sorghum bicolor
  Clone ID: SORBI-28MAY03-CLUS2288_1
aaaaaaaaaaaaaaaaaatctccggccgcatctctctcttctcttcttctcgcctgttgcctgtccctgtgctcgccacacgcggcacaaccccccacccagccagccaggacaagaagatctccgtcgcctgctcttcgcttccgcttcgaatcggaggtcaactagccggtggtctccatatggattcagcatttagaagagctctcaatgagcctatgtgcttggaagaaactgtcgtccaacaaggaattgaaagatgcccattcctgaggaacatcaatgagcctacaagtttttccttctcgtctgtcaacttccctgttccggcaagaggagccaagggaccaattttcgaagatggacctaattttgacatggcatttcgagttttccatggtagagatggtgttgtcccactttcagaaggatcattggcccagattgagaagccactgccaaagcccaatcctgagttcaacccattggcggccaaagctgcaaccatcagtctatctgcatttggagggtttttcagctttggtgacttctcaaataagcacaataagaaaaactccaacaaaaagaaccccaacaacctcccccagaataaaggccagtctaagtctaacaatcatgaagcactgagtaacgagtggctggaaacgggccaatgtccacttgcaaggtcttatagggcattaagcggtgttgtgccacttgtagcaaagatgatgacacccccagctggtatgaaactgaagtgcccacctgcagtggttg

SEQ ID NO: 10561 - DNA, 471 bp, Sorghum bicolor
  Clone ID: LIB3481-006-Q6-K1-F2
tcgcccagcgtccgtagagtctgctctcatacagtctatctcatcttggaggggaactacctgttggtgatttttggcataggccactaggcaatactcaagccgagaagaacaccgacaacctgccccaggtaatctgtgctaactatacgtctcaatatttgttgtctacattgtcacaatattccagtattgtctagtacagtcgatctttttcatcaccacagaacacaacttattgatagaattagacagacacatttcttgcaacgtatctaaacagtctttcacagtggtaaacactataattggtacatgataaaaacatagctgtgtttttctgtgaagcacgccattcagttgtctgattttgctttccctggaatttcagaataaaggccagtctaagtctaacaatcatgaagcactgagtaacgagtggctggaaacgggccaatgtccacttgcaag

SEQ ID NO: 10562 - DNA, 1003 bp, Sorghum bicolor
  Clone ID: SORBI-28MAY03-CLUS23529_1
acgtccagagcaccaggatcaagtgatacacagatcgagatcgcagcagcacagaagcataagcgattcgatatggtttccaagagaaccatgtcgtcctccctcgccttcctcatggcactgctgctctcttgcagcaccatgagcagcgcggcacggtacctggaggagacgaagcctgcagaggagtacccgccgcatcccaccgtgccggagatccccaagccagaactgccaccgcatcccaccgttccggagttgcccaagcctgagctgcctccacaccccactgtgccggagctgcccaaggctgaactgccaccacaccccgccgtgccagagcacccaaagcctgaaccgccaccgcaccctactgtgccagagcaccaccctaccgtgccagagctcccaaagcctgaactgccgcaccccaccgtgccggaggttcctaagcccgagctaccacaccccgctgtgccggagctgccgcactctgctgtccctgaggtgccaaaacccgagctgccgcaccctgctgtaccggaggttccgaagccagagctgccgccgcaccctgctgcaccggaggttcccaagccagagatgccccatccggctgtaccggaggttcagaaacctgagctgccgcacccagaggtgccaaagcctgaactgccgccacaccccaccgtaccagaagtgcctgaggtgccaaagcatgagctgccacccaagccggagagccactacccggtgcccgaggccaagccatgatcgaactacgtcactgttgtcccaggaataaatatgtgttgtactagtgtctatgtgtatggtgtagaagtagtgtgacgttcagtgttgtatgttgtgctgctttgagatgtatgcacgtatctattgcctttggtgtgccatatattcatgtatattggtattgtttccatgttacttatgctattttgtcttctatatataataggaatctctgaattaattctgc

SEQ ID NO: 10563 - DNA, 686 bp, Sorghum bicolor
  Clone ID: SORBI-28MAY03-CLUS2151_1
ttttatgctgtcatatttccctctttgatgcaattacatgaaggaatcaatgaagttgaggataaaaaacagaaagcaatatgtctagagaggtatagaagacgagatgaggatcagaaaacagtaatatcagagattgatgataatatagaggaggaatgtggcatatgcatggaaataaacagcaaagttgttcttccaacttgtagccatgctatgtgcatcaaatgctaccgtgactggaggtcaagatcccagtcctgtccgttctgccgcgacagcctcaagagggtaaactctgctgacctgtggatatacacagataacaaggacatcatcgacgtggcgacagtccgaagagagaacctgaggcgactcttcatgtacatagacaagttgcccactgtcatcccagaatctgtgtttgacgtctacgactcccatgtaaagtgacagtcgagcccgtctgccaattgttttatgtatttgctacttctactagtgctgagccctgggcctctggtgctgttgtgcctttttttttgagagtttcgaagcaactgggtgccaaggaggctaatttatatagggagctatacactgaatgtaagtagaacttgttctatcatcttgcgtgatgcgatttgggtctttatggtggtttagggtaatttgacgctatatat

SEQ ID NO: 10564 - DNA, 890 bp, Sorghum bicolor
  Clone ID: SORBI-28MAY03-CLUS21618_1
gcacgaggggggacatatttggatcagcgagatgcgattgtgggaatcaacttgctctggcaatgatcatgattgagaaaactggccggggtgtagtagtttatcttcgtggccatgagggtaggggtattgggctgggtcacaagcttcgagcatacaacttacaagatgatgggcgagatccgggcgaggctaacttggagctagggctgcctgctgactcacgggagtacggtataggtgcacaggtgaagtcgtaaagatcactttcatttgaagtgttttcagatggtttcttgtgaagctgattaggctttcttctctgcagattctgcgcgatcttggtgtcaggactattgggttgattacccacagcccagcgacgttccctggactcaaagctaatgattatagggtctttgtcagagtgccgctgttgagaccggggaaggatgagaataggcgctacagcgaaccagagagagggaagggctgggatggttatggcaggcgcgcgaatcatcatgcaagtggcagtggcgacgaactagctggctctagagaagatcaagagcataattatagtgctgtcgtgcaaaataatactccagtagcttgcgtgcctaaatctgcgtttcttctgtcagtagctgagatttatgcatctatttagttaaccttttttcttcttacggctgaagtattctacggttaaagtaagttggctttgaagattttactgagagaggtaggcacccgtcggacagtttgttgctttatatgtgcaccagtggcggtttgatctaatggacaattgtgtcagtggtggcgtgaacgacttactaatttaactgggggccaatccttaatggtggttttttccgatgcct

SEQ ID NO: 10565 - DNA, 679 bp, Sorghum bicolor
  Clone ID: SORBI-28MAY03-CLUS2164_1
cgtccgcccgagcagagaggcgagcgcacgtgccaccagctagcagcaatggccgccgccgccgccaccacctcctcccacctgctccttctctcccgccagcaccgatgccgcctctccttcctcggccagtccagaaggcccgcaggcagggtcacgtccccgcaggcgccggccgctaataacgtgcggtgcatggcggccgtggacactgcgtccgccgcggcgacggagacgacgagcccgaagtcgagcagctacgagatcgtgacgctcacgacgtggctgctgcagcaggagcgcaccggcgcgatcgacaacgagatgaccatcgtgctggccagcatctccacggcgtgcaagcagatcgccgcgctggtgcagcgcgcgcccatctccaacctcacgggcgtccagggcgccgtcaacgtgcagggcgaggaccagaagaagctcgacgtcgtctccaacgaggtgttctcgaactgcctcaggtcgagcgggcgcaccggcgtgatcgcttcggaggaggaggacgtgccagtagcggtggagcagagctactccggcaactacatcgtggtgttcgaccctctcgatggctcctctaacatcgacgccgccgtctccaccggctccatcttcggcatctacgcccccaacgacgagtgcctcgcca

SEQ ID NO: 10566 - DNA, 1087 bp, Sorghum bicolor
  Clone ID: SORBI-28MAY03-CLUS21676_1
gcacgaggagcaggttcaacaagctgaggtaaatcaggagttggattcaataccagtacattccggggaggatgttgatgaagaacttgaaggagagagaaccgcacaggctgggttggaacaagagtgtgactctgtgccaattgattctggggaacatggttgcctaacttcatatgctcatactgatgatgagcaagctgaggtgaagcagaaagtcacttctgtaacagcagatgttctacagtatgcagcagacaattttaatgttaacacaaacacatggaaagaagatattgaagaggatccaactgaagctgctctaacggccatacatccgcattcttatgaacctttgacaagcttagacaagttctctccggatcatagtgtctctgaagaagacagagagcctgatacaccgactcatattgaaggtatatgtgattcacaggaactgttggattctaaagcagctgcttctgatgctaaatctgtagattcaagtgttgctactttgtctactgatctggaaagcactgaattggtgagcgtcgatcaactaaaatctgctttggcttccacccgcaagtcattgaagaccctatattctgaacttgaaaatgagaggaacgctgctgctatagctgctgatgaaaccatggcaatgataaaccgcttgcaagaacagaaagctgcaatgcagatggaggcgatccagtaccagcggcttatggaggaacagtcagagtatgaccaagaagcactgcagaggctgaatgaactagttgttaagagagagaaggagaagcaagatctggagagagaactggagctgtatcgccacaaggttcatctctatgaggtaaagatgaggaaaatgtcaaggcacaaggctgatgaccagaatggatcatcgtcaacttcatcgagtgctgaggacagtgatgacctttcgcaaagtttctatgaaggtgatgaatcgtcccatggtcttaatggaagcaatgggagtattcctacagatgttgtgctacaagagactgccaggcatcttgttacccttgatggttcactacctgatttt

SEQ ID NO: 10567 - DNA, 860 bp, Sorghum bicolor
  Clone ID: SORBI-28MAY03-CLUS2171_1
cgtccgcaacgaccaatggcacaccctcaaggacggcgtgccgcacctggtggtgtacacggccttcttctacttctccatctcgtgcttcgtcatcggcgtcggcctcaacatcctcttcctctaccgccccatggccggcgtgccccggtcctccttcggcgcctacctcagggactggaacggccggcagtgggcgctcctcgccggcctgctctgcggcttcggcaacggtttccagttcatgggcggccaagccgcaggctacgccgccgccgacgctgtccaggcgctgccgctcgtcagcaccttctggggcgtcctgctcttcggggagtaccgcaagtcgtcccggaagacatacgtcctgctgggtttcatgctcttcatgttcgtcgccgccgtcgccgtgctcatggcttcgtcaggtcacaggagcaccgagtgatcctgatctgatgctgtcgtgctctttgtttctcattcaagtttccactgctgtttgttcgtcttgtgtttgcaagagcaaacggcaggcaaacccatctcctcttgcaatagtcgatccacagaacgaaaatccagcagcaaggccggaagcaggggaagtccattccttccagacattcacgaaagtttctgtaggatgaaatggagatgtacataaaaacgtttgtggtgtgattgatcaagtccagtatatagaaccatataaaagctatttatattcttttcaaaaaaaaaaaaaaaagagcgtaggaacactgaaattgttccagaaaaaaaattctcaagatcgaggtgattctgttcaagagaaaaactggtggatgcaatttggtgtacagctcttataatgc

SEQ ID NO: 10568 - DNA, 652 bp, Sorghum bicolor
  Clone ID: SORBI-28MAY03-CLUS2177_1
cgtccgcccacgcgtcctcacacgccgcacccaaagcgaccaacctcttgcttcccaccgtacctgcctgccacgccgcagcctccggctccgatgtcgtcgcagcgcccgggccgccaccagcgtcgcgcgtcgcagagcgtgttcgtgctcccggagaacctggcctccctcgacgtcgacgcggcgggcgaggtgggcgcgaattcgaaggccggtggcccagacggcgccggcgccgagcagcaggcgaggccgcccgcggggcgtcaccgccgcgccatgtccgtggccgtggcctccactagggacctcgagctgatcaaggaggacctcggcagctacaagctcggcgcttgagagagggggccggctggcacgtcgcgtcatgtgtatatagcctgtgggttagccgtgcccagacctggctttgatcggcgcttaacagtggcttaattacaaggtctctcctccgttgctctttttgttttcgctcaacacacgcatatgtaatactactactagtactatgtagtaacttttttcattacaaagaggaagtatttggacactttaatcgcgtgaaggtcctgctcagtggcagcatatgactacttcttatacttgtaccccgagcttatatatgcaattc

SEQ ID NO: 10569 - DNA, 1484 bp, Sorghum bicolor
  Clone ID: SORBI-28MAY03-CLUS24215_1
gcacgaggctaagctaacccgctgctttccagttttccatccatcccccggggttcttgttcggcctaatccgaatcccatcctctctttagtacttttgtctctgtgccgacgacggtggaaaaggaaagtgagtgatcccggccagtctccggcggcggcgagaaatagctaaatcctagctcctccggcgagcgagaccatggcgtccatcatcatcatcgccgtcgtgctcgtcctggacgtcctcgccttcgtgctcgccatcggcgccgagcgccgccggagctacgcctacgtgagcgtggactcgaacgcgcggggctactgcgtgtacagctccgacgcgtcgacggcgtacggcgtcagcgcgctgctcctgctgctggccgcgcaggccgtggccatggtcgccacccgctgcttctgctgcggacgcgcgctctcgccgggacgccgccgggcatggtccggcatctgcttcatcgtctgctgggtgacgttcgtgatcgcggagctgtgcctgctggcggggtcggtccggaacgcctaccacaccaagtacacgacgctgttcagcaagggtccgccccagtgcgccatgctgcgcaagggcgtcttcgccgccggcgccgccttcaccttcctcaccgcactcttcaccgagctgcactacctcttctacgccagggcgcgcgacgccgccgacgtgcccccgcccatcgttggcggcatcggcatgacccgcatgtgatttatttttgtggctgtggtcgtgatcgcggcgaccggcggtgcaggcagccgtgcccgttccgctgtggagccgtgcttgactgctcccgtgtacatgtgctccatcgttccttgcattccatggggaccttgactgaactgaaagcgtgtgatagtactgtgacgtgctgcgtgctctgtaactctgtgatagtacattagtcatcagcattcagcagagagtggattagtttttctgtgttgtacagtacattcacaaggaaggaatcatcagagattatggcctcggtctgaagacgaacttgctgtgcgatctgcacacaggcaggcaggcaggcaagctgcagctgcgcggcgcctgtcctgctcccggcgagcagcggggctttgtttatcccgcgagcgaccgcatctccggctgtgtccccgtgaggtccggcagggctgagcctcgtttctagcttcgccggtgagctagccaccgctgctacctacgtagctagcatatatatgcgcgtgtctgacggtgacagcgaacaagaacatgatcgatcgatcgaccggcggcaggaggcaggggacgatcgacgtcgacgaccgccgtctccagcacctgcagcagacagagcagcgagtatctctccccgtccaacgtaggtcgtccaaaaacaaagacaagcaacatgcgtgagcgtgagtgatgctgcccggctcgctgacccctaact

SEQ ID NO: 10570 - DNA, 1058 bp, Sorghum bicolor
  Clone ID: SORBI-28MAY03-CLUS2423_1
agccaagaggggatctcgcgcacgccggcgaatccatccaccaagattccgtgcacctccaccgccgcctccgctgtcggtctgtccccgcggccgcagcagcctagccctagcaggaggggaggatcctctcctcccttactccctgtctagtgtctagaacagctgcttgcgttcctcgcagagcacatcgacgggcttgctgctgacacccccagcactgatggggatacccagcgacgacgtggtgcaaatccgccacgccgacgccgctggcgagcccaccgtcgtcaccgtgagctgccccgacaagacgggcctcggctgcgacctctgccggggcgcccgcctcttcggcctcagcgtcgtcaagggagacatgagcacggacgggcggtggtgctacatcgtgctctgggtgctgccacgcggggggcggcccgtggccgtgccatgggacctcctcaaggacaggttgcttcagctctgccccgtcacgccgccgttcggattcgacaacgcgtacctcgcggcggctggcctacaggacgtggcgcctcccgcaccacagctcttcttgctcaagctatgctgcctcgaccggatggggctcttgcatgatgtgacacgcgttttgtgcgagctagagctcacgattcggagggtgaaggtctctaccacgcctgatgggagtgtgctagatctttttttcatcacagatgccagggagcttctgcacacaaagaacagaagagaagaaactcaggacaaactcgagagtgtcttaggcgactccttgacatgttgtgaaatagatcctgctggtgaagacatgttgtcttgcctccaatcctgggcttcgctgacgcctgctattatggaacagatgtttaacacaaatctcatagaggagcaatcgatcagcacaaggggtggtaccatctccgtgacaatggacaactcgcttagcactgtccatactcttattcagattcagtgtggtgaccataagggcctcctatatgatatcatgaggacggtcaaagacctgcacattc

SEQ ID NO: 10571 - DNA, 1180 bp, Sorghum bicolor
  Clone ID: SORBI-28MAY03-CLUS2428_1
gcacggggctccctcttatcgcctccgcgctctaatggcctcacaccccaccacgcagtaaacgaaacgacgggcccactccccgacggctgacgccctcccacgcccccttccatgaggcagccgcacctctcgccgcagctctccccttccccggtcctctcctcccacttctcgccgccggcgacgggggcctcgccctggcggcggcggctgcaccgggggcgggccttccaaccgccgctctcctcgctgcgggagcccaacaaggccacgctccgcaaggcctcgcccaacgtacccttccgcctcggcggtggcggtggcgggagcggcagccccaaggaccgccgccccgccgccgacgacaaggaggaggaggccgagggcagcggcggcggcggcggcgccggggcactcacagggacgctgatcgcgggagcgctactggttggtttcgtaggggggtttggggcggccggatacgtgtacaaggaccagatcaacaccttcctcacgcagttctcagggtttattgacggctatggtccagccggatacgctctgttcgtacttgtatatgcagggttggaggttctcgcaattcctgcaatacctttaaccatgtcagctggtctgttgtttggtaatgtgaccggtacaattattgtctcagtcggtggaacactagctgcagccgtggccttccttattgctagatactttgccagagagagaattcttaaaatggttgaaggaaataagaagtttctggcaattgataaggcaataggtgaaaatggatttaaggtcgttactttgcttcgtttgagtcccctgttacctttctcccttgggaactatctgtatggcctgacttcagtgaagttcttgccatatgtcttgggcagttggttgggaatgcttccaggttcatgggcttacgtcagtgctggtgcattcgggcgagctataattcaagatgagtcggaaattggtttgggaggaaatggacagctatggacactgggtgttgggttattgtttacagccattgctgccacttatgtaacaaggctcgcaaaggatgctgtaaaggagatcgacgactagaatggtaggattctctagtagaaagggccctctggagcctggatagtatactagcacattgtacatc

SEQ ID NO: 10572 - DNA, 945 bp, Sorghum bicolor
  Clone ID: SORBI-28MAY03-CLUS24350_1
tgacacggcccagcgcatcgcgttcccctctccacaagccaaacgcgaattccagccccgtgacctccccgatctccggcgatggccgcgcggcgtctcggatccaccgcctccaggtggctgcgcccgtccgcgctgcttctcctggtcgcctccgctctcctcttggccccgtcgccggccagggccctccggttcgacctcgagtccggccacaccaagtgcatctccgacgagatcaaggtcaacgccatggccgtcggcaagtaccacatcgtcgggcccgaccccaacttccccgacgcccagctccccgaatcgcaccgcatctccctcagggtgacgtcgccgtacgggaacagcatgcactacgcggagaacgtgcagtcgggccacttcgccttcaccgcggcggaggccggcgactacctggcctgcttctgggcgcccgaccacaagcctccggtcaccatcgggttcgagttcgactggaggagcggcgtctccgccaaggactatcccagcgtcgccaagaagggcaaggtcgatatgatggaattggagctgaagaagctagaggaaactattagaaatatacatgaagagatgttttatctgcgtgaaagggaagaggaaatgcaggacctgaacaggcgaacaaactcaaggatggcttggttagggttcctctcccttggcatctgcttatcagtggcaggtttgcagctgtggcacctgaagaccttctttgagaggaagaagttgctgtagttgccccatgattcacggtagacctcaccgcaggtgtaacctatttttgggtgaaatgtcgatctgttacagagcttggaatcccatgtaagaaactggtatgtcatactagagaaatatgcttcattatgctttagcctgtctggttgaacttctataagaaacttaaaatag

SEQ ID NO: 10573 - DNA, 677 bp, Sorghum bicolor
  Clone ID: SORBI-28MAY03-CLUS2254_1
cgtccgcatcttcccgccacatgctcaaaagcaagcgacttcccactcccatccacccacacgcgcacggccgcaggcagtagaagcagcaggatgtggtcggcagcagcggcggcggcgcgcgcggtgtccgtgcccgtgtctccggtcccggcgccctcgctcctcagcggccggcgcggcgggccgcggggcggccgtggcgcggtgtccgtgcgcagctcgttgctggacttcgtgggcggggacctggtgcggccggacctgggcaagtggctggacgacgtggagaagcacaaggcgctggccatctacccgccgcacgagggcggctacgagggccgctacctcaaccgcctccgctaccagggctactacttcctcgacctctccgcgcggggcctcggcgatccggagaccacgctcaccaagatccaccccgtctgcccggttctgtccaaggctgagctgcagttcctggccatgctcccagacatccgtcccaaagtcagggtgctcgcagaagtcggcaactggagaagttttgtttggaagccactgaagcaaattgcaggccttgagcagaacccggacgcggaagaatgatcaagcgacatgtctggggcaactacagctacactcaaattgcttctgggatcgacatctctccctgccat

SEQ ID NO: 10574 - DNA, 956 bp, Sorghum bicolor
  Clone ID: SORBI-28MAY03-CLUS22622_1
tttccgttgttcgttatggtggaccacactttgtttatccatcaagttattccaaatccttggcttttcttttttcgcagggatataatcttcttgttgtcaactacaggggttcgttaggctttggggaagaagcactacaatcccttcctggcaatatcggttctcaggatgtcaatgatgtattgacggcattggaccttgttataaagagaggactaatagatccatctagagtcgccgtagttggaggttcacatggaggtttcttgaccactcatttgatcggccaggctccagacacatttgttgcagcagctgctcgaaacccagtatgtaacttatcattgatggtgggtaccagtgacatccctgattggtgctttgttgagatttatggaaaagaagggaaaaagtacttctcagagtctccttcagtagacgatatttgtcaattccaccagaagtcaccaatttcacatatttcagaggtcaagacaccaacactctttctccttggagcgcaagatctcagagttccagtttctaatggcctgcagtatgcaagggctttgaaggagaggggaatcgaatccaaaactattatcttcccagaagatatccatggaatcgacaagcctcagtctgatttcgaaagcttcctcaacataggagtttggttcaagaagcacatgagcaaataaacattagtgcttcctattagatttgtgatttagtttttcattgccattgagtgcttgtaactgggtcaaagtatccgatagcatgatttgtctgtccaatctgatgttgccaagatggaataattcttgaagacaaaatcttgtttgttctagtaatttaggcaatatgcttctaataaatgatgcttacatattaatgtgaaaagttggttgcttttgaattgtaatgagaaagaattacatggcccagcg

SEQ ID NO: 10575 - DNA, 1579 bp, Sorghum bicolor
  Clone ID: SORBI-28MAY03-CLUS22643_1
atacataggaagcaaccttccggtttccgagtacaatgcctctcgccgcagtcctccccatcctcctcctcgtcctcgtcctcggcgcgtctccggcgtgccacggcgccgctgcgacccacaacatcacggcgatcctggccgcgcacccggacctctccgacttcagcgccgcgctggtgagcacgggcgccgcggcggagatcgacagccgccaaaccatcacggtgctcgccgtcgacaacgccgtcatggcgcggctcaaggcgcagaagccggacccgaaggagctgcagcgcgtgatctacctccacgtcctcctcgactacttcgacgccgccaagctgggcagcatccagggcggcttcgcccaggtcaccagcctgtaccaggccaccggcaaggcgcaggggagcgacgggatcctcaacatcaccgtgttcaccgacagccgcgtggcggcgttcacgccgtccaccggcccctccaacaggctgccgaccgccttctaccagcgctccatcaaggaagtaccctccgacatcgccgtcctgcaggtgaaggacctgatctggtctccggcgacggcggacggagtgcaggctcccgcggccgctcccgctcccgcgcccgcgccgcagcccggcgcggcgccggagttgacggatctactgtccaagaacgggtgcggtggcttcgccggcctcctcgccggaacggtcgacgcggtggcggcgtacgaccgcagcgccggcgccgccgccgggctcaccgtcttctgcccggacgacaaggcggtggatgccttcaactccaccttcaagaacctcaccgccgacgcccggatcgcggtcctgctgtaccacggtgtggcggcgcactactccgcgcagtcgctcaaggcgatcaacggggacgtgggcacgctcgccaccgacggattcaagaaccacgagtacaacctcaccgtgcgtgccgacggggacacggtgaagctgtcgtccgcgtccgccagcaacgccacggtgaccaagacgctgctcgacaaggcgcggctcgccgtctacctcatcgacgcggtgttgctgccaacggagctgtctaagggcggccagggccgcactgcgcccgcccctgcgccggcgacgtcgcctgcacatgcacctacgcctacgcctgccattgcgccgccgcctgccattgcaccggtctcgccgccggcagctgcacaagcacccacacccacacttgcccctgctccggaggctgcaccacccacgcacaggcgtcgccctgcgccatcgcctgaggacactaccccagctccttcgccggacgaggacggccaatcgccagcagatcaggagaacaacggagcaagggacacggcgtcttggactcttggcgcggcggcggcggccgcggccacggcgctggcggccgtgttcctcttttgatgaagggtttaagctttagctagattgacgtcgattgggatccatcatcaagcctataccagtgtagaatgaagactatgtttatgggcatgtattggccaaaaaaaataatatcatcctgc

SEQ ID NO: 10576 - DNA, 1306 bp, Sorghum bicolor
  unsure (1)..(1306): unsure at all n locations
  Clone ID: SORBI-28MAY03-CLUS22427_1
ccggggtgctctttccaagggcgaattcgcggcgtcgcccgcagcagcagcagcggacggcggaccacngccacctcggcgacactgagcgagggagcgtttcggatccggattcgaccagaaccgacatggacggcggcgagcacgaagcggagtcctcctcccagcgccgggagcgcctcctggccctccgctccgccgcaaacgcgtcgccggcgggggatcctccccaggcgcccgcggggagcctcctcccggaccctgaactcccgggggaccaggccgcatccgtgtgcccgcccccgccccaacggttcgactactacaccaaccccgccgccgccttcacttcctcctactccggcggcgccacaaatcccacctggtcccacaagcgtaagagccctcccgcctgctacgccccgcctccgccggcttacgggaactatggcagcaactaccctccacgccagcagcatataccatcacaagttcactctccatccctgatgccacaagatgcaccagggaacagtccatggcgaagtcctatgcagttccaggatccaatgtcaggataccgaggagctcctcctcgcgctccaccttcttggggctcacattgtggtcctcgaggccgaggtccttattcaaattcaccaaactttgggttcaggcacccgaatcctggccgaggtggtagcccaatgaattatggaccaagaggtggcccatactcatcttatggacgtggcagggagcccaactactttggcaacccaggttcaagggggagaggggggaggggtggtgtcggtttccagaaccatcctggctggcaaggccggagttacttcaacaagtcaatgcttgatgacccttggttggacttgcaacctgctgttggcaacatactcatacctagggctgagtatgactccaacaagtcctggcttccagaatcgctgcgcaaaaggaaggaaacacctgctcaaggccaaattaaaacaacatcaggattgagcctagcagaataccttgacctgtctttcaatgaggtttctgataaagagaagtagcctttatgtatgcatagttaggacaacagattgatgttgtttttgctatcatttgcaatagatctgttctctctgaaatcatgtgctcctttatctttgctcctcccattgccctgtattgtgcggatatggcaattttacagtatttgtgcgttctagcgatcctttttgtaccttgactccttgaatttagggaactgaataactgattaatgatagaggaagca

SEQ ID NO: 10577 - DNA, 653 bp, Sorghum bicolor
  Clone ID: SORBI-28MAY03-CLUS2294_1
gtcgacccacgcgtccgggatttgattcgggaaagtggtattgcgtacactattgtacggccatgtgcattaactgaggaaccagctggagccgatctcatctttgaccagggagacaacatcacaggaaagatatcaagggaagaagttgcccgtatttgtgtagcagctctggcaagcccaaatgcagtgggcaaaactttcgaggtcaagagcactgttccatttagtgaaccatatgtgattgaccctacaaatcccccatcagaaaaggactatgatgtatatttcaaagaactcaaagaaggcatcacgggtaaagaggcattagaggcaacacctgcccaagtttgaagatatcattgaatgaagaattacatctgcttgcataaattctgacacagtaacctccactctgaatgtcttaagccatcctgaaagatagacgacgctgatgctaaattttgtagttgaagatcacaggaataaactagatgatactccgcgtgttgctgcggaaatttgtagtgttgtataattatttgacatttgatgaaacataaatacataatgaattttattgtggcatgtgcaaaagtcggaattgtaaaaatcgcatgtagtaatcaatgacagaagcccaggttatagtg

SEQ ID NO: 10578 - DNA, 720 bp, Sorghum bicolor
  Clone ID: SORBI-28MAY03-CLUS23062_1
gcacgaggctgtctcaatcctagccacaagctctcccggggctgaggatgaccccccactccgggctcctccggcggctccgcatcggccgtcgaccaaaacccgccctgctaaatactcgctcgctacagctctcctcgcaattactaaattaacagctccgttagcacgagctgcggggagggagttgggaggagaaacagaggtgccggggcgatgggaaccgtgctcgattcgcacttcctggcgctcaccgccatcgttactgtggggtaccagctgctgttcttcatcatcacagctctcctccggttcgataaggtcacggatttcgcaggcagtacaaattttgtcataatcgccatcctaacattagttttgaagggagcatggcattttcgtcagattgtgctgacagtgcttgttaccatttggggtcttcgcctaggactatttttattgatgaggattctgcaatggggtgaagaccgacggtttgacgaaatgcgtgataatttggggaaattagcatttttctggattttccaggctgtttgggtttggactgtcagcttgcctgtcactgttgtgaatgcaagtgacagaaacccctcgattgaagccagggacataatcggttggataatgtggttggttgggatatgtgtagaagcaacagctgatcagcagaagcttgtgttcaagaattctccaagtaat

SEQ ID NO: 10579 - DNA, 711 bp, Sorghum bicolor
  Clone ID: SORBI-28MAY03-CLUS25379_1
ttctgatgctgtttaactcatccgatgtcttgacttaccgtgaaattgagcagtctacagcaataccagctactgacctgaagcgatgcctccagtcgctagctcttgtgaaaggtaagcaagtcctgcgaaaagagcccatgagccgggacattgccgatgatgacagcttcttcgtgaacgacaagttcaccagcaagctcttcaaggtgaagattggcactgtggcggcgcagaaggagaccgaccctgagaagctagagacacggcagcgggtcgaggaggataggaagccgcagatcgaggcggccattgtgcggatcatgaagtcgaggagggttctagaccacaacagcataatgatggaggtgacgaagcagttgcagccccgtttcatgccaaaccccgtggtgatcaagaagcggattgagtcgctcatcgagcgcgagttcctggagcgggacaagacggacaggaagatgtaccgttatctcgcctaaaaacaacctcccctgtctttggaatttaatttcattatatgctacccgtatcatataaacagaccttgatccatgtacttatgcatagaaggaaatgggtctctgcatcccgtgatacttttagttgaaactggtttttgctgggtttgtccagttagttgctagcttagcttctataacttctgcgctgggatacatgctaatgctaaga

SEQ ID NO: 10580 - DNA, 665 bp, Sorghum bicolor
  Clone ID: SORBI-28MAY03-CLUS25367_1
ccaagcccgtggtgcccggcgccgacgccacggacaccggcaccccggccgacgacacccccgcggccgtcgtcgccgcggacgacgagccgagcggcgagcagcaggaggaggaggaggacccggcggcgctggtgacgtgctccccggagagcaccctcggcgaggcgatcgaggcggtggcatcgaggcacgtgcaccggctgtgggtggtcgacgaggaagggctccttcacggcgtcgtgtcgctcaccgacatcctccgggcggtgcgggacgccgcgctcggcgaggaccgggagctgcacagcatcgtgtcgtgagtcgtgactcgtgacgtttggcagtagtagtgtcatccgcctgccgtgctgctgcagggtacgtacgcggcagcaaagggcgatcgagacgtgttccgacggccggccggccggctggctggcgggccggtcgccggcgagctttgttttgccttgttgcttttgttaggctcgtggctccgatccaggcgttgtgtttcgtctacacgccttcgctgtttttgcatcgttttattaatcaactataaatacgtgctgcactgccggtgttttccagcgatagacagcagggcactgtggctggttcttttgtgcgacccttcttgataggaaaaaaaaaac

SEQ ID NO: 10581 - DNA, 978 bp, Sorghum bicolor
  Clone ID: SORBI-28MAY03-CLUS25381_1
caagaacaccgatgcagccacagatgacgaaagggccaggcttgaggtcgtgggggagtaccatcttggggagtttgtgaacagattccgccatggttcactggtgatgcgccttccagactcagagattgggcagatccctacagtcatctttggcacaataaacggggtaattggcattattgcctccctcccgcatgatcaatacgtcttcctggagaagctgcagtcgactcttgtgaagtacataaagggcgttgggaacctgagccatgagcaatggcggtcgttccataacgacaagaagacggcggaggctcggaacttccttgacggtgacctgatcgagtcgttccttgaccttagccggagcaagatggaggaggtgtccaaggctatgggcgtcccggtggaggagctgtccaagagggtggaagagctgacgaggcttcactagtagatggatggatggatatgtagatgctttgcttgtaagcctgtaacttgttgcatgtacatcctctgtttaacatctgttttgtgctgtagcagtgtcgccgtcggatgtacagcagttccctgagctgcctccgcagttgccgcgggtcacacgagcaaagtgttggcccatggctgtagcctatacctgtcctgctttgttggttgacccgaatacttttttgagctgccagtttgttgagattgtttttgtttacttagccggaatggaaagattagtggtgaatcctgtgatggtgctagttgatgagatgggtgggcgtggattatgcgagtcctagagacggcagttgagagctgtcttgtcttctttctggtagtggtccagtccaggcccaatccagtcagtcagggccaacctggtccagcaggcagcagcccagccatttgatttgaacctgccgtctggggggcgctaatgcgacagccaccaccaaaaccacactgtgcccctcgtgc

SEQ ID NO: 10582 - DNA, 1583 bp, Sorghum bicolor
  Clone ID: SORBI-28MAY03-CLUS25390_1
gcacgaggggcattcctgtctcatttggctgaggacaaaaacatatggggcccctttctagtggtggctcctgcatctgttgtgaataattgggctgaggagttgattagattctgccctgacctaaagatacttccttactggggcccagagaggatgattcttcgaaagaatatcaaccccaagcgtctctatcgcagagatgctagcttccacattcttattacaaactatcagatacttgtgaatgaagagaagcttttgagacgtgttaagtggcaatacatggtactggatgaggcccaggctatcaagcgcgcgggcagccagcgctggaagacattactgagcttcaactgtagaaaccgtctacttcttactgggacaccaatacaaaacaatatggctgagttatgggcacttcttcatttcatcatgcccactctatttgacagccatgaacagttcaatgagtggttctcaaagggtattgagggacatgctgagcatggaggagctttgaatgaacatcagcttagtagattgcatgctattttgaagccctttatgctccgccgggttaagattgatgtcattgctgaaatgaccaaaaagaaagaagaaattgttccctgcaaattgagttctcgtcaacaagttttctatcaagctataaaaaataagatctcgcttaatgagttgcttgatggaagtcgtggtcatctaaatgacaagaagttacttagcctgatgaatattgtcatgcagctacggaaggtctgcaatcacccagagctgtttgagcgcaatgagggaagctcttacttttactttgctgatatcccaaactcacttctttctcccccatttggggaattacaagatgtacactatgcaggcaagagaaatcctataatctttgagattccaaagttagtttatgagggaatcatctgcaacacggaaaattctggaaacatctgtggatttcagaatggatatttgaacaggctgtttaatatatttttgcccagcaatatccatcgctcagccattccagaagttaattcatcaaatgagtctgttctatcatctggtgcatttggctttacacgtttgtcaaatctgtgcccagttgaagcttccttcctggccactgcttcattgtttgagagactagcgttttcagtaatgcaatggaataggaactgcactgatgaaattatggatgcatttcttgattcagaagatcctgacatccagtccagtcagaatgattccacaacagttcgtgcagttgcccgattgttgctttcttctacaaaggccaagcccagtttgcttaggacaaagattgggactgggccaagtgatggcccatatgaagcattggtgctatcccatcgggacaggcttgcttcgaacataaggcttcttcggtcagcggatgcttttattccgccagctagagcaccacctataaatgtttggtgtgctgatcgaagttttgcctataaggtcaccgatgagatgcatgatccttgggccaagaaactggtcctgggatttgctcgaacttctga

SEQ ID NO: 10583 - DNA, 1274 bp, Sorghum bicolor
  Clone ID: SORBI-28MAY03-CLUS23577_1
gcacgaggctgggcgcgaacgtggccacagtgtaccagccggggtgcacgaatgtagggtgcagcggcaacagcctgcagctcgacgcggccaccaaggccgcagccagcgctgacgtgaccgtgctggtcgtcggcgccgaccagtccatcgaacgcgagagcctggaccggacgagcctcctgctccccggccagcagccgcagctcgtgtccgcggtcgccaacgcgtccagaggtccgtgcatcctcgtcatcatgtcaggcggcccctttgacatctcgttcgccaagtccagcgacaagatcgccgcgattctctgggtcggataccctggcgaagccggcggcgccgccatcgccgacgtcctcttcggccaccacaacccaagtggaaggttgccggtgacatggtaccccgagtcgttcaccaaagtcccgatgaccgacatgcgcatgcggccggacgcgtcgacgggctaccccggccggacataccggttctacaccggcgacacggtgtacgcgttcggcgacgggctgagctacaccagcttcgcgcaccacctggtgtcggcgccgaagcaggtggccctgcagctcgcggagggccacacgtgcctgaccgagcaatgcccgtccgtggaggccgagggcgcgcactgcgagggcctggcgttcgacgtgcacctccgggtgcggaacgcgggcgacatgtccggcgcgcacacggtgttcctgttctcgtcgccgccggcggtgcacaacgcgccggcgaagcacctgctggggttcgagaaggtgtcgctggagcccgggcaggcgggcgtggtggcgttcaaggtggacgtgtgcaaggacctcagcgtcgtggacgagctgggcaacaggaaggtggcgctcggcaaccacacgctgcacgtcggggacctcaagcacacgctcagcttgggagtttgatgaaaaaaacccgagactgatcgagagggaaatggctaccatgatggaggctctgttggaattggatgggtcggccggggaagagaggtttgtcagaattggttcggcaggtgtctaataacggcttcctgttggcaaagaattggatccacgggcagcttactgatttgtttggaggtgttggattcattggaggttcgatttgtgattgtgatcctgataaatgtaatcgattggaaattccgaagggagtatgtagagctctagtcttttcatacaatcaattccaagtgtgctcacaatggttctttttct

SEQ ID NO: 10584 - DNA, 713 bp, Sorghum bicolor
  Clone ID: SORBI-28MAY03-CLUS23580_1
gctttctctctctctctctctctctctctacatacaaagcggaaaaaaaaccacacccaaaagaaaggctcacaccacccaccaccattagcttagcctactactccatcctctcgctgtcttccccagccaacaaatcgacctagctgggaacaagagagggggctagagacagaggagggcagcgcagcacgcaccaccgagctccgagcagaagcggcggcggcggaggaggaggaggcagagcaatccgcagggagcagaggccgcgcgcgcagccatgggcagcgcgccggtgcacggcgcccttgtcttattcctcctgctcctggtaggggcggcggccgaggagacggcgccgcaagaacccacattgcccgccgccagctccggctccggctccggcgctgccggctcggcggcggcggtcggggtcaactccaactccgtgctggtggcgctgctggactcgcactacacggagctggcggagctggtggagaaggcgctgctcctgcagacgctggaggacgccgtcgggaagcacaacgtcaccatcttcgcgccgcggaacgaggcgctggagcgggacctggacccggagttcaagcgcttcctgctggagccgcgcaacctcaagtcgctccaggcgctgctgctctaccacgtcctggcctcgcgcctcccctccgacgcctgggccgcggcctccc

SEQ ID NO: 10585 - DNA, 1173 bp, Sorghum bicolor
  Clone ID: SORBI-28MAY03-CLUS23768_1
cggccgctcgagggcggcgggccgggtcttcccgcttcaccgcaagccccacaggtctctctcgccgccgcacaagctcgtgtaaccctaaccctaaaacactttacactcgcctccaaccccacgctcccatggaggggcgcggaggctaagcgtagccaacccctaaaccatatccccatggattgagcggattcccaaggcatgggtacaaaccctctcctgcaagagctagccgctgtggtagtggcggcggcggattctgaaccaccacggccgcggccgcgcgtggtgcggatcctagtgcacgatgctgacgccaccgattcgtcctccagcgaggatgaggcgcggccgcctcctcggcggagggcgaggggtggcaacagcagcgtcggcgtgaggcgccacgttatggaaccggccggagcaagctcgtccgttcggttccgtggcgtccgtcggaggccgtgggggcgctgggctgcggagatccgcgacccgcacagccgccgccgactgtggctcggcaccttcaacaccgctgaggaggctgccaacgcctacgacgctgcgaacatccgctttcgcggtgccagcgcccctaccaacttccctgcggccagctactcgccgcctccagagccagccaagcctatcatctcgctgactcctgaacccggaaaggtgataaccttaccaccggtacctgtgaagcagaccttccctctgcaggtgaaggaagagggtgggagccgtgacggccaggtcaagggaggtagctcggaggtcaaggcccttccacccaagcgggtgtgggagatgatccccagcaagcgccagaagtatccgggctgtgctgatggctctggcctgcgtgccatccatgctgcctccctctatgtggaggaggttggtggggcctgatggcccaagtatccgcaattactattggtagaggtttcattgtctatctccggggattattagaacttggtactgtattattttggttagtgttaaactgttgatgtcaaaacctatgactctggttgtgtaatgatcggtggtgatctaataatgtatatatggtgacatttggtactatgttcctgatctatgttatgcaatgtgcgtacttgaatggggaatcaaacctgtcatatagtagtc

SEQ ID NO: 10586 - DNA, 637 bp, Sorghum bicolor
  Clone ID: SORBI-28MAY03-CLUS23778_1
gacgtctcagaaaaacgcaactcctttttttgctgcgaagaaaagggacgcgggcacgcgacaggggcttcgtcgctaaacactacaaacagagagagagagagagagagcaacaacatctagcacgcgacaccgcgtcctcgatcggactcggaggcgaacgctcccatggcggcggcggcgggcgcgggcggcggcgcaggagggaaggtgtccttcaagatcatcctcacctccgaccccaagctccctttcaaagtgttcagcgtgcctgaggcggcgcccttcaccgcggtgctcaagtacgccgcggaggagttcaaggtcccgccccagacaagcgccatcatcaccaacgatggagttggcatcaacccccagcaaagtgcaggcaacgtgtttctgaaacatggttcggagttgcgcctcatcccccgcgacagagttggagctgcggttgtgccttcctattagaggatacaaatgcataattaatgagtgaagtgagagaaataaaactttggtgttagctctgcttggttgtacaattgttatacaaagataaataagtgaacctaatcgtacatgtctccgttgtatgctcttgtgtgcacttggtggtgctaggaaagtggtt

SEQ ID NO: 10587 - DNA, 752 bp, Sorghum bicolor
  Clone ID: SORBI-28MAY03-CLUS24068_1
aaccctcttttccgcccagcctagggttcttccttcccgacgcgccgccgccgtctcgccgccccgactcgcatctgcccacccagatttacggctccaattggcgcccatggcggaagaaaccaatgtaaagaaggaggaagaggagttcagcaccggtcctctctcagtgctcatgatgagcgtcaagaacaatactcaggttcttatcaactgccggaacaacaagaagctgcttggtcgcgtgagagcctttgatcggcattgcaacatggttctcgagaatgttagggagatgtggactgaggtaccaaagaccggtaaaggcaagaagaaggctcttccggtgaacaaagataggttcataagcaagatgttcctccgtggggattcggtcatcattgttctcaggaacccgaactgagttatcttgtacacgtggagagtctatgtgccagtacgttgctatagagtagtatgtatgccagatgctcaaaacatgtgagtgtaagatgtgacatttcctgaaccagaatttgctatgtatgttgatggtggaggattttacttgaggcaggatggtaggacttggttttacctcttgtggatgacttgaactggatgtttctttgaagtagtaacaacaccactgcatgaatcattggttccaaaatgtaagtaaagttgttaatagcacactgactgccagatgtatgcttggttaatttagtgcaatattaactaccgtttct

SEQ ID NO: 10588 - DNA, 928 bp, Sorghum bicolor
  Clone ID: SORBI-28MAY03-CLUS24194_1
ctcgcaccaaccgcggttgccaacctaaccagcagcctttgacccccccccgtcggccgccgccgccgaagcggaagccgcagaccatggagcacgcgtccgccttcctcgcgcgcgcgctcactacgccgctcccggcatccgccgccctcccgcggcggcgcccggctcgcgtggccgtcgccgccgcggcgccggagcgcaagccgccgggtgcggtggcatccaccaccaactacgtcgtgccgctcgacgccgcgccgtccgggatcacgcgccctctcgtcgagatcctccgcgacctcaacaagcgcgtcccggacgccatcgtgcggcctccctcccggcgcgcctccgcctccgaccccgtcatcccctggtaccatgccaacaggatgctcagcttttatgctccaggttggtgtggggaagtccgtgatgttatttacactgacagtggaaaggtgacggtcatataccgtgtgactgtacgcggaacagatggagaggttcatagggaggctgctggaacagcatcactgagcgatgcacggttcgacgatcctgtgtctgcggcagaagaggctgcgttctgcaaagcctgtgcgaggtttggtttcggcctgtacctgtaccatgaagacgagacaccatagaagaccaacatttgttcacatcatctaagccggctctgttcagatttacactctagaggctgtggtgtactggcgttgatcagtcagtctatcagatacccatccatactgcactgtaaatacagaggcacgtcaagttaccctttgttgctagggccttgagctgttgtaattttgtgtgggatgttgtttgctcattttcgtacagtcttgtcttgcaaaaaatgttgtcagctgcagttggtgtggattatggaattattatgaatata

SEQ ID NO: 10589 - DNA, 956 bp, Sorghum bicolor
  Clone ID: SORBI-28MAY03-CLUS25884_1
gcacgaggagagtacatcaagacatccagcaagccgactgcctccatcattttcaatggcacgtcactgggaaccactccagctcctgtggttgcttacttctcgtctagggggccaagtactgcaagccctggcattctgaagccagacgtcattggacccggtgtgaatgtcattgcagcatggccgttcaaagtcggaccaaatactgccggtgccggccctgaacatgatacaactttcaactccatctctggaacatcaatgtctgcacctcaccttagtggtattgcagctattctcaagagtgcacatccagattggtcacctgcggtgatcaagtcggcaatcatgacgacagcctatgtcgcgtatggtaacagccagccaatccttgatgagaaactcaatccagcgagtcatttcagtattggggccggacatgttaaccctgcccaagctatcagcccaggcttagtgtacgataccgacgtggagcagtacatcatgtatctctgtggcctaggctacacagattctcaggtggagacaatcacggatcagaaggatgcttgtaacaaaggaagaaaactagctgaagcagagctgaactacccttcgattgcaacaagggcgagtgcaggaaaacttgtcgtgaatcggacagttacaaatgttggagatgcaatgtcgtcttacaccattgagattgacatgccaaaggaagttgaggccacagtgtcaccaacaaagctagagttcaccaagctcaaggagaacaaaacgtttactgtaagcttaagctggaatgctagcaaaactaagcatgcacagggaagtttcaagtgggtctctagcaagcatgggtcaggagccccattgtaatattctaatgtaagatcatcaagggaggactagcttgcgtgatgagatcctgctacttgttataataacaa

SEQ ID NO: 10590 - DNA, 999 bp, Sorghum bicolor
  Clone ID: SORBI-28MAY03-CLUS25845_1
gcacgaggcccaacccagctccaagcgaagcccatcgcagctcccaaagttccaagcccacccgccaccgaccaccgtccggcgggggcgccctcggacagccgtcaggcgtactgtgcaaaccccctcataaaaaacccacaccgacccgcgatcccgagtcccgaccgcaggcccccctccccgtcccacctccgggcctccactgtagtgtacatccaccgcgcacgctgccgtctgctcccctcagcgagcgagatcgatgcgggggccggcgtcagtgaaggcggggagccggccgccgtggctgggtctgggtgcggcggcgtgggtgcaggtcgcgggcggcgccagctccacgttcgcgctctactcgcacgcgctcaaggtcgcgctcggcgccgaccagagccgcctcgcgctgctcggggtcgcctgcgacgtcggcgagaacctcggcctgctccccggggtgctctgcaaccgcctccacccggccctgctcctcctcatcggcgccggcgcctgcctcctcggctacggcaccgcctggctcctcgtctccggcgtcgcgcccgcgctgccctactggctgatatggtttgcgttatgtcttgctaccaatggtggtgcatggttggcgactgccgttctagtgaccaacatgaggaacttcccactcagcagaggtgctgttgctggcattctgaaagggtactcgggtttaagtgcagctgtttacaccgcagtatacactggagtgctccgtgattctcccatcaaccttttgctctttctcactctgggaattcctgctgtgtgccttctggcaatgtactttgttcagccttgtgaaccctctctggtggagacgaatgcagagcaagtccattttttatttgcacaaatggcgagcattcttcttggggtttatctggttggggctacgatattggatcatgtcgtgactctcaatgacattatcaactattctctgct

SEQ ID NO: 10591 - DNA, 825 bp, Sorghum bicolor
  Clone ID: SORBI-28MAY03-CLUS26031_1
gcacgaggaaattcacaaggcagctgccgaattgctcctgcagagtgcacactgcagagcatcggtccatcgccattcgtcgcggcggccatcccgtccgttcagcctttcctgctcagacgacttgtcgtcgttccctacatctgatcgtaatcctcagcggcggcgcgtagatcagcagcagccgcgatgaagcaaaagatcgtgatcaggctgagcgtggcgagcgacaagtgccggtccaaggccatggtgctggcggccaaagcagacggggtgagcaagatggggatcaccggcgacggaaaggaccagctggaggtggagggcgacggcatcgacaccgtctgcctcgtcaactgcctgcgcaagaagatcggccgcgccgacatcgtcaaggtggaggtggtgaagcccgaggagaagaaaccggaggagaagaagcccgaggtcgtgccgctgccgtacggctggtgctaccccaattactaccagtaccacccgcactggtagtggtggtgactggtcaccagcgaagctgttcgtgatagcatacaagccgttttgacggattggtatacagttgccattcagctctatgattgtacttgtaccggtgtgcgaatgaatgaaatatatatatgaaaaagcaacaaaaggaggaaaaaaaaaggaaattggcaaagcttacttgtctaagtcttaatgttcgctttgctcctagttccaactgcggaggagtgttggatgtaatttggttagtgagcctacctatcttggctccccacctagcgtatatgtaagcactggcatctctagaaaaca

SEQ ID NO: 10592 - DNA, 634 bp, Sorghum bicolor
  unsure (1)..(634): unsure at all n locations
  Clone ID: SORBI-28MAY03-CLUS263_1
gccggccgggccggggcagtctgcatacacatatccccatagcggaggagatccatcgtcgtccatcgatcaggagacgggttccatggcgaaacagcagcaccaccaggctgtttgcatggtgtttctgatggcctttatcatcctctctgccatgcacgctgtcccagtggaggcagggcgagcgctacgtgaggcatcctctgtttcaagatttgaccccctggacccaaacagcaggcattctgtgcctgctggcgagccatacactcgcccaggatgcacgaacgtctaccaatgccatggagcaccataagccttgcttgcttataaggcagctagtccgatccagcgcatatagcacatgcttacatgcctaaaataaaaagcctagctgaaccgcatggcgtcttgtgtgtgcacatgaattgtgcatatgtgttatttgcccaaatcctggggatgctaatccctgcgattgaagcaatcgtgttatttatgataaagtgtgtgtaaagacatgtaagtggctggtgtaattgatatggtacttatagatatccatatatatatacctaagagcatctctaacggttttgcaaaaaaaaaaaaaaaaaaaaannnnnnnnnnggc

SEQ ID NO: 10593 - DNA, 884 bp, Sorghum bicolor
  Clone ID: SORBI-28MAY03-CLUS26157_1
gcacgagggggctgcacggggagttgaagcaagaaagaatggcggggctctacgagaagccgtcggagacgtacgccaagaagcgtccgcagtaccccaaggagtggttctccatgctggccggcctcaccgcggggcaccagcgcgcctgggacgccgggtgcggcaccggccaggccgccatcagcatggcggagcactacgagagcgtggtggcgacggacgtgagcgagggccagctccggcacgccgccgcgcacccgaaggtgcggtacctccacaccccggagcacctcacggaggacgagctggtgtccctggtcggcggcgagggctcgctggacctggtggtggtggccacctccatccactggttcgacatcccgctcttctacgccgtggtgaaccgcgccctgaggaagcccggcggcgtgctcgccgtgtggggctacaactacgagatccacccgttcgagggcgcgctgcacggccagctctacccggcgctgcggccgtaccaggacccgcgggcggtgctggccatggagcggtaccggcacctgccgttcccgttcgagcccgtcggggtgggcgccgagggcgcgcccgccgacgtggacatcgaggtggagatgacgctggaggacctggtcgggttcctgaacaccggctccgtcgtgaccacggcgagggccaagggcgtggacctggaggcggtcacgagggacgcgctgaagcgtgtggagcaggagtggggcggcgcgcccacctcgccccggaagctcgtgttcaaggcgttcatgctcgccgggaggcccaagtgctgaagcgatcatgccgtggttgctaatcactgcttctcgtttgcagtttgctcgtggtta

SEQ ID NO: 10594 - DNA, 784 bp, Sorghum bicolor
  Clone ID: SORBI-28MAY03-CLUS24364_1
caaactactcgtgtcgtgtaccctcctccatcttcttccccttgctctacggcacttgcacacgagtgagtccaggccgcccggggccatggcggcgtcggggctcaaggtccccgagatggcgctgagggtctgcgtcgtgccgctcgcgttggcctccctctgggagatggccaccaacgcgcaggccgacgacacctacggggaggtcaagttctccgacctctccggattcagctatttggtgggcgtcaacgccgtcaccgctgcgtacgcgctagtctccatcttgctgtcgtccttgaagcccctcgcgcgctacgactgggtgattctcgtcatggatcaggcgtcggcgtacctgctggtgacgtcggcgtcggcggcggcggagctgctgcagctggcgcggcgcggcgaccgggaggtgtcgtggggcgaggtgtgctcctacttcggccgcttctgcggcaaggccacggtgtcgctggcgctgcacgccgccgcgctcgcctgcttcgtcgcgctcgccctcgtctccgccttcagggtcttgagcaccacaggcagcagctgccatccccccaagcacgcacaggcacaggaacatgagcaagggaggtacaactgaatgcagcagcagtgacagtgtcagtgagcgggcgtttgctcgtgcacagtgtttgtgttcttaccactactactactactaccaagggcatcgcatcgcatcgagcgatctttgcacaggccaataagctagcaatgcattgtgccatgtaca

SEQ ID NO: 10595 - DNA, 633 bp, Sorghum bicolor
  Clone ID: SORBI-28MAY03-CLUS24624_1
gcgtcgctgccgcatggccctggcctccctcgcggcctcgctcccaatcgccgccaccgcctccgccgcctccgccgcggtgagactccgattccgcgtccgcatcggccgcgccatggcctcctccgccgccgcaggcgcgagcgcggccacaggggcctcgccggcgagggtgggcgtggtacaaatgacctccgtcggggacgtcgacgccaactacgccacctgctcccgcctcaccaaggaagcagctgcctctggagtgaaatttctttgcttccctgaggtcttctcattcattggatccaaggatggcgagtctgttaagctagctgaaccattagatggaccaataatgcaaagatattgctcacttgcaaaagaatcaagcatgtggttatctcttgggggatttcaagaaaagggacctgatgattctcaccagtacaatactcatgtattaattgatgatactggaaaagttaggagctcatatcgaaaaatacatttgtttgatgttgatgtacctggcaatatggtgtacaaggaaagtcgtttcacaagtgcaggcgatacacttgtttctgtggatagcccttttggacggttggggcttactgtttgctatgattt

SEQ ID NO: 10596 - DNA, 893 bp, Sorghum bicolor
  Clone ID: SORBI-28MAY03-CLUS24637_1
ctactggacttccattccctccaggcccccacgaactcgctcatccatcctccattcctccccacgatgccatcctcacgcctcccggttctcctctgcctcgccgccgtcgccgtcacggcggcgatggccgccggagaaggaggcctccgcctgccccgcgacgccaccttcccggcggcgcaggcggagcggctcatccgcgcgctcaacctcctgcccaaggagaagggcggcggcgacgggcccagtgtggcgccgggggagctcctggagcggcgcatcaggctgcccggcgtgcccgacggggttggggacctcggccaccacgccggttacttccgtctgccgcacacgcatgacgccaggatgttctacttcttcttcgagtcgagggggaagaaggaggaccccgtcgtgatctggctcaccggagggcccggctgcagcagcgagctggccgtcttctacgagaacgggcccttcaccattgccaacaatatgtcgcttgtttggaacaaattcggttgggacacaatctcaaatatcatatttgttgatcaacccactggaactggctttagctacagctctgatgatcgtgatactcgtcatgatgaaaccggtgtcagcaatgacctatatgactttcttcaggtgttctttaagaagcacccagaatttgcaaagaatgacttctatataactggagaatcttatgctgggcactacattccagcatttgcaagcagagttcaccaaggaaacaaagcaaacgagggcattcatataaacttgaagggatttgctatcggtaatggtctcactgatccagaaatccaatacaaagcctacacagactatgcactggaaatgaatctgattgagaaatc

SEQ ID NO: 10597 - DNA, 776 bp, Sorghum bicolor
  Clone ID: SORBI-28MAY03-CLUS2484_1
ccggctcctcccctggccacccgccaccctccgagggcgccttcctgcgtccctgcgtcggcctgcgcccccgggcgtgggcgccggggcgtccccgccgggtggtgcccgtggtgttcgggtccatccccgggatcatcgcggacgacatcgtgctcccctttgcggacgcgatcccatgggaggagatcgccgtgttcgtggccgaggacgacgtcttgaagctggacaccatcctgacgtccatacccatggaggagatcctccgcaaacagcggctgctggcgaacccgtcgatgaagcaggcgatgctgttcccgcagcccgcggagccccgggacgcgttccaccaggtgctcaacgggctggcgcggaagctcccccacggcaagggcgtgttcctcaagcccgggcagaaggtgctcaactggaccgaggggacccgggaagacctcaagccgtggtaggtgtgtatagtatagtggcgactggtgaggttgaggcaccgtcaccatttggtgctcttttgtaagcgacacaacaaccagatgagaggctgatcgaagatggtgatgctgatgatgagtgaaccacacagccattgatgattaaatgtaaagctcttctcttgctcctccaaccattctcttttttgaggcaatgtgcctgtacttgcctgtatatatatatactcgtcgcacctgccagtcggggggcccggcgcagaggctgatgccgctgatgggtgtaccaccctgccattgatgattaaatgt

SEQ ID NO: 10598 - DNA, 703 bp, Sorghum bicolor
  Clone ID: SORBI-28MAY03-CLUS25032_1
gcacgagggcaacccgaacagcagccccggcccggagaccccggtgtcggcgacggtgaccacctccttcgcggtggctcgtcggctgccgtccgccatctccccggaccggcggccgcggacggcgctgacgcaggaggagccgcccaactacgagatcgggtggaagcgcaccaaggcgcttccgctggagaagccccgcgggtgggccgtcgccgacttcctggagaagctggagggcctgctggcgcgcggccggtacgggtccgcgcagctgccgggcaccgtggccggcgtggtgacggagcgcgcccgcgaggagaccgaggtcctggtggccgaaggcggcgtggaagagcgcgtcgtcacggagctcttccgcgtgctccgcctcgtggagatggacgtggagatggtcaaggccgccgtcaaggaggagaccgtcaaggagcgcgtcgagaccgcgcgcgcacgctgccgccaggccatcctcgtcgccctctcgctctgacgctgatctgatcggcagtatacacgcctttctgtaataactacataaacaaacgagattagcgtgatagtattggcttattcgattacagaaatactgatgttataaacaaacgagattccgcgtgctgggttatgtgatcggtccaaacatcagtatttcgttaaaaaaaaaaaaaaaaaaaaaaaaaaa

SEQ ID NO: 10599 - DNA, 955 bp, Sorghum bicolor
  Clone ID: SORBI-28MAY03-CLUS25339_1
gcacgaggaaagactaagcctgatcgaggaatatttgtaaagcacttcaagaatatcccaatggctgacatggaaattgttcttccagagaagaaaaatccgtcactaacaccgatggattgggtcaagtttctcatttctgctgttatcggtttggtcactctagttgggtctcttgaaatgccaaaggctgatgtatgggttgtaatagcaatcttgtctggtgtgattggatactgtgctaagatatacttcacatttcaacaaaatatgacaatttatcagaatttgattacaaaatcaatgtatgacaaacagcttgatagtgggaaaggaactcttcttcacttatgtgatgacgtgatacagcaagaagttaaagaggtcataatttgttactacattttaatggagcagggaaaagccactacacaagatcttgatttacgctgtgaagagctaatcaaagaagagtttggcgcagagtgcaattttgatgttcatgatgctataaagaagttagagaagcttagcattgttcatcgggactcgattggaaggatcttgtgcgttccgttgaagcgtgcgaacgagatcatcggtacaacgactgaagaactggtgttgcgcgcacaacagagcccttcttcgtaggttccatttccaagtcgcgatgggtttgttaccttccatctcatttctgtgcaaaacacgcactagaaaggtagcttctgatcatcccggaagtttattcgcctgtacatgtgtatgtttgcaatgcattgctttccctttcgtttggtttagcacagagtgtatattcaaagctggctgttgcagttgaagaatggtacaggggatgtgtacataacaatgatacgtataataaaaatgtaacagtacaaatttgtcctctccctagtgtttctagggagacatatatattcttattatt

SEQ ID NO: 10600 - DNA, 596 bp, Sorghum bicolor
  Clone ID: SORBI-28MAY03-CLUS25354_1
agcttctataatgctgccaatgctgccctcataaacttcttcgagacgctccggactgagctaggaaaccaagttgggatcacggtggtgacgcccgggtggatcgagtccgagatgtcgaaagggaagtacctcaaggagcatggcgaagtggaggttgatcaagaaatgcgcgacgctcagatcggtctgttcccggtggagtacgccaagaactgcgccaaggccatggtgcaggcggcgcagcaaggcgagcgatacctcaccgtgccggcgtggttcaggccgatgtacctgtggcgggtgttcgcgccggaggtcgtcgaggcctgctaccgcctcctgtacatgcacggccatggcgccaggcaggccgacacggcgagcaggacgatggcggactccggtggtaagcagctgctgtacccgacctcgctgcgctctgaggagatcaagagtgactgaggtcaggtcatgtgcctgatatgcagttgaaacttgaatggtcccatggaacgagtggagtatagaaactgtagacgagaacgaacatttgtggttatgtcaatatgctgtgtacctggtaatgacataaa

SEQ ID NO: 10601 - DNA, 721 bp, Sorghum bicolor
  Clone ID: SORBI-28MAY03-CLUS26563_1
gggagcccgacagcagcaccgacacgtccaagttcgcgcggctggtgaactcgtgcgacgtgatggtgggcgtccacggcgccgggctcaccaacatggtgttcctgccggccggcgccgtggtggtgcaggtggtgccgtacgggcggctggagtggctggcccggaacacgttcgcggagccgtcggcggggatggaggtccactacctggagtacgtggtgcagctggacgagacgacgctgagcgagcagtacccgagcgatcacccggtgctgagggaccccatggccatccacaagcaggggtggaacgcgctcaagaccacgtacctggacaagcagaacgtgcgcccgcacctgggccgcctcaagaacaccttcctacaggcgctcaagatgctgccgcacggccgggacgattgaagaatcgaattagttgatcatttgacctggacctcggcctcagttatttattagagggtaaatgtataggttaatggtaattactactattttttggcttatttttgtttttctctctttatttgtttgtacgagtaagaagagggtgcgctagtagcagcagccagcaagcagtagtgctgctgtgaatgggtgcacagttcgcaggacaaagaacttagtgtttaactgtttatattttatcgttatatatgctgctttgatagcatgaaacgtgattacagttatgtgctttc

SEQ ID NO: 10602 - DNA, 637 bp, Sorghum bicolor
  Clone ID: SORBI-28MAY03-CLUS26574_1
gcacgagggctgtgcgcgcccggcggcgtgcacagggcgacgtcgatagcatcgtcgggttcgacctggacgagctccgcgagatgcactacgtgcacgcggccatcacggagtcgatgcggctgtacccgccggtgccgattaactcgctgcgggcggagacggacgacgtcctgcccgacggaacagccgtgcaggcagggtggttcgtggcgtacaattcctatgcgatggggcggatgaagtcggtctggggcgacgacgcgcgggagtaccggccggagcggtggctgaacaccggcgacgggacgttccggccggacagcccgttccggttcgtggcattccatgcggggccgaggctgtgtctgggcaaggagatggcgtacatccagatgaagtccatcgtggcgtgcgtgctggaggagctcgacgtcgcggtggacggcgcgcaccagccccgaccggttgcgtcgctgacgctgcggatggcggacgggctccctgtgaccgtgaagccgagacgggactgacgaactgctgtcacaaacaactgcagactctgcaggaggctgaacatttggaaagaaatggtgtacctttttcctatacgtgaataaatccactaaattcgtct

SEQ ID NO: 10603 - DNA, 814 bp, Sorghum bicolor
  Clone ID: SORBI-28MAY03-CLUS26706_1
gcacgaggggttgatgaagctcagaaagctttggaagaggcagaagctctgaaaaagctggcgccacgtccggagccaccttcagacccttctaaatataccgccgtccttcttcggtttgctggtcatatgttccgcctccggccgcacgagggagcatttctgagtgtatatgacaatgatcgacgtcttgctgaccattttggagggaaactacacctaggctacatgctgattcgtgagaaacagaaagaacttcaggagcagagaaacaaaaggaggacgggcaaaactgaagatgatagacgatcaagagagcacagcaaggatcgcaacggtcggtcatccagggatagagattcagaaaggagagacagagttgagtctcgagatggtagaagagattatgatagagatcgtgatagacgtcacgatagggaccgtcgccatgaccgtgatcgggatagggattatgaccgttcccgcggacatgattcaaggagaagagagcgttcacgctccagggagcgcagcaggcgccatgagagatactaaatgttgctccatggctgacagattttggagtgctggcgtctgttcaagatatggtttgagttgtgctttgtatcttctgtaggttcctgctcgagaaatccgagagtcaatcttggtgcattatgcatcatgtcatagcgtcgtactgtttagtataccaattttatatgccgagaacaatcacattaaaggaagcttgggaaaccgtcctacttgacgctaaatgtgcatggagttttaagtatttaaacgcgtctgg

SEQ ID NO: 10604 - DNA, 1139 bp, Sorghum bicolor
  Clone ID: SORBI-28MAY03-CLUS26741_1
gcacgagcccggcgcaccactctcgctcgcactcctcgtcggcgtggttcgttcgtggttgcggctttccgcgaagcgaagcgccgtccacggtacgtgtagaggtagcaagccagagccactgttgctgatcgatcggccggtatggccgggagtgcgaggtcgtcggcggccgcgaagcacgcgtaccggatgttcgcgccgtccaggggcggcggcgccgcgacgagggggcccggcgctggcgccgcggaggagttcgacgagtcggacgtcgtctggggctcgttcggcggcggcggcggcgcggactcccactccagccccggggcggagctgcaggccgcggccggctgggcgcgcccgatccccgcctcccgcgccggggccgggcggaagaagcccgccgccgtggacggcggcggccccgcggggtcgctgccgatgaacataccggactggcagaagatcctcggggtcgagtaccgggaccactaccgcgcgggcgagtgggagcctgacgcggacgacgacgaccacggcagggcgcgcggcggcggcggggccggggcggagatggtgccgccgcacgagctggcgtggcgcagccgggccgcgtcgatgtcggtgcacgaggggatcgggaggacgctcaagggccgcgacctcagccgcgtccgggacgccgtctggaagaagaccggcttcgaggcggactgacctgatcgtcggtgatccgccgccgcgcccgcgccggcgggggatgagcgcgcgcggttgccggttggtgttggtgtaggtattatcggtaggttagaaaatgagcagtgctgctaatttcttatctcttgatttctttctctctcttttttttttgcccttgctatcatcacttttccatttttttttccttttgcgtttccatgcttgtaaggggaaaaagtcggggtagtaagctttttcttgtttttgttcgtgttgatgcgagccagagggttgggtgttcgttattcatggtgtgacaattttaagggcacctggagaaaaaggacgaatttgtacaaccgatcagttggttgatcatgtctttttttttttgtccttctctaaggaaaaatttcaattttttcccagttccc

SEQ ID NO: 10605 - DNA, 784 bp, Sorghum bicolor
  Clone ID: SORBI-28MAY03-CLUS25524_1
gcacgaggatcgtttctgatccctgcccggcgcctccctcccttcgcagccacgcgacgacgaaaccctagcctcctcctcccccctcccccacctcgtcggaaccccggcgcctcgccggagcacggggtcaacgcacccccgtcggccgcggctgcggaggagcggaggaagacgatgaacggcggcggcggcggccagaagaagcggggcacgaggatcgagcccttccggcaccgcgtcgagaccgaccccaagttcttcgacaagtcgtggcggaagctccatgacgccatccgcgagatctacaaccacaacgccagcggcctctccttcgaggagctctacaggactgcttataacatggtcctgaacaagtttgctcctcagctctatgagaaactcacagaaaacatgaaagaacatcttgaagatatgcgcacatgtatagatgctgctcaaggtggtttgttcctggaagagttgcagcgaaaatggaatgaccacaacaaggcattgacaatgattagagacatcctgatgtatatggacaggacttatattcctactaacaaaaagacacctgtctttgatcatggattagagctttggagggataccatagtccggtctcccacaattcagaggaggttgtctgacacgcttcttgaactcatacatagtgaaaggacaggcgatgtgattaatagaggcttgatgaggactacaacaaaaatgttgatggatctagggttgtctgtttatcaggatgattttgaaaggc

SEQ ID NO: 10606 - DNA, 810 bp, Sorghum bicolor
  unsure (1)..(810): unsure at all n locations
  Clone ID: SORBI-28MAY03-CLUS25666_1
gcttcaaaggaaagtccagcaagtgctgttgctagcgataagggtacccccataccctcaagttctagccaggagaaggattcagtgactaagactatactaaacaaggtgaaggaaaaaagtgatgacgaaggtaaaccattacccgctgaacttgatggaaaagaaaacttggtggtgaactcgaaaaatgagaagtctgattctggtgttgaccggagtcgggaaagagaaagagagagatcaagagggcgggaacgtgatgccaggggtagggattcggatcgtgatagcaggggtcgtgactctgatcgcgagagggaccggagacgtcgctctagggaaagaagttcaggacactcagacaaggagaaatcaaggcgacattcatcacgagaccgggttgactactacagttcgcattcatctcgtgaaaaagatcggcacaggcaccattgatcaaggtgaggaggatcccgatctgcagggcatcgctgcatggagaccaccacttggcagtgccgacccaatcatgaaaacttgtggattaccatcatcccattggtggttgcattggcttcattgtttatgcaccttggattttgtaacttgcaagataagcgagctgtgaaaaacttggatttgtagaaacttaaacgaaggatatatatataagataaaattggcgcaggtgcacactgaactgccatttccagcagagcttgtggaatgttataaaaaaacagagcatgtggaatgtttgtgccgtcatggtaaacgtttgtgtggatttggccatggtacactncc

SEQ ID NO: 10607 - DNA, 961 bp, Sorghum bicolor
  Clone ID: SORBI-28MAY03-CLUS25541_1
gcatacttctatgcgaggatacagagcttactatagaagggattctccagttcatgcctcaaactataaatatggacggtcacatccagagacaagaatcagggaagaatatgatgagagacgatacactagtaaatatccaaaacacaggcaggcaatgcatgaaaccatggagcgggatgcatactgcaggaacaaatatggacattcataccaggagagggcacatagaacttgcccttgcccagaatgtaacttgagtggtcaaaattgcagttaccccaatggcgaggaattttctgcaatcagcggttgtgagcaggcatactacaagacagaccgtgatctgacgccttcaacttctcaagtagcatctcattgtgaggattcttgctgcaagggccagcagttgatgcctaaaagttcttctgtgatgtgtgattgtgacgaatgctatgctaatcaagagtcaacaccaagtccaagtgagcatgccagaaaaagatccaatcttccagtgcctcttcatcatcggcttgccaaacattctaatgagcatgggaggcatgtggatgatgcacattctgcttttgaggtggagtacaccgtcagggaaagccgaagtcggtatctctcttccaaagatgctccaagtactcactccaggaagcaccataggtcagcaagataagctgttaagtctcacaagatagagaaaatctagtagcggctcgcttctgatacttcgtagcatgtgatcgatagcatttgttaccccggccctgcttgcgtggctgacaccctgttgcggggaggaaactgcttgaaggacagcagtataccgtcccaagttataaccggatattttgccttgtctcggttctatgtattcgcgttcgatccctcgaaatgtgttgctgaactggtttgggtgcgcaaacctagaaattgatcttacagt

SEQ ID NO: 10608 - DNA, 1040 bp, Sorghum bicolor
  Clone ID: SORBI-28MAY03-CLUS25579_1
gcacgaggagacagcaaaagcaactagatcgagacatccatcgccatcatatcatcgagtggtactatatactactacgatggcaacggcacgagcactccgcctggtcgtcacgaggccgccggctaccagcagggacggcctcctggccgacgtgcgtcaccgactcctgtccgtgtcgaccgaagccgcgggcgcgggcgacacggccgtgcactccggtgacgctccgagcgacgattacatggaccggccgccgaagttctccggcgccgaggaggccactggcgctgggggccgcggcggcaagcacccggtgggaaaagcgggggcgacaccggggcacgcggaggcggcagcagatcagcgcgtcccgccgttcgcgccctcggggaagaaaccgccgctggccgggtccgaacatgagctggcggacccggcgggaggcgcgtcgttcacgcagaagcggcggctgtcctcctcctcgcgggaacgggacccgcgcgaggcggcgacgcccggcgagtccgagtcagcggcgcgcaaggtgagggaggaggacagggagtactaccggacgcacaagccgtcgccgctggcggaggtggagttcgcggacacgaggaagcccatcacgcgcgccaccgacggcagcgccacggaccggtacgcggacgtgccgggaaggatggtggaggacacggtcgacgactcgctggcgcgcgccgaggccatgttcagggaggccgcggcgcgcgggaaccccgagtggccgcactcccgcgcgctcgccgacatgctggcgcgccgcgagcttgggaaggacgctgctgggagcggcaaaccctgctggggcagctgagggcggaggcctcacgcagaagcagtgtttgacgagcacgttgtacttgtacagttgtttgtgatggtgagctctgatatatatgagcagcggtagaccggtagtagtactactaaagttaccccctcaatatgtagggttttcatccttcatctataacaaaaaaaaggtttacttt

SEQ ID NO: 10609 - DNA, 1365 bp, Sorghum bicolor
  unsure (1)..(1365): unsure at all n locations
  Clone ID: SORBI-28MAY03-CLUS25711_1
ccgaacccgaacgaacacccgcaaatatctgtcgccgtcctcgcgaacagcaccaaccgccgctccgaattcgatcgccatggcgagccaaggcgagccgtcttcgtcggatccgaaggggaagaaggattactcgacggcgatcctcgagaggaagaagtcgccgaaccggctggtggtcgacgaggccaccaatgatgacaactccgtcgtcgctctgcacccggacactatggagaggctccagctcttccgcggtgacactgtcctgctcaagggtaagaagagaaaggacactatctgcatcgtgcttgcagatgacacgtgtgaggagccaaaggtccgaatgaataaggttgtcaggaagaacttgagggtacggcttggtgatgtggtatctgtccatcaatgcccagatgtcaaatacgggaagcgcgtgcacatacttccaattgatgacaccattgaaggcatcactggcaacttatttgacgcctttctaaaaccatacttccttgaagcctatcgtcctttgaggaaaggagaccttttcctagtcagaggtggcatgagaagtgtagaattcaaagtcatagagactgatcctatagagtattgtatcgttgcaccagatacagaaatattctgtgagggtgagcctgttaagagggaggatgaggaaagacttgatgaggttggctatgatgatgttggtggagttagaaagcagatggcccaaattagagaactggttgaacttccactgcgtcatccccagcttttcaagtctattggtgtgaagccaccaaagggcatattgctgtttgggcctcctggatctggcaagacccttattgctagagctgtagctaatgagacaggtgctttcttctttttgataaatgggccagaaatcatgtcaaaactagcaggagaaagtgaaagtaatctcagaaaggcatttgaagaagctgaaaaaaatgcaccttccatcatttttattgatgagatagattccatagctcctaagagagaaaagacccatggagaagttgaaaggcgtattgtttcacagctcttgactcttatggatggtctgaagtctcgtgcacatgttattgttatgggtgccacaaaccgtccaaacagtatcgatcctgctcttagaaggtttggtaggtttgatcgtgagattgatattggtgttccagatgaagttggacgccttgaggttctccggattcacaccanaaacatgaagttggctganaatgttgacttggagctcattgcgaaggatacccatggttatgttggtgctgatcttgcagccctttgtaccgaagctgctcttcaatgcatccg

SEQ ID NO: 10610 - DNA, 1206 bp, Sorghum bicolor
  Clone ID: SORBI-28MAY03-CLUS25791_1
gcacgaggctctcttatctccttccaagatcccacccccccattcttccttttttttttggtcgtccccaccattcttgctaggatcattccttgatctttcgctcgctcgctccagtacgcccgtttttgttttccagctccgggagatcccatctcggccgccacctcctgcggtttccaagctccaagaggcaagattcattccagctcaaatttgagctcaatttgccccgctgagctcgaatcaatccacgaacaactggctcggcaacaagtgtccttcgtcccccccgatccccgggcttcgattcgatcgaatccgacctaattttattgtgcttgtgcctgtgtgtgtgtctgtgtttttttaacctcctctcgctgcgcttttccgtcgcaaagtgggttccatcgcgtcacccgcacggctcctctccgatcggccggagaaagaaggcgcataaaaaggcgcgcggcctcttgatgcggtcttggtcgtagcaacatacagcagctccactgctcctgcctggcctcgcctcgcttgctgttctttatccatatacggacggagcagcggccagcgggcgctccggcagcggcggcaccgcgcggtccaccctccgccagcgggtgctgatgcttgccctgctcgcccccttcgccgtcgcctgcctgctcttcgtgtccaggccatgcgcgcgtgacatgagactgttcctcgcctccctgtgccagcagctcctgctctccctcctcggactcctggcaggcctccgcctgctgggcggcgtcgcggccgcgtcccacgcggccaacacagagaccatgccgctcatgccgtccttcaagaggaagcgggccgcggtcacggtggagaatgcggaggaggcggccggcgccgccgctggcggcgagccgtcggtgctcgacctgccggagctggccatcgattgcattctcgagaggctgcagccggcggagctgcggagcatggccgccgtctgccgctccatgcgcgagcgctgccgcagcgaccacctctgggagcgccacatgaccagcaagtggggccgtgtcctgggccgcgccgccagggacgaatggaggacgcacgtggcgtccgccagcgagtccggcgcggtctcgggcggcggcggcggcggcaagcgccggaggtggctcgcggcgctctcctgcgttt

SEQ ID NO: 10611 - DNA, 1156 bp, Sorghum bicolor
  unsure (1)..(1156): unsure at all n locations
  Clone ID: SORBI-28MAY03-CLUS26979_1
gcacgaggcaccacctttccctcccccgccttcttccttcctccccaagaccgcgagaatacttcagcagcaatcgcaattcgcaagctcgaagcttaaaataatctcttgtagacgcctctggaaggtcagcagctaaacccaggtaacctccagtgctggagccgtactcaaccctaaccctagccccccaatggcggccggcggcggggctccgtgggcggagcgcgcgcgggtggtggggacgcagatccgcaacaggttccgcgtggcgcccgtggaccaccggtcgctgtggctgcgggcagacagccgtgtcgccactgaggcggtccggcggtggtcggatcgcgttcgggccctgcttcagagggaccggggcgcggatcggagctccacgtcgacggagacgtctcctgaggcggcggcgaagccttcgtccagtgctttgagattctacagaaagagagtgggcaaagaagtcaatgggattgaagactctgttatttttcgttcgcttcaagcattggctgttcctcttattggcaatgcatgctatgtttttatgcatggccttaactctgttcaggtttatggtgcagaaaagcttcatcaggcattacaggggagacctaaaggcaaggctcttctaacggtcagcaatcatgtggcagcaatggatgaccccttcgtaattgcctcccggctcccaccatctgttatgctggaagcacaaaagctgagatggacactgtgtgcaactgaccgttgctttacaaatccagttttgtctacattcttcaggtccgttaaagtgttacctgtttctcgtggtgaaggcatctaccaaaagggaatggatatggcactttcaaaacttaacagtggtggatgggttcatatatttcctgaaggaagccgttcaagagatggagggaaaaccattgctcctgccaagagaggtgttggaagattggtaatggatgctgacagccttccagttgttataccctttgtccatactgggatgcaggatataatgcctgttggaaaacgcatccccagagcagggaaaagggtgattgtnggntgtgggtgacccaattaacttcgatgacctgctcattgacaactgtgatgatgcccaacacatctc

SEQ ID NO: 10612 - DNA, 1298 bp, Sorghum bicolor
  Clone ID: SORBI-28MAY03-CLUS2714_1
gcacgaggctggttctctcttaggagcagctgcacaccgtctggtgaaaaactccctccagatcaaatctggcaatgctgctgggttaattgatatgccatacaggggtgcaccctacagccctggaaacagaccaaggcctgctggaccattagggtatgagaggggttttgtggataatccataccatgcacacatgtctagaagtgttccaaaccctcaccctcagttctttggtgattctcaagctaacaaacagccaatgcggatactagaacggccaaacccccgaagtcatgatgctggtatccgtgcatcaatgtcaaagttgacaatccgcgtcgggccaaggcctcatcaaaataataggatgcagaattctgggtactggcccaatcaaccacattctaatcactttgctggacccccagcccagcggcctatgcagaacataagttttatacctcagcgacctttccaaactggaggattcccgcagcagagacctgtaaatggggttccaccaccattacctcccagtaactggattgggaagcaaccaaatggaggccacacgggtgtacctgcaaaacacgatccaaggacagctccagatagacagcctaagcaggataacccaagatcacaacaggataagagacagcaggctactaccaaggtataccgtgtcaaaactcaagctactaatggtaatggtttgtcagagtcaggtaaacaggaagaatctgcagcgtaactgggttgcttagttgctggaaatccacacgcaaagtttaatgtgcgtgggcatcctgctatcaggagagaatgcaggctcttggtgatagcagcagagggtttccatgtatccacactcaatttatattccgttgttgaattgtttgttgtattacttggaaaggagttggctaaattttaggacgggggatttagatacatccttatttagttgctaggacatagtatgggcatccactgctgttgtaaagctgttagtgggatagctgaaactgtcttgtgctggctgactgctgaataatttccctagacccgtcgaaggctggctcacctgccctgctgtatctcatgaaagttgggggcagatgtgcctggtcttcaacggaccaaggtgaataaacttaccataagtttctttgtgtcagagggaggaggaagcattctgacttcttcctctcgagcttaacaagggtgaatattaggacaacgaatatgatcttttttcttttctgggatgcaaacatgatatattcagttgt

SEQ ID NO: 10613 - DNA, 1044 bp, Sorghum bicolor
  Clone ID: SORBI-28MAY03-CLUS27154_1
ctggaccgctgggtggaggagaggtacatggacgacgagaagaacgccaagatcctcgaagtggacaccggcaacaagccagggcggtatgcttccaagaggcgcggcggcggtggcggcaaccatcaccaccagtcgccgtgctcgacgatgacctctgaccagaacagccggagctacgcgaccatgccggagtcgccgtccaaggactccacgaccgcgcagcagtcggtgccgagcccgtcgtcggtgggcatggccgaggctctgagcccgctgcgcatgcccgtggacatcgccgagctctgcgacagccctcagttcttctcggcgacgtcgcggcccgggagctcgaggaggggcccgttcacgcccaccaagagcgagtgctcccgcagcctcttcggtggctactccgactaccccaactacatggccaacacggagtcgttccgcgccaaggcgcgttcccagagcgcgcccaagcagaggccgcagtacgagaagtccagctccctccgcaaggcgtcggcgcacgccttcgcgacggggccgtgcgcgccgccgtcggcgggggcggccgcgcagaggtcatcggcctcactgcacgccaagttcaccaacaaggcgtacccgggctctggcagattggatcgacttggcatgccggtcaggtactgatcctgatcgtgaatttcctgatcctacctaagttcgcttcaggataatgtggtgctgcgcctgaactgatgtccgtgtgtcaagcgaggacgatgaaggaaatctactagtggtcgttaggttttgtgccttcgtggtgctatcacccgtaaacagttttctgtttcttgctttgtgtagcgaagtgtaagttgctggtagctgtaatactatgcgtgctaacaactcccctccacatttcctccgtgatatatatatctgccatcaaatcatgcaggggaattgaatgtgttgttgcaatgctggctcgatgttggtcactcatatactagttcttgttcatgatgagacgttaacatcatc

SEQ ID NO: 10614 - DNA, 838 bp, Sorghum bicolor
  Clone ID: SORBI-28MAY03-CLUS27219_1
gtggtacccagatcattgtgccttttcagtccagcacctcaactcatgtttcagatttcatttccccctacatttccaacaaaaacccccttgcctactcatgctactgttagtatgtttttgtactgccattaataagatcagctgaagtgacccccagcccccagggcagtgctttgggtgcaaacacaagtccctttcgttaacatgatgttgtccactagttaatattttgtggttgggtttcctagcacttattccgtgctggtcacttggccggccgtgaaccttggggacttccgcaaggcccgcaatcccgtcctagcctgggctctggacctggtgttcggcgcgcggagtgacgtgttcatccctgctgtcgctggcctattctacgggcatgtcacaggtaagaggatcgcatctggtcgtacccagatcattgtgccttctcagtccagcacctcaactcatgcttcagacttcatctccacctacatctccaacaagaaccaccttgcctactcatgctactgctagtatgtttttgtactgccattaataagatcagctgaagtgagccgcagcccgcagggcagtgctctgggtgcatatacaagtacctctcgttaacatgatgttgtacactagttaatattttgttattgggaatattagcatatattgtgtgctgtttacttgtttggacattaaactttggaacaacagcaaggagcataaactgcttgtatgctgtaaaatgaacgtgatgttaggcgtgtgaaaagagtccgcttcatgtaccttgtagcgctctttatcttctgtctgctcacaa

SEQ ID NO: 10615 - DNA, 1274 bp, Sorghum bicolor
  Clone ID: SORBI-28MAY03-CLUS2723_1
cgtccgcaggtagagggtaagacgaaggagcatattcagaattcaaagtgctgtgctgggcccaattcccttttctgaaaaccaccaaaggttagtagctcctgggcccacatgcagagataacaggagccaggagcgtgagagtgtatgtaagccggagcgggtggccagaatcgcgccacctcggagcccaggatttaatctaatccaaaacccctcctccggtctcactgccctgctccattccatttgccgagagtttcctctgcttctcctccgttcgttcattcttccgtgcacttccagttccagcaaccccatcatctgctggctgctctaaccagctgcagagctgctccaatggccaccttgtccgccatctccgccaaggccggctactgcaaggcaccaacgctgagctggaagggaagcagagtttcagcccggaatgtggtctccatggcgaccacccggagaggaggcctcgtctccctaagatcccctcggtttcgcgtctacgcggcaaaggcggagacggtgagcaaggtgatggacatcgtgaagcagcagctggcgctggcggcggacgtggggctgacggcggagtccaagttcgcggacctgggcgccgactcgctggacacggtggagatcgtcatggcgctggaggaggagttcaagatcaccgtcgaggaggacaacgcccagagcatcaccaccatccaggaggccgccgacctcatcgacaagctcgtcgaccagaacccagcggcggcggcgccgccggcatgatgagacgagacaacatcgaaacctctatacatgagcattattggttgatcgatctctagctagagacaatctggacggatggaagagctgatcgttgccaggattctttttgcttcatcggtattccagcattagctagcgtcgttgatgttcgacgacagacattatagccagctctcctttcaatttccccaactttttagctgtgtgtggtgagtgcgtgggttcttttttgttaggagaagatgattgatgaacatgttatgcgctaaaatgcttccaacttttttccccagctaattaaccggaattggtcgccatgcacgaacgtgttcatgtactcccatactcctgcttcgcagtagtgacctgtatgctaacctgtgtcaggctccaattattgccctgtttgtttggacactgttttgatgatttgtgtaagaaaaaggcgatataaactgtgtcaaaaaaaaaaaaaaaaa

SEQ ID NO: 10616 - DNA, 752 bp, Sorghum bicolor
  Clone ID: SORBI-28MAY03-CLUS26316_1
gcacggcacgaggcttctccctcccagactccagccgccgtgagcccgcgctctctccccctctgtctgcgccgactgcctgtgccaccgccgccgatctcttcgccggcgaagaccgcccaccaggctccggccaagggcgtgatggcggctgtggggagcttgcagccggggatggaggctctacacgtgcagggggactacaaggacgcgcctcctccggccaaggcctccgtggtggctgccgcggtagagagcctccagccggcgatggagagcctacatgtgcaggatttcaaggacgcggcggcggctccggccaagggcgccaccgccgtggggagcttgcagcctggggccgagaacttgcaggcgcaggattacaaggacgctagcatgtactatggtgcttacccggcttatgcctatggagcctatggtggctggggggagtactccacatacctggctgatggagcacagtcaccaactgctggtacctatgctgatatgtactatggctatgctccctatggtgttgcaaccttggggtctgatggtcagatttatgggtctcagagttacgattaccagtacccatcaacatataacaagcaacagaattctactgccaagctgtcgaccaatggtaaaagtgagaaattggctccggcgccgcaaggggatgtctccactgttggtgtcgatgaggtgaaaggtctgaaaaattcaaactcgaccttgaaggcaga

SEQ ID NO: 10617 - DNA, 1062 bp, Sorghum bicolor
  Clone ID: SORBI-28MAY03-CLUS26357_1
aactccattaactttacaacttactaaatgcctataagcagtatctagccattctaatggatgaatttgaagaatcaaaaagtagttttgctgaaaagacaaaattcacataagttccttgctgcagatcataaacatggcataatttgttacaagatgtgatgtaatgccacagatttgcaaacgtcattgcatgcaaataataaaaattatagccattctaatggatcacctcaggataatcttaacatgtgacttcactggcccgcggctggggcctgtctgcacgttgcggcacacatgctctgtctctcagcggctgctccctagatccattacttgtctttctcttctgctgtcgctctcttccactgtgttggctggagtacaagacatgtattgaattagtagaatttcaaacataaaataatgcaacattaatatgtactacttcactgactcattgagattacacatgtcagcaagcactggagttgcgataaattcaactcgaaattaagtaacactgaaaaaggatctatcaagagtaaaagttcaatttacccgatagtagaagtaatcatacagacgcaaaaggtggtacttgtcagctggatcatgcttgttaacatacttcaggagcttgatctcatcaaggctctggtcgaaaaaatctttgttattttttataattttaacacatacatccattcctgtgtgcaaatcatgtgcctggatagctttgctgaatgcagctgaacccaaatactctgatacatgataacgccccgcaatgacagaattgagaacaacatggaaatttttgtcttcttcaaaaccagttctgttttttctatgcacaatcttaagattgaacgtttcaaactcttcctcctgtgcctttatctgcctgacttgttcttgcaatgctgctgcttcctcatcatccaagttggttccagtgtcttcttcttgtgcgtcatctagtttgtgttgccgaacattcgttgtgtcctctgtttcgtcatatgatgcacttgaatttcttgatctaacaacatc

SEQ ID NO: 10618 - DNA, 1364 bp, Sorghum bicolor
  Clone ID: SORBI-28MAY03-CLUS2637_1
gcacgaggtggttgttttctaacctttgctcgctgtgtctctctccctttcctctctctccgtccaacgacgccgcgatccagatccagggcatcctgccgccgccgcggactgcgcctatcttccttctgcagcggcggggcatcgccgtcgtcgtcgatcatcccctgggctggatcggggcggagatccagccggaactgcggtgatcccttccttttctcgggtagtgtagtgagcgagccaatggagaggtaattcgccaggtcaggctggtatcaagttcctggttcatggtgcctggatgagcagtggaagagatgctactggccgtggaaggaggagggttcttctcgtcttcagcgtcagggtacagccatggcctcgcgctcttgctgctcgggcggaaagctgaggagaagcccgtcaaggtctcgccgtggaaccagtaccggctagtcgaccgggagaccgagcaggtgtaccagctgccctccgcggccaacgccaaggaccaggcgcctgggaaatgcgctcccttcgtctgctttgggtgcacggcgaatgggctcgaggtggcgtctcctcccaaagcggcctccagcagtgcgcccggtaacggtgcctcacaggaagaagcctcttgttcagcaaacaagacgttgaccactagtggctccatcggtggcagtgagagacgaggctgtcttaagagcaactccaaaagggattctttggagcaccgtatagtggtgagcgagggtgaagaaccgcgcgagtctgtggaagaggtgcagaccttgagatctagcgtggaacggaggaaagttcagtggacagatacatgtggaaaggagctttttgagatacggtcgtttgcgcgtccggacgagggcttgtcagatgatgatgcagaaaacgaaggtttccggaaatgtgagtgtgtgattcagtagatttcatgtctgcacaacaagcctgacagaaacatctcctcatggtaagcctgtgtcctgcttgaaaggatgtgccgcaccggtgacttctttgcaactgaaatgatcgacgacagtcgaaacaaagcaaacagtgacaagtcgatattgtgctagattatttgttggttctatgcttaactagtcagcagggttatagtttcgaagcccacctgtacaatatcaatatctcctttctttcttttctgtcattttgtttttctggctttccattgtgttttcacgcccgctgtaccatataaggctgccctgttacttctgcctgggattttggatccctgacttcattctgttcccttttgttttgcacctgacgtgttgagtgatgaattgttgacatttttgtcc

SEQ ID NO: 10619 - DNA, 639 bp, Sorghum bicolor
  Clone ID: SORBI-28MAY03-CLUS26523_1
cagcatgagattcagtatggaggtgacaatgcatcagcctctccgagatcacaataccctagccaaagcactgcacctacagtgcacatccccaaccacaagcagccagcatccatcaccaagtttatttgctccaggaaaccctgggttgacacagtccaagaattccatggtcttttcgaacgcattatctagccccatccggcggagcctgcaaccttaccacctagagcagggtggggacgcagggtactttgcgaatggcgcaagccgtgacgtgaaccccacggcttcgaatgattcgtccatggacatgcactcggacagcccagctcatgactcctactgagcagctctctccatggaaccggaagaacagcacttaaagtggacgaaagtctgctgtcacagcctcccaaggcctagtaggaatattcaatttaacaccttccgtagcctcttacactaagcgtgtaatgtcttgtgttgttgttactactacttaccacatgttgctttgcctggatactgtaatttgcatgtactgtaccatttgatttatctgtgcatattactgctgttggtatgtgactgagttcaggaaacgaaccattggaaagaattaacaacgtgaacagt

SEQ ID NO: 10620 - DNA, 870 bp, Sorghum bicolor
  Clone ID: SORBI-28MAY03-CLUS26529_1
gcacgaggctttgctttgcttcctccctccctccctctagatctcgccttcacggcgacggcgggtacttggagatcgaagaaaaaatgtcagcccagtttgcatccgagcatgcctgctatgtcaattgcaactattgcaacactatcctggtggtgaatgtgccaaacagttgttcccacaacattgtgactgtcaaatgtgggcattgtacaatggtgctctctatggatctcagtcctttccaccagcaggcacgcactgttccagacaaccaggttgtccagaacagagggtttcaatataacaattttgggagctacgagcaagcctcgtcaagaaatctacgaacgccttccatgtattcagtgtcaaacaatcagccacaagtgccaccaataagacccccagagaagaggcaacgtgtcccatcagcatacaacagatttatcaaggaagaaatacaaaggataaagacgagcaacccagagattagccacagggaagcattcagtgctgcagcgaagaattgggctcatcttcctcggctccatttcggcctcagcgtcgccgacggtggcggcggcagcaactagatgatcgatcgtgtacgtgatcgagacggcgacgatcgtgcgtgcatctggattcgatcatgcacacacagatagatcgatcgagctctttgccttacatatatgctgtgctacgtgcctgtgtttaatttgcattgtaagcttgttaagttttgcatttgataacctgtgttttcagacttgtgcgtactttgcatgtatcctgtgttcagtgtagcatgctagcttcacaaggggattatatgatatgcatggtgtataatatttcttaata

SEQ ID NO: 10621 - DNA, 1149 bp, Sorghum bicolor
  unsure (1)..(1149): unsure at all n locations
  Clone ID: SORBI-28MAY03-CLUS33429_1
gcacgaggcccgccccccgggccccggacccccgccatgggcgcctcctcctccgcccccccctcccccgcccccgccggcgccgccgacgaccgccgcccgtccaaggacgacgacggcaagaggaggcgccgcgccgccggagcctcgccggaagccgccgcggcgccggtccccgtgccgccccggccccgcccccggaggggcgtcgcggcgccctcgcgggccggtcgccggcccgcccccgccccgtccggctcctcctgccccgccacccgccccgcctccggcggccccgccgccggctcgcccaccccctcgcccccgtcgaccccgcctcctccgggcgcggatgtgaaaagagaagtgaagattcttaaagcacttaaaggacatcagaatattgttcacttctacaacgcatttgaggatgattcatacgtgtatattgtgatggagctatgtgagggtggtgaactattggaccggattttggcaaaaaagaatagccgttatagtgagaaagatgctgcagtggtagtccgccaaatgcgcaaggtagccgcgcacgagggaaagatgctgcggtagttgtccgacagatgctcaaggttgcagctgagtgccacctgcatggtttggttcatcgggacatgaaacctgagaacttcctattcaaatcaacaaaggaggactcgccccttaaggctacagattttggtctttcagacttcataaaaccagggcggcaattccgtgacattgtcggaagtgcctactatgtagcaccagaagtactcaaacgcaagtcagggccagaatccgatgtttggagtataggtgttataacctatattttgctgtgtggaagacgacctttctgggacaaaactgaagatgggatatttaaagaggtcttaaaaaacaagccagatttccgccgcaagccttggccaaacattacttcgagtgcaaaagattttgtacaaaaattactagttaaggatccccgtgtgagactaactgctgcacaggcattatcacatgattgggtgagagaaggaggaaaggcatctganatacccttgnatatatcagtattacataatatgcgacagtttgtgaaatacagtcgtttcaagcaatttg

SEQ ID NO: 10622 - DNA, 859 bp, Sorghum bicolor
  Clone ID: SORBI-28MAY03-CLUS27581_1
tggatcagtcacacacggacagttcccacccccaccacaccaaccgctcgccacccgcctcgccgtcctcgttcgcagctgtcctgcactgcaatcggctacatggcggcctccaccctcgcgttcggccaccccaaaaccctaggcgccgccgccgcatccgccggtgcgaaggccctcccgacctcctcgtccgtctccttcccggccacccagcagcccgcgtgccacctctcctcgtccgcgtccgcgtccgcgcacggggcccgccgccgggacgtcgccgccatggtctacgcgccgccggccgtcggcaccgccatgccgtcgctcgacttcgacacctccgtcttcaacaaggagaaggtctccctcgccggccacgaggagtacatcgtgcgcggcgggaggaacctgttcccgctgctcccggaggcgttcaagggggtcaagcagatcggagtcattggatggggctcgcagggacctgcccaagctcagaacctgagagattcactggctgaagcaaagtcagacattgttgtgaagattggtctacggaaaggatccaaatcttttgaggaagcacgtgctgctggattcaccgaagagagtggaaccttgggcgatatttgggaaactgtctccgacagcgatcttgtgttgctgctgatttctgatgctgcacaggctgacaactatgagaagatcttctctcacatgaaaccaaacagtatccttggtttatctcatggatttcttctgggacatttgcaatcacttggacttgatttcccaaagaacatcagtgtgattgctgtatgccccaagggaatgggtccatctgtccgcaggcttt

SEQ ID NO: 10623 - DNA, 599 bp, Sorghum bicolor
  Clone ID: SORBI-28MAY03-CLUS27540_1
gcacgagggttgcttcccaccctttccggcctctccatccccacgccgaccgcaccacccgacccgatcgcacgcacacaaacacaaaccgagcagcagaaacatgcgagacatggaggacagatcggtcgtcagccgccgccatgaacccaccaccgtcgccaggacggcggacgacgacgacgacgacgtggcttccggcgacgaggactccgactcggacgccgagttcgagttccccttcgtgagccgggagtccgaggcggcggccgacgagctcttcgcgggcggccgcatccgggccttctacccggtgttcggccgagtcctggacgacgaggcgccagccccagcgccgcgccccccgcgcggccggccctgccggctcgagcaggcgcggacctcgtccgtcgcgtccacgtcctcctcctcctcctcctcgacggcgggcgcaggcgcggcgggcctcgacggcgcgtccccggacaccggccgccccgggccgccccggccgccgccgcccccgcccgcgcccccccggtcgccgggtccacgggctccatcccgcggtggcgccgcatcggggagctcgtcgtcgg

SEQ ID NO: 10624 - DNA, 1118 bp, Sorghum bicolor
  Clone ID: SORBI-28MAY03-CLUS27784_1
aaaaaaggaagaactcagctcgcaaccacagaccctagacggtcctccgacccagacgacaagcccgattcttccagtatcttttacccaccatgaactcccatggtgctggaaggcggactccgaagaggcggaggactacgactaagtcgcattctcagcttttggacctcaactgcccccctgctgaaggggctggtgagggggctctacctttcaacagcatgcctgtctcgcacatccaggcttcaagcagtatgcctgtgcagcacatccaggcttcgagcagtacgccaccggctactgatgaacctcgcattggcatgcttagttgccccatcgatgtggaagccatcgatgatgatgttgttatctattcttcaagttcactccctcaagcaagacaacagtcgaccaggacagcagttgtgataatagatgatgattctgaaacaaacccagaaccagcaggggatgctcttcatgagcatgtgaacacactgctatctctgggcataaaccgtaggcacgagcctccgagagcaaccaacgcccgccctgtaataagtatagtggacacaccagaagtcaacaccttcaaggcaccccctgaacctgtgaaggaggtcccgaaggaaccaaagttcagctgcccaatctgcatgaatgagctaactgaagcagcgtccaccgtctgcggccacattttctgccagaagtgcatcaaggctgccattcaggcccagaagaagtgccccacctgccggaggaggcttactccaagccagcagcaccgggtgtacctcccattgactgagtagcccagtgcagtcgttttgctacaagttctgcagcgcctcacctttttcatcccatcgtgggcttgtggcgggtgtattttggaggtatttaggggcttatcattagcatagagtattacagggaattaacaagtggttttgccctcggcattcaaggctggatcatcagtaaagtatatcctagcatcaacatcatcagaatgttggtgtttgtttgttaactatggtcggtgcggtgtcttaaccttctgtgtgggatgtgagttgtgatgcaatgcaatgtgaaccatgaagggt

SEQ ID NO: 10625 - DNA, 1192 bp, Sorghum bicolor
  Clone ID: SORBI-28MAY03-CLUS27831_1
gcacgaggagttggttgggtgggtggttcctacctcagaagaagagttattttgcattgaagcttcccaatggatggtgggtttttggtcttgaccaagctcttcatggagacattgatgtctaccagttcaagttttttgctgagttgtgtcaacagaaggtaatttcattctctgatcttcatggtattagcagttgtatcaagtttctttttgttttgttttgttttgttcaatagtagcacaactctataagcttgatcagtactgaagatcttgttgtcataagcagaaaacattgaagattataggatgtgtttttcagtgacttcatattccaccggtatgcaggttggagaaactgattccataattattataactcatgaaccaaactggctccttgattggtactggggtgatagcactggcacaaatgttgcatatttgatacgggagtacctcaggggaagatgcaaactgcggatggctggggacctgcaccattatatgcgacattcttgcattgagtcaaaagaaccagttcatgtacagcacttacttgtaaatggctgtggtggggcctttttgcatccaacacatgtctttgagtccttcacggctgtgtttgcctgcacgtctgggacaaaatccacatatccttcttacactgactctagcaaggtaaggttgagccgtacatttttatgttattctagttcattgcatggctgcgtttgattggtcatgatgtttgagtggtttgtattatcatgtgacttctcttctttgtttcattctctagattgcacttggtaatattttgaagttccgaaggaaaaattggcaatttgatgtaattggtggttttgtgtacttcgtcttggttttctcaatgtttccacaggtgagggaaactagatgagttgagacagttgactttttttatgaactctatggtagaaaacaacccttaggttaaagtataagcttaaaaattatttgtttttacattcactaatgcgccaggaggttctggcaggtgatgctctggctgtgtaatgtggtccctttcttcctggtgaattgctttttgggctttacaagccttgtactttgtatagttgtacagctaccctttgttattatttttgttcatattaatgaaaaagaaaaaaagaacaggtaggga

SEQ ID NO: 10626 - DNA, 735 bp, Sorghum bicolor
  Clone ID: SORBI-28MAY03-CLUS28021_1
gcacgaggcttcttcgagaagttggtgaagatttcaacgctatcattaagtttggcaggtggcagtgattcaggagcatctgtttcttctgctatcgttgggtggtatttgcaaagagatggtatgaagcatgctaggaagatgtacaagagatttcttgctttacctcggccaagcctcaagttcatgcagtactgcatagagctggaggcgaaccttgcatcactcggagaccatggcgcccttacaaatgctcggcggctatatgattcagcgctcgacctgtatccccaggaaagggaagtgtggaggaactactacaacctggagctgaagatgggaacatcagagtctgccaacgccgtgtactcgcgtgctcgcaaggtgctcggtgactccactgccctgacagctccccggagctagctagctaccagcagcaatgtatttcgatatgtattgcagtttctgtttggattatttttttagttctctgtgtgagcatgtttagtttgggtcagcaagtaattaagctgaccatcaaaattttggccctaaatcattgggtggtaacttgtgacttacaatatgctgaggtgcttgcgctaagcatattttgttttataaaaaaaaaggtaatgcagctgctcgtcggtgtctccctgtccttttcttcttttttgagcagtagctggactgttggtgttagactgttatggagtgatagtgtcaatt

SEQ ID NO: 10627 - DNA, 688 bp, Sorghum bicolor
  Clone ID: SORBI-28MAY03-CLUS39698_1
gcaccccgcccgccctgccgtctcttgcccccccaccatcgccgtcgacggggccccacgcccccccggaccgcagccggcgcgacccccattcgaagccggggccagcgaagcgagcgcctcgcttccacaacttgctagctgcagctgcagcgccgccggcccgaccaacgcccgagccagccgtgggcgtacggccgccgattcctctgggagtctgtgctctggtggatgccacgtacgaccgcgccagacgtgggcacacgaccgccgaatccttgtgcacttcatcctgcggttgacgcctcgccggttcattcccatctcaaaacctatactcttctccctactttttcctttcatcctctctactccttccgctactgctaagatcttgcccgagaatggccctttctcatgccttgctccatccacgggggctggggggctgcttgtggtcggccacaccccaggccttgtccacgtcacggtgaatgtggcgcctgggtggggcgtggacacccaaagcattatcaacatgactatgaatatgacgtctgggtggtgcattgtgaaagaagaactcacatttcctgctggaggtgcccctttcagaagttgccatgcttcaactattgtacaggttgaggaacacaatttttggtagcatattttggtggatccagcg

SEQ ID NO: 10628 - DNA, 794 bp, Sorghum bicolor
  unsure (1)..(794): unsure at all n locations
  Clone ID: SORBI-28MAY03-CLUS39880_1
tggaggccttcaagacctgccataccagctccaaaaaaggtcttgatgaatcagcaagagaggcactttccaacatggaagctttgagggcagcccctgttgatgaaggtgagacagcagtttctagtgtgcaggttgtgtcccaggccctccccaagaacagctcgaacagtttcctcaagaatattggcatcaaaccaacgacatcgtctaagtctgcagcattgaatgaaagcgaccttcgggagcaactagcagctgaagctagagctgttgtacagggtgaactcgatgctctcaagaagaaaagtgaagaagctgatgaaaagctcgagaggcaacaaaaggagatggaggagatgaggaagcagacagagataaaccagaaggaattgcaggagaccaatgtgctgctcaggcgtctgttgtccctcaacaacgcttcgacatgaaccgttgctgatgttgtgtgctaccaaggagtatgtgttgctgctgctggtgcttggcaaggggtcaaagttgttggctgattttgcttaggctaaaacctatgatgttgatgcttggcatctttatattattagttgtgttgttgatgtgaactgagatcaaagtagaacctggaatgtgatgtcaatggtaatacatgaattgagtttagtagtgttgagtcagttttatgatgactggaatgctggatctgttgaaccatttggtcattttaatattatttgcattttgtaaaaatattagcatttgcacctatgatgaaaattctgggttatngacgt

SEQ ID NO: 10629 - DNA, 618 bp, Sorghum bicolor
  Clone ID: SORBI-28MAY03-CLUS3970_1
tcgtccaccggagcggcggtatcaggagagctcaggagctcgctgaggagaaaggcgcgctggcgattcagagcctgcagtgccttccgaggagcgagttcagaagcgccctcgagagggtggtgcactacaatctccagcggattcagtaggtatacttaccggcggctccacgcggtttctctctagttctctgaaagatcctgggggctccatgtggatgtagagcaactcctgccggaatcccgatatttggctccggggagatgattggcgcagcagcatcacatgcgagtgtgtaaccgacactgccgcgtacccaccaacctcgtgggaactggagcattttgcttctgcagctggtgtcatgtatattgtatctgcaaggggaataggaaaacaaaaaagagagaggcaggtagcatatattgtatagttggttctccatttctttgggcactagcataaagcttggtgtgcagtagttctaatgttgtattgctgttgtaagctgtaactacaaacagagaaactgttctggacgaccacgacgttgacatgacttatttatgtatagatatgcaatcctccctgatcatggaatatactgctgagata

SEQ ID NO: 10630 - DNA, 564 bp, Sorghum bicolor
  unsure (1)..(564): unsure at all n locations
  Clone ID: LIB3481-032-P1-K1-D6
cgtccgccgacgcgtgcgcccacgcgtccgcccacgcgtccgcggacgcgtgggtccgaggagcgagttcagaagcgccctcgagagggtggtgcactacggtctcgagcggattcagtaggtatacttaccggcggctccacgcggtttctttagttctctgaaagatcctgggggctccatgtggatgtagagcaactcctgccggaatcccgatatttggctccggngagatgattggcgcagcagcatcacatgcgagtgtgtaaccgacactgccgcgtacccaccaacctcgtgggaactggagcattttgcttctgcagctggtgtcatgtatattgtatctgcaaggggaataggaaaacaaaaaagagagaggcaggtagcatatattgtatagttggttctccatttctttgggcactagcataaagcttggtgtgcagtagttctaatgttgtattgctgttgtaagctgtaactacaaacagagaaactgttctggacgaccacgacgttgacatgacttatntatgtatagatatgcaatacttnctgatc

SEQ ID NO: 10631 - DNA, 809 bp, Sorghum bicolor
  Clone ID: SORBI-28MAY03-CLUS39889_1
tcctatatcagtgaagttcggtggatagatgatggcttccgtggattgcttccatttcccttcaatgagaccctgggtggaacaactgcagctccgtcatacttcaataacaagaacaaggctgctgaagggcaatatcttaaagacatcggagcatgtaccttactggtggaacttgatctaagacggccttatccctcacgcgggagtgacttgtcaaagtgggaggcactggccgcactacagttcctggatagagagctttcccctgcactataccggtccttcttcataccataccgatggcaacaaaacaacgtgttcggcctgtacaagctactgaggaggttgcatcctgaccatgcgtgatcaagaggcgtgtggggtttgcttcaatgagcttaatcacgtgatttattttaccaaacagctcattaaatttgactgatataggttttctgatccgaatgggttttcctagtgggtaatggtgaacccgattttctcccactgatcgtcccaccatacaatacagaaccagattacgagctgtataactgaattagccccttgacgaggacgagagttgtgaactgctgatgtagtgatgttcgaggagaatcatgtttgcgggcgctggtcagttgtgttctgaaactgctgtttttgccagttgtaacttgtttggattgtttgttaaatcaaggcccatgacagactgatggattagcgattaattcatggaaccaacatcattgagatttatacttttttattatattgattgattgattgatttttttttttct

SEQ ID NO: 10632 - DNA, 1121 bp, Sorghum bicolor
  Clone ID: SORBI-28MAY03-CLUS39997_1
acatttggctatcatgcacctgagtatgcaatgactggacaacttagctctaagagtgacgtctacagttttggagttgttcttctggagctcctgactggaagaaagcctgtggatcatacattaccaagaggacagcaaagccttgtgacatgggcaactccacggcttagtgaagataaagttaggcaatgtgttgattcaagacttggaggagaatatcctcctaaatctgttgcaaagtttgcagctgttgctgcactctgtgtgcaatatgaagctgactttcgaccaaacatgagcatcgtggtgaaggcgctccagcccctgctgaatgcacgtgcatccaacaaccctggatgaatgaatgactgccgttgcttttacctgacgagagtatcagaatcagacaaatcatgcagcattgaattaagataaatatggtgtttggcttatacacttgaccctggatgttcatcaggagataatctcttgcagtttctggatgttacctactagtgtctgtatcctgagtgccatagactataaactgtgacctattgttcggttgcattccatctggtgtcggttagatccatgaggtcaagcagcatccagtttgaggatccagtaaaattcctcattgtagcctccgattcaaaatgattcgttacagttaatacatggtctggctttctgtttcccccacacgaagacgagggtattagagcctgcttgtttgaaggcgagtaggctaaaatgtaaggcacacaaatattagggcaagccaatattttgatagagcaatcgaatcaaggtccttggttcgctaccaacaagataaagatggtgccttgccaatattttggaaggcattgccaaaaatttagtaaaaatttgcttacagccattaatgcatattttacattgccatcctgtgatgagtatcaccataattttacatcacacattttcccatttcaaatggcaaaggctatagtgtggcttggacatggtacagtcacactgatatgtcatgggcgtgatgccaacaaatttggtttggatcgtaaagcaaaatttggtgatcaattacatagataatggcatatctttcttcg

SEQ ID NO: 10633 - DNA, 839 bp, Sorghum bicolor
  Clone ID: SORBI-28MAY03-CLUS4006_1
cgtgaccgacaacatcagcagcagcagaagttgcaaggagatcgacgctcttgagttcttgaattgttgttgatcgatggcgctgaggagaatcatcaaggagctcaaggacctgcagagggatccacccacgtcctgcagcgcagggcctgtgtctgacgacatgttccactggcaagcgaccatcataggccccagtgacagcccctactcagggggcgtcttcctggtcaccatccatttccctccggactaccccttcaaacctcccaaggtggcgttcaagacgaaggtgttccacccgaacatcaacagcaacggcaacatctgcctggacatcctcaaggagcagtggagcccggcgctgacggtctccaaggtgctgctctccgtctgctcgctgctcaccgacccaaacccggacgatccgctcgtcccggagatcgcacacatgtgcaagaccgaccgactcaggtacgagtccaccgccaggggatggacgcacaagtacgccatgggatgataatgcatgcagtgaggctgcctggggagcaaacatcgttgtatccaaatccaaatgttctttttaataacgtaatctaacagtaacagcaggtggaggagctctgcatttcgttctcaaaattaagaagaggaggagagaggttctatgtatgtacaagaactgtgtccgaatcgatgtaccatcacaatctcatataaaaaatgcaagtgaacaataagattttgttttggttttgatggccctttgtgtctgaatccaagtgttgcattggcaaggagtaggaggtcattgttttggattgaacctatatgtt

SEQ ID NO: 10634 - DNA, 688 bp, Sorghum bicolor
  Clone ID: SORBI-28MAY03-CLUS28658_1
gcacgaggaggagatgtcggtttcgcactttcgcccagctcaccaccccctccggcgcacgaggccagctcgccgccagcccctgccgcccctgcccccctccccccgccccgcgcgcagcccggtcgagccagccgattttccccatggcggctgcagtcgcggcggtcgcggctgcgacgacggcggaagacgaggcgcgcctgctgcgcctggaggagcaggcggagcacggcggcggcggcgcctgggagtacctctgcctcgcccgccggctccgcgcccgccgccccgcccacgtcctccgcgtcggcctcgccctcctcaacaacgcctccgcgcgctccggcctcgccgcagaacagtggacgctctacgagcaggtggccatggcggccatggattgccagcgtctcgatgtggcaaaggactgtattggagtcctttcaaagcaatttcctggcagcacacgggttgcccggctagaagctcttctatttgaagcgaaaggtgaatggactgaagctgaaagagcctacgcgctaatcctggaaaacaatccatttgaccagattgtccacaagaggaaaattgctattgcaaaagcacaaggtgatatgtcgatagtggttgattatctcaataagtatctgggattatttatggcagatcatgatgcctggagaga

SEQ ID NO: 10635 - DNA, 509 bp, Sorghum bicolor
  Clone ID: SORBI-28MAY03-CLUS28836_1
gcacgaggattatattgctcatctcatcaactagctagtctgaaggcccgccggtccgtccatagcggccgccggagctgaggatccgagcggaggggttccagttccagttgcagttgcagttgcagcgagcagatcagatgggttccttcgtgcaaggagatgaggtggaggtcccggtgtacgagtcgggcgccgaggtgctgcagaaggcgcaagagaaatggagcgtggctccgccgccgtacccggccatgtactcgagcgtgttgggcggcatcatccttgaccctgccatgatggtggtccccatcgacgaccacatggtgcaccggggccacggcgtcttcgacacggccatgatccttgacggcgcgctgtacgagctggacgcgcacctggaccgcttcctccggtccgccgccgcggcgcgcgtcgtggccacgcccccgttccctcgccacgccctgcggagcatcctcatccagatgacggccgcgtcgggctgc

SEQ ID NO: 10636 - DNA, 691 bp, Sorghum bicolor
  Clone ID: SORBI-28MAY03-CLUS28850_1
tgcttggagcaacacattactcaactggggttgatatgtggtctgttggatgcatctttgctgaaatggcccgacggcaggctctctttcccggtgactctgagttgcaacagttgcttcacatcttcaggttgctgggaacaccttctgaggagcagtggcctggagtgagtgaattgagggattggcatgaatttccacagtggaagcctcagagtttggcacgtgtcgtcccaacactggaacctgaaggcgttgacctgctatcgaaaatgcttcagcttgatccttcaaacaggatatcagctatagctgcgatggagcatccatactttgacagccttgacaagtcccagttctagccattgtaccatgtgattcagaagtgaaggcgctactctcttattagtgagatttcaaatggaggtatgaatttcacttgccatctaggcaactggttcatactttttaccgatctattagtgagcgaaagttggcatgcctatgttttcatgtgagggtcatatgtgtttcacctttcctgttatagtgagtattgttgtctgttgccttaaaaacttcttgtgacgtgtaacaagagttacttgtgggaggccctgtgataatgctctttatttctcaacatccattttcttcagtatggttgtgaaataggaaatctgatttcctg

SEQ ID NO: 10637 - DNA, 762 bp, Sorghum bicolor
  Clone ID: SORBI-28MAY03-CLUS28927_1
gcacgaggcagactcaacgcaatctccagcaacagcttttgatatggggaatggctttgtcaacgctaccgctgctttagacccaggtctcgtatttgattgcagttatgatgatttcttctcctttctttgcggcataaatggctctagcccagtcgtgacaaactacactggcaacagctgcgtggcctccaccatgacaggagcagatctaaacctaccatcaatcaccatagctgtgctcaaccagacaagagccataacgagaacggtgaccaacgtggctgcggccgacgagagctacactgtcagttatagcgctccctatggaactgcagtctcagtggtgccgacacaatttttgattccaagcgggcagaagcagcttgtgaccttcgtcgtgaacgctaccatgaacagctccagcgcaagcttcgggaacgttggtttctatggtgacaaaggccacagggcgatcatcccattctcggtgatctccaaggttgtatacagtccctgatgactgattagccgagctgatgcagtggatgcaatgcaaaccagggcctgactgatccagcatatgcagtgatgacttgactgcatggagggtggagcttacctttgactagagaatttttttgttggttgtggtgtgtacactctggagcatgttgatgtaagtagctgagtgattaaccagtaactgtaaaaagaatgtactaccagaatgttgccatgaatgggaaatccttttgcccc

SEQ ID NO: 10638 - DNA, 719 bp, Sorghum bicolor
  Clone ID: SORBI-28MAY03-CLUS27259_1
ccaaggatatggcgctagcggcggtgtccatgaggcctatccctctagccccaatcatggagaagctctccctcaccccagagaactacggcaccgtccgccgctacttcatccagacgctcgatgaccacatgctgtcgccagatgcccaggagaagctggtccgcgagaaccctcctgacggcatcttcaagatcaagggcggcgaccactgtcccttcttctcgaagccgcagtccctcaacaagatcctgctggagatcgcacagatccaatcctccgtggggctgctcccaggcaaggcgagcgcggaggagaccaccgctgccacagcagcagcggcagctaagtcatgactgcatgtatgtagtgtacatgaaaagaaaaatgagtagcacataggaggatgcaaaagggagggaggaaggtctggggattaactgaaagcagctgtgtcggataataatgtagggaggtcaaagtgtttgtttttttttccttctgccatcagatcagatcatatagagaatgagaggtggtaatcagatagttgcatttctttttttaccctgtgaatgaatgaatgagatatgaagttgaagtctgtctgtgatgtgtgccctgcttgaacagtgagcaatgtcaatgcagatagcacttgtggtgatgcttaattccccaacaattattgttaatttgatggtaatcctctcgttcgt

SEQ ID NO: 10639 - DNA, 967 bp, Sorghum bicolor
  Clone ID: SORBI-28MAY03-CLUS27374_1
gcacgaggcccccccgccgcccgatccccccgccgacccccgctcccccaagcaaacccctcacgccgcgtccgatcgacgacgacgacggtgcgccatgtcgatgctggacgccttcttcagcaagggcggcggcggtggtggcttccgcggcgccaagtgcaagacgctgctgaagctgtcgatcccgcggataaagctgctgcggaaccggcgggagctgcagctgcgccagatgcgccgggacatcgccaagctcctcgaggccggccaggaggccaccgcccggatcagggtggagcacatcatccgggaggagaacatgatggccgcgcaggagatcctcgagctcttctgcgagctcatcgccgtgcgcctgcccatcatcgaggcccagaaggagggtcctattgatctgaaagaagcaatatcaagtatctgttttgctgctccaagatgtgcagatctacctgaactgatgcaagttcaaatgatgtttgctactaaatatgggaaggaatttgttgctgcagcttcagagttgatgcctgattgtggggtcaatcgtcagataattgaactactttctattcgtcctcctcctgttgatgccaagttgaaactgctgaaggagatagcagaggaacatgaagttgattgggatccatcagagacagagacggaatttctcaaacctcatgaagatctattgaatggaccgacctacttcaatggctccacactacctcttcccaaggagaaacatgaggaaacagtagccgcaagtgctgccgagcagcctgatgaagattacgaatcagataccggtcttgactcactggatttgcctgaagtcccaaaagctgcaattcgcccaccttctgatgcaccagtgaccccagatattggtccacatgttcagggctcccagtcactccctcatgagttctcagagcctactgacttg

SEQ ID NO: 10640 - DNA, 1219 bp, Sorghum bicolor
  Clone ID: SORBI-28MAY03-CLUS27527_1
gcacgaggtcacgggcgcccgcgtcggggcagcaaggcaggtgcaagagctcaatgctacccgaggcaacctggtggcgctgcagcagaagctcactgtcatcctctatgtcagccaggcgcttactgcactcaagttgcttgttgcagcagcagattgtgctggtgccctcgatgtcattgatgacttgcaaaatttgctagacactgatgaacttgctgggctttattgctttcggcatatccgagatcagctgggaacatcactagattcagtgaacagcattctttcagcagaatttgtgcatgctgctgttcctgatggaaaagctgtagatgctatgattttatcaactgtgaaaagaaaggcttccagtccattgaatgggacagaccatgagggtaacgtagacgaggaggaaagttttattctcagggatcgactcctccccctcattatttgcctactgagaacggacaaacttcctgcagttcttagaatttaccgggatacacttataactgttatgaaagcttcaatcaaagccacagtagcagaattactcccagttttaaccgccagaccaatagattctgattcagtaactggagacagagctaccgatgctgacgctggaggccagtccttagcaaataagttgcggagtctttcatctgaaggatttgttcaacttttatccgccatttttaggatagtacaggtacatttacagcaagcagctgaagtgaaaagaatagttgagtggatcatgggaaaccttgatgggactttaagtggtgattctagtaattctacattacgacatggcggttcagttatttctgatacccaagagaatgactcttcacggggctctaatactattacacggagtacttccaagatcccatttgtccaaggaaaaacaaatgatttttccattataaattcaataaagaatgttcgggccgatgtcttgagagaaaacactgaagcagttttcgcggcttgtgatgctgcccatggacgatgggctaagctattaggtgttcgtgctgctttacatcccaggttaaggcttcaagaattcttgatcatctacaacataacagaagaatttatagctgctacagaaaagattggaggcaggttgggttacaacattcgtggaatcctacagcaacaatcaaagcaatttgttgattatcagcataatgtt

SEQ ID NO: 10641 - DNA, 820 bp, Sorghum bicolor
  Clone ID: SORBI-28MAY03-CLUS27506_1
gcacgtcgctctctctctctctctctgtgggttgcttcatcacacaaacacacatctcgtttgcaattcaacaagcccttcactaaggtccgcagataatatatgtgaaatgccacaagtggaggggagagggactctcttggaggttcctgcggctgccctagcccctgtctttcgcgctgggcgctccttcatcacacaaacacacatctcgtttgcaattcaacaagcccttcactaagttctcaggtattctgctgttgatgaactgcctccacacctgcagtgacaagaaaacgctgaagaagtggtttttcatcgacaagacagtaggctaaatttcagttcagagaacaaaacaacactccaccacacagctcttctcttcattgtcccgatggatatgagcagcagctcacctgttatcaccgatccaatatcaataagcccaccactgttgggaggcttgacatcaaatctgatgccgttttcagtcatgtctggaggttgctccagtcctagtatgaccgccagtaggcgtaaaattgaggaggtccttgttaatggcctgctagatgcaatgaaatcctcgtcaccgcgcaagaagcacaatctcgcctttggacaggataattcactcgacgaagatcctgcttacagtgcatggctgtcaaaatgcccttctgcgttgacctccttcaagcagatagtagccaatgcacaaggcaggcggattgctgtgttcttggattacgacggtaccctgtcaccaatcgttgatgatccccgacaagcattcatgtcccctgtgatgagagct

SEQ ID NO: 10642 - DNA, 1237 bp, Sorghum bicolor
  Clone ID: SORBI-28MAY03-CLUS27532_1
gcacgaggccggagcgaggagcccactgcgggggagagaaaatgaattgaaacgaacagcgcgacccgcgacgcgagggaactcccaccggtctcggcgcctccgcggcggacagcctctccgatctcgagcgcggtccgctccggctcctccctgcgtcagctcgcgaggcccttggagcttcgagtcagatccgggcgggcgcggcccagggtggctccggtgccgttgagccgcgtgatgtagggttttcgcgcgccgcagagtgggactgggactgggagcgatggggcgccggaagatgtccgcggcggcaccgccgtctcggagctggtccaacgtcggcggaagcgtaatccccgaacttcgagcgaaacacaaaatggacttggagaatttgacgctgacaaaacagccactcagaacattgcattttttcctgttagccatgttacgatacttgaaaagattagcaacgtatatcctgagtaagggtggtttcttctttctcctaattgttctgttggtagcttctggaatcttactcgccgtttcggatggccagaataagaagcatgtccaggagttccttaattatgctaaatttgtgttgtggtgggcttcattaggtgtggcctcgtcaattggactaggttctggtttgcatacgtttgtgctctatctgggtcctcatattgctctgttcactattaaagctgttcagtgtggtcgaattgatttgaaaatggctccatatgataccatacagcttaaggttgggccgtcatggcttgacaagaaatgttcagaatttggaccgcctgtgtatccagcatcagctcattctgttaggatcccagtcttcgacttactacctcagatacagctggaagcagttctttggggcatcgggactgcgcttggcgagctccccccttattttatatcacgagcagctcgcttgtcaggaagcaaatcaaaagctgttaaggagcttgatgtcgctacttccaaacaagatgggacagtagcctccactcttaatcgtaccaagcgttggcttctttctcactctcaacatctcaacttcttctctatcttgatacttgcttcggttccgaacccactctttgaccttgctggtattatgtgtggccaatttggtgtacctttctgggagttcttttttgcaactttgattgggaaggccatcatcaagactcatattcagacactg

SEQ ID NO: 10643 - DNA, 1069 bp, Sorghum bicolor
  Clone ID: SORBI-28MAY03-CLUS29262_1
cggcacgagggccacctattcctttctctttcctttgaatccaagggactagccttcggctccgctcctgcatcttccagccggccccctcccttctgcctccggcgagcttgccggagagcgcagggagaggggcctcacctcagtagttagtagatcgtacttagttgtagtaggtatagtagagtgtctttatgggtgtgtccctttgtggtaatcgctgcccggagttagtcgtcgccgtcttcgtcgttgtcactgaggttttcctcggcatcttcattgccgttgtcgtcacttccgaggttagtaagaataaaataaattcgtctcctacttctcttgtgcttcttcctgggttgctccatggtggagagggcgacatggtgttgttcccttccatggcggagagccaaggcaagagcacagtcagcaacaacgccgtggtcacctgcggcaacaacgtcaaaatcaatgccagttcgaggagtgatgatgtcaggcggcgtttgtgtgacgagcgtcctactcgtttggatgctgccgctgtttgcacagcgcaggcggtgctgtgcgggcaagctgctacaggctgtagcggcagctctcaatcctcgggccgctcaacgacttcgcgaggtcgtctgcatcgagcttattaggaggcgcgatgccttcttcgtcttcatcccagttcaagtggaagacgaaggaaggatgatgcaagggcggatttcctgacgacggcggatggttctccacgcaagagctgttccttcgcctggaaggactggtgttcatgtgcttcactgtggggcctgcaacatgtgctgtggggcccgcaatcattttctgctttgcatcgtggccggcatgcacaaatctctagcgtcctcctctacctcatggccacacgcgtccacttgcccagggtcgtgtccactctcccgtccatctattttggatggcatgtttgtgttatgcttatgcacatacacggtcattagtccttattttgacagaggcctccgggttctttgtctcctttcttgttgtcgttttgtgcatg

SEQ ID NO: 10644 - DNA, 839 bp, Sorghum bicolor
  Clone ID: SORBI-28MAY03-CLUS29358_1
acggttcagtgaagcggctaggaaattggcagtttgtcagcgcaatctgcaaatggcggaggcggaggcgacggcggggcgactgaggctgtactcgtactggcgcagctcgtgctcccaccgcgcccgcatcgctctcaatctcaaaggtgtggagtacgagtacaaggcggtgaaccttctcaagggcgagcagtctgatccagaatttgtcaagcttaatcctatgaagttcgtccctgcgttggttgatggcgattctgtaatcggtgactcttacgcgatagcattgtatttggaggacaagtaccctgagcctcctcttctacctcacgaccttcaaaagaaggctttgaatcaccagattgcaagcattgtagcttctggtattcaacctctccataacctcacagtgttgaggttcattgaccaaaaggttggtgcaggggagagtgtcttgtggactcaacaacaaatcgagagaggtttcacagctattgagagcctaatacaactaaaaggctgtgctgggaagtatgcgacaggagatgaagtccaactggcagatgtattccttgcaccccagatctatgcagccattgaacgcactaaaattgacatgtcaaattaccccattcttgctaggcttcactcggagtacatggcacaccctgcatttgaagcagcgctccctcgcaggcaaccagacgccccttcctcttcctaggaactgcacgctgtttgctccggcgtcctagtgtagtattactgtaatgttcctctgaatatacagatttggagttgttccgagttacttctatctataagaataagtacag

SEQ ID NO: 10645 - DNA, 1311 bp, Sorghum bicolor
  Clone ID: SORBI-28MAY03-CLUS29383_1
gagagagagagagaggggcaaatcgaatcgaatccagccggggagaagcgtggaggagggcggcggaatcggcgccggcggcaggcatggaggacctgagcgtggaggagctcgcctccaacctctccacctacaaagagcagctccgcgaggttaagaagctcatcaaggagaaaaaggatgaccctggaatttctgaatatattgatatggagaaagagcttcaagaggtcataacattaaccgaagagattttggcaactgcaaagcaaactgagagtgcccagaatgctgcaggtctatcaccaccaaattattcagctggagcacagtctgagggactggatgacctgtcacattcccataagtttgccgtcggtactagagttcaagctgtgtggagtgaagatggggaatggtataatgcaacagttgaagctttgacaccaaatggatattatgtagcctacgatggctggggaaacagggaagaggtggacccagataatgtgaggctgcctgaggaagaagcagctgatgccttgagacaagctgaaaaggaagctgaagctacaaaaatggcaataaagagaaaaatcgaacaggcagcaacatctgattttcaggcgcgtagcttgcctgccaaacttcgtatcgaaccaagtgatcctgaggatgttaaagctgcaaagcgtaagaaaatacatgccttcaaatcaaaagcccgctttgagcaacttgaatttgcacaaaacaagcggcagaatgcatggcagcagtttcaaaccaaagggaaatccaaaaaggtgggtttcttctctggtcgcaagaaggagagcatcttcaagtcaccggatgaccacagaggtaaggtgggtgtcactgggagtggcaaaggtctgactgacttccagaggagggagaagcatctacaccttaaaggtggctctggggatgcagcggatgacgaggaataaacccaaccggcatgtgactgttagcttgtgagtgtatcaccaaacagacatttctatggctgtttagtgccgacctggtctccaggggagcctgttgtactcttgacctgtggaaactagaaatatcaatgtttgtgccattctatatatagagatgctgttgccttcgggcgcccccctccgctcattgttgaatgttgctgttgttttaaagctgccttttggtggcatttggttttggttttttaactatcgagggacaagtggtcaacccgtcgatataaaagtagtatgtatggtgtaatgtttgttcaatattcctggagctctgctc

SEQ ID NO: 10646 - DNA, 1306 bp, Sorghum bicolor
  Clone ID: SORBI-28MAY03-CLUS29417_1
actaccctactccgatctcgagggcgcgacgccaccgtcctctcccctggcgtcgtgcctcgtcccaactcccaactgccgagggggggtggaggggcaattccggtgtgcgcgcgcgtgcgtgcgtgcggaagtgaacccccggtcgattagtacagcaggtgggtgggagatcgaggtcgcgcccttgccccacacgccactaaacgccgcgccgacgggctcatcaggcgatttggacgggctcgcctcggccgctctgcgcttgtgcggtgggtgggttgcgggtgcgggaagcctcgccaaacctagcggtgccgactgccgagctgggtgggggcgcgaggagtcgacgggaagacaaggaatcatgagtgaaacagggcacactgtacaagtcactaacctctcgagcagagtatctgaaagtgatcttcatgagttcttttcgttctctggtcctattgagcacatagaacttatcagatcagaagattatggtgccactgcttatgtgacattcaaggaacgctttgccttggaaactgcagtattgctcagtggggctactattgtggatcagccagtatgcataacttattggggacaacctgaggagacttttaatttctgggacaggccaacttgggagaccgaagaggaaatcgaatacaggaactaccagacatgccagtacaacactactccgcaggaagcttttacagtggctcaagatatcatgaagacgatgctagcaaagggatacgtgctcagcaaggatgctttggctaaggctagagcctttgatgagtcccatggattaacagctgcagctgcagccagggctgcagagctgagcaagagaatcggtttaactgacagggtcaatgctggtgttggtgcaatgcgatcagtcgatgagacatatcgtgtaagggagacaaccaagacggttgctactgccactggaagaactgcagctaaggtggtaaatggcatcgtcaccagcagctacttctctgcaggagccatgatgctgtctgatgctcttactagggctgccaaggccgcggcagatctggctgctcatggtaggcagagttgaatgaaaagtgaacatacaatccatccttcagttactaaacaggaggaagaacaccttaatacgatatacttcaagtgatgttcgatgtatatttataacagacaacagtgttgtaaattaaaaggagacgaacactgcgtttggaacaaattgtttgctctgataagtttgatgcaaatggagtcaagtgatcggccaaaa

SEQ ID NO: 10647 - DNA, 1062 bp, Sorghum bicolor
  Clone ID: SORBI-28MAY03-CLUS29470_1
caacgctctcccatcctccactcgcctgcacgaggctccactctctccctctgtccgccatggacaggcagcctccatgggcgccggtgctgctgcactgcagcttcctgcagcggccaagccgtgcacgtgggagtacgtgtgcacaggcctattcccgtcgtggccacgcctttccttgcagcaaccgtcggccggccggactcctccttctccgtccggttccgtctctgctttggtaaagaggatgaagaaaggacctcgggttcgaataagaaacaacccagggttccagatgcgaagccaagactcatatgaatagtgtttgtgggctgttaagtgattcatggaaagttcagggtccccggtgaaagatctgttttccttttcttttgtttttgcagatttcatgggtgaactttggaaatgcatagaaattcgtagatacgtcgtaaaatagcaaatgtggactttttggaatccttgtgaaattctctatgcagtagatctataatatggcatggtttagtttgcagttttagcggtaaaaattgatttatgcagttcggttttaattgcttgctataattgtctttttcataaccactgtattattgctaaaataaatgtgaaaatattgtgacaagcttttcatattatatttgatgtctggaaaaagtttggtgaatttaggcttgatagattaagagttataaaaataacaaatgctctgtgttgctttgctcctattctgagtggatctgcatgtttatatcggtgtcccatttcaggttgtgatgtatcatagctactgcaagatttggatgactcctgctttagggaaggagtaagatcatgggcatgatccttcctacttacctcatctatgatgcttttgttggaatggaccatggtactggcatgtatttgaaataaaagtgatattggtttcaaattactttgcttccgctatttgtaaacctgagttgtaataaccttatcgaactccgatgtatttgaactacttgcgacaatgtatgtaacgtgtgacttgttatgttt

SEQ ID NO: 10648 - DNA, 742 bp, Sorghum bicolor
  Clone ID: SORBI-28MAY03-CLUS28196_1
gtgcctggggtgggctttcgatgagtgatgcctctccctgctccatctccaaatggcggtgtgcagggcccctagggtgtgtgcctgcccgctcgcgctcctctgccgtgcttgcgctgcgcccggcccctggggggtgctcctgcccgttcaagcaccactgtcaaacttgagctgcttccattaacagatggaatcatcacacttgatactttgcaaataacggctagggagaaaggccttgcttacataccggagcactccttggagatccatgccacctctggcatgtcatcaggaaggtcataggataggagaacatcaagaggctatactcttctgtatattgggggtctgggactcgttcctgtccaagggagacaaccaggccgaatcgtgttttgctcatttgtattggatggacataggcgctcaccttggagcgaaactaccccaagatataaccgaaggatggttgctgcctacatggagaaacgagcaaacgagcacagtagccttccatgtatcataattgtgtttcaaatccattcatttcatagtgaggccgccgagatactggtgtctgtcttcacattattgttgttggggcgttcattttgtcatgttgctgagttgtaccatatgcgggctctgactctgatcataatatactggagaattagaaacatgtgtatccattgctcatctaaataatattatgattagttgctcatgattttgg

SEQ ID NO: 10649 - DNA, 1303 bp, Sorghum bicolor
  Clone ID: SORBI-28MAY03-CLUS28246_1
catgatgtttatacaatgcatgatcagtcagtgacacactggtcctcactggagcagacgagcactgagctagcccgtgctgatgattgcatcgtcccgaaacagagggggcatggttcacagtcagtggcaatggtccaggtcacaacaatggccgtggatagtaatttattagtagttggtggctttcaaggggagcttatatgcaagcgcttggatgatgatggggttgtttacagcacaagggttacagatgatgaaaatgcaatcactaactctttagagatctatcaggatcccagcggatctagaaggttggtggctgctaacaatgactgctccatcaggatttttgacaccgagtactttgacctcctcaagcactatgtctttccttggtctgtgaatagtgtttctgtgagcccaaatgggaaactctttgctgtcctgggagatcatgaggatggttgtatagtggatcccaagtgtggcaaggcaattggttctcttaggggtcacttggattactcatttgcatctgcgtggcatcctgatggcaatatcgtggcaactgggagtcaagacactacatgcaggctatgggacatcaggaacctatcacagtcggtagctgtgcttggtggaaggatgggctcaattcggtgtgtcaagttctcttcagatgggcgcttccttgcgacagcagagcctgtggattttgtccacatatatgatgcttatgcggactacagcaaatgtcacgagattgacttgtttggtgagattggtggtttagcattcagcccggacactgaggccttctatgtgggccttgcggaccagacatacggaggcatgatcgagttcagaaagaggcaccaacatcactacctcaactccttgtggtgagaccagccactgagcggaaatttggcttggcagctgttggaccccattgttgcactgtgtgctgaagaggagtgcatgcgtgcatggtcctgcagaggaggatgtcatggaagcgtttgctgcttttagtttttgggtgcagcaccgggatgcagaagtgtataaaattcttggggggaggggtttctttccttgttgctagtaatctgggtttgtcgcatgacttgtggaactgaaggcggtagcatatgtatagcctttctgtttctcgacacctaacaatgtacatagttcgtgtctggagattatctccccattcaccgtcttactgaacctggtggaacatgataacaatgtagtaggtgtaggttgaagtttatgttccttttcgaat

SEQ ID NO: 10650 - DNA, 687 bp, Sorghum bicolor
  Clone ID: SORBI-28MAY03-CLUS28334_1
tacaccgtcatgttcaagaagggtgcctttgagcttgggtgcgctgtctgtccaatagctatcaagtacaataaaatattcgtggatgccttctggaacagtaagaagcaatcttttacgatgcacttggtccgactgatgacatcgtgggccgttgtgtgtgatgtttggtacttggagcctcaatatctgagggagggagagactgcaattgcgtttgctgagagagtaagagacatgatagcagctagagctggtcttaagaaggttccctgggatggctatctgaaacacaaccgccctagtcccaaacacactgaagagaagcaacgcatattcgcagaatctgtcttgaggagactagaggagaaatgaggagacgccaaacaatacaagtgcgtttggttaggggtttaccgttcagctaccttgtaattcggttactaaaaaaaaagtgagcccaggacatgccaagtggccagctcagttttgttgtaaattttgttagaagttcgacagaattagtatgtacttaccaaggaagggagaatacctgcatgtgttttggctgttcattctatgattgattagaaattgacacttggaacacggtgccctattgagaatgctgtgtcggtatttatgaactgacgatgtcatggtttaaattcatatgagtattggttt

SEQ ID NO: 10651 - DNA, 957 bp, Sorghum bicolor
  Clone ID: SORBI-28MAY03-CLUS28394_1
gtacggcctcccataccttgtgtttgtgatgtggcttgacttggtgacgtacctgcaccaccatggccaccatgagcgcctcccctggtaccgcggcgaggagtggagctacctgcgcggcggcctgacgacggtggacagagactacggctggatcaacaagatccaccacgacatcggcacccatgtcatccatcacctcttcccgcagatcccgcactaccatctcgtcgaagctaccaaggcagccaagccggtgctggggcgatgctaccgggagccacagaagtcagggccgctgccgcttcacctccttggcgtgcttctgagaagcctcagagtcgaccacttcgtcagcgaccatggcgatgttgtctactaccaaactgaccatgaattgaacactagtgctcccggctgggccgcccaaaaccatcataagcaaaaatgataggttctcaaagactggccaaagtaacaatattttttttttacaacaagccacagaagaacttcaactccatatataatatggaattgaagcctagcataggcatgagaaaatcaaataagcaagcaacctaagggatcctctagttgaagaacaggtttgattatattgtgatttgtgacaggcgggcagccctgcaacaccacaggactagctacttactacacattggttcattgcctcatcaggttcagaattaaaatcattccgcccactagatcgtagctaagcatcactcctactatatactatacaatataattatggcttgcatgtactacctagatgttgagttggagccctagattcgtgtaacggtggttgcatggccactactctctgaaatttgtatttcctacctctcgaaaacgttgtgttgtgtggtacaaattgggcttcgtctgtaccattttattgggaatttaattattatatggctactaatg

SEQ ID NO: 10652 - DNA, 787 bp, Sorghum bicolor
  Clone ID: SORBI-28MAY03-CLUS2852_1
gggtttgtgatattgagcgactcatcattggctgagacgtttcatagtttccccagcttgagtcggccgcacaacacattaaagtacactttcaaacgtccgctgggtcttaagaaccagaaggatcagcatttctcgaatctaatggtggagcagaaggaggaactgaagaatcgcgccaaccacttgataaagacactggagagctgtggctgggatgttgccattggttgtggtggcatctcaatgttggcgaagccaactgcctacatcgggaagcccttcaaagctgatggtttcgacggcaagctggatgcaagcaacatcagggaagccatcctcaaggccactgggctcagcataaacagcagctcctggacggggatccctgactactgccggttcagctttgctctggagagcggtgaattcgagcgtgcaatgggatgcatagctcggttcaaggagctggttctgggaggcagtggccaggctcagatgaatggtgtctgatggagtaaggctgacacgcttttgggaggcaatccatctttgtctggaaaccttatacgcaccttagcgctttgtacaagtggtaatattgttccgggtgatggagatatcaaacatgtagaggaataatagcagcagcaaataaacgcctgctgtgaattgaatgtaggatcgatagggcgctttgcttcttctgtcttcgatttgctgtgctgtggtgtgcacggagaataaacatgaggtcacgaagcttttactgtttccatttcttgtt

SEQ ID NO: 10653 - DNA, 614 bp, Sorghum bicolor
  unsure (1)..(614): unsure at all n locations
  Clone ID: SORBI-28MAY03-CLUS29777_1
gcggttcctggcgcaggtgaaggacgggacgtggggcgagcaggggtggcccaaggtgtggacggactactcggtctccaagctggccctgaacgcctactcccggctgctggcgcggcgcctgaaggcgcgcggcgcgcgcgtgagcatcaactgcttctgccccgggttcacgcgcaccgacatgaccaagggctgggggaagcgcaccgccgaggaggtggccgacgtcggcgcgcggctcgcgctgatgccgcccgccgagctccccacggggactttcttcaagtggtgcacgccgcagctctactccaagctgtgactggctggctggtagctacgtcgtcgtcgccaccgctcgtcgatcggccggacgggcgccccgtgacggctggagtatgtagcatttcgtttcggtgtagctgctcctactcctgctgactactagtacgtacgtgtcaacgtgtgcagtgaatcaagtcagaatcgggagtgtcgaactgtcgacctgccaaggtgctctggttgaacacagctagctcgtttgcgactctcagcaatgtactatgtgcttgtctaagatttaggtcaacttccgagcactggttcaaaan

SEQ ID NO: 10654 - DNA, 660 bp, Sorghum bicolor
  unsure (1)..(660): unsure at all n locations
  Clone ID: SORBI-28MAY03-CLUS29889_1
gggctggaggacgaggcccggcggaggccggtcgaggcggcggtgctggtcaagaagtcccagctgtccgccgacgacgacgagggctcctcctgcgacgagaacttcgtgggcaccgacgcttccggcacgctgccggagatcgaggcccgggtgtcggaccgcacggtgctggtcaggatccactgcgagaatcgcaagggggtgctcatcgccgcgctttccgagatcgagcgcctcggactctccatcatgaacaccaatgtgctccccttcaccacctcctccctcgacatcaccatcatggccatggctggtgatgacttctgcttgtctgtcaaggatattgtcaagaagctaaatcaagcgttcaaatcatccttctgatgggtttagcttctgaccaagcttaatctaggccaactttttcccatcagccttaaggatttgaggctaatggttaggttatcaggttattccttgccttgcttccgaagagagttgcttgcagtccccaacagagcccccccaaagatagccatttccactggtttttgctgcatgggtgcagagattattacctagttgcctaccaacctattttctctccctccaattttttacatggtttgatacttgtcactnccatgtttttgggag

SEQ ID NO: 10655 - DNA, 1207 bp, Sorghum bicolor
  Clone ID: SORBI-28MAY03-CLUS30090_1
gggagcgcgctccggcccctccggccgccccgacgggcccggggccccgacgggcccggtctccccggcgcccgccgccccgtccccgccggcccctggtgtccgccgcgcagccgcccgtctgcaggccctgctcctggggggccccaccccttagtctgcccttccaccccgtggcctgccgcgcgcactcggctggtccgcccccctgggtcgtctggcgcgctgccggcctccctcggcccgcggccgccgaggccgcttccgttgttgcgtggatcggccccgcctcccttcccccgggccctgctgccccccttgcttggacacctactacacctggagtagcaacctcccttctccgtggaagaagaggaggtagctcgctcaggcgccaccggccgccgcgatggacgcggagaccggagatgcccggtctcccctgctgccgcatcaccttcccagccagacgcaggtttcctcagcgaatcagcactataacaagcccttcagctggaaggccccagccattattttggccttcgaattcttggagagcattgcttactctggtatagcactcaacttggtcgtgtatctcggaaccgtcctccatggaaccactgcctccaatgcagcaaccgttgatgcgtggaacggtgccacctttcttacaccggtccttggagcctttcttgctgatacatactggggaaagtacaagaccgcagctatctctataattttctacgttgttggcttgctcataattaccgcctctgctgtcataccatccctacggcctgccacatgtgaaggcggttcttgccctcctgcaacagggtttcagtattttgtgctctttggttcattgtacctcatttccattggtacggggggcgtcaagtcagctttacttcccctcggagcggatcaatacaatgatgcaaacctcgaagagagtaaaaacaaacaattgttcttcagttggttcttcatggctgtcaacctcggagtgttcatctccggcactgttcttgtctggatacagcagaatgttgcttggtctcttggatttggcatctcctcgatatgccttgttattgccgcagttgcctttttggttggaacaccgctttacagggttcaacttccaaatgggagcccactcaagagtatagtaatggtgtttgttgcctcttttaag

SEQ ID NO: 10656 - DNA, 724 bp, Sorghum bicolor
  unsure (1)..(724): unsure at all n locations
  Clone ID: SORBI-28MAY03-CLUS3017_1
ccnnntnnttttttttttttttttttttttgtgatcgcgaataaaacgacaatgattcttttcatataaaatcacgtagtaatagtattacattacattatacatatccaataaacaggaaagaacagctaaaggtagctaggtacccctatgacgaaagcaaaatccatttgcagccattattcagactttccaagcagtacaccggagaccgaagtaaaaaattttaggacaccccacgacggggaaccgaaatcgcaaaaccaaactgacatgacatcagagcggatgcgtgcattgcaggcgtagtagcgttgtgcagaagaggaacaaccgtggctttatcagtttccgttccacaggatggtggtctcggcgatcatgccggtgacgacgtaggggtccatgttggatgccggcctgcggtcctcgaagtatcccttgccctccctctccgtgtcgcggcccacgcggatggacgcgccgcggttcgccacgccccatttgaaggtgttgatgtcggcggtctcgtgtcggcccgtgaggcggcgctcgttgccctcgccgtacgcggcgatgtgctccctgtgcctcttccccagcttctcgatcgccttcttgatcacctcgtagccaccggcctccctcatcgacttggtgctgtagttggtgtgggcaccggcgccgttccagtcaccctggattggcttcgggtccaaggaga

SEQ ID NO: 10657 - DNA, 618 bp, Sorghum bicolor
  Clone ID: SORBI-28MAY03-CLUS30346_1
gcacgaggccgacacccgggctcggggcccggagaggcggagaccggactcaaaaggggacgaggcggagcgcagccaaaaaccccaagccccgcaaaacccctaaaccctagcacctccataccccgtccccggggttctccgcgcggcttccaacggttggaggcgaagccgccgccatggcgacactcctcaggcgcgcgtcgctgcggcgcgtcgtcgccgccgccgcctccgcctcttcttctcaacctgagagctataagcaagtgatctgtggctccacgtttcattgccgagagttcgcatcaaaagctaaaaaaaagaagtcaagtggaacagactctggtgaggagaatatgtcaaagaaagacttggctttacaccaggctattgatcaaataacgtctgcatttgggaagggggcgataatgtggcttgggcgttcacaaggccatagagatgtacctgtcgtgtctactggctctttcgctttggatatggctctaggaactggtggtcttccaaaggggcgtgtcatagaggtctatggtccagaggcttcaggcaagacaacgcttgctctacatgtcattgcagaagcacaaaagaatgggg

SEQ ID NO: 10658 - DNA, 904 bp, Sorghum bicolor
  Clone ID: SORBI-28MAY03-CLUS29163_1
gcacgaggatcgaacgttacacttcgtcagcctgattcctctggtggcacgctaacttatgagggacgctttgagttgctgtccttgtctgggtcctttatgccaactgaaaacaacggaacacgaagtcggtcaggtgggatgagcgtgtctcttgcaagcccagacggtcgtgttgtcggtggaggagttgccggcctgctggtggcagcaagtcctgttcagattgtggttgggagtttcctgccaagctaccagatggagcagaagaacaagaagccacgggtggatgcggcacctgccaccgtcccacagacgcctcctgctgtcccaatctcgagcacggacacccacagcagcgagcaagggcagcaggcccagagagggatgacctcaacaggagcctacggcgcggaccagagctgggcatcctctgcgcagcagccgatggccgaggtgtccaggacgccgtcatccggggacctgaagatgactgcgtctggatcatgagccctctgaaacccagctggagctagccacactgactgggagccaaggtccccgccggaagagggaaggatgatggatgtattggttcatttgttcctgacttgtgaaagatgtgtctactgctgcagatctcgcactagggcggtctaattgttgctgtatgatgaggcaggcaggaggagagactaacaactgcattcgctgtagccgtgtgaccttagtgtgttgtacccaacccccctacctagtagggttttgtaacacccattgtcggagagtgcgtgcgtgtgtgtagtagctattaccattaccaccacagtttgagtgtgctagctagcggcgtgtgttgtttaggcgaccttgtcgagtaattcttgtgtggattattacctac

SEQ ID NO: 10659 - DNA, 1150 bp, Sorghum bicolor
  Clone ID: SORBI-28MAY03-CLUS29164_1
gcacgaggctccccgtgacgtcaccaaccactccgctccactccaccagccgcctcgcctctctctctccgacccacccatcgaccggaacgcgcgtcccgaggtcggggtagcagggtcgggaggagggcaatggcggtggtgggcgtcctcgcgctgcagggctcctacaacgagcacatggccgcgctgaggaggatcggggtgaggggcgtggaggtgcccaagccggagcagctcctcggtgtcgactcgctcatcatccccggcggcgagagcaccaccatggccaagctcgccaactaccacaacctgttccctgcacttcgagagtttgtcggaggtggaaagcctgtctggggaacctgcgctgggctcatctttcttgcaaacaaagcagtagggcaaaaaacagggggccaggaacttgtcggaggactagattgtactgtccaccgaaacttttttgggagtcagcttcaaagctttgagacagagctatctgtgccaaagctttcagagaaggaaggagggaataatacatgccgtggtgtatttatacgggcacctgctatattggaagtaggtccagatgttgaaatattggcagattgtcctgttcctgctgacagacccagcattaccatatcatttggggagggtactgaggaagaagtgtattcaaaagatcgggtaattgttgcagtacggcaagggaacatccttgcaactgctttccacccagaattgacatcagactccagatggcaccgcttcttcctggacatggataaagaatcccaagcaaaggccttctctgcgttgtcgatatcatcatcttcaagagacactgaaaacctgccaaagaataagccgcttgatctgcccatttttgagtaacgctacaaacaagacggtcaaaagattgaagaaaggaatgaagaaactgaccatatatttatcattagctggttacaaaaacaaaaggctgagaatctgttttactcagccggaaagtgttgtctggtagctaactgtaccaattaaaataatcatgctgtgtgttgtacacaattcttcagataagcaaatattgttttggaaactacaaatttgctgtgcaatgaaaggttatcagtggaacattgtg

SEQ ID NO: 10660 - DNA, 706 bp, Sorghum bicolor
  unsure (1)..(706): unsure at all n locations
  Clone ID: SORBI-28MAY03-CLUS29167_1
ggactgacagggttggtaagcgaccgggtcaagcagatccaattgagacgctataccatgctgacaaggcaaggactgaggattgcattctagagttggttgtctggcttcatcacctcgtcagccagagtaaccgtccggcaatgcaaaaagccactgaccaaggtatgtaaccaaaagccaggaatggtcatggaccatgacatgctaagcatcgcacaacgccttttatccagaaaggctgtgtttgtcgagtggtctaaggtgtcagagttatctgaaaagaggggacgccaaactcttctgatccagcttgctggttgttttcgtcttcgttattaggtcgtagatggaaactagagttgttcttgctgtggagggcgtgcgttttagtttttgccatagaggacgtacgtttttcttcatgtccggatatagtcgggcatgcttatatgtgctctgtacatcagctgagtaggtatagtataagaagagctttgttacttcgatctgtttgttatttgtatgtgcagttgtgacaatcacattatacaaagaaaacggcatcatgtcagggcagggaaaaacaaacaaacatgaatctctttccgcacatattatctgcagttgtgaaaatcacagcgcggtgacaaatatgtatgagttatttgctacttccctatgtcccanaattatatgacatttt

SEQ ID NO: 10661 - DNA, 714 bp, Sorghum bicolor
  Clone ID: SORBI-28MAY03-CLUS2920_1
ttattcccccttgagctccttataatgggagaatttgatcagatgaaggtcgacagctccaatgtgtcaaactggctttcatttgatgtggtcctccctgttgctctctcatgcctgtttggactatcgatatccttctttggattctcctgcagacgggctatctctgctactgggttcacagtgcttggcatagtgaacaagctcctaactgttgtgattaatttgcttatttgggacaagcatgcctcttttgtgggtaccattgggctcttgatatgcatgtcaggtggtgtgctctaccagcaatccaccacgaaaccaaaggcacccaaggctgagccgaaggaagagaacgacgaggagcagcagaaattgctgcagatgcagggagtgcaagagagcaattcaactcaaaagtaaagctcttcataaaccttacaaggaagttcctttgatgcattatctcctttgcaacagcctcaccctgaacgtttttgtattggctaatatacttggaaagaagcatatggatgaatgcagtcctggactaggagctacaaaatcttatgttttagatattagaagtcatggaggggaccaaattatcactatgcaattctttataactatattgctgctttcatttgtaacgcaaaattgttatgataggataccaggtactcagcaaatataccacattgaatacttcct

SEQ ID NO: 10662 - DNA, 995 bp, Sorghum bicolor
  Clone ID: SORBI-28MAY03-CLUS29229_1
gcacgaggaagcagttgtcttctccaggcaataaactagttagatacatatccccaaagcagccagctgcgcgacccgcggcaacgaagtatcatttaaatcccacatggccccgttctgttcttcggttgcttccagaggcttggcacttcagaccgcccttgtggtttctcctcctcctcgctgccgtgggactccggtgatctctgcatcacctcatgctcaccgccaaagtcttatcggctcaacgacgacgaattcttcaggcacgagcccgatcaaaagaactacacgaatccgtgcggtagatccagcctctgcaaattctttaggcgaaggaaacctcgtaatcccaataccagacctgctttcagttctatcatggccctggatgtttggtgcggccatagctgcagcagtacctctctacagaaggttcagaacactagaagataacgtggagaaggcggcggaggcggcgatcgaggtgatcgactcggtggcggaggcgacggagaaggtcgccgtcgacgttgccgaggcgttccccggcaatgaaactctgaagcaggctgccaccaagattaaggcgatcgcggatgagatcgaggaagacgccgacaaagctgaggccctgattgagaaggttgacgagataaaaagagaggtggattcaattatcgatcctctaatcgacaaggtcacgaagaacaaatcctagagaaggagaccatgcaactggaggagacaataatgcaaaacaaacagccagtgaattaatttaagaagcaaacactagctagtcgggcagtaaccagaagaaacaacggatgcacgtacatatgacacgtacgtctcagtgtcatcatcacctatttaagtatctcattcgatgctttctaatcacggtttgttcagttagtgactctagctacgaactccacctatcagagaggacaaatttccttggatgttttattattgttcattcaagg

SEQ ID NO: 10663 - DNA, 1151 bp, Sorghum bicolor
  Clone ID: SORBI-28MAY03-CLUS29337_1
gcacggcggggccatggtgcctcccccacgaccatcagaatttctcatgcctttgccagccaatcctattaaagaagtatgcagaaatatcgacagtcaacctgagggtactagtactctggaacgcatatatgcaggagtaaatgtatactacaattatactggcacagttggctgctttgatctaaatgatgatccccatggaatgggtggatgggattggcaggcttgtaccgagatggtaatgccaatgtcttacagtgaaggcaggagcatgtatccaccatataaatttgactatccttcctatgctgatgggtgcatcaaaagctatggtgtcaggccaaggcctcggtggatcacaacagagtttggtgggcataatatcactacggtcctggaaaagtttggtagtaacatcatattcttcaatgggctccttgacccgtggagtggcggaggtgtcttgaagaacatatctgagagtgtcattgcaattgtggctccattaggagcacaccacatcgatctgcgccccgcaactccagacgacccagattggctggtggccctgagagaatcagagctgaagatcatctctggctggttatcggattactacggggcgggaggggcggtcttccagcctgtagctgccaagggctcctcttcatcctaaggaaccacacactggccaaattgaaatgcccgatctcagaaataaagagggccgattcgcgttgctgtgagtgacaaccaccgtcactgctgcagtgcggcgtcatgaagaacgaagatcctcgtattgattcggatactgaatcggctccggctcctgcatcatgtgccatttcagtagcattgttctgtatatatggcgcgtgcacatggctgataagagtgattaactgataaggttaggaaaaaaccctggataacgtaacgtcgtaacgactctttcacagtggtagtggtggtcaggtactctctgctggatggaggtctgacgccatgtgccgtgccgctgtaaataacgtaatgctccatttttttttttttttttgttctttggccttgtttagttccttttcgaaattttttcagaacactgtagcactttcgtttgtttgtggtaattatggtccatcatg

SEQ ID NO: 10664 - DNA, 1248 bp, Sorghum bicolor
  Clone ID: SORBI-28MAY03-CLUS30678_1
gcacgaggtgcctcaggggggcggggcgccgcgcagccggcccccacttgtggggatgcgggggtggagcccggccactccccgggccgcccgcttcttccccttcgtcgcgcctgtattgtgccggcatgcaggtccgggggttccagctgccccctgatggttgccgggtcacgtcttcgcccggagccggctatcctggtaggcgtgctggtggcttctctggttctgggtctgccctccgatggtcagttgcttggccctcggcgctctcagtcctgggcgcaggtgccccacctccttaatgaacttggctggctttgtcagagggcttctgcctgtacattgtccaccagatctgatatgtctgatttggatttgattaagttttcaactgcacggttcaaatatcttttactgttctctagtgagcgtgactggtgctctcttactaaaacacttctggatattcttgctaagagaagcttggtcagcaaggaactatcaaaggaaacaatggagatgctggctgagattcatcttctgaacagagcagtaaaaagaaagagtaggagcatggggcgtttgcttgtacagtttgttgtaatttgccctgataattccaaggtttaccccttccttccaaatttgcctggccctggtggtttaactccgttgcatcttgctgcatccattgagaatgcagaggatattgtggatgccttgacagatgatcctcaacagattggtttgacctgttggcagtcagttctagacgaagatggccaatctcctgaaacatatgccaagttgaggaatcataattcttataatgagcttgtagcacaaaagctggtggacgtgaagaacaaccaggttactataacagttaatggcgatgaaatttgtatggatcagttagggaatgttggtgaccataaacaatctggggttcaggcgttgcaaataagatcttgctcccagtgtgccattttggagtctggtgtgctaaggcagccggtgcgatcaaggggattgcttgctcggccttatatccattccatgcttgctatagcagcagtctgcgtctgcgtctgtgtattcatgcgagctttgctgcggattaattctggtaaatccttcaagtgggaaaggctggattttggtacaatataatataatgatggggacacctgagccttgtggtattattaagttaacaagcagttggggtttgaagctattttg

SEQ ID NO: 10665 - DNA, 1813 bp, Sorghum bicolor
  Clone ID: SORBI-28MAY03-CLUS30758_1
aaactccattgctctctctgatcttttggcattggcagcatccattatccaatcgtgcgtgtgcgttaggtgatggcggcagtccagccgtccatggagacgacgcagcaagggccgccgccggcggccaactattctccggccagggatggcggcaggagcgccgaggagaaggcggcggagatcgacaactggctccccatcaacgcgtcgaggaacgccaagtggtggtactctgcgttccataacgtcaccgccatggtcggcgccggcgtgctcggccttccctacgccatgtccgagctcggctggggcgctggcgtcacgattatgatcttgtcatggatcatcacgctgtacacgctgtggcagatggtggagatgcacgagatggtccctggcaagcgcttcgaccggtaccacgagctcgggcagcacgcgttcggcgagcggctgggcctgtggatcgtcgtgccgcagcagctcgtcgtcgaggtcggcgtcaacatcgtctacatggtcaccggcggcccgtccctcaagaagttccacgacgccgtctgcgacggcaagtgcaagcgacttcaagctctcctacttcatcatgatcttcgcctccgtccacttcgtcctctcacagctccccaacttcaactccatctccgccgtctccctcgccgccgccatcatgtcgcttagttactccaccattgcgtggggcgcatcactggacaaggggaagggcacagacgtggactatagtctgcgcgcgacgacgactccagggaaggtgttcgacttcctcgggggcctaggggacgtcgcgttcgcgtattcggggcacaacgtggtgctggagatccaggctaccatcccgtccacgccggagaagccatctaagaagcccatgtggaagggtgccttcgtcgcctacgtcattgtcgcgatctgctacttccccgtcgcattcgttgggtactgggcctttggcagtggtgtcgatgagaacatcctcatgacgctctccaagcctaagtggctcattgccctcgccaacatgtttgtcgtcatccatgtcattggcagttaccaggtttatgccatgccagtgttcgacatgatagagacggtgctggtgaagaaactgcggttcgctccaagcttcactctccgtcttattgcccggagtgtttacgttgcgttcacaatgtttgtaggcatcactttccccttctttggtggattgctcagtttctttggcggattagccttcgcaccaacaacttattttcttccctgcatcatgtggctcaaggtctacaagcccaaacgcttcggcctttcatggttcatcaactggatctgcattgttattggagtgctgctgctggttctgggtccgataggagggatgcggcagattattttgtcagccaagacatacaaattctaccagtaaaattgtttaactggagttgtaagcatcacaagattctaaaggtcagagacttgtcccgttgtctcaaataaatttaatagggtcaactggacgcatcaactgggaatacgatagatggcttcaaattcaaaacatgatcctgctgatgatgtggctgttttgttccctttggattaaatcagggttcgttttgagttaatcataggcataaccacataaatatgctacttttttttatgtttcctagggttgattggcttttatgtacacgagggagattgatgctagtggcttgtaggagtatttctatcatccacagcatactgttacttgtacttggaacgttaaaaagag

SEQ ID NO: 10666 - DNA, 850 bp, Sorghum bicolor
  Clone ID: SORBI-28MAY03-CLUS30857_1
gttccagggtgatattgatctagatgtgccatcaccagttgaatttgccttgggagaaaatctgttgcttactgctgtcaaaaaatgctcaaagcctttagttgaatgtctattaagatacacaacaacaaattatgctccagtgggcagtggagacggtgctccagttcagttcttgttcactcctgcgatgactggactgtcaaatattacacctcttcatattgcagccacaatcagtgatgctactggtgttttagatgctttaactgatgatcctcagcagttgggaatcaaagcgtggaagaatgctcgtgatgccactggcttcactcctgaggaatatgctcgacagagaggccacgtatcctatattcaaatggtacaggacaaaattgacagaaggatgagcagagatcatgtcttggttaccatccccaccacaattgatgctgtcggaaagcatgctagcggattgaagtctgccgatcaaatcacatttggtgtggagaaacaactaaacatcaacgaaacatcgagctgcagacaatgtgtccagcaggttcagcagtttgcattccaaccccgtacaaataggtttttgtctaataggcctgcgatgctttccttggtcgccattgctgccgtctgtgtctgtgtaggattgctcatgaagagcccgccacaagttgcttgtatgaggcctttcctctgggacaatgtacgttggggccccaattgatagccaacccaattgtatgagtgtatgatgaagatgttgcgatgagcgaagctagattcttgtgatgtacatgttacttagactataaatgtctaaattgaaattttg

SEQ ID NO: 10667 - DNA, 596 bp, Sorghum bicolor
  unsure (1)..(596): unsure at all n locations
  Clone ID: SORBI-28MAY03-CLUS31004_1
gcacgaggcagggttcgcacgaggcaattgctccgctacattgtagaggagactcctgaagatgcagaaaagaaaaggatatttagatttccatttatagcttgtgaaatatttacatgtgaagtggatgtcatcatgaagacattggtggaggatgaagatcttatgaatttgcttttctccttcctgaaacctgaccaccctcatgggacattgtcggctggttactttgccaaggtagtgatttgcttgatgatgaggaagacactcccactagttagttatgtgcagggccatcctgaaatagttagccaacttgttgatcttattgggattacttctatcatggaggttttgattcgcttaatcggtgcggatgaagctatgtattcaagctatgcagattctatgcaatggttagatgacatacaagtccttgagatgattgttgacaagttcagcacatcagattctcctgaggttcatgcaaatgctgctgaaatcctttgtgcagtaactagatatgcccctccagcacttgctgcaaagatttccagtccaagctttgtggggagattatttncacatgcttttga

SEQ ID NO: 10668 - DNA, 942 bp, Sorghum bicolor
  Clone ID: SORBI-28MAY03-CLUS30911_1
gcacgaggcagtgatgtatgcagctgaggcatcctgaacgaacgggaaaaggaacaccgcaatggatggcgccggaggtgttgcgcaatgaaccttccgatgagaagtctgatgtgtatagttatggggttatcctgtgggaacttgttactcagaagataccgtgggaaaatctgaactcgatgcaggtcattggtgcagtaggttttatgaaccaaaggttggatatcccagatgaagtagatcctcaatggaaatcaattatcctgagctgctgggaaagcgacccacagcaacggccgtcattccaagagcttctggagaggctccgagagctgcagaggcattacgccatccagcaccggaacacaaagaacagcatcgaggagtgacgaatgcaatgcaactcccagagcgcggtgggctttgctttgaagcattttgcgagtgaccaagctgagtgagcggcatgtgtcagatctcgagaagggcctgaacctcctgtactgtatggttttgcttcgccgaaacagctaaggctggaagaagtttgttgtacagacgagggtaccttctgtcttctttggtttttcctttcctccccagggcaattgtgactgtaatttctgggtgctgacagcaaaggtagtagggtagcgagtgagtagtgactgagctccggattgctggcgcctttgggttcttctgattcgtggcaatgcaaatgcgtggttaacaataacatccaatccgggcttgagttttctggcaagggcatgatgatctgtaggttgtttgttctgagtttctgacaacagtggtgtattgtatacatgtgatcgattgtgatcatgcgtgagtttaatcgatgtactcgtgaaatcgactcttttttgcttcattcacataatcggtcgtcagacttgcagtcaggattttttt

SEQ ID NO: 10669 - DNA, 782 bp, Sorghum bicolor
  unsure (1)..(782): unsure at all n locations
  Clone ID: SORBI-28MAY03-CLUS29486_1
tgaaagtgaggtcattggccaaaatgggcacacccagctaggttccttcgaggtgcacaccaagggctttggttcaaagatgatggccaaaatgggattcatcgagggcactggccttggcaaagatggccaaggtatagtgcagccgatacaagccatccatcgtcccaaatctcttggactcggtgtacaatttgacagtctggctgaggcgatcaaagcaaggacagaacccatcaaattaatatcagagccaggtaaagtgaggtcagatctgaggcggaatgtgtgggcaccagagacgagtggggttggctccttcgagcgacacaccaagggttttggatccaaaatgatggtgaaaatgggatttgtcccagggtctgggctgggaaaggatgggcagggtgttgccacccccttgacagcattaaggcgaccgaagtcacggggattgggagccaaggacaaatattaactgataccattttcacttttgatgtatctttctttgttgttccttgttacaggcgtttgcctttagatcacattgtatgctgggagggcgcaacagagcaccctgaagcggtgaaacgatgggttttgatgcccctagcagtagcacagaatttattctattgacattacttttccacttggttctttcaacttctgaaggaaattttatatatttgttatatttgtttgatttttcntgtaacccgttcatggcatgccagtgcaactgtatgacttgaataggctcatcggaaccagtacag

SEQ ID NO: 10670 - DNA, 658 bp, Sorghum bicolor
  Clone ID: SORBI-28MAY03-CLUS29577_1
aggagcctgatatggatcttcatggcatggctcccatgggaggccggggtttttcaacaatgaccagaccaaccacatgatcaccattgggatagacaagccttccaaggtgagacatattaaatgcttgtgtgttactggaccatggaaaagatgtgctgaaaccttctactcgaaatggatgtgacgattaaccttgctcctgaagacaggagtcacatggccctaggagacggcatgttgacagtcgttttccagcaaaactgtttaaagatcattgaagcattggatctggtcagggagactatttattatttcctgtgaaccacagccaaaagcttggttgttgcattttttcccccgacaagcattgagtcaatgactccaaggtcgtgaaagggattcggaggtcatgtagcttcacatgtacagtaaagcaggttgattcttgcatacagttgttgtaactaggtcattgagggcattgaataggatgacagtagaatcacagataagttgctgggctgcgaatagcataaggcatctgtaacgaaataatgaagcgtaggctcgtaacattttgttgttattcttttgatcaaatatttatagcctttggtactaataataaataaataggtccacagttttgatgctg

SEQ ID NO: 10671 - DNA, 843 bp, Sorghum bicolor
  Clone ID: SORBI-28MAY03-CLUS29585_1
gcaggctctcatgtcatggagtatggtgacaagaccttcaagggagagaagctttacctttatcaaggttttgatcctgcaaatgccaatgtcacaaataagctacttcggccaggcctagaggctgtggtcaaccaaagggatgctgatattctcttcctatggaagaggtatgaacttttacatgagaagtccgaagagaagcaggaagttctgagggagatcactggaacagtaaggcataggaagcacctggacagtagcatcgatttcattggaaagcttctcttcggcattgagaaagggcctttcacgcttcaagccgttagaccttccggccagccactcgttgatgattgggattgcttgaagcaaatggtacggatcttcgaatcccattgtggatcgctcactcagtacggtatgaagcatatgagggcgttcgcaaatatatgcaacagtggcacgcctggcgcttcgatgaagcaagcgagcatgggtgcctgtggcagctacaactcggcgagatggagcccgttggttcagggctacagcgcttgatctttgaagattctagggggagcaatgcttagaggactattactgcttgcttaagcctgctctggcccaactttatatggatgtgtatgtagggctagtcagtactgtatactgtaaaagttgacctttgtgcctctgtaatgtacggttgtgtgtgtatatatatcgaccgtgtgtttctgagttctgtatgtttggctggtcagtggtcatatagcctgttcacgaatagttcgcgaataatattttcagccatatcttttaaacaagcgaacaagctat

SEQ ID NO: 10672 - DNA, 924 bp, Sorghum bicolor
  Clone ID: SORBI-28MAY03-CLUS29672_1
tccacacgccgccgcataccccccccccaaggccgcccccgccgcctaccacccgccgccggcgtccaccacgcccgccgccgacccacgccgcctcccgccccgcaacaccgccgccttccccgacgtcgacgtgctgtggttccggaacccgctggagcacgtgacggcctacgcggtcatgagcgtctccagcgacgccgccttcggcgacgcccacaccgtggacatcttccccaacacgggcttctgccccgtgaagccatccatccggacgctcgccatgacggcggcgtggcacgaggcgagggagaggttcccggggaagaacgagcagccggtgttcaacgccatcaagaaagggctcgtcgccgacctcgggctgcgcctgcagtacatcgacccggccttcgtcgccggcttctgcagctacggcaaggtcctccgcacggtgggcaccatgcacgccaactgctgcgtcggcctgcgtaacaggctcgccgacctccgggccgtgctcgtcgactgcaccaacgtcgccgccatgccgcactgggccaggcaccaggctaagtggcccgtccccggagcatgcatccattgacgacgatcgatcattgtgtcgtcagatcgatcagttacgcctatacacgacgtacgtacgggatttgtttactttgcttttgttgcggtggattgaatccccttttctttttcttctctctcgaatttttggttatactagtattatatatagatacataccccccaacagaaagagtacgtatatagtgccccgcccacgaatatacgtagtgtcctttattgtacactgctggtaccaggctagtcttactttcgtcaactccctccctgtcttgtaccagacacatccagacaagattacaaatttcggccgttttc

SEQ ID NO: 10673 - DNA, 805 bp, Sorghum bicolor
  Clone ID: SORBI-28MAY03-CLUS29696_1
tgagaaattacttgctgcaactggcccagttccagacccatggcatcatttgcagaccctgtcagcatgttaggtggtaagaacgaaaatgtgtcatcatatggtggctggacaatggcagactggacattggtccatggcctctggcgttgagctggatgtgaaacctctggttaagatggaacattattttaaactggatcagaagatagtcaatttctacacaagaaatggggaggtcgtggcatctccgaagggcagtaagagtaaagaaacttcgccgattcagctccaacaatgaggagcctctcttccgatataggtctggagaagggtgcatcagggagtgttggttgttgttcctgctgcctgctgctgttgttgtaacttcgtgagtacagtcccaaggttgggaggcttggtccttacccttggaaagggtacagggagctgtgttgttcgtcgtcgctgttgtaactctacttgtgcatacaccgtggcttgtcacagcaatttccgaagatgtccaatattgttgagataactgaactgcttaccgtggcaaccactcactgtaacatcaagttgaaatgagggctgaagtttccctcgaggctaccatatgtgatatgtcctgtgtaccacttaagtgtgcctgtgtcatgtgtgatgtatctcaatttgctattgcagaaatgtttggtgaaactttcatcctctcatgctttgagcaaagcgaacctaactcctttgaatcagttgtaatggctgggaatctgtatgtacccaccgttgtcttcattat

SEQ ID NO: 10674 - DNA, 903 bp, Sorghum bicolor
  Clone ID: SORBI-28MAY03-CLUS28726_1
caacaataagagtattcctgtcacccaacaactgcaggggagcaaccactgggaaatccttgaactatatttggataaatacaaagatctgcatcctaggttgccggtcattgttgctgagacacttctttataccgatcccgagattgagctaccactttggttggttcagatgttcaagactaacaaggcagggaacaagatctcctggggcatgtctgggaaagaggcagatcctgccgccttattcagactatacataaactacggacgccatgcagaagctactaacttgctggtggagtatttagagtcgttcgcatcatcgaggccagtggaccttctccaccgcaagcagatgtccgccacttggttcccgtacacggctgtggagaggctgtggtgccagctgggtgagatgcaacgcgccggccacagcgtggatcagtgcgaccggctcaagaagctgctgcatggagccctgatgagccacctgcagcaggttgtggtcgactcgggggacgtgctgtcgtcagttggagatgggcaggggatggagggccagagcagatgaagtcctagagatcgtgttggtgttggtatgtgtgttgtagagaacgatgcgccaccactgaatcctgtacgtaattgtttgtatggttagcctgtcttatatagaattattagaagaaaaacaaagatggagtgatggctccatttgtaacgtgaacatggaatcatcgctgataacggccggttcaccctcccacatgtaggagtagaagatggattgacgcctccattacagcactggtattgtgtcagagcactggtattgtgtcagattctgggtgtctgtagcttgtgaattgtgatggtggtttgggaaatattgacaaactt

SEQ ID NO: 10675 - DNA, 1164 bp, Sorghum bicolor
  Clone ID: SORBI-28MAY03-CLUS32012_1
gcacgaggcacttctctcacgccacctctctgccaacaggtagttttttcctttctctctaggtgcacctcggtttccctcgttcttccgagtcctggactgacaagaattcgtagcatttttgttgtgttttggagtgggaatggaggcccaaatcctccttttgtcctttgggattcctatttttgtgtcattgattttcgctgtccaagttcatcgttttttccctttttcgttctttgctataatctgaatttttccgagtttgagtcaatcccaagtaatgatttttggggaatagcttcgtggtagggcaaatttcatctgtgccaagtttggcagcgattcgttttgttttggaggagatccgtatgtttttctgtctggcatcggtctctgttcttcttgttcgtcttgctcaggctccaggcggacggaccgatgatggcatctaccaccactggtgtttgttggcacgaggtcgagcactcctagccgaacgtcgcagcagccgtgagcatccgcagagcaaacaccaggtctccggtgtttctctctgttttacccgtcgcagttttctgtgcccttgtttctctctgttcttcactgctttaggttgtgtgctcgaattggcgctgtgcacgagcaggcccaaattagtcctctttcttacgcagctgtgagcatcccctcaacttgcgttgtccctgtccagttcttgttcgtaaatttttgtttcgtcctagctgatttcctgctaagctgcttctgcatttacgtttcaactctaagcatttcagcaccgtcagtttctgcaacaagctttacttgcttcacggtgtacgtggccttcttagtttctttttgtgcatccgttcaacaagttggagagcagcttctctattgctgtgcgtgtgtgttgcagtcttgagaatgttgttacatctgcagtctggctctcggtttagcagttttgcaggtagcttgtgagcttcaagtaatgcagcaggtgcttgcctctttcaggttcctatgcattgatttcagtagcagctgctcagcatctcaccatggtttttgagcggcaagagctgcagcccgtgcttgcctgattttgattggtcacaagcccttttgttcctttcgtaatatactaaagcaatg

SEQ ID NO: 10676 - DNA, 660 bp, Sorghum bicolor
  Clone ID: SORBI-28MAY03-CLUS32055_1
gtcctcccccgccccttacgcgacgcgactcaggcgccttcccatcggaaccctaatcctctctttccctactcgcggaagccaccaccaccaccggcaggggaagcggaagagaagcacctcggccccggcaagatggtgcttgcgcagctgggcgggagcatctcccgcgccctggcgcagatgagcaacgccacggtgatcgatgagaaggtgctcaacgactgcctcaacgagatctcgcgcgcgctcctacaggccgatgtccagttcaagatggtccgcgacatgcaggccaacatcaagcgcatcgtcaacctcgaggcgcttgccgcaggcaccaacaagcgccgcatcatgcagcaggctgtcttcacggaactctgcaacatgttagatcccgggaagccttccttcactcccaaaaagggcaagccaagcgtagtcatgttcgttggtctgcaaggttctggtaaaactaccacttgtacaaaatatgcttattatcatcagaggaaaggattcaaaccagcgctggtttgtgccgatacatttagggctggtgcttttgatcagttaaagcaaaatgcaacgaaggccaagattcccttttacggaagctacatggaatccgatccagtgaaaattgctgttgagggt

SEQ ID NO: 10677 - DNA, 789 bp, Sorghum bicolor
  Clone ID: SORBI-28MAY03-CLUS32107_1
gatgatataagcctggacaagcttccagacgatgcatttgttgtttatcagggacaccatggtgacaaggctgtctatagggccaatgttattctgccatcttcagcattcagtgagaaggaaggcacctacgagaatactgaaggttgcacccagtggaccatcccagctgttcccacggttggtgatgctagggatgactggaagatcatccgcgctctttctgaggttgctggggctcagctgccttatgacagcctctcagctgtgagggaccggattagtacggttgcaccaaatttagtacacctagatgagagggagccatccacaatctcagctgaggttaagccgccagtaaagcaacaagtcagctcgacaccattcaaaactgttgtagaaaacttctacatgactgatgcaatcactcgagcttcaaagattatggctcaatgcagtgcaaccttgctgaagaagtgagaattgcgcgccttcaagctaatcttcagcaaacaacttcttagtctccttttttccttgctacgagtttcaccacccgttgcttgttttcttgggaggttggtgtataatttggactgcctctagattttcagagcagcaaaacttgatcagtacatttctgtgttgtgtatgaggagagcatactcaataagcttgttgcccccattgaatcatacaagtgccacaagcaaatgattttgccttttaaacatttgccctctctgctttgttgtaatatgcaacttgcgaaagctagcaaagtagttc

SEQ ID NO: 10678 - DNA, 1026 bp, Sorghum bicolor
  Clone ID: SORBI-28MAY03-CLUS32336_1
ggaaggagatgaactaaaaaggaatgctgatgttcaagaaatccaccgaaggacaatatttaatccagtttccagagtcaacatgcctaagacgatatatgaccatgaaaggattgtatggctaggtgatctcaactataggctcaatttaccatatgagaagacacatgaactcatctccaagcaggactggaatgaattgtttgggaaagatcagctgaaagtagagctgaagaaggggcatctatttgaaggatggaccgaaggggtcatcaactttcctccaacgtataaatacaaggttaactcagaaaagtacataagtgatgatcacaaatctggaaggagaacacctgcatggtgtgaccgaattctttcccatggtaagggtatgaggttactgtcatataagacagttgatctcaggctatcagatcaccgccctgtgattgctgtgtacatggctgatgttgaggttttctcttcaaaaaaactgcagagagctcttaccttcaccgatgcagaggttgaggaacagctctccttcgaggaagatagtacttctggaatatacaaccttggactaaattaaagttcaaggtaatcttggacatataacaaaacagactttatgcttttctcaagtatccaaggaagaattgacaagttacgacttagtcctgcccagcctgtgcctctatttttctgagaccagcaattggaagtaggtagtcctgtacattttatccatgctctgaccatattttgaaatcagatgtcatgcgttttgctgcccttgagtactgtgtacctcatatgtggaaaaaaaaaatctctgaccatactttgaaaccaaacgtcttgtattttgctgtcccccctcccccgttttgagtatggtgtacctcatgtgtggaaaaatattttccttcgtaacctaagggtctaactgtaattaaaatgttggataccgtaaatacttcaccagttcacacagaattgtgacattgtgcagtttcaattcca

SEQ ID NO: 10679 - DNA, 1232 bp, Sorghum bicolor
  Clone ID: SORBI-28MAY03-CLUS32282_1
gcacgagggtcagcaccagcctccccatcaccgtcctctccttcttcggccagttcgccgccgcctggaacatgctaggtgtgtttgtgctgatgattgccgtgccgaccgttgccaccgagcgggcgagcgccgagttcgtgttcacccacttcaacaccgacaacggcgccgggattcgcagcaacctgtacatctttgtcctgggcctgctcatgagccagtacacgctcacaggatacgacgcctctgcacatatgactgaagagacgaagaacgcggacaagaacgggccgatcggcatcatcagcgcgatcggcatctccatcctggtgggctggggttacatcctgggcatcacgttcgcggtgaaggacatcccgtacctgctgagccccgacaacgacgccggcggctacgccatcgccgaggtgttctacctggccttcaagagccggtacggcagcggcgtgggcgggatcgcctgcctcggggtcgtcgccgtcgccatctacttctgcggcatgagctccgtcaccagcaactccaggatggcctacgccttctccagggacggcgccatgcctttctcctccgtctggcacaaggtcaacggccaggaagtgcccatcaacgccgtctggctctcggctttcatcgcgctctgcatggcgctcccgtccctgggcagcctggtggcgttccaggcgatggtgtcgatcgcgacgatcgggctgtatatctcgtacgcgctgccgatcctgttccgggtgacgctggcgcgcaagtacttcgtgccgggcccgttcaacctgggacgctacggggtgctcgtcggctgggtggccgtgctctgggtggccaccatcaccgtgctcttctcgctgccggtcacgtacccggtcaccaaggacacgctcaactacacacccgtcgccgtcgggggcctcttcgtcctcgtcctcgggtcctgggtgctcagcgccaggcactggttcaagggccccgtcaccaatctcgacggatgaattgaatcgcgcggtggaggactagtgggcggctgctgctgctctaggcctgtagctaggctgcctgctgctttgttcgaacatgtaaagtgtgcgtgagtagaggcagggaagagttggaggcaacgacatgttgtaactagtactttgttccaaaaaggactagcaaggaaaccgatatggaatgaatttctcgtcgatgat

SEQ ID NO: 10680 - DNA, 717 bp, Sorghum bicolor
  Clone ID: SORBI-28MAY03-CLUS30388_1
gcacgaggcaattactcattcagggcaaaagacacaaatccgaaaccctcgcatcatcctgcccttagccgccgccgccgccgccgccgcgacagagcccctcatctcggccgtcctccgcgagcaggcgtcgccggagaccaaagatccggccagatctgatgtcaggagggggtggctcatccgggcgcgcggccccgcggtacgccccggatgacccgacgctgcccaagccgtggcgcggcctcgtcgacggcaccaccggctacctctactactggaacccggagaccaacgtgacgcagtacgagcggcctacaccccccgataaccagctactaccgcccccgcccccgttgcctcccccgcctccccggagtcgcgaccgccgcgacaggtccaggtctcgatcccgatcccgcaccccgccccggcgcgaccacagggaccgcgaccgcgaccgtgacaggcgccacgacgagcacgcgtcctccaagtcggcgtctgcccaccaccatccggctccggtagccgccgccgccgccgatccgtcgaccgaggcatatcgccgacgccatgagatcaccgtcacgggggataacgtgccggctccaataactccgtttgaggctggtggcttcccgtcagaaattctgaaggagatgcgatatctgctccgaggtggagctaatgtcgtatgctgccccgcgcgccctc

SEQ ID NO: 10681 - DNA, 1176 bp, Sorghum bicolor
  Clone ID: SORBI-28MAY03-CLUS3037_1
gcacgaggcttcaattgttgctgataagattgctttgaagttggttgggaagggtggctttgttgttactgaggcaggttttggtgctgatattggaactgagaagttcatggacatcaaatgtaggtatagtggattggtgccacagtgtgctattattgtggccacaattagagctctcaaaatgcatggaggggggcctgaggtggtggctggaaagcctctggatcatgcatatgtgagcgaaaatgtggcccttgttgaagctggatgtgtaaatctggctaaacatatatcaaacacgaggagtgtccgagttaatgttgtagttgcaatcaacaaatttgcatcagatactgaagcagaaatgaatgtggtgcgtagtgcatcaatggctgctggtgcttttgacgctgtcgtctgcacgcaccatgcccatggtggtaaaggagcggtcgagcttggacttgctgtccaacgagcatgtgaaagccagacagaacctctgaagtttttgtatcctttggaatctagcataaaggagaagattgagtcaattgctaagttttatggtgccagtggtgttgaatactccgagcaggctgagaagcagattgagatgtacaccaagcaagggttctccaacctccccatctgcatggcgaagacccaatactcattctcacacgtcccatccatgaagggcgcgccgacgggctttgttctaccaataagagatgtgagggccagtatcggagctgggttcatctacccgctcgtgggcaccatgagcacgatgcctgggcttcccacaaggccctgcttctacgagatcgatgtagacactgccaccgggaaggtcatgggcctgtcatgaatggaattcaacttctgatggtgtcgtgcatataccagatttattgcacattcgttggagcgtcatattgtgtagtcggggcagtcctggagttgaataatggtagtgatagtgataataatagccgttcctggcttcctgctgttgcagtgccgcttcttgttacttgcttttgtaacccggagctgtaaatgttgtcgacccgtgctgtttagactcccatccctcacatgcagcgttcagttcagtgtccctgtttggtccacggtcacaactcgccatgagtaaagttggcagcc

SEQ ID NO: 10682 - DNA, 1157 bp, Sorghum bicolor
  Clone ID: SORBI-28MAY03-CLUS30407_1
ttcgtaccctgagtgaaggtggctgtgttggtaacttttctagggaacaggttgaacttttctgtgtgaataatcttatcaactgctcactggaatcgaatgaggaattcatatttatggaatttagatttgctcgaggagacaatggcatgcgtgctgctttccaactccttcatatggtccttgagcataatgtgtggctggaggatgcattcgatagagcaactcagttatatctgtcttactatcgctctatccccaaaagtttggaacgttctacagctcataagcttatgttagccatgctaaaccatgatgaaaggtttgtagagccgtcaccacattcgttgcaaaagttgactcttcagtcagttaaagatgctgtcatgaaccagtttgtgggtggcaacatggaggtcagcattgttggtgatttcactgaggaagaagtagaatcttgtgttcttgattatcttgggactgcgagggctgcaagttctccaagcacagaggagcgtattgaaaagatttccttccgaccgtttccatcagatgttcatttccagcaagtatacataaaggacacagatgagagagcctgtgcatatattgcaggccctgctcctaaccgttggggatttgctactgaaggaaatgacctatttaatgttattcagagatctgatgctgatgcagaaatatccgaaccagtaaacttggatctaacagggaagagacgcatcgatgttcgcagccaccctcttttctttggcatcactttgagtctgcttgctgaaattaccaattctaggttatttactacagttcgagattccatgggattaacatatgatgtttcttttgaattaaacctttttgacaaattggatcttggttggtatgtgatcgcggtcacttcaactccgagcaaggtccataaagctgttgatgcttgcaaaggtgttctgagaggattacatagtagccgaattgtggaaagggagcttgaccgggcaaagaggacgctgttgatgaaacatgaggctgagacgaagacaaatgcctactggcttggtttgctagcccatctacagtcttcgtctgtaccaagaaaggatgtatcatgcatcaaggaattgacgacgttatatgaaagt

SEQ ID NO: 10683 - DNA, 1627 bp, Sorghum bicolor
  unsure (1)..(1627): unsure at all n locations
  Clone ID: SORBI-28MAY03-CLUS30432_1
gaggaggaggaggaggaggagaggacagaggaccaccacccgactcccgaccggacgggacgcggacgggacccgcgaagagagggcggtgagagggacagaggcggaggatccggaatctcgccggagaccggcgtggtgatgccggtgggcgaggtggcggcgcggccaggaggaggaggagggatggttctgggcggcggcatggcggcggccgccgtgggaggcgacgacgccgtcgtcatgcagctggccgccgccgcgcgcggggagaccgtcatcaccgtcaactgccccgaccaggctggcctcggctgcgacctctgccgcaccatcctcgagttcggcctccgcatcacccgcggcgacgtgtctacggacggacactggtgcttcgtggtgttctgggtggtgccccgctcctcgtccatcaaaatccggtgggcgagcctcaagaaccggctcatgtcaatgtgcccttcctcctactccatcccgttctacccggacatcagccagccaggtccctcgcagtactacctcctgaagctcttgtcgccagaccgcgaggggttgctgcatgatgtgacgcacatactatcagatttagagcttataatccacagagtgaaggtgtgtaccacaccggatggaagagttgtggacctcttctttatcaccgacggcatggaactgctgcacaaaaaggaaaggcaagaggagacttgctcgacgttaattgctaccctgggtccttccataagctgtgaggttctgtcagcagaagggttccagcagggattctcttctcttccaccgaaaattgctgaggaactcttcagggtggaactagctgacagcgagatctgctcgagttcgcttagcgtggagttgaagaaggttcagacggccactattaactttgacaattccctgagccctgcacacacgctagttcaaattatctgtgctgatcagaaggggctcatttacgacatattgaggacgatgaaggactgcaacattcagatattttacgggcggttcagatcagacaagaaagggtcagtcagtaaaggttgtcgagaggttgacctttttgttaaacaagtagatggcaaaaaggttatggatcctgagaaacaggatgctctgcggtcgcgcctgagatctgagatgctccatcctcttacggttatgattgtcagtcgtggacctgatacagaactccttgttgccaacccagttgagctctctgggaagggacggccacgcgtattctacgatgctactcttgctttgaaagcacttgggatctgcatcttctctgctgaaattgggagacaagcagcatccgagcgccaatgggaggtctacaggttcctcctggatgacagcaaagagttccccttggcaaacagcctcactaacaggaaccgtgttgtcgatagggtaaggaagacactgatgggatgttacaactaagactcggtgtccatctgtctgcgagaatccaaagcttgaaggtgactgacacagtcagctccatcgaatgtaccctgtaaattatgtatccccnaaattatggccactccagaatttcgaaatacagttggcgatctcaatg

SEQ ID NO: 10684 - DNA, 1254 bp, Sorghum bicolor
  Clone ID: SORBI-28MAY03-CLUS30533_1
gcacgaggctctccactgccaccaggcaaaccagccgcgccgccgccggcgatgaccaccgcgcggttcgtctcaacctgccccacccgcctatcctccacgtcgacttccccgattcgaacctcggggtgggttatcggtcgggtccccgctaggccgctcggtttctcgcttcgtctcaagcccgccatggccgccgccggcgtccgcggcaacggctccccgaccgcacccggagactccataggatcttctacgattggagaggttaagagggtgactaaggagacaaatgtgcacgtgaagatcaaccttgatggcactggtgtcgccgagtgtagcacagggataccggtcttggatcacatgctcgatcaggtggcatgacatggactctttgatgtgtacgcgcgggcaacaggtgacacacatattgatgaccatcactcaaatgaggacattgctttggcaattgggacggcactacttgaagcacttggtgatcgaaagggaattaaccgttttgggcattttacagcaccgctcgatgaggcagcggttgaggttatactggatctgtctggtcgccctcatttaagctgtggcttagatattcctactcagagagttggcacatatgatacacagctggttgaacactttttccaatctgtggtgaacacatctgggatgactcttcacatccgtcagcttgctgggaaaaactcacaccatattatcgaggcatctttcaaagcatttgctagggcacttcgacaagcaacagaatatgacttgcgccgccaaggcactgtccccagctccaaaggtgttttgtcaagatcataacattgtgagtttgaacgtacgcataccgttcattgcagcgcacatcaatgagaggaaacctgcaggcagctgctgcggtttctgctgcttacattgggagcctgcgttaacctttgacaccaaagcatggaccttgctagtgagataaatcaaatatcaaatgtagcactactgcaactctatctgctctctggagttacaggaaatctgaagattgaaaaggtctggacaagctgtgactttgaaagctactccggtcaccatgaataatgctgcgccttgtaagaactttgcaacgtggatcatccgcacaaacataggagtatgtaattgtttggccattgaagggaaataaattggtttttgttcgtcccagtttgtgcgagttgagaaaataggagccct

SEQ ID NO: 10685 - DNA, 1107 bp, Sorghum bicolor
  Clone ID: SORBI-28MAY03-CLUS30567_1
gcacgaggtcgccacgctcgtgctcgacttcctcgccaccaggttctacgaggccaagcaccgcgacgaggccgcgcgcgtcaaggcagccgccgctgccgcgctcgttgcgacgacctcctctgcgagcgacgaggacatcaccgtgctcaccgtcgacgctgaggacgaacgcaaggcaccgctgttgcaaacgcactgccatggacacggacacggacacagccacagccatgggcatgagctcgtgcaggtagtgggcagcgaggcggaggtgtcggcacatgtccgctccatcgtcgtgtcacagatactggagatggggattgtgtcacactctgtgatcatcggattgtcactgggagtgtcacggagcccatgcacaatcaggccacttgtcgcagcgcttgcattccaccagttctttgaggggtttgcactaggtggctgcattgctcatgcacaattcaagaacctttcggcaattctaatggcatctttctttgccatcacaacaccggcaggaatagctgctggggcaggcttgaccacattctacaatcccaatagcccaagggctcttgtggttgagggcattcttgactcggtgtcggctggcatcctcatatacatgtcgctagtggatctcatcgcagcagatttcttgggtggaaagatgacaggatccctgcgacagcaagtggtggcatacatcgcattgttcctcggtgcgctctcgatgtcatcacttgcaatatgggcttgagacctgcccttgattatatatcagagaagatgaagtagtgtccatataaaattcctgtggtatgtgtacagttttactgggtatgtagcattgtgttgtatctcatagtatggtagctttcttcgggatcatcataggataacatgccttgttttttaagggcatgaaagaaacacccctgatgtagaaggggcacattgtgcctgcactacctccacaatggcggtttcactgatgagatggtgactatttcggttgggttttatatatactcgagtcgagggtgaactatgtggtttctttaagcgaggagcaagcaatgttatgtttgactgccgctg

SEQ ID NO: 10686 - DNA, 1332 bp, Sorghum bicolor
  Clone ID: SORBI-28MAY03-CLUS32994_1
gcgcgggggcgggcgcgggcgggggcggggggggcgggtcctgtcggtccctgtccctcgctccccctcgggcccctctgggaggctccgggcgccgccgcgctcgcctgctgctgccgggtcctctcgggcccgcccggtcctggccggtgcggggcctgtggcgagcagggtccctgtgcagtgcccgccacacccgcgcgtcccctcccctcccccccttctcctcccccccccgcccgcggcgcgggcctaggccgggggggtcggcgggtcggttgtggcggctgcccgctctcggccgggccccctcgcccccccccccccgccgccccccagcgcatcctgctcagagcctataggggtcacagagccccccgcgtgcgcttggcgcgcgcccccgcctcccggccattcccagcacgacgctcctgtccgccgccgcattcgggcccctgcagctgccctgctggttctgagctatcttggcttacgagacattcttgctgttgagatggtgtgcaagtcactacgttcagctgtccggaacgaaccctttttatggaaatgcatccatattgactcgcacttgggcaagaaggtgtctgatgctgatcttctgtgcctgacacagaagtccccgggttctgtgcagtgcctgagtcttatgggctgtctaagcatcacagatcagggattgaaagctgttttagaaagtaatcaacagttaacaaagttgggcatttttggtgctttccggattactcatcaaggtcttattgacaatctgaggtcatttaatatggtagcagatattggtttaaagaaactcagagttacaaatcgtgtcactgcatcagaagcacaatatgaagagttgttgtccttgatgaaaatagacaaggagctggcattacacaaacaagagcctcggatctttcatgctgatcgtcttttaccagatcttcatggtggatatgttcccgattctttcgtaccagatcttcatgatgaatatgctcttgatattgagaagtgtcctctctgtcctaattacaagcttgtttatgattgtccatcaaaggaatgcaagaccagcggagctagtacttgcagagggtgtgttgtttgcatctcaagatgtctgcgatgtgggagatgtatagacagtgagttccaagagacatttcttctggagaacctttgccgtgactgtgtcaaatacgaagactcaccccccacagaaaaatagatgtttgattctgttatatccactggatgtgaatggatacagttaacatagcatttcttctgttgattgatgctcctatc

SEQ ID NO: 10687 - DNA, 1088 bp, Sorghum bicolor
  unsure (1)..(1088): unsure at all n locations
  Clone ID: SORBI-28MAY03-CLUS330_1
gcctccgctgctgnnccgcctccccgcntcgcggngtcgnnctccctccacnntcggtccnncgccctcgctcgcaggggcccctcccgcggnaccctcggcntnnctccgctactncnnctccctccaagnncccaagccggggnacccagtattggggagggagnggtcctgcgcatggttccttggagggagaaggcagctgcacgnngcgatttcgtcacccaagaatctctgacatgggtctggnagggaggaatgnngcgccaatgttgatnngcggctggaggcgaccacgggccaagggagtgctgtagatgttgcccccgcctgaagtcgtgcgggaagatgctgtggacgagggaatgttgagactagcagcagccagagattgggtgtccggtgacagcagccctcctttgagcaagaggctttctgctaaggataggcagaatgagagcgacaaaaggaaggagctgaatcttttgaaatatgaagcactcaaggacgaattgctactcttgaccacaggaattggagcagcatgtagtttatactgtctcctggttttctctctcgagactgctgtcagttatgcttttggggttggtttcagttgcttgtatcttcaacttctgtgtcgacatgctgataacctatcaaaggaagatattccagaagtttttcttaggaagaaagtgaagaaaattggcattacaagtgaagatttgaagaatacaatagagaagacattgggtggtgcaggagtagctctttcatccccaaggcttgtgattcctgccgtgatttttggattgtcagctttatcagatcacttccaaaatagcttcagttttgaggttcttccagggatgatgggtttccttgcatacaaggctgcagctttggttcaagtctacagagataacgaggacctccgcttgatactccctgaggaagagggcgctgacagtgacagcacttgatgtatacaaattagagattatgttaacccagttgtcgataaatacagaacagaccactttacagagtcacacttctgaattttgaataaaattctctttagg

SEQ ID NO: 10688 - DNA, 900 bp, Sorghum bicolor
  Clone ID: SORBI-28MAY03-CLUS33023_1
tctcattttggccatggcttttacccgacccacccatgccgtgtctttattcgcggccgccgacctccggcgcatgagaaaatagaaaattcccccaaaccctaaagccctctctgcccatctgtgtgcactctgaatctgctcccaactctgctagggtttaatgcccgcgtcctcctcacgcattcggccagctcgctgatctgcgcctgttcgcttccgctcggctctagggcccaggccctagaggcggttggagtggcggcacgacgagaggggggaggcggatgcagacggaggcgagggtggggatggccgccgccacgatggacggcagcggcgccgccgcggccgcggcgcggaggtacacgacgcagcagcagcagcagcagcagggcgcaggcccagctgcagcaccaccagccgcagctcgggactgtgccccacctcctcgccggcggcgtcgccggcgcagtcagcaagacctgcaccgccccgctcgcacgcctcaccatcctcttccaggtacaaggaatgcactcagatgtggctacaatgcgcaatactagcatatggcgtgaagcatcccgcattgtctatgaagaaggttttcgggctttctggaaaggaaaccttgttaccattgcccaccggttgccttactcttcaattagtttctatgcctacgagagatacaagaatttgcttcagatgctaccaggtcttgagaagaatggtggattcggtgctgacgttggtgttagattgctaggtggtggtttatcaggaatcactgcagcttcgatgacgtatccattggacttggtgcgaacacgtcttgctgctcagacaaatactgcttattacaggggcatatcacatgctctttatgcgatctgt

SEQ ID NO: 10689 - DNA, 952 bp, Sorghum bicolor
  Clone ID: SORBI-28MAY03-CLUS33136_1
gcccgaggcccccctcccgccccccccccccttctctgttcctccccacctcgccccccggccggggtggtcgctcctcttgccacgtccctcccttggcctctcgcgccggccagcggcccgcggccctccgccccctccaaatcccagaggaagccctcgcgtgctatcaattccctgatccaactcccccgtctcctcctactcgcctgacgacgcctccttccgtccgtcctctataagggcgccgccgaggagagagagagagaccgagcgatgacttcagttggccgcggcagctctccggcagaaggcggcgcagatggcttccgcggcggctcagtgcttcagctactcctcgtcaccggccacgtgggctatgcggcagcgcggcggcggcggttcccctgccggtgccggtgccggcgtgcttcggctctcgtcccggcggaccttctcggtccccgcggcggcccggttcgacacccagaccctcctgtatgtcaccaccggaagagggaacgccgccgggttcgccgcccggacgttcgtcgtgctcggcatggccgatcgccgcctctgcatcgtctccaaggagccagttccaccatacgaacggccagccttgaccaaaggctatctttttcctccggacaagaaaccggcccgcctacctggtttccatacatgcgttggatctggtggacagcgacagactgctgaatggtacaaggagaatggtatagaggtgctgtatgaggatccagttgtagcatttgatggcaaaacacaaaccttaaaaacttcatcagggaaaattctgaaatatggctcacttattatttctactggatgtgaagcttcaagattacctgagaaaattggaggcacattacctggagttcactacatacgggatggtgctgatgctgattctctagtatcctcattg

SEQ ID NO: 10690 - DNA, 759 bp, Sorghum bicolor
  unsure (1)..(759): unsure at all n locations
  Clone ID: SORBI-28MAY03-CLUS31313_1
acaagagcactgcagcttatagttgacgtgaatgatacggcaaaccctactgatatatcctacatcttttcnggatacgcacctcttagtatccgccttgttcagcatgcagtgagatctggatggcggtctattgaagaactgttgaaactattgccaggcccacatctagatttgaaaagaggtggtttgacaattaattcgtcaccagaggtgcatccaggtttaggggctcaacagagtattgacagggttggtcatcgctctctggttttggttgtatttattggcggtgtcacatttgctgagattgctgcccttcgattccttagtgcacaggaaggaatgggctatgacttcctcgttgcaacaacaaaggtcgtcaatggaaacacaatactcagaccaattatagctaatagcaaagaggggatgatgtgattttgttcttttgcttgcatgtgttttcgtaattacaattgtagacaaacccaagcttgaaggtgttctggtttggctaggggttcgtgtttgttcagcaactggatgacaaggctaacaccgtaacacgcttgtcgatagatggaatccaatagtctcattttgattcagttctgtagcacattctccttactgtaaatcactggtcttcatgtgttcgtctatccttttattcaattaactgcttccttgaatgccgtgcatgttgtttctggaccaatattgtgaaaaaaaaggaataatatatagagcctgtgc

SEQ ID NO: 10691 - DNA, 677 bp, Sorghum bicolor
  Clone ID: SORBI-28MAY03-CLUS314_1
gcgttcaatcctatcgcgtcgatcgatcgaatcgaaacattccgctcccactccaggattcggtgggacggtggcagcacatatgcgcccgccgcgcggctcccaccatcgctcgcaccgctcgtgagtcgtgacgacgaacacttgggagtcttctagcttacccgcaacctcctccgggaaacgcgatcgccgcctcgaaggagctgaggatccatccaagttcttctgtcgcagttcgagggaagttgaagcaaaggtgcaagtaaaaatgttttacgggggatatgcttaccatggcaactcgtttgagcaaacgtaccgttgctatccagcatccttttttgataagccacacctggaaggtggcgataaagtaataatgccaccgtcagcccttgatcgtcttgcctccttgcacatcgagtaccctatgctatttgagctgcacaatgatgcaacccagcggatttcacactgtggtgttttggagtttgtggcagaagaaggcatgatcatcatgccctattggatgatgcaaaacatgcttcttcaagagggtgacactgtccatgtcaaaaatgcaactcttcccaagggcacatatgtgaaattgcaacctcacacaactgattttctggatatttcaaatccaaaagccatcttggaaaaaactt

SEQ ID NO: 10692 - DNA, 590 bp, Sorghum bicolor
  Clone ID: SORBI-28MAY03-CLUS3159_1
gtgcaagcacgaggcttttgcggtaaaaaatggcgaggccacacgttgtggttgtaccgtacccatgctccggcaacatcaacccagcgttgcagatcgccaagctgctgcaccgccacggcgtgtacgtcaccttcgtcaacaccgagcacaaccaccgccgcgtgcaggccaccgagggcgccggagctgtgcgcggccgggacggcttccgcttcgaggccatcccggacggcctgcccgacgccgaccgcggcaggcaggactacggccgcggcctggccgtgtccacgagcacccgctgcgcggcgccgctcagggacctcctcgcgcggctcaactgcacgcccggcgtgccgccggtcacctgcgtgctgcccaccatgctgatgagcttcgccctggacgtcgcgcgggagctccgtatcccgaccatgtcgttctggacggccagcgccgcctcgctgatgacgcacatgaggctccgcgagctccaggaaaaaggatacgtcccactcaaggatgagagtttcttgacgaacggctacctggagacgacggtcatcgactggatccccggcatgccgccg

SEQ ID NO: 10693 - DNA, 774 bp, Sorghum bicolor
  Clone ID: SORBI-28MAY03-CLUS31696_1
gcacgagggacccaagtgacaagtacaaaattcagacaaagccacatgggcatggagatgttcatcctcttcctcgctcgcgcggctcgcgcgcgccgcgatgtcatggctcgctcgctccatcgccgccacactatcctccgcccactctgacgacgacgatgaatccgagtccccctccggcgacaagagcccgccgcgcgcctctgaccccaccagcgctgacaccgtggagtccgacgagcagccggacaccccgagccgcggcgttaagggcgggttctccgagcggccccagtcccgcgcccgcccggcctgggccgctccctcctgcctcgcgccacccccgggggggggcgaggcgggggacaggctattctccatatcctggaaatataaaccagttgatactggagcttggaccgtacattgaggagctgaagaaaacacatggtgccatttctgaatttgtaaatcccaagtatactgattcgaccaagacagcatttaaatcctccactcgtctagagtgcatgatgcaagactatccgaagtcgttgcccccctctgcactggttcgacccacgctgctggttactccgcctcccgtcgcgcctgtgaagaataatcctgaagacgcagctaaagttccaaagggcaatccttatcatagtgcaacctcgggagagatggcaatttacagggcaaacagccttattttgagaaaggctggtgcacagatagctgaccctgttgttgataccttcaacggac

SEQ ID NO: 10694 - DNA, 735 bp, Sorghum bicolor
  Clone ID: SORBI-28MAY03-CLUS3171_1
catccagcacgtcattaactatgacatgcctgctgaaattgagaactatgtccaccgaatcggtcgaactggtcgatgtgggaagactggcatagcaactaccttcatcaacaagaatcaaactgagaccacgcttcttgatctcaagcacctgctgaaggaggcaaagcagaggattccaccggtgctggcggagctcaacgatccattggaggatgaggaaataattgccaaggagagtggtgttaaaggttgtgcttattgtggtgggcttggccatcgtgtcagtgactgtccaaagctggagcaccaaaagtccatggcaattgctggctcgagaaaagactactttgggggcgggggttaccgaggagaaatatgattgctctaggttgatgcttgtgtgtggttatcaggagctaagatgctgcaacttcagctcaaacatgttacatgtatcagctagccaaggctcctccctcgatgttgaaggaagacgcatcgtattaacgaacttgtgatatgctgggtataacactgcttgctactgacctaccatatatcttgtttgaaggaggcaagtagattattctgccctgttggaaaatgtaaccagaacaattgctggcgtatgtttcttataggaatgttgcgaagcaccagttttaacccctttctgtaatcaatcaacatttcagattaactccaggtatgtatattttgatctcgtatgct

SEQ ID NO: 10695 - DNA, 695 bp, Sorghum bicolor
  Clone ID: SORBI-28MAY03-CLUS33563_1
gatgcaacctatttatattctctccttaattccccatctttctcgtccgcctccgcacctccgcaacccccgcccctcctccgccgaagcctctcctctcctccggccgccgaaaccctagccgccggcgccgccgacgccgccgccgtcatggcgagcagcaacgtctccaccgtctacatctctgtcattgatgacgtcatctccaaggtccgtgaggatttcatcacctacggagtcggcgacgccgtcctaaacgagctccaggctctctgggagatgaaaatgctgcactgtggcgcgatctcggggaacatagaccgaaccaaggctgctgcaccgtccgccggaggcaccaccggcacgacaccgcccgtgcacgacctcaacgtgccgtacgaggccacatccgaggagtacgccaccccgaccgctgacatgctgttcccgccgacaccattgcagaccccaatccagactcctctgccagggacagacacagggatgtacaacatacccaccggcccttctgattatgccccatcacctatcagcgatatcaggaacgggatggcgataaatggggcagacccaaaagctggccgtccaagtccctacatgccaccaccttccccatggatgagtcagaggccgctgggtgttgatgtgaatgtcgcttatgtggaagggcgtga

SEQ ID NO: 10696 - DNA, 802 bp, Sorghum bicolor
  Clone ID: SORBI-28MAY03-CLUS33581_1
gcacgaggccccgcaggttggaagtgtgaacagataccttcctctgaataatgcctaccctccaaaggttcctttttcatatgggagtagttatggaagctatggtagccatggtagctataccggtaatcctggttttggtaacagctacggaagcaccggtgatgttaatactatgaatatgtattactcacccttaggtttttctggattagcgcaaattggctctagtccagatgttagattaaggatgcgtctcccacatgatagaggaattcgattgagccctggtagtcttgggcctatgtctcttggagccagtccatcgcactttacgccaccaaactaccagatgcaaatcccagctaattctactgggaaacatggttccggttctcctgcaagtggaggcattcatggttctccattaggaagagctgcagcagtgggcccatataacatgaggaggaatttgccaatgccgccacatgattatgtatctcagcatggacaagggcgttttggagatggtgtcagtttcagtcattctgatgcctatgctcgaggacatacaggccactctcatactgcagcaggacctagttcttgtcattctagttggagaccacaaataggtccaaggagtggtatttccttagaggagtcgtttagtcatgtgccttcacaggctccgtcacaatcacttgacttttcagcttcatcagaacttgatcctgctaattgggaccctaattacagtgatgagtcactattgcaagaagacaattccctgtcagctgat

SEQ ID NO: 10697 - DNA, 647 bp, Sorghum bicolor
  Clone ID: SORBI-28MAY03-CLUS33708_1
tctggagccgcaacccccttttcccccagccgtctcccgaagcatccccttccaaaaccctcgccgcagtcgcagccgcagccgcaagccaccctttgcttccgcacgctagcgcccgggacaagccatccatggcggcgtcgctgctcctccgcgccgtgcgccgaagggagctcgcgtcccctctcggatccttgggcgccagcttacagtcaacatgtgctgccaacgtatgctcaaaatggggaaattttgcaagaccttttagtgcaaaagctgctggaaatgaggttattgggattgatttggggacaactaactcatgtgttgctgttatggagggaaagaacccaaaagttattgagaatgctgaaggtgcgagaacaacaccatctgttgttgcatttactcagaagggcgaaagacttgttggaactccagccaagcgccaagcagtaaccaatccccagaatactttctttggaacaaagaggttaatcgggcgacgctttgatgatcctcagacacagaaagagatgaagatggtgccattcaaaatcgtgaaggctccaaatggtgatgcttgggttgaaacaacagatgggaaacagtactcaccaagtcaggtcggtgcatttgtgctgacc

SEQ ID NO: 10698 - DNA, 557 bp, Sorghum bicolor
  Clone ID: SORBI-28MAY03-CLUS3345_1
gcacgaggctgtgtgacggcgcggcgtccgtcgccctcgccgccgccgccgcggcggggatccgcgtccacggcgtctacgcccaccgcgcccggcgcgccgtcccccccggcgtcgccgtcctcaacctcgcctcccgcgacgcgtccgtctcccccgtcggcagcggcttcagccacggctccctgctcgccgaccgtgacggcaacaaggttcttgacgccacaaccatctcctcgtacttctcctccgacggcaactggttcatggacgtgttcaatgtcaccgaccgtgacggcaacaaggttcttgacgccacaaccatgttctacatccagaagacgctggaggcggacgactggtactacccggaggcgcgcaacacggtgggcatcgtgccgtcggaggactacacctccatcgagctcacccgcaccgaccacccgcaccgaccgcccgggccgtgcgtccgacgcgtgcgcgtgggctgccgccttgagctgcgcgagccaaagcgcggcaacacggacgcacaacacgcgcgtgaccgccgtgac

SEQ ID NO: 10699 - DNA, 377 bp, Sorghum bicolor
  Clone ID: LIB3481-022-P1-K1-A12
cgtccggccgtcggaggactacacctccatcgagctcacgggcaccgaccgcccgggcctgctctccgaggtgtgcgcggtgctcgccgccatgggctgcgcggtccagagcgcggagctgtggacgcacaacacgcgcgtggccgccgtcgtgcacgtcacggacgccggcgccggcgccggcgcgggcagcctggcgctccacaaggagcggcgcctgcaccagatgatgttcgacgaccgggctcgacccgacggctcccccggcccgccgcggacggaggtgtccgtgaccccgtgcgccgagcgccggtacaccgacgtcgtggtacaaggaccggaccgggccaagctgctgttaaacacggtgggcacca

SEQ ID NO: 10700 - DNA, 666 bp, Sorghum bicolor
  Clone ID: SORBI-28MAY03-CLUS32702_1
tcagctgatgggctcatacgattttgggaaaatgaaggaggaataaaatgtgtcaagaatcttacacttcatacagcaaccgttctgtccattagtgctggtgatcactggctagggattggtgctgctgacaattctatgtctcttttccatcggccacaagaaagattcggtggcttctcaaatgcaggatcaaaagttgcaggatggcagctttacagaactccccagaaaactgctgcagtggtgagatgtatagcatctgacctggataggaaaagaatatgtagtggtggtcgcaatggactcctgcggctttgggatgcaactacaagcatctagtctagaactgatatatgttcatgtaaagaggcaattgaccatggtgttgcatgctattttccttgctccttttccttttagctaggaatttctatgctatttagataagaaaggagccggactttgttccattctttctttctcatctaaaaaaaacctgtccagtagagtatatgcttgatgtctcgtgtaaaattttgtttgtattttcgggttcagtagccttgcgtggctatgattttgtacgaactatgaggaacatgggaagttttgtactgctactaatgcaaatgtttggtgtaatataacattcttttcatgtgc

SEQ ID NO: 10701 - DNA, 686 bp, Sorghum bicolor
  Clone ID: SORBI-28MAY03-CLUS32745_1
caatgaggcacaagaactggctattctagcactaaggtgctcagaaatgcggcgcaaagaccggcctgatttgaatgatcatgttcttccgacactggaacggctgaaggatgttgcagccaaggccagggaagatgcttttcagggtcacacagcacctccaagccatttcatttgccccatacttcaggaagtgatgatcgatccatatgtcgcatcagatggttacacctacgaccgtaaggcgattgagttgtggctaagcacgaacgagacgtccccgatgaccaacctgcgtctacccaacaagagcctgataccaaatcactcccttcgttctgcaatcttggactggaggtcgaaaagcaagtgacatgtgattccttcaatcctcggatcgcatgcttcatgatgcagcgatggcttatttgtcttacacaacgaagctgacagtttttgttaaaaaaagtgtatgggagtagtcttcagaaagggttttaggttgtgcagcagctcaagcaaaatgtaaataaagtcgtctgatagcatacctcgctgtcttagcgaagcaattcctttctctgtcctatgcaaataatgtatttgtaagcctgtagtcaatgtcaattgttatgattcatcatttgattcttagacgaaatgaattctgcatattgctgctgttt

SEQ ID NO: 10702 - DNA, 1152 bp, Sorghum bicolor
  Clone ID: SORBI-28MAY03-CLUS32786_1
ccacattgccgccggggttcaggttctaccccagcgacgaggagctggtgtgccactacctctacaagaaggtggccaacgagcgcgccgcgtaggggacgctggtcgaggtcgacctgcacgcgcgcgagccatgggagcttccagacgcggcgaagctgacggcgagcgagtggtacttcttcagcttcagggaccgcaagtacgcgacgggttcgcgcacgaaccgcgccaccaagacggggtactggaaggccaccggcaaggaccgcgaggtgcgcagcccggccacccgcggcgtcgtcggcatgaggaagacgctcgtcttctaccagggccgcgcccccaacggcgtcaagtcctgctgggtcatgcacgaggtccgcctcgactcgccgcacacgccaccaaaggaggactgggtgctgtgcagggtgttccagaagcggaaagacagcgagcaagacaacggcggcggctcctcgtcgccgacgacctttgccggcgcatcgcagtcgcagggggtcctgccggagccggaccagcccaccagcatgatggacgcgtcgtacgtagtcgaccagccgggctctaccgccggaatattcgctgcaccgccgcatcatcatcaggagaacctgatgagcctcggtattggtggcctggacgcgttgctgatgaacggagcgatgtggcagtacacctcgtcgtcggttttcgatcacttcccgcagcaggaagtgaccagctcgccgacgatgatggggctaggcagctccaggggaggaggaggagacggcggctgcagcagcagcttcttctacgacagcggcttcgaggacatggccaacattgggggcatggggttcccacagggatggactggctgagaggactgatcgaggaggcacgtaccaattgcaatgcgtacgtacgtgcaggtgcagccatgggagatggactgggcattgtgaaggaaatgattgaattgattccattagtactagtaccctctagtattattgtacagtaggtacttagcgtgaggttagattactagaaattgttaagagtgcacctctccaatccaaaaggaaaaaaaaaaacggaaagaaaaagtagagtgcatatgtgcataagatagatcgatgg

SEQ ID NO: 10703 - DNA, 871 bp, Sorghum bicolor
  Clone ID: SORBI-28MAY03-CLUS32840_1
gcacgaggtataggagcaaaaccagttgtcagcccctttgaagctgttggagtcagcgctgaagttggtggaatagaggttgattccctgttcagaactagtgtacctggcatctttgcaattggagatgtagcagcctttcccctgaagatgtacgatagagttgctcgagtggaacatgtggatcatgcgcgcgaggctgcacaccactgtgtagaaactctcctaacatcccagacaaaagcgtatgactaccttccatatttctattcaagagtttttgagtatgaaggaagtgcgaggaaaatttggtggcagttttatggtgataacgttggcgaagcagttgaagtagggagctttgatccaaagattgcaactttctggattgactctgatagtcgactgaagggtgttttccttgagagtggaacctcagaggaattctcgcttcttccgcagctcgctaaatctcagcctgttgtcgacaagtctaagctccaggccgcaacttctgttgaaaatgcattagagattgcaagaagctcactccagtccagcgcttcggtttagttctcaaaatctagtacttcttgaacctgagactgtgcgctgctcgaacttttcaaagcgtcaagatcacatcaacaataaagcacaattccatagcattagtttccacttgaggctgtgcacctgcgtcggccatttctggcttcaaataaacttgattgccctttgaggggttgatgaggatgataggatgaagactttatgctactttttcttgatgctctactgatcaatcatacatatatgcttgcttctcgatatatagtttgtttagtactccatcctttccaaatcataa

SEQ ID NO: 10704 - DNA, 1019 bp, Sorghum bicolor
  Clone ID: SORBI-28MAY03-CLUS32954_1
gcacgaggctccgcctcccctccccccctgcacgcgccgatgaggtgagccgtggtctactctccgggccgtcccccccgcccccgtgcagctcgccccccccccccctccgccctcctctcgcctcctcctccctcttcctccgcctcgtggcgccgccggtccgccgccagccgccggcctacccggcctcgatcgatcttgtctgctcgattggaccctagatagataggagaaaagaggagagcatttgtggttggataactgggcggagcagtttctcatatcgaattgatcgattaattaatacatactaaatatatatatatagttattatatacgccaagagaatagaggaacgccggccggtttcagttgtctccttcctccgatccctccctgcctgcctcggcggccggctgggctcgggcgttttcctttttttcccttcccatggaggacgccaagatggggaacgccgccaccatccgcgccgtgctcgccatcctccagtggtggggattcaacgtcaccgtcatcatcatcaacaagtggatcttccagaaactggagttcaagttccctctgacggtgtcgtgcgtccacttcatatgctcttctatcggagcctacatcgcaatcaaagttctgaaaacaaagccactgatcgaggttgccacggaggaccgatggagaaggatattcccaatgtcattcgtgttctgcataaacattgtgctggggaatgtgagcttgcggtacattccggtctccttcatgcagaccgtaaaatctttcactcctgcaaccacagtgattcttcagtggttggtgtggaggaaatacttcgaatggcgcatctgggcttctttgatccctattgtgggaggcattcttctgacttcggtaactgagctgagcttcaacacgtttggcttctgcgccgccatggtgggctgcctggccacatccacaaagaccattttggcagagtcactgctccatggatacaaattcg

SEQ ID NO: 10705 - DNA, 631 bp, Sorghum bicolor
  Clone ID: SORBI-28MAY03-CLUS32972_1
gcacgcacgaggctagggttctgtggccgtgcgccctctgccgggtgtctacgccctctggccatgcgaccggaccaggtcgccgacgtcccccgtaccccgcacgcgccattgcagcgcctccggggctccgcctagatctccctcggccacggcgcggcgcccgctggagctgcagccgtcaagccgatcgccgaccaccgaccaccggccgagccgccgcagctagctgtgctttgaagcatgggttgttttgaacaagttactccagaaggccctgaaactaatcagcacgatgagcagcgctccatacgtttacatgcattttctgatctatcacacgtccctgcagccacttttatttatctcttaaaggactgctatggatatggtactaacaaagcaacctcaaagtttaagatcctcatgcagctggtaaaagtggcattgcataatggtccacagccaggcccgttcacatatgttgtccagtgtatgtatattgtacctctgctggggaaaacttattctgaagggttcagccatatgttgacatcttctttaaggcacttggaatctgtggaatcagtacagagagatttcttggaggcaaagcaccttgctgcacaac

SEQ ID NO: 10706 - DNA, 1146 bp, Sorghum bicolor
  Clone ID: SORBI-28MAY03-CLUS342_1
gcccgggcccgggaagccaacccacgatttttttctcactagtccgcaagcaaatcgaacgaacccgcagccgaagcgagagagctgagcagggcgaggcggcgatggagcggctgcagcggatcttcggcgcctccggcatggggcagccgccgacggactcgccgctgctcgactcctccgagcaggtctacatctcctccctcgcgcttctcaagatgctcaagcacgggagggcgggcgtgcccatggaggtcatgggcctcatgctcggcgagttcgtcgacgactacaccgtcagggtcgtcgatgtcttcgccatgccgcagagcgggactggggtcagcgtcgaggccgttgaccacgtcttccagacaaacatgcttgacatgctcaagcagaccggcaggccagaaatggttgtacgctggtatcactcacatcctggcttcggttgctggttatcaggcgttgatatcaatactcagcagagttttgaagctttgaaccccagggcggttgctgttgtgatagaccccatccagagtgtgaaggggaaggtggttattgatgcattccgcctcattaatcctcagaccatgatgcttggccaggagccacggcagacaacatcaaatgttgggcatctaaataagccatctattcaggctcttatccatgggctgaacagacactactactcaattgcatcaattaccggaaaaatgagcttgaggagaaaatgttgttgaacttgcacaaaaagaaatggacggatgggctaattttgaagaggtttgacactcactcaaaaaccaacgagcagactgtccaggaaatgctgaacctagccatcaagtacaataaggcagtgcaagaggaggacgagctgccacctgagaaacttgcgatagcaaatgtgggtcggcaagatgcaaaaaagcatttggaagagcatgtgtcgaatttgatgtcatcaaacatagttcagaccctaggaaccatgctcgacacggttgtcttttagtctgctaatattgttattccaaactgaaacatagccactctacttaagcttatcgaagcatgacacatttggtcctaaggtttgtttatgaatggatttgtctacaattcattgttgtt

SEQ ID NO: 10707 - DNA, 620 bp, Sorghum bicolor
  Clone ID: SORBI-28MAY03-CLUS34289_1
cctgcccgggtgtctgccggccagcccgaggccgccacctggcttctcccggcgctattcactaactttttgattcctagttggtttgaagtagaaggacctaccaaatacaatccgtttaccttacctgaagtttactgggcatcccaaaggaaaaagcatgcttctctggtcgatattcaaaagaatatccgggaactggagatcgatgataaccggaagaaagaattagcatgtgcccttcatgctcaattcaaagattggttatatgcttcagggaatatccgccagctatactgtttgcaaggtgaataagcatacggtgggattcatctctcattgcaatatgcaccagtctgcatctgtaagtgcaactcaactcggggcgcctccgaaatccaaaagtgacttccaagctgacttcgtgttgcttgccctgatgcacctggtatttcagctgtagtgtttgtggagggaaagtatgtatgtaactgtaacgttttttgtttgttccaatcattttttatcactttccccattttgtttggccgcaaggtttctgtaaatctttgatattgcgggtttcatacttgaaattttcacaaagcggatactcaatc

SEQ ID NO: 10708 - DNA, 1396 bp, Sorghum bicolor
  Clone ID: SORBI-28MAY03-CLUS34385_1
ctcccagcaacgcctgttgaagttgaacaatcgattcttgaggacctgcgaaaccgtgcacaactgaatagcgtggcattgccatctgtcagcttctacacattcgttaatacacataatggattaaactgctcagcacgagcacacgacggatcgctggttgttggtgggttttctgattcgtcagtgaaggtctgggatatgtcaaagattggccaaccaacaaaaatgtcaagttcacagagtgagaatggatcttcccagggtgagcgcatatcaacattagatgaggggaaaagaacttatacactatttcaaggccattctggaccagtttattctgcggcctttagcccgtttggggatttcctcttgtcatcatcttcagactcgacaataagactatggagcaccaagctgaatgcgaatcttgtctgttacaaaggacacaactacccagtttgggatgtccaattcagtccagttggccattactttgctagtgcttcacatgacaggactgctagaatttggtcaatggataaaatccagcctttgcgaataatggctgggcatctttctgatgtcgattgtgtccagtggcatgtaaactgtaactacattgccaccggctcaagtgataaaactgtaagactctgggatgttcagacgggtgaatgtataaggatgtttattggtcataggagtatggttttatcactggcaatgtcacctgatggacgatatatggcctctggagatgaagatggaacaatcatgatatgggatctctcagctggccgttgtgtttcaccactactaggacacagctcttgtgtgtggacacttgctttcagttgtgaaggagcattgcttgcatcgggatcggctgactgtaccgtaaagctctgggatgtcgcttccagcacaaaaaccctgaagacagaggacaccaaaggcagctcagctaaccgactgagactgcttaaagctctcccgacaaaagcaactcctgtttatagcctgcggttttctcggaggaaccttctatttgcctctggtgctctctcgctaagctcgtcgtaagctgtgttttgtagaatacaactagaactgttccggttttgacattgagtactgaagctggcatttcggagactccgctgtggatcctattgtagagctaatcttttcatcagcaatcccaacgaacccacagcatgtactgctgaattgagcaccgcagatcctttgtagcgtgttgtaatattgtaacattattattaggtaattacgttgtgtaaaattattgcttaggttgtgacattatgaatgccactgtaaatgtaaaagcctgatatcttgtgttcaatggtctgtcatggggtggtctatc

SEQ ID NO: 10709 - DNA, 743 bp, Sorghum bicolor
  Clone ID: SORBI-28MAY03-CLUS34405_1
gacaaatcgcgcgaaccaaaccgaaccacccgcagtccgcgtgccctcctccacaggaccaccggtccaccgccgcctctcctcggctcctcctctctgctgctgcggcggccgtaccgtcggtcgcctggactggacgggtgcggcagccacgtcttcgtcttcatcgtgacccacggagaggagagagggagaggcctggtggctggcgacagggaagaagacgtctcacctcgcctcgcctcgcctcgtcgtcttctgcggcgtctgttcttcaagctctcccccgtcacccaccagcagcccgctgcccgccccccgaggaggacgcagcgattgccatgagaagataactttggtagtgccaaacatcagcctcggaatttcagcatgggttcggggaatttggtaatgaagaaggcgataaggcccagctcctttgatctggacataaaaattgatcaaagttggatggaggatgttgcttgcccaatctgtctcgatttcccccacaatgcagtactgcttaggtgcacctcatatgagaagggctgcagacctttcatatgtgacactgaccagactcgctcaaactgtctcgagaggttcaaaggcgctcatggactgccagccaatttgaaagtctcatctcgtactgtggctccccttaatagcattcatatcatttcatcaaatgcgaataaccgcccagcttgtccgttgtgtagaggtgatgtgattgg

SEQ ID NO: 10710 - DNA, 697 bp, Sorghum bicolor
  Clone ID: SORBI-28MAY03-CLUS3441_1
ccgggcggcacgagggccaagcgagcgaaaggagtagctaaacagagagcctacgaccgacgcggccaaacggagataagagcaagataatgtcgtcgacggcgtttagccacctgttcccctccgccgccgtcgccgcggtatccctcctccctcgctgcgtctccttcggcgccagcggtggagctgcccctggatggaggagaagaagccgcagcatggccgcggccaccgcggaggcggcggcgcccgcctacacctccgactccctcgtcctctacttcaaggcggagggcaccatggaggagagggccattcccaagatcaccgagtctcttcagggtatggaaggagtcaaggacctagaggtgctcattgaagaaggcatcgcgagtgttgtgttaacaaaggagacaaccgtgcaagctactggagtagcctcgaacctagtggaagctatccagggagctgggttcaaactgcaaacactaagcttgagcttcgacgatttcgacgacataacagcaggagcaggaggcaatgtccaacccagcgagtgagctaatttgtgcagccgtgcttagtgccaaatgcatataattctgtcgggtacttttacattgtgtttaccccgttgaatttcccgagcacgtcctgtaattttttgcaaatgggtgagaaatcacgattcttttcg

SEQ ID NO: 10711 - DNA, 1067 bp, Sorghum bicolor
  Clone ID: SORBI-28MAY03-CLUS4812_1
gcacgagggagaggcacggagacggcggcgacgccaccggcaggggaggaaagggaagacgacgatccgcgagcgtggtgcccgggcccggccggcgacgagatgtggcggaggcgagtgggcgccctccttctccaatccccacttgcttcctcctcctcctcctccacggccgcctcgtcctgccagcgcctccgacaccaccttctccccagcgaggaacctcttgctctcaatcgtcgtcttgccaggctcttcacgtcccaggatggaagtgatggtggcgatacccagaagccctttattgcttttgtcttagggggtcctgggagtgggaaaggaactcagtgcaccaagattgcttcggattttggattcgcccatttgagcgctggcgatcttctccggcacgaaatagcatctggcagcgagaaaggggagttgatcctagacatcataaaggaaggcaggattgtcccgtctgagataactgtggaactcataaggaaagcgatggaaacgaaaaatgctaaaagggttcttatcgacggcttcccaaggtgtgaggaaaacagaatcgccttcgaaaaaattgttggaacagaaccagacattgtgattttctttgactgtcctgaggatgagatggttaaacgccttctaggccgtaaccaggggagagttgatgataacattgagacaatcaagaagcgtctaaaagtgtttgaaagtttgaatcttcctgtcgttgactactactcttcaaggggaaaagttcacaagataaatgccacgggtactgcagacgaaatatttgaagctgtccgcaggctgttttcttccttaaggttatgatgaggctagcgtcttcgagggaacatgaggatttgtctcttcacaggctcattgcattttcatcagaaaaaaaataagacactacacattttgttcaggatccacggagttatgtatcaatgtatgtgcccctcagcacattaacatcttggcatggtaactgtacatatatattcccaataatgaatcatgaatgtgaaccatgggatatt

SEQ ID NO: 10712 - DNA, 684 bp, Sorghum bicolor
  Clone ID: SORBI-28MAY03-CLUS48285_1
gtgcgttttctattctatctcccccaccctttttcctccctcccccaccttcttcttcctcctcccgtccccgacggcgtgcttcctactgccgccgtcggcgacctgctcttccgcggcatgactccgcatcctggccgcctcgtcctacccccggcggctccttctccctgattcccgccgcccgccgtccatcacgcctccttcagcagacacgcgggcctactctgctgcacaacgccgcctccaggcgcctcgctcgtccgttcctctccacctccctccgccggcgaaagttcgggctcgctccgccgagctccctccgctgttccggatctgctggagcgccagcaacgcggcctcgccatccctccggagtccggggttctgctctctcatgctgcagttttacaactttgaaggcttcaaaaatccacagaactagatgatacttgcataatgcagccctcagatatttggaaggcgcatgctggttcatcacagtcagagggttcgggtctggatatggagaggaacggatgcagtcataattgttgtccatctcctctccaaccaattgcctcagctggtcagcactctgaaagcagcgctgcatacttttcttggcctacatctactctaatgcacggctcagctgaaggccgtgctaactacttcgggaat

SEQ ID NO: 10713 - DNA, 384 bp, Sorghum bicolor
  Clone ID: SORBI-28MAY03-CLUS4813_1
ggggaaatggaacctgtgttataggatactatatattaatgaaataaattaattatagtaatatattttattgccatattgtcatacattttctttaatgaattatcgatgaaggtaaagagttattgcatgccattgttcatgcactttgttatttctgtcaaatgatttgatcttccacaacctggattgaagcagaaacaagcattgcaggtctgctgcagcagagacaaggaacctactcatgcggcagaacattgatgggctacttgcacagctcccgcctgtgtctgcttatgttctaatgttttcttcttaaaaattccttctccaaacacacaccacaatttgttacctcaaacgcatgcccattatatacctatg

SEQ ID NO: 10714 - DNA, 367 bp, Sorghum bicolor
  Clone ID: 14823749
gcacgaggcttcctcgctctcgcagtctccgccgccttcctcgctctcgcagtctccgccgcattgtcgttccctcgctgtgtcgttcggcgagtccaccgtacgcgctaccgcgcaggtggtggaggtgggggttcccacagggccacccacgctgcagtgtcagtccgggttcaccggataacctaccgtgcggggggttctgcagcagtacctgcgccgcggagaaacacgagcttgtatcttcttccatcgttggtgtcccagattcatctttggccatcggttcgtggggatctggagggattctggtggtttctctgctttttgccttccgtcagtccggatctgcagggctgccgtcgtt

SEQ ID NO: 10715 - DNA, 586 bp, Sorghum bicolor
  unsure (1)..(586): unsure at all n locations
  Clone ID: SORBI-28MAY03-CLUS4835_1
gcacgagggttgcgcgagccggagggggtgagaagttctctcgccttctcggagacgtcgccatccaccccccccgcttccaccactctcggcgggtcgggcagaggctttgcagctttgggtcagatacagtgctctccaaggcccactaaatggagtctcacaatggcgaggctgatgacttgcctccaccacctcctttgaatgctggtgttgaaccacttaaagctgatgaaacaaaggtgccattgaaacataggactctggtccagaggaatggctttggcagaaaggggcagcagataaaactgctaacaaatcacttcaaagtttctctcacgaatgctgcagattatttctatcattactacgtcaacttgaagtatgaagatgatacaccggttgatcgcaaagggtcgggaagaaaagttatagaaaaactgcagcagacttatgctgctgaacttgcaataaagattttgcatatgatggtgagaagagcctgttcacaatcggtgctcttcctcaagttaaaaatgagttcactgnnntgttgtgatgatgtttcaactgggaagactcctgc

SEQ ID NO: 10716 - DNA, 727 bp, Sorghum bicolor
  Clone ID: SORBI-28MAY03-CLUS48299_1
aaaaaaaaaaaaaaaataaaaaaaaaatgacaagaagacaagagaagaggaaaatcaaggacaagagacgtaccaacctcggctactacgacgacccgtacgaggaggaagaagtcgactggcgtggcggaggcggcggcggttccaccccccacgcgagaaattcccaggcagccatttggggagctgcacgagtaatggaggtttattaggattccagggggcatcagaatggcatacttccctgaggaagtagtggagtacatccttggctatgtaacctcacaccgggaccgcaacgccgcgtccttggtgtgccgggtatggtacgacattgagcgccgtggccgccgttcggtgcttgtaagcaactgctacgcggtgcacccagagcgtgtacatatgcggtttcccaacatgcgtgcactgagtgtgaagggtaaaccgcactttgctgacttcaaccttgtcccggcgggttggggtgccagtgcagagccatgggtggatgcgtgcgcccgtgcatgcccaggtcttgaggagctccggctgaagcgtatggttgtgactgatgaatgcctcaagttgctttcttgctcttttaccaactttgaatcacttgtccttgtctgctgcgaggggttcagtactgctgggcttgctaacattgccaccaattgcaggtttcttaaggaactcgacttacaagagagttgtgtgaaacatc

SEQ ID NO: 10717 - DNA, 814 bp, Sorghum bicolor
  Clone ID: SORBI-28MAY03-CLUS34703_1
tcgcaacatgcatattcccacccccagcctgtgaaagcttcgaacccttttgatcttgggaatgagtcagctccaattcaagctcacatgcccccatctgggccaccaggagcatcagcaggcctagcttctcaaaccttaattggcaactctagttttggtgttcctccacagcagcctcaccagctctatcagtcagctgcacagccaagccatttcatgatgcagcaagttccgaacagcatgcccatgccggagcaacaacctaatagcatgcttgcaacgcaacaaggtttgggttccttcaacatgggttttgatcagcaagctcctcccagatacccgcagccaaacaccccaccttcctacggctccgttgggggtagtaatccgtttggctaaagcaagtgtggaaatacctgctctttcatctctagactaagggtctgcagcactcagcgggacagacatgcatcgaagcccacgagagaatgtgtttcatacaaccaggtggtgtattttgtcggccgtaatctgttgtacaacttgtttccaaaggcttaatgatcgaatgtaactctgtttaagagggcctaagctgctttcagcctcattccttgtatattgtgcctggcgttctgcttgaattgcatagtatgtatatttttgtgtcttggacagtatcagctactgttttagtacaagtcgtttctagtgcagttggctattcaatttaacgtggatgataagtactgtatactagatacagaagtgtaatcgtgatcaatcaattttgtggtttcttttacttgct

SEQ ID NO: 10718 - DNA, 683 bp, Sorghum bicolor
  Clone ID: SORBI-28MAY03-CLUS34808_1
tcaccagcgcagaagtaagccaagatggtcggtttatcacgacaactgatggctcaagcgtgaagttttgggatgcaaatcactttggacttgttaagagttataatatgccatgtgcagtggagtcagcttctctcgaaccgaattgtgggaataaatttgtcacaggtggagaagacatgtgggttcgtgtctttgatttcttcactggagaagaattagcatgtaacaaggggcaccatggtccggtccactgcgtacggtttactcctgttggtgaatcttatgcatcaggatccgaagacggaaccatccgaatttggcagttgggtccagctaacagcgacgaacaggaggcagcaagtgcaaatgggaaggcaaaggtcggggtaaatgatgtcgcacgtaagatcgagggtttccacatttctaaggacgggcaggtagagggcacttgatgcccaccatgcttgctgggagacttttgtgggatgctctttcccttcgttcctcccagaatctgttgtaaacttgtaaaagtataagcactggcctgctgcagttgggtttcctctaacagcacctaaatggtggaatttttgttgggggtcctccttgtatttctcaaactctggacagtactctcactgaggtgaacgaatatataagactcaaaaatgcca

SEQ ID NO: 10719 - DNA, 674 bp, Sorghum bicolor
  Clone ID: SORBI-28MAY03-CLUS34833_1
aagaaatgacccactgacctagaaactaatgtccatgctctgctcgctgttgtgcccgctccttttctggagagagcggttgataagttgaagaattgttttggaccacgacactttgggttaggttttgcttacaagaatctggggcaggcctatcttgagatggaccaacatcagtcagctgtgaagttctacaaacttgcaaatgatattattgaagctgcatttggactgacacatgaggattctattgatacaaaacagtcccttgcaaatgcatacggactgatgggaagctacaaacttgctatagactttcaagaacaagtcgtagatgcctacagtaggtgtggcagtggtgcctttgaggacctcagggaagctaataggcttttagagcagctcaagaagaaggcacaaggattgcctcatgcagtatttcctgcatattcattgccggttctacctgaaaataatgattagtcctccatcagtgccaatttagatgacttactggtaaactgttactttacaagtgacccctcaagtttttttatttagtgctctttttgttcttatatatactccattacttggttgtggtagcgtcatctgcgtggtcagaattgacgtgttaaaatctcggtattacattttggttttctgagttccag

SEQ ID NO: 10720 - DNA, 794 bp, Sorghum bicolor
  Clone ID: SORBI-28MAY03-CLUS34827_1
aatgatacacatcacaagagaacttgctgccccctaggactgttgcagcccgatcagctattaacatgaccactacaacaaatgatacacatgctggaactggtgagagcttgcaaccccttagacatgatgtggcacattcatctaggaacaagagaactacaccaacaaatgatggccctcgcttttctcatgataaccttgaggcgagcctcttgggattgaatattgtgaagtagttgttaatgttgtgatgaaaagagatgctctgctgccccgagcttatggcgacgtgcagactatggctagtgctctcaagatcaccatcgcatggccatacaataaaattaaggaatgcaagaagaaggcatctggacctctcaagagcactgaggaagtgctccaaactagcctttgacttgagtttctggaatattattctgctgatggatgagctctaccttttggcaagtcattccttttggctttgagttcttagacctagaaatgagattctatgcacaaacctgagaatcgaaaacacaaagtactagtgtctaatccttttggtgcttgaccttgctggatgtgtgatgtatgacaagacaaagtactaatgtaattcttttggtgcttgaccttgctggatgtgtgatgtgtatggcaagacaaatccatttagtggtccacttttgctggatgtataatgtaaggacacatttggatattatatgtatgtggctgtgtatcttcatgacttgtggacactatattaagattttgataacgttttt

SEQ ID NO: 10721 - DNA, 829 bp, Sorghum bicolor
  Clone ID: SORBI-28MAY03-CLUS34849_1
tctcactgggggctgacttggactgcggcctggctcacacagttcttaggggctgacgttcttgggggcctgtgacgagctgttcgaggcagctcagcttcctgggtgccttagatgcggggttccaggcaacacagcttgcagagttccaaagatgcatggttccactcttccgccagattgcccgtagcatgaacagctctcatttccaggtggcagagcgggctctgtttctctggaacaatgaccatattgaaaacctaattaagcaaaactacaaggtgctattacctatcatctatccagcacttgagagaaactccagaggtcactggaaccaagctgtccgtagcctgaccctgaacgtgcgcaagatcttctctgatcatgattctgcattttttggggagtgcgttcagaggttcaatgatgaggaggtcaagcaggaggaatctgattcgaagcgagaagccctatggaagcgcttggaggaaatggctgcctcaaaacctggcgaaaacaatcccttaggtgcacccaatggcaaacccagtcaagctgctggctagaatagcccaccatatcagccgcagctgtgtaactctttgactctcgtgcgagatctcctggaacctgggttgtgatttttagctttgggaattttttttgcgttggtttgcccctgttgtaggtgggtaggatgtgtttggttttgtcagaactgtatgttcaaaatgtacacatacagaggaatttgagagatttggcatgtgtagtaacattaatcagaattaccatatagtccaataaacaacgtcgattttaatgc

SEQ ID NO: 10722 - DNA, 1110 bp, Sorghum bicolor
  Clone ID: SORBI-28MAY03-CLUS36227_1
gcgcgtggctccccccatggctccaccgtactgcctctatgcgctggttgcgctggcgccgagggggcccgccccagccttgctagacgcttgtatgcagttatttcagtagagaagtctgaggtcaataggacgattctgaagagttggtgggatcagacgcagactggtcttttaattgagatttgtgatgtgcagacattgacatctgagaggatcgaggcatatgttagaagaattggtggctttgatcttgtgattggtggaagtccctgtaacaatcttactgggagcaaccgttaccacagagatggtttggagggcgagcattcttcgttattctaccactatgttaggatcttagactctgtcaagtccatcatggagcgtttgtagtttttagaatctttattattttggttctagaattgtagcatcttttgcttgcctgctgacttggtgtttcttcccggcgttccctggggtcgctcccgtgccacccgcaggtcagagaggtttcgttctctaggaaattcatttcaagttgatactgttgcttaccatctctcagtcctcaaggatatgtacccagaaggcatgaatgtactatctttattctctggtattggaggagcagaggtggctctccacaggcttggtatacgcatgaagacagttatttcagtagagaagtctgaggtcaataggacaattctgaggagttggtgggatcagacgcagaccggtactttgattgagatcaatgatgtgcagacactgacatctgagaggattgaggcatatattagaagatttggcggctttgatcttgtgattggtggaagtccctgtaacaatcttgctgggagcaaccgtcaccacagaaatggtttggagggcgaacattcttcattgttctttcagtatgttaggatcttagagtccgtcaagtccatccagcgtttatagtctttaggatcttcattgttttggttctggaattgtagcatctttcgttgtgatcaaacttgtgaataatttgaacgtcgactggtgtaattactcatgtcactctaatttaggctacttttaattttatcccctttggtg

SEQ ID NO: 10723 - DNA, 1162 bp, Sorghum bicolor
  unsure (1)..(1162): unsure at all n locations
  Clone ID: SORBI-28MAY03-CLUS33792_1
gcacgaggaatgattgctctcaagcttgagtttggagttttccataatcaagtgtttgaaaggaccattgcagtccattttactaacccattccatgtaagcacacgcgttgtggacaagtgcaatgatggagctctacttctacaggtgatattgtgttctgaagtgaaggccacactgcatgtaaaggatgtacggttagatcttcaatctggatttgagcacttgggcaaaggagatggacggccagctttgagtttattccctctggttattgctccttcttccaaagctggaattttattcatgatacggttaagtggtacaaaggatgcagatgaggcagaaaatgcagacagcatgctgaatatcacttatgggatatctggtgacagaacaactggagcacattctcctgtacctgtcaaatctggtgactctgaagagcttctgttcaagattgcacttagactgaagcgacctgtcctggatccatgtctagcagttggattccttccattttctactgactgcctgagggttgggcaattagttaatatgaggtggagggtcgaaaggctgaaaaccccggaggatgcatccatatctgtcgacgaactactttatcaggttgaggcaaacccgcagaactggatggttgctgggaggaaatgtggtcacgtatcgttgtcaaatgagcaaggttcaaggatggagatcatggtgacatgtgtgccgctggtgtctgggtacgtccacccaccgcagctgggcctgccggaggtgggcgaggcaaatattagctgcaacccagcagggcctcacctggtgtgcgtccttcctccagccctcagcacctcctactgtatacctgcggcatgattcttcctgggcagtcggtttgctgccatttacacatagatgagctgtagagtctgtttttggcgagactgtgtttttgtgtagacatggtttcaccggaatgtgtttcttgtaattctgttgtgccatgatcagtgtgcagttgtacattgactggtacatgaaactgcttccccagtattccgtgaaactgcaagccagatttgttcttcagattgtgttgttacagacagattaccttttgtatatcatccggactcaaatgatacttgtgnttaga

SEQ ID NO: 10724 - DNA, 694 bp, Sorghum bicolor
  Clone ID: SORBI-28MAY03-CLUS3378_1
cagcacttcagatcagggtgggggcaacagcttcatgaggtatgattccatgaacagcagcagcgaccatgatagaggcgacccatttgcgaggtttgattcaatgaagagcagtgactacaacagccggggctactcattcgatgatgaggaccccttcggaaccgggccgtttaaatcaacagaaaccaagaacagcagcccgacgaaacatgggacagacacatggagcgcgttttgacagggattgtatcatattcatagaggtcatgtgcttgtgcaccttactgcagatatatacacacgtacaggggcgagacaatttttttttgcatgggcctctactccacacctggggacggcaagggaagggatgggacggggcttgcttgtgtgtttgctttgtgtttaattttgtacctaggctgggaacatgtgtttggtgggatgctgctgcttataaactcaacattctttataccttgtattgtacaagtacatgtacaagatgcgagtcaacccgttgggttgagaaactctcgagtgttttttcttccatggcgtagcgtttttcagtttctctaaatttttctgagctctgtacagacagacaatgttgctgagaagtcggaatctggttatgggttacgccttactggagtacaatatactgtgaggcaattaaatcgggttc

SEQ ID NO: 10725 - DNA, 789 bp, Sorghum bicolor
  Clone ID: SORBI-28MAY03-CLUS33814_1
gatggaagtgctgatcagatagtagaatttgttgtgtcaaaggaaaatgcaaaccaactttggagttccatcatcaacaagcttgaaacaccaaccaagacaatcactccagttattccgcagtgtgatgggattcaggatgactataatgatcaatttttctttcaaggagttccaactgaagattataatacccctggagaatctgcggagtatcgagctcctacacctgctgttggaacaccaaaaccaagaaatgatgctggagatgatgacgatgacgatgatgaacctcctcttaatgaagacgatgacgacgatgatgagttagatgaccttgagcaaggggaggatgaacctaacacacaacatcttgtacttgcacaatttgacaaagtgacaaggaccaagaatcgttggaagtgcactttgaaggatggaatcatgcatttgaatggcagggatgttctatttaacaaggcgacaggtgagtttgatttttgaatttttggatgaagatgagctattttagaagcagctgtatggacatatcttgtctttgacataaggacggggaggtgacaaagtgttcatggtggggtcctggcagtatgactgcgtcgtgttttcctattgatactttgtttcaccctctggtttgtcaccgcaactgttatcgctgtaaaaaagttactgcttgtgctgtgtagacattttctgagatgggtctctcaaatctgcagcgtaactatattatctgatttaatgttagttatacattttttctct

SEQ ID NO: 10726 - DNA, 968 bp, Sorghum bicolor
  Clone ID: SORBI-28MAY03-CLUS3392_1
ccgccatcctcgcagcccctcaccatggctgccacgctctcctccgtggctgccccttccctccccaagcacggctccatcatcagagctcagcagcaggcgcctccttccatcatctcggcatcaacgactaagactgccttccatggggtgtcgctggtggacaggaggtgggcggccgccggccaccggggaggcggcggcgcgcggcggaggctgctgcaggtgaacgcgaggaccgccgccaagaacattgaggtggaggtcgacaagccacttgggttagccttaggccagaagcccggcggtggcgtcgtcatcacttctgtggaatctggagggaatgcagcaagagctggtctgaaagccggcgaccaggtcttgtacacaagtagcttctttggagatgagctgtggcctgcagataagcttgggttcaccaagacagccatccaagcaaagccagactccgtctactttgtcgtgagcaggggtgccgaagttgatgtgaagcgcctacctaagaggccggcaccgcctcggtttggacggaagttgactgatgcacaaaaggagagagcaacgcacatctgccttgattgtggattcatatacttcctacccaagccttttgaagaacagcctgatgaatatggatgcccacaatgcaatgcgccaaagaagcgatttgcaaagtatgatgctgccactgggaaggccatcggcggtgcgctgccgcctattgcggtgatcataagttttgtaatcggcatcgccggagtaggggctctgcttgtgtatggcctgcaataggctgctcattcttcagatccaaatttttgctgtgcacaagaagctcagctgactgctgctgtactccatctcacaaaacattctgagtgatatacataaaatcgaaaggaaatatacaatatttgaggttaaaaaaaaaaaaaaaaaaaggcggg

SEQ ID NO: 10727 - DNA, 704 bp, Sorghum bicolor
  Clone ID: SORBI-28MAY03-CLUS33921_1
acatatcggagcagttcaatcacacgaacaatctcaaacttgtagctcgggctcatcaattagttatggagggatataactgggctcatgaacaaaaggttgtcaccatattcagtgctccaaactattgctatcgatgtggcaatatggcatccattttggaagtcgatgactgcaacagtcacacattcatccagtttgaaccagcccctaggagaggtgaaccagacgtgacgcgaagaacaccggattatttcctttgagctgtcgatgttgccatttcccagcttgtgccgtgataatctatgtcaacatctgctggatcaagggccacacagaaataacaggggaatacaaaagcactatgcaaaacttgagggccccattgccattggtcagtgcaagagatgctgcaatcctgagctgagaaagcaattgtgccaagccatgcccgagtttcagctttcaggtgatatataagggcggccatccacttacaactcttgccgccctcccttttatgcactttttacagaggcgtggaattggcaaaaaaagactcaacttccatttgtacttgtgtagcgtaagcttgtaccaataggcgtgtactaatttgtatcatcattcatcaatggcaagccactgttaaacaccttctcatcagtaaattaaattttggtaaagaactggcttacagtgtt

SEQ ID NO: 10728 - DNA, 675 bp, Sorghum bicolor
  Clone ID: SORBI-28MAY03-CLUS33946_1
accatcatattaatagctagctatctgagtgatgttctttcaacattaggtggctggtttgctgtagcatcacccagtgtcatgtttgttctgttgggaaacattacaaattctcaattaaattgtgcagacttaagcaaggaggaagaagaagatgtacagttcaagcaggcttggctgatctatttctggaggagggctaaaaccaacagcgtggaagaagatattgcagaggagcgattgcagatgtggatcgatcgacacggccagcaaccaacgtcacatgacgctgtggatgtcgagcaaggcatccacgagctgaggaagctgggcatcgagcagctcctatgggagctctcccgccatgaggcgaacctcacgaaagacgaaccgtcggatgtcgaggacctgacctaacagcctcagcggacgacggcgaccatcttccgaattgcagttcagtcactcatatatttgtatatcatacagaaaagagaaaactgggacattgtaaacatttttgtggttttggttttcagctttgtcacaaaatggttcattgattctttccccccatgtacataacttccaccctacttttgtgttagtaaaaagcagcttgaagtgtgcaaaaaaaaaaaaaaaaaaaaaaaaaaaaaaaaaaaaaaaaaaaaa

SEQ ID NO: 10729 - DNA, 964 bp, Sorghum bicolor
  Clone ID: SORBI-28MAY03-CLUS35692_1
gcacgagagcaaatcaaggttcgaatggaacccattgctagcaaaggaacccacaactcgtttgcagagttggctcaagcatgctacatggaacgtgtggatctatctgctcatgggttttatgctacacctaatattgggtttgactggacaattggcaagggaactccgttcaattatttcacatatggagctgcatttgcagaagttgagatcgacaccctaactggggatttttacacaaggacagctgatattgttatggatcttggcttttcaattaatcccagcaattgacatcggccagattgaaggagcttttgtccaaggattgggttgggcagccatggaagagctaaaatggggggatgataaccataagtggattcgacctggacacctcttcacctgtggtcctggttcttacaaaataccctctgtaaatgatatacctctaaatttcaaggtttctctattaaagggggttccaaatccaaaggctattcattcttccaaagccgtgggagagccaccatttttcctcggctccgctgtcttatttgcgataaaggatgcgatctttgcggcaagggctgaggaggggcacttggagtggttcccactcgacaacccggcgacaccagaaagaataagaatggcgtgtgtggattccattacaaagaaatttgccggcatagattaccgacccaagcttagtgtatagcggctgctgggctgattatacggaagaataaattgtgaatagaagcccacgcttgtaaagtttcatgctcttgtgctagaaataatggagggacggtttagggttactgaacatcgttcagtgcctgaaaatataggtggaaaacaatatactactcctgtatgtatattgtaactgttcggatttcccacagatggcaactgtacaaatcccattgggttttgccaaactcatgctgcg

SEQ ID NO: 10730 - DNA, 712 bp, Sorghum bicolor
  Clone ID: SORBI-28MAY03-CLUS35794_1
catatgttggtggtgttggcctgagcttacttcaattctgcaatctaaacagctttaggaccaagttcatcatggggtttgctttcttcatgggcttatcagttcctcagtacttcaatgagtatacagctgttgcaagttatggtccagtgcacactggcgccagatggttcaatgacatgataaacgtgccattctcgtcaaagccgttcgtcgctgggttggtagcctacatcctggacaacacccttcagataaaggaaagcgcggtgaggaaggacagaggcaaccactggtgggaaaagttcaggagcttcaagaaagacgcgaggagccaagagttctactcgttgccgttcaatctgaacaaattcttcccttcggtctgatctcaatggcgctgctaaatgaattctggaaccaaaccgttgttcatatgtgaacataattctgctggtctggccagtggaagcttcttgtcaccaatgttggtcaattttgtgtattttcggacgagatggagtaattggacagtagaattattaggactgaagtatattacgttcttttttgtgatctacatggatcagcgtctgataatctggttgtagtttcttttgtcaagctggcaatgtacatcagtattacaacttatgtagcttttcatagccgtggccgaggttgattgttgcttgtgtgtaagttgttaatt

SEQ ID NO: 10731 - DNA, 676 bp, Sorghum bicolor
  Clone ID: SORBI-28MAY03-CLUS35849_1
cactggcacctcaaaggtaccgttggaaggttttagtgcacttcaagggatctctgggccccaaaggtttcagatacacaaggcctacggcagcacgaatcatctgccttcagctcatacttgctttaaccaactagacttgcccgagtacacatccaaagagcagctccaggagaggttactgttggcaatccacgaagcaaatgaaggtttcggatttggctaatcagtcatactcgtttgtccgtgcctatccgtgagatctgtatagatactgagaattgcaataggcgagcagcacgtgtgtgctgatttccttaccaaattctgaactccacgtgtgatgagaggaatggacggggggaacatgtccaggatagaagaatgtccgtgggggaggtactgttgagagatagagactattttgtgttcataatattcattactcttttagcttctttcggtcgtcggcccctttcgtagtttttgcctttcactgttgctccgaagatttttccctgcctttcgttcatagactggtgtacgttgtaacccaacagtatgtcaaatgcaagtcatcttacgcagcaattttacatccgcctaatctgttgaaactactgtaaattcagaagccatatttatttcccaataatatacagcgaaaaatccccgt

SEQ ID NO: 10732 - DNA, 1079 bp, Sorghum bicolor
  unsure (1)..(1079): unsure at all n locations
  Clone ID: SORBI-28MAY03-CLUS3616_1
gcacgaggcgcgagccttttctttccttccttcgcatcgaatcaaacccccatccatcccaaaaagagaccccgcaatccccaatttcacgcgcagcggagaggagggagggcagtaggattcgtcagcggctcgccggcccggaatcgcagccgctgctcggatccaaggaaaccagtcgtcttcttgctccaccgcccgcccgcccgccgccatgagcttcatcttcggcaagaagaagaccccagcagagctgctgcgggagaacaaacggatgctggacaagtccatcagggagatcgagagggagaggcagggcctccaggcccaggagaagaagctccgtcacgagatcaagaaggtggccaagcagggacagatgggagctgtaaaaattatggcaaaggaccttatccgcacaagacaccaaatcacaaaattttatgccctcaagtcccagctacaaggtgtatctcttcgtattcagactctgaaatcaacacaagcaatgggtgaagccatgaagggtgtgacaaaagccatgggacaaatgaacagacagatgaacctgcctgccctgcagaagataatgcgggagtttgagatgcaaaatgagaagatggagatggttagtgaggtgatgaacgatgccatcgatgatgccttggagggtgacgaggaggaggaagaaacagaggagcttgtcaaccaagtccttgatgaaattggcattgatgtcaactcagagcttgtcaaggctccagcgactgcagttgcaaagccagtcgcagctgggaaagttgctgcacaagctgaagccgcaggtgggccagatggtggcatagatgatgacctacaggcacggcttgacaacctaaggaagatgtgatcactggagcctaacaaagtttatccacacgctttgtttgtaggtttgtaccataaaaatatagccatatcatggcaaattcttttttcgtatctgagttgcagagtgtttggcattgcccattgtacatagaatatatttctagcaccctgcactaggctgtgcgttntgttnccaaagttnccaatgc

SEQ ID NO: 10733 - DNA, 701 bp, Sorghum bicolor
  Clone ID: SORBI-28MAY03-CLUS34632_1
cctagttagatacaaagccatgcggatgcttcgtgggaacgagtctgctctgttcctttcactctgccaggcatttatcgaggttgcatacccttattgcactgcatgttttggccgatgctacccgaatggagcaacattgatctctgagtgtcagggcacatttgatgctctccgtcagctattgaccgtgcctgcaagatctaacagttccagcatcgaaagaaggcagtcaggaggcatggaacgaaggcagtcaggaagcattgaaagaaagcagtctgttgagagcactgggacagcagtaactgataacgggctctcagccgatggacctgggctagagaccaacgatgctgttgcaaccaccaccccaccggtagaggacggtgtgagtacccatccactggcaagtaagtagcttggatctccgtttgaatctgttaaagcccttgatcatcaaggcctggtttagtcaaccagaaaagagattgctgcaaagattatattcgatgagaatcatgaagttttgttcctggtcctacagtgtacacaagatctcaccggatgtttgtaatcactcgatgccattaaattttagctgttcattgttatattcgatacctagatgttgtagagtgtgtccatcctgaacattcaataatctgataaatacaaactgtgttccctgaattgcctcc

SEQ ID NO: 10734 - DNA, 626 bp, Sorghum bicolor
  Clone ID: SORBI-28MAY03-CLUS34476_1
ctactggcaaacgcccccgtatcgtcggttcccctgagcctagggtttaaccagcaaacgccgcgcttctcgaagcatgtcaccgccgtcgtcgctcaagcacctgcccccggcaaccgccgccgcggcctctccgcgcgcggtcgccaccccgagagccaccgggattcgcggcctctgtgcactcccgacttggcgcctccggtgctcagcctccgccgccgtggccgccaccgagatggttggtgctccgctggactgggcggggaggtcgctggaggagttgcgcagcttgccggaccacgacacgttctgcctgatggcgctctcgccgctggacgggcgatacgatcgcttcgtcaaggagctgatgcccttcttcagcgagttcggcctaatcagataccgtgttctcatcgagatcaagtggctactgaaactttctcaaattcctgagatcactgaggtgcctcagttcagcaaggaagcccaggctttcttgaatgctattattgaggatttttgcattgacgatgcaaaagaagtaaagaaaattgagaaagtaaccaaccatgatgtgaaagctgtcgaatactttctgaagcaaaggtgcagctcaaatccag

SEQ ID NO: 10735 - DNA, 1162 bp, Sorghum bicolor
  Clone ID: SORBI-28MAY03-CLUS34639_1
gcacgaggttctaagtaaacctgatggtgatgtttttaccatgattgcttcaagatgggctgataaagaagaggctttgatatcttccaaagagagagagaacactaaaagattgatatacggcatcctttatggaatgggtgcaaattcccttgcagaacaacttgagtgcagcactgaagatgctgcacagaagattcaaagctttaggagattatttcctggtgtttcctcatggttacatgaagttgtgttatcttgtcgccaaaaaggatatgtggagactttattgggccgccgacgttttcttacaaaaataacggctggcaatagcaaagagaaagctaaagcacagagacaagctgtaaattctatttgccagggttctgctgctgatattatcaaggtggctatgattagacttcattcagtaattaccaacagaactagggcaactgattccacagatgaagttacaagaaaattttcagaatttggtggccagtgtcaccttattttgcaggtgcatgacgagttggtattggaagttgttccatgcatggtagcacaggctggaaggctgttacagatatgtatggaagaagcagcttcactattggtacctttgcgcacaaaaataaaggtgggaaaaacttggggttcactagaacccttctatcctgagccttgttgatgcaaatggtgaatgtcacttggagtaagctacatggatgccaatttttcatgacatgcaagggcctagatgatttttctgtaagaaggctgaacaagttccaatatgccccactgggaccatgtgtccagctccattactgagaatttgctatggacttgtggttatgatggatggtccatgtggtatgccagaagcaattatatatatctaggccttttgtatatcatatcaccaatagatgctgtcaaagggcgtgctggcatctcttggaggtgcatttggtttgatggatatcctcatggaaaagggatgtttggttcgcttacgagttggatatagatataggtgttggtatccctgccaccaaaaaattgcctagcgagttcatccatgttttgtaatctgtcattagcaaaaaaattatggattattggtttgatgatattgttacttgtaattatgata

SEQ ID NO: 10736 - DNA, 726 bp, Sorghum bicolor
  Clone ID: SORBI-28MAY03-CLUS34649_1
ttccaaacagtgtaggtcttggagattatgtcatcgagtatggggatgatgaagcgggagatgactatgaagtttaccacagggttagagcaaactggtggacatcctgtattttttgcaaagcattctgtagatcttcaggaggaggtcgaagaaggacaagatcaagggaaaggagaagtagtggaacaaggagcagcaacagatctagtcaagaaagctttactcttgaagtgcccacaagatctgttgacatgagagaaatcagatttgatgaaattgatgatgaatatatagttacaggggccatggctagggctgctgtgtcaaggagaatggctgctcattacagggatcccagatttggacgccgcattcctaggatcatcaactaaggaaagctgtgctgatgtcagatgcaacaaaaatcagaaccgttctacctctgttcatttctatttccttttctttttttgccttgaaaatgaaaaggaagaaatcactttaccctgtgggtggtactggggcagcccaaacttgatgtacagataagatagcagtaaactttttcttactgttgattcgctgcaggtttcaccattttaggttctttggtgtaaatatttagtttcctactaccttgtagcaatgctgaagatcagtttcctgtcttggaaatccttgtatctcaaattgcttctctgaaatacagccaacttttatagc

SEQ ID NO: 10737 - DNA, 1066 bp, Sorghum bicolor
  unsure (1)..(1066): unsure at all n locations
  Clone ID: SORBI-28MAY03-CLUS3468_1
nggcgggaagacgaaaacaccaacgccgccgcctgccggagtggaaagggggaaaacccgcagccatcgcaatcccacccatccgatttcaattcgtcagtggtgcccgcagcggaggggatggcgagctcattctccttcccgctgtttacgccggcggatatcgtggcggcgctgcacagctacggcatcgcgcccagccctagcttctgcgccgaggacgtcgtccaccctcagcccggccttctcgccgaggtcctncagctcttcctcctcaacttcgtcggcgacgagcccgacgagcagctacagttcaatgccctgcaggtgctcgacaacccggagcaccacatgcgcgccctccggctcccgcccgccgtctacgccgccggcgctcgccgccgcgccgcccagctccggcaccgcgccctccccgacctcctccgccccggccgccccccacgcggccacatcctcagcgccctcatccactttctcttcttcaggcaagagaagctcaccttgctagagcctatcgtcgaagagtacggcgcgattgagaaacggcagggggagctcagggctaagatcgccgagcttagcaaggcgaaggaggaccatctgcttaaggagcaggtggaggcacacatggtccagcagctcgagaatgaggtcaatgccctcaagcagaggcttcatgattataacagagagcagctgtcactgcgcaatgcatcaaaagccttggacgcctcctccgcgccgacactgtgcaagatcaaccaggctgattttgagttggtgaaagttatgcaagaaaagaaaaagctatcagccaaaattgttcattcccctgaaaagctccagaggaaccttgaggagaagaaatcagtccgtgatgagttaaagaacttagagaagatagcaatgcagaaagtccaagagaaaaccaatactcttgagatgtatactaaggtttctgagaaactagcgaagcatctctctaaaatatctgctgtacatgaaaagagcgctgctgctaaagcttttgagaaggatgttaaag

SEQ ID NO: 10738 - DNA, 870 bp, Sorghum bicolor
  Clone ID: SORBI-28MAY03-CLUS36377_1
taatgcacaacgccgcattggtaatgggagcgatccatttctggaggcaaacagacgagaagcagctaaacaagaagcagctgccagaagggtccatccaacactgcatttacctacccctgcgcagcccatggcacaaatcgctgcaccagctacaactacaagccaaccgcagcaatcttcctttccatctgctgcgacttcctcaagtgccttgtcaacctttagcactccggcttctgctccatcttcatctagtctctttgcaactccaacaactccagctccatcaggcaacctttttggtgcatctggatcggctcagttgaccacaccatttgggacagcctccactcctacattaacatcaacaccagctcctggatttgggactagcactacatctttgggtggaacatctctattttctacaccattcggaggtggagctaccgcttcaggttccagctttggtggggcaacgaaaggaaggtcgaagccccggagtcgacgctagatgtagatgaaccaatgtgaaatgtggatgctattggttctcttgactgttatttcccctatcttatgcaaaatttgtaactaattctagtgtgagttttaagtaacttgttgcatgcttactaccttaactgttttatcagatactaccgtactctagttgtcataaagttctaatccccgtgtccgttcataatcttgcctgaataccgagtgttgaactgcaaccttaagatgttctggattgtaaaagctggtcccttttagataaggtagagcggagtctgttgaatgtgggattgttaaaagctgggtgataaaggctgtaatcttctactatgattcacattgact

SEQ ID NO: 10739 - DNA, 721 bp, Sorghum bicolor
  Clone ID: SORBI-28MAY03-CLUS3665_1
cagcttggcaaagcagaaatctccagttagacaagaagtgtccacatcaaaagatgctgtgttcgccagttcatctattttgggtcggtcaagcggatcgttgaggcgtcctgctgttcctagcagccgagttccaacgagtgaagctttactacgcagtcgtacaccagatggaagcccagggtctttccaaagaaatgctcctacacataggacctcacagacccatgagtacttggaccgctccggagtttcgttgtctggcaggctcatgcccaacaccaagcattatgagtccactctaaggagcatccaaggcctaaatgttgatgccaatgataggatccactactagcatcttgtggatcccatggacgtgtacaatctatatgatatcttgaagtccagatgaagagcaagtatgtaacttccaagctacctgctggaggagcaaggccacttgttgacccagcactgcactctagttggcgaaataaagggctgtctgtgttctggagcagcttttgtcttaagaaatggcatcatggccatgttttagctctgtacaggttctgatttgtccataatgtgcttgtggattctggtttagcgttttccacatatataatctctcttctcgagctgtgtcagctcggtcgtgcaccgtttgctcctttctgtatgcgtggaattcgtaagtaatctaaggtgattatcattc

SEQ ID NO: 10740 - DNA, 1183 bp, Sorghum bicolor
  Clone ID: SORBI-28MAY03-CLUS36762_1
ctactggatctcgccttccctttcttcctccctcccgctcctgacccgtaacctcaccaaggccaacgagggagagagagagagagagaggagacaacaacaacaacaacaacaacaagccaacaacaatggcgacgctgcaggacctgggcgtgtccgccttcatcaacatcctgagcgccttcgtcttcctcctcctcttcgccgtcctccgcatccagcccgtcaacgaccgcgtctacttccccaagctctacctcgcgcagaagcgccagcacgaccacaccgcccgctccgccgtccggcgcttcgtcaacctcaacatctgcacctacatcaccttcctcagctgggtgcccggcgcgctccgcatgtccgagacggaactcgtcgcccacgccggactcgactccgccgtctacctgcgaatctacaagctcggtctcaagatatttttgcccattgcaactctcgcccttctggttcttattccagtcaatgtatctggcggcacattacttgatctaaaaaaggaagttgttttcagcgatatcgataagctttctatatcaaatgttaaccctggatccaacagattctttattcatctcttgatggcatatgtgttcacattttgggcatgctttatgctgtacaaagaatacagcaatgtagcatttatgagattgcatttcctggcttcccagaagcgttgtgcagatcatttcactgtgattgttagaaacattcctcgtgtctcaagccattcaacttctgaaacagtggacgagtttttccgaagaaatcatccagaccactatcttggtcagcagcctgtttacaatgcaaatcggtacgctaaactcgtgaagcaaagggagaggcttcaaaactgggtggattactacgaactgaagtttgaaaggcatcctgagagaagaccaacaggacggacaggatgccttggtttctgtggcagggaagtggatcaaatagactactaccgggctagaatcagcgagcttgagaagaggatggcatcagagcgccagaaagtcctcaatgacccaaaagctgttatgccagtttcctttgtgacatttgactcgagatggggtgctgctgtgtgtgcacaaacacaacagtcaaagaacccaacccaatggctgactgattgggctcc

SEQ ID NO: 10741 - DNA, 592 bp, Sorghum bicolor
  Clone ID: SORBI-28MAY03-CLUS36808_1
ctgctgaagtgtcgcgatcgcaggaggatgttgatgtgcatactacagaggtggcgcgtggacctgcagtggcagcttcagtgcagcgggcaacatgctggaattgctgcggcctttttgatgcatttactggttcagggagatagatgaagggttggaatttgaagtcaagaagttcagttcaaagctgataagcagttgtaactagactctgtttgaatagtcacatgaatgatgaagcagaaggatttgggataacatcgagctgatgtctctactttcttcctccctgtgtctctgcatctgtgcaaagttacacggggtcgtggttaatattcttaatttccttagcatccccaacacctagccccctttgtctagtgtcgtctaggtactgctgtccttgtagcataagagttgaagtgggtcgaccgtaaagaaattttgctgtttctgcctttatacttattttttctggggcatcgtctgctatgcccctttctctcatggttgtgacttgtaaggagtatatttgttcgaacaatttgagatggttctttgaaatagctacaatccgagattgctgagtgtc

SEQ ID NO: 10742 - DNA, 744 bp, Sorghum bicolor
  Clone ID: SORBI-28MAY03-CLUS36850_1
gcacgaggggatctcaaaagtgcaaactgcctggtgaacaagcattggactgtcaagatctgtgactttggtctatctcgagtgatgattgatagtcctatgactgataattcctctgctggcaccccagaatggatggcccctgagcttatacggaatgaaccttttacagagaaatgtgatatattcagccttggtgttatcatgtgggagctgtgcacattgagtcgcccatgggaaggcatctccccagttcaagtggtgtacgcagttgctaatgaagggtcacggcttgagattcctgaaggacctctcggcagattaattgcagattgctgggcagagcctgagaatcggccgagctgccaggagatcctaacccgtttgctggactgcgaatacactgtcagctgaatggaagctgcttgctcagccacccaattcctgcacaggtgaaaacatttcttgtataaaacctgtaaaaaaaaggctgccgattctgcggactcgaggtcacatattgaagccctgtgtttttttttgcaacgacgaccctttctcccaaaaatgtaaaaaattcttcccggttatagaagaacatgtctggttcgagaaacgtgccttgcatcgcagggcaagctggttgttgtaccttattctagataagtagcatgccctcgaatcaacaagtgattgttccgcaagaatgttgccggtactctggggaatggggtgggatggtgc

SEQ ID NO: 10743 - DNA, 670 bp, Sorghum bicolor
  Clone ID: SORBI-28MAY03-CLUS34905_1
gtgtatgaaactttacggtcccattggcaagtagagaggccatgtgattcccctgtcctgatcagtttggcttgtggaagtctttcaggaattgcatcgtcaacttttacattcccattggatcttgtgagacgccgcatgcaattggaaggagcagctgggagggctcgtgtctaccagacaggactctttggaacctttggacatattgttcgcacagagggttttagaggcctgtatagaggaatcttgcccgagtactgcaaagtggttcctggtgttggcatcgtatttatgacatacgagatgcttaaggccatcctcacaggactggaatctgatgattagatctctgcagttctgtcatgccctgcaattttgatatatggtgtcagaataacatttgaggctgattagagtgggagaaatatgagcatgtagcatatgttagggtttaggacgtgctaagttttgcagtttgtgttatatggttacagatctttatgtagtgcaccgtgaaagatgccataggtcttccaaaaagaatttcttttcacctcaccatcattttgtgtatctttcacgactttcacattgtaatggtacatgaagttgttgtctttggcctgatgatcttcatacctgtgagatatggtctcccatttcacca

SEQ ID NO: 10744 - DNA, 720 bp, Sorghum bicolor
  Clone ID: SORBI-28MAY03-CLUS34915_1
cactaaactccaggatcttgtatcatctcttgagccactattgcggaactctagtgagcatcggcgcaattatttggttatcaaaaacttgattttccgggcaaacttgcaggtcaaggaggatctgtataagcggtgtcaagctgtcgtcaagatcgatggagatagtatgtgttctctttgccataagcgtgttgcaaatagtgcttttgccatttatccaaatggacagactttggtgcattttgtctgctttaaagaatcacagcaaattaaggctgtgagaggagcaaactctctgaaacgaagataacatggccatgatccagagtagcatggtgtattggtcaaatcgggtatcctcatatttgttaaaccaggtttggttggtgtcagcttatggaattccttcgttgtcttcacactggatttgagtggactgcttagttttaactggagtgctcttcactctcttcagagattgagtttatataaccgtgcgtgtgtgctcgctctctttgttttctgagtgtaatggaaaacagggaatccccttgcttttggttttcatgtatagaatgtaaatgatactgtaaagtttcaatcagcagattgatggtcttgattatagtgttgtaatgtgtggtacaataggtttgggcattatattttgtttgcttacaaccctcattaatcatttcttatctgtaaaattttttt

SEQ ID NO: 10745 - DNA, 993 bp, Sorghum bicolor
  Clone ID: SORBI-28MAY03-CLUS35323_1
gcacgaggctgacaaggactcaatcagccggtacggtgctggtgaggcgcatgacgaagtgcgcaaggggaagcccgtgtccatgaagaagctctactccatggtgcggccggattggttcttcggcgtgtcgggcaccatcagcgcctttgtggccggctcccagatgccgctcttcgcgcttggcgtcacgcaggcgctggtgtcctactacatggggtgggagaccacgaagctggaggtgcgcaagatcgccgtgctcttctgctgtggcgccgtgctgacagtcgtgttccacgtgatcgagcacctcagcttcggcatcatgggtgagcggctcaccctgcgggtccgggagaagatgttctcggcgatactgcggaacgagatcgggtggttcgacgacaccagcaacacgagcgccatgctatcgtcgcggctcgaggctgatgcgacgcttgtgcgcaccatcgttgtcgaccgctccaccatcttgctccagaacatcggtatgatcgtgacgtcgctcatcattgccttcatacttaactggaggatcacgctggtcgtccttgccacctatcccctcatggtcagcggccacatcagcgagaaaatgttcatgaaaggctacggaggcaacctcagcaagtcctatctgaaggccaacatgctcgccgcggaggcagtgagcaacatccggacggtggccgccttctgctcggaggagaaggtgataaaactctacgcggacgagctgaaggagccttctaagaggtccttccggcgaggccagggcgccggcctcttctatggagtctcccagttcttcctcttctcctcttacgcactggcgttatggtaaagcgtatattggatggaacacaatgaaatctagtttttggtctccatcgaaacgtagaattgttccaaaattcaggtatggttcagtgctgatgagcaaggaattggccagcttcaagtccgtgatga

SEQ ID NO: 10746 - DNA, 985 bp, Sorghum bicolor
  Clone ID: SORBI-28MAY03-CLUS35514_1
gcacgaggcccacccccaggcccccccccagcagcggcggcggcgccatcaccagcgccagcgcaggcggaggaggccccggcgacgcggctgggcgccgttactggtctgctgctcttcgtcagcggcgtcccttcctgtcaagctaaggtcttccagcgacaaaggttactaggaggttaccatgggtctggataatacttatggggagctatctggcatgttctgtggaggcctgtcttatgatggctacatagatcacagcagcggaagtgattatttcaggttcaccgatccacttcctgtggttgtgccccagatgacagcagaagcttgttcaaatccttcctccactgtgtcaagggccaacactgaaactgacaacccagaggattgggaattcatctcagatgagtccctcaactatattagccggatgctcatggaggaggatatagatgagaaagtcagcatgtaccaggcggagtcagcggcactgcgtgctgctgcaaagccgttctatgacattcttgggcacaagtttccaccgtctcctgatcaccagccgatcccttggtccatggacagccccagtgagagtagcagtagcatttgtacacaatctattgcaagtagtgtcactagcagcagcattggtggcacagtggatagcaactggcgctacgacgttggacgcagtgagcagttggaagcttatcaaggcttgtgtggtcagtcttctcaaccgcttgttggtacatctagtgatgcttccaatgcagtggatgggctagatgaccctttgatcacgaatggccagatccctgagtatttgtttgagagccttccaacttgggatttcaggagaggtattgaggaagcccagaagtttcttcctgttagcaatacactagtgattgatttagaagctggtggtatcacaagacctcaagaagcaaggaaagatgtttctttgaatgccaaa

SEQ ID NO: 10747 - DNA, 876 bp, Sorghum bicolor
  Clone ID: SORBI-28MAY03-CLUS35437_1
gcacgaggccctcccaaaggcgagtccgttagccaagaatcccggcaacaatgacctccctctcctccgccgtggcactgccgtcctcgtgccgggcatgcccggcggggggcaggcacgaggcgcggatggtggtgacgcgcgcggcggcgtccagcccgaagctgccgaacgggcggcggctgcgggtggcggtggtgggaggcggccccgcgggcggcgcggcggcggaggccctggcgaagggcggcgtggagacggtgctgatcgagcggaagatggacaactgcaagccctgtggcggcgccatcccgctgtgcatggtgtcggagttcgacctgccgctcgacctcgtcgaccgcaaggtgaggaagatgaagatgatttcgccgtccaacgtcgcagtcgacatcggccgcacgctcgcgccccacgagtacatcgggatggtcaggcgcgaggtgctcgacgcctacctccgctcacgggcacagtccgccggcgcggaggtcgtcaacggcctcttcctaaggtacgaggcgcccaaggagccgaacggctcgtacgtggtgcactacaaccactacgacagcagcaacggcaagatcggcggcgagaagcggtcgttcgaggtggacgcgatcgtgggcgcggacggcgccaactctcgcgtggccaaggacatgggtgcgggcgactacgagtacgccatcgcgttccaggagcgcgtcaagatccccgacgacaagatggtctactacgaggagcgcgcggagatgtacgtcggcgacgacgtctctcccgacttctacggctgggttttccccaagtgcgaccacgtcgccgtcggcaccggcaccgtcacgcacaaggccg

SEQ ID NO: 10748 - DNA, 786 bp, Sorghum bicolor
  Clone ID: SORBI-28MAY03-CLUS37490_1
tcgccttccattccccgccgcccaatctcacccctcgccggccgagccccaaccctaacggaacacacacctgcttgcggcggcggcggcgccggggagcggtcttacgcgtcgggcgtcgcggcggcccagcggtgtcagatccgggccccgcgccgttaggttgcgtgattcgagctaagcagtgttgggttgtaacatttgtatcacatgagcatctcagtgttaaaactgtgagcatattaattccccttctttaagcaatatgggagctaattgctgcgttgctgcaaaggagaggacacagccatgcatcactccaatagaagtatcagcgtacaggaatgtgaggcactcgccatcatggagctttcgatgggacaatcgcacacatatagaagacataatggatatccctactctgttctccaaccatagtagtggaagcattcggcctgatacaaagagtggttcaattgccccaactgaaggattttctaatggaaatagccgtggaactagcccttccaatgtgtttcacggagcaaagtggcacaaatctgataaaaaaacagaagcaccgaaggttacaaaggttgatcctcgagctgaccgcaccacagcaagtaactgttctcctgaggcaaagctttccaggaaatcactggacatgtcaagtgttgcttcagatttgaagacatcagtatctgttccttcaacgccacccttagtatccagagcagatccatcatcctccagggggcattctcaacctacagattcaga

SEQ ID NO: 10749 - DNA, 828 bp, Sorghum bicolor
  Clone ID: SORBI-28MAY03-CLUS37743_1
gcacgaggtctgtttcgtcaccagggaggagagatccatatggaagaaaagaacatgaggtccagttggcaagtccggagaccaaacggaaggatgtaaacttacctgggatttcaccaatttcgaacatattgagaaaggtagagaaagtgtctcaggacattcctaaacatagaaaggtaacacatcatgaatatgaagttgagactgcaaatggaagaatcacaaagcgcaggaaaactaggagcactgtcatgtttggtgaaccgaacactcagaaatctttgcataatactgctgacaaagatgttacaaaaataaaaaaggttcctacaggatcccatgcacatcctgcaaaccttggtgaattattctctgagggttccttgaatccatatgctgacgacccttatgcttttggctagaaggtgataacttgtttgcgttcgaaaaaagctcacacctggaagtatcatctttgcaagcacgatgacgaaatctggaacacacaatttacctccaccgtgttgaatcaataatcctgcaaccattccctggttatctgtccatcctagtgtacatgactgccgttcactcatgtgtctgaagcattgctaccgcaataagcatcacgattgtctgattttttttagattaagacgattgtctgccatgtaggtcatttgtgaatgaacagtacacgtgtctgatataaatatgccgtcggtatgtttctcagataaaacacttaccagcctcagcatagcggtatgtttgtctgatgtgccgtggaccgtacatttgtgaatgaaccatacatttgtctga

SEQ ID NO: 10750 - DNA, 711 bp, Sorghum bicolor
  Clone ID: SORBI-28MAY03-CLUS37832_1
agtaagagctgattgccactttgtgtgcattggaaagccactgagttcgtcgtggctacatgataccatcctaaaggaatctttggatagcaaggggagagtaatggtggaaaatgatttaagagtgaagggttataataacattttcgcgattggtgacatcacggatattcctgaaatcaaacaagggtataacgcccagaagcatgccctgctagtggcgaagaacctgaagttattgatcaagggtttgcctaacagcaaactgtcaacttacagcaccggttacccgctggcactcgtctctcttggaaggaaggaagggctggctcaaattccctttctgacgatctgcgggtgcttgccaggcaagatcaaatccggcgatcttttcatcggcaagacgaggaagcagattggcctgagtggttgactccggtccgtggaagtttgaaaatgcttgcgtcctcgttgtttacagacgatggattccttcaaacaaagcttgtgtgttgttcatatgaccatatgcctctgtattcgtctgatggtgtggatgcttggaatggtgacgagcagaatgtatgctacgtacatgactacatgtatacatggacctttttgcttcgatgaatcttgtgtttattaaaaagccgcattttgtttgctggcaactaaacaatgaatcatctttgcttgatggcaatacaa

SEQ ID NO: 10751 - DNA, 942 bp, Sorghum bicolor
  Clone ID: SORBI-28MAY03-CLUS3794_1
acgcgtccaggagcatcaccaccgcaccgcggcagctgagctcggcccccaggattcagaatctccgaggcgcggcgacgggcggtcggcgacatggaggccgcggtgcccagccgtgttgcgctctccgcggcgagccgcctcccgaatcgccacgccgtggcaggagatagatcttttgtttacaagggaagatgccagagtcttgcaattcctatggcgctgtcagcagctgcaccaggcaaagggggtgtgcttgatcggccagtagagaaaactactcctggtcgtcagtctgaatttgatgtgaagaaatcccgcaaaatgtcgcctccataccgtgtcattctgcacaatgacaactacaacaggcgcgagtacgttgtccaggtcctgatgaaagtgatccctgggatgaccgtcgacaacgctgtaaacataatgcaggaggcgcatgtgaatgggctgtcagttgtgattgtctgttcccagtccgaggctgaggagcactgcacgtcgctcaggggcaacggcctccgaagctcaatcgagcctgcgagtggtggctgctgaggttcgagaaatgggtgtaccttgttttgccgcgtatagtttgtaaatacccagcatatcaaagataaactgaaacaggttggttacatgcagttatcgatacaacgaagctgagtatctcttgggtaggtgtaaatcatgcaagcgtaccaacctgtagaagaagaaacatagtattttcggttatgattacgatttactccaaccgttcaagaaagagtcactatgggagtcaagttagtcaaactttctgagtttgactatatttgtagaaaaatattagcattatatctttaaataagtttgttatgaaaatatttttagcgatccatactaagtatataccataaatattatatatatttggtt

SEQ ID NO: 10752 - DNA, 675 bp, Sorghum bicolor
  unsure (1)..(675): unsure at all n locations
  Clone ID: SORBI-28MAY03-CLUS3624_1
ngacttcacgatctcagtctcagctcgtcgcattctccaccacgcaccccagctctctgatattttccccctctccccccccgatcgagcagcgaagagcggataaaagcaagatgtcgaactcggacggcacggcgacctgcatcgacatcatcctcgccatcatcctcccgccgctcggtgtcttcttcaagttcggctgcggggttgaattctggatctgcctcatcctcaccttcttcggctacctccccggcatcatctacgccgtctgggccatcaccaagtagcctgcagacggaggctgtgtcccctgccattcagctcgcctcttcaaggcgatgagctgatgatgatgggggacgtggtgcgtgtggtgactccggccgtcgcgcgcccgctgtgaaatatggtgtcgatttgagatgtgattccttccttttctttgttagttgctgctgctggtgtcccccgtctccaatcccttttccatggggatttgagatgtgcctcctcagctgcgtcgtccgatccagttcctctgcacattcgatctcctccatgtactgcttcgattgatgctggattattaattcctagttgtttgtttaaaaaaaaaaaaaaaatttttttttaagagaatgattttatgatgagtggttataagatattttg

SEQ ID NO: 10753 - DNA, 821 bp, Sorghum bicolor
  Clone ID: SORBI-28MAY03-CLUS36265_1
gaggacctggatgctatgcttccgaagtgtgatgtgattgtgatcaacacacctcttacggagaaaacaagaggcatgtttaacaaagagaggattgcaaagatgaagaaaggtgtaattattgtgaataatgctcgaggagcaatcatggatactcaagcagtcgcagatgcatgttctagcggccacattgctggatacggtggtgatgtgtggttcccccagccagcaccaaaggatcacccctggcgctacatgcctaaccatgccatgacccctcacatctctgggactacaattgatgcgcagctgcggtatgcggagggtgcgagggacatgctggataggtatttcaagggagaggacttcccggtgcacaactatatcgtcaaggaaggccagcttgccagccagtaccagtgaccgtgcgagatgtcgctgcaatatggcttttctcgggagaagctgcgaggaagaaactgctgttgcgtcactgtatgagagtagctctgagaaacctgtcagcggccacctgcaataagaataccttgcttatctcaccgaggagctgagaaacctgtcagcggccacctgcaataagaatgccttgcttgtctcaccgaggtgatgaataagagtcatttttttcccttctctgtcaacgaactgatagtgttttggttgtcacatgatagtgttttggttcaacctgtgataacgcaaatggtaacgaactgcatgcgctatgtcatttgctgctattcccttggttttagcagattttgttccggaaagcatatttccagccagctgggtaggac

SEQ ID NO: 10754 - DNA, 722 bp, Sorghum bicolor
  Clone ID: SORBI-28MAY03-CLUS36280_1
gttggtctccgcgctcctccacgtgaggccccgatgctcgtgcggcctccggccgctaggcgcacggcgcacttctgcattgccgccggtgcacagtcttctgcccctgctccgtatctctccgaagtgagggcacgaagcacgagcagtagcctgcccatacgtgcacggccaactgcaacattgtctcgggtcgacgaacttacggccgagctgaatgaaacaaaggagtcgcacgcgcacctgaccgctcagcacgcgcagctgaccactcaggtggcgcagctgaccgctcaggtgacccagctcattcaaagcatggggcaaggacaaggtgtgctagcggctggacactacactcctcctccatcggcgggttcaaacgctaatgcaccaccggcggttgatcccgtcaatccttcaccgatgaccgggaggccaccctttgagtcttcgccacagtagcccgggaggccaccctttgagtctttgccgcagtagctatgttgaccttttaataatagagtgtcatgttgaactttaatgcattttgtgatggtcacagtagccacgttgaactttgatgcatttgtgcgggacatgtcatgttgaactttgatgtattcgccacagtacttgtcatgttgaactttgatgcaattgtgcgggacttgtaatattaaacttgtgatgttcaattttaatggattttcgatggattg

SEQ ID NO: 10755 - DNA, 962 bp, Sorghum bicolor
  Clone ID: SORBI-28MAY03-CLUS36375_1
gcacgaggctacgttgccttttctcttctcttatgacatcaacgctggaggcttgtgctgcccttctagtatcccaggttgcaactggtctgtgttttcgtttccggtcccgcagtggctgcattcccatttaagtgtgattgcgtttgcactgacccgctattgtccctcggtccataggcttgttggttgctcgagcttgccttgcggctgggcctacaagatgtagagatgatatataagttttcttgcactgtacttgtatacttgtagtcactgcgattatcagccactgctaaatgtttctttgcacatcttcctgttcatgaaaactgaacaaaaaagttatgttgattaatttcaatctatattaatgtaatttgcagatattgggcctcgctggccgaggtctgtgcatttgctttgcgagctgtctttcctgtcttcatgtgtgcggctcgctgctgcgagcagcgtccccttcctgtcacttttcacaggcacatgttaactctagttgcaacaagtttcatacatgcaccagccattttggtacaccgaagcacatacagatctttatgaagaccctcactagcaagaccatcaccctcaaggttgagtcctcggacacaattgacaatatcaaggcaaagatccaggacaattagggaatcccgccagatcagcagcgcctaatctttgcaggcaagcagctggagcatgctgtaatccaaatttgtgttgttgtctatagttttcgaaggcttttgctttgctttgcgtggttctgaccagataagatgctttgcttaccttatatacagaatactcattttttagtttaggaaacctcaatgattggtaaatatgctctagcacaatctcacataagcattttcatggattgcttatctggctctagcacaatctcacataagcatttaaatgaaaagcatatctgt

SEQ ID NO: 10756 - DNA, 684 bp, Sorghum bicolor
  Clone ID: SORBI-28MAY03-CLUS36287_1
aaatggagaagttggaccgaagacgattcacgtccctacaagtgataagctcttcgtgtttgatgctgcaatgagatacaaagctgatgggcatcataccatagtgttggctggagaggaatatggcagtggaagttctcgggattgggctgccaagggaccaatgttactgggggtcaaagcagtgatcgccaagagtttcgagaggatccaccgcagcaacctcgtgggaatgggagtgttaccgctgtgcttcaagcctggtgaggatgctgattctctggggctcaccggtcatgagcgctacacaataaggctccctaccaatgtgagtgagatacaaccgggccaagatgtccaagtggtcactgacactgggaagtcatttacctgcaagctccggattgataccctggtggagctggcttactttgatcatggcgggatccttcactacgttctgaggaacctggtgaagcagcaacagcagcagtaaaactctaaaaatacatgaaaatctgtgaatatttgcctatcttgtgtgtttcgaaaaaggctattgtgaggaataaaatcactcctgcagtttgtaaagtcaagccgatgtaaatgttcatgagctgaggctgagctgtgctgttttgtattaaaatttctgtgctaataaataaagatggtattggt

SEQ ID NO: 10757 - DNA, 715 bp, Sorghum bicolor
  Clone ID: SORBI-28MAY03-CLUS35610_1
cttctgggcggccagccgtcccgctcaagatgccgtcccctcgcggctgctgacccttctgacagagctgaatggaatcatcaattccaagaaagaccatcgtcttcccatcggaaggatgatgctgcagcaaacaaagagcttacagtggtgaatggcacaaagaagaacagaatccactattcgggaccattgatgcctcctggagtgaacatggatgagattcttagagagcatgagcgacagatccaacaagcggtgcgaagagcccgccttgacaagggaaagggaaagcacaacggtgagagagaccagtcagaggcactgctgtatactaccgggaatatcagggctgatcgctaataaagatcagtttggtgtcgacccccgagttgagcaatcatcaaaagcatagaaaatagcattgaatcctttctatttttccgtccccccctcaagtggagaggtttttgttttgccagaaactccactgctgatgcggtttggtacccaggaggccaggagggcagctgccaaaagaaaacctgttcctgtagagatttaccgcctgagtttagcataggctgtctgaaatattttctgaagatttgttggttatccatagtcgtcaattgtatttctccagagtactctccccaaaaatgaaaattgatccatacacttgttttggcatatgacaagatgaatacagatc

SEQ ID NO: 10758 - DNA, 765 bp, Sorghum bicolor
  Clone ID: SORBI-28MAY03-CLUS38612_1
ctactggggtgtttgtgttcccgacctccacccgccagggatagggacagagaccgggaggcacggtcgcacggagcagtagtcttcgctccggccacgtccacggccacgggagaagctctggccatgcggccctcaacggctccctctgctatcctccctccgcctacctgctcctcgcgtctttccccgctccgcagcttcatcggtctccggtggtccgccccccgtttccaggttagggagcgagccggtgcgtccgtagcgggtgccaatggcaagccgggatgcagcttcagactcggagtacttactttaaatgtttgtcaatcaagtcaaagggcggttgtcattagaaatgaacatggtcaaaatgctgactttccacggaaatattcaaaaagagagaagaaaccattccctattccagtgctggagttaaggcgccgagcaaaggagaggatgaaggcagcacaagggaaaccgaaacaaccaatgcctcccccaaaaaacggaatgctagtgcgtagacttataccagttgcatacaaagtgtacaatgcaagaattttgctgatcaacaacttgaagaggcttatgaaagtagtaccagtaaaaggctgcaagtattgcccggtgccccttctttatcgttgattattcattacaaactatgctgttgttaccctgggatgtttctttgttttttgatcggacggatctcattttcaataaaccaaggtaacataatatgatccatttaag

SEQ ID NO: 10759 - DNA, 644 bp, Sorghum bicolor
  Clone ID: SORBI-28MAY03-CLUS38536_1
tcttcctgatggagcgcgacatggacgaactccgccgccggctcctggccgtcgaagagctctgccgggaccgccacagcgacggctgcgttgtggacgccgccaccgccgccgacgaggccatgctctccgagagcgcggccgccgtcgcatcccccggcgccggcgccggcgaggaggccgacacggtggacgccatggccatggagaagtgaaaagcatacagtacccgctacctgaccagacaaaggccttctcggccgtactgctgaaactgtacatacggtttccatttccctgtgcagatgtcgctgtgaagagtaggaggaggaagaagaagcagcatcagctttagaaagcttttttttagagttactcttcgttcgttgcatcttgttagtttgatatcgtctagctttgatttcatttcatgttcttgtagaaagaatcagccatcggtcaggaaagagcgaaagcccgtggacgacgacggaatgtgcggggaggaacacgagatcctggtgtcctccacctgctcgtccagatcctcaaccccactagtcccaaactcttaccagcttttttttagtgcagccagtaacatgttgttttgttgtaaagaaaaaattgttattccgaaatgt

SEQ ID NO: 10760 - DNA, 746 bp, Sorghum bicolor
  Clone ID: SORBI-28MAY03-CLUS38638_1
agtgaccctagaccttcgcgttctcgtttgcgagccccaaaaattcctccccccccaaaaccccccgaacaagagagaattcggtgaaaggaggagggcagcggcgccggcgtccacctcgcagcaccggcgagctagccgcggcatccatgctcgcggggatctgaactagccgccgctgccccatcgcgccgacgactgcggcgccggcgtcctctcctcatatcccatccatccaaagcactcatttctccgtttcccacttccgaaacgccacctaaaaagagagggaaaggagagcatcgcagtgacacacgcgcaatggaaggctcgccggtgacgcgcctcccggaggctaacaccctacccgacggcttcgtccccgacgtcgagagctcaggcacggacgcggcttctccctcctccgcgcccattgctgctgatgcgctcgactccgatatccccgccgcgaccaaccccggcggtgaggaaaccctaagcgatctctcccttcctgcgtccgccgccgaagatgcctcctcggccgccgctgctgaagccttgggcacactttctctggccgctgctgcggagccggaacgcgctctaggggagcacggacccaccggcgctgcaagaggtgaagaaaccttgaaggagaactgcgcatcagagcaagtgggtgctccaactgctcaaaaggggagcggtgaaccaaaacgcaaggttgggaagcgtagcaagct

SEQ ID NO: 10761 - DNA, 904 bp, Sorghum bicolor
  Clone ID: SORBI-28MAY03-CLUS38663_1
gcgcggggcctggcgccctcggcggcggatccttgcagccgtggcccccaggcccgcccgctctgcactggcggggcttccctgaccgttcaactgaaacacatttcgttgggatcagtaagggcaccaaatccccatggggactccatccgcgacaatgctaatatgtatgcaatcttgctcgccaatgagcttctgagcatagagttgcagtggcaagatcagcgtgacactttggaactgatcctgggggtgtgggtggagatgtcgttgtatgctgcggatcattgcagccaagagtcccatgccaggcagctcagtaatggctgtgagttcattaccatcgtgtcattgctggcacaccacttcaagtactactctggggtcttcaggggcactgacaaccttggtgaagataaaccggcaagtgaaaataaccctgtttctgaaagtaatcccatgagtgaaaattgtggaaacttggtttagatgagtttccacaattttcatttgaaatggcctctctatccgttcagggaaaaaactgaggattcgtgacttcagaagagagtaaatatagttatctgtagatgaacatagtaattaaagtactggcattcgttcataacagcaccacatgcatcaagattacctttggactctccattcagcagtttatcgtaagggtcatgaccgtcgttgaatgttgattaaaaggctcagactgatggcgcagtgatgatgcagtgtgtcaggaccatgatcgcccttgactaatcccctctctctgtggatgtttgtgtctcacacagcggttaggcaaaccaccagtgtaaaatatgccattattatttttgtatacatgctgtttgagtaaccatgagaaatagatatggtatccacc

SEQ ID NO: 10762 - DNA, 700 bp, Sorghum bicolor
  Clone ID: SORBI-28MAY03-CLUS38677_1
tttcctagtattcttataacgcctcctgctattcttggttcagctagttgacccattgtgagtttataactgtttagacattaatgaaacttgacttcacttgtgcagaattgatgcacctatattcttataatttatctatccaatttatatgttttcatttgacaattttgctgctgtccttgatgtgtgttactcctgccaatcataatttcatacaattattattatgcttctagcaggccgtgaagcagcctggcaatgatagcgagcagtcagccaacttcaccagtgcggtgaagtccagggtgtctgatctgaatgatatatggatctgggtaccctagtcatcccatgcatattcgaagtggcgcttatgattctcactgcagaaatttccatgaagacaagactaatttgtaatgggctgagctacgtacaacaaactgctgctgggatgtaacctagatagtgcgaaggactccttttgtgtagtctgacatgctcctacaaactcaaatataagtaggtgctaaacttgctttgtagtcgactctgatcagtcaatggcacttgtatttagacggcttataaaaaagtgatcagttatatgtttattcagtgcaaatattttgatttctgggtggatgtataaatggtggcattgtgtataactgtatcctgattatgagaggtatag

SEQ ID NO: 10763 - DNA, 1091 bp, Sorghum bicolor
  Clone ID: SORBI-28MAY03-CLUS36938_1
gcacgaggtgggcttaaaagccccctttcagcgcggacactcggcgccgcctgcgttcttcttctttttctccaaacaagataatctatgaaggttgggtggcaggagtactctggctcggatcgatgaaggctccggatccgaagaagacaggagggtcgcagtagtactccggatcaaatcggatgaaaaaggcaagaaggcaggaggatcgaacaaagcactccggatcagatcgggttgaagaaggcaggaaggcaggagaatcgaaaaagcaggagttttccggatcgaagaaggaaggagagtttgaattcggatcgaagaaggaaggagagtttattcgattagaatctatccgaatcgagttgggcttcttcggatccggagtccgtttacttccgagcagagataagcggaggcggcggtataggaagcggcgtggaaaaagatcctattcggattcatacctggcttcttcggatcataaaacacagtcaccctcctgagcgcaaacaccaacccataccattcagatcctaccgttcggatcgatggatatcggcggcggcagcagcaccgagcatccaaggaaacggaaagcagctacggcggaggacgccgacgatgagcagaagtctgtaatcccggcggaggacgacgatgagcagaagtctgtaatcccggcggaggtggtggagggaagcaagcatgaggatggatcgatctacaggcccgacgagcacccccttcacagtctctatcaccttcacgaccctagagaaactcgcctggatcctatgaggctgacagacccaaccgatatatgccatccctgctggaccgtttgcagacaacatgtgggttgcgccatgatgcaaatcttctccctcaagctcagcaagctaccaagtggagcagcagcagcagcagccgctggcggcggcccaattcagctgtatgggtttatggctgtccgagatctcttggaccctctacgcaattacgtcttcaactacagcagagatgatcctttcatcatccatgacctccattcagatcccttcgtgtacctgtctggccccaggaga

SEQ ID NO: 10764 - DNA, 710 bp, Sorghum bicolor
  Clone ID: SORBI-28MAY03-CLUS37182_1
gtacagtgaagctatttggaaagctcgaatcaaagattaagagcaagataccaaaaaatgttgcagttgatatgaatccagatgggaacggtaataagcaccagaagaaaggtagaagagagcccaggttaggtacaagttcaagcatgaaggtcccatttagtcgtccatttttgaggagacatttctccattggatctcgaccacctcggtcagtctcagaaactgattcgacaagaaagaagggattctgggcaagacactggagagagtagaatagcttgcaattatcattaggtgggctggtctccattattatgttttggaaggatttttaagaggaggtgaactcttcggcgtgcaagctaatggagttcagactggcacaagggctgccgagcaaccaacatatttggaagtttctcccagccatcgtattcggttactggtgcagagcgcatggtagcgcaggttccagtaatccaggatactagaataacaaggtttcttataccatgcgagacagggttgttgtaggccccagttgcagctttagtaatagtagcattctaacagaaagtgtggccttcctgggtgtaaggcccaatgctgggttgcaagattatacataaccagcatgctagattatttattgtactcgcagcttttttatgattgattaaggtacttattgttcgatggaatgcgtt

SEQ ID NO: 10765 - DNA, 736 bp, Sorghum bicolor
  Clone ID: SORBI-28MAY03-CLUS37270_1
gcacgaggccagtctcccctacgtcgacgccgtcgtcaaggagaccatgcgtctgcacccggtggcgccgctgctggtgccccgcctggcgcgcgaggacacgaccgtggccggctacgacatccccgccggcacgcgcgtgctcgtcagcgtgtggtccatcggccgcgaccccgcgctgtgggacgcgccggaggaattcatgccggagcggttcctcggcagcaagctcgacgtgaaggggcaggactacgagctgctgccgttcgggtccggccggcggatgtgccccgggtacagcctcggcctcaaggtcatccaggtgagcctcgctaacctgctgcacggcttcgcgtggagcctccccgacggcgtgaccaaggaggagctcagcatggaggagatcttcggcctgtccacgccgcgcaagttcccgctcgaggccgtcgtcgagcctaagctgccggcgcacctctacgccgagccatgatcgatgcgtgcgtgattctgcagcatatagtggcctcttttgcgttgatgtctcgtgtgtgcgtccacttgctgctcctgttgttgctattacttctgtaatagtgtaagtaggtatttctcctagcttgcgtcgtgcgctgcgttgtgagttgtgacactacagtggaataatggtgtaaccaacccttatatttatttatacccagtatattttccccccaaaatataacagtgtgttgtaacg

SEQ ID NO: 10766 - DNA, 875 bp, Sorghum bicolor
  Clone ID: SORBI-28MAY03-CLUS37293_1
gcacgaggcacctttctctacgtcgacatcctcgacacgactggcagcctctacaccatggcgcggttcgccggattcgttgacgatgtgacgggggagttcgagggccagtacttcgccttcatgtccgacgcgacggccatcgtgtttggctcgctcctgggcacgtccccagttacggcgttcatcgagtcgtccacggggatccgggagggcggccggacggggctggcggcgctcacgacggcggcctacttcgcggcggcgctgttcatcacgccggtgctcgcgtcgataccgtcttgggcggtcgggccgccgctggtgctggtgggcgtcatgatgatgcgcgcggtggcggaggtcgactgggacgacatgcggcaggccgtgccggcgttcctaacactagcgctcatgccgctcacctactccatcgcctacggactcgtcggcggtatcgcctcctacatgctcctccactcgtgggactgggcgtgccatgcgaccaagaggctcggctgccgcaagaagatcggaggcggcgccgagaggactaattgcggcggggaagagcagaggaaggatatggaatccgcataacatttctttccccttttgtcctctcggcctttcactttggactctttttttcccccgtcaatttcttcctgtttttagggaatttcatgtacgctatcggggttgctaggtactccgtattataaatagatcggaatttcatgtagaatgcgcgtgcttttctgctgagacatactgtactaagtcgaaggttttgggatcaacaagggccaaacgcccacctctgcgcacgaggggtaagcatatacataaggcatacagtatatgacata

SEQ ID NO: 10767 - DNA, 706 bp, Sorghum bicolor
  unsure (1)..(706): unsure at all n locations
  Clone ID: SORBI-28MAY03-CLUS37350_1
ntacgtcatgcttgtgggagcatacccatttgaagaccccgatgaccccaagaatatacgcaagaccattcagcaaataatgcaagtgcaatacaagataccagattatgtccacatatctacggaatgccagcaacttcttgcccgtatctttgttgccaatccaatgaggagaatcacaatgaaggaaataaagagccatccatggtttttgaagaacctaccacgggaactcacggagactgcacaaggcatgtactacaggagggataacagggtgccttcttactcagaccaatcgtcggaagaaatcatgaagatagttcaagatgcaaggaccatgccgaaatcatccagatcaggctatgggtggagcactgagtattcggatgaagaagaagagaaggaagaggaacacaggccagaggagcatgaggaacaggaagatgaatacgataggagggtgaaggaagtccatgcaagcggagaactccgtttggacgctcttcacatatgaaagcaagtggaagaaagttacgtgtacataactgggttgcggatctgaaggatccagtgggatgtatgcaattttggcttcagaattgcttctgtttggtcaattttcatgtaacataatttaatacactgagacagactaccatgttcttatattggtaaatatgaagcatgtacatgtctgcctgca

SEQ ID NO: 10768 - DNA, 1075 bp, Sorghum bicolor
  Clone ID: SORBI-28MAY03-CLUS37356_1
gcacgaggctgcgacggcaccggggacgggcccgcgtcgctggccttcgcgggttgcctcgctggcttgctcgcgctggagcttcgtgcttgccgtgctgtcgccgaccgtgtactcctccttgcagccgaccattgccgcacgctgacgtccctcctggtttatgacggcggcagcagcgaggccctccaccggttcatccagcagcgtgctgctggtctgcataccttggaccttcgcctcccgctcgacctgcacaatgatcatctccttgccattggagctggctcagttcaacacgggcaggatgccacacatggcctagctgcacttcgcctccagagctgcgtcctcatcacagggcacgggcttcggtccctggcacgaacagccactggagccggcatagaagagcttgccttggtgagttgcgacgtggtggagcgggagcctgggttgctgacattcctcagtcaaagcatgccgcgactccgtcgacttaacttgtcttacaatgagacgctgaatgacaaggtgattggtgccatgctgtcatcctgccggaatctcattgagatcagactcagagggtgccggggcttgacgggcggctcgctgatctcattgctcaggcactgtgggcagtcactggagatccttgacatctcccgttgtcctggcattgctgtaggtaatgttgaactctttgcccagcgcgccactcggttgaatcatatgatcatcgaggagagcgcgatgtcggaggaattgaaggcaatcgctcagaggaaaggcatgaaggttggctcattgccctgcgaaggtccattctgaagtaaggttatctcgttcagaatgcaactcatgttctctatacacgatttgaatgtaatcttactggaatgttaataaagtattgctgcttagtactttgtgtatgcagctttatatttgccttgtaagtttattattatgacaagcctcttggtgcttgcctgacatgtaaattgagcgccaaggatgtgctgttgtatttgttcaacaattgccccggaataataatccagtaaattcc

SEQ ID NO: 10769 - DNA, 860 bp, Sorghum bicolor
  Clone ID: SORBI-28MAY03-CLUS39582_1
gcacgaggcagaattcacaagagctgcagtgaggagagagaggagcggcaccggcacgcgcgggggagagatttcattatttggcgcactggagagtggagagcggtagagctggaaggcggaagcagaaatccacagcgtatagagggaggagggagatctggagctcctggggagcggagagggagaaggagctggaatggtaacagttggcagaggggatccttgatctgttcttgagctggaagaattcttctcttgagccgcggagccggagaaacttggatctcgaggccatccaagagaaagttttccccttccttgctgctagcctactgcattgctgcctccccccagatccgagctgccacaaggagaaaggtggaatctctgctcgccttctccacaaatcccccccaaaattttgggtttcttgagctgttcttgggagcgccgtgcttcaaatcttgggcgaaaaaggtcgattttttttcctgttggggtagatgcgggagtgatgtcgactactttatgagctgccccctgctaggctgctactttggggtttagattcgctatagttatggcggatcttgccatggagcattaggagttcctttcgtcgaaggcgaaaggaacctgcccgtaagctgcaatgtctctcaagagcattgtgcgggagctgaaggagatgagggacggtatcgggagcatgtcgagacgcggcggcagcggctccgacgggcgtgccggccatggccgctcggggtcgcggcattcttggcctagcctgtgggccgagcagcaacagccgcagcggcagggtcaggaggggccgcagcatcagcatcagcatcaag

SEQ ID NO: 10770 - DNA, 649 bp, Sorghum bicolor
  Clone ID: SORBI-28MAY03-CLUS39598_1
gctcgagcgcacgagggcagaccagagagacgcacacaaatcagagcgggggggcgaggatgaaggtggaggtggtggagacgacgctggtgccgccgagcgaggcgacgccgcggcacgcgctgtggctgtccaacctggacctggcggtgcccaagacccacacgccgctcgtctactactacccgaggccgcccgaccccgaccccgagcccgacgccgacgcgcccgccggggaggggtcgttcttcgacccggcgcgcctgcgggaggcgctcgccagcgcgctggtggcgttctacccgctggcggggcggctcgtggtcggccagggcgggcggatcgagatcgactgcaccggcgagggcgcgctgttcgtcgtcgcgcgcgccgacttcaccggggacgacatgttcagggacttcgagccgtcccccgaggcgcgccgcctgctcgtgcccttcgccgaatccggcgacccgccctgcgtgctcgccatggtccaggtgaccttcctcaagtgcggcggcgtggccgtgggcacgggcatgcaccacgtcacgatggacggcgcgggcgcgatccagttcatccgggcgtggacggcgctggcgcgcggggagtcccccacgtgggcgccgacctacga

SEQ ID NO: 10771 - DNA, 832 bp, Sorghum bicolor
  Clone ID: SORBI-28MAY03-CLUS39624_1
atcgcctcgcctcgtttacctcaatcgaggttgttttatttgctgaatgatgcttcctcgctgacccgctctcaccagttgccccgccgatcatccagagtcccagacctccacggcaccgctgcgtctcctccattccaacttccgagccgcaaaccccccgaacccttccgtgcgtgatggaccccacctcgccgtcgcccgcggcccgccgcgccgccgccgtcgcgcgccacctcgctggcgccaccgcccccttcccggcgagcactcccctggaaccttcctgctgcctgagctacgtcccgccggagtccaccgaacggccggcggcgttcgcgccgggcgacctcaggcttctgctggacgggcacgacctgcccgcgcgcgattggctcttccgcgccatggaggagagcccccttttccgcagcccgagcgcgcggacgggctccagggtgttcgtgggggcggacttgaacgacggcaaggaagggcagcgggaggccaccatgcggcggatcgcgtacctgaagcagcgcggcgtgttccgcgggtggctcaccaaggacggcgctgacgccgagctccgcaaactagcgctccttgactgcatcgccatctatgaccactctctcgccatcaagattggcgtccacttcttcctctggggcagtgccatcaagtttcttggaacaaagcgccaccatgacaagtggttggttgccacagaaaattatgatatcatgggttgttttgcaatgacagaactaggccatggaagcaatgtacgaggaatagaaacaatagcaacttatgattcagaaacaag

SEQ ID NO: 10772 - DNA, 1103 bp, Sorghum bicolor
  Clone ID: SORBI-28MAY03-CLUS38313_1
gcacgaggtagagataggcgtcctgttatgtcaatgccagatagagctaggcgtttacctcctccagagagagcttatgacaggaggcccccagccccagtttacccgaagagaagtccaaggagagaatacgggaggcgtgatgaacttcctcctccaaggagcagagctacgattgattacagtcctagagttccagttgatagacgtccctctttgagggatgattattcaccccggggatcaggttattcagacctacgtcctcgtagtgctccacgtctttctgatagacgagcttatgctgatgatagttatggggggaagtttgaccggcctttaccgtcctatagggagggtcgtggccgtgattatgataccatttctggatcaaagcgtccatatgcagatttggatgacgtgcctcggtatcaagaaattggtgttcgtcagtccaaggcacgcttagactatgacattggtggcagcagtgctcggtatggagatacatatagcgagaggtctggacgaccacatgtgggatatagcagcagccgatctatccctggtcatgattcagcatatggcagcagccgtcatggcatgagttatggaggttctgctagcagtgctgatgctggtggtatgtacccaccgagttacagtggtagctatgggtctcgtggatctgatgttggtgggagttcatattcttcgctttactcctcgagccgcaatttgggtagcagcaatggtggctactatggaggtagcggttccggttcatattactaagatttggcatcacctcatctttgtggaacagatttggcatcataggacgttggtgtaggccctgcattttatggagctccttgatttaagccctacagatctggaaaagaagtgccaagcacccaagtgaggcaatgttttcaaataagacatttcaacgaagccagaccatcgagttggttgaagcagtagtcctgaggatgttctggcttgtttatgtaatgtaaggatttgctttatctggtcaagagttatgaacataagagcccagatatggtgttttaagtgtttcgaccatgtttacttcc

SEQ ID NO: 10773 - DNA, 769 bp, Sorghum bicolor
  Clone ID: SORBI-28MAY03-CLUS38408_1
tgaattgacagtccaacatataaaggatatacctcttgataaagtattggcaaagcaacagatggatcttctcacagcaaaatcatggcttatggagaataaagagcttgagcgcaaggttgtgaaattaagcatacaaaatagccttccttctgagtacacacgcatggtactacttcaaaccagcttggacaaaatagatccagcacaacaggcgaagaataaaccaacaaaacaaagcagcccagatgagctaccagctatgccgcttggtggcctagcactcggatttggtgatgtcgcggcaacaagggagaacctgacaacaggattcggagacatgaaagcaccggagaagtttgtgatattcgagaaggccgttggctgctgcagccgcgtggcggattgctgctgctgcatgtgcttcatcaaggcgtgcagcaagatgaacgaccagtgtgccattgtcatggcgcaggcctgcgctgccctcgcgtgcctgggatgcttcgagtgctgctcagagttgtgctgcggcgggtcgaactgagtcacatgagcaagtcggtgtgattgtgttgtacattaatgtaaatacttaatgtacactatttattaatgtacagaataggcatcacgtgtttatctaacttgactttgatcaataaaagcatctgttgtccgtaagtacatctttctagaatgaactatatataagttgtatgcagcgtcgatgtaattcaaatccccgtattaagggatatgactg

SEQ ID NO: 10774 - DNA, 1170 bp, Sorghum bicolor
  Clone ID: SORBI-28MAY03-CLUS38434_1
ctaacaagacaaatattagcaccaaattttgatcgtagttatgctcgacctgcagaattattggtttcaacaagtggtaaaaattctaaacaagaaaaaggagaaaatagtggtgcgtatataattcggctaccgtttggtccaaaagataagtatcgtagctaaagaacatctatggcctttcattcaagaatttgttgatggtgcactcagccatattgtgaggatgtcaaaagccataggtgaagaaactggccgcgtgcatccagtatggcctgctgtgattcatgggcattatgccagtgcaggaattgcagctgcgttactttctggagcacttaaccttcctatggcattcacaggacattttcttgggaaagataaattggaagggcttctcaaacaagggagacaaactagagaacagataaatatgacatacaaaataatgtgccgaattgaggcagaggagctatctcttgacgcatctgagattgtcattgcaagcactaggcaagaaatagaagagcagtggaacttgtatgatggttttgaggttatacttgcaaggaagctccgagcaagagttaaacgtggtgctaattgttatggccgttttatgcctcgtatggttataattcctcctggagttgaatttggtcacattattcacgattttgatatggatggtgaagaagagaatccatccccagcatctgaggatccacctatttggtctcagataatgcgcttctttacaaatcctaggaagcctatgattctagctgttgctcgcccttatcccgagaagaatattactacgcttgtaaaagcatttggtgaatgtcggccactaagggagcttgcaaaccttacattgataatgggtaaccgtgaagctatatctaagatgcacaatatgagtgctgctgtcttgacatcagtgcttacattgattgatgaatatgacttgtatggtcaagtggcataccccaagcatcatagcccactcggaagttcctgacatttatcgtttagctgcaagaacaaagggggcttttgtaaatgtagcttacttcgaacaatttggagttactctgatagaggctgctatgaatggtttgcctataattgcgacaaaaaatggagcccctgttgaaattaatcagg

SEQ ID NO: 10775 - DNA, 555 bp, Sorghum bicolor
  Clone ID: SORBI-28MAY03-CLUS38461_1
gcacggcacgaggctctttcttcctcctctctccacaactttcttcctccccaaattcggcccaaacgaattcgttaaataatctcagaaaacacacggttaacgggatcgaagggattaaaacgaaaacgctccgatcctgtgatcaggtctcggtgctaatcgtgtgattttttgagggtgtttgggcttgtgatttagtgttagggtttcggatctggaggattagttcttccgacttccgagtcagacgaccatgaatgagcagatgatgagacctccggcgctgctgccgttccaccagatgtgggcggcggtgccggcggctcccccgccggcgatggagcctccggtggcggcgttcaagccggcgcggccgtcgtggaagcgggcggcgcggacgccctggaagcgcaaggcccagccgccggcggcgtcggtcggcgcgaggtggggcggcgccgcgccgcgcaacacgacgtcgttcctgatccgtgctaagcgggccgggggcgtggcgtcgctggtgtccccgtaccccgtgacgccagcggt

SEQ ID NO: 10776 - DNA, 1041 bp, Sorghum bicolor
  Clone ID: SORBI-28MAY03-CLUS3847_1
cgtccgtctgtacctaaaaatatcttctttcttatccatggagacggctgcgctcacctcccactcgctgcagtgtccagctgctgctgctgctgctgccgtgcatggcaagcggcggaggggaggaggagcggcggccttgccgcgccggcggcagacgttcgccggcaggatccgggctctgccgtcggcggaggtcatcagcgagatcctgcacccgaagctggtgcccggctcgccctccgacaccggcgacgtctcctcgctcgtcccggtcagtgctctcatgctgctcttctacttcgtgtccaactgggtggtgcccgagctgctcatgaagcgcctcaacgagcccaagcccgaggaggacgaagctgctgctgctgctgcatccatggcgtcgtccggcgcagcggacggcggcgacgacgccgccgcctcgccccgtaaaatccggctcaaggtcaagaagaagaagaacgggaaagcaaccatcgtgaaggtctagttattaggtaatatgcaggagcacacgcatggagcgtgcgagggcgtcgacctctaaacacagatcgatcgagtacgtacggagtaagtgtattaccgccgacgtcatagtaagataagatactgtattaccaatctccatcagagcattgaagaagaattactctagtaataattactgtcagatgatatgcacgttagtgtgctgtgtgtgtgtgcgcctgtatttgtcttttgtgatcgaataaaattaagctccagtgcttatttacactacaccacgtctatggatgatggatgctatgttactgccacactcagcggcgtcccggcaaaatacgagaccctattcgaaatagtaaatggaggtctaatatctagtgccaaaataaaaaaataataatacatatcaatgtattacttatattacaaagtatagcagcatagaccaagaattataacagttgtataatcatcacttgaaaagtgatattcttttagcattctttgaaacaaatcttcaatgatatactc

SEQ ID NO: 10777 - DNA, 654 bp, Sorghum bicolor
  Clone ID: SORBI-28MAY03-CLUS38476_1
gacggcctccgaggcggggccgaaccgccgaggtagccaagacaacacgagcaacgaaacgccatccctgccggattagtgagtctgctctagtcccgactctgctccagctccgggccgccgccgagatgggcgcagatggcgggctgaaccgggcggcggagaagccccgggatggggagggcggggaagcgagggtgttccggtgcacggactactcgctgccgcggacgacgctggcgctgacgctctggctgggcggcatccacttcaacgtccttcttgttcttgcgtcgctcttcctcctctcccgccgcgccgctgccatagtggtggcgttccagctcttcttcatgttcgcgcccgtcaacgacagggacaaatggggccggagcgtcgccaggttcatatgcagacacgcaatgggctacttccctatcagtctgcatgtggaggactacaagtccttcgatcccagcagggcttacgtgtttggttatgagccgcactcagtgctgccgataggtctgtcagctcttgctgatcttgttgggtttatgcctctcactaagatcaagatccttgcgagcagtgcggtgttctacaccccattcttgagacagatttggacgtggcttggattggtacctgcga

SEQ ID NO: 10778 - DNA, 1147 bp, Sorghum bicolor
  Clone ID: SORBI-28MAY03-CLUS4013_1
cgtccggttatatttcaactgtctgaagacatcccttgcatttctgctgttgttgtggctctccttgctgatccagagccaaaaattgactacaccctgaaggccattggaggaagcctaactgcagttcctggactttctgacatgattgatgacactgtcaattcaattgtttctgatatgctcttgtggccacacaggcatgttgttaaacttggtgtcaatgttgatacaagtgacttggagcttaaacctcagggaagactttctgttactgtggtaaaagcaacttctttgagaaataaggagatgattggtaaatcagacccttatgtgaaactgtacctgcggccaatgtttaaggtcaaaacaaaagtcatagatgacgagctgaatccagaatggaatgaaacatttgatctgattgtcgaagacaaagaaacccaatctgtcatttttgaggtttacgatgaagacaaacttcagcaagacaagaggctgggtgtggcaaaactagcagtgaaccctcttgaacctgagatcacccaagaattcactctgaagctgctacattcactggatccaattaaaaatagggacaccaaggatagaggcacattacatcttaaggtaaagtatcacccctttacaaaggaagagcagctggaagccctagagatggaaaagcaagccatagaggagaggaagcggctgaaggaggctggagtaattggtagcacaatggatgctgttggcggtgccgcatcactagttggttccggtgttggatttgtgggcactggcattggtgctggcattggcctcgttggttcaggaattggtgctggcgctggccttgttggctctggtattggtgctgtcggcagtggccttggtaaagccgggaagttcatgggcaggactgtgacagggcctttcagcatgtcccgcaagaacggcagcagctccactgctccccagcctgatcaaccttcggcatagtctgatgtacagtgaaagacaattgtcatatttgtgacagggttaccattctactgtgtaaacgtgctatacctaggatatacgtagtacttcgtttctgtttcagtcaatgcctggttatatgaaatatatgctgatttatttt

SEQ ID NO: 10779 - DNA, 653 bp, Sorghum bicolor
  Clone ID: SORBI-28MAY03-CLUS4016_1
cggacgcgtgggcgcgcgacgagggcgtccgcagcctgtggcgcgggtcgtcgctcacggtgaaccgcgccatgatcgtcacggcgtcgcagctcgccacgtacgaccaggccaaggaggccatcctggcgcgccggggaccgggagccgacggcctcgccacgcacgtcgccgccagcttcaccgcgggcatcgtggccgccgccgcgtccaaccccgtggatgtggtcaagacgaggatgatgaacatgaaggtggcgcccggcgcgcccccgccgtacgccggcgccgtcgactgcgcgctcaagacggtgaggtcggaagggcccatggcgctgtacaaggggttcatccccaccgtgatgcgccagggacctttcaccgtcgtgctcttcgtcacgctcgagcaggtgcgcaaggtcttcaagggcgtcgacttctgaggaccggcgccgacgaagatgatgatgatgacgacaaccgccgccgccgccgccgcctatgctacccgttcgtcaccgcgttcgctgctacgaataacccgctgctgctacctagaggcggcgactattatgccttcgcttgcattgcatcccgtgttagccttgtgttcctctcttgatgcatcctgtggtatctggatggatttgacc

SEQ ID NO: 10780 - DNA, 758 bp, Sorghum bicolor
  Clone ID: SORBI-28MAY03-CLUS4028_1
gcacgagggagagagagagagagagagagagagagagagagagagagaggctggacctcatgagctcctgggtcagccacctgccgccggaggtccagttccggcgcgtcgtcggccacgggctcaacgcgcaggagctcgccaggaacccgcgcctggactacttcttcgtcaaggacctcaacaaggagcagcagctggagctccagagcggcaccttcgacgccgtgctctgcaccgtcagcgtgcagtacctgcagtcccctgaaaaggtcttcgcggagatgttccgggtgctgaagccggggggcgtgtgcatcgtgagcttcagcaaccggatgttctacgagaaggccgtcagcgcgtggcgggacggcacggcgtacagccgcgtccagctcgtgacgcagtacttccagtgcgtcgaggggttcacgcagcccgaggtgatcaggaagctgccgtcggccggcgggtcgtcgccgtcctcgccgctggacgccgtgatgaggctgttcggcgtggcgggctccgacccgttctacgcagttatctcgtacaggaacttcaagccaatgtgaagccctgagtgacagagcctgtgccagcattgggataatacagtagtacatacaacctataggattactggtgcaaagctagtttgtactcctacatgttacactacagcagcagatcagctgcggacagatgaaagttcagaagctgaaacatcatccatcgaccatctgattcag

SEQ ID NO: 10781 - DNA, 556 bp, Sorghum bicolor
  Clone ID: SORBI-28MAY03-CLUS40338_1
gaaaatgccaaggactgtagttgccttggatggtgggctctatgaacattacaagaagttcagcagttgcgtagaagcaactcttacagacttgctcggcgaagaggcctcttcctccgtggttgccaagctggccaatgatggctctggcattggagctgctcttcttgcagcctcacactcccagtatggggagagtcactagtcttgaaaacgggcgtggatcgaactttgagtgtagctctcactttcttttttttgcccccttcaaacattcctaatattccagctctcctcggggaattttttggcttcctttcttggctattctgtggatgcacataagtgtctgcagcgggatatagctagtatagaaccaatgagtttggaggttatctaatggcataaggtttggacggcgggagcatggaaatggaagctgaacaatgccattcatgttctgcccatttttctccttgtagggtgttgtaaaccaatcgaaaattttaccccttttttttgttttggtaataaagagggggacacaatccaattt

SEQ ID NO: 10782 - DNA, 1070 bp, Sorghum bicolor
  Clone ID: SORBI-28MAY03-CLUS40423_1
tacgcggtgtcgttatgctgtgtcgtcggcgtgcgcctgcagcagcggccgcagcagcacctagcagcagcctgtagtgcttgccgcgcgcagttgcagcgacgatccgtccaccggtccgtcgtccgtccatggtgagcggcggcagcatcaaggagcagcagcacgagatgaacatctccttcgggatgatgaaccaccaccaccagcagcagcctccgtcctcctcctcttcctcctccctgcacgccgccgctgcgagcttcatgagcggcaagcaggcgtcaggggcgtatgaccatctgggggaactggaccaggcgttgttcatgtacctggatcacggcagcagccatgtccatggcggcacgcagcaagagcatcaaaggcagacactcaacatcttcccttcccagcccatgcatgtggagccgtcgccgaagggggagattagtttagtcctgtccccggcgccggtggggtccaagcagcctgctaggtcacccgaccatcaccatcaccagcaccagcaggcggccatggaggagttggcggggagcaggaggcagcagcaggagcaccaccacctgcagcaccaacccttcgctgctgccgctgctgagccggcagcacccgtcgggatgatcaaagatgtcaagccactggccaagaaggatcataggagaggcacatcgaccagtgaacgcgacccaaaaacgctgagaaggctggcccagaacagggaggctgcaagaaaaagcaggctaaggaagaaggcttacatccagcaactggagtccagcaggatcaggctagctcagctcgaacaagaactgcacactgcaagagctcagggagttttcttccccaacagcggtatcctcgctgaccaaggtgtcgccggcaaaggcgtccccatcggcggcatcgacggcctcagctcagaggcggcgatgttcgacgtggagtacgggcggtggcaggaggagcactaccggctgatgtacgagctgcgggcggcgctgcagcagcacctgccggagggggagctgcagatgtacgtggagagc

SEQ ID NO: 10783 - DNA, 750 bp, Sorghum bicolor
  Clone ID: SORBI-28MAY03-CLUS38859_1
ctatttcagaatcgatggtgcatagacatcagatgcaagcaatgggaacaagcatatcatggcacactaagtattggatatttatcggggcaggcttgtacaagatggctatggctattgaccaacggccagtgctgaggagcacaaggattgcaacgtatcatgttcttgatcgttgtagtcgactacccgctttgaccacaagaggggtcatattgtgcatcgagagaggttgacggcactaccctcatctctcacctgtatagaaaggcaatcggggcctataatggtacgatgtgaatattccaggatttgctgtcactcagaaagtcaaagtcgcagcattgcatgcctacatggtaccatgaagacgcccgcagagtggctttgtatagaggtgctataggtggggtggccaaccctttcggatatctcacatggcaagatatttacctttacattttgtatgcatccgatatagttttcatatttatgccacaaaaatgatttaggtgatggtaaaagtagtttgtgatgattgaaaatttgggagtgctgtgaaagtcagtttgatacttttgtggggaatggctgatcgtagtgggatttattttattataatttggatggtctgttcagagaaatattcatgctttggtgcagcacgtatttgttctatttctttcagcaagtggttcctttgtaagaggtcaactctggaatgaaatcttggtgttaattttgtgtttg

SEQ ID NO: 10784 - DNA, 1304 bp, Sorghum bicolor
  Clone ID: SORBI-28MAY03-CLUS39_1
cgctaccggagccgccactcccacgaccacgaacgccggcgaccgagcggaaacgaaccagttatctagtggagctgcctcgtccaaggtactgtaatgtcctttctattcaagtctagcaatggtggtaccactgaaaaaaccatgcccctggaagaacagcaagaaaaaataaatgaactacgcaaggtgcttggtgaccactcatcaccagccattcaagacttcctttcagatgcctcattagcgagatttcttcgagcaaggaactggaatgtgcagaaagctagtaaaatgatgaaagcagctgtgaagtggcggcttgcattcaaacctgaaaacatctgttgggatgatatttcagaggaagcagagaccggaaagatatatagggcagactataaggacaaacatggcagaactgttcttgtattgaggcctggtttagagaacactacctcagcaacaggacagatcaaatatctagtctactctctggagaaagcaattatgaacctgacggaagatcaagagaagatggtatggctgacagatttccagtcctggacattgggaagcacaccactgaaggtgacccgtgagactgtcaatgtcttgcaagactgttatcctgagaggttggggcttgcaatcctttacaaccctcctaggatatttgaatcattctggaagatagtgaagccgttcctggaccaagagacccgcaagaaggtgaagtttgtgtactccaacgacaaggagagccagaagataatggcagaagtctttgacatggaggagctcgactcggcatttgggggaaagaacccagcgacatttgagtacaacagctacgcagagcgaatgcaggaggacgacaagaagatgggatcgttgcacagttcaaccaatagcttgcttgaatcagctgagaaggaggctaatggcgcagactcggacgcctcaagtgaggcctccttctacagtggaactgactctccgaaacatgaggacggtgaacacagcatcgcaaagaagagcggctgagctaaactgctttgattgctcaaattgagggagctgaggaatggaataggtcaacatatctagcttgaacgattgtcaggaccgatggcgatgagccgatgacagattacaagctggttagataacgttgccgggtctaggcggaatgtatatttgctgctcatgatattagagtatatgtaagagtttggaccatcaacgctgaattggtgatgcgttatacatctttggaataagtttaacttctccgcggtaca

SEQ ID NO: 10785 - DNA, 1056 bp, Sorghum bicolor
  Clone ID: SORBI-28MAY03-CLUS39265_1
gcacgagggttcacgccgccaccgcctgcgcctcccgacgcggttgccgatccgcccattccgccgcaacccctctcccgacgccgcgcgccccagccgcccgtggcccggccatggagcgcgctgccggggaggcgggcgcccccacgccggcggcgagagggggagcggcagcgccagcgggagcgggggcaggaggagggatggtgaaggggaagtcctgcaagggctgcctctactactcgtcggcgctcaggtcgcgagcgcgtggccccgtctgcgtcggcgtcacccgcgccattccccaagtttctgagcgtatggttggagaacttgaactggaagctatccaagaaggtcgctatcttgcagatttcagatatggatgcattggctattcaatgtacttagatgacaaggaaactcccacagggatacgagataaggcacgtgcacaactacctgtttgtgctggagttgagctattggcagatagaaaagtcccaacaaatgttaagaaagaagatctaaaacgacgtcattacaaaccagggcaaccagggcacgtgggagatgatttcttaactaaatttcagaggaatgcagggcttgtggcgaatggtgtggctaagaacctgaatagagttgggacctacatcaaagacactgtgggtgatatgatgcagccttaccgcaagcgtcccaaataaaacatagacctgtctcccctaaagacctaaatcctgtatgggagtaaacattagatgaccaggaacgtcggagcaatcactccccgcatacaccgggcacagcagtagttttcttttgttttttgaagccctagaaaattgagaagaattattgtttagccaattggagcatgttatccactagctgttggggctttgatttcgcgttgtctcgtagccccactgcctcgccccatttgggagcgattgttatttcactaggtccctccagtaatgtacaggatgtcatgtaataaaacattaaaacagccccgtctcgtccttttgagaatagtagcgtagtgct

SEQ ID NO: 10786 - DNA, 1938 bp, Sorghum bicolor
  Clone ID: SORBI-28MAY03-CLUS39379_1
gcacgaggtttaggtctccggggtcaaaatgattacgaaatctgttgagggaaatgaaaatagacgcacgtggcgcccctccggcccggctcctgggcgggcccaccgccaccgccaccgcctccgccaccgccctgcccgccgcctaacgcgaggcccgcgaggtagacgtcggcgagcagctgcactccctcgccggcgtcctccgcagcttcgtcgccggcggctgccgccccgtcgagcgcgcgccgccgctcccgcggctccgggcggcggcctccgaggccgcgccgcgcctgcggggcgcggcccggctccccgcgccgcacccgcccctgcggtccaagcggggcggcgcccgccgcgccggcctcgtcagctcggtcggaacaatcactcttatagcattgactggccttctgatcttcatgttcttcctgttggttgccactgctaatgcggtcatcgtctcagtcctgatgtcactggctgctgctggaggattcttggctatcttctttgcttgcttagttgcagtttatattggagcagtatcagctgctatctttgccatttctgcgactgtcatatcagcagttgttggagttatgattgctaccggttgggttgggttcttctggatgatctggttcgccgcaaggaagagcatggacctgacgaagcactccattggcgtgacgagctcggcgatccaatcgtactcggcgtcccggcatgtgaaccagaagcctgtcgactgagtttagttggttgcatcctgtatgaagcccgccggtgtatctatgtgaattacggtttggctgtttgtaagagtggtttggctgtttgtaagagtgtagaagacggcacctctgtttctctcggtgactagctgtataatactagctctgaaatttggcagcctgtacgttgggcatcgcggccaatgctgttctgtttgggatagtgagcagataaattttctagtgaataggggtcatgtgtacattgtgcaggtacgcagtatgtacatgtcctttatgagtgaacaataataatttcattgtctttgttactgaggacatacacatactggaaggttttgagttgtcaatgcaaccagtacaccattccaagaatacaagtacacatgagtatttacaaggaacctttccatggagttcctaacatgaatataggaagcacacaacgctttaaaaagcagcagctacacaccgatggcgggtggcaatggctccagagtctgcacgaagcagcagccgtcgtcgtcgtcagtagagtaattcattcagtaggttcggtcgcggccgacgagggagaggaggaaggttcggtagttgccggacgtctcggcgtggatggcgtcggcgagcgagcgcttgtacatccggtgatactccgccttgatgtactgcatgtcgatctcggccctggtgacgacgaccctgatgagcgtcgagtccgaggtgcccagccctttcatggccttgtgcagcaccccggcgaagtacctggcggggctgtcggcgcaccggagcacggtgaggaggccgaagccgaagttacccgacgtctcgctcttgacggcgctctccagggaccggtcgtacatgtggtggtacgcgcgcttgtggttgccgctgagctccgacgcgagacggcgggcgaggtcctggttgaacacggcgcggtactcctgggcgatcgccgcgcgctgcgccgcgtcgcggtgcgccaggatgctgatcaccgtcgtgctgtcgcagccgaacccgcggaacgccttgtggaggtcgatcgcgtcctgccgtggccacgtcggcaccggcggcaccgtcaggctcgccatcaagctgctggacgctgctggtgtctagttgctcgagctctgccgcacgcggcgggggaacctcgtgc

SEQ ID NO: 10787 - DNA, 702 bp, Sorghum bicolor
  unsure (1)..(702): unsure at all n locations
  Clone ID: SORBI-28MAY03-CLUS39436_1
gcagaggggctcctgcagccgctcttccccaccattgtccccttcgctcaatctctccacccctgcacttcctcccgccatttcgccccccgctcgccaacccaaaccccctctgctcccaaaccctaaccctagcctgcccccggcggatcgacgatgccgaaggccggaggaggggcggcggacgaggaggagttccgcgccgaggtggaggagcgcctcatcaacgaggagtacaagatctggaagaagaacactcccttcctctacgacctcgtcatcacccacgcgctcgaatggccctccctcaccgtgcagtggctccccgaccgcaccgaacccccggggaaggaccactccgtccagaagatgatcctcggcacgcacacatccgacaacgagcccaactacctgatgctcgcgcaggtccagctgcccctcgacgacgccgaggccgacgcgcgccactacgacgatgaacacaccgacatcggggggttcggcgccgcctccggcaaggtgcaaattgttcagcagataaatcatgatggagaggtcaatcgagctcgctatatgccccaaaattcatttataattgctaccaagacagttagtgcagaagtatatgtcttcgactatagcaagcacccatctaagcctccactagatggtgcatgcnaccctgatttacggctgaaggga

SEQ ID NO: 10788 - DNA, 690 bp, Sorghum bicolor
  Clone ID: SORBI-28MAY03-CLUS3931_1
gacgagtccctaccgctatctggacccctgtgccccccggcgcgctgcaacaattcgtccagatcaacactactagctctagctctgcgccatggcgcccgtcaaggcgcaagacgcgagcactgaccagcagactatgcttgatgctcagctccagctctggcaccacaccttcggctacatcaaatccatggcgctcaaggccgcgctagacctccgcatccccgacgccatccaccagcatggcggctcagccaccctcccacagatagccaccaaggccacgctccacccgtccaagataccatgcctgcgccgcctcatgcgcgtgctcactctgaccggcgtcttccagcactcgacgacgaccgacgacgacggcggcgagcttgtctacgagctcacgccggcgtctcgtctcctggtcggctcggtgacgacgaacgtgagtccgtttctgaacatggtgctcggcaccgtcttcgtgtcttccttcctcgacctcggcgagtggttccagcacgagctgccggacccgtccccgttcaagttgacgcacggacggcacgtgtgggacctggccatccacgacgcgagcttcgccaagctctgtgacaatgggatggtcgcggacagcgggttcatcatggacgtcatggtcaaggagtgcggcgacgttttccaagggat

SEQ ID NO: 10789 - DNA, 762 bp, Sorghum bicolor
  unsure (1)..(762): unsure at all n locations
  Clone ID: SORBI-28MAY03-CLUS39560_1
gcacgaggcccacgcccctcatttctacaaccccaaaccctagacgccgccgccaaagaaaactgccttcgccaatctccgccgccgcccacgagctctgccgccatcagtcaccgcatccacatctccgccgcgggttttgggtcctcgtcctggacgatggtgacagccacgagctgacgcccaccaacgatgtccactaggtgacgaccaccactgacgaccacctcgtgtacatccgcaatggtggcaaccaggagtggaggtagtaagagagtggcacaacaagaacaagtcccctccagggtatagtcggaaaatcatcactcggaggattaaaaaggcttcaggtcccaacatgccgccaggaggtaggtctggtaagagagtgagggcaccggaaggttcacagctggaacctcctagtgcccagttaagatcatcaaaaaggcttcaactgtcagcgatagatggtcagcctgcagaggaaggcaatggatcagctggtgcagtgcaaggcaatggagctggtgcccaacaaggcaatggagctggtggtgatgacattgcagccgcagagaatgacaatggagctgctgatcaagacatggcaactgtacatgaagataatgtagctgcagaggatgacactcaagctcctgcacagcgacgcccaagggatcccaggccacccaccaagggagcatacttggacaagatgacnaaagctatgggacatagactgcccatagctgttgctcc

SEQ ID NO: 10790 - DNA, 834 bp, Sorghum bicolor
  Clone ID: SORBI-28MAY03-CLUS4135_1
cgtccgagacagcaggcctaatatctatagtcaaggatgtctgaataactttctagaagtctgcctctgcaagacaaaaccttctaaacacaagtttcgggcatatgcacaagaggaagtgcgacctccaacagttagctttggtagggatgttgaagatgaaccagttggcggtcctcggtcgaaagttgaagatgatcttgaaattggtagtgatcttctgaagatctctcagcggcgcaattatgaggatgttaatgtagaagtgggaggtcctcacaggctcagcagtgagatggaaggcatagccaatgccaaacttgtggcatgttcagaatcacagatccctgcagttgggagcgacgtaagggtgcgacactcaagctgggatcggagaagtgggaactgggacatgtcatcagatgtacttacaagaagcgcatcagatgtaattgaacgtagcgtgtttgccacggaggctgcacatccatctctagcagagactcactagtgaattgtttgtgcattcagaacaatgtgtgtgcagtttggattgcaaggccatttaagttaactcatgttggctcacccagacagcaaggaagaaaacgcctgtcatgcattttgactttgactgccttgattgggttttctttccgacccttgtcaattgtcatgtatgagcaactatttagtcaaagaattagccccattgtgccattatattcgtgtgtttgtgccatagtctcaatctgacgctgtgttgcgtatggtcctgtctgtaaattgcaagtgcaggattctcaatttctcatccacattgtaattcttctt

SEQ ID NO: 10791 - DNA, 1003 bp, Sorghum bicolor
  Clone ID: SORBI-28MAY03-CLUS41419_1
tattcttttcaatctcaacaagttcatggcgtttgaaactcgtgatccattcctcattcgccaggaacgtgaaaatccaactctaactgagtgggatcggtttgcgcatagagaatatattagattgtccatggaagaagatggtgaggatgcttcaaatggaagtggtgatgtgtgggatgaatcacttgaggctccattctgaatggtgtcttgctgcttgaatctggttggacatggatgattatggttgtgaagtggaagaattgtaaagttggtggctaccctgtggaggccattgtagtctcacagcagattcagtaacaccaaagactacttacaagttttactgtgcagatctgattcgatatttgtcagttatcctgttgtgcaaacatttttgcttggctggaaaattggggagggaggttggtgggcgccctgcagtttcaaggcaacaacctcggcagtcacaaatgatactatagtgaaggacccttcctggtcggctagttccatttgtgttctgattggtccttagggggatatcagttaattcaattgttgtgcaaattttggagctgaactgttaatgtttggctgccattttctttgttaatcttggaagtgcggcctagcaattccatcacaactaagatcgtggcatgtagctttcaggttctgctttctcatcagcatggtgttttgtagttcctggtttgttgccgttcttggtgcatcttgggaggaatgatctgagaacttggagcgttggatactgttgtcattttgtaacattaccgagaagctgtggattgggtgcatagtaacacaaaggtagataacattggcaattcaatttttgttaaggtgtaaattcagagaatgttttaggtcgcaagtactattcgttaggttcgatctcttccttgaaagtgctttgcctgttgagctacttatttcgtgatgtgttgaaacttgactcgtaaaaaaaaaaaaaaaa

SEQ ID NO: 10792 - DNA, 735 bp, Sorghum bicolor
  Clone ID: SORBI-28MAY03-CLUS41478_1
gactggttcgccgtcctcgtgccctgctaccgccatggacgccaagagcagcagccccggaggcacgagggcaggtttcttggcgccggcgccctcaccgatggtggcctctctgatggaaagaattttgtagagcagtggctttcttctctccagaactaatattgccagtcctgtcctagctacgctgtaaatagtagtattactctgttttgttctactacgtttgtcctagtcgcagaatgtatcgatgaaggaagacatgaaaaagccctaaaaaaaagaaggaaatctaaaaataaaaaatgaggagcagtgggattctgaagcagcaccaaatgggtatgtccttcctgaggttcccaagctattctactcttgcaaagcaaggcgaaagctgaactacacaaactgcgcgtcatcgaaaatgattttgccgtcctgatatgtgctgagtgctaacttatgatgattgataacacgtagagatgaactgctattccattgttaatttgtcccacttgcttgcggacctcgaattctactgcctgtacatagtgttcttgtagtgtatatagttttgcgcagagctgcagttgcgcgatttttcagagtgtggtgtgtgtgtgtcctattcttacatgggaattgaattctgatgaatgaatctatctgctgtatataaattatgacaatgtgtccaattctgctgtgtcaaaaaaaaaaaaaaaaagg

SEQ ID NO: 10793 - DNA, 754 bp, Sorghum bicolor
  Clone ID: SORBI-28MAY03-CLUS41624_1
gcacgaggcgtcgacaaaaatggggcgtctcacggagtaccaggtcatcgggcgtcacttgcccaccgaggcaaaccccacgcccaagctctaccgcatgcgcatctttgcgcccaaccctgtcgtggccaagtcccggttctggtacttcttgacccagctccgcaaggtcaagaaggccaacggtgagatcgtcagcctcaatgtgatcgccgagaagcgtcccaccaaggtcaagaacttcggtatctggctccgctacgactcgcgttccggtacccacaacatgtacaaggagttccgtgagatgagccgtaccgacgccgttgaagccctctaccaggacatggctgcccgtcaccgtgcccgtttcggctccatcaacatcctcaaggttatcgaggtcgacaacgccgagaacatccgccgcccctacatcaagcagctcctcaccaaggacctcaagttccctctgcctcaccgcgccgccaagcctgctggcaagaagatcttcgcctactcgcggccatctaccttcgcataaatgtgatgttaggggtttttggagtaggagtgtgtggatgaacgataatgatacagccatagcatgcaaagaggtcataaagcacgcagagaacacagcgtgtatttaccactcagaaaatgggaaggattgttttgatgtcactatagtcctctgcagcgacggtttttcaagtttatatcacaaaaaaacaaaacttggggtttcttt

SEQ ID NO: 10794 - DNA, 988 bp, Sorghum bicolor
  Clone ID: SORBI-28MAY03-CLUS41684_1
gcacgaggccgagtacgagaactacgtgccctgctactacaacgtcacggacgccgtcgacgtctcggatctgggcgccggcgtcctcataagctacgaccgccagtgcacgcgcgacggcagggtcacttgcctcgtcgcgccaccaaggagctaccggattcccgtgcgatggcccagcggcaagggcttcatctggaaggacaacgtgcggattagcgggcaggagttctcgtccgggagcctgttcaagaggatgatggtggaggaggaccagatctcgttcccgtcggacgcccacatggccgacggtgtggaggattatgcccatcaaattgccgagatgattgggttgcggaatgaattcaatttcaatgaggctggggttaggacagtccttgacatagaatgtggatttggtaccttgcgcgcgcatctttttgagagagatctcttgaccatgtgcattgctaactatgaagcatcaggcagccaagtgcaaattacactggagagaggcattcctgcaatgattggttcatttgcaacaaagcagcttccatatccctatctttcctttgatatggtgcattgtgcaaaatgcaatatcgaatggtacaaaaatggtatgtgtttaaagtcttctttcacatgtcctggccctcgttgacaattcagcaatatcttaagttagcacttcacatgtaaagatcggtataaatgttaaatatttaaggatatacagctgtgggtaacttttggttgacttccaacccttgccactgcgaacttcacatatatctgatttctgtaaagaagcatctatggtaatttcgtactttagcatggctataaagtagtatctcttacagtcttactaagaggctgtttggttgctagccacagtttgccacacttaaccttaggcaagtttgaccaagttggcaagtgtttggttgacaactaagtttaggcatgattcttttgg

SEQ ID NO: 10795 - DNA, 719 bp, Sorghum bicolor
  Clone ID: SORBI-28MAY03-CLUS41706_1
acaccgtttctctcgtctcctttcgaccgtttcactcgtctcctttcgatacatacatacacccccgcgcacgtacgtcgttcgtcccgcagctggttcacgcacgacctcgagcgagagaaagatggcgacgccgaacgggcttgcgcggatcgagacgaacgggaagaagaagcacgacaacggcgtgtgccacgacgacagctcggcgccggtgcgcgcgcagaccatcgacgagctgcactcgctgcagcggaagcggtcggcgcccaccacgcccatcaaggacggcgccgcctcgcccttcgccgccgcgctctccgaggaggagagacacaggcagcagctgcagtccatcagtgcgtcgttggcgtctctgacacgtgaaaccgggccgaaagtggtgaagggcgacccggccaggaagggcgaggccgccgccaagggcgcgccaccgacgccgcagaagcaccaccagcaccaccaccccgccgcacccaccatcgccgtcagcgacagctccctcaagttcactcatgtcctctacaacctctcgcctgctgagctgtacgagcaggcgatcaagtacgagaaggggtcgttcatcacgtccaacggcgcgctggcgacgctgtcgggcgccaagaccgggcggtcgcccagggacaagcgcgtcgtcccgccgacatcatagcccggtccgcttactttgacacata

SEQ ID NO: 10796 - DNA, 977 bp, Sorghum bicolor
  Clone ID: SORBI-28MAY03-CLUS611_1
cccagcctcctactcgctgagcgccccatctggggttgcactctcgtgatgttttttaagtatcccttgatcgtcccgtcctgcttgtctcgaatttgtgcaactgatggaactatactacgctgggagtcatgggatggacatagtgacatctgtagcttcacatgctagaagaaaagtgcaaacaagccaatctcaagaaaacgggatggtcgattcttcctatgattgacgaggtttccaagtccctcttggaggtcacgagtggaattgaaggtgcgtgggttgagaacaacaagttctgtgtatctgtacattaccttaacgttgttattcgggactggaaagtggttgcaggcctcgtaaaacaagtattggaggcctttcctcgtctcaaagtaaccaatgggcgaatggttttagaggttcgcccagtgatcgactgggacaagggaaaggccgtcgagtttctgcttcaatcactcggcttaaacgactctgaagatgtgattcctatctacatcggagatgatcgcacggacgaagacgccttcaaggtacttcgagagcgaaaatgtggatatggaatcctagtttcgcaggtgcccaaggacactactgaagccttctactcgctgagagacccatctgaagtgatggggttcctcaattccttggtgagatggaagaagcactcactgcgacgaaactgaagaaaacaggatgatcgatccagaagtcgtaaagtaactgtaattcgtgcggcggcaaattttgtagagttggacgcaccgggtggtggttcattctttcatgggtttgttcatttttttctattgtccgtgttattcgccactgagatctgagaaatgatcagtggctgtctcatcctcttgcaactgtaatttgtaagcaagaggcccctcttcctgttcagtccattgaataataaaactgggacgctttttcccttgccc

SEQ ID NO: 10797 - DNA, 743 bp, Sorghum bicolor
  Clone ID: SORBI-28MAY03-CLUS61611_1
tagcttatgtaaatgcatgacatgaatggagcagagaaattctttcgtaggattaaagatgatggtctgaagcccaatgttgtggtttatggtactctgatgaaaggctattcaaagttaaataatgttgagaaagttatgcgggtgtatgagagaatgcggatccagggtgttgaacccaaccagactatatatactactatcatggatgcacatggcaggaactcagattttggaaatgctgtcatttggttcaaagaaatggaagctcgtggatacccaccagaccagaaagcaaaaaatatcctactttcacttgccaacacaccagaagaacaacaagaagcgaatgaattggtaggtaatggtgcaattcagctggaagtgaaacctgataatgaagaggtggatgatgatgggcatgaagttatacatactgatgctggaagtcaccgtttgcttgacgacacacaaacaagaaaccacgtaaatggtaggatcagagctggtaattatacttttgatgaggatgataacgatgatgacgacgatgattatgaggaagaggatgatgaagagttcaattttgtttctttcaaagataagagagaactaaattttgcaagttgatgtcataaatcttggtgtatattttttccacaaactcatgatcacacgatggcctttcctatacaaagagactaacttgaaatgttaatagaatttggctcgaaccttgaacg

SEQ ID NO: 10798 - DNA, 713 bp, Sorghum bicolor
  Clone ID: SORBI-28MAY03-CLUS61612_1
gtccttcagatgatgcgggagactggtgtcaagccgaaggaaagcacccaccgtctcattgctgatgcatggaaagctgttggtttgatcgagaacatcaacaactcaaatggttccccgaatggtccttatgcaattgacaaattggatgattcagatgacaattgcaacgtgcaaatatcagaagacgataacaagctgcaaagttttgatgaaagtaaaggacgtgcaatgaatggtcggtcacgttccagttttcttcagataacaaatgcattaggctgcggtggtatagtttctgccaaggtcctgaaggttggagaatttccatccgaaagactgaaggctatcaaaaacacgtcctttctacaaagatcacaacgatttcaattattgcatctcgagttttgtaggaagcagcttaagaatggtggattctatagtcagagcatcagctcattcaaaatggttttctctagtagaggatatatttattaattagacgtacacattgggctgtatcttaaaaaaaatcttgatgttccaaatctgctgcctatgatgtgggtcattttatatgactagttgggtcattttgtatgactagttgagcacctgtgcgttgcaacgggagcacaacattaagccgaaggtaatacaataaagccatgataatatacattttttttgttcaaactcatgttactatgagc

SEQ ID NO: 10799 - DNA, 662 bp, Sorghum bicolor
  Clone ID: SORBI-28MAY03-CLUS61737_1
caagaaaagattttcctagctgcaacgaaggagtcttctacagatgttaatcaacagtacacaaagatcacattcacacccacacaggctgatcgatttgttttagcattccgggcatggctaaggaaatttggcaatagtcagcctgagtggtttggaaatcctagccaggaagcattgccttccacggtcctttcaaagcgtgagatgctagacagatacgagcaacacacattgaaatgctcgtcttgcaaaggagcttaccatgcattccagactctgcagaaggtattcatgggagcgacagtagtgggctgtgctaccgctgggattcctgcagatgttcagctcagactattaattggtgcagctgctttgattagtgccgctgtagcatatgcattccatgagctccagaagaattttgtattcgtggattacgtccatgctgacattgattgaaaactttgtggggatctgttgtgtcgacatcgcacgctcgtgtctgtagtctagggctcttggcgtgtagctagggaaagtagtaacttttttgccggatatatagctcatatatatgtgtatataatagtaggcacgcaattgtatccgatgtaatgcggagatataattttgtatcttactgtattatatattggatt

SEQ ID NO: 10800 - DNA, 1168 bp, Sorghum bicolor
  Clone ID: SORBI-28MAY03-CLUS61842_1
ttttttttttttttttttgtgacaacagacgcagagaggattgacccatgttgatgccttgccatggatacaggaggcgtgcacggggcacctctctctctagagaagcttcagcatcttcagccgttcctcgtgctccggatcaagcttaggcgccgtgtagttgccgtgaaggtcttccaccacgtattcctttgtcaactccctttttgtcaggatgtgataatgcctctgccagatcctctggaccgccatggttgcagcgaggaagccgtaggcgatgccaaggatagcaaacacaacgatgaaaaccaaaaccagggcaaagcatgcctccaaggaagcaggcaggcagtccaggatgccccaaccatagcagcagttccggcacccagccaggcatggatcctggttatcgttgaaggatgagcagtgtacaatcagcccaaagaatccaagcagaacaaagaaaaccacaacacctatgcaataatagaatggtattgggtgctttgacaagaagcggtcccaaccatcgctgaagctgttccggaaacttccatccctgtctagaaagtatgcaattgcaccgataatagcaatagtaagctgtacagcaagaaagacgagtagaacatcccttgcaacaaagatcctgaacttcattttatgccacgagttatcctcccaggtctccactcgaagatgaaactgagctttgcaagttgtgcagtgtgaaaatgcaaatccttccttaacagaccgccagtggtcaaggcaagaacgatgaacgaactgctgagttcccttgcacatgcaaggtgatattagctcatcacctatctcagactcagcctcaaggcaaatgcggcagcacgcagcagaagagccgtcagtctcttcatcctcaatctccggcgggctcacagttgctggctgtggcggtgacagctccaccgatgactcagactccctgttctccctcccaagaagagggtccaagtcatttgggaccacctcttccagttcctggttcctatccattccgaggccgttcttctcttcttctagttttcactgcaacaactgcgggctgcggactcggagaagcagctaccgtcgccggccgatggcgagaggagagagagaactagctcgaggggggccc

SEQ ID NO: 10801 - DNA, 1594 bp, Sorghum bicolor
  Clone ID: SORBI-28MAY03-CLUS424_1
gcccctcgggcccgggccccggatcggtgctgccgcgcctcggcggctgcccctcggcgccgtcccgcgtcgcaggcgccgcccccggcccggccgcggccccctgcggccgaggggcagtccctgccccggcggcggcggcggcgcctccccgcacctgcgagtgatgcagtgtttgaaaatcactgcctagttcactttcccagccttttgagattagcaagggaagctggacttgaatatgtggagattcagaatttagccgagttttatgatgataacagaacacaatttgctccaatgcttggtggttacagtgcaagttttttggatgctcgtgggaagcttgttgctcgttcctacgacattttaggcttgtattcaacatttgtattctagaagccatttttgcctgcaataataccgagggtatctcccgacttgcatgatcctgataatgctcatgaagagcgggaatggcgccagccaggccactacataggcatcgatgcctctgcttccggtgtcaatgatgcccgtgagctatgggacaacaagaggaaacctttcaccgctgaattcatcgagttggatcctactgatgatggttttgaagctcaagtgcaggaaaagggcatccaagcagatatggtttgctgtatgcagcacttgcagttatcccatagccccgcgtccggggccaagaagcttctgaacaatgtatcatcacttctcaaacctggaggctacttttttggcttgactccagattcatctacaatatggacaaagtatcaaaagaatgttgaggcttcacataataagggtctgaaggctgttccaaatagcattcgctcagagaactatacaattacgtgggaagtcgaggaagaaaagtttcccgtttttggaaagaagtaccaactcaaatttgcgagtgatgcagtgtttgaaaatcactgcctagttcactttcccagccttttgaggttgtgttgaaacagattagcaagggaagctggacttgaatatgtggagattcagaatttaaccgagttttatgatgataacagaacacaatttgctccaatgcttggtggttacagtgcaagttttttggatgctcgtgggaagcttgttgctcgttcctacgacattttaggcttgtattcaacatttgtattccagaagcctgatccagatgcaataccaccgattgtatctcccaacttgcatgatcctgataatgctcatgaagagcaagaatggctccagccacagcaggcatcagtggaagatgagaggcgcttgcatgcggatgtgcttcccatagacccagcgaaaggcatcctgggtcctggacctgcagacatgaggctttagttgctggaaattcaaatgcagctgaacctgggtagtgatgttttttcatgtgcggtgtttccactttccactaaggacattttcccatagccccatgtggccatgggacccatatgagttcagaaaaatatcaaacaacattacaaggctatgtaatgttcgtagttttgaggcttgaccagatcttgccgtaaacgacagttttatgacc

SEQ ID NO: 10802 - DNA, 746 bp, Sorghum bicolor
  Clone ID: SORBI-28MAY03-CLUS4222_1
ccgggagcagaagatatatataacacatcccaatccctcagtgccccccttcccagccgccgccgccgccaagcgcccccgcgagccagctccggcgaagccgatcccgcgcgccgaaggcaaggcaggcaggcaggcagcatcaagcatggcggacgcgaaggttttgcccgcggtgacgctccgcacgcgcaagttcatgaccaaccgtctcctcgcccgcaagcagttcgtgctcgaggttctccaccccggccgcgccaacgtctctaaggcggagctcaaggagaagctggctaagatgtacgaggtcaaggaccccaactgcatcttcgtcttcaagttccgcacccacttcggaggcggcaagtccacggggttcggcctcatctacgacaacctcgactcagccaagaagttcgagcccaagtacaggctcatcaggaacggtcttgctaccaaggtggagaagtcgcgcaagcagatgaaggagaggaagaacagggcgaagaagatccgtggtgtgaagaagacaaaggctggggacgcgaagaagaaatgagcaaggatttcagtgtactttagacgtctcgactttgagtgccacctgttcagcgtccgaatttttgtacaccgtatcgcaatgctttgatcaattagaaagagaatttttgagctggttacatcttctatctactggtacatttgatttggaaagcatatatcccctggtatgacctgacttt

SEQ ID NO: 10803 - DNA, 527 bp, Sorghum bicolor
  unsure (1)..(527): unsure at all n locations
  Clone ID: LIB3481-036-P1-K1-D6
cgtnccccgcctgctgcggccgccgccgccgcgcccgcacagccgcagcaaccatggcggattcgaaggccactgcggcggtcaccctccgcacccgcaagttcatggccaacctcctcgtggcccgcaagcagttcntgctcgaggtcatccaccaggccgcgccaacgtctccaaggcggagctgaaagagaggctggcgaagctctacgaggtcaaggactccaactgcatcttcgtcttcaagttccggacccacttcggaggcggcaagtccaccggcttcggactcatctacgacaacctcgaggccgccaagaagttcgagcccaagtaccgcctcatcaggaacggccttgctactaaggtagagaagtcacgaaagcagatgaaggaacgtaagaacagggcaaagaaaatccgtggtgtgaagaagacaaaagctggagatgccaagaagaagtaagggggaagtttggttgctgccatcttcatcttgtttgctttggtttgttagggtgggttcc

SEQ ID NO: 10804 - DNA, 1448 bp, Sorghum bicolor
  Clone ID: SORBI-28MAY03-CLUS42954_1
gcacgagggcaacactttctgaaaacgatactgttgtggtgaactatgggcagctggaatacaagttaaaggttcttgaactgaagcctgcatcaagtgtatctgtcctagagacagatgttgaagttgacattgagggatcagattcggttttggacaacgaagaggaccaacatgtgcttgtgcctcttgtaattggaaacatagaatccagtgttgtggaagaaggaaagttcaggtactacaaattttcagttgaagaaaatgtgagtgagaaagtagcttctgggcgcgcaaatatcgaggttaaaatagataccgatgcgagcggtggcgacactgatatctatgtttcaagacatcctttagtattcccaactcagcaccgacatgagtggtcttcccatgaaatgggatcgaaggttcttatactcaaaccgcgcgaggctacattggtcactggtgtttacagtatcggagtttatggtttcaaagggacttccaagtaccagctctctgtagctatcaaggatgttaatagccaaaggattggtgaatatgctagtgcctcacgaagtgttgatgttgattcagtgctgtgtaagaactgtaagcgccatatagccagccggtctgctcctcttcatgaggcatactgcatgagacacaatgtcgcctgcccgcatgatggatgtggagttgttctccggaaggaagaagcagcagatcatgtgcactgcaacaagtgtgggcgagcttgccagcagagagaaatggagaagcatatgaaagtcttccatgaaccgttgcagtgcccctgtggggtggtcctggagaaggaagatatggttcagcaccaatcctcgacctgccccctgcgattgattgtgtgccgcttctgtggtgacacagtccatgctggtggagagcctgctgatgttcgtgaccggttgcgaaacatgtctgagcatgagagtatctgcggatccaggacagcaccatgtgactcctgtggacggtcggtcatgctgaaggagatggacattcatcttattgctgtgcaccagaagagctgatcacctacttggcactgggctgatctgaggctcactgcaggtcattggtcaatagaagctgtgcagttcaacgtgtggcaaattccagctctggccttgtttggacgtagtcggatttacaccaatccacatgtgttggggtggattgaagtggaacttgaactaaatttcacctccattcaccccaacccaagtggattgaggtgaatccggtaacatccaaacaaagcctctgttggattgaaaaccacaccccttgggactagaaactcaatgtgaattgtcatttgtggtgttccatgggattaaacataccggtgttggtgtgatgtctgtattttatctctctgtattatctgtaaatcttctttt

SEQ ID NO: 10805 - DNA, 776 bp, Sorghum bicolor
  Clone ID: SORBI-28MAY03-CLUS42402_1
gactcttctcattgcctttttgcctgtgcttgcccccgttcctttctcctccagcaagtaaaccccgtttccgcagcgtcacgcaccgccgccatgccgaccgtaagcgtgaaatggcagaaggaggtctttccaggcatagagattgacactagccagcctcctattgttttcaagagtcagctgtacacactaactggtgtgccacctgaacgccaaaaaattatggtgaagggtggaatattgaaggatgatgcagattggtctactttgggagtgaaagacggccaaaagttgatgatgataggcacagctgatgagattgtgaaagctccagagaaaggtccagtgtttgttgaggatctgccagaagaagagcaagtggttgcactgggtcacagtgctggtctttataatcttgggaatacatgctatatgaattccacgttgcaatgtctgcattctgttccagagctgaagtcagcactgctaagctattcagatactgtaagaggtaatggcattgaccaagcttctcataatttgactcttgctactcggaatacctttggcgatcttgatcaaagtgttcgccctgttgcacctctacaattcttgcagacactgcgtaaaaaatacccgcaatttgcgcagcagcataataatgtctacatgcaacaggacgcagaagaatgctggacacagttggtgtatacactttctcaaactcttacctcagattcaagtgaatctgcagttcttccgatgaagcaact

SEQ ID NO: 10806 - DNA, 816 bp, Sorghum bicolor
  Clone ID: SORBI-28MAY03-CLUS42997_1
tgatgatgatgaaggaaaaatctttgctaattcaagaagttccctacatctaaatgtagctttttgctaccagaagatgggtgaatacagaaaatccattgaaacatgtaataaggtgctggacgcaaatcctgtgcatgtgaaagctctttaccgccgagggacgtccttcatgttacttggagaattcgatgatgcaaggaatgattttgagaagataattaccgttgacaagtcatcagaaccggatgccacagctgccctccttaaacttaagcagaaggaacaggaagctgaaaagaaggcgaggaagcagttcaaaggactctttgacaagaagccgggtgaaatatctgaagttggtgtagaatcagagggcggaaaggacgcgggtggtgcaagaggctctgatgaggcaacaagtgctgatagaggtgcaaatacaatggatagtccgaccagagaaccagagtacgccttcgaggaagagaggcctgggcttcttggccgcttgtggccctctgcgaggaggatcttctcgtctcttggcttgaacaggtgcacaatactctgagtttctactgcggcgacttccaaaatcatggcagtgaagaggagctgcccccgaggtttctggtatttattagaagtacctgacgacgaaaaattgatgaggaaagtttggatgtatgtatggtaaatgaaccgtgtgcaagatacaaccaccgatgtaaatgagataaagtgcagggaattttattctcagttccgatggtgcaattttggtgatggtaatgccacggcaaacgtggcttg

SEQ ID NO: 10807 - DNA, 666 bp, Sorghum bicolor
  Clone ID: SORBI-28MAY03-CLUS40583_1
ggtccggtgcgatccctccatccatccatcattacaaaatccctccttcccctcttccccctcccttcgtaaatcgcaaagtcaaatctcacctcgccagaggctgcctgcggcctactccgctccgcgctgcgcctctccacagcctcagtgccctgctgcgagcgacccttctgttctgcgttcttgggtgatcgcgggagcccggaggcctttgtaggtttttatctgagggaagaagaaaactgtacaattcatcatgtcaggagtgtcgtctgaatcttccccattatctggacgaaatagctttagttctcctctgtcaagattcaatgaccttgaactgtcttcagagtctggttgcttgtccattattgtactaggtgcttctggagaccttgctaagaagaaaactttcccagcgctctttcaccttttccatcagggatttctgcaatctggagaagtccatatatttgggtacgcaagatcaaatctttctgatgatggattaagagaacgcattcgtggatacctcaagggagcttcagatgaacatgtttctcaatttttgcagctagttaaatatgttagtggctcctatgatagtggggaaggatttgagttattaaacaaggcaatctctgagtatgaaacatcagaaaa

SEQ ID NO: 10808 - DNA, 774 bp, Sorghum bicolor
  Clone ID: SORBI-28MAY03-CLUS4070_1
cctctaagtcagcattgatggcaacatctgtactgtaatggttaccattttggtcattgaggggtggcaacgcaaactggacccaggctttgatatcatgcacacgtcgtccgctttactgatagagaaggacgtaaagcaaccaattgattttttctcataagcaaaagatgtcagatcgttctcatgtatagaaagaaacaatggaagatgatgccctaccgatcagaaggcgaaacatttaatctaacttaaggcaacctggcattagttgagcaaatatactatgcactatgttctctctcctttcttgatagtattagtagcagaaactgtccgcattaggtttcattttttacaaccttcagtatgaaaatttgtccacccaggcggatccagccatggatttgtctaaaattcttctgaagtttctgtccacaaactcttatggaagagagcaaacaattgtagaacagagtagtcattgaggccgagttgaactacattgcatagcacacataagtttgttgccagactatttgtgccgacgcaaacgccacccaggctttgatttcatgcacacgttgaagactttactgatagagaaggacgtaaagcaaccaattgattttttctcataagcaaaagatgtcaggtaatgttgattcctgtaaataagctttttttttgttgtcaaaacttcacccgagaaattaatagagcaattactgcacccaaggaataaatgtattgcaacaaccctctagtaccagc

SEQ ID NO: 10809 - DNA, 668 bp, Sorghum bicolor
  Clone ID: SORBI-28MAY03-CLUS40807_1
tcttcggacagaatcttatcagatatggaaagttgttatggcaatttcaagtgtattgatgtttgtgagaaaaatgcactattgactcatcttcttggtgctcatgctgcgaaaccaagagcaacgtcggtcaagctttgcaaatggcctccatgtggttctgcggtggtcgacgtgcaccgacacgcagctactcactgcatcgagtggagcacgttggataaagccagggcatcaccactttcttttggtatttcagatctgttgaaccgatacacgtggcaggaagtgattcgggggatgaggtatgagttccctcattatccccaggctgtggcacgatctttcgagaacaacaagttgtggtacacactgagtatgcataggaggctcccagttcccagcatctatggatatgttgcaccccgcgttagtaaataaggcgttttcctgtgaatacaatatctataagttatcaggacggttcaacatctagtgatttagatgcttagcccatatctttaatacattggttacgctgctgtaagcctgtacccttaagaggaggctaaactgatatactgctgtaaagtatatgtcttccggaagtagcaggggataaaatcccagtgcgccggcttgagaatagcctatttatactcttcccc

SEQ ID NO: 10810 - DNA, 914 bp, Sorghum bicolor
  Clone ID: SORBI-28MAY03-CLUS4100_1
ggatgttgatgatataacaatgttgttacataatgttccatatggtgaggagaagacaggcagggtgcatgctgctaggaggttatttgagtacttgcaggccagtggtttgaacttccctgtaattcatcacatagatttccctaaagccattgacagagatggtcttgtcattggtgctggggccaacgttggtgctctcctagtcgatggtcttggtgatggtgtacttcttgaagctgctgaccaggaatttgagttcctgagggacacatctttcaacttgctccagggttgcaggatgcgcaacacaaaaactgaatatgtgtcttgtccttcatgtggccgaacactctttgaccttcaggaaatcagcgctgagattagagaaaagacctctcatctgccaggtgtctcgatcgctatcatgggttgcattgtcaatgggccaggagagatggccgatgccgatttcgggtacgttggaggcgctcctggaaagatcgatctttacgttggcaagaccgttgtgcagcgcggcattgccatggaaggtgccactgacgccttgatccagctgatcaaggacaatggccgatgggttgatcctcctgccgaggagtaggactgtaggctgtagcctagtctgtagtttatactgtattttgtaaagcggaacacgcaatgcagtaactgcgcacacaatgtacatcatccctacactttttgtacatctattgagatttgggaaataaattagaaatcttgggtgagggcaagtctgcagcatgccagcacccccgatgaagcagataagatacatcagaagaatcctatcatccatcagatgttaaaaaaaaagattatgctagtatttctgctaattgctattcttgtttggtttctgaacccaa

SEQ ID NO: 10811 - DNA, 1061 bp, Sorghum bicolor
  Clone ID: SORBI-28MAY03-CLUS41182_1
ccccctcccaatccttaacctccccatcgttccatcgattggtggttgcgtcgtttcttcgagttcgtggaggttggagtcggagtgtgagtgggccgcgtgcgtgcgagaggatctgagcggagacgagagggcatggaggagagcgaatagcggttgccgagtcagaggcgttgttgtggtttctgatcgtactcgcgtgcgtttgccgggcctcgatttcgagcaggcaacagctttttaccggagattcttgggtgtgtgtgtgtgttttgggccgcaacttttacccgaggcgggttttgtgtgctggtgttcagttttgttgccggattttgaattggaggaggagcggagattttttttttttgcctgtgttttcgggggtaatggtttcggagtccctgttttgcccgccacatgaagacttgagattcatataggttgttggtctcgcgcttcggattactgaatttttgctccattttttcgttgtgctactcgtcaatcaaaccagtgaagtttgaactctgaaagaagaaactttcctaattggacccggtatttcgtgggtggcgtctaatctattcaggttttcgacgactcggcagatccagggggggaacgccgacgaattttgcctgatttctccgcggtttttggtccgatccagaggctcccagtctcaggctttttttctcgcgaagaagcaaggttttcccttcttttttttcccccgccatgtccatggcgttgagccgcttcacgcaatggctgtggccggggggcgcggcggcgcgggtggcggccacccacgagcaccccagcgcggggctgacgagctcctccttcccggacttcccatccgggttccgggagcccgacaccgtcacgttctacaccggcgggggcgccggcggccgccgcgcgcgcccgaggagggtcagcaaccgccgccgcagccgcggggaggcccgtgtcgaccgggagtacgacatggtcatcgtcccgtccgacggcggcgggtgcttgtccggctccgactcggatgattccgattg

SEQ ID NO: 10812 - DNA, 866 bp, Sorghum bicolor
  unsure (1)..(866): unsure at all n locations
  Clone ID: SORBI-28MAY03-CLUS43739_1
ccccggggcctcctccccctgcggtctgcctccctcgcccccccccgctcgccctcccctgccggccggcccgccgcccgccgcccgcgccccccccccccagctcgcgcctcctccttccctccctacgcccgccccgggcgcccaccgcccccgtcctcccctcccgtccagtgtttgcgtgtagctctgtcccgccgcccccacctaccgccccccccctatttcacaagcctcatccgcccctgatgacaagttgctggctgtacatgtgtacacccatgtccttcactgggtccgcccctgagccttccgatcccaacacgaaacctgcgaaaaagcagactcgacaatgggctgcgtggacacaccaagaggaggagaatttcttcaatgcactgcggcaagtaggaaaaaactttgacaagattacacaccgtgttcagagtaaaaacaaggaccaggtcaggcattactattaccgtcttgttcgacgcatgaagaagctactgggtcctaggttctcgcttgatgcaaaaaactccaaggataccattgctgctatgcttcgctggtggtctctgcttgagaaatttagctgcagtgcatcaaagctgcatctgaagcctcggaggttcaaaacatttatagaagcattgggaaaacaactgctaaaggacagaaataagtccaggagaaagcgttcacgagtggatatgtgcctaccttctccatctccaattatcagcaaggctcctgngaatgagactcctcctgtaaagttcctgccagtagatgctcaaaatggtagcagagtagcatcttctaaagggacaattttcaagcgggttgctgaaccnnatttc

SEQ ID NO: 10813 - DNA, 679 bp, Sorghum bicolor
  Clone ID: SORBI-28MAY03-CLUS43892_1
tctggcccctccctccccgtaatcccacccagccgccgcgccgccgcctcttacctccggatctagtccagcatcgccgccgcaaccatgggcttcgacgtgggcgtcgtcccgtccaaccccgacggctggggccctcctgacgtcccggcaattccgcagtccctgggcggcggcgcctccatccccttcgcgcccttctcccgctccgacaagctcggccgcatcgccgactggacgcgcaaccccgcgggcccagccgccttcgcagcggcgtcccgggactccgtcttcgacttcacctccgccgacgactcgctcatcgccggggccgaggactcctcattccgcctcgtcgacgctaagccaccgccgcggccgcaacggttcggccccaagtggcgcttcaaccagcgccagcagctcccgcagcgccaagacgaggaggtggaggcgcgccgccgcttggccgagaaggagcgcgcacgccgcgaccgccacttccagaacaaccgctcacatcaccactccaacttccggttcaaccagcctttgaactcggccaagccctccgtcgacatccagcccgactggaccatgcgcgagcagatccccttcgccaacttcaccaagctctccttctccgtcgccgaccagcccgaggatctcctcttatgcg

SEQ ID NO: 10814 - DNA, 626 bp, Sorghum bicolor
  unsure (1)..(626): unsure at all n locations
  Clone ID: SORBI-28MAY03-CLUS4406_1
cgtgcgctaaatcataactctnatccaattcataacattagcaataaccttgaagctgaacttttggatgactttgaagtcgagctagataaccacgagaatactgatcaaaggatcactgatgatggaaatatgactgaatcaggggacacaacaaactctgatgctaatcggagggctggtttgaaaagaagacacagattggttattgatgatgacgatgaggatgactaacttttcaggaccagagttattaccaaagaatgtgttaccaaatcaaatgtgggataaaaaaaagctgtttcaggatgatctgcttctatttccctcgcactgctgagctccaagcagggttcaggatgaccacctgtctgtttcacacttcccagtgccagatgttcttcacagaaacttcattctgacctgcagtttcatttgtactagttggttgggtcacaatcaaatggaattttgcatatgcaaagttcaggctgtagagctgtcatgtgtggcctcttgtacagagtccttttagggggtgttctgatgataatttcgagtactgttagttgtaattgaaactaccagcactgcaactctagcaaatgtaatccgtagttgagggc

SEQ ID NO: 10815 - DNA, 649 bp, Sorghum bicolor
  Clone ID: SORBI-28MAY03-CLUS44114_1
ccctccgatttcgccgtcacctacgaggacaaggacggcgacctcatgctcgtcggcgacgtgcccttcgacatgttcatcagcacctgcaagaggctgaggatcatgaagggatctgaagccagaggactcggatcagtcaagaacaactgaggattgtcgcagatcgagatgcacggcttgtgcattcgtgagcagattcttttgttcttttggggtttcttgtgttgtccaaagcgtgtttgtctgccaacaatggagcagcaaaccaaaagcatggagaacgactgacgagaagatgaagctgcttgggttgaaggagagacagagctttgtgcatccaagtgcatgcgtggaagaatgatgtgtggtcactttgtttgttttgttttttcttttgtggtactacttgtaggtgttattagcaacacaaaaaggagtggagagtcgagttgaatctccatgtgtgtttgtacaaagccaaagatcactcttctttcttgtcttacttaagttatatctacccatcaatcaatcagtacttgattgcttctgtaagtgcaagtgctgcaagctaaggggggaaattgggcctttaattcccccccttgtgagttcagctatctatctatccatgtatttttatttc

SEQ ID NO: 10816 - DNA, 1132 bp, Sorghum bicolor
  Clone ID: SORBI-28MAY03-CLUS44178_1
cgcttatgtccagcaacaagcaccctcaccaactccagcaaaggtggccccgaaccataaaagtcaggggaatgcttcttcccggcaagcttctggatcatctccatcacaggcagttgcccctgtccaaataagttccaatgctcccagtcgttccaagtcaattgctgaagatgatttgttttggggcccttctgagcactccaaacaagataaaaagcagtctgagtttccatctctgtcaagtcagagcagaagttccatgatgaaggatcaatctccactgaatcgtcaaaagtctcaggcaggcagattgccagtttcttctgctgctactgccaaccaatctggcaaagggaaagcagaggctgcgaacaagcagactgaggcaatggacttcagagattggtgtgagagtgaatgggccaggctcactggaacaaatgatataagcttccttgagttctgcataaagcaatcaactaccgaagcggagatgctccttcacgagaacattggttctcttgaccgcagtcaccagttcatcgacaagttcctcaactacaaggccttcctgtcagcagacgtgatcgacatggccttccaagctcccaacacgcgtggtacccgcggtgacggcgcagggcgtgcaaacgctgctcctgcagccagaggaggcacgagcgtggacgcggagctggatgttgtcgggaagaagaaaggcaagaaggggaagaaggtgagcgcggcagtgttggggttcaacgtggtgagcaaccgtataatgatgggcgagatccagaacgttgattaggaggacgacggcggacggaccgtgtacataaccttttggttttccctccaggacatccatcgccgcatgacccatatacagacatagtttaacctcttgttatatgctgaagtttcgggcttaagggaagatgggtgtgtgtccccagtcttgctcggaatggagcagtctagtcttttgatagacctgtttttgctgagggtgggaaactgagttttagatgcagggtcatgcggttggtgattttgggttcctgtaacatttggttagtgtcctgtaacagacagaaaattttttcttctcaatagaaactcacca

SEQ ID NO: 10817 - DNA, 686 bp, Sorghum bicolor
  Clone ID: SORBI-28MAY03-CLUS41715_1
gcaaacccccttcgtcgtcctccgtcgccacagcagagcagcgagcgagcggcgcgcgcgatggcgggcggcggcgatcgccagggcgcgaagaagcgcaagcgcgagcatgcggaagggaaggccaagcctcggccgcaagttaagggaggtggggacggagggaagcggaagaagcactcggccgcagatggcggggccggagaggctgtggcgaggaagaagactccggttacccacaaggagaagcgcatcgcggccaaggaaatgtcggaggccaggaagatgaagaggaaacggcattacagccttgagaaggaactaacgaaactgtgggaaaagatgagatgtcacgatgtgagcaaagaagagaggtccaaggtagtaagtgaggctatcaagaaaatggatgggaaatatttggatattgccacatcacatattactgcacgtgttcttcaaacatgtgtaaagtggtgctcgcagtcagagagggatgctatttttgatgttctacatccacatttgctcgatctttctcgcaagaaatatgctgttttccttgtaaagaagcttatagaactcgcctctaaaaaacagtttgccagtttcatctcttctcttcatggtcgtgttgccaaacttcttcatcatactataggagctgcagttgttgattatgcatt

SEQ ID NO: 10818 - DNA, 726 bp, Sorghum bicolor
  Clone ID: SORBI-28MAY03-CLUS41840_1
gcacgaggcgccgccccgggggtgccggtgcgcgctggccgtccccggccgcgccgcgccacgggtggcccgggatcgccgggggtttcttgggctgcccgccccggcccgcacgggcagcacccgcagccgcagccgccggagtggcggttcgcgctggcctgcggcgagcgcgccgcgggagaggatgtgcaggaagtggacataatctctgcaattgagtttgacaaatccggcaatcatcttgccactggagatagaggtggacgtgtggttttgttcgaaagaacagacatcagtgataatgctagtcgaagagaacttgagaggcaagaatatcaggctgctaggcatcctgagttccgttacaagaccgaatttcagagtcatgaacctgagtttgactacctaaaaagtttggaaatcgaagagaagattaacaagatcaagtggtgccaaacagccaacaatgcactctttctcttgtctacaaatgacaaaacaatcaagtattggaaggttcaagagaaaaaagtgaaacgtgtttcagtgatgaatttggatacctcccaaagttcagacaatggttcaacttcaagtccaggtaccagtagttgcagggctcttctcccaaatggtggatgctcagaaaagatgtacactccgaacaacaatttgtcgtttcctccaggaggatgtgcttcgctgcgtttgcctgtggtggtt

SEQ ID NO: 10819 - DNA, 626 bp, Sorghum bicolor
  Clone ID: SORBI-28MAY03-CLUS42095_1
gcttcggcaacgccatcgtgcgggacctggtgaccgtgaaggtgggcgacgtgctgtcgcagccgctcgggttcgtggcggaccggatcaagcgcgccgtgtcccgcgtcgacgacgccttggtgcgctccgtcgtcgactacctggagctggaggccgagaagggcaaccaggcggcgcgcgggcagttcatgccggagtccgacctctgggtcgtcagctggctcggcatgcccatccacgacgccgacttcggctggggccgccccgggttcgtggcgcccgcgcagatgttcggcagcggcacggcctatgtgacgcagggctacgacaaggacgaccccatcaacgtcctcttcgcgctcgagcctgagtacctgcagaccttcgagaaggcattctacggggagtgaccatgaccgtgactgatcgaccagccatggcgaggtctatagaggagtgggagagccagtcgtcccgctgtggatgcgaagtgattgtgatgccgccgtggtaacttccatcggttcgtgtggagagttggtccatgtgcatcgatctgctgggggcctctactgtactatatcgtagtgcatgtttcgagatgcaactcgatgcctaccgtg

SEQ ID NO: 10820 - DNA, 845 bp, Sorghum bicolor
  Clone ID: SORBI-28MAY03-CLUS42167_1
cagcaatggaaaagctggaatgtggatttgaccttgctgaagtctggaaatttgaaggtgacgagggcagggcaacactcagtgcaggagagaattccccacctaccagtggtgtgactgtgcttggggctcaccaagttcctgaaacgggtgcacttacagggcatcctgatctgatagatccactgggtgataatgactttgaaacagatatagaaaatcttccagtgttcattactggagatcagaatgttgcgtctgccaaatttgaggatgagatagatcttgctcttgaagaactgaagaaatctcaggaaatggaatataacttggcagagcagaagctttacgctcagaaagaccgcatcctctgtctgtacagggagcttgatactgaaagggctcagcttgcagatcccatgcccttgtctgatgcttcaaattatggcgcaatgctcgctaatgttctacgccttgtggaccaaatcaagcgtgatgaggagaaatttaagtccatgctgaaagttgctggtggatttgcgaaagcaccaccaaacgtcatcaaggagctgttcgggttacctgctgataagtagttctaatatcagacttgcttggaacttagctatcggtagtttaccatagaatcgaacttggctatgctgttgtatgtagttctaatatcagacttgcttggaacttagctatcggtagtttaccatagaatcgaactcctatgctgttgtagctgttgtagttgcatgagttgtacatcctaccaacgggttaccccataagtctggtttggacctgcttgtgttaagagtcattaaatgtgacgttct

SEQ ID NO: 10821 - DNA, 631 bp, Sorghum bicolor
  Clone ID: SORBI-28MAY03-CLUS42263_1
acgtatccaggagtttgatatcctgaactggtggaagctaaacacagtaaagtttccaaccctctctaaaatggcccgtgatatcttggccattccaatgtccatggtaagcagtggcagctctatattctctgctggaacaggaagtcacatgctcgatgattacagaagctctctccgacctgagattgtggaagcacttgtctgtgcaaaagactggctccagtattcaccacctgccaccgaggcaccgagttctgcactggtgaaggctgaaggatcgtaggtttgtcgtcgccactgatcactgcctgccttgtggaagcaagaatctatttatccatctgtcgtatctatgagtgtagttaactgtaggtgtattgtaggctgagattgtgaactgattgtgatctattctggtatttatctcgtaaaggtgtgtaacttgtgttgaactctgctgaacttgtcactgttgtcatgtaatagtttatgtatcattttctggtatcgtctgatgttggagtttgcatggttggctatgtacgtgtacaagcccgtgggatgcatcagctggttgctgtgtattttgtttgaacccccgttttgtgttcaatttgttttgtactgg

SEQ ID NO: 10822 - DNA, 812 bp, Sorghum bicolor
  Clone ID: SORBI-28MAY03-CLUS44874_1
gcacgagggctcacccgagcttcccacctcacaccctcactgcatcatcggctccctctcctctccattctcttctcagttgtctcaccaactccccccaatcccaccccaaagatccagtttcgatccacgaacccccctcccaatcctccaaagatcaccgctttcaggtaccccccgcaatggctgccggcggcctcgcgctgctgcccgccctcctcgtcgcggctctctgcgccgcctcgtggcgcgccgaggcggcgatcggggtgaactggggcaccgtgtccgaccaccgcgccccgcccggcgtggtggtggacttgatgcgcgcgaatcggatcagcaaggtgaagcttttcgacgccgacccgggagtcctgcgcgcgctcgccggcagcggcatccaggtcatggtcggcgttaccaacggcgagctcgcaagcatcgcggggtcgcaggcggctgcagatgactgggtcgcgcagaacgtgtcccgatacgtcggccgcggcggcgtcgacatccgatacattgctgtaggcaatgagcctttcctaacaagctaccaaggtcaattccaatcatatatcattccagcaatgacaaatattcagcaatcgctggtgaaagctaatcttgctagctacataaagctagtagttccctgcaatgcagatgcatatcagagtgcttctgttccatctcaaggagtattcaggactgaattgactcagataatgacccagctggctgcttttctgagctctagtggggcaccattcgtcgtcaatatctacccattcctcagt

SEQ ID NO: 10823 - DNA, 655 bp, Sorghum bicolor
  Clone ID: SORBI-28MAY03-CLUS44913_1
tactggagggtttgtgcttcagccgccaccgcccgcatccgtccgaggagcgaaatccccctacctctaacatcgatcccctcctccaacatccatgggagacgatcactgtcctcccgatgatccggcgtccaagcacgacatgttccctgccaatatcctgattcccccgcctatgtaccccgaggatattgatccccttccggactccatcctcttcgatccgatcggctacatcagcgaccgcaccaaccacaccaccgccggcgccttgattaagggcggcaggcgcatcgaggtgacattctgggtggcccaccctccacgcgcgtcctacttctccgtccgcaccccatctggcctggagatcggcgaccatcccgcgatcgtcaccacggagaaggacctcgccctgctccgcgtccccttctgccatccaaactacaacttcaactctacggacagtgactacttcgtctatgaggccggcaccaagcgcaagcagccaaggctcaagctcatcgccatgcccccctatctctccatcccggacagcaacgtcggcctcctgcgcttccgccgacgcggtatgttcttaatcgccatactgtgttggaccttcaccattgggcagtacgatctccacctgtacagc

SEQ ID NO: 10824 - DNA, 1004 bp, Sorghum bicolor
  Clone ID: SORBI-28MAY03-CLUS44926_1
gcacgaggtcaagacacagtacaatctaatggacccattcgtgtccaggtgttgttcaaagccgtttacacggttgcaaggtttgctgatgctcttctgcatagccacagtcttagcctggttggtttcagggcattggttgctaaataacctactggggatttccatatgtgtagcatttgtcagccatgtgaggcttcccaacataaagatctgtgcgctgcttcttgcctgcttatttgtgtatgatattttctgggtgttcttctcagaaaggttttttggagcaaatgtcatggtctctgttgccactcagaaggcatctaatcctgttcacacagtagcaaataagctcagcctgcccgggttgcagttgattacaaagaagctggagcttccagtcaagcttgtatttcccaggaatttgttgggtggtattgttccaggaagcaatcctggtgactacatgatgcttggccttggagacatggccattccagggatgcttctagctctggtactcttttttgataaccggaagttcaaggatgtgaatgttccatcagatgtgtctcccccaaaacggcggaagtatgtgtggtatgctctaacagggtatggtattggcttggtagctgcactagctgctgggatcttgtctcagtctccccaaccagccttactgtacctggtgccatcgacactggggcctgtcatgtacttgtcatggttacggaatgagctgtgggagctatgggaagggtctgggacgattctaaacgagaaagctcgtttgctggaggtctgagatccaagtggacaataaaaaggatctgagcccgccgtaattgaatctaattaaacattagttgagctcctcatactgaaggagagtatttataagctagaatgttctagtcatgtaagctgctacgcagttgccctcgcaagaggaaacacagacaaatcatgtaactgtttgtaatagaaaggttcagttcaat

SEQ ID NO: 10825 - DNA, 948 bp, Sorghum bicolor
  Clone ID: SORBI-28MAY03-CLUS4495_1
gcgggagactgggtcgtagctgagtgattttcttccaatttgctaattggtcgccattgcaggcaacgtcttcgccctcgccctcttcctgtcgccggtgccgacgttcaagagggtcctcaaggccaagtcgacggagcagttcgacgggctcccctacctgctgtccctgctcaactgctgcatctgcctctggtacggcctcccatgggtctccggcggcggcggcagggccctcgtcgccaccgtcaactgcaccggcgcgctcttccagctcgcctacatctccctcttcatcttctacgccgacagcaggaccactcggctgaggatcacggggcttctggtgctagtggtcttcgcgttcgcgctcattgcgcacgcgagcatcgccttgttcgaccagccggtgcggcagctgttcgttggcagcgtcagcatggcgtctctggtctccatgtttgcttccccgctggctgtcatgggtttggtgatccgcaccgagtgcgtggagttcatgcccttctacctgtccctctctacgttcctgatgagcgcatccttcgcacgctaccgccttctgctgcgtgatttcttcatatatttcccgaatgggcttggagttatcctaggagcaatgcagctggtgctatacgcgtactatagccggagatggaaaaacagcggctcatctgcaccgttgcttgcttgatcataactgagttgatcagtcaattatctgtgtcgtggtttgtattctgtcatcctggagttctgggagaggggcgatggagagggtgttttttttacgttaaacaggaggggcgcacccctactggtgggttattaggaagagtttgaaagtgactacaaaaagaaggaggtgggggagagtaaaaggattaggagacaaagaaagaaatgaaaaaatgagccacactaagtaga

SEQ ID NO: 10826 - DNA, 1102 bp, Sorghum bicolor
  Clone ID: SORBI-28MAY03-CLUS44952_1
gcacgagggaattatggcgttcgacgtatggaccttggtggcaaggcccttacaaattatctcaaggagcttgtctcatatcgttcccttaatgtcatggatgaaactccccgcggtgatgatgcaaaggaaaagctatgctttgtgtcgcttgatgtccctggtgatcttcaccttgccaggttatcatttaaggacaacccttttaggtgttcttacattctccccgatggtataacatacaagaaagggtttgtcaaggacatgaatgaagcacatagatatcgctctctgcctcttgatgaagaagcaaagagaaaagaacatagcatggatataaataagtccgaggaccggaaaaagccagaattaagtcaaaatgaatttgtattgacaaatgaaaggttccttgtcccagagatgctttttcatccaatcgatcttggcataaatcaagctggacttgctgagtgtatagttcgtgctgtacaagcttgccatccatatcttcaacctgtgcttttcgagagcatcatcttgacaggtggaagcacactgttccccagattcgctgatagactggagagggaacttcggcctcttgtccctgacaactacaaggttaaaataactcatcaagaagacccaattcttggtgtctggagaggcggatctattctggcatcaactcctgatttcgaatcaatgtgcactacaaagtctgagtacgaggagatgggatcagcaaggtgccgacgaaggtttttccactgaagagtagagcttgacaatttagttgcatgtgaaattagaagttcggtttacagtagtaactcctctgcgcctgggatttcttttctttttagtaaaaaatgctttcttgtagttcactttttcagtagatagctcatgtacccgctgatctgatctgacaactgtagcaagtcatgagattgaaatggcaaactgccaagctggttcatccttgctatgatccttacggccttagcgcataagtttttttcccccatttctattggaaagatgcaatgtaacgtacactgtcgtgaatcgcttcaagtttttttttttggcaacaacc

SEQ ID NO: 10827 - DNA, 647 bp, Sorghum bicolor
  Clone ID: SORBI-28MAY03-CLUS43090_1
cttaaagctggacaataaccccttggtagagatatcatccactgatcttgtgcctctgtccaaacttgaagtacttgatctaagtggcaatgcttcagcacttcctgaaccttctgcagtttctgcattaccacagctgcatgagctctacctaagacgaatgaaactccatgaatttcctaatggtttgttgggcctaaaacagcttcggattcttgacctgagtcagaatagccttacaactgtgcccgagggcatcaagaatttcactgctctcattgagcttgatctgtcagacaacaatataacagcactcccagcagagctgggattacttgaagctaacttgcaagtgttgaaactggatggaaatccactaagaagcataagacgaactctgttggagcgaggaacaaaagcaattctcaagtacctcaaagaaaaattgcctgctgaataatatttatagagcaaattattgtggagtcatgcaataaaatgtttttttttggctactgtatcttgtgttattccttttcaatattctggacttaattttatggaaaaaaaatctggatcttgtgtgagaagggagctttgtgatcgtttgtgtgttgccatcctgatattatccacattttttatgg

SEQ ID NO: 10828 - DNA, 1086 bp, Sorghum bicolor
  unsure (1)..(1086): unsure at all n locations
  Clone ID: SORBI-28MAY03-CLUS43211_1
tggagccatccctccccacgcacagaaacaccaaagcccaacaaaacccaccaccacctcccaatggagaacggcgacgaaaccctcgcctcccccaccgccgccgagaaggccgcgctcaacggcggcgtcgcggaggaggagcaagtacccatcacccaccccgcaaagtcctacgccgccgtcgccgccgagaaccccgctccaaacggcggcgtcgcgaaggaggaggaggaggaggaagagggggtcgccggcgcccacaccgccgccaggtcctacgctgccgtcgccgcccgcgctgagatcgaggacctccgcgccgccaagctcgacctggaggcgaagctcgccgaggcccgccgtgagaacaagtccctcgccgagcagacgcacagcatcgaggggaccttcatgcaggcccgggaggaggtcaccatcgccgagctcgccgccgcctctgccgagaaggaggtcgcctcgctccgcacggaggtcgaccgcctcgaggccctcctcaagactgagaagggcgagcgcgagctggacaaggagagccacgagaaggtcgccaaggaggtggatgccgtgcgccaggagaagctcaagctcgaggaggagatcagcgccctgaaggcttccgccaccgcagccaccaccaaggagnagggaggctgcgctggcggctgaggccccgaaggaaggggaggctgcgtggctggggatggcggtggctgcggctgccggcgccgccggcacggctgctgtcatgctgatctatctccgccttaagaggtaatctggtgctcggttgcgtagcagtgctggaagttttcgtcgtgatgctgctattactaaactggaagttttcgtcgtgatgctgctattactaaactggaagtgatgcgacttctatgagtagttgcttattagcctacagaattatagggatctggagactggttatgtttcatggctgtttttgcggtgacacaaaaaaaaaatattcgggaaactgaggaacgttgtatggttggttatcttctggtttatgttactgctatggcatggcctcatgtcgctttt

SEQ ID NO: 10829 - DNA, 1049 bp, Sorghum bicolor
  Clone ID: SORBI-28MAY03-CLUS43309_1
gcgggagcagcactagtaaatcgcgcgccatcgggaagatgttcttcaagaccaagctctgctgcaagttccgcgccgggacctgcccctacgtcaccaactgcaactttgcgcacggcatggaggagctccgcaagccaccgcccaactggcaggagatcgtggccgcccatgaggaggccacggagcagcgggaggagcaccagatccccatcatgacctcgggaagtgtcgtcgctggagacggcggcggcggcggcagctcgcaagggggcagggcgtacaagggtcgacactgcaagaagttctacactgaagagggctgcccctatggtgacgcgtgcaccttcctgcacgatgagcagtccaaggcgcgggagagcgtggccatcagtctctcgcccacggttggcgctgggggatacaatgctgctgcctctgccaatggagtgatggtgcagaagccatccaactggaagaccaggatctgtaacaagtgggagatgactggatactgtccatttgggagcaaatgccactttgctcatggttctgctgctataactgcagaacttcacaagtatggagggggcctcatggacgtagatggcagggatatcgcgtctactccggactcgaagcaagctggtgcttctactaaagctcccgctgactctgctgctgcatccactgcaatgcctcctcatgcagacgtgtaccatctcggcatccagtcacagcgctccaccatcgtcagccagagatctggacagctgcaaaggcccattcagaaatggaagggccctgacaagatcagcaggatctatggtgattggatagatgagaatgagtaggaaggatctatgttaggccgcgaagggaggctgttagtatctgtgtgactccgcgtcagctggtgaaggtttaccaggcatagaaaccttgtcttgacacaatgcagggcgtttgtcttatgttatgtttgctgcgtgcccctgctgttgtctctgttgtaagcatgcttaacagcttaagtcaagatcaatttg

SEQ ID NO: 10830 - DNA, 1145 bp, Sorghum bicolor
  Clone ID: SORBI-28MAY03-CLUS43267_1
gcacgaggcaaaacgcacgaggcttccttgccccgccctagggttcgcgccgccgcgcctcgccgcgccgcgccgccgttgtcgtagccatggggtcctcgctcccgcccaaggaggccaacctcttcaaagtcatcgtcaaatcctatgagactaagcaatataagaaagggcttaaggctgcagattctatattaaaaaagtttccagagcatggtgaaacactatcaatgaaaggtttgacgctaaactgcatggaccgaaaatctgaagcgtatgagcttgttcgccgaggcctcaagaatgatctgaagagtcatgtctgttggcatgtctatggtttgctttatcggtcagatagagaatacagagaagctataaaatgttacagaaatgcattgaggattgatccagataacatagaaattcttcgtgacttgtctcttctccaggcacagatgagggacttgtctggctttgttgagactaggcaacaacttttgtcgttaaagccaaatcatcgcatgaactggattggttttgcggtcgctcatcatttgaattctaattcttctaaggcaatagaagtattggaggcatacgagggaacactggaagatgattatcctccagagaatgagcgatatgaacatagtgaaatgctgctgtataagatatcactgtttgaagaatgtgggatgctagacagagcccttgaggaaatgcagaagaaggagagcaaaattgttgacaagctatcattcaaagaacaaatggcatccgtcttgttcaaacttggccgctttgatgaatctgagagcatatacagatctttgctttttatgaatcctgataactacaaatacttcattgctgtccaaaagtgccttggcctatactctgataatggtcaatattctgctgatgatgttgagcgcttaagtgcattatacaactcacttaaagaaaagtatgcttggtcatctgctgttaagcgtatccctcttgattttctggaaggtgagaagttcaaggaggcagcagaccactatgtcagacctctattaacaaagggtgtgccctcactattttctgatttaagcccactgtatgaacatcctggcaaggcaaacatactggagcaa

SEQ ID NO: 10831 - DNA, 694 bp, Sorghum bicolor
  Clone ID: SORBI-28MAY03-CLUS43667_1
actaccagaggccgacgaggtgtgaactgtaatttcagatttcagagggcgtaggcgcccctttgagtcttgacaccgccgccgccgccgccgccgccgtgaagccaagcaaaacctcgtaagcagagccatggagggatccgccgccgcgccgctccgcacgcgcgtctgcatcatcgggagcggtcccgcggcgcacaccgcagccatctacgcggcccgcgcggagctcaagcccgtgctcttcgagggctggatggccaacgacatcgccgccggcgggcagctcaccaccaccaccgacgtcgagaacttcccgggcttccccaacggcatcatgggcgccgacctcatggacaactgccgcgcgcagtccctgcggttcggcaccaacatcctctccgagaccgtcaccgccgtcgacttttcggctcgccccttccgcgtcactgccgactccacaaccgtcctcgccgatgcggtcatcgttgccacgggagccgtcgcgcggcgcctccacttccccgggtccgatgcgtactggaaccgcggtatctccgcctgcgccgtctgcgacggtgccgcccccatcttccgtaacaagcccatcgctgtcgtaggcggcggcgactccgctatggaggaggccaacttcctcaccaagtacggctcccacgtctacatcatccaccgc

SEQ ID NO: 10832 - DNA, 656 bp, Sorghum bicolor
  Clone ID: SORBI-28MAY03-CLUS452_1
ccgagcagcagcagctccaagcataccaagctagctagctactaccacatcgatctgcttgggggggctgccaagccaaggaacaaacaaagagctagctagagtctcgagaagctaagcttctcaagctctcgaggatgtctctggtaaggctgttggacacgctggctctggactcgtgggtgcggaacccgttcagcatcttcggcacggcggtggccgccgacgcgtggctggccagcgacacgtcggcgttcgccaacacgtacatcgagagccgggacacggcgggggcctacgtgttcagcgccgcgctgccgcccggcgtgaggaaggaggaggtcacggtggaggtggacgagggcaacgtgctcgtcatcaccggccagcgcagcgtctccagggaggagcgcgtcggcgacaggtggcaccacgtcgagcgctgctgcgccagcttcctcggcaggttccacctccccgatgacgccgccgtcgacggcgtcagggccgccatggacgccggcatgctcaccgtcaccgtccccaaggtcggtgccgctgctgccgctatcgccgagaagcccaacgaggtgccggcggccgtcgaggcggccgacggcggccctgcctgctgatcttctgatggcgatcgacgc

SEQ ID NO: 10833 - DNA, 1081 bp, Sorghum bicolor
  Clone ID: SORBI-28MAY03-CLUS45561_1
gtcggcctctacgaggtcgccggcgccaagtccgccatccgtggcagcgccaagatcgaccacaccgacgacttcagatggcttgacaaggccgcgctgcagctggaaggtgacctcgccggcggcggggaggaggcggtgaacccgtggcgtctgtgcacggtgacgcaggtggaggaggtgaagatcctgctgcggctgctgccggtgccggcgtgcacggtgatgctgagcgtggtcctgaccgagttcctgaccctgtcggtgcagcaggcgtacacgctcaacacccgcgtggcggcgctgcacctgccggtgacgtgcatgccggtgttcccctgcctcgccatcttcctcatcctggcgctctactaccagaccttcgcgccgctggcgcgccgcctcacgggccacccgcacggcgcctcccagctgcagcgcgtcgggctgggactcttcttctccatcctctccgtcgcctgagcggggctcttcgagcgctaccgccgaggctacgccgtccgccacggctacctcgccctcttcctcacgcccatgccggacctcagcgcctactggctgctcatccagtactgcctcatcggcgtggccgaggtgttctgcctcgtcgcgctcctcgagttcctgtaccaggaggcgcccgacgccatgcgcagcgtcggctccgcctacgccgccgtcgccggaggcctcggctgcttcgtggcgtcggcgatcaacaccgccgtggatgccgcgacgcggaacgacgccgaggggcggccgtcgtggctggcgcagaacatcaacgtcggcaggttcgactacctgtactggctgctcgccgtgctcagcaccatcaacctgctcgtcttcgtctactttgccaagcggtacaagtacagggtcagggtcgacacgcagcagaccacagtcgttgttaataataaacagtagccggccattagcacaatgataaggatttgctgagtttggtctcgaccgtggatgtgctgtaacaaaggattaccgggaataccataacatcgaacattttttgcaaatacagcttaacagaaac

SEQ ID NO: 10834 - DNA, 1075 bp, Sorghum bicolor
  Clone ID: SORBI-28MAY03-CLUS45671_1
gcacgaggatccaagggtggagacgacgaggagttctcagagctgtacacattcaaatggacaacccttctgatacctccgaccaccctgcttctactgaatttcattggagtagtagctggcgtttccaatgcaatcaacaatggatatgaatcatgggggcccctgttcgggaagctcttctttgcattttgggtgattgtccatctttacccattcctcaagggtctggttgggaggcagaacagaacgccaacaattgtcattgtctggtccatcctcttggcttcaatcttctcgctgctctgggtccggatagatcctttccttgcgaaggatgatggtcccctgttggaggaatgcggtttggattgcaactaggaggtcagcatgtggagttccccatcagtgtgttgtcgaagaagtaattttgcagatgtgtgcccatattttttttcattttttcctctgtagatagaaacacggggagagaaaaaaaatctttgcatttcttttgttccatggtggtggtagctcagcctcatgactgcaatattgggcaaaacggaggctgcgacaaccttgtgcagttcggccacgaatatactagagaagatcgatcgagaccaatcaatcgatgcctgagttcaattgttcagcattctttattagttttggatggatacttaatcggtgagccgaacagaaagttgtttgagtatgaactgctctacatctgcaaagttgttgtttatcatctatctcaataaggcaggacggaacagatgtatgcagaggaagagatgcatgcacattgtttgtttgtttatttatttatgtagtagtgatgagtgagtatacctttgctcgccctgccccattgaaggaaagggcctgtgcattccttcccttgctcccccgtcgggtgcatttctccttactaggacacaagactcctccattagcgggtgtctagtgatgtagcagcttcgtccagtgatgtaatttgtaaatgtgccattttgttttggtgatcagctgcatgagtaaagaatcgattcgaatcgttgctgtg

SEQ ID NO: 10835 - DNA, 985 bp, Sorghum bicolor
  Clone ID: SORBI-28MAY03-CLUS456_1
gcttgatcaagtggaaccctgtggccaacgtcgacggcaaggacatctggacgttcctaaggaccatggacgtccctgtcaacaccctgcatgctcagggctacgtgtccatcgggtgcgagccgtgcaccaggcctgtcctgccggggcagcacgagcgggaaggccggtggtggtgggaggacgccaaggccaaggagtgcggcctccacaagggaaacatcgagaaggacgcgcgtgcggcggcccccaggtccgccaacggcaacggctcggcgggcgccccggacatcttcgagagccccgccgtggtgtccctcacccgcgccgggatcgagaacctgctgcgcctggagaaccgcgccgagccgtggctcgtggtgctgtacgcgccctggtgccccttctgccaggccatggaggcctcctacgtggagctggccgagaagctggcgggctccggcgtcaaggtggccaagttccgcgccgacggcgagcagaagccgttcgcgcaggccgagctgcagctgcagagcttccccaccgtgctcctgttcccgagccgcacccccaggcccatcaagtacccgtcggagaagagggacgtcgactcgctcctcgccttcgtcaacagcctccggtgaggccgccagtgagcgagaaccatcgttctctgtcagtatgtacttgtaccgtgttatgttggcgtccatcttaggtgctgtatgtagagactagagagggagatgggagggaattgggatgatagaaacacatggaggggattcaggaaaaaaaaacagatgcaggttatccagacaaaaaaaaatccagatgcaggcgttgcatgtttagtttatgtaactgcagaaggagtctgaggtcctgtgttatttgggagctgagaggaagaggttatttgtgtgtgcttatagctagtggcgagtggccatagagtattggaaggaaaatcaaataagataat

SEQ ID NO: 10836 - DNA, 846 bp, Sorghum bicolor
  Clone ID: SORBI-28MAY03-CLUS44230_1
gcacgaggcaacgctctcgttccaaatctgctcggcgccggcacggagacgacctcaacgaccatggaatgggcaatgtcgctcctgcttaaccacccagatgtgctgaaaaaggcgcaagaagaaatcgactccaatgtcggagagggtccgcggcccgacaagaacgaccttccccgtctgccgtacctccactgcatcatcagcgagacgcttcgcctctacccggccgcgccgatgctactgccgcacgaggcgtctactgactgcaagatccacgggtacgacgtcccggcaggatcgatgatccttgtcaatgcgtacgccatccacagggatccggcgacatgggaggacccggaggagttcaggccggagaggttcgagcacggcagagcagaggggaagtttatgatgccatttgggatggggaggcgcaggtgccccggtgagaatctcgcgatgcgaaccatggggctggtcctgggggcgctgctccaatgcttcgactggaccaggattggggatgcagaagttgacatggcaacagccactggcaccatcatgtctaaggctgtcccactggaagctctgtgcaagccacgagcgaacatgtctgctgttcttcagaaaatctagagtgaaattgtgaacatttgtaggtacaaataaacgatagtacataactacgtaatgctagtataatctgtatagcagtttcatctttatacagtacttcttggggtttatccatcgaattgagagccgacgggccgtcccctcgtgttctatcacgatctagaatcttataccccatctgtcttaaacaaaacttgagttttagtt

SEQ ID NO: 10837 - DNA, 693 bp, Sorghum bicolor
  Clone ID: SORBI-28MAY03-CLUS44279_1
ctattgcagttgaagttgtgctgggaagttttcatggaagaatcactgccaacactgccaacatgcgcaacgagcttgtgctctacgatagcaaagaggctgatgcgatgactgttgacaattgtggagacctcaagcttttgcgacatgttgtatgtgtctatgttaaggatttgctcatgattgctgcacagacaagtgatggtaaatctgagcgcatatcattctccccaaggatcaacgacaaagctgaaggcccacttgttgtcggtggaactgagttgcgtgtgaagatttgttggtcagtaatgaacccctgaatagctatctgtctctcagtgacactgtagtcacctaagtgttgcgtgtgaagatttgttggtcagtaatgaacccctgaatagctatctgtctctcagtgacactgtagtcacctaagttatgcggacttagttggacctgataagtaactagtgtgtcggacctcacaagtaatagtagtgtgtgtgtgtgtgtgtgtgactcttctgtattgtgcctagcttattatatttggacgcacttgtgccgtgctgggctggtagggcttgttatgctgaattatcagttatctaaaatgtgttgcgctttatgctgtgaatgaaaatgcacgagattgtgccaaattattttctatatattgggaccaagaat

SEQ ID NO: 10838 - DNA, 1366 bp, Sorghum bicolor
  Clone ID: SORBI-28MAY03-CLUS44289_1
acagccagtcggtggcacaggcccctcgcttcacttctctgcctccgctagcgcaacgccgtctgcttctcatcacttccatggccgccgccgccgccgccgcctcggtggctccgtccggcccagtcccgttcacggaagtcgacgatggcacggtcccggagcacactcccaaggaggagttcggcgaccttgtggcctccctgccgcgcagggagcagtccatcctggagctgcgtctgtaccagggcttctggctgccggagcactgggtgcccggaaccatcgtgttccagcgccgcttcacgccgcgccccgacgacgtgatcctcgccagctaccccaagtgcggcacgacatggctcaaggcgctggccttcgccacggcggcgcgtacggcgtacccgccctctgacgccgggcacccgctccgccggatgaacccgcacgactgcatcccgttcatcgacgagatcttcgccggcggggaggacgcgaagctcgacgcgctcccgtcgccgcggctgatgaacacgcacctgccctacgccctgcccccggcgtccgtcgtcactgccaccggcgggtgcagggtcgcgtacgtgtgcagggaccccaaggacatggtggtctcgctctggcacttcctccgacgcaccaagccggacctctcgttcgccgacacgttcgagtccgtctgcgacggcaccgtggcggccggcccggtctgggaccacgtcctctcgtactggcgcgcgagcgtcgcgaccccggacagggcgctcttcctgaagtacgaggacctgctgcgggaccccgccggcaacgtgcggcggctcgccgagttcatgggctgcccgttctcggccgccgaggaggccgccggcaacgtcgcggccgtcgtggagctgtgcagcttcgacgagatgaagggactggaggtgaataggcctggtggtggcaccgcggggaagtaccgcgccatgccgcgcgacgcattcttccggaagggtgtcgccggggactgggcgaaccatatgacgccggagatggcggcgcggctggaccagatcttccgtgacaagctccaagggacggggctcgccttctcgtaatgcttaacaatcatttcgagacgtggacgcttttggatttgcgattctcttggcagttttgcgtgtctacatttccggaggaatatatggtaatgcaaatgtgtctacatgagtggaataaagagcgattttatattggtcacacgattcgatcaaatttttatatttgtttgttcagagtctaagaaacaaatgtaattccttcaataggtgctgcaattgcaactgcaaaactctcaagttctgtcatt

SEQ ID NO: 10839 - DNA, 984 bp, Sorghum bicolor
  Clone ID: SORBI-28MAY03-CLUS44586_1
gcacgagggcggcacgcgggtgatggcggcgaacaacgactgcgtcgtcagaacattcgacgccgagagatacagccttctcagtcagttcaccttcccgtggtctgtcaacagcacgtcggtgagccccgacggcaagctgctggcggttctgggcgacagcacggagtgcgtgatcgcggacccgcagtcgggcagggcgacggcgacgctgcgcgggcaccaggactactccttctcgtcggcgtggcaccccgacggccgcgtcctggcgacggggaaccaggacgggacgtgcaggctgtgggacgcgcgcagcctgtcggagccgttcgcggtgctgaaaggccggatcggcgccgtccggggcctccggttctcccccgacggcggcaggttcctggcagcggccgaggccgccgacttcgtgcacgtgtacgacgccgcggccgggtacgtcgggcgcgagcaggaggtggagctgttcggggaggtggccggcgccgcgttcagccccgacggcgaggcgctgttcgtcagcgtcgccgaccgcacctacggcggcctgctcgagttccgccgccgccgggcggacggctacctcgacacgtgtttcttctgagctctgagggaggcgcgcgcgccattatatcgactgtgcactgtgcatgtgccggccggcgatgtgcacgtatatactgtatacatacagaggtttggtgtgtatagtgtaggtgtggtgcggcctgcattcgctccttttagaacggcgtaatggcaggtgcttgctttcaggagctagctagcgcctctttcttgttggtggtttcggacttggggaagcaggacacttgtgtggtgactggtgtttgaggtactgtgagcttgctgctatagaggtgctgtgtatgaattcacactcggtaatgtaagaaatgtaaattattgctaggtgttcttaataacaaataaattccagggtct

SEQ ID NO: 10840 - DNA, 689 bp, Sorghum bicolor
  Clone ID: SORBI-28MAY03-CLUS44393_1
ttcggcacgagccacaggaccaccaccacctccagagagccacagcaccagcagcagcagccgccgccgtccaagcccagctccaccaccgtctcaccgcgcccgctgctgtctgcgtgtgcgtggctctaccaatggcggaccgcgtctaccccgcggccaagccgaacccgccaccaggcgcggcgacggcggccaacggcgccggcaccggcaacggcaacgcggcggcgtcgttcccggcgcccaagtcgcagatgtaccagcggcccatctaccgtccccaagctcccgcgaagcgccggcgcggtcgttcctgccggtgcagcttctgctgctgcttctgctgggcgctgctagccatcatcctcctcgccttcgtggccgccgtcgccggcggcgccttctacctcctgtaccgcccgcagcgcccgtccttcaccgtctcgtccgtccgcctcgcctcgctcaacctcacgtcctccccggcgcactcgtgcaaggtcagagtccgcgtcaagatctggaagtggactttctaggttggtggtatattattctcgttgtgttaggtgctagctgctggctgcagcgcaaaaaagatttttcagtaaaggttttcgctttttatttattgttattattaatcgtttacatatactactatactgtgataaatttcatttatc

SEQ ID NO: 10841 - DNA, 699 bp, Sorghum bicolor
  Clone ID: SORBI-28MAY03-CLUS44832_1
cttttcattggtcaatcccaagggcgcctatattgcatcaatgaagaacattgggcagatggtatcccatctgaactgtccagtcgtgtttttagaagagactcccacgaggattctaatctactgtcaatctgggttcttgaggactatgatacacaaaagtgggcccttaagcacagtgtgagctgttcacgtctgtttggaaggacaggttttcttggttacaatgttgttgccattcatccagacaacaacaatttcatgttcattgtatatcggaaacaccagctgatatcatatggcttgaatagcaaggaagtgcggactgtcggcacatttcaggaatccttgcagcttcctccttatgttccttgcttctcggacttcttatcagtggcacggcatgaagagatactaggggttggcgtgtgagataagcgtgaaggacgttgccagggcaggcgaccgtgcagtggccattgatcactcaggacagatagcacggaggtgggcaagacgaaccctgtagcatccgctgtgtttctgcattcgctctagcatgcacaagcttttgtatttgcttatgaaataggctatctgcctgtgacttatttgtttcatttcttatcctctttcttgagacgtcttatctaattaatactgcaaccactcctactaaaaaaaaaaaaaaaaaaaaaa

SEQ ID NO: 10842 - DNA, 729 bp, Sorghum bicolor
  Clone ID: SORBI-28MAY03-CLUS46174_1
aaaagctctcggtgaaggctccatcaggtgaatcaaagctaaaagtcttgaaagctattgcccaagagtacaatattgaatgggattcatctaatactgaagcagaattcatcaagaaatatgaagatctactggacggctcaggatcttcagtccaccaggtccagccacctatcattgagggctcagtgagctcaccagttgcttctgcttcaagagataagctggcagcattgaattcacctgtcattgatgccgaaaaacatcaaattcgcgagtctccgacttcactagctggaggtacaagagcttgtgttgccactaagggcaatgtggcaaccatggagcatcactcccccgctgaggaaatgccctccaccagcccaagttcatcagacgcactggagaaagcccgagctgctatagcagctgccacccgtgcatctgctgctgctcgtgcggcagctgaacttgcaaaagtgaaaattacaagtcagtgacgccttcagttccatcaaggcgagtcacagatccatcaaggcgagtcaggaaattcacgatttacgaatctggcaacgcagcaccaggacagactgaaatatatttcattgatgaataacttgttactgtgtattccatttgtgagcacttatcacatcatatgaggagcgtggcttcccgtcctcctttgaatttaatcaaagaaaatgttcgtggtttgcctgttgg

SEQ ID NO: 10843 - DNA, 1022 bp, Sorghum bicolor
  unsure (1)..(1022): unsure at all n locations
  Clone ID: SORBI-28MAY03-CLUS46157_1
gcacgaggaagcagttagtaaagggctgngaaaaagttcagcttgagtatgatgcttcagaaagggatggtccagtatccgaaatttttcgtgagaaactgaaagagttcaccgacaatgctggagctgatgtgcagttgttatcttcattgttttctgaagtgggtaaaaaggccgacgcactgattaagtattttggtgaggatcctgttcgttgcccctttgaacaagtaatctctaccctcttaacatttgtaacaacatttcgaaaagcacatgaggagaacctgaagcaagctgagcttgagaagaaaagggctgaaaaagaggcagaagcagagaaggccaaaaacacacaattgactagcaaaaatgactctaaaccatcaaatccaagccggcaagctaaacaaacattagagaggacaagatctgcaagcagacgaggaagagacgttgggtgatatcccgaatggccagctattgtgctgtgcttctgacctgctcgtgaggcaaatggatgaccgttagatgcatttctgggcaagggaagtttcgtggatggacgtgcatccgtcgggtgcagcgctatcgcatcaaagaaactttacaggacaccctctgcggtctcactggagaatgccgacttctttttttaaacatgtcggccatcagggtccagtgctaacttctgactgctgtaaagagttgctaacactgatgctaactccattctttcttttgttttttcatggtacatttccattctttctaacaacggtggccaagtacagccatggctttgagaaaagacagcccgctccttaggtggaaaattgtaaagattaggtattagggtaaaagggtatggagataatctagggggcaaagagtttcaggagtaaatatgagatgtaaactcagcccgtagtttagctgtaagttttgtagtgagtgtatcaccactttctatgatcatgatgcagtgaacgcgtcgttttctttaaaaaaaaaaaaaaaaa

SEQ ID NO: 10844 - DNA, 658 bp, Sorghum bicolor
  Clone ID: SORBI-28MAY03-CLUS46204_1
tagccgctcagataatacatccctgtgatccccagtgctccttattccatgcaaagcatggccaaacagaagagtcatattatcaaggggtgacttgagaaccggaagcgtcacaataccacgatgaggcaggccgggggacgtgttccagccgatcaactcagtgctggctgttgttgttgtcccttatatcaagtataggtccatgtatattttggaaagtcaaggaaaaaaactgtggatctcccatcatttttctccgatgaagagtttagcttcagaattttttagagaagtcgatgcttactagcttagtacatctagcggatttcttcgctatttgtcaatctctaagaaatccatgatgatggagtgttggcaggctagagtggaaataataatgtgagcctttctctgggttctttggttcctttaggatgggatgcaaattgggtagtgtgtccagtctaactgacaacccttgttagtcagcagttaattactagttttatgtagtgctgaaagcattcatggaacaagtggcgggtaaagtgctttggaaattcttgttaacttctgtacccgtgatgtttaaacgctaacgggttcttgtaaatttaaagtgccaatattcctgaggttatattttacttcatgc

SEQ ID NO: 10845 - DNA, 776 bp, Sorghum bicolor
  Clone ID: SORBI-28MAY03-CLUS46383_1
tggcctggttgaactgtgctctaccagaaatgacctgttccagaggtagtccgccgtacaaggatacagccccagccccccagaggacgaggagtgcctactctcctgccatggccgcgcctccgctccccttccccctcctgatactcctgctcctactcgctgtatcctcctccaccgtcgccgccgccgcggcaatcggggctccggtgctaggggaggactacgtccgtccgccgccgtcgcggtcgcaccgcaaggcactccttagcctcttcccttggagcaagaagaaggagtcatcctccgcctccgatccgcagcaggtgcacatttcactagctggagaaaagcacatgagaataacatggattaccgatgataactctgtcccatctgtggtagactatggaaccaaagaaggtgcatacacaatgaaatctcaaggagaaagcacatcctacagttacttattgtatagctcaggaaaaattcatcatgttgtcgtcggacctcttgaagacaacactatttattactaccgatgtggagggcaaggtccagaattccaatttaagaccccgccctcccaatttccattgtcattggctgttgttggtgatcttggtcagactagttggacaacatctaccctgaatcacattaagcagtgtgagcatgatatgcttttactccctggtgatctctcttatgctgattatatgcaacatttgtgggattccttcggcacattggtggagtcacttgctagcaac

SEQ ID NO: 10846 - DNA, 738 bp, Sorghum bicolor
  unsure (1)..(738): unsure at all n locations
  Clone ID: SORBI-28MAY03-CLUS4646_1
cgnctgaaaggtttaaagtgngatctggtggccgaggaagaggacaagtacctagcagaagggaagcttgtttctttttgcgggcagattttgaaagaggcatctgatctccagcctagcactggggaggctgccagtgcagacatacatcgtgtattagacttacgggcacctgttattgtcaaggttttgaaaggaatgtgcatcatggatgctcagatcttcaaaaggcacctgaaagagttctatccattaattaccaaacttatttgttgtgatcagatggatgttcgtggagcccttggtgatctctttagcaaacagcttactccactgatgccctgaagtatggcagtatttcctctcttgcatatatcttgttggaatatattcgtcatcagcatttttgtgcaaacatggagcaccggtagggtgcttgacatccttaaggcacatgtatggtgcaacagctactccctaggaagttactaagagcttggtcagcgggaacggcaagtccctaggccacattttttttggatgacacaagggaagtagcttgactgttgcgcacaccatgtttttgctagtgacttgtacttttgagctatttatctgtgctcggacagggacgatgcttccattatacagtagagtagtgttggtgatatgtacacattgttcaggacattgtacttgaggcctgttattatatggcaatagtagattatttgcggc

SEQ ID NO: 10847 - DNA, 655 bp, Sorghum bicolor
  Clone ID: SORBI-28MAY03-CLUS44959_1
tttccagaagatttgttacccttatgcaagggaacatctggctcgaaagcgaaggtgtagggaagggctgtacggcaacgttctttgtgaagctaggactatctgataaaccaaatgcaaatctccggagaatcatgcctcctgtccaaccaaaacaaggaactgcagatccagatgcatcatcaataatcaatggcgacatggcaattcttccgtatcgttaccagtcgatgatatgacaagaacctggaggcaacctcatccaacgggaggcaggccacgagcctgattttgtgatatcattatttgaagttgcatttgtggggtttaggatgttgtgttagagattgctctcccccttgttccagagctgctgcgctcttgctaagcttgcttctctgcagctgcgagtgtgatcgggtgagtccaaattagtggctcccctctagggaattaacagggcaaggagagcggtgtggtgttttaagttgttatacaagtgtggtgtttgttacaggtgatttaggggttctctagtgtagtatatagtcttggtagagagaggcaggaagaagctgatctgtacatgaggcaaacaagtgaaccaccatgatatgataatggctacttctaattagattagaacattggtccg

SEQ ID NO: 10848 - DNA, 1359 bp, Sorghum bicolor
  Clone ID: SORBI-28MAY03-CLUS45192_1
gcacgaggctcctcctgacctcatcacaacagagccagaaaaaatctcagaacgcatctctagtgcttcgacctcgacgcgacctgcccctcccctcccctcgcttggatccggagtccggacggcccggccccgtcccctccgccctcccatgcgcacggcgccgccgcggccgacatgacgctcgcctccctcgcccgcgccctcggccggtccgcgcgctcctcccggccgcgccagggtttccagctcgggggcctccggcagtcgccagcgccgccgctaccgccgcctgtccacggccgtgagagcggggcgacaggatttgtccgtagttacctgactgcggcatcgtcggcagctcttgggaagcccgcagcgggcaagactgtggactggagatacatcctcgccagcccacagttccgacgcctcttctcggacgagtccaagaagaactatgagaactactacccgaagggtaagaaggaggcgccgaaaggagatgggagtaacaagtctggctcgaggcaggaatccaatacagatgaaggatggaatttccaggataatgctatgaaacacctgcagaatttccttgcacctctattaattcttggcctgatgctatcatccatgtcatctagcaccgcagaccagaaggagataagcttccaagagttcaagaacaagttactagaacccgcgtgggttgatcgcattgttgtttcaaataaatcagtagcgaaggtctacatcaggaattcacctcttccaaagagccaaggccaaaatagtgatacccatatttctaccactgatattccaggcaagcctgctcccagcagatgcaagtattacttcaacattggtagtgttgattcctttgaagagaagttagaggaagcccaggaagctttgggaatagattcacatgattttgtcccagtaacttatgttgctgaagtaaattggttccaagaagttatgaggtttgccccaacagcatttcttgttggtctgatatattttatgggaaaaaggatgcagagtggtttcaatattggaggtggtcctggcaaaggaagaggaggtattttcaacattggaaaagctacagtgacaaagatggacaagaactccaaaaataaggtgttttttaaggatgtagccggttgtgacgaagcaaaacaagaaataatggagtttgtgcatttccttaaaaatcccaagaagtatgaagatttgggagctaaaatacccaaaggtgctctacttgtaggccctcctgggacagggaagactttgcttgccaaagctaccgcaggagagtctggtgtgccatttttgtctatttct

SEQ ID NO: 10849 - DNA, 845 bp, Sorghum bicolor
  Clone ID: SORBI-28MAY03-CLUS45250_1
gcacgagggtcctcttcggaggggcggcgcggttccgccgccggtgtggtgtgaacaggcccaccgatttctctgtcccgagtttcagaaaatcacttctccgcagatgtgcaacttcgtctggctcttccgcgtgctctggcgcatcctcagcgtcgccttctgagcctcccactctccaccccgcgtgctctccacttcgccgcggctgctggccgtcggctcctcggactggactgagtgggggaaaagttttccgtcggtggggtttcctgtagacttcgttccgtccaagcgcgtcgcgtgcggtgcggtgcggtgcggcggaaagccgggacgacgctgctgcctgctgctgctgcctttggtccgtctcacacaaggaacgcccgcgtcccgcgcgcccattgatgtagtgtggtggtgtccactgtcctgcggggtggccgccgccttggaggttgggaattggaaccggttgctgctccgtccgggacgatggcctgcctcaagctgggatccagggctgatgtgttccggaagcaagggcaggagtggtactgcacatctggtcttcccagtgatataactgtggtagttggggaacagtcgttccatcttcacaagtttcctctgttatcaaaaagtggcctgttggagaagcgtatcagagagaaaatcgataagggggacgatagctgtaccattgatctatctgacattcctggcggagcaaaggcttttgaactggctgccaaattttgctatggtgtaaagtttgacatgactgcctccaacgttgtacaccttcgttgtgctgctgattatcttgagatgacagaaga

SEQ ID NO: 10850 - DNA, 566 bp, Sorghum bicolor
  Clone ID: SORBI-28MAY03-CLUS45450_1
cgatgacggcgatcacgagaaggaggacagcgacaaggagcggatcaagattggacggcccaacggacatgccacacgtttcacacatcacctatgacaatttcggcggcttcctcagcctccccgccggccttgaactagacatactgtggcgcacgcccagtgccaggaatgagattgttcaatgttcacgtcgagctttgaggatggtgcggtgccgacaagctttggcaagggcagtccagcgtcgtgcgaccacgtgcacaaatggtgaacgtggatccttgagttgaagatgaaggaaagggagacaccatcaatatggtctgggctctgtgaactgttcaacctcgccaaagaggcgtcgaacctgctgatcatctggtgtccaatgagaaggtcctaccttggatgaggggtagtacatttggggtctacttgacagtagtttttacagaagtcatagctcctcaaccaaacgacccaaaagcagggataatggtggtgtgaaatttgaacaagttaaaaggtgcttttggttatacaatatataaaacgtcaatctt

SEQ ID NO: 10851 - DNA, 669 bp, Sorghum bicolor
  Clone ID: SORBI-28MAY03-CLUS45474_1
ccgacgcgctcagctgcccctccaacgtcgccaactacatgggccagatggccgccgccatgaacaagctctccacgctcgagggcttcgtcagacaagctgagaaccttcggcagcagacactgcatcggctgcaccagatcctgacgacgcggcaaatggcgcggtcgctgctggccatgtcggactacttccaccgcctccgcacgctgagctcgctctgggtcacacgccccagggcgccgcaggagcagcagcagggccacagctagtggcgtcgtcgtcgatctgcggcggcggctctgatgaccgcgcgccgcgcgcatatgtccatccatgcatatatgagtcatgcatggacgcatgctgcatgcatgcatggtgtgttcgtcgtcgttcgtcatcggttcaaggaacagaccagacaagaatagaacttgcaggtagtagctagccagtgttagggccgggggagagaactagtgaggccgagaaatcaaccaaaggatgatgttaaatcttaattagcgacgagactgtcgtttggttgcttgtagctatagctctaggtgtacttgatcgttcgatagcgatctatcggtcgacatggctgattgagatgatgtgttctgaattagttatcttatatgatcaccggatgcgtagctt

SEQ ID NO: 10852 - DNA, 674 bp, Sorghum bicolor
  Clone ID: SORBI-28MAY03-CLUS45546_1
caaaattggctgatttcggtttggcaaaagacggtccaactggtgataaaagtcatgtttctactagggtcatggggacacaaggatatgctgcccctgaatatcttgcgacaggccatttgaccgcaaagagcgatgtgtacagctatggtgttgttcttttggagttgctgtctgggcagcgtgctctggacaagaaccgtccgcctggtcagcacaatctggtggagtgggctagaccttacatcaccaacaagaggagggtcatacatgtcctggactcacggctgggttcccagtgttcccttcctgcggctcagaagatggcaaccctcgcactgcaatgcttgtcgatggacgcacgaggcaggcctggcatggatcaggttgtgactgtattagaagatcttcaagaagccaagggctcagtgaaaaagctggcaagtaagtagggaggattgctggctacagatgtccattacctctctggagtctggagcatcctcctgtaatattttattaggggagtaaaaacagagaatggatgaggatttgaagggctaagtagcttgtgaagagaatataatattgccttgctttgtgtacagctagttgcttcgtcgttgtaagttgggtctctagtacttatatattttggtagtcttcgttgtccc

SEQ ID NO: 10853 - DNA, 1158 bp, Sorghum bicolor
  Clone ID: SORBI-28MAY03-CLUS47268_1
gcacgaggagattgccggcaagcatggcaagaggaatattcaaagcacatcaaaggcaagccctcgcaaaggatggttgtagaaccaccaaaaacattggctcgaccgctggtgaagacaattccagctccaaaattcctgacacggaaggccagaaaagataacgcacaaaacagggaaggcaacctgatgacctctggcagaaatgttcactttggtccatctgtgccatctgaatccatacatgcagctacgagagggaccggtagtgatcaggctgtctcaagacatcagccagaactgaagcgaactactacaaccataactggaaagggccatcaaactacaggatctctgggagaagagctgctgataccactagacaacagcaatgtgaacatttcatcatctaattctagtccaacaccccatacaaatcgatctgtgtttgacacacttgaatcgtcatcaaggggctcccagaaaacagtgaatcaagaaacaagctctgacaataacaagatgagaccagaaaggaatagcacccaggaagaaggtatatctcattcagcagcagcagcagcagaaccaccaaggaataacaacttcctattgcataataagacagagataccagaacatagtcctgggtctgcttctcctatgcactgccatgatgatatggacatcagttcaaacttgcatactatggagaagtcagttgcaaccaacagcatgaagcagcaacaacctgcagttcctaatacgtgtggtaacactccagagaaagatcatccatccaagcctcccagcaatagcagtgaaacatcttcagacaagacaactgagctgaaaccaaatactctagtgcgtgctttaagcgagagacaacaagaacgacccaatgaacaatcgtcaaaaatgatcaagtctcggtcagtcggtgctaatagtcctcagatcataattctgtcacaagaagctaaagacaacatcgcaccgttgatctcaaagcatgaagaacatgaaaccaagaacagtgaacaagatagtttgaaaaatgcagagttgggcagaggtcttacaagtaatgtccagataataagcaatgaggacctcgaagatctccgtgagatgggatccggtgcattcggaatg

SEQ ID NO: 10854 - DNA, 1014 bp, Sorghum bicolor
  Clone ID: SORBI-28MAY03-CLUS47627_1
tgatcccgcccaccagcatcctggtgctcaacatggtgggcgtggtggctggcttctcggccgcgctcaacagcggctacgagtcctggggccctctctttggcaaggtgttcttcgccgcctcggtcgtcgcccacctcggcccgctcctcgtgggcctctgggccccgctgctccgcccgcccaccatcgtggtgctctggtccgtcctcctcgcctccgtcttctccctcctctgggtcaagatcgacccattcgtcggaggaaccgagaccgtcaactccaacaactgcaacacagtcatctgctgattcaccatcggtaagctggtgccgtgccgcggccgatgtgtttctggtgcggatttcctctgtccatctcgcatctgggcttttgccccaggatctgggaggggtggtgtagattagttctattttgcatccaagtgttgattggtgtcgtctgtattatgaaaagttttggtgctgaagtgttaaactcgcctcaattgtgaaaaaggcactgtttaagtgtgtgtaaatcataggaacgtgggggaaaaaaggaactgagatacacttgcctaccaaaaggcagagatcatttacatcagtggagcttgaaattgcagttgggttaagcatgaccgcacgagtgatgattatgggtacgcaaacgcaactgaattttatgcactggcctgctgtggaaaggagatgacatttcctcatgaagaccatgattaacgtacattgtacactaaacaagacgtgcgctcagtctttagaaatcctccagggtaccaagtgctcaagcccccaagctgtctgtcatcatccagtagcacgaactttttccacaccaaggccttgtttagatacgaaaactttttggatttcgctactgtagcacttttgtttgtttgtggtaaatattctccaatcatagactaattagggttaaaagattcatctcgcgatttacaagcaaactgtgtaattagttttattttcg

SEQ ID NO: 10855 - DNA, 634 bp, Sorghum bicolor
  Clone ID: SORBI-28MAY03-CLUS47657_1
gccgcaccgcgggggacaaggagcagaaccggctgaagcgcctgctgcggaaccgcgtgtccgcgcagcaggcgcgggagcggaagaaggcgtacctgacggagctggaggccaaggccaaggacctggaggtccgcaatgccgagctcgagcagcgggtgtccacgctccagaacgagaacaacacgctccgccagattctgaagaacacgacggcgcacgcgagcaagaggagcagcggcggcggcggtggcaagggcggagacggcggcaagaagcaccacttcgccaagagctgatgagaatgagagagggagctggtccgtgctcgcctgatctgaccattgttggcgtgttgctgttgctgatgacgtcttcttctctttttttttttccttcttcttttctactgtacttgtgttggtctaccctcgctgatggactgttttaactgttgtttacgtagcaatcccgtctctccgaccgttggtaggactactcaccactactggtagttttcttggtagggtgtcagaacgccgtgtaattttcttcttgtattgtacctgtaattcagccttgcgatttggcaattcacaattcaagattacccccgtgccaaaaaaaaaaaaaa

SEQ ID NO: 10856 - DNA, 1045 bp, Sorghum bicolor
  Clone ID: SORBI-28MAY03-CLUS47779_1
aatcctccccaatttgcgtttccactcccaccaccgcttcttcccggatcccttgtcctccttgatttcctctcaccaaaagcgggagccgcttcccgccacttgagcgcgtggcgagctcacctcggtctcaggcagtggcgccgtgcggtgcggggggcgcccgtgctgctggttttgctccaggggagaaggggggcagagggagcggagcaggttgggcacgtggggcgcctgcgttttcttttgcggggctgtgggtcaaaagcgcggcgctttccgctccaccttctcacgccggaatcaaatcgatgcccctctgatttggttcgtggtatcggtgcatgagcttgctccaagagatctcccttttggttcggcgtcaggggttctgtgaggtcacgcggtgtcttcctcttggtgcggctcacatgtccgggcgctttgatttgtgcctactgcgcgagtgattctgctgctgtagcagctgttaggtgcgcgcgcgtcgtgatggggtgaactgaagcgttcctcacagagctgggtgggtttatttcgccgcctgtctgcttccccgcaccttgttcttgtgcccatacttctttgcttttgtcacgcctgaaccgtgtcttcttgtagtatctgaggcttggcagttggcaagtacatactgactagcaacttgcttagatataaaccgtgtctggtgcagagcccaaaggggttgcaaatatttgatgcatagatctgcttcctgttgaggcgaggttctaagtctgctctgttgatggggctaccatgaaccacgggaacgggatgttgaactctgtcaaggtggagagccggccatcagtggttgctaccaatggccagcctaggccgatggatgtgctccatgacggcggcccaccaccgttccttaccaagacgtacgacatggttgatgacccaaccacggacgccgttgtgtcatggagcgccactagcaatagcttcatagtttgggatcctcatatctttgggacggtgctgctgccaaggtatt

SEQ ID NO: 10857 - DNA, 588 bp, Sorghum bicolor
  Clone ID: SORBI-28MAY03-CLUS4809_1
tcggggaggcagcagctcccccgcaaaaaccctagctttacctccgccccgagtctcccaccaagcggctccaagatgaagctcgtcaggttcttgatgaagctgaacaacgaaacggtgaccatcgagctcaagaatggcaccgtcgtacacggaaccattaccggcgttgacatcagcatgaatactcatctgaagactgtaaagctgacgctaaaagggaaaaatcctgttacccttgatcaccttagtgtgaggggaaacaacatccgctattatattcttcctgacagcctaaatctggagactttgctggttgaggaaacaccaagggtcaagcctaagaagcctacttctgggaagcccttgggacgtgggcgtggccgtggtcgtgggcgcggtcggggacgctgagcatgctcgcagcttttggaaattgcactgcgtgcatctgcagtgtaatctacattcctatcatttgtatggagtatgcctttgattatggcacccatattagtgtcagttgtttttgctgtggattcatgttgatgagtttacaatgtgatcatatgttcttttccaactcct

SEQ ID NO: 10858 - DNA, 604 bp, Sorghum bicolor
  unsure (1)..(604): unsure at all n locations
  Clone ID: SORBI-28MAY03-CLUS45737_1
gcacgaggccagcgtctaaggaaaccgccgtcccctccgtgatccccttccctttcctatcttcaccgtgaccactaagcagagaccccgatcctcttcccctttccaccgtgagcagagacccccatcccctccgtgatccgcatcgactcggagaagctgcggcagcggcacatcccctccgtgatccgcatcgactcggagaagcggcacatctcctccgtgttccgcatcaccgcctcgcctggctccttcctcttcgcctggctgggcactgggactcggagaagctgcggcagcgcctcctcgcctggttagtcccgggaggccgcagtgaagccggaacccgctcgatctccgttggccgcgccccgcgccgcgagctcggtgcccgaagccggtggccgcgcgcccgcctgctggtgctcgcggcgcgccccgcccaccgcgagctgcgggaggccgcagcgaagccggtggccgcgccccgcccgcccgctgcccaagcggccgcgcagttggccgcgccccgcccgccggtgcccgcgtctcccgccgcgagacctcgcggacgcccnctagccgtgagtcgcacatggacagg

SEQ ID NO: 10859 - DNA, 690 bp, Sorghum bicolor
  Clone ID: SORBI-28MAY03-CLUS45773_1
gcgcgagctccgccacttgctcccgcgcgaggtgaggtgagcactgggttagcgccactgccactgccgccgccaccactactactagtaccagcactctcgcagcgggagatgcggcacggggctgcgcccccctccctgctcggatctcgggagtggtgccggctcgtgtcggctcggctctacccaggctagctccctcgtcggttcttggcgagctcgcctgccatggagggcgacgcggacggcgtgaagtcggggaggcgcgggggcgggcaggtgtgccagatctgcggcgacggcgtgggcaccacggcggagggggacgtcttcaccgcctgcgacgtctgcgggttcccggtgtgccgcccctgctacgagtacgagcgcaaggacggcacgcaggcgtgcccccagtgcaagaccaagtacaagcgccacaaggggagcccggcgatccgtggggaggaaggagatgaaactgatgccgatgatgctagcgacttcaactaccctgcatctggcaatgatgaccagaagcagaagattgctgacaggatgcgcagctggcgcatgaacgctgggggcagcggggatgttggccgccccaagtatgacagtggcgagatcgggcttaccaagtatgacagtggtgagatccctcggggatacatcccgtcagtcactaac

SEQ ID NO: 10860 - DNA, 793 bp, Sorghum bicolor
  Clone ID: SORBI-28MAY03-CLUS45833_1
gcacgaggccaggccgtcggctgcctctagctccttccccgcgcgctggctgccgcgagagctgagctcggtggaatccagcggggagcaccgaacgcgcgctgccgcctcgttcgtgtttgggcatctcaatttgttcctgatggggaactgcgccggcgtggaggggaacgctgagatcaacccttccttcagtgcccccaattcgtcagggaccggttctaaaaacagcagcaagaatgcaaccgacaccagcacctttggtaccaagacgtccggctcgtcgtcgtcggtgccaccaactccccgtacggagacagagatcctggagtcgtcgaatgttcgcaagttcaccttcagtgagctgaaaggctccacaaggaacttcaggccggacagcctgcttggggagggaggctttggctctgtgttcaagggatggatggatgagcgcacgcttgcgcctgtgaaaccgggcactgggatgattgtcgccgtgaagaagctcaagctcgacagcttccaggggcacagagaatggctggctgaggtcaattacctagggcagttatcccaccctaatcttgtgaaacttatcggctactgcttggaggacgaacaacggcttcttgtgtatgagtacatgccaagagggagcttggagcatcatcttttcaggaggagctcgaacttccaaccgctcccatggaacttacgcatcaaggttgcgcttgaagctgccagaggtcttgctttcctgcatggcgaccaggctaaagtcatttaccgtgat

SEQ ID NO: 10861 - DNA, 696 bp, Sorghum bicolor
  Clone ID: SORBI-28MAY03-CLUS46071_1
ctcattgtgttgttgcatgtaccatggtacaatagcaattgggctcatcagggtgaaggtgacagtatgatggcttcaatggagactttgctgtatgctgctcgtgtggacatggtaatagcaggtcatgtccatgcttatgaacgtgcggagcgagtctacaatggcagacttgatccttgtggtgctgttcacataactatcggggatggtgggaaccgtgaaggcttggcccacaggtatcgtaatccgaagccagcttggtcagtcttcagggaagcgagctttgggcatggcgagctaaagatcgtgaactccacccatgcccactggacctggcacaggaacgacgacgaggagcccgtgagaactgatgacgtgtggatcaactctcttgctggttcagggtgcatcctggaaggcagccgtgagttgaggaagatcctaatgtctccttgatgctacatacgtagtttatagcttagtctaaaagggcctgcgatgtactgtatatatgcttgcaactttgataatctaacaccgcaaagttaatgcgtcgtgctgcctgtgtattgggtgtttcttgctcttgttgtaccactatggatgtttgtagcaagtgacatttctgtatacgatggtgttgtaatggactgaagacgatacttcacttatcggaagatacagtaattgtgt

SEQ ID NO: 10862 - DNA, 756 bp, Sorghum bicolor
  Clone ID: SORBI-28MAY03-CLUS4608_1
cgttcgtccgcccagcgtccgcggccgcgtggggtatggccgaagtttcatatccaatggaaagaccaagcaatcaaactgtgggatgtcaggaaaatgacgtccaatgctgatagttgtgcagacggagccccaagttgggactacagatattcgaggtatccgcagcagcataaacagttaaagcatccgcatgatcagtcattagcgacataccgtggacatgcagtcctccggacattgatccgttgctacttttctcctgcttacagcactgggcaaaagtacatatatacagggtcgtatgattcctgcgtttacatctatgatgtggtaagtggatcgcaagttgcgaagctgaaatggcatcaaatggcgattcgtgactgcagttggcacccatttgagcccacgcttgtgagctcatcctgggacggccaggtagcaaaatggaccagtgcacgtgatcaacaggcttctgatatagattgagtcgaccgtgcagcgagtgatcttttactgctcgtggttctgggctacaaaaacatacgtatgcagtctaaagtaagcacagctcataaaaaagaaagaagatcatgtgttgtagtggtgaattgtaatttgtaaatactgaactgaaaactttgtgaatatgaagttgtttcataaggcttcatgtccgtgtgtttggttggtcgatgttcgttaactttgggggggcaatgagctctccttttgtaaatataaaattacttc

SEQ ID NO: 10863 - DNA, 856 bp, Sorghum bicolor
  Clone ID: SORBI-28MAY03-CLUS46084_1
gcacgagggaagctgaaagctcagttcgagtgtgaagcatttgtttctgtatctcttgacccgagaatggatcaggttttcaagagcatgctccgtcaacttgataaggacaagtacaacaacatcaagggagaaatgtgggatgaaactcaactaatcaacgagttgagatacctccttaaaaataaaaggtactttattgttgttgatgacatatggaacaaatctgtgtgggctaatattttgcgtgctttgaacaaatgtggacgtgggagcagaataatcataaccactcgcattcttgatgtcgcccaacaagcagacagtgtttataaactacaggctctctcagctggtgactcaagaaagttattcttcctcagaatatttggtaatgaaaacagatgtcttccaaaggaattggataaagaatctaagaacattttaaggaaatgtggaggtgttcctttagctataatcacgatcagtagtatgttggccagtaagcaggaaacagagaatacaagtgaatattgggccaaggtgtgcgaatctatgggttctggactagaaaatacaagctcagatgtaattgacatgagaagaatactttcggttagttatcatgacctaccgctacaccttaggacatgcttgctgtatctaagtttgtatccagaggattataagatcatgacacatgatttggtatggaaatggataggtaaaggttttgttgtaataaaacaagggatgaacatgtttgaagcaggtgaggattatgtacatgagttaattaacagaagtttgattctgccaacatttgacaataaaagtaagaaggcaagtagttttc

SEQ ID NO: 10864 - DNA, 861 bp, Sorghum bicolor
  Clone ID: SORBI-28MAY03-CLUS48430_1
aaaaaaaaaaaccccactccactcggcgtatggcgcgcggtacacctacgcttgtgctgcagctgagcctctggactcggtaatcgtcgcccccgtgctgtcctcccgctaccaaccacagtccctcgatccatgggtgcggaggaggagcgcgacggcgaggagcagcgccgccccctcctctcctccgccccgccagccgcggcggaccagcaccagcagcagtaccagttcctgggccggagcagctcttcggtgctgcgcggcggtggcgggggctgggaagggcccgaggtgagcgccgacgaggtcaggtccgccgcctccttctcctccgccgccggcttctacccgcctccctacggcgaccacgcctatgcttacccgccgtccatccacagcgccttgctctccccgtccccatctcacgccccatcgtctccgcatccaaatgcggaagcgttggcgattgttcctcaagggccatatccctacggtggcagttaccaaccttctgagagcgtcgggagggatgtactggatgaggtggagatccgacagctgctcattgaccatattggacatcgatgctgttggggaagtcaccctgcccgcacatggaaaattacctccattgaggactgcaatgtctatgttggcaccttggaaaccttcatcgaggaaaggcacattattacaaaaaaggaaccctatgaaagtgggaatatagatggaagagaaaaaggtcctttgcttggattatgggaactagatttgaggtctaagtttcctgcactttttgtaccagaggaagaagtgattgttaagattccacattcagatattattgaaaaatgctca

SEQ ID NO: 10865 - DNA, 609 bp, Sorghum bicolor
  Clone ID: SORBI-28MAY03-CLUS4846_1
gtgaagtagaaagacaacgtcaactggatattgagcgtgcaaagtctagggaactgcaattcaatattgatttggaaaaagagaaacaaactcagagagagcttcaacgtgaactggagcaagtcgagttggggcggtcatcaaggcgtgagttctctgccaatcccaacagccgctccagggagaggtaccgcgagagggatggcggcagagcacagcaggaggcggggagcttgaggtcgagcagccgaggccaagagggggtctctgctcaggcgcccgcaccggccggggcccccaccgtcatgctcgccggatcaagaacgttctcagggggcaaccttccgacgattctgcagcctcgcgagcgctctgccgacgaggacaacgcctgggccgaggatgccagcagcaatggagatcctgaactggatggcgtgaggccgcatgggccacgaggcggcggcagcagcaagccatcctcgaggcaggttgtggagcggagggagcgggatggcggcactgctgccggcacaggcaggagagaagggaaatgggagaggaagcagcacccgtgactaaaaaaaaatttgtccaacaaataggcac

SEQ ID NO: 10866 - DNA, 1034 bp, Sorghum bicolor
  Clone ID: SORBI-28MAY03-CLUS4850_1
cgagtcaaaagcccgcacgtccgaacaacggcacgcagaagctcaaagagaagcaagaacactgtgccggcggccgatcgaatccaccgagcaatcgtcgtgcgctgccgcggagcctccaaggcggcggagatcgatctgcgacatacgatggcggcgccctactacggcggaggccctgcgccgccaccggcggcggcgccggcccctgtggcggtggtgtccccgcagttctgcgcgccgtacgtggtgcccctgacggtgaccaagaaggccatcagcctctccgacggcgacttcaccgtcaccgacgccaacggcgccgtcgtgctgcgggtcaagggcgccatcttcagcgtccgccaccgccgcgtcctcctcgacgccgccggccagcccatcctgtccatgcaggagaaggtatttagcatgcacaacaggtgggaggtcttcacaggggatagcgccagcgctaccgtcgtgctcttcaccgccaagaaatcttccatcatccaactaaagacagagatggacatcttcctggctgccaacaccgcgcagcagttgtgcgatttcaagatcaagggtaggtacttcgacaggtcatgcgccttgtaccttggcgactctaacaacatgattgctcaagtgagtacagaaacagggagtatttgtttctgatgatatctttcttggactaaatatttagctgatgtgtttgccatccatttggtccctcctgcagatgaaccgtcagtttactgtctcgaacgtactgcttgggaaggacacgttcggtgtcaccgtgttcccaaatgttgactacgtgttcatcgcagctcttgttgtgatactggatgagattcatagggaacgatccgactgaggaccggtacatatgcacaagatcatcatgttccagcacgttatatatatagtagtataatatatattatcacaagttgttgtcacctgctttatccatgtatttgagggttttgaatatgtccaattatctagaaagatctactatg

SEQ ID NO: 10867 - DNA, 933 bp, Sorghum bicolor
  Clone ID: SORBI-28MAY03-CLUS4852_1
gcacctgtgacaacacaatatctttttgtgactgccactcttccccttgatatctacaacaaggttgttgaaacctttcctgactgtgaggttatcatgggacccggtgtccaccgaacaagctctcgtcttgaagagattcttgtggactgcagtggagatgataatgaagaaaagaatccagaaactgcattttcaaacaagaaatcagcacttttaaagattattgaggaatctcctgttcgcaaaacaattattttctgcaacaagattgagacatgtagaaaggttgagaatgcgctgaggcgggttgacaggaaagcttcgcagatcaaagttctccccttccatgctgctttggatcaggcccagcgcatcacaaacatcaaggagttcctgaacaagcaaacggctgactccatgttccttgtgtgcacagatagggcatcgcggggcatcgactttgcgaacgtgaaccatgtggtgctctttgactacccccgcgacccaagcgagtacgtgcggcgcgttgggcggacggcccgtggtgcgtccggcaacggcaaggcattcgtgttcgcggtgggcaagcaggtgtccctggccaggagggtgatggagaggaacatgaaggggcacccgctgcacgacgtgccatgcgtctaagactctacagcctggaggatggaggtgcctgaacagaaatcgcttcctgaatcgtccttgcacctgaagatgttgtgcttgtgcccctacctagcctagaaactggagtacaatggttgtgtggtctgtggtgtagcatattttagcactttggacagacatctagatcagttcatgtagaacaagttttgatgcatgcaattgctgcctaaacaagaacatttgaacagaattcagatgtgcagttcataactcattgtttgcctg

SEQ ID NO: 10868 - DNA, 706 bp, Sorghum bicolor
  Clone ID: SORBI-28MAY03-CLUS49021_1
ggttctggagctatatttacaggtgacaccttgttcaatctatcatgcggaaagcttttcgaagggactccacagcagatgtattcctcactccagaaaattacagctctacctgatgatacaaaagtatactgtgggcatgaatataccttgagtaattcaaagtttgccttgagtgtagaaccaggaaataaagcattgcaggaatatgctgcaaatgcagctgagttgcgtaataagaatatacccacggtgccaacaacaattggaagggagaaggaatgcaatcctttcttgcggacctccaatccagaaattaagagcacactgtccattccagatcatttcgatgaagatcgggtgcttgaagttgtccgtcgagcaaaagataacttctgactaacaaaaggaaattctcgtgacatatgacctatatcttgttaaagttcagacagagaacctctaagtcacaagaaacataggaggaaaggaaggtatatattgtttgagctagattttgaaatgcttcggcaaaattatgtcgagtgtatgtagcttgggcagtgcttgtctatagcaatcagtgattctttttactactacaaataagcgtgttctgctaccatctactctctgtaaaaaacaccacttagctgtttcatagtcaatcttcagttcttattcaaaaaaaaaaaaaggggggccc

SEQ ID NO: 10869 - DNA, 1184 bp, Sorghum bicolor
  Clone ID: SORBI-28MAY03-CLUS49138_1
gcgcgcggcgcggagcggggccgccgaggcgggggatccttttgccgcggccgtgctcggggaggggattgaggggatccaaagtgagggtgctgggctcgatgacctcgatgctggggaggaccctgatgatgagctgaagcggcagcagaataaggcgagggagaaggagctgatggagatactcaaaggtccaaatcgtgcttttggtgatctcattgctgcctctgggatcacagagggaatgattgatagtttgatcctcttaaaggatgtcagagacattccaggattgcctcccctaagtgaaattgaagatgaagccatccagaaattgaatgcaacgtcaagcagagctgaagttgagcgccaaaagcaagaggacattgctaaggcacgagtaaggcaggttgatgagaaaggaagggcttatggaacagggaaaaggaaatgcagcattgctcgtgtttggattgagcctggtgatggtaaattcattgtcaatgaaaaggagtttgatgcttacttcccaatcctggaccatagagctgaacttcttcgtccatttactgtgaccaagaatttggggcattttaatgtgacctgtactgtgaaaggtggtggcgtatcaggacaagttggagctatccgcttagggatcagcagggccttgcagaattgggaaccaggactgcgtccatatctcaaagcagctggatatttgacgagagattcacgtgtggtcgaaaggaaaaagcctggaaaggcgaaagcaagaaagagcttccagtgggtcaagcggtaacagagccatctgcagggctgcatattttgttggggcaggtctctgccctttgttgtgggtatcctagtcaacaggatcacttgatctgctgttattttctggttcggtccttttcagcttgattctgaaatactctagcttgtatcgatacgaggaccatgctacactttggattctctgtttctgaaacgatgaaaccgccaaattgatctagaaaatatcattgaccaaatcgagatcaagaagttgctttgcagtgagctgccaataaaacaggctgtgccaatgagactaaatgttcagctcagaaggaaaaacccttctggtctcttaggatttaatggctgggaaactggtttcggatgtcaactgatgatta

SEQ ID NO: 10870 - DNA, 918 bp, Sorghum bicolor
  Clone ID: SORBI-28MAY03-CLUS46719_1
gcacgaggcccgccgccagtcctgccctggcgcccccgtggcaagccttagctagcaaaggcgatagccatggcgagccctggacggatcgagctggacaagctgagcgtggagcagctcaaggggctcaaggagcagacggatctggaggtcaacctcctccaggacagcctcaccaagatccgcaccgccaccacccgactcgagagcgcctccgccgcgctccaggacctatccctccgcccccacgggaagaagatgctcgtgccccttacggcttctctctacgttcccggctctctggacgacgccgagaaggtcctcgtcgacgtcggcaccggttacttcatcgagaaaaccatggctcaggggaaagaatactgtgaaaggaaagttaatttattgaagtcaaattttgatgaactgcttgaggtggctacaaaaaagaaagccatagcagatgatctgggtatgctactacaagccaagctgaggcaagcatcgcctggcccgagttcatgagagctagatgcacacctagccaagctgaggcaagcatcacctggccctagttcatgagagctggatgcacaccttgtatgattccttgttggatgaatgtatcttctagtttgtggcatcaagggaacatattttagtttgtggcatcaagggaacacaggattgtcatggtggcagggtcatggataatttgttgaacatgccgcatcaaacatcatagagtaaagagtactttgacgttggtatcgagcacacatttagtaattttgatctgaagtttgagtcacgcagcgtagatttttttttggctgcttctgtcgcacagcagtctgtatgatcatcattactgtgcctccagtggttgattttgtttctattgctgcccatagaactttc

SEQ ID NO: 10871 - DNA, 656 bp, Sorghum bicolor
  Clone ID: SORBI-28MAY03-CLUS46522_1
agacttctcttcctcccgtgtagacccaaaccaccgacgggagcttcaggttgtactttgtacgaccgaggcccgaggggcggcgagcgcggcgctggaaggattgacggagaatccgcggaagtccaggcagcccgcccgcgcgcgccggctcccctggcgacggccgcatctcgtcgcctactcgcctgtgcccttacccagccaatccgtcagtctagtggggttggagtggagatccattcggacgtgggctgctcccttcttttggcgttgcgcgctaatttgagttgttctccttcagcgtgctaatttcagtcgattctcgttcgagcacagggatcgtctcctctcacactgagttgctggtttattctgaagatctttcaagctaagttcggatgatggctgcggctaatggaatagtagtccgtgcattcacaaaggaacccttgttttcctttggtgtcatagctgatgttcagtatgctgatatcccagatggccgctcgttcctcggtgtcccacgatactaccgccacagcatctccctcctccctaccgccgccgcctcggcgtcctccaaagggctgtcaacgggtggaacgaacaaggtaacatcaagttctcgatcaattttggcgacatcattgatg

SEQ ID NO: 10872 - DNA, 1465 bp, Sorghum bicolor
  Clone ID: SORBI-28MAY03-CLUS46745_1
gcccgcggcttccacccgccctggcacgcgccttaattagcttcttcgtccctccctcccgaccggtcaatcgatcgtccaccggctagcttcttcgttctgcacgctgaacctgtaatatgcctcctgccgtcctccaagagccatgagtaacaccagcaacaccaagaagcacagcctcctcgcgccaaaggccaccgtcgacatgtctcgcctgcaccaggcctacgaccgcggctagctagctagttagccggcttgatacctagtgcttgttaatttcttgctcgatcagtaacaacgtttgctgtcgtaagttcgttctcgtaacaacaacaacaatgaaggaaggaggcgagaagaagaacatcctgtccaagacgctccagaggtgccggacctcgctgctggcgcaacggaggcggcccgagagggcgtcgtcgtcgccgcccctgggtgtgccggggccccccgccgggcacttctccgccctgctcggccccgacctagcgctgtcttgtttgtgttaggcttgttaatttcttgctcgatcagtaacaacgtttgctgtcgtaagttcgttctcgtaacaacaacaacaatgaaggaaggaggcgagaagaagaacatcctgtccaagacgctccagaggtgccggacctcgctgctggcgcaacggaggcggcccgagagggcgtcgtcgtcgccgtccctgggtgtgccggtgccggccgccgggtacttcaccgtcctggtgggtccggagaaggagcggttcggggtgcgcgcgcgctgcgccaaccacccgctcttccgggcgctgctggacgcggccgaggccgagtacggcttcgccggctgcgacggcccgctcgagctgccctgcgccgtcgacgacttcatggaggtcatgtgggagatggagcaggccgaccccagcgcgtcgcctgctggctgtggacgcttcgccgccggcagcagtattagagcccaccaccaccatctgcaccaccaggccgccggcggctaccagatggtgagcccggcgaggttcctcgtcgccggccggtgatcgtgatggatgttattcgttacttgaacagctagaacgcctgctttggtccatcgcccggcgacgacggtctaaaatggtctggtcgtcgtatcgtcggttgtggttacgttgagcacttttctgagatcaacgatctcgatcgcttgatgaaagaaacctagctcgatctcttcttcttcttcggcatcgatcataagtagactagagatccaggcgcacgcacaagtttgttccactgctcgttgtttgctgctttgccgtctgttaataacgtttgtttcatcactctttgttttttcattcatcgtagtgtactccatagatttgctttgcccgtcttgtaactctcatgtttcttcaagtcgtttgaagatgtatatatgctactac

SEQ ID NO: 10873 - DNA, 653 bp, Sorghum bicolor
  Clone ID: SORBI-28MAY03-CLUS46837_1
tattgagcgagttataggagctggtgctgaacaagctattgattacactgctgaggatactgaagcagcagttaaaggaaagtttgatgctgttttagacaccataggagtacctgagactgaaagaattggcatcaatgttcttaggagaggtggacactatatgacccttcagggagaagcagctgcactagcagataggtatggattggctgtagggcttcctgctgcgactgctgctttactaaagaaacagacgcagtatcgttattctcatggaatagaatattggtggacatacatgagagctgatgccgaagggcttcatgagatccaaaggctatctggagctgggaaattacagatacctgtggagaagacctttcccatcagccatgcaagagaagctcatgcggccaaggagaaaaagttggttcctggcaaggtggtcctagaattcgattgatgtcattgagattttgtccatcaggaactaaagggctgtgtgtttgtaaatcaatcaggatagtattttttttcttttttttgaaaaagaaactgaatcgctctgctgatgtcaggttccagtttatcattacgtttcagtagaaatacggtaaataatcatatcagatacgagcaagattttgctg

SEQ ID NO: 10874 - DNA, 1345 bp, Sorghum bicolor
  Clone ID: SORBI-28MAY03-CLUS46980_1
gcacgagggtcaaggttggggagggcctctttgggccgtatgaatgggagaggttcgatctgctcgtgctgccaccgagcttcccctatggaggcatggagaaccccaggatggtgttcctcacccccacggtcatcaaaggggatgctgcaggggctcaggtcgtggcgcatgagctcgcacatagctggactggcaatctgattactaacaagaccaatgaagatttctggctaaatgagggattcacaacatatgctgagaggaggagcgcgggggttgtgcaaggggaggagcgggcagccttaaacatggggattggatggagggggttgaacaggatgatggagaggtttaaggataacatggagttcaccaagttgaagccgaatatggcagggattgaccctgatgatgtgtactctgaagtgccctatgagagaggtttccagtttctttggagaatcgagcgtgagattggcaggcctgcttttgatgaattcttagagaagtacattgcaaccttcaagttccaatcaatagatacagagacatttcttgaattcctcaaaaccaatgtacctgggatagaaaaccaaattgaccttaacctgtgggttgaggggaccggtatccctcctgatgccatggaaccagattcagctacttacaaaaagatctgctccttagctgcagaattcaaatctggaaaacttccaagtgaagatgaggtggcaaactggagtgggcaagaatgggaactttacttagaaaatctaccaacagatgttgaagcctcacaggtcactgctcttgacgagcggtacaagctatctgaaagccgtgactacgaggtcaaagtcgcattcctccagctggcgatccccaccgggtgcaagtgctacttcaacgaggttgagaaatgcttgaagcaggtgggaaggatgaagtacctccgcccgctctacagctcactggccaagtgctccagcgaggagaagatgctggcccagaggatcttctccgaggctcaagagttctaccacccaatagctcgcagtgtcgcggagtccattttgtcgaagcatagctaagcaggccaagactcttgtttagcaaatccatcgtccacggcctcacccgactcacggttgggagcaactgagatctggtgattgctcagttgcttctttctcataaaatttatcgtctgctggatctaacttaggaaaaacttgggacttgcactgcatcttgtcttgataatatgtggagacagaaccgtagtacctgagtaatgtatgttctgggattttgcttatgcttaaaaatgttccgggactgc

SEQ ID NO: 10875 - DNA, 690 bp, Sorghum bicolor
  Clone ID: SORBI-28MAY03-CLUS6183_1
aaggatgttaaagcacacaaagagaagatcagtgatcaaaatctggagataaaggcacttcgcaataaagctgctgaatgggaaatgaaagtactcgagaacgaggccaaagtgaaagcaaaggagaaagaaagggatcaaagagttggagagcacaatcggaagatgactgcattgaaatctgaagttgaatcggagcagaagtgccttgaggagaaagaaagaaaaataaaggaaacaattgacaagggttctgaattatgctctcaagctgattcggttgctgaagctggaaggaagaaaatagaggaaatctatgggaagtatgatcaagtttgtgaggcggctaacatgtacattgatggttcggatcagtccttcgaagagactgatgaagctgcagcgatgctgaaaactatagcccagagtggcgcttgatgtggtgaagtgaccatctggcaaaggatcgtggacaattatcatcatagtaataattgtgctagtgtccggctttgtatatataccttcattggatcatgtcgtgtggtcacttttgcatctcgttcatgttgttgctctgatcgggtgtggtcagtgtatgtgcttttagcacctctattttaatttaattatcagtacttcctagtattagtgtaagcaatggagcattgggcgtggtcttacaacttt

SEQ ID NO: 10876 - DNA, 862 bp, Sorghum bicolor
  Clone ID: SORBI-28MAY03-CLUS49942_1
ggacacgaggccggtgcgcgcgcgccggtgagatccccctccccagcaccgagacgacggcgaactgaaaccctcacaaaaatctcacctcctgacctcctcccagatccctctcgccgaaacccggcgcccgccgcagatctgagggtcatcggcagccatgatctcctcaagcaagctcaagtccgtcgacttctacaggaaaatccctagggatttgactgaggcatcactatctggcgctggattatccatagtagcagcactagccatggtgtttttgtttggaatggagttgagcaattacttagcagtcaatactaccacatctgtgattgttgataggagttcagatggggagtttttacggatagatttcaatataagctttcctgcactttcatgtgaatttgtatcagttgatgttagtgatgtgctgggaacaaacagattgaacataaggaaaactgttcgaaagtattcaattgatcggaattttgtaccaactggatcagaattccaccccgggcctatccccactgtcaataagcatggagatgatgttgaagaggatcatgtggatggtgcattttcattgtcatctcgcaattttgatagcttttcacaccaatatcctgttttggttgtcaacttctatgctccctggtgttactggagcaatcgactgaaaccttcctgggagaagacagcaaaaataattagggagagatatgaccctgaaatggatggtagaatccttctaggcaaagttgattgcactgaggaagttgacttgtgtaggagacaccacatacaaggatacccatccattcgcgttttccgtaaagggtctgatataaag

SEQ ID NO: 10877 - DNA, 1313 bp, Sorghum bicolor
  Clone ID: SORBI-28MAY03-CLUS5012_1
gcgtctagcacggcgccggtgccgaagccggcgaccgtggccatgcagtcgccggagccctcctcctcctccccggtcctcctcaatatagggggaaagaagtacgcaaccaccgtggagacactgacgcagcgggagcccgactccatgctcgccgccatgttcagcgggcggcacacgctcccgcagcacccaaccacggggaaggggatggtgttcgtggacagggacgggaagcacttccggcacgtgctcaattggctcagggacggtgctatccccgtgctgtcggagtccgattaccagcaactgctgcgagaggcagagtactaccagttgctcggtttagctgattacataaatgagaggcttggttggaagaaagccgacaattcagaggctgaattgacacgaaaggacgtgatcaagtgcatacaggcgccaggtgtcggggcgcgtggcgggctggcctcgggccgtcttctctcgactcttcactggtcggcggcggtcttccgtgctgcatgcactctgatctctcatgtgccatccgctaccctgcacaaagcaaaatttgggcaggtggaagctttgtcttcgtctttccaaaacgcaaatttgcgtgagtgtgagtttgttggagcgaatcttcaagaatctattctggatggagcaaaccttcgaagtgccaacttgcaagatgcatccttaacacgatgcagcttcattgaaacagatctccattctgcccatttacagactgctaaccttacacaagccaacttaagaggagctaatcttgaagcagccaatctcaagggtgctaagttgtctggtacaaacttgcaagacgcaaatcttcagagagcttacttgcgagaagttgatttgcgtgacactcaattgactggtgctaagctcggaggtgcaaatctacttggagctatcagatgatctacagtttgtcggtgtagcttcatactgtgtatactgtactgtacaatttcattggaggtaatgcctgaggcatgatcatctgtgcaatactggtctcagtcacgattgagaacacaaatattccctctggtccaaaataaatcaattcatagaatcaacccaagtcaaactatcttaagtttgaccaacattataggaaagggtaacagtatctgtgacaccaaataagtacattatgaaatagatttcatgatgtatgtattgatactaattaggtgtcataaatattggtgctttttttttgtaattatcaaacttaaaatagtttggcttaggacaactctagaagttgattc

SEQ ID NO: 10878 - DNA, 615 bp, Sorghum bicolor
  Clone ID: SORBI-28MAY03-CLUS50351_1
gcgcgcgggctggcattggctcgtccctcactgtcacccctgcggccgctgatgaagaaggtgattttgccgagctctacatgttcaagtggacaacgcttctgatcccaccaaccactattttgattatcaacctgatcggtgtggttgctggcacttcctatgcgatcaatagtggttaccagtcatgggggcctctttttgggaagctcttcttcgcgttctgggtgattgtccacttgtaccccttcctcaagggcctcatggggaagcagaaccgcacgccgaccattgttcttgtatgggctaccctccttgcatcgatattttccctgctgtgggttcgtatcgatccattcaccacccgggtcactggtcccccaattggtaattgcggcatcaactgctagaatgagctgaatatattaaagagtggaactagctcccattgtttcgtaatttataggtgggtggctctttttaatacgtagtatgctaggaacatggtcgggagaagttaattacatatgttgtaatatgtacctccgctggtgtttatccataagttaatacagactgccttatctggaatgtgtatgagagcatcagtgaatt

SEQ ID NO: 10879 - DNA, 844 bp, Sorghum bicolor
  Clone ID: SORBI-28MAY03-CLUS50297_1
gcacgagggggtggtgggcccaggcacgtgcgccggtccccgtccgggaagactatcaaggtgaagaaagatggagctggtggcaaagggacttggggcaaactaattgatactgatgcagaggcatgccttgaccgaaatgatccaaattatgacagtggcgaggagccatatgagttagttgaagcccctgtttcaaccccactagaagactacaagaaagctgttatcccattaattgaggaatatttcagcaatggtgatgtaaaattagctgcttctgatcttaaagaattgggttatgatgatttccaccgttactttgtcaagaagcttgtttccacagcaatggacaggcatgacaaggagaaagagatggcatcagtgcttctatcatatctttatggcaacgtggtcagttcaactcaaatcagactgggcttcgtgctgctattggaggctgttgatgacctggctgttgacatacctgatgtggttgatgtgctcgcacttttcgttgcacgtgcagttgttgatgacattctgccacctgctttcctcagcaaggcaaaagtgagtctctcaggatcgtcaaagggtatgcaggttgtacaaattgcagagaaaagctatctttcagcaccccaccatgcagagttaattgagcgacgatggggtggttcaactcacatcacagtagaagaggtgaagaagaagattgctgatcttctaaaggaatacatcagaaatggtgatacagctgaggcttgtaggtgcattagggagctggcagtgcccttttttcatcatgaggtggtgaagcgagctcttactcttggaatgg

SEQ ID NO: 10880 - DNA, 910 bp, Sorghum bicolor
  Clone ID: SORBI-28MAY03-CLUS50372_1
tccgcacctccccctgcgcacgtgagtgtccccccccgcctcgcccccccccccttcccctccccggagctcggggctcctcgtgcgcccccgcccccccctgtttgcatcaaaaaatacaacatttcccagtttagttgcccactctgccccattggtaccaaatcctgcatctttgacacccaaagttcaagatcattttagggcaaggcaaacactgccaagtactgcttcacctttaccaactccaccgcctggatctatagcccccagtgtctctctaccccctcgggggggagcacctcgggtttctcacactgtagagacacaggtgctccgcgacacgggggcgcccccagtgtgcccctctcctctcccccctcagcagaaacattcttggaagatcgtcagccgttgtcagcagctgccgaatcggttagcaaaacataggagtattaagtgtgaaggtggattattatcattatcaaaatggcttgctgagccctcttcctggaagaatgttgtacatattagcatgtgaactctggccagtatcgcggaagtagttggtgtttcgcgtgccctctggttttgaggtagtcttgccaaacagtggctttgcggacatgtgagccccgcttgccccaccgggtggggggcgcggggcttcttgctgtgccctggtccctgtgggcctggcagcgggctctcagtgccggccttctgttttccgcacttgacctgggtttcttgtgcttatgtaattatcacctggtttcctgtgcttatgtaattatcatctgtttccccacccccaagggctgtgttgccgtattggctctacatagacctgggttcggtttggctccacaattgctacttcatgactcggcgaacagcaacgtttttc

SEQ ID NO: 10881 - DNA, 764 bp, Sorghum bicolor
  Clone ID: SORBI-28MAY03-CLUS75223_1
ccctgaggctcgtcgtcctcgcctgcggcccgctgtcccgcccgcgcctcgccgtggtctcctcctgcttaggattttgattcagcaatcaaggagatgtgttccagtcgtccgttccaaacgtcttcgacaaccaaccaaccaatgggcagtcggccttcccggtgggaaccgccggctcaggcttgcggctcagcggccacggcgaggtggtcctcccgtccgttccacacgtcttcgacaaccagccgaccaataggtagtatgctttttaggatggaacagctggcacaaacttgcagcaaagaagctactacaaggaggcgctcctcagcatagaccaaccatggaatgcatggattcagactgatccaacaacatggccggaccttccacaaacacagcttttgggaccgcatacgaggataattgggcgatcactaccgaccttgaaatgaacatgtataattactctcgatatcgctatgtacataaaccaagaccttacccctgatgtatagaactatgaagcagtgaacactactacacctcctattattcatcaccctatgtataattataacagtgctaaacctgtgaaccctatccgtcccccgttgtgttgacccatgtagcagtgcactcttcttctcctcctattattcatcacccgatgtataattagaacagtgctaaacctgtgaaccctatccgtataatgttgtgataacttatgtaatattacaatcaccatctaccatact

SEQ ID NO: 10882 - DNA, 942 bp, Sorghum bicolor
  Clone ID: SORBI-28MAY03-CLUS75360_1
ctcctcctccaatggggccagggcccaacggtcacttcatgccaccaccaatgcctcacctagacatggttcctccttccaccttcggtgcttcagccacagccaagatcagtgtcgatgcatcccttgctggcgccatcatcgggaagggtggtgccaacacaaagcatatatcccgagtgactggggccaagttagccatccgggacaatgaggctgatcccaaccataaaaacattgagcttgagggaacatttgaccagatcaagcacgctagcgcaatggtcacagagttgattgtccgcatcagtggtaaggcgcctggcccacaagccaagaataacccaggaggcagggggcctggttctcatgctgggggtcctggaagcaacttcaagaccaagttgtgtgagaacttcaacaaaggctcctgcacctttggggacaggtgccactttgcccatggcgaaagtgagctgcgcaaacctgctgctgcttgataggtatgcttattgtggcctgtggtgattactctgcctgtatggctgaataacaccagaaccaaggacagtcacccatggtgaaatgtattgagcctcatgcttcctgagatagatccgttccgtggcttgtatttgatcatcttactgctgtaactctttgatagagagaagcaatggcctgtcttctagtttttgtaggtttgccgtattggtctccctttatcttccccctgcttctgaatcctatttctgtatcgtttcttaggcacttttggctggcggatcattgtgattctgttaacttgaatagttgctattgatgttatccgttggtgaattcttaatagctcttttgaaatccagatgtcgttaacgatgttctgagcgtaatcgtgagatttgttatccgggttaatttcaatagcgtttgactacaaaa

SEQ ID NO: 10883 - DNA, 678 bp, Sorghum bicolor
  Clone ID: SORBI-28MAY03-CLUS75650_1
cggccagacgtcgccgatcagcgacggcgcctcctcgtacagggacagcacgagccgggagatgcagcgggtgacggaggaggtgctggccacgtcgcgggtgcccgtcgggctcgtcaacatcacgcggctgtccgagtaccgccgggacgcccccacgcagacctacaagaagcagtgggcggagccgacggcggagcagcgcgccgaccccaggagctacgccgactgcacgcactggtgtcttcccggcgtgccggatacgtggaacgagctgctgtactggaagctcttcttccctagcaacgatcagttcctctgatgatgcgtgcctgcgtgcctctgcctgcatacatacagacacttggacacggccggactgctaggggctagcccaaagtaacatcctttgtgccggcatgcacagcgtcgatcgaaacagaacaaagaaatgtagatgaagaactgaacctcgtgtaagtgtaagtggtgtacatggatgcgtgcgccatgctcaacgttagttcgtggttcatggagcagaaactttccgttgatgtaatcagtttttctttcttttttgggggtcgctgtaagatcgaggctcttttttgtgtcaatttcaaagaatccaggggaaaaaaaatcttcttctgcgtaaaacaagattcagcaaaa

SEQ ID NO: 10884 - DNA, 654 bp, Sorghum bicolor
  Clone ID: SORBI-28MAY03-CLUS75387_1
cgaaacctgctgttggatctactctcattggtggtgagacagaagctctggagaggttgaagaagtttgctgtagaatgctctatgcagccaaacaaagcagacaaaagcaatacccaagatagcatatatggtgctaatttctcctgcaaaatttctccatggcttgctacaggttgcctctctccacgcttcatgtatgaggagttgaagaagcatgctactagagcaattccttttgggtcaacacccaagaataatgatggcacatctgatgctgggacaaattggttaatgtttgagttgctatggagagatttcttcaggttcatcacaaagaagtacagttctgtacagaagacatctgaagttgctactggttgcactcccgccccagcgcttgcatgaacatacttagacaagctgattgccagctgctttttgggtgataaacttatgtgcactttcaatggagtctgaaattttcttttttttgccgccaataatgttggtaatcgaagtaaaggctgaatgcgcattcttgcgttttggttggtagatctcagaagggatctttgtatctgattctgtcgacattcctctgaatgaccgttcaatgcaatgatgtgagcaacgtatcggctgttgtataaaa

SEQ ID NO: 10885 - DNA, 617 bp, Sorghum bicolor
  Clone ID: SORBI-28MAY03-CLUS51202_1
tatgagcaacagcaacagcaacccgttgccgagctacatgcaatttacagaatctgcaagagccaagacgtcgtccccgaagatgagccctgatgtgcaggagagcaacccaaggaaaaggcattcgttgcccatgaccaacggcaagcacgactcgtcacctcgcatgcagcgatcatcatcgcaggttcagcaaaacgtgaaaagcaatggccctgcacctcacaacgcatctgacaagaggtggcatatctgatgagtaggccgagcacagcagcatatttcgcgtgggggtgccatcgaatatctagatggatttctcgtgatgactcttgccttctccgcacactccatctaattcgtcagatttttatttcttgattcgtcgttggaatactgagtatggttggaaggagggcagcagctgccgcttgatatgtgtacatttgttggttcttcttattggttgtgttatgtgactgatagtggtttccgtgtgtaatataatatgcccctttgacttgtaatgcgacagtggcatcaagagtgtgtggattggtctgttgtatttggcgatattgaagtttctgttggtgtggatacggctctcattccat

SEQ ID NO: 10886 - DNA, 926 bp, Sorghum bicolor
  Clone ID: SORBI-28MAY03-CLUS51723_1
ctggactgaatttgatcgattgcgcacgcggcatgaagataatccaaaagatgataatataagccaaaaggcgtcaacacagcgatctgctgtcgaaaactttgttcgtgtatcagagtcactcaagactagttcgtgtggtgagaggctgaaggatattattctggagaagggcattacgaaagctgctgttgagcatgtgaaggaaagctttgcttctgcaggacagactggctttagaacaagtgaagaatggacagctggcttaaaactgccatctattccacccattttgtcaatgttgaaggggctggccaagggccatctgtctacacagaaatgcattgatgaagaaggcatattaccgctgctccatgctttggaaggggtgcctggtgaaaatgaaattggtgcaagagcagaaaatcttttggatacgctagccaataatgaaaataatggcgatggtttcctaggagagaagattcaagagctgcgacatgctacaagggatgagatgcgtcgccgtgctcttgagagaagagcgatgctactaaagggaatgggaatgcgtcaagaatttgcttctgatggagttagacgtattgttgtatctcagcctacgattgaaggtttggatgatgtggaagaagaggaggatggtgtagcgtgtatggtttgtagagaagggtacaccttaagaccaacagacatgttgggagtctatgcattcagtaaacgagtgaacttaggtgcaacaagttctggtagtggccgtggggactgtgtttacaccactgttagccacttcaacatcatacactaccaatgccatcaggaagctaaacgtgctgatgctgcactgaagaatccaaaaaaggaatgggatggtgctaccttgcggaacaatgagacattgtgtaatt

SEQ ID NO: 10887 - DNA, 649 bp, Sorghum bicolor
  Clone ID: SORBI-28MAY03-CLUS52009_1
tttggtacaactgagagctcatcaggttctcgtaacaatgatgcaacttggaatgggagcagtcactctaccaagaaaattgttgacaggaaaaatgattcttcacgcttgaataaccctaagggaaccataaggtggcccgtgcctgttgaagatggtgcgtctcctgtcaggtccgagcggggtcttatggtcgatatgaggcagccccatggaaacggcggaaggcttccggtccaggtgtcatcacaggcacggcttgagaaagaatatgagaaccagcagaagttgaggaaagcaacactgacctcttctctgggatctgcaggagattggaatagggagaggaacaggagaatgtgaagtgtacattattcatgtcaaaatcataggctaccggtatatcgtctgggggacagcggaaccaggcaactgtttcataagaggtcacagaacattgggagatgtgataatttaggtggcgcgtgatgtatctattgggccatttgttgttggggaaactgttgtaactagtgtaatttctttttttttcttaccattatatcacagggtctcgtctcactattgtccgttgtgtattactagtatgtgtcaagcttttcgtaaaagtaataattgcaggcgacgt

SEQ ID NO: 10888 - DNA, 920 bp, Sorghum bicolor
  Clone ID: SORBI-28MAY03-CLUS5211_1
gcaaagtgaaagcgtccggtagaacatctcgaatggaaagtttcaaggacaagagcttatcaaatggattattcttccttgagcttctaagcacagtacagccacgggttgtgaactggaaagttgttactaaaggggaagctgatgaggacaagaagctgaatgctacctacatcattagtattgcaaggaagattggatgctctgtgtttctgttgccagaggacatcgtcgaggtgaatcagaagatgatcctaacacttactgctagcattatgtattggagcctacagagacagcctcaatcacaatctgaaatgccagaacaatcagaaccatctagcatgacttcagatgcagcctctgacattgcctctgaggatggtgcttcaacgacagcaccatctgagtcggaagaggtgaactcgctgtctgatagcatatcgaatttgacaatggatgatgctacttcaaacgccccacctgctgaaaacggaaatggtgtggaagggtcctgatggttataattatgcagacccggttcttttttgctacacagtgctgttttttatatacaggaaatagtgctttcatggtgcccaaagtcgtcgctaccagaagtggttttttaatacttctgcttcctgagtatggtagcttgatagatacaacaattgcagatagatatagatgccgtttgttcatccgcttatactataggggaaaaaagataatagtaatgtcgccggctgggtattttctgtattgctggcagacccatgcaaattttacttcttctgtaccttgtcgatcaattcgttcatatgtttattggactagtcatcgcttgtaatgctgttgctgctttgaaccgtgcctgtacataacatatactttaaaaaaaggttttgcctttcccg

SEQ ID NO: 10889 - DNA, 1130 bp, Sorghum bicolor
  unsure (1)..(1130): unsure at all n locations
  Clone ID: SORBI-28MAY03-CLUS5222_1
cttttgtaaactacaacagtctatctnttgattntgtttcacagggaagctattggaaaaattcttgcccgtggtcacagtcgtgttcctgtatactcagggaaccctaaaaacatcatcggtgtgctattggtgaagagtcttttgactgttcgtgctgaaactgagacgccagttagtgctgtttcaattagaaggattccaagggttccttcagacatgcctttgtatgatatactcaatgagtttcagaaaggaagtagtcatatggctgctgttgtgaaggctaaacccaaaactgaaccactccctgataaaactgaaccaaacagggaagtagttgggtcagcacagttgactgttcccttgttatctaatgctgaagaaagtgcagacaatgtggttgtggatatcgaaagaccacataacaggcaggttaatggaaacgcagtgcctaggtcatcagaggatattgaggacggtgaggtcgttggtatcatcacacttgaagatgtatttgaagaactcctacaggaggaaatagtggatgagactgatgaatatgttgatgttcataaaaggatccgagtagctgctgctgccgctgcatcatcggttgcaagggctccatccgttaggagatgcacgaggcaaaaggctgcaaaccttcagggagcacagaatcgccaaggacagcaacctcctggaattctcaagaaacccactgagggtgattcaaacccatcaaaacaagtgaaccttgtggagcctcttctggaaaagaggaggtaactctaaaatgcgtcgagcaccgtagccgataaaacgcgcggaatcaagctggaagagcctatggttcttgctatatagcaagaggtacatacagatgaactcattgttgtaaattccaacaggagcgatgtgcttttggtgtcatggtctcatggacattagtgttgaattctttctcttccgcctcccccttttagttatgggcttcgaaagtagaatagccacttttgaatctgtctatgaccgctcaccggcggtagcacctgctttatatatatgcttcaaattcgtagataactaggctttatatagttattcataagatgtttttttgatcg

SEQ ID NO: 10890 - DNA, 762 bp, Sorghum bicolor
  Clone ID: SORBI-28MAY03-CLUS52190_1
tcaatatggtagatcctggtggaatctctaattggtctgttacaaatgtggattggtctgagggaaaatggcatccaaggtcatatagcgctgatgatgtcacctatgatctcttgaagaatattacggcaattgatgagaacatccatgttacaagtgatgacaagaaacttgtgatgcagaagccatgtttgtggaatggatcaaagagaccgtgctatcttttcgctaggaagtttaatcctgaagcacttgacaacctactgaagctatttaccagttatacatctgtttgagtccaacctgattctttgccttgggctgtcaaatcccacaagcttcttttcctgtttgtatgtaaattgtgaagtccgtacttattaggatctgggcccaaagatactggtacaactgcaacaactgtgatggcttggagctcagtcctcggtaaaacggccacagcaatgtttatagaatgacactgccctcatagtatgtcgtgttcaatgtatgtctccatagtcttccacccaactcccaactcattagttctttgaagaacagtttttttgtcagaatgttatactgtcattatatgatacattctttgtagacacagattacaacagatgtaccacaagcgcatagtcttaatttagtcactattaaatcttttgtcatggattctactgaattaggtgttcgcatttcttcattttcactgtgattaatttttcagcaaagtaaacgtatttgagctgc

SEQ ID NO: 10891 - DNA, 712 bp, Sorghum bicolor
  Clone ID: SORBI-28MAY03-CLUS4950_1
gcaccaccagcccccgccgctccgccgagggagaggcgagcgagcgagcggagcgggaggaagagatggagcgggcggcgccggtgaggagctcccacacctccacggccgacctactctcgtggccgcagccccagggccacgccccggccgcaacgccgtcgccaccgcgcaggcccggccagccgtcggaggctatcaggaaggtggtgttcgggggccaggtcaccgaggaggaggccgacagcctcaccaagaggaagccgtgctccgcgcccaagtggaaggagatgacggggagcggcatattcgctgccgggagcaatggcgacgctggggaggcagctgcggacgccgcgaagcccgcccgaaccccgtggcgccaggcgatcagtactttaggcgacatctcgtatgctggggattggactgatcgtccgatgaagcccacttgatcatgtgccgggagtgaagagccctggtttagtcctgatgttcatcgagtttcactgttggtgtgtgcatgtttggtttggttgtgagatacagatacccatgccattctcatgtcagtgtgtagtgtgtacggttgatatgttttttacaaataataactggagtctgaaccgagctcacgtcttgcaccatcaaattactagcaacagtgtatgtaccaagcgttttcaatttgcaaccagaacagatgcacgat

SEQ ID NO: 10892 - DNA, 909 bp, Sorghum bicolor
  Clone ID: SORBI-28MAY03-CLUS4959_1
agctcagccagctcctctcttcctcctccagctcatctcatccgcccgggccacctcgctcccatcccatccgtcccaaccaaccacagccagcaagcagatcagaggaatggcggcgacgcggctggcgcttgccctcctgctggcggcggcggtggctgcgtcgcagctgccggcggcggcggtggcggccaactacacggtgggcgacgagaaggggtggaacccggacgtggactacacggcctgggtgaagaagcacaagcccttctacaagggagactggctcatcttccagtaccagaacggtcggtcggacgtggtgcaggtggacgaggtcgggtacgacaactgcgacaaggccaacgcgctgagcagctacagcaagggcagcacctacgccttccagctcaaggaggccaaagactactacttcatctgcagttatggctactgctaccacggcatgaaggtccatgtcaccgccaagtcctccggctcttcctcctccggatccggctcctcttccggcgacgattcctccgactcctctgacgactcctcctccgatgactcgccctctccgcccgccaagaagtccaaggccaagtcctccagcgccgccgcgccaccgccgtcgctcctcgccgccacgccccgcgccgccgccattaccgccgccgtggctctgctcctcaacaggatgctctgatctgatctgaggaggagtcatgtggctccatcagtcagtcggttcagctggctccagatcttctgtgttgatgcagtttgcagacaagatgatgattagtataatgtcaagtgtgaatgaagtgctctatttatttagtattataactacacgtagaccataaatcatactgctacacactgttattgtttatttat

SEQ ID NO: 10893 - DNA, 742 bp, Sorghum bicolor
  Clone ID: SORBI-28MAY03-CLUS49677_1
gcacgagggaagccttcttcacgcgatgaaattcaatgacttttatcatgacactgtacaccagtttgcacctacgtatcatgagtatgtgctctacagtaacgagggggaggatgaaccaacaaaatacagccctaaccctatcgtgacaactggagagcacctagtagagctggcggaagtcactgttgtgagctcgaaggctccagggatgtcaagtttattgctgaatgaggctgatcaggcagaaacaataccctctcaagtcatggaagccagcactgctgcttccgtggaaccatacgacctctcaagcttcctcaacgtagagttgtctgattaccctgatcaggtccctgcgattcccaatgtaagagaacgatgacatgttgcggtgtatattcatggtgtaaatgggcggtagcgctgttgagctgatcatagattacggtgtacatagaaatgtctcgtgtcgttttatttcattgttcatgcatttgagtggcgtgctcatgttttttccgtgtgggttaaagatgagccaagctgacagatgaattaggggcgtaagcggaaatatgcggtataacatgtacattaaatgagttgcttttgtcaatgagacgggtcacggactcacgggtatatgttgtacttggacgtggtttctgtgctgatgatattatgaaaagttcacatgtaagcaacatgttgtggattaaatgaatctgcaaggttgcac

SEQ ID NO: 10894 - DNA, 780 bp, Sorghum bicolor
  Clone ID: SORBI-28MAY03-CLUS49719_1
gcacgaggaccgcacgcaggtgcccgcctgcaacatgaagctccgctacgcgccgctgctcgagctctctgacggcaccaggatccacggcgccacgctcgtggtcatcaagcccgtcggcgacgccgcgggcgtcggcggcaggaaggagctcgacgagttcgtcgccggcgccttcgacgggcccttcagggaggccgtggccgcgctcagcaagcgccgcacctacctgctcgagatgaatggcttctagtctgcgccacctccctcgtccctcctgcgcacgcgcgtcgtctgcagcagcaagacctgcccccaccacctccatggcatgatggcaatggccattggcaacagcggcaactagattgctcagctcggtcctgaatctgatcgggggaaggaatactgaggtgttccttcctcctcgcatcgcatcccatgtcgcaatatccaacgctgatgcctcctcgtcctcgcatttcgttactgccttggtatccttgtgaaaatagtagtagtatatcgaatggagtgtgcggcgccagcttctgagcttcattacattttggtgctatcatgaacggaatgaagcagtcacattttcaatcaaaatcaaatgttgtctgtaaaggttctgagatgaaatcacagtttcaatcatgaatgggatgaagcaatcacatttccaatcaggtgttgtctaagagtgctgtctgtaaacaatcttgaacggaattgcagtctggcaattcaaaacatgctttttgccaaagaaaa

SEQ ID NO: 10895 - DNA, 730 bp, Sorghum bicolor
  Clone ID: SORBI-28MAY03-CLUS49820_1
aaagatcctcgctccccgcccacctgttgactgccgccgatgctgccgtctccgcgcctcacgccctgcgactcatcacttgctcctgccggctgccgccctctcctcccaccccgcacctgccattgatgatgaccctgacagacgatctcgatctgacctgcgaggctgcgatggacaccgaaggtggcggtggcaaccccaatcgcgccacggccgtgccagtggtcatcgtctcagatccgactgcggctggtgtcaaaatcatccattcgtgggtaaggcgaactcatccattcgtcagtactaaccagtataacctccgttggccaccatgatcagcgtacgaggagcaccttcaggtaagtttcagatcccctagtattttggtggtggcgacgtctcctggtggcacacgcctcctaggaacgccctaagccatcggcccacatggtttgcttgcttttctagatctcgcttatttaattggtctattatcactatttgctgccgcaagatttgaagctgaaacgattcagttcgccattatatatccaggcaaattcaggactgtcgctactagtgctgcacatggggatgggacactagtatgattttagattcatacattttctttggatacagatggttatttcattcatatatttgcgttgggattccatcaagttgtcgtgcatgcttacagttttgggcttattgattttttctt

SEQ ID NO: 10896 - DNA, 737 bp, Sorghum bicolor
  Clone ID: SORBI-28MAY03-CLUS53103_1
ggagctcaaggacgccgccggaggcgagtgggcgctgaagaacgagatcggggtcagcgacgtcgtccccggcggcgcgtcccagtccatcacgttcttgttcatggcgttccaccccgagcgggagctggtgtacctgtggtcgccgtggaagctgctggcgttcgacgtggtcgagaggcgcgtcgaggaggagtgggtgtttggatcggagaaagatggcacgcatctcatacaggtttggctgtttccattctcgcgccatttggccaacgcgctggcctgattgggcttgccgacgagccgaaaatggtatggcgcccaagtgttcgttgcctatccacaatgctttggttgctactaaaagattgataaaaatgtcaaaatagaaaacaagagtcaaagacagtattcgtcgcaaaaaaaaaagtaatgaaactgaaaatacatgtaatacattacacgacatgttgttctgcttaaatcatgattacttgtatagggactattcgtctgtaacggtgtgtaagcgtggtactggttgtgtcgttaattttctagtaatgtttaagaatatatgtggttcaagttactttgaatgttggtagcgactcaggcaagtggcagtggagatatcaagttatcaactgatgcgatatgacagcttaccacgtgtactcttattgtaatcgtattatagaacgcttgagttgaaatcatgccactcatttcgtttt

SEQ ID NO: 10897 - DNA, 809 bp, Sorghum bicolor
  Clone ID: SORBI-28MAY03-CLUS53526_1
ctaaatttagacgcttaaagtttagttggtacatccaaatacgcccttactgtttcgccttgtggatgctcgtattcccgcttccagggtctttttactcatatgtgctagccaattcatgctccccccattttttttccccccgcttgctaagaagccatatttggttgcacgtactgcctagccagtgttgaagtaaataaattatatccattgttaggactatgctttcagcatagcatagcatagcatagcatagctcaaccatgctttcaatgtactgactatacctgtcatactcgcgttacgcatactcagattaggacaacccctcttaagaaacatatcatccctgcagttaacataaatgcacccttgatggcttatacaaaacttttttgattccaacaacctataggttaatttatagcaacaacacgtctattgtagttctttacagacgcatatctcctaattcttgacaggtacatgaccgcatcatccacagagtcatcgattagcatctcagacgatgatgaacaaggatgggagtttgatcgcagcatgaaccttggctgatcttaccggctctatcatagcccaacaaattctatagtccacagacttagtgacttcagtaatatttaggcctaccactattgggtacttctgtgcactacattttgcagaaactagcctccacatccttgctacatagcactctgcagtgcttttgtatgaccaccaagacttcgtgtatgatagacctaatatctataattgttgcatgaattactctatatgtattc

SEQ ID NO: 10898 - DNA, 1005 bp, Sorghum bicolor
  Clone ID: SORBI-28MAY03-CLUS53572_1
ttttccaagtgacactccaccgaacttaaggactaaactgccagaacgaccactctctactggtagagtacggccaggtattacttcaggtgtccggtcaaccccgaatgctgaaccagtcctctcaggtcctgtgaaaaagatgtctgtgcctgctatcactcgaagtaagttctcagatatacaatcaaagacatctcttaccaatggtcaccaaagtaggccgagtgaaagatctcttttggatggtcaaacaactagaacctcgcggtctgtcacagctgcagacaatggattcggcaggacaatatcgaggaagtcacttgacatggctatcaggcacatggacattcgacaaaatttgggtggcatccgtggtacatctctatttcctcatagcattcgttctactactaccaagggccgaccagctcgaacctcagatccaggccattccgtctcaaatggtgaccgatacttcacagataatggcagcagcaatggacacttctctggagattctagtggtgctctttcacataatggtgggagctcaattggttcccctgatagggaaacctttggaacaaaagaggttctgagtgaactggatatatatgccaattcacgatatgaggcgatgttactgaaggaggacaccaataacatgagttggttgcacaatgtggacgacaagtttgaccagagcccagtgtttgatcataggttcgagccgctccctgagccattcggtccgctatgaactctttatactatgcataaagattccactcattgtgttgttcatcacttgttattgagttgaaggttttatgccgtctctctttctgtttgatcgcccacctcccccatctttttatagatatatgctagaacagataaagatcgtggggtttgcactttctctttaatagctgaagtcttgattccgagtgacttgtgctggaaatccaatgtgcgggaataatatatatactcattccc

SEQ ID NO: 10899 - DNA, 1037 bp, Sorghum bicolor
  Clone ID: SORBI-28MAY03-CLUS53173_1
gcacgaggcacgaacgttcactgaattcatttcaggtttttgctatcactgcgaaaatgacacgtcacctctccttgagtacttcagtcggactgtaggagtatcaggtattatcatgcacttcttgtgatgtgcatcgaccgaaatctctgcgtggcgtggacatccaagcttgcttcacccggtggagaaaccaaagcatagcccaaaggttttatatacatcgttctatctaaaattctatatatatagcagtgtcttgatgagtagaatcagcagaagggtgcaggttcaggaggagctctctgctctcgaggaaggtccaaagaagatggcgggtgaggtggacgaggacgtgctgacggagatcctcgcgaggctgccgtgcaggtcgctggcgcggttccagtgcgtctccacgtcgtggcggcgcatcatctccagcgactacctccgccgccggctgccgctcatcacgtcaggggtgctctaccacgacgacacgcaccgcggcggcgacgcggacagcggcaggaggcagcggcaggcgtacacgtacgcgtgcgcgtcaggcggcgtcggcagcggtggcggcacggcggaggccccggacatgggcttcttcccgcgccacgacacgtccaccatcatcgacggctgcaacggcctgctgctctactactcctcccgcccgacggcgttccacgtcgtgaacccaaccacgcggcggtgggcggagctgccgccgccgcgcgccaggacgctgctctccgtgctggcgttcgacccctgcgcgtcgcagcactacagggtggtgtgcttcaccgggtggcttccccggggcgccaccatcgaggtgttcgactccgagcgcggcgcgtggcgggaccacgaggtcgacttcggcctcgacaccgacgccatgtcggccaccatgcactactccggcggcgcgctccacgtgctggcctactcgggccacgtcgtccgcgtcgacctggacaccatggcgtgcgcggtcaccgcgcttccggccc

SEQ ID NO: 10900 - DNA, 945 bp, Sorghum bicolor
  Clone ID: SORBI-28MAY03-CLUS53926_1
cgcctggaggtgcagtggtgcggagtgcgtccctagttgcccgctccgcatccaaccagccaacgcgtccccatggcggccgccgccgcgggggctacaccggcgactgcgaggaagaccctcttcaccactacagtcaccctcctctcatcctcactcacacgtagcagcagcagcagcagcagcagcagcagccgcagccgcagcctctcctgctctgccgcgtccgccgccgccccgcgcctcgcgccgcagccgccggaccttgtccggtgggtgcagcgcgagggtggattcgtccaccctgccctccgcgtcgcgaatcacccggaacacgggctcggggtctctgccgccgcggctgacggcgacatcccccctggggacgtcctcatcgcgctcccgggccggctccctttacgactacggcgccccaccggtgccgcggatgacgtgcttgtgcagctcgcccaacaagtcccggaggaactatgggctatgaagctgggcttgaggttgcttcaagaaagggccaaatctgattcattttggtggccgtatattgccaatttgccagagacatttactgttccaatcttctttcctggggaagacataaaaaacttgcagtatgctcctctcctccaccaggtggctgtatacgttggcgcggagctggagggtggcctatctgcttccccttccctgtcctacggctgccaccccagggttttctttcttctcgttttcgccttgagtttgagaaagagatacagcagaagcttcatactgtgccctcggtagatcatcctttctatggacaagatgtaaattcatcttcccttggatgggctatgtcagctgcctcttctcgtgcattccgattgcatggtgaaatcccaatgttgttgcctcttattgatatgtgcaaccatagtttcaacc

SEQ ID NO: 10901 - DNA, 1019 bp, Sorghum bicolor
  Clone ID: SORBI-28MAY03-CLUS50472_1
gaccggcaggggcggcgccagccccccgggcccgccccgcccgcggctgctgctccgcggctgcgtgagcggctgcgccaccaggggctcatgttcgtgggtgactcgctgaaccgcaaccagtgggagtccatggtgggccggccgccgcctcgaccccccccgggccagaggccgctgcctgggcttcgcccccaaccgctccacccccggggcctgcggcgccaacggcgggatcaagtgtgctatggagacgcagccgatcagcaacaaccggacgggacggctggacatcgggacggactggcggctgcacggcgtggcgctcggggtgctggcgcgctacctccgccgcgtgccggtgcagttcgtggacatcacgggcctgtcggagctgcgcaaggacgcgcacacctccgtgcacacgctgcggcaggggaagctgctcaccccggagcagcaggccgaccccaagacctacgccgactgcatccactggtgcctcccaggcctccctgacacctggaaccacttcctctacgcgcacatcatatcaccaagcccgccctcgtcgtcgtcccaggatcactaaccattttccatttttggccctacctactgtagatcaagcgtcgtcttcgttccaggcaagggaacaacagccagctcggctcggctctccggcggtccggctcgaggctgtgccctggtctaagtggcattgtcactaagccagcggctgcgatgcccgccttccttgtttcttcttcgctttttttgtttaccgggtgtgcttctggttgcgtcatgctgttgtgccctgttgttaaccttcgattcttttgtcgaacgaaacaagtgggaggtctaggatgcctaggagaaagcaaaagctgagtatgcatcggatgtaatgtaatgtaagggggggaagggaagcaaagcgggggtacatgtaaagaagaattttttgtgttacattttatatgccggccagtgcacccaaggtcaagagaggt

SEQ ID NO: 10902 - DNA, 639 bp, Sorghum bicolor
  Clone ID: SORBI-28MAY03-CLUS50764_1
ggtcctgggccacatgaagaccgtgtgcgtgctgatcctcggctggatcctgtttgactcggccctcaccgtgaagaacatcctcgggatgctgcttgccgtgatgggcatggtggtctacagctgggccgtggaagcggagaagaaggcggcagccccgatcccccggaacaagagcgacatgctcgatggcgaggacgtacccctcaaggccagggtgagtggcgtgcccacgggcgacctcgaggacggcgagatgaagagctagctgctgcggccgccgctgctgattcgttcattcttcttgttcttttgtaactgtgcgcgcccactcgctcgctcgctcggtctatccaaagttgcttgttcgtcagtcctcagctatcgacactacactgttaattttggccctttgttggggggagtccgttcgtaggtgacgaagagaccacccccggtttcgacgtagatgaaacacatactggcagattgttaggatttctcaggcgggaaggtggagccattcattgtcaatttcgtggtggcatgttgttatagatggtgacaatactttagacttataagtaatggaaatacaggtgtttctacgtggtaagactgataggattcagccggcga

SEQ ID NO: 10903 - DNA, 1159 bp, Sorghum bicolor
  Clone ID: SORBI-28MAY03-CLUS5085_1
gcacgaggctctctctctggaaccagggtggttgtcaaagcggtgttggagttgggagtccttgccattggtacaagagcaagaagcaaggacaaggaagggagagaggaggaagaaagagggaagagagtgaggggcactagaaaggtgcttgctttgttgcccgtggcttcttctctctccttgggcgggggagagagaagcaggagaagagatgggcgagatggtcgtggccgggtatggcatggacaaggctctgcgggccagcgtcagcttcgacacgccatgcggcgcgctgctgcgcgagcttgagctgcgttgctccccgagtggcgagcgtgctctggttgttggtcccccgcgccttgaactggaaacagagtgcatgcgtgtataccgtcgaaaggttgatagtgccaatgctgagagagcgcagctccgccagtcattgatggccaaagaagcagagcttaaagctctagttgcttctataggggaaaatggcccacgatttacggtggatgaaaagcacacatcgttgaaagatcaacttgctgcagtgacacctctcttggaagatcttagagcaaagaaacaagacagaatcaaacaaatctcagatgtgcaatctcaaatcgagaagataagagcacaaatttctgatcacaattatcaggacagtgatggttccgtcaaacaacttaatgatgatcatgacttgtcaaccagaagaatttctgatcttcaaatgcaactgcgtaatctacagaaggagaagtctgatcgtcttcaaaaggtttttatatatgtggatgaagtgcactgcctatgtgcagtgcttgggatggattttgcaaagactgtaaaagaggttcacccaagtttgcatggagccaattctgaaaattcaacaaatattagtgataaaactcttgaaggtcttactcagactatcctgaagctcaaagcagaaaagaagacaagagttttaaagttgcaagagactgtagaaaaacttcacaagttatggaatctgatggagtcaactgaacaagagaggatacacttctctgaagtagctgctgttcttggatctactgaggaagaaatcaattctccaggcattctgtcattggagacaattcaggagactgaagag

SEQ ID NO: 10904 - DNA, 812 bp, Sorghum bicolor
  Clone ID: SORBI-28MAY03-CLUS509_1
cgtccgcagctcgctttcccctgccttcgcccaccgctcccggaaacaagcagcagccggaggaggaggagaattcggctccgaacccagagcaagagcaaccaggcaaggtccaaggcaaccaaccagcgaatcagccatgtcgtactacggcgaccggcgcccggagtcgtcgatcgtggaggcgttcacgctgtcgccgctgccgtacccggtgatcctgatcctgctcatggtgacgctcctgctgggcgtctcctggttcttcacctacgaggacttcatcgaggaggcgtcgcagcagctgagctgggcgctgctggcggtgcccatcgcgctcgtcctcctcatccgctggatttcttccgtcgaatccttcgagggctacttcggcttctaccccagggagagccgctggaagggctacgagcggccacccgccgagggcagctcgccctggggcgtcgccatggtcgtcctgctcctcctcgtgctcgccagcttccactccaccatccaggacatgtggaggccatgaacggatcggcgaatactgcttccctctcatacgtgattctctgtgtacctgcatgcagtgtgctcgatcgatcagttcccatgctttttttttccttgcgcgcttggttggttccacttccactggttgctggttgatcgattcgatgattcgatgtatatataatatgttattattaggggatgctgcagctcgctattagctgcaggttatagagtttggggatgatatactcatcagttagctgcctgtatgtaacactggttttggtttt

SEQ ID NO: 10905 - DNA, 646 bp, Sorghum bicolor
  Clone ID: SORBI-28MAY03-CLUS51171_1
gcacgaggcggaggagatgatgaaggccatggccggtccgaagctgctcgtcgtccacccgccgcccgtcgtcgccctgggcccggtgccggatggcgccggcgtcgcccatgccgttccatgggtggtcccggtgcatgtggctggcggtcctctgggccttgttcacctgcgcgtccccccgcaccctgtgctccacggcgcgcgcctcggccggggcggcgtgccagccggcgcccttcacggccagcgccggcgccgcggaggctcgccggccgcggtacgtgcgcgacgccctggcgcagtgcgcggcggcgccgccgtcaaccgggaagccttctgcgggccgcccgccgctcagaaatcgaaatcgaactaagcgacgagtagttacttctgcttcccccgtttttagccccaacatgctccagttctttgagcgatgatcttcctcgtcctgtcgtccaggcagataaattgacaggagaaagtaatgaactcgcagaattgtgtcaatgtagcatagagatcagtggttccttgtattcttatcgcacaaatcttctttgtgagttgtggtgggtccaaatgatttctcccttcaaacatatggtaatgcctgacgtgccaacgcaaaaaaaaaaaa

SEQ ID NO: 10906 - DNA, 690 bp, Sorghum bicolor
  Clone ID: SORBI-28MAY03-CLUS55207_1
ccaactcccgcttaccccgtccctgagaccaccgtcgttgctgtttccgagaccgtcaccgtcccttgcaccaacactgctggttctcccaccaccttcgtccccgttgtcaagacccactaccctgctcctcctgctccccctgccaacaacggcactgctcccaaccctcccgtctacacccaccctgctcagcctcctgttgttcctactcagcccgctggccagcctcccgtctacggccagcccacccctactcccgtccccgtctctggtgctgcccgcttcggcgctcccattgccgttgttgctggtctcgtcatggccgctttcgctctgtaagcgaggccgcgcactggatctaatctttggttcctgcgtggcgtcatgacttcatgactgcattttagagggtttctcgtttcttcaggtatggagcagtctgggtatatcaggcctttgttgcgcacatacgttgcttcttgtgttggtatctacgagttggaaggttttctggattgttaatgtattgaggaaaaactataaaacccacttgggttatttgtcttgctcaaattcccctgatgtagctgccatgtgttccttcgccgctacgtctaatagacatatgacccagcttttgtttttccaagagattcctgtcgactagtgttattactacaataccca

SEQ ID NO: 10907 - DNA, 691 bp, Sorghum bicolor
  Clone ID: SORBI-28MAY03-CLUS5573_1
ggtgtgtgtcagcctatcactgccatttcgcgcacgaagaaatcgcgagaggggagcgtgccgagctgagcaggcaggcggtagtggccgagcgaaagcatcctcgatctcgtagcagccgccgccgctcgggtaggaaggaaggagagcaatggagagggcggtgccggttcggaagccgcacaccaacacggccgaccttctctcctggtcggccacgggccctgacgcatctgcctcgccggcggcggcctcgcgccccagcctcaagccggccgcggggattacgccggcgatgttcggcgcgccggtcaccgatcaggaggccgaggatgtgagcaagagtgaaagaaaattttgctctggctcgaagttgaaagagatgagtgggagtgggatttttgctgagaagagtgaaattggtgattcagaggcttcaaatcctgctaacaagacttccttgaggatgtaccagcaaactgtgactggaataagccagatttcattcagcgctgacggaagtgtttcgccgaagaagccatcgtcgatacctgaggtggctaagcagcgagagcttagtggtaccctggaagatgctgatgctaaaattaataagcagctttctgaagccaagaccaaggagcttagtggcagtgacatctttggtccgcctcctgagattcctgccagg

SEQ ID NO: 10908 - DNA, 886 bp, Sorghum bicolor
  Clone ID: SORBI-28MAY03-CLUS55280_1
gcacgagggttcgctctactgatcgagagtcgtcgagactcgactcgacacggggcagtagtacactacacgtacaaagctcacaaccaagaggtgtcatggctgccaagagcaccatgattccttcccttgtcctcctcatcgcgctgctgctctcgtgcagcggcattagcggcgcagcgcggctgctggaggaggcggagtacccgcaccctgccacgccggcggagctgccaaagcccgagctgccgccgcaccccacggtgccggagctgccgaaacccgaggtgccagcacaccccgccacgccagagctgcccaagcctgagatacctgagcacttgccggagttgcccaagcccgagctgcctcctcctcacccagctgcggtgcctgaactgcccaagcctgaggtagtacccgaacaccccgccgttccagagctgccgaagcccgagctgcctcctcaccccgccgtcccggagctgccaaagcccgaggtgccggcggcgcaccccaccgtgccggagcttccgaagcccgagctgcctcctcaccccacggtgccagagctgccaaagccggaggtgccaaagcatgagctgccaccaaagcccgagagccactatccggtgccagagaccaagccgtgatcggactagtactgcatgcacatatgcgtcgctgtcgcccacgtcgtgtacttgtctgtgtatgatggtgtaatatttgtatgtttgattgtttgtgattttgtgctagctaggagtgtgacatttcagtgttttacttgtacgttgtgcccctttagtttttcctttgattttgtacttggcctttatgtactatatatatttatgaataatgttacgttcatgttgtagtt

SEQ ID NO: 10909 - DNA, 965 bp, Sorghum bicolor
  Clone ID: SORBI-28MAY03-CLUS55763_1
cctactgggtgctgtgtgttatccatttcttctcctctgctctgctcgccgccgccgctcccgctgccgctgctgcagtccagttcggtagttatggcggccgggagtgccagtgccacggcgtctctctccgtggcggcggcagcggctgctgctctgcgcgtcaggcggccatgcgctcgcgctcgcgcttgggccccctcgcagcggccgcagcaaggggcactcctcagcctcaagccttgcgcctcactggcaccacacgcgcctctgtggcgggcggagtcggatgccgcgggcggtggtgccggcgccggcgacgtcatgggcctccttctccgggagcgcatagtcttcctcggcaacgagatcgaggacttcctcgcggacgccgtcgtcagccagctcctcctcctcgacgccatcgatccggactctgacatccgcctcttcgtcaactcacgtgcaagtgggcaggccctagatgtagaggtccaagcgaaggagatattgacgaacaagaggaatgtcattcggatcgtgtcaggcttcacgggccgcactctggagcaggtagagaaagatattgacagagatcgttacatgggccctcttgaggctgttgattatggacttattgatggtgtgatcgatggagacagtatcatcccacttgagcctgtcccagagagggtgaagcctaagtataactatggagagctgtacaaggacccacagaagtttcttacaccagatgtcccagatgatgagatatactagtctaaaagttgtattttctacgaatcttaagtctgttgttctgcaaacagttgcttttgatcgcttgtagctgtcaaacaaatttagcactagcagtagcttattgatctggtttactgcctattttactgactgaatgttgattcgagctggcaactagaaccagttggttggttgtgttgcca

SEQ ID NO: 10910 - DNA, 648 bp, Sorghum bicolor
  Clone ID: SORBI-28MAY03-CLUS5577_1
attgttggagcaatatctgtctgcacatgttcaccctggactttttgaatcaagtggcaaacagccttgagaaggacagtgtatatcatctagctgagaagaagattccttccatccatgggtttacaacaggcctgaagcttgaacagtttatattcgatgctttcacttattccccatccacggcactttttgaggtcatgcgggaggaggaattcgcaccagtaaagaatgccaatggcgcaacatatgacacccctgatagcgcaaagctcatgctactccgcctccatagcagatgggtagtcgccgctggtggcttcttgacgcattctgtgcccttgtatatgacaggcgtcgaagtttctccactttcctcctatgctggagagaacctggaagcaatctgccgtgggcggacattccatgcgccaagtgagatatcattctaggtaggcctgtccatggcagcagctgagcagcagttgtgtaactgtaaaacaaacggaaaggattgcagggtgcgtatattttcttgtaggcgtgagatggatgtggatgggcgggttgttgtgtacttgtatgttctgtgcgtgttgtaatgtagcatctcgaactccaaattcatcttgagttttctcctcatcc

SEQ ID NO: 10911 - DNA, 1166 bp, Sorghum bicolor
  Clone ID: SORBI-28MAY03-CLUS55916_1
tgacagctcttcgcaaatctgaagaaaattccttatgtcaatgtctggtagtacagcagcaattagtagaattgcatcagcacccttagagcgagcattatagatttgccacttatcaatgacaaaaggaattttcttcagatttgcgaagagttgggaatgacagctcttattgaggttcatgatgaaagagagatggagcgtgtgctgaatataaatggagttaagcttattggtatcaataatcgaagccttgagacatttgttgttgatacttcgaacaccaagatgttgcttgagaagcatggcgatagcatcagggagaagggaagctcgggggtcggtggagcaggtctgtctgcgccgcttggtgttgcttgggttcgggcgccccgcgggtctgctgtgccccctgcgctgcctcgggtgtggcatgggtgcccggcacgtccctaatgctcgctctaagggtgctgatgcaattctattaattgctgctgtgctaccagatgttgacataatgtactttattaagatttgcgcagagttgggaatgacagctcttattgaggttcatgatgaaagagagatggagcgtgtgctgaagataaatggagttaagcttattggtatcaataaccgaagccttgagacatttgttattgatacttcaaacaccaagatgttgctcgagaagcatggcaatagcatcagggagaagggaattttggttgttggtgaatcaggtctgtttactccggatgacgttgcttatgtgcagaatgctggcgtttctgctgttttggtgggggaatccctggtgaagcaagaatgccctggacgagccattgttgggttgtttggcaaagaactgctgcactgaatgaaacgacaaagattgtaggtacttggcttggtggtgatgaggtattaggagctgttagccatagcctggtttgggtaataacatgtgagcattaggtacttggtttggtggtgatgaggtattagtagctgttagccatagcctggtttgcagtaataacatgtgagcattagttttattaacaaaatgccgtatgtcacatgcagaataaaaataatgttcacctgtaaattccattcagtgtttttttagttctgtgatgacacaaatgttatcgttc

SEQ ID NO: 10912 - DNA, 497 bp, Sorghum bicolor
  Clone ID: SORBI-28MAY03-CLUS52259_1
cgcacgaggggagtagctctcacggccattatcctgtctgatccgtgttcgctttggccgttgcctgttggccaatcgggtacggccgtttctggtatatatcactatcatcatatgtattaggagagactcctgaagcagacgcatgcaaccttgcctctgcctgccttttgtttcttatactaggagagactcctgaaacagagtttggcttttatctagcactaggagagaaattgctcatagtcacggagacacagatcatgaatgtaagagacatcaataagatcatggaaaatatatatattcctgtaatataattttatctaataagaaagcagtttaaacaggaagggacatatgaatttcttcatttactcaaatcaattggcagcagttccttgagggaggggtgacctctgcagtaggtcatcttggaggtcctaaaagaatctgtagcaatttctagagcagtgacctctgcagtaggtcatctt

SEQ ID NO: 10913 - DNA, 692 bp, Sorghum bicolor
  Clone ID: SORBI-28MAY03-CLUS52408_1
gcacgaaacaagctagtagcaacaccctcttctcttgtaacatagtgcagtaaaggttactcacatgacaacttccatgggtgctctcgtcttgctctgccttgtttctaccctcctctttcccagtgccgtccttggccacccatggggtggcttgttcccacagttctatgaccattcgtgccccaaggcgaaggagattgtgcagtccattgtggcacaggctgtggccaaggagaccaggatggcagcatccttggtcagattgcatttccatgactgctttgtcaagggctgcgatgcttcagtgctgttggacaacagcagcagcatagttagtgagaaagggtccaatccgaacaggaactccctcagggggtttgaggtggtcgaccagattaaggctgctctcgaggctgcctgcccaggcactgtctcctgtgcagacattcttgccctcgcggctcgtgattccacttccctggttggtggcccatactgggatgtgccacttggccggagggactcgctcggcgcaagcatccagggctccaacaatgacatcccagcccccaataacacactccccactatcatcaccaagttcaagcgccagggcctcaatgttgttgatgttgttgccctctcaggtggtcacaccatacgtatgtctcggtgcactagcttccggc

SEQ ID NO: 10914 - DNA, 715 bp, Sorghum bicolor
  Clone ID: SORBI-28MAY03-CLUS52788_1
agaaggaagcaatccaaccgagaatcagccaggcgttcgagaagcagaaaggcagctcacttgaatgaactggaggcacaggtagcacagttaagagttgaaaactcttcgctgttaaggcgacttgctgatgttaatcagaagttcaatgaggctgctgttgacaatagggtgctaaaggcagatgttgaaaccttgagagcaaaggtgaagatggcagaggactcagtgaagcgggtaacaggcatgaacgcgttgttccctgccgtgtctgatatgtcgtccctcagcatgccattcaatggctccccaactgactccacctctgatgccgctgtccccatccaagatgacccaaacagttacttcgcaaatccaagtgaaatcggaggcaacaatggttacatgccagatatagcttcctcggttcaagaggacgacaattttgtcaatggggctgctggcaagatgggcagaacagcctcgctgcagcgggtggcaagcctggagcacctccagaagaggatgtgtggagggccggcttcatccgggtcgacctcctaggtttctccattgcatatgaaaaagaccctgatgcctaacggcaagatgataaattaacaatttcacatactttgtagtggacattgctaatccggcgatgcgcattcgttcgttgtggacttatgggtcaagtgctattgacttattttgc

SEQ ID NO: 10915 - DNA, 836 bp, Sorghum bicolor
  Clone ID: SORBI-28MAY03-CLUS52852_1
tgcctgttccctatcacgcttcccgtgaccagcgcgttaggtgggaaagtggcaggcgtatttaatgcctcggctcgcgtgcgcgcgtcaggcggcgggcagtacccttgcgctcgacgcttccagattcgcacgagcctgtttccgtattcgacggtagctggcgctcgacccctgatcgattcgctcgacgtcatttccgtcttcgaggttgcggtcgtcgatggctgcgcatatgtatgatcagagcgtcgagttgagggcctcgacctgcgtacggataatcttgttatgtgcatcggtgagggtaccccttattgataccctcgacacctgtcttccatgagcgcagcaaacatatcaaaatcaagtatcatttcatccgaagctgtttggaggatggcagcattaaggcagaacacatttcaacaggtgatcagctggctgacattctcaccaaggcactgggcaagaccaagtttgaagagctcaggggaaggatcgttctggaggcaatctcagcaaaggggaacaagaccaagggggagaattgatagcagttggtcatgtatctagtttagcagggcctaagtattgcccgttgcagtttttctgttttctttaccttggttgtttatgtggctgtaataagcttgcttgggggtcaagaagataagacccttggcagccaagtaatcatggcatctactttagaatatgcttagtcctaggggtggctctcagcctataagagctgggttttctgtaaccaagacttccattttccacttcaatcaaaaggccatagcaggcgaactgccctctggctgttaccc

SEQ ID NO: 10916 - DNA, 1115 bp, Sorghum bicolor
  Clone ID: SORBI-28MAY03-CLUS52891_1
gcacgagggtgagaaatagcaagcaggtgtactccataataaaggctatggtacactctgagaggcttcagaatgagaaccagcctgcctttactagtcaaacaggtgaaagagggagagatgttagtggcacgaggcaggatcagaaatatggtagtggtttcatgaagtgccattcgttgatgaaagataataatgtggtgtttcaccaaacactgcctaccacattgcatttccttccacaggatggtgatagtctcaaactgcaactctcatcagcagtcactatgtcttcagataggacctgcagtacgtcggctgatgatccagcatctaatcatgattacatgactgtactgtcagtaaaagcggccagtgttgcttctcagtggttggaattactgcaccaggacatcaggggacgccttgctgctttaaaacgcagcaggaagagagtcagaaatgctcttcgcacggaactgccatacctaatgtcgacagaatttccatctaatcaagagaatgaatcatcgattgcaaatacttctgaggctggatgtactgaaaaagcagtttcagaagcgcatgtggcacgatggaggtctctgtttgtccagatggacagaacacttcaggaggaagggaaacaactggagaaccggttgaagcaagtgcaagaaatgcaattgaattgtgataaaggcctcaaacacatgacctgtgaagctcctctgctaggacccatggctgaactatggaagctgaacaacccagataattctgagagtgagtgggcggtgcaagccgctgctgcatcaatctactcgacctgcaacatggtcatgagagcggagaacaacgtgccttgcttctgatctcacacttatagtttagtttcttgctttgctgatttttacctcaaaattaggtttcctttcttacctttagcctttgtgaattgtgatcccttgtccattacagtagtggcgagtgatgtaacaagaaacttgtgatgtatgttgtcccccagcctacaatttcacaggcacgtgaaataacacattcttttcatggagttcagaatcttcagatcctaccgttttggtttggttgtc

SEQ ID NO: 10917 - DNA, 1121 bp, Sorghum bicolor
  Clone ID: SORBI-28MAY03-CLUS56402_1
gcacgaggcgcacgcctcgccgcacctctgcggcatccggtggacgcttgccgccgggcaagatgtcgccccccgcggcgatgccgactcatcatcctccgcccgccgcggtccaggaggtgcctctgccgtacacgtccctgctcatgatggcgtccgccaactgcgccgacctcattggaggtgccgacagggtgggtgatgacgacgaacaactgctctgggactgcgctgcgccctcagtgccgcccacccggatttgggacttcaatttgggaaggtcaagggatcacgatgagaagtctgctcttgaagttggatatggttctaaccatggaggctttatgattaagagttatagtgacatgcttaaggaaatttcttcggggacaacgaaagatctggaagatatttatgactcaagatactgctcaactgccgaagatatcatgtcctctaatatctgtcagttgtcatcgaaaaatgtgagcaccgcgagcaacaaacggaagctgagctcctgtgcctcgacgatcgatggaccaacaacctctggaaaccatgtacccacatcaggaccagcactcaccagggagatctccttcggggatcaaacggtctccacccctgcagctgagaggcctgctgtgaggatcgacagcgagacgctcgcgcagaatagggacagcgctatgcagcggtacagggaaaagaagaagaaccgcaggtatgagaagcacatacggtacgagtcgaggaagctgagggcggacacaaggaagcgggtgaaagggcggttcgtcaagtcgaccgaagccctgaacgccggctatggcggatgagccatatggcctgtaaactgtggtttgctgtgtgcctgcgttacgtgcagtagcaatgttggtggtacggatgctatggcggaatcgataagcagtgttagagagccaagtttttgcgttgaagcaattgtggtcattgggcagtagtcaactccagagattgcacggtattgcttgtaagagacgaccccctgccatctcatcagtatgtagcttacatacagtactgatttaccatatgatgcatgtggtctttgcagtgaagtaacttgttttgtt

SEQ ID NO: 10918 - DNA, 1371 bp, Sorghum bicolor
  Clone ID: SORBI-28MAY03-CLUS5642_1
gcacgaggcacaataatgctaataatagtggcggcattgttttacatggaagcccagcaccttcaaacattcagcagcaaaattactctcttttacatcaaatgcaagccttgaggcatacagatattgatccaggcacgtgggctgggaaggcgacaagacctgatattggtcctgatgcttcacagattgactggaagtctggtcagaggtttgctcatgtagccaataactcaaccaaatcgtctgcagataacattggaagccctggtgtcccagggccattcacttcagacatgaaaatgctgagttttgcttcaaggagtgaggagagaaatcctaatgtaccttctcagcttccttctggagagcgcccatcacctggtatggttactgcacaaaatgataatcggaatcaagttcagcctatgggcacaagtgcaacgtcaaattctgttgaaagaagtgagaggccgaggataaaccctcaaatggcaccttcttggtttggacattacggaaactatagaaatggtcagagtgttgctatgctcaatgcgcagaagcccacggctttgccatataattttccgaaagcttcttggaacaatgaaaataatagccctgctgaaaatagagttgaatctggccaatctgttaggcctggcacgaggctcccatcaacaagaatggaagctttggttccttccaatgtaaaagtatcttcaatgatgagaaggcctaagaagcgtaaagcaatggactccacacttgtttcttggcataaaataattgaaagcccacaaaaactgaggaacatcagcacatttgagatggactgggcttgggcagctaatcggttaattgagaaggatgagtcagaaactccagacgacgctcctttaaattatttaccgcggaagaggctaatcttgacaacccagttgattcagcaacttctccctgctataccagcaaccattctgagagcacaagctgtgtctgcttacgaaagtgcgacatacactctatcaatgctgacactaagggatgcgtgcagcatggcatcatcatcattatataactcttgctctcccgtggaggatgaaaataacccatctgaacaaacaacaagtgctaagaaaatggaagacaaagtgtcaaaggccgtggaagtctttgttggaagaatccggaagatggaaaatgactttataagtttgaacaagagggcctcgatgctagatgtgcaactggagtgccaagatctggagagaatttctattgtaaatcgtttgggaagatttcatggccggaaccatgcagcagcagttgagggttcatctgcttcagaaatgactcctcggagaa

SEQ ID NO: 10919 - DNA, 586 bp, Sorghum bicolor
  unsure (1)..(586): unsure at all n locations
  Clone ID: SORBI-28MAY03-CLUS56444_1
gaagccggcgagctacaacgagggggttcagcaggtcgccaacatcgccaaggacatcgtgctcaaggtggaggcggagagccacagcaaggcggaggtggagcgggtggcccagctcgcgcggcaggtgctctacttcctgccccacctgcagacaccccagctggcgcagcacccggaaacgccagggctgttgcacagcctgtgggtggacctcgaggccgcgcacgagaccatcgtcttcggcggcggcggcggcccactccagtgcggcggccgcggcgcggccgtcatgaccggcagcttgagcttctccagcgagcacgccaagaagatatgcaggattgggaacagcgtcgagcgggtgtatcagagcctcacgttcattgccatgcatcagatcctccagaacaatgcctgctagctagctccatcttcccaatttttcattgatgcctccctttacctcgctgtctgtctatctatctatctatctatctatctatctatctactcttgtaatataatgtattttagcaattttcaaacagactaaaagagaatatagaagacantatatgccctc

SEQ ID NO: 10920 - DNA, 1430 bp, Sorghum bicolor
  Clone ID: SORBI-28MAY03-CLUS56917_1
gcacgagggtcttcccgatcccctacgttcgagcttagctgaggcattatgggcaagtcaaacaagaagtccagtgttggggctgcacctgctgctgtcgcagttccagaggggaaatctgtaaagaaggggaaggcgcgtgcagaagatgagatcgagaaggccgtgagtgccaagaagcaaaagactgcacctgaaaaggccgtgccagttaagaagcagccccctccaaagaaagttgagagcagcgactctgaggaggattcttcagattctgaagtgaaggtgccggttaagaagcagccccctccaaagaaagttgagagcagcagctctgaggattcttcggattctgaagtggaggtgccagttaagaagcagccccctccaaagaaagttgagagcagcagctctgactctgaggaggattcttcagattctgaagtggaggttaaggtgcagccaaaaaaggttattcaaccaaagaaaggtacacaacttgctaaacaggagtccagtgatgacagcagctctgagagctcagatgatgaaccttccaaaaaaccagttgccggttcaaagaagccagctgccagtagtagcgacagtgatgacagcagtgacagtgatgatagcagttctgatgaggaacctgcaaaaaaacccactgtcctttcaaagaagcctgtcacagcagttagtaatggttcaaaacaggttaagcatgatagcagcagctctgacagtagctcagatgaggatgaaaaacctgctgctaacctaaagaagcctccagttgcctctctgcaaaagaagacccaagaatctgatagctctgacagtgattctgatgatgatgaatcagaagatgatattcctgctaaagctccagtagtggccaagaaaaaggaagcatccagtgacagttctgattctgagtctgaggatgaggataataatgctaaaacagtacagcctgtgaaggctgctgctcctaaaaagaaggaagaatctagtgggagctcagaatctgactcagagtcagattctgattctgatgaacctgaaaaacctactgtgcctgggaagaggcctctagcaacaaataagaagaatgaagaatccagcgacgaatctgatggcagctctgatgagagttctgatgaaagtgacgaggagccaccacaaaagaagtctaaggaaactcctgtagacactacgcaaaagtcagcacataatgagcccaaaactcctgccaaaagccaaagtcaggctactggttcgaagactatttttgttgggaatttagcttatagtatagagcgtgaacaagttaaggaattttttgaggaggctggagaagttgtagatattcgtttgtctacttttgatgatgggagtttcaagggttatggacatgttgaatttgc

SEQ ID NO: 10921 - DNA, 687 bp, Sorghum bicolor
  Clone ID: SORBI-28MAY03-CLUS5652_1
ggaggcgtgggtcggacgcgtggggggaagcttgcacctaacgaatttcaagggggaactttcagtatctcgaatcttggaatgtaccctgtggaccatttctgtgcaatcattaaccctccacagtctggcattctcgcagtcggtagaggaaacaaggttgttgaacctgttgtggacagcgatggaacagagaaggctgctgcggttacaaagatgagcttgacactatctgctgaccatcgtgtttttgatgggcaagtaggaggcaagtttttcacggagctggcgctgaatttcagtgacattaggagactgctattgtaaatgaaaggaggcaattacgtgttttgaagaattctttgggggcgaaaaccgctcaagagaacaattagatgcaacgcgagctctgctgcttgatcgttagcccgtacaaaagtaaccaattttgtaataaattataataagaatgcattggcacctccacggttttttttaacccgttttccattagttgggaggaggcatgtcctgggaatttaacaggtacggtgccatttcatgtttaagtttaacgtggttctgcaacaatgaccctagatgaggctggctgtgatgtgggcgggtgatcttattcttacttgctctttgagcgtttctggatgggctgcccattttatttagacc

SEQ ID NO: 10922 - DNA, 829 bp, Sorghum bicolor
  Clone ID: SORBI-28MAY03-CLUS5373_1
cgtcttccccccctcgaccctttgcgccggcacgagcgtcttcctccccctcgacgcttttccccatgacgcgcacccaaggcgattttgtcggtgcggcgacgatttggtccagcgaactcgcgctcctcgatgcagagtgctgccgaagatagtgatggcagttggagggtttagctcatcattccttcctggagggttctagattgctctgaaggcaatggttcctcggataaagacttctgttctcatgataaatctatcgatggggagaatgatgatgattttgatatgaactctaaagaaaacatagcttctttggatccacatttgtcagaggatgaggttgatgaagctgaactagtgaagacttgcaagcattttcatataggtgccagctactataaggtttgcattagacagagaaatgacaccctatttgcccgccgggtgtctggtgttcgcctgtgtccaccaccatgacctgccgcgcttggcgccctctcgctccttggcgtgcgtcaaggaccgcgtcaagctattcaaattgcagggctggctagcagcatggagccccctgctgtcctggctctccacctggaccctctcgtcgccggcctcgcggcccgccgtccccggccgcgcccatagtgagttcttttgttcaaaattgtttctacttgagaaggatctgattatgcatgtaagcttacacgtacgggaagatgcatggaaggaaatataaagtaaatggtgatctagcagcatgttggggccatttggaggtctgcaagtactagagtgaggaactagggtggatccaaatatg

SEQ ID NO: 10923 - DNA, 734 bp, Sorghum bicolor
  Clone ID: SORBI-28MAY03-CLUS54266_1
gaggaggcagtcggaataatcacaatggaagatgtcatggaagaactgctacaggaagaaatctatgatgaaacagacgagtatgttgatgtacataacaagatcaggataaacatgttacctccaggcaaatcactgtcacctactatatctcctggtggtggacccttatctcaggggcttcgaaggactcctatggcatctccgttctcaccataccaccatggtagttctgtcttacgttccccagcttcgaaccatggtcagtcacctgggattttaccgacaatactttctcctggaagatcacctactgcacaaacacctgggcaaagttcaccaagtggaagtcaggtttcaataaattccaacggtcaacataaaaaggacggtgagagctaacatcccagaagattgtttttcagacgaaggcctcgtctcaagagtcaagatggcatgcatgatcaaattatgacattgctagcgtaggattaagctgcgaatataagtagcacagctctcttgtatggttattagcccatatttattgattgcttgcctgtatatatatgcttcagcatccggacctcagtatggcctaatcctcagtatgtattgtagaggtcttcctaaggactctctccttttgttgtcgtcttgtagttatccggagaggggacaaaaggtaagcgttggactgaatatatttaagcaaatatcaagccgattttgcg

SEQ ID NO: 10924 - DNA, 995 bp, Sorghum bicolor
  Clone ID: SORBI-28MAY03-CLUS5434_1
gcacgaggattttcttctgaaaaccgaaggctccggcatccgcctgaaagggaaaaaaaaaaaaacccacacaaacaccaaatcccctgcggcggcggcggcggcgatggacccgtcatcggcgggctccggcggcaacgccctcccgtccgttggcgccgacgggcagaagcggcgcgtgtgctacttctacgactcggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccgacgactacatcaacttcctgcgctccgtcacgcccgagacgcagcaggaccagatccgcctgctcaagcgcttcaacgtcggcgaggactgccccgtcttcgacggcctctacagcttctgccagacctacgcgggcgcctccgtcggcggggccgtcaagctcaaccacggccacgacatcgcaatcaactggtccggcggcctgcaccacgccaaaaagtgcgaggcgtcgggcttctgctacgtcaacgacatcgtgctcgccatactcgagctgctcaagcatcacgagagagttctgtatgtcgacatcgatatccaccatggggatggagtggaggaggctttctacacaacagacagggttatgacagtctcgttccacaagtttggggattatttcccaggaacaggggatatccgtgacattgggcactcaaaggggaagtactactccctgaatgtccctctggatgatgggattgatgatgaaagctaccagtctcttttcaagccaatcatgggcaaagttatggaggttttccgccctggtgcagttgtgcttcagtgtggtgctgattccttgtctggggataggttgggttgcttcaacctctcaatcagaggtcatgcggaat

SEQ ID NO: 10925 - DNA, 739 bp, Sorghum bicolor
  Clone ID: SORBI-28MAY03-CLUS54810_1
agagcccgggcacccccccgcgcccccccccctgcgccccgccggcctgacgctcggggacctgttcctcggcccggggctggacctgctgctggagtacctggccgagaccgacccgagccggcagggcacgccgccggccaggaaggaggacgtggccgcgctgccgatggtccgggtgcgcgaggccttcacctgccccgtgtgcctggacgaggtcgcgggcggtggcgaggcgcgcgagatgccgtgcagccaccggttccacgaccagtgcatcctgccgtggctggagatgcacagctcctgcccagtgtgcaggcaccagctgcccacggaggagcctgcggcggaggcaattggcagcggcagaggcgccggtgatgagtccagtggcaacgcgcgcggcggcgacgggggaaatggcggcgggaggaggcattggttctcgtggccctttggcgggctgttctcgcaaagatccaacggcaactcctcctcgtcgtcgtcgtgatcgtgatgctaatgaacacttaaacacagatgatatatatacttatgttggtgtaggtaggggcttgtcttgtactttacgattggagatgggaggggttctttttttttggccagtgtaaagctgcatttgtgttctttggctgtagttttgctaaagctcaggtggatggagattggagattgcatcttctgactgatgcttcctatggtttggttttctgtt

SEQ ID NO: 10926 - DNA, 633 bp, Sorghum bicolor
  Clone ID: SORBI-28MAY03-CLUS54860_1
gcacgaggctcttgctgcttgctttcgttctcgttctcgttctctctccctgaccgaggaagacgaatcagatttggagatcgtgtggagagcctacaagtggcgcttctgggctctgggagaaggacagcctgtgtctctattggcaggtaaatgttctatccactgatctagttgtacttgttctcgtttcaaaattgatcttgttgtgatgttctgcgacatgctcggcgctcgggggcggactgcctgtgtcccccttggctggtggtcgtggctggcgcggacctgctggtcggatccggccccgcttcgaggtcccgccgcctcggggccgcgctggtcttccggcccgagctgggcatcgaggagctgaagtgtccccactgccacaccggcttcgtggaggagatggcgggcgaccggcgaggcagcgacggggcggccatccgaggccgtgctcccgcggatgaggcgagcttcaccgcctccgtcgcggcgctggcgcgcgaccggccgcgctgcgcccccgcgcccatccgcggccgcgcccccgcggatgaggcgagctttaacacctcggacgcggcgctggagcgcgaggtttcgctctgggcgcctgtgctcatggac

SEQ ID NO: 10927 - DNA, 1012 bp, Sorghum bicolor
  unsure (1)..(1012): unsure at all n locations
  Clone ID: SORBI-28MAY03-CLUS58338_1
gcacgaggcaacattcgtaggcgaccagctgatctgcggctgattgcttgcttcaaggaatcggaatcctcctccagtcctcctctcttatccaaatataccactcgtgagtccgtgacccgtctgcgtcacgcagattgtctacttccacgagcgtccatggacgggagcagcagcaaggtggttgagctcaagccgcacggcgacgtcgcggaggaggaccccgcccgtcgcggcggtccggggacggatgaagccgatgacaacgagaaggcgcctcgccggagcaggcgggttgcttccctcgacgtcttccgcggcctcaccgtcgcgctgatgatactggtggacggagccggcggcgagtggccggtcatcgggcacgcgccgtggaatggctgcaacctcgccgacttcgtcatgcccttcttcctcttcatcgtcggcatggccattcccctctccctcaagaggatcccagaccgtggccgagccgtgagaagagtagtcataagaacactgaagctgctcttctggggcatcctgttgcaaggccgttactcccatgctccggacgaactgacttatggagtcgacatgaagcacgtaagatggggtggaatcctccagaggatcgctcttgcgtatttggtggttgcagttctagagattgtcacaaaagatgcaaagattcaggatcagtcaagttcaggtttctctatattcagaatgtatctttctcaatggattgttgcatgctgcatcctagtgatctacctggcccttgtctatgggatttacgttcctgattgggagttcagagtgcgcaatgttgacagcccaaactacgggaaagtgttgacggtgacgtgtggtacaagggggatattagaccctccttgcaacgctgtaggttacattgaccgcaaagtcctcggcatcaatcacatgtaccagaaaccancatggagaaggcacagggcctgcactgatgattccccacacgagggtc

SEQ ID NO: 10928 - DNA, 1135 bp, Sorghum bicolor
  Clone ID: SORBI-28MAY03-CLUS585_1
gcgttctcagtaatggccgttctttgcatccactgcgagggtgatttgctgacagaaaacaagtgcaaaagacaagtacaaattttttgagttgttgcggagcaagtctgtaaatggttcaggcactgctattgagtctccatctggcctgactgatgatcagcagaactctagtcttgattcggcgtggggtttattgaaaatgggagcagttcctgtgaagaagcaaattcttgtgagggttctcagcgacacttgtcggacaatgaggaaatcattccaccttcagaatctcatgatgttttagatgagggatctctggggattcaggttgacgacagggatgccagctcttcaccagtacttggtgacatagaagatatagcttctaagaagccccagcaagacaatgttgctattatgcccatcatacctgcttatgtaaatgatggttctgtgatgcccaattctgttgacaatgaagcaagtttgtcgttggaggaagccaatcctgctcaagtgttacagcacattggagtaagagaggagaatccctgtcctgctcaagagttcgagtcctttggggcaggtggggaggaagagttgaacctcctgagatctatgggctgggatgagaacgaagatgttcagcctcttcagcaggaggagattgctgattgtctaaggcagaacgccaggctgcagcagaagcttcaggaatgcaggggctgatcgcggaatcaatggagcaacgtcactgtgctgtcaccatactgagacgatgctggtgtggagctgcgttttggtaccttccggtcaactgatcagggaatgattgtctctagcttagcaaatggagagttttgtttttgttaatgcttgttcagcattgcggggggaggtttcatggtagagctgataattttcccccattgaaaagaggttttagggtttttcttcctcattttcccagaaggaatcccccaaatggaagtcttgtctggtgttggaggcacataggtgtgcgttgctctgaaagaagaataggttgtctttcttacttttcgtcgccatctttttgtttttttttttttttgggaaaaagaaggggaaaaaagaatgatcgagcttaccc

SEQ ID NO: 10929 - DNA, 1211 bp, Sorghum bicolor
  Clone ID: SORBI-28MAY03-CLUS58921_1
aaaccgtttgaccgaatactaatctccgcgaaaacaaaaaatcattccaactctcgaacaccacctgcgctgcgcggctgcacccaaaacttccccatccggccatctcccccaaaaggctcctccgatctgattccgagccccgccaggcgccagccttctcccgctgtgtcccacgtgcgccccaccatctcgagccgcgatcccatccggcggccccgatgcggtcgccggcgctcctggccgccgccctagtcgcggcggtgctcctcgctgccggtgccggggtcgcggcggccgcgacggaggaggcctacgtcacgctgctgtacggcgacgagttcgtgctcggcgtgcgcgtcctgggcaagtccctccgcgacaccggcacgcggcgcgacatggtcgtgctcgtctccgacggcgtctccgagtactcgaggaagctcctccaggcagatggttggattgtgaatcgtataacattactggctaatccgaaccaagttagaccaaagagattttggggtgtctacaccaagctaaagatatttaacatgacaaactacaaaaaagttgtttaccttgatgcagatactatagttgtgaaaagtatcgaggatcttttcaagtgtggcaagttttgtggaaacctgaagcattctgaaagaatgaattctggtgtgatggttgttgaaccctctgaaactcttttcaatgatatgatcaacaaagtgggtcaattgccttcttacactggtggggaccaaggttttctaaattcatattattctgattttgccaactcccgtgtctatgagccagactcgcctttaactcctgaaccggagacacaacgcctttctaccttgtataatgctgatgttggtctttacatgctagcaaacaagtggatggttgatgagaaggaattaagaatcatccattacacgctgggtcccctaaaaccctgggactggttcacagcgtggcttgtaaaacctgttgaaacatggcaggatattaggcaaaaacttgaagaatctcttccaggaactggtgggggaaggaaccctcatgaccagctggttgtcaaaatattgttcattctcccattttgcttgctgttatttggttattaccaatcatgttttcagacaaacaaggagttgataagtataagatcactatgtgcatttgctagaagagct

SEQ ID NO: 10930 - DNA, 1225 bp, Sorghum bicolor
  Clone ID: SORBI-28MAY03-CLUS5927_1
ctactggcgaccaagtcacgcagacgctgcacgctgtcgtctcgcccgtcttccccccgaaggccgccccgacctcaccgcgtcttctcctactcggcttgacccctccaccacctccatggggtcgtcggaggccgacgaggaccagctcctcaagagcttcctcgcggaggtcagcgaggccgagcgggacaacgaagtgctcaggatacttggttgcttcaagttaaaccccttcgagcatcttaagttgtcttttgattcatcaccagatgaggtgaaaaagcaatacaggaagttatcattgttggtccatcctgataaatgcaagcatcctcaggcacaagaagcttttgcagctctggcaaaagcacaacagctcctgcttgatccacaggaaagaggctacattcttgaccaagttactgctgcaaaagaagaattgagggcaaagcggaaaaaggagctgaagaaagatagtgcgtccaagataaaatctcttgtagatgagggaaaatatgaagagcagtttgaacgatcggacgaatttcagcagcagttaataattaaagtacgtgaaattttgacggacaaagaatggcgtcggagaccatcgcggatcaggtgctcggtggtagttcgatgtctcctgcaggtcggggtggatacataactgtggtgggggtggcagcggcagcatgaggcgttgtgggtggcgtcctcggaccggcgcgtctcgtcctggtgcgttttcgtgaagacaggaaagaagggacggaaaggtgaaatcaaacccccaaaattaaagactgaagatccaaacaaatcttatgtccaaaggccagtaaagcgcaattgagaggaatgatattagtgtcagcaatcaaagaacatctggtagcgatctttcgtgtcaccagattcaaactgcaacccttccatgttgcgctggccctcaaggttgtgaggttcaattatgcccgctgggctgatgagctctagtgtcgtcagtgaacagaacagattttacccgtattgctacctagagtgatttgggtgatgtactcatcagtctgaagattttactggaaagaagtacaaattttccgttggaaaagaacctactgaagtgaatgttgacaggctcgtctctttactgttttgtatcattttaatgtaagtaatgctgatatatatacatggtttgtcatcattgatcactttc

SEQ ID NO: 10931 - DNA, 1290 bp, Sorghum bicolor
  Clone ID: SORBI-28MAY03-CLUS59344_1
actagcagaagccgcacgaggacaggacggaatcccacggaggcgcaggggcgcgagccatggagatggagatcgccaaggtcgacctccgcggggtggtgcccgggggcgcagcgtgggatgccgcccgcgccgcggtgaccgcgtccatggtggcgcacggctgcgtcgtggtggcgcacgacgcgctcggcgcggacctccggcgggcgctcttctcccgtgccctgccggagctcttcgcgctccctctcgaggtcaagcagcggacggtgtcggacaaggggcagttcagaggctacatcggccagcagcccggcatgaactgggagagcctccgcgtcggggagcccaccgacgccgccagcgtccgcggcttcgccgagatcctctggccggaggggaacccggagttctgcgagacgatcctgtcgttcgccaagaacatgaagaagctggaggagatggtggagacgttggtcctagagggcctcggcaccaggggggagagcatcgacgcacactttggcttgctgggccacggcttccggctgtcgcactacggcgtgccaccggacacggagagcagcatgtccatgtcgccgcactgcgacgacagcatggtgaccgcgatcgtgcagcacgaggtggaaggcctcgaggtgcacgtcggcgacgggcgctgggtcgccgtccctgccgagaccggcaccatcaccttcgtcgccggcgagcagctcagggtcgtgaccaacgggcgcgtgccggcgtgcctccaccgggtgaggacgccgagcaaccgcgagcggttctcggtgctgttcggccgccggcagaaggacggcgtcttggtgcgcgcgctggaggacctcgtcgacgcggagcacccgctggtgtacaacccgctgcggcacgaggagtactccaagtggcgttactcggaggaagggctcaaattcgacgatccgctcaaggtctactgtggagtggacaaggaggagaaggtcgtcggagccatggcgtgatgatcctattctattcctatcactatcccaggcagctactacctcaaataatgtccagcgccagcggaccaacctttatttaccaatataagtcgctatcgatcgttatcttacccatactagtatctggctaccgatagatattttgagttgagattaccaaaatcagtttgcagtttacacaattacacacagttgtcctttgcgatggaaaagctagctacccatccaacccgtacagttgggtgcaacaaagagaaacaat

SEQ ID NO: 10932 - DNA, 805 bp, Sorghum bicolor
  Clone ID: SORBI-28MAY03-CLUS59345_1
cctactggctccctcccacctccgtccctcctctcccctccctctccgaaagctggagaggaaggagatccattgcttccgatggatgcctgccgtctctgacctccgacctctgctgccttctccccccctacctgatagctactcctgatcggattcaggctaggtcacagccctcctctgaaactcagcaagcggacctgaatacgaattgatctctgcggtgcaaccccgttagttgaagccatggggtctggggactggttcaagacgatcatcagcaagaaaaaatcgaaacgggcaaagtcaaagcacgcaaagctctctggtcaagtaacaaatggaagcaaccagacaaatcagaagttaaatggcccttcttccagtagtgacgaccatgaagacaatgcagcactagaggaatgggctgctactcgcattcagaatgcattccggaaatacagggcaaggaagaccctgcgttgtctcaggggagtcaaaagattgcgtgttgtcggtcaggcgaatccggttaagaagcagactgctgccacactgagttacatacagtcttggaacaagttgcagtcagagataagaaaccggcgtgctttcatggtcaccgaagggcgcaacaggaagaagaagcaggagaaccaaatgaaacttgaggcaaaactccataatttgcacgttgaatggaatggaggttcagatactatggatgaaatacttgctaggatacaacaacgagaagaagccgcagtgaagcgtgagcgagccatggcgtacgcgttcaaccatc

SEQ ID NO: 10933 - DNA, 821 bp, Sorghum bicolor
  Clone ID: SORBI-28MAY03-CLUS5609_1
gctcataatctgcttgatcctactcaaatgcaagttccttaccaacaatgccacaataacggtgtcttgcatggtggtgttaattaccctggaaaccgtctccacttaggtccgcgaattccagttctcttctccagtcctgaacgtacttttggacctccacagcatccattcctggcaaatccagttaaccaccgcaacataaggattctaccacccgagcatgccacaataatggatttttcgagattgtatgaagtgtcaaatactgtagatgagcatagagatatgcgtctagacatagacagcatgacgtatgaggagcttttagcattagaagagcagattggagatgtcaatactggcctgacaaaaagtcacattgtagataaattgaggactagcctatatgttccaggaacatcaagcatgcctgatcagccatctaaatcttctctagagaatgatgcttgcataatatgccaggaggagtaccaggctagagactgcgttggcacccttgactgtggtcacaggtaccacgcagagtgcgtgaagcagtggctgatggtgaagaacttgtgccccatctgcaagacaacagcattgtctgccaacagaagacaaggaaaatgagcaggaatgaaataagcctgttacttatttgcttcgacaaacgttcagctcaattttgtacataagatgtggtagacaatggtgctacctgtatttgttaactttgttgtgaccgggagtacccagcttcctaaaactgtacagccataacatttattatttttcttcaaatgtagaatattttt

SEQ ID NO: 10934 - DNA, 1105 bp, Sorghum bicolor
  Clone ID: SORBI-28MAY03-CLUS56078_1
gctccgggcctcaaatatcagacaaaacccaagtggtctagtcatggcgatctgtattatgaaggcaaagaatttgaggttaaactgagggaaatgaagccaggcatgctttctcgtgagcttaaagatgctcttggtatgcctgatggtgcccctcccccatggcttataaacatgcagcgctatggtccacctccatcgtatccccaactgaagatcccaggtctaaatgccccaatcccccctggtgccagttttggttatagaccaggggagtggggaaagccaccagttgatgagcatggacgtccactctatggagacgtttttggtgttctgcagcaggatgaacctaactacgatgatgaacctgttgatcgcagcaaacactggggggatttggaggaagaggaggaggaggaagaggaagaggaggaggaagaggcacgaccaatggaagacgaggaaatggaagacggaattcagtctgtcgatactatctcaagtactccaactggggttgaaacacctgatgttattgaccttcggaagctgcagaggaaggagactgagaagcaggcagaacggccattgtaccaggttcttgaacaaaaggaagaaaggatcgcccctgggacactatatgggtcaagccatacgtatgttctgggaacacaagataaatcatcagctccaaaaagggtggatctgcttaagaatcaaaaatcagacaaggtggacgtcaccattcagcctgaggaactggaagccatggatgatgttctggcagccaagtatgaagaagcgcgagaggaagagaagcttcgcaaccaaaaagaggacttcagtgacatggtggcggagaatgctcacaagaggaagcggaagcaagagaaggaaggcaaatcgaagaagaaggaattcaagttttaatataagggtgatatatatatatatatatataggtcggttgtattagcatgctcgcggcgatcttgcgagccaacgtcacttggtggctgtactgtgaattttgtacgctactagtaccttaacatacgttcccttggctggatttggatttgctgctgcttggtttttgact

SEQ ID NO: 10935 - DNA, 1531 bp, Sorghum bicolor
  unsure (1)..(1531): unsure at all n locations
  Clone ID: SORBI-28MAY03-CLUS56369_1
tactggattgtttcttcacataattatgaatatactccatcctgtgaggaaatacaaatcttgttgctagaatacaagcagttggagctgacatagtgaaagttgcaacaaccgctaaggacattgtcaatgtatcacggatgttccaagtgatggtacactgccaagtgcctatgattggactcgtaatgagtgaaagaggtttaatgtcaagagtgttagcacccaagtttggtggatatcttacatttgggatactgaatgctacaaagacatcagcttctggacaaccaacagttgaggacttactgaacatttacaacataaaatgtattcggcccgaggcaaaggttcttggtcttatagccaacccagtaaagcagagcaagagcccaattttgcacaataaatgtcttcaatccattggatataatgcggtttaccttccacttcttggagacaatcttgctagttttcttgagacatattcatctcctgacttctcaggatttagttgctcacttcctttcagcgcgggggctgtacagtgttgtgatgaacatgacccggttgctaagtcaataggagcaataaacaccataattagaagaccagatggcaaattagtggggtacaatacggactacattggagcgatatctgctattgaggatggcattggaggtccaggatcaaaggatgctgccagctcaccgttggctggtagacttgttgttgttgtaggtgctgggggtgctggtaaggcaattgcttatggggcaaaggaaaagggtgcgagggtagttatagcaaatcgcacctatcagaaggctgtaagtcttgccaacgcaattggtggtcaggcgctgagattagaagacctggaaactttcagacctgaagaagggatgatccttgctaatgcaacatcattgggaatgtacccaaatgttgatggtactcctattccgaagaaagctctgggtttctatgatgtagtatttgatgccgtatatgcccctaaagttacaaggcttcttcgagaagcagaagaatgtggagttaaagttgttagtggtgtggaaatgtttattagacaagccatgggtcaatttgagcgtttcaccggtggtatagaagctccggaatgccttatgcgtgagatagcagcaaaatacacctagcaggctaatggcgaaaacccgtctctgatgaatatttgcccaaagattttgtcggggctgagtgaataaaagttttggatacctgccctgttttgcagttaccgaggtttgctgttgtattgttatatttttttagacgacttgtcacctgcacaatataagattacgttgtcatgctatatagtgttcttgtacttgcaatagaagtgttgcaagaataaagagtcagcttagaacccaacgtatgatgaccaagggagaaaatatgcatcaaataaaaattcagttgacagttggttntgcggatcatgtaagagctacaactgttgactgacatgcccaatagg

SEQ ID NO: 10936 - DNA, 1128 bp, Sorghum bicolor
  Clone ID: SORBI-28MAY03-CLUS56379_1
gcacgaggggcaccttccgtggaaggggactaggggtgccttcgcgaaggccacttggtgttaatactcggtcctcgcccgtggctattgccaagtcattcaataaagcaaaggattttgtgtggagacatgatctctttgaggatagcatggtggcagctgggctttctgggatagaatctggtacaaagctgtacatttcaaacttgcactatggagtgacaagggaagatatacaggagcttttttcagaaatgggtcatttgaagcactgtgctgttcattacgacagttacagacacccaactggttcggctgaggtgatattcaccaggagaagtgaagctcttgcagcactgaagagatataataatgtgcgccttgatgggaaggcaatgaagattgaagtaataggagctgatttgggtctatcatctgctgccgcaccccgaattagtgttgttcctggtgcaagcggaagagggcagagagaagttgttatgatgcctggtggaagtgggtttggactaggtgcatctggcccatctagttcgcttcctgggtggaagcgtggaggttttgttcaaagaggaggacaagggcgtggtggttttgctcaaagagggcgagggcaagtgcgtggccgcggacgcggccgtggccgtagtagctttggtcaggtccgtggacgtggctatgtgcgcaagggtaatgtggagaaatcagccgaacaattggacaaggaccttgacaactaccaccactctggtgcaatgaatgtcgactaaggtagcgaatccatcatccagtccaacctggaagttggaactatgttgaagctaagcttgttttctgtctgttggttttctgtcaaatgagcaaacttctgttctgctctcgttgcatcagttagattagattcgtactgcaatttcttgtttggagttagtcctgtgatcagaatttgctgttaaactgattgatgaattatgttttcaaccgttgaatggttttctgttaaattgtaagaattttcaataggcagtacccaaaatgttcggtgatgccgtttcaaaaaaaatgttgggtgaggaccacaggttggaggttctatttatgcttggttac

SEQ ID NO: 10937 - DNA, 604 bp, Sorghum bicolor
  Clone ID: SORBI-28MAY03-CLUS56398_1
gctttgtttgttgagggagaggagccaatcaggcagccgataattcctgccacagaagttattgataccacgggggctggtgacactttcacctcagcatttgctgtagctctggttgaggggaagcctaaggaggagtgcatgagatttgctgctgccgccgcctctctttgtgttcgtgtaaagggtgctatacccagcatgcctgacagaaaatcagtaatgaagcttctggattctgcgaaagtcgaataaccgcagaatgcgatgatcgttcaaagctgtcctcattcgtcggcgataggggtacgcggaattcgtgggatcgatccatcaagtgtcgctacgccttcacgtgctcctcccccaaataatgcgatggtctccattccctccgatctcctccaaggcggaggaaacgcattttccggtgccgcccggatgaaaaatccccccacacacaaaataagaaacggtcccttgtgcgtttaactcccgtctttgcagacagacacacatagttctactacatactcccccggttccgtgaacacaataaacagtttcacactgggccagagctatcggacggtaactctgatct

SEQ ID NO: 10938 - DNA, 1237 bp, Sorghum bicolor
  Clone ID: SORBI-28MAY03-CLUS60681_1
gcacgagggaacaagccggtggaccaagaattcggtgccgaagcgggggcgcaggagaggagagcgcgtcacgtttgatctgggaattcattctgtacagtgctagctactttgatacaaaggcctcaacaagttagcctgagacaagagcactggaaccatggtttcaaaatcatattcaaatctgctagagatgacctctggagatggatttgactttcgacaaccttttaagtctcttcctcgtgttgtaacttctcctggcattatatctgatcctgattgggatacaataagtgatggtgattcagttggttcagcatcttctaccgagaggaaaataattgttgccaactttcttcctctgaactgtacaagagatgatactgggaagctgtccttctcattggatcatgatgcactactcatgcaacttaaagatggtttttcaaatgagactgatgctgtgtatgtgggcagcacgagggttcaggtagatcccagtgagcaggaccaagttgcacagaagcttcttagagaatatcgatgcatacctacttttctcccatctgacctgcagcagcagttctatcatggcttctgtaaacaacaattatggccactttttcattatatgcttccaatttgcctagacaagggtgagctatttgatcgcaacctatttcaagcctatgtccgagccaacaaactttttgcagataaagttatggaagcaatcaatacagatgatgattgtgtttgggtgcacgaggatcatctcatgctgctccctacattcttgaggaagaggttacaccgaataaaaattggtttcttccttcacagcccttttccctcctcagaaatctacaggactctgcctgtaagggatgaaatcctgaagtcactgcttaatgctgatctcattggtttccaaacatttgactatgctcgccacttcctatcttgctgtagcagattgctacgcctgcattatgagtcaaaacgtggttacattggaatagagtattttggccgaacagtcagtctgaagatcctttctgtgggtgtccatgttggtcgtcttgaatctgtcttacagttgcctgctacaatcagtaaggttcaagaaattgaacaaaggtataaaggcaagatactcatgttaggtgtagatgacatggacatcttcaagggaataagtctgaaattgcttggactggagcttcttctggat

SEQ ID NO: 10939 - DNA, 921 bp, Sorghum bicolor
  Clone ID: SORBI-28MAY03-CLUS6070_1
aagcacaaggacaaatgtgccaaaaaccaactgaatcgtgaaaaagttcagtttcagcagcgtactggatctcggtgttacattgcacaagcctatgtcgtgaagcaagaaaaatacaaagacattgagctcactgctgttgatctattcaaggagttgcattgcagcaaaactaaaggttttagtgaacctgtgaagaaagctatagatgatatgcatgcccaggaagcccttccttcagaatcagtagaagatgggcagcaagctaagacttcaatagaagttgtttccaaagtgctgccgaagtcaaatacattccttcgcaatgttggaattcagcagcctgctgccaagacaaccaatgtggtgaaagaactacaagctgaattggatgcaaagaagctagagtctataggacttcagcaggagcttgaaagattgaaggcacagacacaagaatctgaggcaaaagtggacaaacaagctgaggagattgagagcctgaggaagatggcagcagatacttagagcctcattcgacaaatgataacatttggacagggtcagatcagtccgccctaagcttcctgtatcctaaggaatttggtggctgatcctgaaatttgaggctaggatcccttttggtattggagcagcgctgcttgattgcgtggcgtggtggactttggtcttggtacttttgtgtatgagattttggttgttggaatagtgttggctggtggcaaattttgtggagtttggctgtgcttggaatattcggctatagtttggctctatgcatggagtgttaaatctgtatttgtaggttgttggaagcctggaatgtggctggatgtcttttgtgtatggaacatgtattctagattattatcaatggctgcaacatattctattgtatgg

SEQ ID NO: 10940 - DNA, 1293 bp, Sorghum bicolor
  Clone ID: SORBI-28MAY03-CLUS60755_1
gcacgaggcttaaaaaccgccaccacgacgacggcgcctcgtctcgtcggagaaaaccaccaccaagtccaacaacgcccgcaaccgcaaccgcaacagcaccaccgcgagcgagcgagattcggggggaggttctctcgtcttcgagcctgcggttgctcaactgaagcgaggaggaggaggaggagcagcagtagcaaacagagtcgtcgtcgcagatggatcggtaccacagggtggagaagccgcgggaggaggaggcccctatcggcgccaacgagatccgcatcacggcgcagggcccgccacgcaactacatcacctacgcgctcgccctgctccaggacaatgcaacagatgacattgtcatcaaggccatgggaagggcgatcaacaagacagttgtcattgtggagcttcttaagaggaggattgctggtctccatcagaatacctctattgaatccattaacataactgacacttgggagccattggaagaaggccttgtcactcttgagaccgttcgccatgtgtccttgatcactattaaattgtcaaagaaggagctggatacatcatccccaggttaccagccacccataccagctgaccaggtcaggccagcagctgagttcgatcaggatgcagaggctgtaccaagtggtcgtggaagaggacgtggtcgtcgaggcaggggcaggggaaggggaagagggttcagcaatgggggagtagactatcatgatgagtttggtgaaccagaggaggctccccgtgggtatggtggcagagggaggggtcgtggagggcgtggatcttttgcacctggaaggggctatggtggtgataattatgcgatggaagaagccggtggatatgatgatggatacaatgcaccacctatgcaaggatatgaaggtggcagaggaaggggcagaggtcggggccgtgggcgtggtcgtgggcgtggaagccaaggccagggacctccacagcagtagattggctggtgcatcaacgcggggatgccataattccacaagattaatgttaccgtccattgtaacttttatatctggttattaggtttatgttgaaagttgacatagtgactccagtgtgggggatgaggctagttatgatttttgtagctaggttattcgtccatttgcctatttattatctcaagatcggtgccgtttcaattgtgcattgtagcctccgttaaaacgtgttatctttaaagttagttcagaagattttttatgtggaacgtttgttttcaacttg

SEQ ID NO: 10941 - DNA, 1350 bp, Sorghum bicolor
  Clone ID: SORBI-28MAY03-CLUS6072_1
gtcaatcgtcgcccacactcgccctcacccacccggccacccgacctgcctgcaaaagtgccaactgccacccactgccgcgccgccgcgccatggcttccccgtccccctcctcgcccctccacccgcaccagcaccagcaccagcacccgccgcctccgaatcctcaccaccaattccaatccccaccaccttcgatgccaccgccgccgtcagcggcgctgcctaaggcgttcgacctggaggttactgtcgtctccgggaagcacctgaagaatgtcaactggcgccgtggcgacctccgtgcctacgccgtggtctacctcgacccctcccgccgcgccgccacccgccccgacgacggcggcgggtgcaaaccaacctggaacgagcgcctcgtcctcccgcttccgccccacctctccccgcacgacccctccatcctcctgtccctcgacgttttccactctaagccctccgattcgcccaagccgctcgtcggatccgcccgctctcctctccgcgaccttctctaccccgcgaaccctaaccctagccacgatcccgcagcctccgctctcgtcagcctgcctctcctccgcccttccggccgtccacagggaaagatccgcgtccgcgtcgccatccgcgagcgctcgccgcctcctcctgagccgcaataccctccgccttccagctccccatactactttccaccgcctcctcccgcctactcggccccgccgcagtacggatccgaccagtactatcgccccagtgggtactactctgcacctgcacctccaccacctcagtatgagtacactggagggccctctgcgccggtggactacaacaggcaatatgagcagagagggaggactgggggcggtggtagtggcagtgggaatggaaggtatggagtaggcactgggcttgcggtcggtgctgtggctggagctctcgggggtctagcaattgatgaagctgtgaagtataaggaggagaaggctgcagagcgggtggaagagaaggttgtacctgctgggagggatgattacagcgagtatcgtggtgactattgaatggaagtttgtgtgagtgtggcattaagaaagcactgtgagttgattcttcttccatgcctatgtgggaataaagtcacagtgttatagtctatggtttgctccatgtatgtatatatatttgtgatgttttggattattctgatacctataacctacaaggttttatgatgacagattttgtgtgtaacataaaggtctcacggtttgctttgatggtgtacttgtgtattgttgtcttgatgttgggtgtttcttttccagc

SEQ ID NO: 10942 - DNA, 1486 bp, Sorghum bicolor
  Clone ID: SORBI-28MAY03-CLUS60893_1
gcacggcgcgaggaagatttggaaagagcttacaagaacactaacatgaagcctatgagccattccacctacttgaggctacaagtcttgcgtgaaatattctgggacgttgatacaaaacttgaagttcttatgaagctgacatttactgatctagtagcatttgtaccgaagatcctttcccagttgcacgttgagggactttgtcatggtaacttgtcagaagacgaggcagttaatatatcaaaaatatttctcaacactctgtctgctccgacactgccggaggaagcaaggcattcagaaagagtaatgtgcatccctaatggtgcaaattttgttagaagtgtgcgcgtgaaaaatgatcttgaagaaaattctgttgttgaggtctatttcccaattgagcaagatgttggaaaggaggcaacaaggctcagagctattacagatctttttagcaacattattgaagaaccatgctttgatcagctaagaaccaaagagcaacttggttatactgtggactctagtccaaggatgacttaccggatgctggcctattgttttcaagttatgtcctccaaatatagccctatttatctgcaaagtcggattgacaacttcattgatggtctatctgatctgctggacgggctcaatgaagagacttttgagcaccatagaagtggtttaatagctgataaactggaaaaggaaccttccctcagctaccaaactaatgattattggtctcagattgctgataaaaggtacatgtttgatatggcaaaactggaagctgaagagcttaagacagttcacaaggctgatgttatagcttggtacaacacatacataagatcatcagctccgaagagaagacgactagcaattcatgtgtatggttgcaactcggatattactgaggctgctaaactccaggagcaatcttggattataattgatgacattgaatcattgaaggcttcgtctcaattttattcaagcctctgctgagggaaggagggaatgatctgacggtgcgaaattgttatgccttcagatgaacatctgcaaagcccagatttgtagaacgtgaatggcactcggacattgccgaggcctgccaaggtgcaagaacaggcccctttgcaaatcaaccaccatattatctatgggtggtgttcgtgaaattgatcagtgtcgttgcacctgacctgttcatattgaatgggtataatgccattatttcatagttgggtaagagaaataggattttgtcagtgcattatgtgatttttcataacaaacacatatgggttttattttgcgccaaaaaactgttgatcttccaatttggcgttgtaattgctggatacataagatagctcatttttttgaggaaacaaaattctgtacttttccttgtaaaaggtggattctatactgaacatttttgagaactagtctcgagggggggccc

SEQ ID NO: 10943 - DNA, 1515 bp, Sorghum bicolor
  Clone ID: SORBI-28MAY03-CLUS56927_1
gcacgaggcacatccctcgtcgcccgaactcttcctcctaccctcgcggctgcggagcctgctcttcgttctcgccgccgcctagactggagcaagaaccagaggtcatccggacacagagactcctttctcggaagcatctcctgaaactgatgtagaacagaggatctgcctccagtcattgtacgccgacatttcatcttgttcatttgatgccatctctctgaaataaactgagtcaacagatcaagatgacagagccatcttcatcatattcattgccttctaagaagcgacaacgctctcctgatgataatgaacattcactagacagagatcaaacttgttcaagccttgttttcccgatgcagaggataatcttacattcaatgataccatgatagctcttcaattgatgcgcacacagtttccaaagctggataaggttgtggcgcagccattcattttgcagtcacaattgtatagcagcgtgaaggatagaacacaagttgacagagacttggagtcattcaagaatgacagagtgttacgaatattcaaacttagttctgggcaggatgatcatgcaatcatgttcatggatgattatttgaaacaggtcgcttttgctattaaacggtcagggggtaaagaccaagacggtaatgaagtatttgagtggtttgagagatatgtggtcccttcaaaactggatgttagcataaatcaattagatctgtgctcactgttatcacggggtggtgatgtaacagacaaacatatcacactgttgatgaatgctggtctcttaactcgccaacttattgatccaaatatttactggttttctattccaagaattggccccatattgaaaggcctatcccagggcaggaaagaaattctttcgctgttgaaccgtagaaagtacaaggagatgctgctctcttcactggagaatacaaagttaagattatcatctcttgatacgcggttcctccttcgcgatttgattggatctgggcacataaaaacagttcaaacacccactggtttgcttgctcgcatatcaagagattgatgagctcactgttgtaattctatttatctgtctgccttatctgatcttgcatgacttgatgattctagttttattttgcattttacctgttctcaacgtcttccagaaaaaggcagaattgagctagtcgtacaacaaaagcagtatttttgggttcaggaaatctgtagtattgcttcatgtactttcaaagacttaggccattggcaatcctttttcttaagcataaaaaaaatcttaggataaatggtgaaattacctaaaacaacttgtttagtggcaaatagactcctgaccgacaacccatttgggtaatgttattttctaaatttatgttgaggattagtgacagtatataagagacaacaccgatatacatgtcctcatgtcatgctattgtatgtatcaattgcataaattaattaacagacatc

SEQ ID NO: 10944 - DNA, 866 bp, Sorghum bicolor
  Clone ID: SORBI-28MAY03-CLUS57026_1
gcacgaggatcattaccacatcaggtttgctagcgaataagatgggaaatgcacgagggtggaaagagtattgtgagtctattggttcggggcttggaagcaatcctgatatggaaaatatgaggaagatattatctcttagctattatgatctaccagctcacttgaagacatgcttattatatctaagtgtatttccagaagactatgagattgttaaggatcgattgatttggaggtggatagcggaagactttgtcccacctggagaaggggggcaaagttcatttgagcttgggttgagttacttcaatgatcttgtaaatagaagcctgatccaaccagcagatatggatgacgaaggtacgcctatttcttgccgtgtgcatgacatggtgcttgatctcatttgtaacatatcaagagaagaaagttttgttgcaacagtactagatgatgccaggcagaacacaccttcttggggaagcaaggttcacaggatgtccctgcacaatactacttggcctacagtaatggacttgtcaaaactaaggtcacttactgtttttagtgctgccaaaattaaattgatgccgtccctttcatatcttcatcttctccgtgtattggatctagaaggttgcagtcttaaggaacttacaaacttgagtttcgttgcacgcttatttcacctgaggtatctaagtctaagaaatactagctatgctggtgagcccccatcggagatagggaagctaaaacttttgcagacattagacctatggggaactgatatagaagaattgccatcaagtattattgggctaagaagactgatgtttctggctcttaattggcgtatctgt

SEQ ID NO: 10945 - DNA, 1225 bp, Sorghum bicolor
  unsure (1)..(1225): unsure at all n locations
  Clone ID: SORBI-28MAY03-CLUS57177_1
atcccattcccacgcagctgctgcaaaatggggagaaacggggtttaagcgagtagtcgaggaaggagaggttctcctcacttccacctcggctcgctggagccgataaggctgccgcgccctccctccctccccctcgctcctgctccccatggagtcggcggcgattgggtcgcagtccccgctctccttcccctccagcctctgcaaagcaaaagtgtcctctggtttaccaatatacaatgtgaagatcaagagcaatcacaggcttgaggtggtttgccgtgggatgttagctacaagaaagtttatgcaaaggaaaaagaaagaagaagttttcaaggatgctgctgatgaggccgagcagatgaattggaggagaatgatgagagagatagaggaggcaggatcagctgtacccatgctcgaggctcagcggagcgggaaagggccacttccaagagatgttatccttgggactctcgtgcggttcaaacaactgaaaaaatggaatattgtcagtgagattcttgaatggctcagaacacagcattggtgggacttcagtgagatggacttcttgatgcttgtgacagcttatggaaagttgggggattttagcagggcagaaagggtcctaaagtacatgaacaagaaaggttaccagcctagcgtcatatcacaaactggtctgatggaggcatatggaagagggaagcagtaccgtaaggctgaagcagtattccgtaggatgcaaacatcaggccctgaaccatcacctgtgacatatcaaatcatcttgaaatctttagttgagggtgacaaatataaggaagctgaagctatatttgaggacctccttaatgaaaaaagaacttcttttaagccagaccagaagatgtttcatatgatgatttatatgtacaagaaagctggtgactatgcccaggcacggaagctatttgcacagatgtcggagagaaaaattccactatctacagtcacttttaatagtttgatgtcatttgagacagactacaaggaagtttcaagtatttatgatcagatgcaaagagctggaatgaaaccagatgttgtgagctattccctgctcatcaaagcttatgggaaagccagaagggaagaagaagcattggcggtttttgaagagatgcttgatgctggagtcaggccgacacgcanatcatataacattttgcttgat

SEQ ID NO: 10946 - DNA, 740 bp, Sorghum bicolor
  Clone ID: SORBI-28MAY03-CLUS57394_1
aaaacaagcacccctctcctccccgcgctgcaacatctgcaccgcgaaaaccaacacctctcggcttcacttcacttcgacacgtgcgaggagaaaatgcgcgcgacgatcccggccctctcgctcctggtggcgccgcgcccgcggctcccctcgctcgccgcgccggcggctggaggccgcgtccgcgtgggccgtcgtcctcggacccgcctacgcgtggcggcgccgacgtccgtcccgggggaggcggcggagcaggcggagccgagcacgtcggcgcccgagtccgagtccggcgagaagttctcgtggaaggatcactggtacccggtctccctcgtcgaggacctcgaccccagccgccccaccccgttccagctcctcaaccgcgacctcgtcatctggaaggaacccaagtccggcgagtgggtcgcgctcgacgaccgctgcccccaccgccttgccccgctctcggagggcaggatcgatgagacggggtgcttgcagtgctcgtatcacggctggtcattcgatggctccggcgcctgcaccaggatcccccaggccatgcccgagggtcttgaggcccgggcggtgcgttcgccgaaggcgtgcgcgatcaagttccccaccctcgtctcccagggcttgctgttcgtgtggcccgatgagaatgggtgggagaaagccactgccaccaagcctccaatgttgccgaaagagtttgacgacccggc

SEQ ID NO: 10947 - DNA, 849 bp, Sorghum bicolor
  Clone ID: SORBI-28MAY03-CLUS58114_1
gcccgtggttagccctctgcgacctgcctaggcccagggccttgctgttgtcttgtacctagagccagtccatgatcgctgtcctgggggactctcttcgtgtttggttctcttcgtgtgggtcggcgttccgccgtctcccctgtttacgggtgcttgtctcccccctctctctaggtgaagtgtgattgaaatttctcaaaatcttggatttctggttgaggagcgcccaagcacgttagttgataacttgggggctgatgtagtcttttgtcctggaacagctgttctagtgtcgcctgttgggagcttcacccaccgtggaagaagagtggagtatgggaagaaccaggaggccggagccgtgtttcagcaactttacgccgcattcacagctatccagaaaggtgtcacggaggacagaatgggatggacgttgcagctagcttagcagctttctatcacatgatgattgagctctacaactcttattatttccgtttcctcaacaagtcccaattctaccaacagccatttgtcgtgcagctcgcgcgcacatcatatcattgccctgggagcagaggcattgggcacactgttagtgtgtaaataaagtggatgtatcttacctgtgtggccgtgtcccaaaccatgatattcctttccataaacattgtgcacccttttggtggtgttcagtaagcaaactggaaaacgtcctatgcatactatcctcaatagttaccactctattgagatgtctacaattattacataaattagctatcaagttcagaatttctacaaaatgcatagatggtattagagctgtcatcactttttcctggc

SEQ ID NO: 10948 - DNA, 751 bp, Sorghum bicolor
  Clone ID: SORBI-28MAY03-CLUS6185_1
cgaagtttcttgatggaatgcaggatcattacacctttgcgcaaccaggaattcagcgccttgtttttagattgaaggaactagttcgtcgtatagatgagcctgtatccaagcacattgaagaacaaggattagagtttcttcaatttgccttccgttggttcaactgccttatgatacgagaggtaccttttcatcttgtaacacgtctgtgggatacataccttgctgaaggagactatctaccagattttcttgtgtacatatcggctagttttttgttgacttggtcggacaagctgcagaagctggattttcaagagatggtgatgttccttcagcaccttcccacaaggacctgggcgcaccatgagctcgagatggtcctctccagggcgtacatgtggcacacaatgttcaaaagctctcccagccaccttgccagctaggactcacccagtgcatcatgcctgtaagcagcagtctgttctgttttttgtgaagccgtgtgcatactatcggttgcgccgcaccgatttgtatattttttttcctaccgaggaatcatgatctataatgaacaccaaaggacaaatactagtgctcaatttgatacccggactgccagttgtattgtttgtccgccgcttggtggcgcaaggcatcactcaagagtcaagatccccttcccattgtagcctatacacaatgcctttttccaactatatgagatgcttgttccctgttttgg

SEQ ID NO: 10949 - DNA, 719 bp, Sorghum bicolor
  Clone ID: SORBI-28MAY03-CLUS62290_1
cagtcccacaggttgatcgtcaggggccgctgggctgccggaacactgcagtgcccaatatttcaaggccatgggaaaaacctcaagtatctagctctaagttggtctggtcttcatgaagacccgctactgcttattgctccacatgtaccaaacctcacctatctgagtcttaacagggtgagcagcacagagacaatggttatttctgaagggtcctttccacagctgaagacactaatactgaagaacatgctcaatgtcaaccagttgacagttgggaaggatgctctcccaaatattgaaggtttatatcttgtggcgctaccgaaactgaataaggttcctcaaggatttgaatcccttgtgtctttaaggaagctgtggttactgtctctgcataaggatttcaaattcctttgggagctaagtagaatgcaccagaagatgccacatgtggtggaggttcgcgtcgagtgatcgcctgcttcttcatgcaacaatacttttgaatatttatgcgtatagtcctttgtctttgattcttccagtagatctgcaattctgaatgattttgtggcttgtgtttttcttttcaataagtccggaagaaacagatctcctcaccaagaatgtgcctgatagttgtgttgtgtgtatgccatgttattgtggtttctttgtagtttgaacttcttcatagtgaacggatgacgact

SEQ ID NO: 10950 - DNA, 676 bp, Sorghum bicolor
  Clone ID: SORBI-28MAY03-CLUS62397_1
catgcccgtttcccttgcattcagaggagtgcccttactcgtatacccgccaatgcaaccatgatggaccactatttgtcatcctcctggagcatgacaagatgtctgtccaagaattcccggcaaactcaactgtaatggatctcatggaccgtgtgggcgccaacagctcaagatggagcccctacagcattcccgtgaaggaagatctgcggccgagggtgaaccacgagcccatatgcgacccaaaccggaagctcagcatgggggacgtggtggagctgacgccggcccttcctcgcaagtccctcagcgggtaccgggaagagatccagcgcatgtatgaccgtggtggctttgcgctctcaacccggggtggcggctcgagacgctgctgacagtagtagcaagacgatgttaaccctttttttctaccattgtactaccattcaattcgttgtaaatatatatagcagttaggtcttgcagccgggtgggttctggcgaaatctgttgttggcctgggtgcgtgttgctgcaccctgtcctgaaccccagaggctgggctgcatgcaatgtgtaaaattagaacgctggtgtaaataagctgttcaagttcgtttcagcttctcccaagatttttggagaaagaaagagctgtagctggatctgcaat

SEQ ID NO: 10951 - DNA, 1121 bp, Sorghum bicolor
  Clone ID: SORBI-28MAY03-CLUS61912_1
ttcggcacgaggatgtggacatgcaaaagataccagttcgatttgctatcacaaatgctggtctggtgggatctgagggcccaactaactcaggaccatttgatattacattcatgtcatgcttgccaaacatgattgtcatgtcaccatctaatgaggatgaacttattgacatggtggcaacagctgcaatgattgaggacaaacctatttgcttccgctatcctaggggtgccattgttgggactagtggaactttaacatatgggaatccgcttgagattggtaaaggagagattcttgtcgagggaaaagagatagcttttcttggctatggcgaggtggtccagagatgcttgattgctcgatctcttttgtctaactttggcattcaggcgacagttgcaaatgcgagattttgcaagccacttgacatcgatctaatcagaacgctatgtcagcagcacagttttcttatcacagttgaagaaggaacagttggtggctttggatcacatgtctctcagtttatttcacttgatggtctacttgatggccgaataaagtggagacccattgtgctaccagacaggtacattgaacacgcttcactggcggagcaacttgacttggctggcctaactgcccatcacatagctgcaactgcattgaccctcctagggcgtcatcgtgatgcacttctgttgatgaagtaggggaaggaactgccaagaagaacggatagataaaggcaatttctgcaaaagttccatacggagaccacttgtcatgctgttccattcacgattgtgttttctggatagaactgaagtgtgccatgggaggtggccaaatgcacaatcccgaagagggacggcgaagcctatagcattatagtgacggtgtacatactataaacactattttgatgatgattaggtgaccctgaaaagaatttacagagcggtgctgtaacgttactactgtgcatgttaatactgaaattctggtacgatgccaactggtgagatgagctggagctgccatgtatcagttcatgtaataaggctactgagttttgtatgtaccaattccactcttaaatgaaatgaaataagtgt

SEQ ID NO: 10952 - DNA, 948 bp, Sorghum bicolor
  Clone ID: SORBI-28MAY03-CLUS59526_1
gcacgaggatcaagtcggactctgcacgcgcttccaaggtattagctgctccatcacggcagcgatagtcaagttctgttctactggaggaagaagagcagggaagggagcaagatggggtccggatctttcctcaaggtgctggctaacaacttcgatgtcctagcagggccactcatatcacttgcatatcctctatatgcttctgttagagcaatagagaccaaaaatcctgtagatgaccagcagtggctcacttactgggtgttgtactcatttatcactttgtttgagctaacttttgctccaattatcgagtggcttccattttggtcatatgcaaagttgttctttaactgctggttggtcttaccttggttcaatggtgctgcttatgtttacgaccattttgtgcggccaacgtttgtgaaccgccaaatagtgaacatatggtatgttccaaggaatgagaagctaggtaaatctgatgatgttctgtcagctgcagagagatatattgagcaaaatggaccggaagcatttgagaagctcatcagcaagtctacaaagtcttcaaaatcaaggaacacaaagcggtcgatcttggaggaggcagaggctgaaaacagagctaaggctgaaagagaatcgtgggatgaaaatcccttctacgacaaaaattacagatactaaaccacgtccactcggcagcttgaagacggaccttgcttatgagccccatgcgagctttagccgcgtcacagactgaagacgactttcccatatttctgactcagtactgtaccttgttacatccactgctactaaacaatgagttatagagcaattgtggactgtaaatggaggtagttgctagcgatgattatttatgtgagcttttgtatattatatacagtggagtagtggactgcgttcatctcttgcgtt

SEQ ID NO: 10953 - DNA, 942 bp, Sorghum bicolor
  Clone ID: SORBI-28MAY03-CLUS59695_1
gcacgaggggcttctgccaccatctcgccgggggccccggcgtggtccttgcctgcgggctgccggggtcttcacccgctccccctggtgccgcacccccccgcgggggtcttcgtgctgttggcgtccccgacggatccggcggtgttttcggctgcgttgattgctgcgctggcgcttggcagggtgctgggacctcctggtctctcgctcaagctcccctccgccctttccagccttattccaccagttgtagaggaaggtttctggtaccatcatgcagaggaaacttacttgatgcttgcatactggcttccaaatacaacacatacactaccagtaaacgcaacccaccgcgttggtgttggagcttttataatgaatgacaaaagagaggtcttggttgtacaagaaaagagtggtgtacttcgaggcctaggtgtgtggaaatttccaactggcgtagttgaaccgatattggtatactctgggggaagatattaatgttgcagctgtaagagaagtaaaagaagagacagggattgatgcagaatttgttgaagtgctggccttcaggcagagccacaaatctttttttgataaatcagatctatttttcgtgtgcctgctacgaccactttcatatgacattacaaagcaagactcggaaatagaggcatgccagtggatgccaatagaggaatttgcggcgcaaccatttgtccagaaacatgagcttgtgaagtacatcctcgaagtaggcctggctaaagttgacaaggaatatgcagggttttcgccaatctccataaaatcagcatttacagacaaattgtccttattttacatgaaccggagggacctggacagggcctcaggatagagtaatatgtaatgacacagggaattcagagatagttgaaattttctctttggtgtggg

SEQ ID NO: 10954 - DNA, 1240 bp, Sorghum bicolor
  unsure (1)..(1240): unsure at all n locations
  Clone ID: SORBI-28MAY03-CLUS59700_1
cttcccaagctgagctcacacgttccctgccgctcgctctctctatccctccacacacatcccaattcgtctccccccattgccattgccatctccctctttccacttgctgcaggtcccctccgctctgaacaatcgccgccgccatttctccagttgtatttaatttcctcgtcctgtatcttccacggagacccacccgggatcccagaaaagttgcgccctttgcacgtctcccagccccgaccgagaccgcaagaacgccttcaattcaatccgtgatttccgagaaccaaaagccgaccttccaatcttccttggatacttttccgttcttgggaaggaactgcacagttgccttcacctggtggtgccgacaagcaatggggaggaagtgccacgccgcggtcgcgatagccgtcgcgttcgcggcagcggccgcggtcgccgtcgctgccgaccggaggctgtcgctggttcgcgccgcggtggcgccggaggaggagatgagcctgttccggaaggtggccaatctgatgtggaagagcgacggcaactcgtaccagcacgtgtggccgacaatggaacttggatggcaaattgtgctgggctcgctgatcggattcttcggtgcggcattcgggagcgttggcggagttggtggcggtgggatctttgtgccgatgctgacactcatcattgggtttgacccaaaatcatctactgcgatatcaaagtgtatgattatgggagcgtctgtttcaactgtttactataatctcaagctaaaacatccgactttggacatgccggtgattgattatgacctagccgtgctcattcagcctatgctaatgcttgggatcagcattggtgttatttttaatgtcatatttcctgactggctggtcacagttctcctgataattcttttcctaggcacatccacaaaagcctttctgaagggcattgagacatggaagagagagacaataatccaaagggaggctgcgaaacgtttggagcaaattgcaggtgaggaagcagagtatgcaccacttcctactggaccaggtgcggcagcaaacaaaaaaaccctctcatcagatgaagcgccatcacttataaagaacattcactggaaggaggttggtcttctctcatttgtgtgggtggcattccttgttcttcaggtcacaaagaattacactgctacttgctccccatggtactgngtctt

SEQ ID NO: 10955 - DNA, 1168 bp, Sorghum bicolor
  Clone ID: SORBI-28MAY03-CLUS6015_1
gcacgaggctgcataggagcacacctctccctccctccgcctccatctccttcgccaccagaccccaagcgctgcccccacacgccgccgcacgcgcacgggagccgcgcgccgcacccgccgccgcgcctccccccaaaaccctaggtctccccactcccccgatccagccctcccatggccgcgccgcagcctgccgcccccgcccccgaggcgccgccgtctgcgcaagtggtgggcaacgcgttcgtgcagcagtactacctcgtgctgcaccagtcgccggatctggtgtaccgcttctaccaggacgccagccgcctcgcccgccccgcatccgccgccggagccgccggcatggactccgtcaccaccatggaggcgatcagcgagaagataatggagatggacgtgtcgaaagcggagatcaggacggtggactcgcaggagtcgctaggcggcggcgtcactgtgctcgtcactggccacctcaccggtcgtgatggagtgcgccgcgagttctcgcagtccttcttcctcgcgccgcaggagaagggctacttcgtgctcaacgacatcttccgcttcgtcggggacatccctgcccctaccgccgttgaggcgcagccggaggcggatgctgtagtcccgcctgtggctgctccacttgccaacggcacagctactcctgctgtggagcctgccattcctgatgatcatgatgctgtgccacagcaggaaaatcatgttgtggaccgatcaccgcctcaacctgaggaggatgaggctgaggtttacaatccgccaccagaggaagtagtggatgaggaacaacctgttcctgaagtgataaatgaagttccaaacaatgtggcacctgtggcggctactacagttgccccagttttgcaggaggaggcaccaaagaagtcatatgcctcaattgtcaaagtcatgaaagaagttccattgcctgctcctgcacctcctactaggcctgcaccgcccaaaccagagaagcagtctccacctgctcctactcctgtcacagatgtaccgcctttcagttctaaccctgacaacagcaatatccaagagcctgaagttgatgctcatgcaatatatgtgaggaatttacctttaaatgccactgagactcaactggagg

SEQ ID NO: 10956 - DNA, 975 bp, Sorghum bicolor
  Clone ID: SORBI-28MAY03-CLUS60291_1
attcgatgactccatcttcatcttcacgccgcccgcgcgcccggcgcccgcaagctccccaccgcgaaattagggggaccgcagtgcctgaagcctaacccagttcctaaccgccgccatgatgacgtctagactcaagctcctcgctcttcctatcctgctggtcctcctcatcctcttcgccgcccggccccgcgtcctcccggaggcggtcctccgcgccccggtcctcccgggcgacctcctcccgctcctgccctggtccgtggcgcagccgctgctccgccgcctcgcgctgcggggccccgccgacctgctcccggccttcgtcggcgccgcgcgcccgcaggcgcccgacgacgcccacccgctcgcggagtggaagggcgcttgcttctacgagaacagggcatgggtggagttccgcaacgggaccgacgggggcctcggaggcggcatagtccatgtggagacatccaaagcacacagctggacttgcatagatctgtatgtatttgcaacaccgtacagagttacatgggattattactttttggggcgagagcacactcttgatttcgaagaatgggaaagcgaggccgagtatgaatatgtgaaacgtaatggtgtgtccattttcctcatgccatctggaacaattgggacacttcgagcactttgggaggtcttccctctgttcacaaatactgcatggggtgagaatgcgaatcttgcttttctcaagaagcatatgggtgccacctttgaggaacgaccgaaaccttgggtctcagagttaaatcctgatgatatccactctggagatttcttggttttatcaaagattcgtgggcgctggggtggttttgaaacactggagaagtgggttactggtgcttatgcaggccatactgcggtttgccttagggactctgatggaaagctttgggttggggaatctggtaatgaaaatga

SEQ ID NO: 10957 - DNA, 1019 bp, Sorghum bicolor
  Clone ID: SORBI-28MAY03-CLUS7570_1
gcacgaggctctcgagtctcgagtctcggcgacgacgaaacgaacacacctagtcgagtcagcgatgagccccttcgcgaagaaaccaactccgcgagaggtgatgcggagcagcaagcgggacctgacgaatgctacgcgagggatcgagagggacattgcgtcattacagcaagaggagaagaaactcgttgctgaaattaaaaggacagcaaaaactggcaatgaggcagcaacaaaaattctagcccgtcagctgatcaggttaaggcagcagatttctaatttgcaaggtagccgagctcagattcgggggattgcgacacatactcaggcaatgcatgccaacacttctgtggctactggtttacaaagtgcaagcaaagcaatgggagctttgaataagcaaatggaacctaccaagcagatgaaaataatgaaagaattccaaaagcagtcagcacaaatggatatgactaatgagatgatgtctgattcaattgatgatgtcttagatgatgaccaggccgaggaagaaactgaagaacttgctaatcaggttctggatgagattggtgtagacattgcctcacagttgtcatcggctcccaaaggaaaaattgctggaaagaaggttcaggttgatgaaagttcggagttggaggaactagagaagagactggctgctctcaaaaatccataagatctgtttgcaatcctctctctgtgcacatagcaagcctgccgtgtacctagattccaaacattcattagacacgcaaagtcactgctatttgtatatatcaaacggaagatggtgcaaaccccaagtttttcggccaatcgatgttgctgcagtccgtacacactatcgcgcagaagatggggctgtgctaccttgttagtgacatgattcagagcaagggattccatagtttgtaaagaaattcgactattttacctgaaagccttttgtttttggtcgttcgttacatgacagcgtttggtttttgagccat

SEQ ID NO: 10958 - DNA, 627 bp, Sorghum bicolor
  Clone ID: SORBI-28MAY03-CLUS62781_1
agacagcgttgcgcccggcctggaggcatttgtacatgacccattaatcaattggcgtctgttcaatttcaatgaggttcctcaagtgtcaaactatggtaatgctcatgctcacacggttgtcagtagtgaagacgcagtggctaatcgagaactcatgcaacctcagcgaggagcacgtgagagggaactgctacaggccgtcaatcaacttggtgatgctaatgaagttctgaatgagcgtgctgtagctgtgatggcacggatgagtgacaagctaacagggcgtgacttctcttctgggtcagctttggctggagcaggtagctcgacccaacatggcagtgagcacttggcttcaggagatgcccgggatgcgcaacctgctctctcggtgaaggttcaggttcagaagctcatactccaagccacctcgcacgaaaatttgtgccaaaactatgtcgggtggtgtccgttctggtgagcgctcttggaaacagtagcagctagcatgtaaatattgtgaataccgtgtacatagaggtttcgtggtgacagtttgtagctaatctgtgtagtgctgtaattagtagaacctcattcgttaataaaaagttgccttagccc

SEQ ID NO: 10959 - DNA, 677 bp, Sorghum bicolor
  Clone ID: SORBI-28MAY03-CLUS63136_1
tggatatatgatcttggccggaagaggaattttgctcaggtttttggaaatgacaaaaaatattggttcatccctgcatactcagaagaggatttgagaagaattccagctctacagggtcttgattatcctgtgagaccagattttgatggtcaggaactgtaatggagcaattttgccagtgtcctcgtcagatacctcagtgttcgacatctactgatataactgacagcatcgctgattgcgctatgcaaggcatcaaatgaaatgttcagaagatgattttagtaaccatgagtgattcatttgttgcacttcatgtatgtgacgaagtggaattcttcctacaggaagtttgttgtgatgtaaattagttttggcgcctgcttggatggaccaaatcttgacgtaatccacacggatgcgccagggttttggacttaattcttggtccatccacgtggattgggatgggtttcattccatccaaactgggcattagtgtgtatcaaatagtcttgtacttcagtttagttatgcaatacaaatacaatttgagataatttgtgccgcttttatacactactatcaatagtaaatggataagcgttgtgtaattcataagaccttgtacaagtacaacgtgttctttacattgcccaagtacgtttctatct

SEQ ID NO: 10960 - DNA, 646 bp, Sorghum bicolor
  Clone ID: SORBI-28MAY03-CLUS6336_1
gcacgagggtataaagctacagatttgggatacagcgggccaagaacgcttccggactattaccactgcgtactaccgaggagctatgggcattttgctggtttatgatgtcaccgatgaatcttctttcaacaacatccgaaactggattcggaacattgaacaacatgcctctgataatgtcaacaaaatcttggttggcaacaaggccgatatggatgaaagcaagagggccgtacctactgcaaaaggacaagcacttgctgatgagtatgggatcaagttttttgaaacgagtgccaagacaaacctgaatgtggagcaagtgtttttctccatcgcacgtgacatcaagcagaggcttgcagagactgattcaaagccagaggacaaggcaatcaaaattaacaagccagaccagggttccgaggcaccagctgcccagcgatctgcctgctgcggctcataagcagatgcgagatggccataatgattggttatttgacattatttatttcccgcttggctgttataggaagaatttgaagaagccacttatgatatactgatgtggttgtactcgtgtttgcttccattatttgaagcaaccacctcctgctgttgacgtagatgttgttattgctgg

SEQ ID NO: 10961 - DNA, 1302 bp, Sorghum bicolor
  Clone ID: SORBI-28MAY03-CLUS6348_1
gcacgaggctcttcactgtttcaagttatactgcttctgccattcgtgatacaaaccttctgagcatatttgaagaggaaataaaagatacaagagatatgcttaaaaccctcagtgcgctggaggtcttatatgagcttgttgaacaccctcacagcaacattttcttgctgaagaccaacttgcttcaactcatagttgatatcatcaatgattcatcagctgattctgttatacggtcaagggcagcattaattagtgggaggcttctttcttcagctgatgctttcacagcaattgataaatcctgcgttaccaatctgcttgtagccatagacaaaattttgaagatggaagaaagccagaatactgatgaaattgagagtgcattggagaccttgggtctaattggtacaacaagtcaaggagcacatttcttgctgacatcatcaaatgttgccagacatgttgtcaagtcatcctttgaccgacaaggcagaggtagacagctggctgctttacatgcctttgggagcatatgtggtatggatagacaagaagaccagatgaaacttgatgacgaagccgaaggaaacttgaagcgcttggtctatacaactgcagcaaacagtccaaaattaaccccttcagctgctcttctgtcaattctgcaacaagacccggacattaggatagctggttacagagtaatatcaggactggtcatccgggaatggtgcttaagggaggtttgcttaaattcagagataatcagatttgttacagacccaacaatggagacaacaaaacttggcatggaagcccggtataactgctgtgtggcaattaacaaggccctatcatcatcccatcttctgcatgaagcaagtctttctggactcattgggaagttgaatgatgccgtgaaacggggcccttacctttctgaaaggaagcgtgtggaggcacggccggttgttgatactgcagagaggttttaagctagccagaggttttaagctagccttgagccttcacccaaagtaaacgatgactctcacagcgtagttaggaggtaactgggcgtgccctgcgtctcatgctgttggcttatgaatatcagacatacatatggtgtacttggatgatggggaggacaatgtgtacttgagctcataccgtttcttctggtttgctttgtggatgtctgatgcagcccatacctgcaaaacaaactcatcggttgcaggaccatgccaaattttgggggaaataacagatgcaaccagaactatttctctc

SEQ ID NO: 10962 - DNA, 1159 bp, Sorghum bicolor
  Clone ID: SORBI-28MAY03-CLUS6358_1
gcacgaggccccgactctgcttcgtttccacgcgcacgaaaccctagactagataaaaattcccctcccctcgtcgcaatccctcctcgccgcctccggagccaccgtgagatctgcccggttccgccgcccggaccctaggggactccctcccctccttgatccgttcgggcggccggccggccctccttcaaaaccggggatggtgttctacttcaaggtgcggcccgaggccggcgattacaccatcttcatgggccttgacaagtacgagaacgaggacctcatcaaatacggcttccccgaggacatctggtttcatgtagataagatgtcctctgcacatgtatatgtgagattgaataaaggtcaaacaatggatgacatgagtgagggtttgctggaagactgtgcacagcttgtcaaagctaattccattcaaggtaataaagtcaataacattgatgtagtttatactccatggtacaatttaaagaagaccccttcaatggatgtgggtcaagttggttttcacaaccctaaattggttcgcactattaaagtagaaaagaggatcaatgagattgtgaaccgcctgaataagacaaaggtggaacggaaacctgacttgaaggccgaaagagaggctgttagtgctgctgaaaaggcagaaagaaaggcacagcttagagacaagaaacgtagggaagagatggaaaggcttgagaaagagaagcaggctgatatcaggagctacaagggtctaatggtccaagagaagatgacttccaacaagcaaatcgcctctggtagcaagaccctgcaagaacttgaagaagactttatgtgagagggcggacatgataaatgtcacgctgaagatttccttgaactgcttttgtcgaagacagaaggggtatcacaggcttgcgagatactggatctaaacgactcatggggcaggccatggcctgttattgtctcctcttgctgttgtggtctatgtaaacctgtttacttgctgaaaaaacaacagtgcatgctctaactgtggctgatgtagtggtctgttgttcatcaagttgaaatggtaatggagttctgctttcctggatttttggaacaataaatacatggcagcagttatcgtggatattcc

SEQ ID NO: 10963 - DNA, 814 bp, Sorghum bicolor
  Clone ID: SORBI-28MAY03-CLUS64101_1
cttcattatggggccactgttcttggagcttggcatccctccccaggtttcaagtgctacggctacctttgcaatgatgttctcatcttccatgtcggttgtcgaatactacctcttgaaccggtttccagtgccttatgctgtttatttcaccattgtggcgtttgctgctgccctcatcggccagcacgcggtgaggaagttgatcaactggttagggcgggcatcgcttatcatcttcatactggccttcatgatctttgtcagcgcgctttctcttggtggggttggcatctctaacatggttcacaagattgcacgacatgagtacatggggtttgagaacctttgcaagtacgatgcataggaagcaggaaggttgaagatgtgagttatgtagtgtgcagttctccgcaagcagaagtgggacataattcaaggatcaaaaggtttccatgattcgattttggtgcataggactgaagagattctagctgcgacagctccgaagggaggctagctgcatagattggtttcagatgaattttggagcatgttttcggtggtctctagtttccagtttaagtcaactaaaccaagtgtcatcactttgtatgtattttcctaacaaatgtagagatgacattctgccacggcagaatgtcgtcagtgcatttcgtggtaggaaatgtacattgcacatcttcagataaccatcctgcaatatgaaaccttcagaaatctgtgtttctatgctcactataagcacaatatcacatgataagcatgaggtgagtgactcttatggattttt

SEQ ID NO: 10964 - DNA, 729 bp, Sorghum bicolor
  Clone ID: SORBI-28MAY03-CLUS107960_1
aacaagcgcgcgcggtggcgatccaagcagctcgagcacgactacgccgcgctccgggcgcggtacgacgcgctccacgcccgcgtcgactcgctcagggaggagaagctcgcgctcgccaagcaggtggatgagctgagggggaggctgcagagcgtcagcgagcggcaagaccagagcggcagctgcgaggtcaacgacgccgcggacgacggcaagaggaacctaaatagcaccaccaccacctgcctggtgctggtgcaggaggacgatggtgccacgccgccggccgcagtagacgcctccggctccgaggactcggcggcgaccgagtacggctacggctacgactacgaccacgtcgtcgcgtacggcgagggcctgcacgatcccttgtgcgccactccggacctgtgggatacatggccgctgctggagtggaacgcggtggcatgaacccacgaccacgagcgaggaagaagcagcagtcgtgtactcgatcatctctcatgtctcttcttctgtatcgtcacagtgtacgtgtacgtgtacgtgtggtggattcatggtgattcagttgatccgtggagagattgactgacgggaaacagatagagatagagctagctgtgtattgatcaggaatcagctggagggggatcgatggatggaccatgaaagcttcatcacgcattgtacaccagggctcgagcgaggggacgatcgtcc

SEQ ID NO: 10965 - DNA, 840 bp, Sorghum bicolor
  Clone ID: SORBI-28MAY03-CLUS10727_1
gccggccgggccgggacctctgcggtacgtgatggagctacttttcttcccctcttctcgcctgctcccgtgcccccctttctatcccgcggcgccgactcgactccacgagagccgccgactcccaacgcctgctgcccccggtctccgtcgggctctccgccggcaacgagcgtccaccaggaggcgggcggccatggccaccttcgagctgtaccggaggtccaccatcggcatgtgcctcaccgagacgctggacgagatggtctccagcggcaccctcagcccggagctcgcaatccaggtcctcgtccagttcgacaagtccatgacggatgctctggagaaccaagttaagagcaaggttaacatcaagggccatctgcacacctacaggttctgtgacaatgtgtggaccttcatcttgacagatgcaagtttcaagaacgaggagaccacagagcaggtgggcaaggtgaagattgtggcctgtgattccaaattgctgggacaatagacttgcgcacctcaaggaaggaagctcttagtgcggtgtggtctgtctgggcgtcagtagttctcttccgctacacacctagccactgcctgaactgaactgaacaacggcatttgcattgcctttttcgtactgtatgtgtatcttgtatacaatctgctgctgctataccagccagagtatggcatggtatgacagcaagcagctgtaaactttacttagtagcacctgtgtaacaatcttggactcgctcgttcttgatgtgttgctgatactaatacacggcactgtaattgaaaaaaaaaaaaaaaaaaaggccccta

SEQ ID NO: 10966 - DNA, 395 bp, Sorghum bicolor
  Clone ID: LIB3478-017-P1-K1-H10
ctcttctcgcctgctcccgtgcccccctttctatcccgcggcgccgactcgactccacgagagccgccgactcccaacgcctgctgccccggtctccgtcggcctctccgccggcaacgagcgtccaccaggaggcgggcggccatggccaccttcgagctgtaccggaggtccaccatcggcatgtgcctcaccgagacgctggacgagatggtctccagcggcaccctcagcccggagctcgcaatccaggtcctcgtccagttcgacaaggtggaaatgctcctcgtctaatttttttatctcggtgtgtgtggtttcccaacggccaaatctagtcattgatatttgcccttctgtgctggtcgtctagtccatgacggatgctctggaga

SEQ ID NO: 10967 - DNA, 1395 bp, Sorghum bicolor
  Clone ID: SORBI-28MAY03-CLUS10751_1
gtcgcacccgtgggtagcagccgcgtacctaccaacctgcgtgctgccgggggagctctgcacgtctcctgtcgcctcctaccccggcatggacgccgggggagagaagttcagcgacgcggcggcggcggagggcggtgagggcggcggcgacctctacgccgtcctcgggctcaagaaggagtgctccgacgccgacctcaaggtcgcttaccggaagctcgccaagaaatggcacccggagagatgctcctcctccagcagcgtgaaacacatggaggaagccaaggagaagttccaagagatccagggcgcctattccggtctcaatcttccttctctcagcaccctgcatccgccccactgctctgttccatctctattcacaaaccaccctttttttgagaagcaacacaaaccacccttcacctgttacaacgactgaccaacaactaataaactgaacaccagctctccgaccctggcgtgcccgtcggtgagctcgtcgcggggagcccgcgggcgcccgtcccattgttctttgtgcagtactctctgacgccaataaacggctcctctacgatgttggagtatacgacgatgaggacgacgaggatagcatgcaggggatgggtgacttcattggtgagatggcccagatgatgagccaggtgcggccgacgaggcaggaaagctttgaggagctgcagcagctttttgtggacatgttccagtctgatattgattcaggattctgcaacgggtctgctaaggatcaagttcaggggcaagccaaaagtagaacatgctcgacctcaccttcatcatcaccgtccccacctcctcctcctactatagtaaaggaggcagaggtgtcatcatgtaatggcttcaataagcggggttcatcagcaatggactcagggaagcctccaaggcctgttgaaggcggtgctggtcaggctggattttgttttggggtgagcgatacgaagcaaacgccgaagccgagaggtccgaacaccagccggaggaggaacggccggaaacagaagctgtcatccaagcacgatgtttcatctgaagatgaaacggccggttcctagcaccagcagctacggtagcagtttgacctgtggctttggtgatatcattcgttggtccttggcggtgccgagggccctagtagccagcagcggcagggaggcacagcatgtcgcttctgctagctgctgtgatctgaagaggcgtttagctcatcatatgccttaccttaggcctgtgagggacttccattgaaactcgtcgaggatactgcatttttctttctccatactgtgtcggttgtgttgtacaatacattgagtgacttctaatcgattctttttttttacc

SEQ ID NO: 10968 - DNA, 416 bp, Sorghum bicolor
  unsure (1)..(416): unsure at all n locations
  Clone ID: LIB3478-018-P1-K1-B4
ccaagaaatggcacccggacaaatgctcctcctccagcagcgtgaaaccatggaggaagccaaggagaagttccaagagatccagggcgcctattccgtactctctgacgccaataaacggctcctctacgatgttggagtatacgacgatgaggacgacgaggatagcatgcaggggatgggtgacttcattggtgagatggcccagatgatgagccaggtgcggccgacggtaagagctgatggcactactggtcctagttacagatgcttctttgtagtatcatcaaggccacgattagctggagcagacatatttagatttgttgtcacactcacgctgctttagcatggaaattgcatctagcacagacactgttgttttaccacttccttttcacataatcctangtggg

SEQ ID NO: 10969 - DNA, 636 bp, Sorghum bicolor
  Clone ID: SORBI-28MAY03-CLUS10842_1
ctgatgttgcacatccagatgagcttgatgaagaatttgacacattcccaacctcaaggagcccagatctcattaggatgaggtatgataggttacgacatgttgctgggaggatacagacagttgttggggacattgccactcagggagagagattacagtcactgctgagcctggagggacccaagggcaacagctatgttcctaatattttgcctgattactgcgattatactatatgtgacaccattccaagtgattgcactctgccttgggttcttctggatgaggcatcctcggtttcgccacaaggtgccgtcagcaccagcaaacttcttcaggaggctacctgcaaagacagattctttgctgtaaagttccttggagagcagctgtcaacgatgtctaatgtacctctttgtgcctgtttttgttacccatatattgttgtataatagccttaagtgagacatatataattgccgcttcatgtgagagaacaaaataagttgatttcattagatgattttcctgcttttagaagttaagacattccaacttctttatagcatgaaaatgtatgtaagatgcctgcttcaacaacagtttctccaattagtcaagtttgtcatgggg

SEQ ID NO: 10970 - DNA, 1128 bp, Sorghum bicolor
  Clone ID: SORBI-28MAY03-CLUS10973_1
gcacgaggccgccatcacttgggagctctgctgagacgcgctgctggagataacgcacgcgcacgcagccaacacacgcggcaccaccgagaggagcgagcggccaccatcaggctacctcatccgagctcccggccgctcctctcgccgccggctagctaggcagcgctaggctatagctaggaagctgcgcgcgtggccgccgacgatcggcatgggcgacggggcggcggcggcggtgccgagcaggttccgcacgatctgcgtcttctgtggcagcaacgccggccgccgcaaggtgtacgccgacgccgccctcgagctcggccacgagctggtgcggaggggcatcagcctcgtctacggaggcggcagcatcggcctgatgggcgtgattgctcggacggttggcgacggcggctgccatgtccttggggtgattcctaaagcgctcatgcctattgagatatcaggtgggagcgtgggagaagtgaaggtcgtggacgacatgcatcagaggaaagccgagatggctcgccagtccgaagcattcatcgctcttccaggggggtacgggacgatggaggagttgctggagatgatcacctggtgccagctcggaattcatgacaaaccagttgggttgctgaacgtcgacggctactacgacccgctgcttgccctgttcgagaaaggcgccaccgagggcttcatcaaccctgactgcagccagatattcgtttctgcgccgaccgcgagcgaactgctgacgaagatggagcaatacacccggttgcaccaggaggtagccccagcaacgagctgggagatctcggagctcggctacgggagagccgccgccgacggcggcggtggcggcgcgccgtcgtcagaagaagaaggcttgtagcagtcatccatctcctaaagcgaatcggagctctccttcctctgctgaattggtgatgacgcatgcatttgtttgggtatttatttcgtcaaagtcgatctctccaaagtccaaaccggttgaactaggtgcctgccgggtcgggagaggcgatgatatattcctctactgtttgagtgctcggttgtgtaagctagctgtggtaactcctccctcct

SEQ ID NO: 10971 - DNA, 778 bp, Sorghum bicolor
  Clone ID: SORBI-28MAY03-CLUS6523_1
tggagccttaatcgctattgtctccacgcaaccgcatgtccgcatcctacatgggggcaacagggacagccacccaagcaacacagagctctaacacgaccaattgccatggctcgccgcctcctactccttctcctcgctttcctcttctccactgccgcgctctgctcgcccgacgcctccgccgctgaggatccgctcatcgagcaggtggtcggcgacggcgcagacgacgagctggagctgaacgcggaggcgcacttcgcgagcttcgtccggcggttcggcaagacctaccgcgacgacgaagagcgcgcgcaccggatgtccgtgttcaaggccaaccttctccgctcgcggcgccaccagcggctcgaccccacggcggtgcacggggtcactaagttctctgacctcacccccgccgagttccggcggcagttcctcggcctccgccgctcccgctcctccggacaggacctgctcaaggggtcggggtcggcgcatgaggcgcctatcctccccaccgacggcctcccgaccgacttcgactggcgtgaacatggcgccgtcggacccgtcaaggaccaggggtcctgcgggtcgtgttggtcgttcagcacatcgggggcgctggagggggcgcactacctcgccaccggcaagctcgaggtgctcagtgagcagcagatggtcgactgtgaccacgagtgtgatccatcagaaccgcgctcatgtgactcaggatgcaatggtggcttgatgactacagctttca

SEQ ID NO: 10972 - DNA, 659 bp, Sorghum bicolor
  Clone ID: SORBI-28MAY03-CLUS6528_1
ctggaacgcaaagtggaggatgccaagtgcagagagagacggtcaaaccaaaggcttctcattgattctgtaaatgctgccctactagacattggccaaagtaaactttggggtgcatacccttgcactgcacgccattctaatgcaccgggagttgctacatgtgatgtgctagtaaccgacgaagcatggaggttagtaaagagttggctcttcgatgatgagaatgatattgctggtttgggagactatccaggccttgcagcagattgggttgtcggtaaggagattaatggcaaagggtggcctgaaatgctgcgcttggaggtggatgaaatcagcaaggagatatgcgaggaagtcctgggcgagttggtcggggaggcattttcacagcttgcggatcattgaagctgctttattttccctgcttgtggcgtccacctgttgcttttatttccaatccggtggagtccggccatggggctgatcttcaccctccagagctgttcttgtgtgtatattaccctcataactgttctgcacgctgctcaaaatgttccccactggctctatctgttcatctcttccgcattgatacattcacagtaataacatttatgaatacagctgctgcatttcaaattgttcttggccac

SEQ ID NO: 10973 - DNA, 1192 bp, Sorghum bicolor
  Clone ID: SORBI-28MAY03-CLUS65600_1
ctgtaccgcttcttggagcacgaccccgctgtccccaagtactacaacttccggggctccaccaacgacggcgagcccaagcctgccgcggccgtcggtcagaggatgaccaggatcatgctcgccatcctggaggcctacgcctccgacgaccgccgccacctcgactacagccgcatcgctgccagcggcacgaggagaaggtacgcgaacctggttcaggaactgcagcgggcggacatgacccagctccccgcggaggagcggctgccgttcttcctgaacctgcacaacgccatggccatccacgccgtgatccgagtcggccagccgggcgccgtcgatcgccggcccttcttctctgacttccagtacgtcgtgggagggcacccctactccctcgccgcgatcaggaacggtatcctcagggctaaccggcggcagccctacacgctggccaagccgttcggctccaatgacaggaggctcgagctggcacagcggcgcgcaaacccactggtgcatttcgcgctgtgcgacgcgacgcggtcgagcccgatcgtgcggttctacacgacgcagggcgtggagccggagctccggcacgcggcgagggagttctttctccgcggtggcgtggagatcgacttggagagccggaccgtgcatctcaccaggatcatcaaatggtacagcgcggattttgggcaggacagggacatcctccggtggctcctcaactaccttgacccgaccaaagccgggcttctgacgcatctcctgaacgatggcggcccgatcaacatctcctacatgaactacgactggtctctgaacgtctgaccagaattcctccgggacgggtacagtggtgtaacttgggggtagggccacggtacattcagaggtgcagtcagttcgatcagctgttagttaatggccaattggacggatcatagagcgcgcggacgctcacatatatatgcaattagcatactgagcttgttcagtagagagaagtcttaagatgtatatatatagaattgtgaatgttgattttgtactctgaagagtgcatcactatgggagaaatttctctccagctgaaggcatgtcgttcagggcaaattttctgtatttgagttgtgaatgttgattttgcttcgatagtgaagaaatagtagatttatat

SEQ ID NO: 10974 - DNA, 1257 bp, Sorghum bicolor
  Clone ID: SORBI-28MAY03-CLUS6565_1
gccggccgggccgggaaccccttccctccgcccgctgccttcccttccccccgcgtggtcctccgccgccgccaccgctctaagctaggtgctgaggctttcgttggcctcttcttcgccggcgacgagcaaccaccagggcacgggcctcaggatgcaatcgttggtccggaatgtctgccgagccggaagccgtggagcggcggcgaggctcctggagcttgccgctgctcccgtagccgcggctcatccgggggcggcgcagccatcctcggccgtcaaacacctctggcagccttacgggttggctcgcccgatcggggtagatcaatccgtacgtgtgcagagccgggtcattcctgctgctgcctccggtttcggtcactgcgcaaaggttcttgttgcgacgaggggtttgtcgacggtggggaatgcagctgaggttgcttctgattcggacgattccacctctcttgcggttgagcaccccccgcgcatcaagttcaagaggcccgacaagaccgccaggcatattatgaatatcctgaacaaagaggcagtcgataaggtccgctcggagagggagattcctgatgtgcagcctggatgtatgattcagatgagattgcaagttcctgagaacaaacggcgcgagttgacattgaaagggattgtgctaggaaggcgcaatgctggcatcaatacaaccttcagattacgtagattagtgtctggcattggagtcgagtctgtctttccactttactcgccaaacatcaaagaaatcaagatcttggacaggaagaaagtcaggagagctaagctgtattacctgagggacagggtgaacgcacttaaaaaatgaggctttcaacttgtctctaggatttttgcccatgtggatcagcatggtttctgaagatgcagcagttgcagcctgagaatcacattgtttggttccatgtttgaaagctcataacttgtagtttgtcaattgtcatgcttggtttcaagctgcaagtgctagcagaatatgttttgacacaaaatttagaaatgcggatcttccgtcttttatttgcagcactaacatcggtgcgaaaaaataatgtgctcaggtctattatattacttccccacccccatatgcgtttgacataaacaagctggaatacttaccaaagtgaaagtattatgtgatgcttcatgttagcaaggttacggttttatatatcaaccccgtgcgtgtttgcttgc

SEQ ID NO: 10975 - DNA, 667 bp, Sorghum bicolor
  Clone ID: SORBI-28MAY03-CLUS6555_1
gcgactgcgactgcgactgcgactccgcctccggctccgactgcgactgcgactgcgagccctagccccgaactcgaccctctcgttaggatggtgctcatggtccccaccgctcctcttccacccaccggttataagaacatcctcgagcttgctcgcagccgcgggctctttgatcccccgcctcctcttccaacccccggtcaagatgaatgaggttccaaaacgaggacctcattccataagtggagcaaggtgtggaaatcttaagactaatgtcctatatttccattaacaagtgcaagcaagcaaggagcagccaatgatcaaggacaaagccctttgttcgagcttgggttccgaaggatctgagaataaatagcctgattcctgtaacctgctttactttgtagtgtctgctgaatggtatgctagctattttggtcccctagctcttgatccctgggtgattggagtaatggctgtaaactcctgctttacttttgtagtgtctgcgcttgttaatgctggtgctatgtaagctgaatggtatgttagctattttggtccccttgctcttgagcccctgggtgattggagtaatggctgtaaactctgtagtttcgttgctttcaagtaatgaaatctgggttttccctgtggtggg

SEQ ID NO: 10976 - DNA, 339 bp, Sorghum bicolor
  Clone ID: LIB3476-021-P1-K1-F8
ggagcagccaatgatcaaggacaaagacctttgttcgagcttgggttccgaaggatctgagaataaatagcctgattcctgtaacctgctttacttttgtagtgtctgctgaatggtatgctagctattttggtcacctagctcttgatccctgggtgattggagtaatggctgtaaactcctgctttacttttgtagtgtctgcgcttgttaatgctggtgctatgtaagctgaatggtatgttagctaaaaaaaaaaaaaaaaaaaaaaaaaataaaaaattattaaaaaaaaaaataaataatataaaaaaaaaataaatatatttgtaaaaattt

SEQ ID NO: 10977 - DNA, 932 bp, Sorghum bicolor
  Clone ID: SORBI-28MAY03-CLUS65656_1
ccgggcctgcttttgagctctctctctctctctcccccatccgtgctttgtgcgtgtctggtgcgcgtccacctatcggggcccccggccggcttctgctttcttgctacgccaccgcgcctcgtctatttatgcagtcccccgatccatgaagccgggccacgccgaggtcgagagttgtcgacgacgtctgccggtagtcctccctgctagctcctccttgccggctgccacgtgatcttgggttactctcgtctccgtcgagagccgtgagccatggccgctgagactgttgtcctcaaggttgctatgtcatgcgagggttgcgccggggcggtcagaagagtgctctccaagatggaaggaattgagaccttcgacatagacctcaaggagcagaaggtgacagtcaaaggcaatgtcaagcctgaggacgtcttccagacggtttccaagtcggggaagaagacctcctactgggagggcgaagccgtagccccggacgcttcggctccagcagcagcagaagcagctcccaccaccgcggcagaagcgcctgcggatgctgctgctgctgctgctgctgctgctgtgccagagataaccccagccaaagctgacgcttgatcgacacactattgctcacatgtgatgctgcgattcctaaaccttatagaaatagctggggaaaacgagtcttgatgaggtttgcatcatgttgctgccggtctagcaagtgactaagaataatggaataaatgataacccagtgtgtgtatgatttccattatgatgaacacatcccctgcagggattgttgttcagtagattttacttctaccgtggctttggagttcccccaaaacaatacttgttcaagaacttcttctctgacagaaaataacatgagtgcagttcatgctttaaaaaaa

SEQ ID NO: 10978 - DNA, 706 bp, Sorghum bicolor
  Clone ID: SORBI-28MAY03-CLUS62420_1
gggatataactcacttaaggattatttccctgcaatggaaatgaggccaaatccacaatgctcgaatccagcatgtgttacgagacagaaagaatatatggaatccaaacctgctagagatgcagcagcaaaggctaagatggaagctgaagcatctgcagcaaatgaatgtcctgtccatgtagacaatgagtggaatattagtgttgttgatgatgaagaaacggggacatcgaacattcgaaacactccagatatcctaccagaaggtcttgtccgtgagcttccagatgctgattcatatgcagaaccagctgcagcaggtagttccagtgctattgatgatgatctcgaggagctccagcgccaacttgatgccctaaacgcatcttagccttgataagtaagctagttcatctgcgtctcggtttctccccaatcccaacttggatggggatagatgattcacataccgttgtttttgtctgttctaacggagttggtaaattcaccggatatagcctttattcatagcaccatggtaatcgaaaaaacagaaaaaggatagctatactgcttcgggagttctggcttacaattttggttgagaacatgtacatttctgagccaggcaactcgttggtactaatgtctgaatttttgtcgattgctaagaaatcagaggtctcatagcttgttggtattc

SEQ ID NO: 10979 - DNA, 990 bp, Sorghum bicolor
  Clone ID: SORBI-28MAY03-CLUS6251_1
gtacgcttctgcttcagtgcttccggcagcaaagcgaaactagcgctgctaaacctcgggccatccccccgcgagcgcgacacacccaaaggccagcaggctccgtcccgttcccgttccgtgtcccgatcgctccgctgcgctccccacgatggcgtcgcacatcatcctgccgccggacgacgccgacgagaaccacaaccaccaggccgaggaggaggagcgggaggagctggggcgcgacgaagacgccgacgacgaggagcacgggcacgggcaccccccggcgctgccacccaaggcggcgctgccgttctcggccacgtgcgtgcggatctcccgcgactcgtacccgaacctccgcgcgctccgcaacgcctcctctgtcagcctcgccgacgccgcctacgtcaagatctccgagggcgactacgggtacgtcctcgacgacgtcccgcacttcaccgactacctccccgacatcccgacttaccctaatccactacaagatcatccagcctattcaactgtcaagcagtattttgtcaatgaagatgacactgtacctcaaaaggttgttgttcggaagaacagtcggcgtggtgttcacttccgtcgtgctgggcctcgtcagaggatttattttggcaccgatgaagtgaaggcctgcattgtaacttgtggaggcctgtgccctgggcttaacactgttatcagggaactggtgtgtggcttgtcacacatgtacaatgtcagcagcatttttggaatacagaatggatacaagggtttctattctagcaactaccttcccctgacaccaaagagcgtcaatgacatccacaaaaggggtggtacagttctaggaacatcacgaggtggccatgatacaaaaaagattgtgataacattcaagatcgtggaatcaatcaggtgtatatcatcgaggagatggaactcagaagggagcatatgagatcttcaaggaaa

SEQ ID NO: 10980 - DNA, 1106 bp, Sorghum bicolor
  unsure (1)..(1106): unsure at all n locations
  Clone ID: SORBI-28MAY03-CLUS6266_1
gcacgaggaaagcctgaaaagccccctgctccccgctcgccgcgcacgaggctaaaccctagccgcaccaacgccttctctaatccgtccttccccggcggcgggcggccaccagcaaccagcatcgtacggcggagaagcgccgtttacatccgtctggcggagatgccgctggggcagcgcccaggggacaagagcgactcccgctactgcggggtggaggtgctcgacttccccgccggcgagggcctccccgccgtcctcagccactccatctcctccggcttcgacttcatcctcgctcctctggttgacccgaactaccggccggcgcccggcgccgtcctgcccgtgtcggcgtcggacctcgtcctcggcccggcccagtggagcaaccacgtcgtcgggaagatcagcgagtggatcgatttggacgcggaggacgagcggctccgcctggactccgagctcacgctgaagcaggagatcgcgtgggcgtctcacgtctcgctgcaggcatgtgttcttcctgccccccggacatctttttgtggcaattatgccagagttgtgaatcaaattttgcaaggcctgaccaatatgcatttatggcttccacgcgtccgggagaagtccgagcctatggatgacgatcttgataaaataaagaataacaaccacatgagtgaaatagtagactcgtgggaattatggaattcgttcagattgctatgtgaccatagtagccaactatgtgtggcacttgatatttcgagcacactgccatcaataaactcattagggcggtggtttggggagcctgtaaaggctgctattctgcaaaccaatgcttatcttacaaattcaaaaggatatccttgtttatcaaagcggcatcagagctgctaactggattttttaaccattctgttcaggtgataattcctgggagatcaaatctcaatgttttcccagcatcntgagtgctctcaggtgatgagagctgcattgaagattcccctgttcgacatgcattagctccgaccctgagtacattgcgtacctatatcagnaagatgatccacttcctgagcaagaacgctttg

SEQ ID NO: 10981 - DNA, 639 bp, Sorghum bicolor
  Clone ID: SORBI-28MAY03-CLUS62542_1
cgggctcaccacggaggaggactacccgtacacgggcaccacggacgcctgcgacagggccaagctcgcccacaacgcggccagcatcgcggggctccggcgagtggccacccggagcgaggcgtcgctggcgaacgccgtggcggggcagccggtggccgtgtccatcgaggccggcggggacaacttccagcactacaagaggggcgtctacaacgggccgtgcgggaccagcctgaaccacggcgtcaccgtcgtaggctacgggcaggaggaggaggacggggacaagtactggatcatcaagaactcgtggggggcgagctggggcgacggcggatacatcaagatgaggaaggacgtcgccggcaagccggaggggctctgcggcatcgccatccgcccgtccttcccactaatgtgacgacatgcatgatgtgcatccttttctcttctttttttcattttacgtaattaaatagtcagcatatgaccaatcgagtcaaacgtttttattcctgctattacgtgtaccatcagtacagttgttgtaaataataatccacacggcacctcgcgtgtaaaccttttcttcttgtgtgaaaacgacttcgacatggaaatgaattaggtatatat

SEQ ID NO: 10982 - DNA, 901 bp, Sorghum bicolor
  Clone ID: SORBI-28MAY03-CLUS62678_1
ccagccggcagggccaaagccaaaggtttatgatgatgggttggataataacaggaagttgggagcggcaaagcgaaggctcccggagcgttaccaggaagcggcgaagggtttgtttcttgatttcaacactcatcagtattggccttgtgtgtcactagtagatctctactgtttcggtttcattaagttgttccatgcctttgtctgtgcagccaaaaggctacgcacgatacatgtaatggagctgcgtgacataccaaagcccaagcatctaaacagacacccgatggtgaagtccaggtaggcccttaggcttcggcaggagccaagctagtgttggcacagccattggtttatgatgacggtttggataataaccggacgtgcgttgcggcaaagcgaaggctcccggagcctagcccggatgaggagaacgcccagggctagcacaagattcttgtagtgcagctccgccaatgaagggtgcccacgcgtagtcgcaggcaaccgacggggtgctccgggagtagcctttggggttgggcggatgagcggcgcctggacatctgtggtgttttcgacctgctcggtttgtttcgtcccgtgcctgccttgtccgatcatgcgtttatgctcattctagagccccggtagcctgctccccggtcttgggcacctccctttccctacagaacctccaatggagggtttccccatgaagtcgcaggagtcgcacttgatgccaagagtgaagctcctgcggtaggagagtttagccatgtctggataattgtagagtggacatgtagctcgatttgtatcggctggttcttttcttcttaatttcttcttcaaaggaagctgtagataccagatagaataatcagcaatatttggt

SEQ ID NO: 10983 - DNA, 722 bp, Sorghum bicolor
  Clone ID: SORBI-28MAY03-CLUS66386_1
cctactgacgccaacgccgcaaaccgaccaccatcttcccggcaataaaacccagtaactcatcggcgtctcctcccccgcttcccagagcaatcgatccctagagttttggaatcccgcttcctgatctccatctcccaccgcatctccgcgcgcgcccatcgcgatctcggctccgcggctggcggctgccacgatcgattcccccaaggccgcaggtgctccccgtcctccctcctcgcccgatccccactcctctcgagtctcgactcgtcgccccttcggatcccgttgcgatgctgagcctgcctcctccggccccacccgcggcagcggcggcggcggcggcgccggcggatgagaagcgtccctcgccgccgatgaaggtgaagctgctttttccgtacgccgtggactgcgtgttcggcggcatgcgccgcgcctgcggcatggctgtcgtcgggctccacgccttgacccgtgtcgtcaaggtcgtctccttcacgacagacgcagaggaggtccgcttcttggtaccgatcttccgcggctgggtgtacctcggcatcgccgccgtggtgctcgtgacgtgcgtcgacatcgtctactacttgaccctgaggtggcccgcttcttgacactaatcttccgtgtgtgggtgtactttggcatcaccgccatgttcctcatgacgtgcgtggacatcggtcactacttgtatg

SEQ ID NO: 10984 - DNA, 736 bp, Sorghum bicolor
  Clone ID: SORBI-28MAY03-CLUS66414_1
aaaaaaaaaaaaaaaaaaaaaaaaaaaaaaacaagcggaagctcctccaaggctgcagctgcaccactccacgcacgccagacgccactctcttctgccgagcaagagagtgtaccgctcgggcgcaacagaacaaatcggcccagcaagagacaatggcccgcacgacggcgccggccgcgggctacggggcggacggagtgtaccgctccccgcgcccggccgtgcgcatcgagtccgacccgggcctctccctcaacgacctcctcttccgccgcgccgacgcgtgcccctccgccctcgcgctggtcgactccgccaccggccaatccctctccttcgccgcctttcgctccgccgtcctcaccacggccgtcgcgctctcctcgcgcgcgggcgtccgacgcggcgatgtcgtcctcttcttcgcccccaactgcttcctctaccccgtctgcttcttcgccgtcaccgccctcggcgccgtcgctaccacggccaaccccctctatacccctcgggaggtcgccaagcaggccaccgactcgcgcgccaagctcgcaatcacagtatctgaactccttcccaaaatcgtggacctccgcctccccaccatcctgctcgacgtcgacggcggcgcggccagtgtcaccgcctccaagcctcagggcgccagcgtcacgctctactcagacctcatttctggggtgcgggagacggagtaccgccgcccgcc

SEQ ID NO: 10985 - DNA, 757 bp, Sorghum bicolor
  Clone ID: SORBI-28MAY03-CLUS6656_1
gctagcttcacgccggattccccaaacccccctacgcagctccctctcctctccgcctccacccatcgagcaccgagcggcggcggcatggaggctggcggcgaggagttcgcgatcggcgtcgtgatctccgcgaagaccaccctgggggaggagttcgagggccagatcgtcgccttcgatcgcccctccaacctcctcgttatccaggaggtcgtggggagggcggagaggggggagcggcggaacgtgagggtgctcaaggcgaactacatccgggagttctctgtggtcagcaagggtgacgaccctctcgatcctgccggctgcatgctggacctcaacgccatttatgcccgggaggatgctgcactcaggcaagcagagattgaggccgagagaattggtgttggtgtcaccccagaagctcaaagtatattcgatgcgctgtccaagacgcttccggttcagtgggacaagactgacattgttgtaatgaaggaggttcgtgtatgcagtccgtacctgcctgaaaatgtaagtggaggaacagcggcagcaaatgagcgcgttaagaaagtgattgactttgaaaggaaaagattgcattcacgtgtacctggccaattctcttaacttaaaaggcttgactaatatttacattagcctccgtgttgtatttctaataccgcagccagttttcttattctcatcgatggggttttctattatatgtttcagaaaaaatctgtcataa

SEQ ID NO: 10986 - DNA, 1128 bp, Sorghum bicolor
  Clone ID: SORBI-28MAY03-CLUS6647_1
gcacgaggcggttgttcctggatatgcccgagcatttggagttgtctagtctgccaagctctaatggtgtattaaaatatcttgctggaaagacattaccgtcgcatgcagctatactgtgtggtttagtaaaaaatcaggtgtattctgatctggaagttgcttttgccatttccgaagatgcagctgtatacaaagcattatcacaaactattgagctattggaaggtcacacttctctgatcagccagcactattacggctgccttttccatgagcttctggcatttcaaattgctgaccggcatccacagcaagagagacaacctgcagaagtgatacctcagcagatgataggattttctgatccagctatgtctactctaaaggctgctgaatttttcgttcctgattcagctgagtccagcattattcatatggatttagatcgcagctttctgccagtaccttctgcagtgagtgcctctgtttttgaaagttgtgtcaggcagaacatcactgattctgaaactgatgtccattccagcatccagcagctggtgaaagatagctatggtttatccgcagatggttgttcagaaattatctatggcaacacctccctagcactcttcaacaagcttgttctttgttgcatgcaagaacagggcaccttgcttttccccttgggcaccaatggccattacgtctctgcagcaaagtttgtgaacgcgagcaccttgactataccgacaaattttggtacaggattcaggattgaaccaaaggttctagctgacactcttaagaatgtatctcagccatgggtgtatatttctggccccacaatcaaccctactggttttctgtacagtgacaatgatattcaagagctgctctctgtatgcgctgaatatggcgctagggtagtgatagatacctccttctctggcctggagtaccaaactgatggctggagtcagtggaatctggaaggatgcctttcctctttgaaacgttcaaagccatcattctctgtggtcctgcttggagagctgtcctttgagctgactgcagcagggcatgactttgggtttgtgatattgagcgactcatcattggctgaga
